United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 72

SEQ ID NO: 3278022 - RNA, 23 nt, Vaccinia virus
uagugaaucgacuauagacauaa

SEQ ID NO: 3278023 - RNA, 18 nt, Vaccinia virus
gucagcggcaucuaaauu

SEQ ID NO: 3278024 - RNA, 21 nt, Vaccinia virus
aggauuaguuuccgaacuaau

SEQ ID NO: 3278025 - RNA, 19 nt, Vaccinia virus
ucuaguuaguuuguauaaa

SEQ ID NO: 3278026 - RNA, 12 nt, Vaccinia virus
acauagaaauaa

SEQ ID NO: 3278027 - RNA, 17 nt, Vaccinia virus
agacccaaaugucuguu

SEQ ID NO: 3278028 - RNA, 16 nt, Vaccinia virus
cgaugcuguagcaucu

SEQ ID NO: 3278029 - RNA, 16 nt, Vaccinia virus
cacucuucgaaaagaa

SEQ ID NO: 3278030 - RNA, 15 nt, Vaccinia virus
uacucuaaaucgcuu

SEQ ID NO: 3278031 - RNA, 20 nt, Vaccinia virus
agauaguaaauagauaguuu

SEQ ID NO: 3278032 - RNA, 15 nt, Vaccinia virus
guauuuauauaugca

SEQ ID NO: 3278033 - RNA, 17 nt, Vaccinia virus
uuucguauaauuuuuaa

SEQ ID NO: 3278034 - RNA, 18 nt, Vaccinia virus
acaaagauggucuaaaau

SEQ ID NO: 3278035 - RNA, 15 nt, Vaccinia virus
uaugucguuaucauc

SEQ ID NO: 3278036 - RNA, 22 nt, Vaccinia virus
gacuaaauuagauuaugaggau

SEQ ID NO: 3278037 - RNA, 21 nt, Vaccinia virus
uuuaccaugggaugcuaauau

SEQ ID NO: 3278038 - RNA, 22 nt, Vaccinia virus
cguuauacaucuuaguuguaaa

SEQ ID NO: 3278039 - RNA, 19 nt, Vaccinia virus
cuguguaaagaaaugguaa

SEQ ID NO: 3278040 - RNA, 18 nt, Vaccinia virus
accgacucauuauuuccc

SEQ ID NO: 3278041 - RNA, 16 nt, Vaccinia virus
uguaguaguaacuguu

SEQ ID NO: 3278042 - RNA, 23 nt, Vaccinia virus
aauucucuuacgccgauauuucu

SEQ ID NO: 3278043 - RNA, 14 nt, Vaccinia virus
auuacaacauaaua

SEQ ID NO: 3278044 - RNA, 15 nt, Vaccinia virus
guuccauuacaaaua

SEQ ID NO: 3278045 - RNA, 16 nt, Vaccinia virus
ucauugaugaaaauac

SEQ ID NO: 3278046 - RNA, 17 nt, Vaccinia virus
cuaaugugauucucuga

SEQ ID NO: 3278047 - RNA, 17 nt, Vaccinia virus
uuaauauaguuauuaau

SEQ ID NO: 3278048 - RNA, 20 nt, Vaccinia virus
augguacuuaugacaaaguu

SEQ ID NO: 3278049 - RNA, 12 nt, Vaccinia virus
acuaucuaaaug

SEQ ID NO: 3278050 - RNA, 22 nt, Vaccinia virus
uguuauacacggucuagagcau

SEQ ID NO: 3278051 - RNA, 13 nt, Vaccinia virus
aagaauauaacgu

SEQ ID NO: 3278052 - RNA, 19 nt, Vaccinia virus
aaauuugcaucuacaucau

SEQ ID NO: 3278053 - RNA, 20 nt, Vaccinia virus
uguaauauucuaguuuggua

SEQ ID NO: 3278054 - RNA, 20 nt, Vaccinia virus
uagcguguuuuaaauccuua

SEQ ID NO: 3278055 - RNA, 16 nt, Vaccinia virus
acaauuacaaaugagu

SEQ ID NO: 3278056 - RNA, 15 nt, Vaccinia virus
aagaaucauccaagu

SEQ ID NO: 3278057 - RNA, 22 nt, Vaccinia virus
uuaaguauuguuuuuucauuau

SEQ ID NO: 3278058 - RNA, 23 nt, Vaccinia virus
gaaaauaaaucacugacgauauu

SEQ ID NO: 3278059 - RNA, 16 nt, Vaccinia virus
guuaucugaugaaaga

SEQ ID NO: 3278060 - RNA, 17 nt, Vaccinia virus
uaaauccaucucagaau

SEQ ID NO: 3278061 - RNA, 18 nt, Vaccinia virus
agauuuccuagauuuacu

SEQ ID NO: 3278062 - RNA, 22 nt, Vaccinia virus
aaaaucgucuucacaaagaaug

SEQ ID NO: 3278063 - RNA, 22 nt, Vaccinia virus
guaaauauucuaaauuaaccaa

SEQ ID NO: 3278064 - RNA, 20 nt, Vaccinia virus
uaaacagcauuucugucaac

SEQ ID NO: 3278065 - RNA, 20 nt, Vaccinia virus
caagaaauauggauccucua

SEQ ID NO: 3278066 - RNA, 23 nt, Vaccinia virus
agauuuuccauccacaauuauug

SEQ ID NO: 3278067 - RNA, 19 nt, Vaccinia virus
auacauccgcauacagcca

SEQ ID NO: 3278068 - RNA, 17 nt, Vaccinia virus
acacauuaggauacaga

SEQ ID NO: 3278069 - RNA, 16 nt, Vaccinia virus
uacuuuuacgagaaau

SEQ ID NO: 3278070 - RNA, 19 nt, Vaccinia virus
aaucuaagaaauuuaaaau

SEQ ID NO: 3278071 - RNA, 13 nt, Vaccinia virus
ugacauauuacaa

SEQ ID NO: 3278072 - RNA, 16 nt, Vaccinia virus
acacuacugaaaaaag

SEQ ID NO: 3278073 - RNA, 21 nt, Vaccinia virus
auguuugauaaaaauauguau

SEQ ID NO: 3278074 - RNA, 21 nt, Vaccinia virus
uacaguuucuguaaugaugga

SEQ ID NO: 3278075 - RNA, 16 nt, Vaccinia virus
caaaaggggugagaau

SEQ ID NO: 3278076 - RNA, 23 nt, Vaccinia virus
auauccucacaacuuaaugaaga

SEQ ID NO: 3278077 - RNA, 13 nt, Vaccinia virus
auacgauaaacau

SEQ ID NO: 3278078 - RNA, 14 nt, Vaccinia virus
aauauauuaccaug

SEQ ID NO: 3278079 - RNA, 16 nt, Vaccinia virus
auacacuaaaauuaaa

SEQ ID NO: 3278080 - RNA, 14 nt, Vaccinia virus
uguguuacauaucu

SEQ ID NO: 3278081 - RNA, 22 nt, Vaccinia virus
guuuuaacgaauuauauagucu

SEQ ID NO: 3278082 - RNA, 18 nt, Vaccinia virus
auuauaauaguuuaucau

SEQ ID NO: 3278083 - RNA, 14 nt, Vaccinia virus
cagaguuuagauua

SEQ ID NO: 3278084 - RNA, 13 nt, Vaccinia virus
auaauaaugaaua

SEQ ID NO: 3278085 - RNA, 23 nt, Vaccinia virus
aggagauuuaguauuuagcagug

SEQ ID NO: 3278086 - RNA, 14 nt, Vaccinia virus
uaucauaaaugaaa

SEQ ID NO: 3278087 - RNA, 21 nt, Vaccinia virus
auaacagagccaucuguaaaa

SEQ ID NO: 3278088 - RNA, 19 nt, Vaccinia virus
aagucugauauucagaaag

SEQ ID NO: 3278089 - RNA, 18 nt, Vaccinia virus
gacagaaccuugugucau

SEQ ID NO: 3278090 - RNA, 17 nt, Vaccinia virus
ugcaaugaauaucuaca

SEQ ID NO: 3278091 - RNA, 20 nt, Vaccinia virus
acaacgaauacaaacgccau

SEQ ID NO: 3278092 - RNA, 14 nt, Vaccinia virus
aguuguaucaucua

SEQ ID NO: 3278093 - RNA, 16 nt, Vaccinia virus
uuaauuccauaucuuu

SEQ ID NO: 3278094 - RNA, 13 nt, Vaccinia virus
uuauaagauaucc

SEQ ID NO: 3278095 - RNA, 18 nt, Vaccinia virus
agaugauguuaacuaugu

SEQ ID NO: 3278096 - RNA, 12 nt, Vaccinia virus
agaaaaacagaa

SEQ ID NO: 3278097 - RNA, 17 nt, Vaccinia virus
ucucagguacagauuuu

SEQ ID NO: 3278098 - RNA, 22 nt, Vaccinia virus
ucacagacacugucucauacac

SEQ ID NO: 3278099 - RNA, 20 nt, Vaccinia virus
cauauauuaaaacuaccaau

SEQ ID NO: 3278100 - RNA, 19 nt, Vaccinia virus
aauggucgauuauagaaau

SEQ ID NO: 3278101 - RNA, 11 nt, Vaccinia virus
aggauggugaa

SEQ ID NO: 3278102 - RNA, 18 nt, Vaccinia virus
gaaggagacggauacugu

SEQ ID NO: 3278103 - RNA, 18 nt, Vaccinia virus
ccgacucauuauuuccca

SEQ ID NO: 3278104 - RNA, 13 nt, Vaccinia virus
uugguuucuaaau

SEQ ID NO: 3278105 - RNA, 17 nt, Vaccinia virus
uagauauagauguuaua

SEQ ID NO: 3278106 - RNA, 12 nt, Vaccinia virus
auaauuucuaga

SEQ ID NO: 3278107 - RNA, 19 nt, Vaccinia virus
auuuuaggacggaucaaug

SEQ ID NO: 3278108 - RNA, 21 nt, Vaccinia virus
uucuuggcaaaagaauaccaa

SEQ ID NO: 3278109 - RNA, 18 nt, Vaccinia virus
aacucuugcuacaaaaug

SEQ ID NO: 3278110 - RNA, 13 nt, Vaccinia virus
caacgauauucua

SEQ ID NO: 3278111 - RNA, 16 nt, Vaccinia virus
caagucccaaauggag

SEQ ID NO: 3278112 - RNA, 23 nt, Vaccinia virus
cccgucuguuuaauuuuuucuac

SEQ ID NO: 3278113 - RNA, 15 nt, Vaccinia virus
uccacuauacauucu

SEQ ID NO: 3278114 - RNA, 15 nt, Vaccinia virus
guugacuauaacaga

SEQ ID NO: 3278115 - RNA, 15 nt, Vaccinia virus
gaaggcauaucguga

SEQ ID NO: 3278116 - RNA, 15 nt, Vaccinia virus
auuaacagaaaaaac

SEQ ID NO: 3278117 - RNA, 21 nt, Vaccinia virus
gauuguauauuuuauuuuaua

SEQ ID NO: 3278118 - RNA, 16 nt, Vaccinia virus
uguucuacacauguau

SEQ ID NO: 3278119 - RNA, 21 nt, Vaccinia virus
cuacaauugucuaaugauauc

SEQ ID NO: 3278120 - RNA, 19 nt, Vaccinia virus
cuaagauuccauuaucuaa

SEQ ID NO: 3278121 - RNA, 18 nt, Vaccinia virus
acuuagaacagauuuaac

SEQ ID NO: 3278122 - RNA, 15 nt, Vaccinia virus
aagguuaacaucuua

SEQ ID NO: 3278123 - RNA, 21 nt, Vaccinia virus
cugaaauggugguaaaacuaa

SEQ ID NO: 3278124 - RNA, 23 nt, Vaccinia virus
agaaaguaugauacaauacuuac

SEQ ID NO: 3278125 - RNA, 14 nt, Vaccinia virus
uauccaagaaaaag

SEQ ID NO: 3278126 - RNA, 13 nt, Vaccinia virus
acaucucucauaa

SEQ ID NO: 3278127 - RNA, 16 nt, Vaccinia virus
gccuauccaauaaucc

SEQ ID NO: 3278128 - RNA, 19 nt, Vaccinia virus
auuuauacccgcuaugaag

SEQ ID NO: 3278129 - RNA, 18 nt, Vaccinia virus
uccuauucccaacaaugu

SEQ ID NO: 3278130 - RNA, 16 nt, Vaccinia virus
uucguaaaauauucuu

SEQ ID NO: 3278131 - RNA, 16 nt, Vaccinia virus
auuuucauuuaaauga

SEQ ID NO: 3278132 - RNA, 19 nt, Vaccinia virus
caucaaaugguacaaaaaa

SEQ ID NO: 3278133 - RNA, 19 nt, Vaccinia virus
uguuucgaaacuuuaucaa

SEQ ID NO: 3278134 - RNA, 21 nt, Vaccinia virus
ucgcauguucagcaauuuauu

SEQ ID NO: 3278135 - RNA, 17 nt, Vaccinia virus
aguuaaauauuaaaacu

SEQ ID NO: 3278136 - RNA, 15 nt, Vaccinia virus
ucuuccuucgauaga

SEQ ID NO: 3278137 - RNA, 14 nt, Vaccinia virus
ugugacaugauguc

SEQ ID NO: 3278138 - RNA, 14 nt, Vaccinia virus
ggauauguuuuuaa

SEQ ID NO: 3278139 - RNA, 20 nt, Vaccinia virus
ugucaaugaagaguauacag

SEQ ID NO: 3278140 - RNA, 22 nt, Vaccinia virus
aucacgauuuugucuuucagga

SEQ ID NO: 3278141 - RNA, 21 nt, Vaccinia virus
uuccacaauacgagucauuau

SEQ ID NO: 3278142 - RNA, 18 nt, Vaccinia virus
uuaaaaaggaaaauacua

SEQ ID NO: 3278143 - RNA, 12 nt, Vaccinia virus
aaccuucuuauu

SEQ ID NO: 3278144 - RNA, 15 nt, Vaccinia virus
uggacaaaucuggaa

SEQ ID NO: 3278145 - RNA, 13 nt, Vaccinia virus
cgaucauaucuau

SEQ ID NO: 3278146 - RNA, 13 nt, Vaccinia virus
uauauaacguuau

SEQ ID NO: 3278147 - RNA, 15 nt, Vaccinia virus
uuuauaacgaaguag

SEQ ID NO: 3278148 - RNA, 16 nt, Vaccinia virus
uccuucauucauuaga

SEQ ID NO: 3278149 - RNA, 20 nt, Vaccinia virus
cuuuauaagagcuacuaacg

SEQ ID NO: 3278150 - RNA, 19 nt, Vaccinia virus
cucagauuaaauccaucuc

SEQ ID NO: 3278151 - RNA, 17 nt, Vaccinia virus
uauaccggcauugguaa

SEQ ID NO: 3278152 - RNA, 22 nt, Vaccinia virus
uuaccguccuccgccaauauag

SEQ ID NO: 3278153 - RNA, 23 nt, Vaccinia virus
acaagacauuuuuuguccuauau

SEQ ID NO: 3278154 - RNA, 18 nt, Vaccinia virus
aaaugauuaucaaacaca

SEQ ID NO: 3278155 - RNA, 13 nt, Vaccinia virus
uuauuaaaguuua

SEQ ID NO: 3278156 - RNA, 15 nt, Vaccinia virus
auauauuaacucaga

SEQ ID NO: 3278157 - RNA, 15 nt, Vaccinia virus
ucauauuuagaauau

SEQ ID NO: 3278158 - RNA, 18 nt, Vaccinia virus
aaaguuagaugugucaua

SEQ ID NO: 3278159 - RNA, 14 nt, Vaccinia virus
agaauaaauuauau

SEQ ID NO: 3278160 - RNA, 14 nt, Vaccinia virus
uucuccuggaugau

SEQ ID NO: 3278161 - RNA, 22 nt, Vaccinia virus
acguuuagccgccuuuaauaga

SEQ ID NO: 3278162 - RNA, 21 nt, Vaccinia virus
auuaaaggcuuuuuauaucau

SEQ ID NO: 3278163 - RNA, 19 nt, Vaccinia virus
uaauauaaucuagacagau

SEQ ID NO: 3278164 - RNA, 20 nt, Vaccinia virus
aaugaaacggugaauacaau

SEQ ID NO: 3278165 - RNA, 19 nt, Vaccinia virus
uaguacgggcgcuguaauu

SEQ ID NO: 3278166 - RNA, 11 nt, Vaccinia virus
aaguaaauacu

SEQ ID NO: 3278167 - RNA, 19 nt, Vaccinia virus
auagacaaugcuaauauau

SEQ ID NO: 3278168 - RNA, 19 nt, Vaccinia virus
auaacaaaauccaaacauu

SEQ ID NO: 3278169 - RNA, 11 nt, Vaccinia virus
ggaaacuauaa

SEQ ID NO: 3278170 - RNA, 21 nt, Vaccinia virus
augaaaaauuuuccacaucuc

SEQ ID NO: 3278171 - RNA, 18 nt, Vaccinia virus
ucacugggguaaaguaag

SEQ ID NO: 3278172 - RNA, 22 nt, Vaccinia virus
uacauuaaacguacauuuucca

SEQ ID NO: 3278173 - RNA, 18 nt, Vaccinia virus
agauuaaaucauuaaaug

SEQ ID NO: 3278174 - RNA, 17 nt, Vaccinia virus
auugauuacuauaaaug

SEQ ID NO: 3278175 - RNA, 14 nt, Vaccinia virus
ccguuaaugaaaaa

SEQ ID NO: 3278176 - RNA, 12 nt, Vaccinia virus
agaauuagaaca

SEQ ID NO: 3278177 - RNA, 12 nt, Vaccinia virus
aacauauucuca

SEQ ID NO: 3278178 - RNA, 14 nt, Vaccinia virus
agaaugauauagaa

SEQ ID NO: 3278179 - RNA, 16 nt, Vaccinia virus
uuguucagcuguagaa

SEQ ID NO: 3278180 - RNA, 17 nt, Vaccinia virus
uccaguaaaccguuuuu

SEQ ID NO: 3278181 - RNA, 13 nt, Vaccinia virus
aucauaaaaguug

SEQ ID NO: 3278182 - RNA, 14 nt, Vaccinia virus
gaauuuauaucuaa

SEQ ID NO: 3278183 - RNA, 17 nt, Vaccinia virus
uguacauuaauaaauga

SEQ ID NO: 3278184 - RNA, 17 nt, Vaccinia virus
aucaaauagcucaauau

SEQ ID NO: 3278185 - RNA, 16 nt, Vaccinia virus
cugcuuagacuuccaa

SEQ ID NO: 3278186 - RNA, 18 nt, Vaccinia virus
caaaagacaugauaauau

SEQ ID NO: 3278187 - RNA, 14 nt, Vaccinia virus
aaguuucaaacugu

SEQ ID NO: 3278188 - RNA, 15 nt, Vaccinia virus
aacucauucuauaua

SEQ ID NO: 3278189 - RNA, 17 nt, Vaccinia virus
acaauacauguacaaau

SEQ ID NO: 3278190 - RNA, 18 nt, Vaccinia virus
augucaaaaauuguagaa

SEQ ID NO: 3278191 - RNA, 23 nt, Vaccinia virus
ucucaucaucagaauaaaucaau

SEQ ID NO: 3278192 - RNA, 13 nt, Vaccinia virus
caaccaaauacuu

SEQ ID NO: 3278193 - RNA, 20 nt, Vaccinia virus
uaccauagaagauguuagaa

SEQ ID NO: 3278194 - RNA, 18 nt, Vaccinia virus
gaguaacagucgaacaau

SEQ ID NO: 3278195 - RNA, 16 nt, Vaccinia virus
cuagguuucucuauaa

SEQ ID NO: 3278196 - RNA, 19 nt, Vaccinia virus
aucaaauggaugcuaauug

SEQ ID NO: 3278197 - RNA, 17 nt, Vaccinia virus
ucagauuucaauucacg

SEQ ID NO: 3278198 - RNA, 14 nt, Vaccinia virus
uauauuuagauguu

SEQ ID NO: 3278199 - RNA, 15 nt, Vaccinia virus
ucguuauagaaugca

SEQ ID NO: 3278200 - RNA, 14 nt, Vaccinia virus
agauuaguaacagu

SEQ ID NO: 3278201 - RNA, 15 nt, Vaccinia virus
cgacaucaagaccca

SEQ ID NO: 3278202 - RNA, 16 nt, Vaccinia virus
uagacagaauaucgug

SEQ ID NO: 3278203 - RNA, 19 nt, Vaccinia virus
ucgauucccauaugauguu

SEQ ID NO: 3278204 - RNA, 15 nt, Vaccinia virus
aguauguaaaaaugu

SEQ ID NO: 3278205 - RNA, 16 nt, Vaccinia virus
uuucuacuacuucauu

SEQ ID NO: 3278206 - RNA, 22 nt, Vaccinia virus
uguauucaacaugcuuuucuau

SEQ ID NO: 3278207 - RNA, 13 nt, Vaccinia virus
uacagacauuaag

SEQ ID NO: 3278208 - RNA, 16 nt, Vaccinia virus
auuacauacuuaaaaa

SEQ ID NO: 3278209 - RNA, 19 nt, Vaccinia virus
aauaaucggagaauguuuc

SEQ ID NO: 3278210 - RNA, 17 nt, Vaccinia virus
acaaauaguaaaugaga

SEQ ID NO: 3278211 - RNA, 15 nt, Vaccinia virus
uuugcacguaaccau

SEQ ID NO: 3278212 - RNA, 13 nt, Vaccinia virus
auaauaaauacuu

SEQ ID NO: 3278213 - RNA, 16 nt, Vaccinia virus
uauucagauuaucaug

SEQ ID NO: 3278214 - RNA, 23 nt, Vaccinia virus
auagauggucgacguuucucaaa

SEQ ID NO: 3278215 - RNA, 15 nt, Vaccinia virus
cauauuucauuucca

SEQ ID NO: 3278216 - RNA, 16 nt, Vaccinia virus
auaauaaauuuuucca

SEQ ID NO: 3278217 - RNA, 14 nt, Vaccinia virus
uagcuauucuucuu

SEQ ID NO: 3278218 - RNA, 17 nt, Vaccinia virus
uccggagauagauuucc

SEQ ID NO: 3278219 - RNA, 15 nt, Vaccinia virus
gacuuaaucaugcau

SEQ ID NO: 3278220 - RNA, 12 nt, Vaccinia virus
uuuuacauuacu

SEQ ID NO: 3278221 - RNA, 12 nt, Vaccinia virus
cacuacaucuuu

SEQ ID NO: 3278222 - RNA, 16 nt, Vaccinia virus
auauauuaauccacua

SEQ ID NO: 3278223 - RNA, 21 nt, Vaccinia virus
agaacacuacaguaguaauua

SEQ ID NO: 3278224 - RNA, 22 nt, Vaccinia virus
aguuuacuuucaugauuucauu

SEQ ID NO: 3278225 - RNA, 16 nt, Vaccinia virus
augagaucaauagaca

SEQ ID NO: 3278226 - RNA, 18 nt, Vaccinia virus
uagaaacuggagaaauca

SEQ ID NO: 3278227 - RNA, 12 nt, Vaccinia virus
cuuucuauuuuu

SEQ ID NO: 3278228 - RNA, 12 nt, Vaccinia virus
gucuuagauaua

SEQ ID NO: 3278229 - RNA, 19 nt, Vaccinia virus
cguuguugaaucuauuuug

SEQ ID NO: 3278230 - RNA, 18 nt, Vaccinia virus
cuauaaaacuacuacaau

SEQ ID NO: 3278231 - RNA, 11 nt, Vaccinia virus
uuuuuaacaug

SEQ ID NO: 3278232 - RNA, 22 nt, Vaccinia virus
cuuaugauauaaggaaacagcu

SEQ ID NO: 3278233 - RNA, 15 nt, Vaccinia virus
aucaugaauggauuu

SEQ ID NO: 3278234 - RNA, 12 nt, Vaccinia virus
ucgaauacuuau

SEQ ID NO: 3278235 - RNA, 19 nt, Vaccinia virus
auaacguaaccagaauugu

SEQ ID NO: 3278236 - RNA, 15 nt, Vaccinia virus
uaugaagauaaacac

SEQ ID NO: 3278237 - RNA, 20 nt, Vaccinia virus
uaacuaugcgauuauuuuca

SEQ ID NO: 3278238 - RNA, 13 nt, Vaccinia virus
uauacgacuauga

SEQ ID NO: 3278239 - RNA, 16 nt, Vaccinia virus
agauacuaguaugaug

SEQ ID NO: 3278240 - RNA, 14 nt, Vaccinia virus
ugaaauauauacau

SEQ ID NO: 3278241 - RNA, 20 nt, Vaccinia virus
ucaacuaucguuggaaaaug

SEQ ID NO: 3278242 - RNA, 17 nt, Vaccinia virus
auacgaagacuauagau

SEQ ID NO: 3278243 - RNA, 17 nt, Vaccinia virus
auauaccgauauguaca

SEQ ID NO: 3278244 - RNA, 16 nt, Vaccinia virus
cauaacuguauaaaau

SEQ ID NO: 3278245 - RNA, 21 nt, Vaccinia virus
ucacuguucuuuacaguuucu

SEQ ID NO: 3278246 - RNA, 11 nt, Vaccinia virus
gcuauaaugau

SEQ ID NO: 3278247 - RNA, 20 nt, Vaccinia virus
uaaacgcgucaaauuuuuca

SEQ ID NO: 3278248 - RNA, 15 nt, Vaccinia virus
uaacagucgaacaau

SEQ ID NO: 3278249 - RNA, 19 nt, Vaccinia virus
aucuugucugcuuaauaca

SEQ ID NO: 3278250 - RNA, 22 nt, Vaccinia virus
auuuuguaguuaauuuaucaca

SEQ ID NO: 3278251 - RNA, 13 nt, Vaccinia virus
uagauauagauuu

SEQ ID NO: 3278252 - RNA, 12 nt, Vaccinia virus
auaaaaucucca

SEQ ID NO: 3278253 - RNA, 12 nt, Vaccinia virus
acaaaaucuuca

SEQ ID NO: 3278254 - RNA, 16 nt, Vaccinia virus
agaauacgaugauauu

SEQ ID NO: 3278255 - RNA, 22 nt, Vaccinia virus
auaagaguguaguaucauagau

SEQ ID NO: 3278256 - RNA, 17 nt, Vaccinia virus
aguuccgagauaauuuc

SEQ ID NO: 3278257 - RNA, 15 nt, Vaccinia virus
agaaaaggauguauu

SEQ ID NO: 3278258 - RNA, 20 nt, Vaccinia virus
auucuaugaugguauugaag

SEQ ID NO: 3278259 - RNA, 22 nt, Vaccinia virus
uuuugguuucuuucauuucagu

SEQ ID NO: 3278260 - RNA, 22 nt, Vaccinia virus
aaccaguauguuuaauaugaaa

SEQ ID NO: 3278261 - RNA, 13 nt, Vaccinia virus
uugaagaaaucaa

SEQ ID NO: 3278262 - RNA, 14 nt, Vaccinia virus
cguggauuauaaca

SEQ ID NO: 3278263 - RNA, 23 nt, Vaccinia virus
ucccauggaaugacccaauaagu

SEQ ID NO: 3278264 - RNA, 23 nt, Vaccinia virus
aacucuaguaaaauaaucauaca

SEQ ID NO: 3278265 - RNA, 22 nt, Vaccinia virus
ggaaauacaccucuacauaacu

SEQ ID NO: 3278266 - RNA, 15 nt, Vaccinia virus
agaauucaacuauau

SEQ ID NO: 3278267 - RNA, 20 nt, Vaccinia virus
gauugauccuagaacuagau

SEQ ID NO: 3278268 - RNA, 16 nt, Vaccinia virus
uaucaaguuggccauu

SEQ ID NO: 3278269 - RNA, 19 nt, Vaccinia virus
auucugaugauauuagaac

SEQ ID NO: 3278270 - RNA, 18 nt, Vaccinia virus
aucauucauuccuccaua

SEQ ID NO: 3278271 - RNA, 22 nt, Vaccinia virus
agauuagguguagaucuagaug

SEQ ID NO: 3278272 - RNA, 16 nt, Vaccinia virus
ccggaguuagaaagca

SEQ ID NO: 3278273 - RNA, 20 nt, Vaccinia virus
uccaugacauauuacaaaau

SEQ ID NO: 3278274 - RNA, 22 nt, Vaccinia virus
aaaucauuagugacggaaaauc

SEQ ID NO: 3278275 - RNA, 13 nt, Vaccinia virus
aaacuuuuagaaa

SEQ ID NO: 3278276 - RNA, 18 nt, Vaccinia virus
aggaugcauuaucauuau

SEQ ID NO: 3278277 - RNA, 15 nt, Vaccinia virus
auuugcauuucuaua

SEQ ID NO: 3278278 - RNA, 20 nt, Vaccinia virus
aaagaguacaaccucauacu

SEQ ID NO: 3278279 - RNA, 20 nt, Vaccinia virus
aaacgcguuaguaaaacaug

SEQ ID NO: 3278280 - RNA, 14 nt, Vaccinia virus
aucgucuucacaaa

SEQ ID NO: 3278281 - RNA, 15 nt, Vaccinia virus
auacauuuauuguau

SEQ ID NO: 3278282 - RNA, 22 nt, Vaccinia virus
uuacuacguucagauuucaauu

SEQ ID NO: 3278283 - RNA, 20 nt, Vaccinia virus
gaacacauaaccaauuuaua

SEQ ID NO: 3278284 - RNA, 14 nt, Vaccinia virus
agaauaucuauaca

SEQ ID NO: 3278285 - RNA, 15 nt, Vaccinia virus
uuugagauuucauaa

SEQ ID NO: 3278286 - RNA, 17 nt, Vaccinia virus
acuguauccucaaacau

SEQ ID NO: 3278287 - RNA, 12 nt, Vaccinia virus
aacuuaaaagaa

SEQ ID NO: 3278288 - RNA, 14 nt, Vaccinia virus
acuugauaaaaaug

SEQ ID NO: 3278289 - RNA, 19 nt, Vaccinia virus
gaucacauuuagauaaaaa

SEQ ID NO: 3278290 - RNA, 22 nt, Vaccinia virus
ucuaaagaaaaaugauuaucuu

SEQ ID NO: 3278291 - RNA, 15 nt, Vaccinia virus
uaauugaguaaauga

SEQ ID NO: 3278292 - RNA, 15 nt, Vaccinia virus
aaauuauauacugaa

SEQ ID NO: 3278293 - RNA, 16 nt, Vaccinia virus
acaaacaccauccuug

SEQ ID NO: 3278294 - RNA, 16 nt, Vaccinia virus
agauacuauauuuguu

SEQ ID NO: 3278295 - RNA, 14 nt, Vaccinia virus
auagaggaugaauu

SEQ ID NO: 3278296 - RNA, 16 nt, Vaccinia virus
cucuuucuccuuucuc

SEQ ID NO: 3278297 - RNA, 13 nt, Vaccinia virus
aauucauuuccau

SEQ ID NO: 3278298 - RNA, 23 nt, Vaccinia virus
auaauuauaauauaaaaauacuu

SEQ ID NO: 3278299 - RNA, 23 nt, Vaccinia virus
uaaaauuauuuaauuuaauacau

SEQ ID NO: 3278300 - RNA, 16 nt, Vaccinia virus
uaacaacgacuuauaa

SEQ ID NO: 3278301 - RNA, 12 nt, Vaccinia virus
agaaaaaaugau

SEQ ID NO: 3278302 - RNA, 16 nt, Vaccinia virus
ggacaaauucuuuuga

SEQ ID NO: 3278303 - RNA, 12 nt, Vaccinia virus
uuaaaaaaagau

SEQ ID NO: 3278304 - RNA, 17 nt, Vaccinia virus
ucgacguuucucaaagu

SEQ ID NO: 3278305 - RNA, 11 nt, Vaccinia virus
uaccuguuuuu

SEQ ID NO: 3278306 - RNA, 19 nt, Vaccinia virus
acaauuuuugccuugaauu

SEQ ID NO: 3278307 - RNA, 14 nt, Vaccinia virus
gacuacgauugcac

SEQ ID NO: 3278308 - RNA, 14 nt, Vaccinia virus
gaacauuuaagaga

SEQ ID NO: 3278309 - RNA, 21 nt, Vaccinia virus
acuuggaaaagauaacuauug

SEQ ID NO: 3278310 - RNA, 12 nt, Vaccinia virus
caaugaaaucac

SEQ ID NO: 3278311 - RNA, 20 nt, Vaccinia virus
aauauuuaacucaugaugaa

SEQ ID NO: 3278312 - RNA, 19 nt, Vaccinia virus
gaguuuuccguuagaaaag

SEQ ID NO: 3278313 - RNA, 15 nt, Vaccinia virus
accacaggagaaugg

SEQ ID NO: 3278314 - RNA, 16 nt, Vaccinia virus
guccaucauuacagaa

SEQ ID NO: 3278315 - RNA, 18 nt, Vaccinia virus
uguguaacacuuuggaua

SEQ ID NO: 3278316 - RNA, 16 nt, Vaccinia virus
cuauaaaaaacauaau

SEQ ID NO: 3278317 - RNA, 18 nt, Vaccinia virus
cugcagcauuuugaggau

SEQ ID NO: 3278318 - RNA, 19 nt, Vaccinia virus
acauaugguuucuaaaucu

SEQ ID NO: 3278319 - RNA, 14 nt, Vaccinia virus
caaagaaaugagua

SEQ ID NO: 3278320 - RNA, 19 nt, Vaccinia virus
auucuugguaauuaauaga

SEQ ID NO: 3278321 - RNA, 14 nt, Vaccinia virus
aucauauucaacau

SEQ ID NO: 3278322 - RNA, 20 nt, Vaccinia virus
gcuaacauacgagacauguu

SEQ ID NO: 3278323 - RNA, 16 nt, Vaccinia virus
guaauaucuuaaauaa

SEQ ID NO: 3278324 - RNA, 14 nt, Vaccinia virus
caacauaucuaucc

SEQ ID NO: 3278325 - RNA, 22 nt, Vaccinia virus
acuacauaauccucaucuggaa

SEQ ID NO: 3278326 - RNA, 16 nt, Vaccinia virus
gugauguuguaacacu

SEQ ID NO: 3278327 - RNA, 12 nt, Vaccinia virus
uggaaauuauuu

SEQ ID NO: 3278328 - RNA, 20 nt, Vaccinia virus
aguucauaacagauacauaa

SEQ ID NO: 3278329 - RNA, 19 nt, Vaccinia virus
caaagaauuuuagacacua

SEQ ID NO: 3278330 - RNA, 13 nt, Vaccinia virus
caguaguauacau

SEQ ID NO: 3278331 - RNA, 11 nt, Vaccinia virus
uacgacgucag

SEQ ID NO: 3278332 - RNA, 19 nt, Vaccinia virus
cuuaaaugccuuauucucu

SEQ ID NO: 3278333 - RNA, 14 nt, Vaccinia virus
aacgaugucaaaau

SEQ ID NO: 3278334 - RNA, 17 nt, Vaccinia virus
auccggauccuuuucuu

SEQ ID NO: 3278335 - RNA, 16 nt, Vaccinia virus
auguaugauucaaugu

SEQ ID NO: 3278336 - RNA, 20 nt, Vaccinia virus
guuaaauguugguauaucaa

SEQ ID NO: 3278337 - RNA, 15 nt, Vaccinia virus
gaugauauagauaug

SEQ ID NO: 3278338 - RNA, 15 nt, Vaccinia virus
auacgccaaggaaag

SEQ ID NO: 3278339 - RNA, 21 nt, Vaccinia virus
agaauaaaaugcuaaugucaa

SEQ ID NO: 3278340 - RNA, 17 nt, Vaccinia virus
uaaacauuguuaucuag

SEQ ID NO: 3278341 - RNA, 13 nt, Vaccinia virus
uaacuaucuguaa

SEQ ID NO: 3278342 - RNA, 22 nt, Vaccinia virus
uaauauaaaaaaacauuauucu

SEQ ID NO: 3278343 - RNA, 14 nt, Vaccinia virus
ugauggaugagaua

SEQ ID NO: 3278344 - RNA, 19 nt, Vaccinia virus
caaauuuuuuuuacaaaca

SEQ ID NO: 3278345 - RNA, 16 nt, Vaccinia virus
aaccagaauuguaaaa

SEQ ID NO: 3278346 - RNA, 16 nt, Vaccinia virus
gauuuaauaguuacca

SEQ ID NO: 3278347 - RNA, 17 nt, Vaccinia virus
aaauaaguaguaauaau

SEQ ID NO: 3278348 - RNA, 18 nt, Vaccinia virus
ugcauaucuuuuucaaca

SEQ ID NO: 3278349 - RNA, 15 nt, Vaccinia virus
agaguuuuauaacga

SEQ ID NO: 3278350 - RNA, 16 nt, Vaccinia virus
uaacaaaacuauuuca

SEQ ID NO: 3278351 - RNA, 19 nt, Vaccinia virus
acuauugaagccauugaaa

SEQ ID NO: 3278352 - RNA, 18 nt, Vaccinia virus
cacauccaucaauuguaa

SEQ ID NO: 3278353 - RNA, 18 nt, Vaccinia virus
uauauagcuuauuccaca

SEQ ID NO: 3278354 - RNA, 19 nt, Vaccinia virus
ggauucuuugcguaucuca

SEQ ID NO: 3278355 - RNA, 17 nt, Vaccinia virus
gcuucagcggauccugu

SEQ ID NO: 3278356 - RNA, 18 nt, Vaccinia virus
agaugcuauaucaaaaua

SEQ ID NO: 3278357 - RNA, 20 nt, Vaccinia virus
aaucugauagaaagaauaag

SEQ ID NO: 3278358 - RNA, 16 nt, Vaccinia virus
auguuuggagaaauga

SEQ ID NO: 3278359 - RNA, 16 nt, Vaccinia virus
aaagcaucacagaauc

SEQ ID NO: 3278360 - RNA, 17 nt, Vaccinia virus
uauccagcuaacuuauu

SEQ ID NO: 3278361 - RNA, 22 nt, Vaccinia virus
uaaugacaauaaaauuaucaug

SEQ ID NO: 3278362 - RNA, 13 nt, Vaccinia virus
uaaauauauuuac

SEQ ID NO: 3278363 - RNA, 20 nt, Vaccinia virus
cauuauagauguguauacau

SEQ ID NO: 3278364 - RNA, 16 nt, Vaccinia virus
augaaugaugauauau

SEQ ID NO: 3278365 - RNA, 21 nt, Vaccinia virus
acaucuauauugcuacauaau

SEQ ID NO: 3278366 - RNA, 22 nt, Vaccinia virus
uauagauggaggggauuggcau

SEQ ID NO: 3278367 - RNA, 17 nt, Vaccinia virus
cgugucaaccaguuaaa

SEQ ID NO: 3278368 - RNA, 16 nt, Vaccinia virus
uuauacuauuacuauu

SEQ ID NO: 3278369 - RNA, 12 nt, Vaccinia virus
gaguuuauacac

SEQ ID NO: 3278370 - RNA, 21 nt, Vaccinia virus
uuaaguucaccaaacaacuuu

SEQ ID NO: 3278371 - RNA, 23 nt, Vaccinia virus
auuuguuuccaugacauauuaca

SEQ ID NO: 3278372 - RNA, 11 nt, Vaccinia virus
ggcaucuuuuu

SEQ ID NO: 3278373 - RNA, 17 nt, Vaccinia virus
aggaaacuuaaaauaua

SEQ ID NO: 3278374 - RNA, 15 nt, Vaccinia virus
ucgagacgucaauau

SEQ ID NO: 3278375 - RNA, 14 nt, Vaccinia virus
guauugacaaauau

SEQ ID NO: 3278376 - RNA, 21 nt, Vaccinia virus
uggaaaaaugaugaauuaaug

SEQ ID NO: 3278377 - RNA, 21 nt, Vaccinia virus
gacgcuuguuaauaaguaaau

SEQ ID NO: 3278378 - RNA, 18 nt, Vaccinia virus
uucaucguaucuagauaa

SEQ ID NO: 3278379 - RNA, 13 nt, Vaccinia virus
auauacacauaau

SEQ ID NO: 3278380 - RNA, 16 nt, Vaccinia virus
augaacaaagaaaugg

SEQ ID NO: 3278381 - RNA, 20 nt, Vaccinia virus
auaucauuaggauuuaacuc

SEQ ID NO: 3278382 - RNA, 17 nt, Vaccinia virus
aguggugugaauacaac

SEQ ID NO: 3278383 - RNA, 15 nt, Vaccinia virus
ucagauaaucugaaa

SEQ ID NO: 3278384 - RNA, 16 nt, Vaccinia virus
uggauauguguuuaca

SEQ ID NO: 3278385 - RNA, 17 nt, Vaccinia virus
uaucaacagauagcuug

SEQ ID NO: 3278386 - RNA, 14 nt, Vaccinia virus
auauuaguacagaa

SEQ ID NO: 3278387 - RNA, 19 nt, Vaccinia virus
auccaaacccuugaucucc

SEQ ID NO: 3278388 - RNA, 18 nt, Vaccinia virus
auauauuguagauaagaa

SEQ ID NO: 3278389 - RNA, 14 nt, Vaccinia virus
agcuacucuagauu

SEQ ID NO: 3278390 - RNA, 18 nt, Vaccinia virus
uuaaucuuuuuauuagua

SEQ ID NO: 3278391 - RNA, 23 nt, Vaccinia virus
auacuaaaaaauguagaaauuga

SEQ ID NO: 3278392 - RNA, 22 nt, Vaccinia virus
uuaacucggucgguuuaucuac

SEQ ID NO: 3278393 - RNA, 13 nt, Vaccinia virus
agaauugucuauc

SEQ ID NO: 3278394 - RNA, 21 nt, Vaccinia virus
uucauaauuguuagcuguuuu

SEQ ID NO: 3278395 - RNA, 13 nt, Vaccinia virus
gaccuauaauuga

SEQ ID NO: 3278396 - RNA, 18 nt, Vaccinia virus
aaguuaacacaugucaca

SEQ ID NO: 3278397 - RNA, 19 nt, Vaccinia virus
acauccucacuauucaugg

SEQ ID NO: 3278398 - RNA, 16 nt, Vaccinia virus
cauagaugauauugua

SEQ ID NO: 3278399 - RNA, 19 nt, Vaccinia virus
ccaaaugcugucugcgaaa

SEQ ID NO: 3278400 - RNA, 23 nt, Vaccinia virus
ccacuacaucaauuuuacaaaag

SEQ ID NO: 3278401 - RNA, 16 nt, Vaccinia virus
aaauaugauuuuguaa

SEQ ID NO: 3278402 - RNA, 18 nt, Vaccinia virus
uaguaaaaauaauuauua

SEQ ID NO: 3278403 - RNA, 18 nt, Vaccinia virus
caauaccaaagaaggaag

SEQ ID NO: 3278404 - RNA, 19 nt, Vaccinia virus
aucggacuuugugcauaug

SEQ ID NO: 3278405 - RNA, 21 nt, Vaccinia virus
aucaggaauccaaagagcuau

SEQ ID NO: 3278406 - RNA, 15 nt, Vaccinia virus
cuuucucacaaaaau

SEQ ID NO: 3278407 - RNA, 23 nt, Vaccinia virus
auaucauuaggauuuaacuccuu

SEQ ID NO: 3278408 - RNA, 16 nt, Vaccinia virus
uuuacguuauuaauca

SEQ ID NO: 3278409 - RNA, 17 nt, Vaccinia virus
cauucuucccauggaug

SEQ ID NO: 3278410 - RNA, 12 nt, Vaccinia virus
uuaauucucuau

SEQ ID NO: 3278411 - RNA, 18 nt, Vaccinia virus
uacuuuacaaacgaugua

SEQ ID NO: 3278412 - RNA, 18 nt, Vaccinia virus
ucauauuaauaaaguguu

SEQ ID NO: 3278413 - RNA, 17 nt, Vaccinia virus
uauuauacaaaaauuuu

SEQ ID NO: 3278414 - RNA, 18 nt, Vaccinia virus
ucuauaauauaauaauca

SEQ ID NO: 3278415 - RNA, 23 nt, Vaccinia virus
ucagaaaggauagagcaauaagu

SEQ ID NO: 3278416 - RNA, 14 nt, Vaccinia virus
aaaagauaaaugua

SEQ ID NO: 3278417 - RNA, 12 nt, Vaccinia virus
auagaugaaugu

SEQ ID NO: 3278418 - RNA, 15 nt, Vaccinia virus
auccuuauccuuuac

SEQ ID NO: 3278419 - RNA, 13 nt, Vaccinia virus
auauauaaugaau

SEQ ID NO: 3278420 - RNA, 14 nt, Vaccinia virus
ucuuaaaaaguuuc

SEQ ID NO: 3278421 - RNA, 19 nt, Vaccinia virus
uagaauaucuccucaagga

SEQ ID NO: 3278422 - RNA, 21 nt, Vaccinia virus
cagccuuaauuuuuucaugau

SEQ ID NO: 3278423 - RNA, 21 nt, Vaccinia virus
cauuuuauggaaacuauaauu

SEQ ID NO: 3278424 - RNA, 18 nt, Vaccinia virus
aguauuaaauauuaauaa

SEQ ID NO: 3278425 - RNA, 20 nt, Vaccinia virus
aaucuagccauugucuuaua

SEQ ID NO: 3278426 - RNA, 21 nt, Vaccinia virus
guugcaauaauaaaaguuauc

SEQ ID NO: 3278427 - RNA, 23 nt, Vaccinia virus
aucuagaaacacuuggauauugu

SEQ ID NO: 3278428 - RNA, 23 nt, Vaccinia virus
uuaaaugaguguccauauuuugc

SEQ ID NO: 3278429 - RNA, 23 nt, Vaccinia virus
uguuauuuuuucuguaauaguua

SEQ ID NO: 3278430 - RNA, 22 nt, Vaccinia virus
gucaucuuauguuuuuaagaga

SEQ ID NO: 3278431 - RNA, 14 nt, Vaccinia virus
auugguacgaaaua

SEQ ID NO: 3278432 - RNA, 21 nt, Vaccinia virus
aaaaagauuccuauuuacaaa

SEQ ID NO: 3278433 - RNA, 23 nt, Vaccinia virus
aacuccaauaaaaagaugauaua

SEQ ID NO: 3278434 - RNA, 14 nt, Vaccinia virus
uuaauguauuauua

SEQ ID NO: 3278435 - RNA, 13 nt, Vaccinia virus
augaaaaaaagau

SEQ ID NO: 3278436 - RNA, 23 nt, Vaccinia virus
uucaauuacuacaaaaauuacuc

SEQ ID NO: 3278437 - RNA, 20 nt, Vaccinia virus
aaguuuuaucuuucucucuu

SEQ ID NO: 3278438 - RNA, 20 nt, Vaccinia virus
aucuagucaccgagggaaaa

SEQ ID NO: 3278439 - RNA, 22 nt, Vaccinia virus
gaugauguucuaccuauuucau

SEQ ID NO: 3278440 - RNA, 13 nt, Vaccinia virus
aucuaaaaaacua

SEQ ID NO: 3278441 - RNA, 22 nt, Vaccinia virus
cauaaauaauaaauacaauaau

SEQ ID NO: 3278442 - RNA, 22 nt, Vaccinia virus
uugugaucggauaguauucaag

SEQ ID NO: 3278443 - RNA, 17 nt, Vaccinia virus
auuuuaaguuuauugac

SEQ ID NO: 3278444 - RNA, 23 nt, Vaccinia virus
uugguguaauaaaaaaauuauuu

SEQ ID NO: 3278445 - RNA, 19 nt, Vaccinia virus
agugacaacaaaaaaugaa

SEQ ID NO: 3278446 - RNA, 22 nt, Vaccinia virus
agcacgaucgugguuaacaaua

SEQ ID NO: 3278447 - RNA, 14 nt, Vaccinia virus
aacaguaucauuua

SEQ ID NO: 3278448 - RNA, 15 nt, Vaccinia virus
aacuacuugaaauuc

SEQ ID NO: 3278449 - RNA, 17 nt, Vaccinia virus
auagaucgaaaaauaua

SEQ ID NO: 3278450 - RNA, 13 nt, Vaccinia virus
ugaagaugauguu

SEQ ID NO: 3278451 - RNA, 22 nt, Vaccinia virus
aauauaaagcacguaggucuua

SEQ ID NO: 3278452 - RNA, 13 nt, Vaccinia virus
aacuuucuagaca

SEQ ID NO: 3278453 - RNA, 11 nt, Vaccinia virus
agcauguagaa

SEQ ID NO: 3278454 - RNA, 18 nt, Vaccinia virus
aaacaauguauacaaaug

SEQ ID NO: 3278455 - RNA, 15 nt, Vaccinia virus
aauuacuuaaagaua

SEQ ID NO: 3278456 - RNA, 20 nt, Vaccinia virus
gaauucauccguccuucaga

SEQ ID NO: 3278457 - RNA, 23 nt, Vaccinia virus
guuuguuucggccugaaguuggu

SEQ ID NO: 3278458 - RNA, 17 nt, Vaccinia virus
aucacagcaguaguuua

SEQ ID NO: 3278459 - RNA, 13 nt, Vaccinia virus
uucgcaucguauu

SEQ ID NO: 3278460 - RNA, 20 nt, Vaccinia virus
gcacacaaucuaauauugau

SEQ ID NO: 3278461 - RNA, 21 nt, Vaccinia virus
caauucauuccuauaaguuua

SEQ ID NO: 3278462 - RNA, 18 nt, Vaccinia virus
agaaucauugcuguaaac

SEQ ID NO: 3278463 - RNA, 13 nt, Vaccinia virus
cacauaaacaucg

SEQ ID NO: 3278464 - RNA, 14 nt, Vaccinia virus
caguauaccaaaca

SEQ ID NO: 3278465 - RNA, 16 nt, Vaccinia virus
agaauauaaaaacucu

SEQ ID NO: 3278466 - RNA, 23 nt, Vaccinia virus
auucaguuuauagagcaaaauaa

SEQ ID NO: 3278467 - RNA, 14 nt, Vaccinia virus
aaacuuuuagaaau

SEQ ID NO: 3278468 - RNA, 16 nt, Vaccinia virus
aguucuuaauacuucg

SEQ ID NO: 3278469 - RNA, 20 nt, Vaccinia virus
accacuucucuaucaaugau

SEQ ID NO: 3278470 - RNA, 22 nt, Vaccinia virus
ucgacauccgucaaaaccaauu

SEQ ID NO: 3278471 - RNA, 21 nt, Vaccinia virus
auuagugaugaauugaaaauu

SEQ ID NO: 3278472 - RNA, 13 nt, Vaccinia virus
aacaaauacagaa

SEQ ID NO: 3278473 - RNA, 23 nt, Vaccinia virus
accaauuacugauaauguagaag

SEQ ID NO: 3278474 - RNA, 16 nt, Vaccinia virus
gaaaggcgguauaugu

SEQ ID NO: 3278475 - RNA, 14 nt, Vaccinia virus
aauuuuuuuuauga

SEQ ID NO: 3278476 - RNA, 13 nt, Vaccinia virus
acaccauagcacu

SEQ ID NO: 3278477 - RNA, 15 nt, Vaccinia virus
agauuuuaaauguau

SEQ ID NO: 3278478 - RNA, 15 nt, Vaccinia virus
aauaucagaaaggau

SEQ ID NO: 3278479 - RNA, 22 nt, Vaccinia virus
acuugguauuuggaaauuagug

SEQ ID NO: 3278480 - RNA, 18 nt, Vaccinia virus
uuauucuauuuuacuaaa

SEQ ID NO: 3278481 - RNA, 13 nt, Vaccinia virus
guuauaaauuagg

SEQ ID NO: 3278482 - RNA, 20 nt, Vaccinia virus
gcuauguauauauauuucuu

SEQ ID NO: 3278483 - RNA, 22 nt, Vaccinia virus
acgcauaaaaauaucuuccaau

SEQ ID NO: 3278484 - RNA, 21 nt, Vaccinia virus
uuauuaguuuuuuauuauuga

SEQ ID NO: 3278485 - RNA, 16 nt, Vaccinia virus
aacguuccguaucugu

SEQ ID NO: 3278486 - RNA, 15 nt, Vaccinia virus
cgauagcaauuuguu

SEQ ID NO: 3278487 - RNA, 16 nt, Vaccinia virus
agauuuuuuaaaggau

SEQ ID NO: 3278488 - RNA, 10 nt, Vaccinia virus
ucuaaacaaa

SEQ ID NO: 3278489 - RNA, 17 nt, Vaccinia virus
uaagauauccauaucau

SEQ ID NO: 3278490 - RNA, 20 nt, Vaccinia virus
caaucugggcguauaaugaa

SEQ ID NO: 3278491 - RNA, 13 nt, Vaccinia virus
aucauuaaaggau

SEQ ID NO: 3278492 - RNA, 15 nt, Vaccinia virus
auauguaucaaagau

SEQ ID NO: 3278493 - RNA, 15 nt, Vaccinia virus
ggaauaaacaugucu

SEQ ID NO: 3278494 - RNA, 21 nt, Vaccinia virus
aaauucuuaguuauauauacu

SEQ ID NO: 3278495 - RNA, 18 nt, Vaccinia virus
aucacaauauauguugau

SEQ ID NO: 3278496 - RNA, 13 nt, Vaccinia virus
guccaauauuuua

SEQ ID NO: 3278497 - RNA, 13 nt, Vaccinia virus
cgaggauuuugau

SEQ ID NO: 3278498 - RNA, 13 nt, Vaccinia virus
uagauuaucuauu

SEQ ID NO: 3278499 - RNA, 16 nt, Vaccinia virus
auagauuuccaaagau

SEQ ID NO: 3278500 - RNA, 16 nt, Vaccinia virus
guaaucauagaugaau

SEQ ID NO: 3278501 - RNA, 16 nt, Vaccinia virus
uaacuuuuguucuaug

SEQ ID NO: 3278502 - RNA, 14 nt, Vaccinia virus
cucucauugauuuu

SEQ ID NO: 3278503 - RNA, 23 nt, Vaccinia virus
auucuacaagugacaacaaaaaa

SEQ ID NO: 3278504 - RNA, 18 nt, Vaccinia virus
uuauuucugaauuauucc

SEQ ID NO: 3278505 - RNA, 14 nt, Vaccinia virus
ccgaucaacaaaag

SEQ ID NO: 3278506 - RNA, 21 nt, Vaccinia virus
gaguuaggccaauagaaauau

SEQ ID NO: 3278507 - RNA, 16 nt, Vaccinia virus
gaagagaaaggucaau

SEQ ID NO: 3278508 - RNA, 15 nt, Vaccinia virus
uauguugacauguau

SEQ ID NO: 3278509 - RNA, 23 nt, Vaccinia virus
ucuuuaugacaucgccuacaaau

SEQ ID NO: 3278510 - RNA, 15 nt, Vaccinia virus
uggucauuaaaucuu

SEQ ID NO: 3278511 - RNA, 18 nt, Vaccinia virus
uuugauagggacaaagua

SEQ ID NO: 3278512 - RNA, 15 nt, Vaccinia virus
aaucaguuuaggaaa

SEQ ID NO: 3278513 - RNA, 13 nt, Vaccinia virus
uacacgaaugauu

SEQ ID NO: 3278514 - RNA, 13 nt, Vaccinia virus
auaaauaguuuuu

SEQ ID NO: 3278515 - RNA, 14 nt, Vaccinia virus
uagaaaucaacgau

SEQ ID NO: 3278516 - RNA, 21 nt, Vaccinia virus
agcagcaucugcgauguuaua

SEQ ID NO: 3278517 - RNA, 19 nt, Vaccinia virus
uuagaaucauugcuguaaa

SEQ ID NO: 3278518 - RNA, 17 nt, Vaccinia virus
augucaucgaaauggua

SEQ ID NO: 3278519 - RNA, 22 nt, Vaccinia virus
gaugauacauguauuaaaauac

SEQ ID NO: 3278520 - RNA, 19 nt, Vaccinia virus
auaguaguguaguuaaugu

SEQ ID NO: 3278521 - RNA, 20 nt, Vaccinia virus
uuaucuucauagaauacuaa

SEQ ID NO: 3278522 - RNA, 15 nt, Vaccinia virus
auuugucuucuuucu

SEQ ID NO: 3278523 - RNA, 14 nt, Vaccinia virus
cuauaacuccuaua

SEQ ID NO: 3278524 - RNA, 22 nt, Vaccinia virus
uuuagcagucuaacauuuuuaa

SEQ ID NO: 3278525 - RNA, 16 nt, Vaccinia virus
auauauuuuucuagau

SEQ ID NO: 3278526 - RNA, 17 nt, Vaccinia virus
gaauauguuauaaauuu

SEQ ID NO: 3278527 - RNA, 21 nt, Vaccinia virus
cuugauucuaguaucuuuugu

SEQ ID NO: 3278528 - RNA, 15 nt, Vaccinia virus
aaagaaguagcuaau

SEQ ID NO: 3278529 - RNA, 19 nt, Vaccinia virus
guaaauauagaucaaacaa

SEQ ID NO: 3278530 - RNA, 20 nt, Vaccinia virus
uguauuaaauagaauauuua

SEQ ID NO: 3278531 - RNA, 17 nt, Vaccinia virus
aucuucauagaauacua

SEQ ID NO: 3278532 - RNA, 16 nt, Vaccinia virus
acuguggauacucugu

SEQ ID NO: 3278533 - RNA, 20 nt, Vaccinia virus
cagacucucaagauuuuaaa

SEQ ID NO: 3278534 - RNA, 21 nt, Vaccinia virus
gaacuauuuuuuuauacuucu

SEQ ID NO: 3278535 - RNA, 14 nt, Vaccinia virus
uaauaaucaauaau

SEQ ID NO: 3278536 - RNA, 19 nt, Vaccinia virus
gcaugcgugguagauguuu

SEQ ID NO: 3278537 - RNA, 14 nt, Vaccinia virus
ucuuuuuuacacau

SEQ ID NO: 3278538 - RNA, 20 nt, Vaccinia virus
auuacuuuacauauaauauc

SEQ ID NO: 3278539 - RNA, 13 nt, Vaccinia virus
ucauauacuauuu

SEQ ID NO: 3278540 - RNA, 16 nt, Vaccinia virus
uuaaagaaaaauacuc

SEQ ID NO: 3278541 - RNA, 17 nt, Vaccinia virus
aagcauaauacucuguu

SEQ ID NO: 3278542 - RNA, 18 nt, Vaccinia virus
uaguuucuauaucuacau

SEQ ID NO: 3278543 - RNA, 15 nt, Vaccinia virus
acaugugucauuuau

SEQ ID NO: 3278544 - RNA, 16 nt, Vaccinia virus
guuauuaguacuauca

SEQ ID NO: 3278545 - RNA, 22 nt, Vaccinia virus
uacaaacgauuauuagaucuuu

SEQ ID NO: 3278546 - RNA, 20 nt, Vaccinia virus
uuacuugauaggugaaaaga

SEQ ID NO: 3278547 - RNA, 18 nt, Vaccinia virus
caggucuauucgacacua

SEQ ID NO: 3278548 - RNA, 18 nt, Vaccinia virus
ucaguguggguacaaaua

SEQ ID NO: 3278549 - RNA, 15 nt, Vaccinia virus
cuuuuauaauucaua

SEQ ID NO: 3278550 - RNA, 13 nt, Vaccinia virus
auaauuuaacaau

SEQ ID NO: 3278551 - RNA, 22 nt, Vaccinia virus
uuauggaguuagcaauuucaaa

SEQ ID NO: 3278552 - RNA, 20 nt, Vaccinia virus
uaccacguaaaacuuaaaau

SEQ ID NO: 3278553 - RNA, 19 nt, Vaccinia virus
gagaaaguggauaaaacaa

SEQ ID NO: 3278554 - RNA, 20 nt, Vaccinia virus
uauggaucuccaucgaugau

SEQ ID NO: 3278555 - RNA, 24 nt, Vaccinia virus
uacuccaaaaaacaaaauaacuag

SEQ ID NO: 3278556 - RNA, 23 nt, Vaccinia virus
uggagacgccugauauguaggca

SEQ ID NO: 3278557 - RNA, 19 nt, Vaccinia virus
ucuuaccauguccucaaau

SEQ ID NO: 3278558 - RNA, 17 nt, Vaccinia virus
cccgcuucuauuuacuc

SEQ ID NO: 3278559 - RNA, 14 nt, Vaccinia virus
uuugaacauguaga

SEQ ID NO: 3278560 - RNA, 18 nt, Vaccinia virus
auuaucucagugcaaaga

SEQ ID NO: 3278561 - RNA, 16 nt, Vaccinia virus
auauucaguuuauaga

SEQ ID NO: 3278562 - RNA, 14 nt, Vaccinia virus
gaucuggaaaauaa

SEQ ID NO: 3278563 - RNA, 22 nt, Vaccinia virus
aauugaacaaaguauucuuaug

SEQ ID NO: 3278564 - RNA, 16 nt, Vaccinia virus
cuauuaucaaauacug

SEQ ID NO: 3278565 - RNA, 21 nt, Vaccinia virus
acagaacaucaaaaaauuaua

SEQ ID NO: 3278566 - RNA, 20 nt, Vaccinia virus
cauaaugucuagcagcaucu

SEQ ID NO: 3278567 - RNA, 14 nt, Vaccinia virus
gcaaacaacaacaa

SEQ ID NO: 3278568 - RNA, 14 nt, Vaccinia virus
ucuucuuauuuaga

SEQ ID NO: 3278569 - RNA, 20 nt, Vaccinia virus
accagaagguguuguaacuu

SEQ ID NO: 3278570 - RNA, 21 nt, Vaccinia virus
uucauauuuuaccaacucuuu

SEQ ID NO: 3278571 - RNA, 12 nt, Vaccinia virus
aauuaguuuauu

SEQ ID NO: 3278572 - RNA, 22 nt, Vaccinia virus
uacuagacugacuucuaacaaa

SEQ ID NO: 3278573 - RNA, 16 nt, Vaccinia virus
cauuaaucuauuagaa

SEQ ID NO: 3278574 - RNA, 22 nt, Vaccinia virus
acguaucucgucguccaauauu

SEQ ID NO: 3278575 - RNA, 20 nt, Vaccinia virus
agaacaugugugaaaauauu

SEQ ID NO: 3278576 - RNA, 19 nt, Vaccinia virus
aucauuuaaacauuuaacu

SEQ ID NO: 3278577 - RNA, 12 nt, Vaccinia virus
ggagaauguuuc

SEQ ID NO: 3278578 - RNA, 19 nt, Vaccinia virus
auaugaccgauaagagacg

SEQ ID NO: 3278579 - RNA, 15 nt, Vaccinia virus
uagaucaucugaaaa

SEQ ID NO: 3278580 - RNA, 19 nt, Vaccinia virus
uaucuauaucauccaugua

SEQ ID NO: 3278581 - RNA, 13 nt, Vaccinia virus
aagaauugugcau

SEQ ID NO: 3278582 - RNA, 12 nt, Vaccinia virus
auagaagauuac

SEQ ID NO: 3278583 - RNA, 22 nt, Vaccinia virus
uuucugguguaauauucuaguu

SEQ ID NO: 3278584 - RNA, 15 nt, Vaccinia virus
aacuuucaucuaaua

SEQ ID NO: 3278585 - RNA, 21 nt, Vaccinia virus
ugucuaauaauagcguuuucu

SEQ ID NO: 3278586 - RNA, 21 nt, Vaccinia virus
cuucagaaaagucaaauauug

SEQ ID NO: 3278587 - RNA, 18 nt, Vaccinia virus
cucaucguauaaaacucu

SEQ ID NO: 3278588 - RNA, 20 nt, Vaccinia virus
uuauccguauuuccauaaua

SEQ ID NO: 3278589 - RNA, 22 nt, Vaccinia virus
gauaauaucuauauaugaucua

SEQ ID NO: 3278590 - RNA, 22 nt, Vaccinia virus
ccuuguccaaugugaauugaau

SEQ ID NO: 3278591 - RNA, 14 nt, Vaccinia virus
ggauacucuauuaa

SEQ ID NO: 3278592 - RNA, 16 nt, Vaccinia virus
auaggaucuauaaugu

SEQ ID NO: 3278593 - RNA, 19 nt, Vaccinia virus
aagauaguugucaguucau

SEQ ID NO: 3278594 - RNA, 19 nt, Vaccinia virus
uauaaccaccgauaaaucu

SEQ ID NO: 3278595 - RNA, 13 nt, Vaccinia virus
gugcuguaacauu

SEQ ID NO: 3278596 - RNA, 14 nt, Vaccinia virus
acuaauaaacauuc

SEQ ID NO: 3278597 - RNA, 15 nt, Vaccinia virus
uaguaauuaaugaaa

SEQ ID NO: 3278598 - RNA, 15 nt, Vaccinia virus
aaauaaguaguuaug

SEQ ID NO: 3278599 - RNA, 16 nt, Vaccinia virus
acaccuaauacucugg

SEQ ID NO: 3278600 - RNA, 17 nt, Vaccinia virus
auguuugucauauguau

SEQ ID NO: 3278601 - RNA, 22 nt, Vaccinia virus
aaucaggguuaucaaaguguuu

SEQ ID NO: 3278602 - RNA, 15 nt, Vaccinia virus
gacauagauauucua

SEQ ID NO: 3278603 - RNA, 18 nt, Vaccinia virus
uacuuuuugcguauacau

SEQ ID NO: 3278604 - RNA, 16 nt, Vaccinia virus
aaaguauacauguuag

SEQ ID NO: 3278605 - RNA, 20 nt, Vaccinia virus
uuuagcaaggucccuaauau

SEQ ID NO: 3278606 - RNA, 17 nt, Vaccinia virus
aguugaagauucuaaug

SEQ ID NO: 3278607 - RNA, 21 nt, Vaccinia virus
uaccccucauaguauuaauau

SEQ ID NO: 3278608 - RNA, 22 nt, Vaccinia virus
aaaucauuaacggauagcaaaa

SEQ ID NO: 3278609 - RNA, 19 nt, Vaccinia virus
cgguuugcaaaacaaaaau

SEQ ID NO: 3278610 - RNA, 15 nt, Vaccinia virus
auuaucggaaauacu

SEQ ID NO: 3278611 - RNA, 22 nt, Vaccinia virus
ugaagcugguaaaguaaaucau

SEQ ID NO: 3278612 - RNA, 16 nt, Vaccinia virus
ucacuguuguacauac

SEQ ID NO: 3278613 - RNA, 17 nt, Vaccinia virus
aacacugauucagaaau

SEQ ID NO: 3278614 - RNA, 11 nt, Vaccinia virus
aagaagagaau

SEQ ID NO: 3278615 - RNA, 21 nt, Vaccinia virus
aagauuaaaucauuaaaugau

SEQ ID NO: 3278616 - RNA, 21 nt, Vaccinia virus
uuauaauagguguaaaucuag

SEQ ID NO: 3278617 - RNA, 13 nt, Vaccinia virus
gugauuuuccaac

SEQ ID NO: 3278618 - RNA, 15 nt, Vaccinia virus
ucaacaaucguuaau

SEQ ID NO: 3278619 - RNA, 18 nt, Vaccinia virus
auaguuuuuuucauuacu

SEQ ID NO: 3278620 - RNA, 22 nt, Vaccinia virus
uaaaauauacucgacaacuuua

SEQ ID NO: 3278621 - RNA, 17 nt, Vaccinia virus
uggaagguuuguauucu

SEQ ID NO: 3278622 - RNA, 18 nt, Vaccinia virus
acaguaaccaaaaugaaa

SEQ ID NO: 3278623 - RNA, 16 nt, Vaccinia virus
auucagaguuguuguu

SEQ ID NO: 3278624 - RNA, 15 nt, Vaccinia virus
acaaugcuuuaauaa

SEQ ID NO: 3278625 - RNA, 14 nt, Vaccinia virus
aaccauucauuaau

SEQ ID NO: 3278626 - RNA, 20 nt, Vaccinia virus
ucuuuggcucuucuaucaac

SEQ ID NO: 3278627 - RNA, 22 nt, Vaccinia virus
cauauaugguauugguccauua

SEQ ID NO: 3278628 - RNA, 14 nt, Vaccinia virus
cucauuaaaaauuu

SEQ ID NO: 3278629 - RNA, 20 nt, Vaccinia virus
ugacucauggauucauuaau

SEQ ID NO: 3278630 - RNA, 16 nt, Vaccinia virus
auuuuuuuaguaaugu

SEQ ID NO: 3278631 - RNA, 19 nt, Vaccinia virus
cgauauagugaaacaaaau

SEQ ID NO: 3278632 - RNA, 13 nt, Vaccinia virus
guugguagauauu

SEQ ID NO: 3278633 - RNA, 21 nt, Vaccinia virus
ucuagaauucauuagacguag

SEQ ID NO: 3278634 - RNA, 13 nt, Vaccinia virus
auuuauaaaaaug

SEQ ID NO: 3278635 - RNA, 13 nt, Vaccinia virus
cuuaguauacaaa

SEQ ID NO: 3278636 - RNA, 16 nt, Vaccinia virus
acuagcuuaaacagau

SEQ ID NO: 3278637 - RNA, 22 nt, Vaccinia virus
guuaucaucguauaaauuaaag

SEQ ID NO: 3278638 - RNA, 13 nt, Vaccinia virus
gaagagguuauau

SEQ ID NO: 3278639 - RNA, 15 nt, Vaccinia virus
ucaugauuucauuau

SEQ ID NO: 3278640 - RNA, 22 nt, Vaccinia virus
uuauuuuaggaucauauuuaca

SEQ ID NO: 3278641 - RNA, 14 nt, Vaccinia virus
aucaacagaaauau

SEQ ID NO: 3278642 - RNA, 23 nt, Vaccinia virus
gagagacccugcgcuuucucuau

SEQ ID NO: 3278643 - RNA, 16 nt, Vaccinia virus
uauaucuaacaucuug

SEQ ID NO: 3278644 - RNA, 17 nt, Vaccinia virus
gagaauaaaaauguuuu

SEQ ID NO: 3278645 - RNA, 18 nt, Vaccinia virus
acuguauccucaaacauc

SEQ ID NO: 3278646 - RNA, 13 nt, Vaccinia virus
cauagcuauuuua

SEQ ID NO: 3278647 - RNA, 22 nt, Vaccinia virus
ucuuuacaguuucuguaaugau

SEQ ID NO: 3278648 - RNA, 16 nt, Vaccinia virus
cguaugccuguuuaua

SEQ ID NO: 3278649 - RNA, 20 nt, Vaccinia virus
uauuggaaaggcguuaucua

SEQ ID NO: 3278650 - RNA, 14 nt, Vaccinia virus
accaauaaacuauu

SEQ ID NO: 3278651 - RNA, 20 nt, Vaccinia virus
uacuacagaaacuaauauag

SEQ ID NO: 3278652 - RNA, 13 nt, Vaccinia virus
uccuuaucaaaau

SEQ ID NO: 3278653 - RNA, 21 nt, Vaccinia virus
acuuuugaacuaaaauacaau

SEQ ID NO: 3278654 - RNA, 20 nt, Vaccinia virus
caacguaguaucaucuucua

SEQ ID NO: 3278655 - RNA, 17 nt, Vaccinia virus
aucuucauaauaaauaa

SEQ ID NO: 3278656 - RNA, 17 nt, Vaccinia virus
aacgucguauguagaaa

SEQ ID NO: 3278657 - RNA, 18 nt, Vaccinia virus
acagacacgaauaugacu

SEQ ID NO: 3278658 - RNA, 13 nt, Vaccinia virus
gagagagaaauac

SEQ ID NO: 3278659 - RNA, 13 nt, Vaccinia virus
aaacauaugccau

SEQ ID NO: 3278660 - RNA, 17 nt, Vaccinia virus
guuuucuacaauaacua

SEQ ID NO: 3278661 - RNA, 15 nt, Vaccinia virus
aauaauucagauaau

SEQ ID NO: 3278662 - RNA, 19 nt, Vaccinia virus
auuguaugguuuuaaauau

SEQ ID NO: 3278663 - RNA, 17 nt, Vaccinia virus
cagucuccaguuaauau

SEQ ID NO: 3278664 - RNA, 14 nt, Vaccinia virus
gcauauauuagaaa

SEQ ID NO: 3278665 - RNA, 16 nt, Vaccinia virus
cugaauauauugauuu

SEQ ID NO: 3278666 - RNA, 19 nt, Vaccinia virus
gucucgcauguucagcaau

SEQ ID NO: 3278667 - RNA, 23 nt, Vaccinia virus
ucaacguaacuauauuccaaauu

SEQ ID NO: 3278668 - RNA, 16 nt, Vaccinia virus
acucgagucauuuuac

SEQ ID NO: 3278669 - RNA, 11 nt, Vaccinia virus
caauuaaaugu

SEQ ID NO: 3278670 - RNA, 23 nt, Vaccinia virus
auguguuuaauuuucacaaguau

SEQ ID NO: 3278671 - RNA, 18 nt, Vaccinia virus
uucacaauaucaguaucu

SEQ ID NO: 3278672 - RNA, 19 nt, Vaccinia virus
cuauauaauucuauuagau

SEQ ID NO: 3278673 - RNA, 14 nt, Vaccinia virus
cagauaauaacaga

SEQ ID NO: 3278674 - RNA, 22 nt, Vaccinia virus
cauuuaucgcuaacaugcauuu

SEQ ID NO: 3278675 - RNA, 12 nt, Vaccinia virus
agaaaaaaaugg

SEQ ID NO: 3278676 - RNA, 15 nt, Vaccinia virus
uuaacuaucuguaaa

SEQ ID NO: 3278677 - RNA, 14 nt, Vaccinia virus
uuuauauuaaauau

SEQ ID NO: 3278678 - RNA, 21 nt, Vaccinia virus
uguuaacugacaauugcaaaa

SEQ ID NO: 3278679 - RNA, 19 nt, Vaccinia virus
auaucgccuuuauuuccac

SEQ ID NO: 3278680 - RNA, 17 nt, Vaccinia virus
aguaugcuaaacuuuau

SEQ ID NO: 3278681 - RNA, 20 nt, Vaccinia virus
aaaauuuuuuagauguagua

SEQ ID NO: 3278682 - RNA, 20 nt, Vaccinia virus
aacauggggauugaaaauag

SEQ ID NO: 3278683 - RNA, 12 nt, Vaccinia virus
aauauacucuau

SEQ ID NO: 3278684 - RNA, 21 nt, Vaccinia virus
uauacuauauaguaauaccaa

SEQ ID NO: 3278685 - RNA, 19 nt, Vaccinia virus
aaaauauaaugauauacaa

SEQ ID NO: 3278686 - RNA, 14 nt, Vaccinia virus
aaaugauuuuggaa

SEQ ID NO: 3278687 - RNA, 15 nt, Vaccinia virus
caagauauauacacu

SEQ ID NO: 3278688 - RNA, 14 nt, Vaccinia virus
uauuacguuagcau

SEQ ID NO: 3278689 - RNA, 20 nt, Vaccinia virus
uuaaauuauccgcacaugca

SEQ ID NO: 3278690 - RNA, 17 nt, Vaccinia virus
gaaaaaaaauuaucuau

SEQ ID NO: 3278691 - RNA, 18 nt, Vaccinia virus
auucugcaauaucuucgu

SEQ ID NO: 3278692 - RNA, 19 nt, Vaccinia virus
uaacaaaauccaaacauua

SEQ ID NO: 3278693 - RNA, 13 nt, Vaccinia virus
auaaauaaugaau

SEQ ID NO: 3278694 - RNA, 16 nt, Vaccinia virus
auaaugaguuagauua

SEQ ID NO: 3278695 - RNA, 20 nt, Vaccinia virus
guuauucuguucuauucaaa

SEQ ID NO: 3278696 - RNA, 16 nt, Vaccinia virus
auagaggauauuucau

SEQ ID NO: 3278697 - RNA, 19 nt, Vaccinia virus
uacacauaguguuacaaaa

SEQ ID NO: 3278698 - RNA, 22 nt, Vaccinia virus
aacauuaaaauguccacagaua

SEQ ID NO: 3278699 - RNA, 20 nt, Vaccinia virus
aaauuuuuuuuacaaacauc

SEQ ID NO: 3278700 - RNA, 17 nt, Vaccinia virus
uauagaucaaacaacac

SEQ ID NO: 3278701 - RNA, 18 nt, Vaccinia virus
agaaucauacaaugaauu

SEQ ID NO: 3278702 - RNA, 21 nt, Vaccinia virus
ucagauuauucuuaaaugccu

SEQ ID NO: 3278703 - RNA, 14 nt, Vaccinia virus
cauaaguauguuug

SEQ ID NO: 3278704 - RNA, 16 nt, Vaccinia virus
auauauaguauuaaug

SEQ ID NO: 3278705 - RNA, 22 nt, Vaccinia virus
uaaauauuuuucuaccuuuuca

SEQ ID NO: 3278706 - RNA, 15 nt, Vaccinia virus
aucugacauaaacau

SEQ ID NO: 3278707 - RNA, 21 nt, Vaccinia virus
acaaaagguauuacaagaaua

SEQ ID NO: 3278708 - RNA, 22 nt, Vaccinia virus
uguauagaggucagauacuggu

SEQ ID NO: 3278709 - RNA, 14 nt, Vaccinia virus
ucaucaucaaaaga

SEQ ID NO: 3278710 - RNA, 22 nt, Vaccinia virus
ucagguucaucgaucucuauaa

SEQ ID NO: 3278711 - RNA, 22 nt, Vaccinia virus
ugcucgacaguguauacuauuu

SEQ ID NO: 3278712 - RNA, 22 nt, Vaccinia virus
acuucuccuuauugauugaaaa

SEQ ID NO: 3278713 - RNA, 15 nt, Vaccinia virus
caccuccuauaucaa

SEQ ID NO: 3278714 - RNA, 19 nt, Vaccinia virus
cuguagaaugcgaaggaag

SEQ ID NO: 3278715 - RNA, 15 nt, Vaccinia virus
agaaacuuaguacua

SEQ ID NO: 3278716 - RNA, 17 nt, Vaccinia virus
uuagucaaucuuauuca

SEQ ID NO: 3278717 - RNA, 12 nt, Vaccinia virus
aauguucaauau

SEQ ID NO: 3278718 - RNA, 13 nt, Vaccinia virus
uauauguauguaa

SEQ ID NO: 3278719 - RNA, 21 nt, Vaccinia virus
aaauuuuacaaaucuauaaca

SEQ ID NO: 3278720 - RNA, 19 nt, Vaccinia virus
cuucuaaucuuguaauauu

SEQ ID NO: 3278721 - RNA, 22 nt, Vaccinia virus
auaagacuuuacuuuucuaaau

SEQ ID NO: 3278722 - RNA, 17 nt, Vaccinia virus
aucauugggaaacauua

SEQ ID NO: 3278723 - RNA, 18 nt, Vaccinia virus
aaaauggugcuauuagaa

SEQ ID NO: 3278724 - RNA, 19 nt, Vaccinia virus
gcgacaguaugugguacau

SEQ ID NO: 3278725 - RNA, 21 nt, Vaccinia virus
gaaugucauuuguauuuuaua

SEQ ID NO: 3278726 - RNA, 13 nt, Vaccinia virus
accaauaaacuau

SEQ ID NO: 3278727 - RNA, 13 nt, Vaccinia virus
uauaguuaacauu

SEQ ID NO: 3278728 - RNA, 18 nt, Vaccinia virus
auucauauuuuaguuuuu

SEQ ID NO: 3278729 - RNA, 16 nt, Vaccinia virus
aucuaugguauuaaga

SEQ ID NO: 3278730 - RNA, 15 nt, Vaccinia virus
caacaacauauaauu

SEQ ID NO: 3278731 - RNA, 15 nt, Vaccinia virus
uaaaauacuacuguu

SEQ ID NO: 3278732 - RNA, 13 nt, Vaccinia virus
acauguaauacau

SEQ ID NO: 3278733 - RNA, 13 nt, Vaccinia virus
aucaugaaaugau

SEQ ID NO: 3278734 - RNA, 13 nt, Vaccinia virus
aacauguuaaaau

SEQ ID NO: 3278735 - RNA, 13 nt, Vaccinia virus
aaaaaagcaaugu

SEQ ID NO: 3278736 - RNA, 19 nt, Vaccinia virus
agcauauuguaauaucuua

SEQ ID NO: 3278737 - RNA, 19 nt, Vaccinia virus
cauuuaaaguuacaaacaa

SEQ ID NO: 3278738 - RNA, 18 nt, Vaccinia virus
uuucgcaucguauuuuaa

SEQ ID NO: 3278739 - RNA, 22 nt, Vaccinia virus
gaagagacgccucguuccaagu

SEQ ID NO: 3278740 - RNA, 21 nt, Vaccinia virus
uuacuaaaauaucgauguuua

SEQ ID NO: 3278741 - RNA, 20 nt, Vaccinia virus
uuaacaucuuuuuauaucug

SEQ ID NO: 3278742 - RNA, 15 nt, Vaccinia virus
auaacaggaguuuuc

SEQ ID NO: 3278743 - RNA, 17 nt, Vaccinia virus
aguagauacauaucaau

SEQ ID NO: 3278744 - RNA, 16 nt, Vaccinia virus
auaaacugaucacuaa

SEQ ID NO: 3278745 - RNA, 16 nt, Vaccinia virus
agacacuaacucuguu

SEQ ID NO: 3278746 - RNA, 13 nt, Vaccinia virus
augaagaaugccu

SEQ ID NO: 3278747 - RNA, 19 nt, Vaccinia virus
augauaucuucacguagau

SEQ ID NO: 3278748 - RNA, 21 nt, Vaccinia virus
uuuggaaacauaaaauaacuc

SEQ ID NO: 3278749 - RNA, 20 nt, Vaccinia virus
aucaacagauagcuugaaug

SEQ ID NO: 3278750 - RNA, 15 nt, Vaccinia virus
aaaaguacagaauua

SEQ ID NO: 3278751 - RNA, 13 nt, Vaccinia virus
uaagacugucaau

SEQ ID NO: 3278752 - RNA, 17 nt, Vaccinia virus
guaucugaaguacuauu

SEQ ID NO: 3278753 - RNA, 14 nt, Vaccinia virus
aauucgauaucuuu

SEQ ID NO: 3278754 - RNA, 19 nt, Vaccinia virus
cucugacauucagaaagag

SEQ ID NO: 3278755 - RNA, 16 nt, Vaccinia virus
uacgcaauguuacaca

SEQ ID NO: 3278756 - RNA, 20 nt, Vaccinia virus
aaguaauuauaguauaaugu

SEQ ID NO: 3278757 - RNA, 20 nt, Vaccinia virus
cugucuauaaugacaauaaa

SEQ ID NO: 3278758 - RNA, 13 nt, Vaccinia virus
acuuuuucauaau

SEQ ID NO: 3278759 - RNA, 13 nt, Vaccinia virus
ucuuauucuuaaa

SEQ ID NO: 3278760 - RNA, 22 nt, Vaccinia virus
auagaugaacaaggaaauccua

SEQ ID NO: 3278761 - RNA, 15 nt, Vaccinia virus
agaaucguaauggau

SEQ ID NO: 3278762 - RNA, 16 nt, Vaccinia virus
agucgaacaaucuuaa

SEQ ID NO: 3278763 - RNA, 14 nt, Vaccinia virus
agcuuccagauaca

SEQ ID NO: 3278764 - RNA, 13 nt, Vaccinia virus
aucgaucauaucu

SEQ ID NO: 3278765 - RNA, 17 nt, Vaccinia virus
gaagauuaccucuaguu

SEQ ID NO: 3278766 - RNA, 19 nt, Vaccinia virus
agauauuuagcaauugcau

SEQ ID NO: 3278767 - RNA, 20 nt, Vaccinia virus
aaacuuauacauccuguucu

SEQ ID NO: 3278768 - RNA, 19 nt, Vaccinia virus
aguucuuacacauaucacu

SEQ ID NO: 3278769 - RNA, 17 nt, Vaccinia virus
aguaacgagucucaguu

SEQ ID NO: 3278770 - RNA, 15 nt, Vaccinia virus
uaacagcuuccguaa

SEQ ID NO: 3278771 - RNA, 21 nt, Vaccinia virus
aucgauaauugucucauaugu

SEQ ID NO: 3278772 - RNA, 19 nt, Vaccinia virus
aauaguuuguuuuggaaau

SEQ ID NO: 3278773 - RNA, 19 nt, Vaccinia virus
aaugaucauccagauaaua

SEQ ID NO: 3278774 - RNA, 15 nt, Vaccinia virus
guuuguauaauaucu

SEQ ID NO: 3278775 - RNA, 15 nt, Vaccinia virus
aaaaaucgauuuuau

SEQ ID NO: 3278776 - RNA, 22 nt, Vaccinia virus
uauaaauaugagcauuaguauu

SEQ ID NO: 3278777 - RNA, 20 nt, Vaccinia virus
uuaccagcauuaguaacagc

SEQ ID NO: 3278778 - RNA, 16 nt, Vaccinia virus
auaagaaauauauacu

SEQ ID NO: 3278779 - RNA, 20 nt, Vaccinia virus
uaguaauuuuuuaucauaaa

SEQ ID NO: 3278780 - RNA, 17 nt, Vaccinia virus
uagcgaacauauaucug

SEQ ID NO: 3278781 - RNA, 16 nt, Vaccinia virus
cacguaccagcauuug

SEQ ID NO: 3278782 - RNA, 17 nt, Vaccinia virus
caauuauaauauacgau

SEQ ID NO: 3278783 - RNA, 22 nt, Vaccinia virus
gaacgauauuugugaaaaauau

SEQ ID NO: 3278784 - RNA, 17 nt, Vaccinia virus
auuaaaaaauaacuuaa

SEQ ID NO: 3278785 - RNA, 15 nt, Vaccinia virus
auuaugauagaaauu

SEQ ID NO: 3278786 - RNA, 12 nt, Vaccinia virus
uagucacaauca

SEQ ID NO: 3278787 - RNA, 20 nt, Vaccinia virus
uuugucuccuucuccguaaa

SEQ ID NO: 3278788 - RNA, 23 nt, Vaccinia virus
cuaaagggauuuuauaugauauc

SEQ ID NO: 3278789 - RNA, 20 nt, Vaccinia virus
gauauaauauauuagauauu

SEQ ID NO: 3278790 - RNA, 19 nt, Vaccinia virus
uuacgacgugcuaaucuag

SEQ ID NO: 3278791 - RNA, 20 nt, Vaccinia virus
aggauaugauaaaaaauaua

SEQ ID NO: 3278792 - RNA, 18 nt, Vaccinia virus
cuuuuaauucuuaucaau

SEQ ID NO: 3278793 - RNA, 19 nt, Vaccinia virus
agauaucuucuuuuuucca

SEQ ID NO: 3278794 - RNA, 14 nt, Vaccinia virus
auacgagucauuau

SEQ ID NO: 3278795 - RNA, 16 nt, Vaccinia virus
agaauaagaacuauaa

SEQ ID NO: 3278796 - RNA, 16 nt, Vaccinia virus
aaguacuugauacaua

SEQ ID NO: 3278797 - RNA, 15 nt, Vaccinia virus
caacaaguauacaau

SEQ ID NO: 3278798 - RNA, 16 nt, Vaccinia virus
uaauacauuuugaacu

SEQ ID NO: 3278799 - RNA, 18 nt, Vaccinia virus
guaaaagaucuauaaugu

SEQ ID NO: 3278800 - RNA, 17 nt, Vaccinia virus
gucucucauaauaaauu

SEQ ID NO: 3278801 - RNA, 20 nt, Vaccinia virus
augugauggaaaaaugacua

SEQ ID NO: 3278802 - RNA, 13 nt, Vaccinia virus
ugaaucaucuguu

SEQ ID NO: 3278803 - RNA, 17 nt, Vaccinia virus
agauauaguauauucca

SEQ ID NO: 3278804 - RNA, 22 nt, Vaccinia virus
auacacgauuuaauccaucugu

SEQ ID NO: 3278805 - RNA, 18 nt, Vaccinia virus
cugaugcauguauuugcu

SEQ ID NO: 3278806 - RNA, 16 nt, Vaccinia virus
augauuucagauacua

SEQ ID NO: 3278807 - RNA, 12 nt, Vaccinia virus
agucauacuaga

SEQ ID NO: 3278808 - RNA, 14 nt, Vaccinia virus
aaauguguaauaau

SEQ ID NO: 3278809 - RNA, 14 nt, Vaccinia virus
caaacauccucuau

SEQ ID NO: 3278810 - RNA, 19 nt, Vaccinia virus
aacauuguuuguauucucc

SEQ ID NO: 3278811 - RNA, 16 nt, Vaccinia virus
gguugccaaauuuauu

SEQ ID NO: 3278812 - RNA, 19 nt, Vaccinia virus
uuaaaauauauucuaauau

SEQ ID NO: 3278813 - RNA, 22 nt, Vaccinia virus
acaaugaugcggaagaacaauu

SEQ ID NO: 3278814 - RNA, 16 nt, Vaccinia virus
acaagaaauauuucca

SEQ ID NO: 3278815 - RNA, 17 nt, Vaccinia virus
uacaaauuuuaagaaau

SEQ ID NO: 3278816 - RNA, 18 nt, Vaccinia virus
cuaaugcggaaugucaac

SEQ ID NO: 3278817 - RNA, 12 nt, Vaccinia virus
auucauuuccau

SEQ ID NO: 3278818 - RNA, 14 nt, Vaccinia virus
aucgacgucaaaga

SEQ ID NO: 3278819 - RNA, 22 nt, Vaccinia virus
aaaaguuguagaacguaaauua

SEQ ID NO: 3278820 - RNA, 15 nt, Vaccinia virus
cucuauaaaauacua

SEQ ID NO: 3278821 - RNA, 20 nt, Vaccinia virus
acucuuggucuaauacugau

SEQ ID NO: 3278822 - RNA, 16 nt, Vaccinia virus
uaaaauaaucucuuag

SEQ ID NO: 3278823 - RNA, 21 nt, Vaccinia virus
auuccuuuucguaggcacaca

SEQ ID NO: 3278824 - RNA, 20 nt, Vaccinia virus
auugaucuauuauuuaauga

SEQ ID NO: 3278825 - RNA, 18 nt, Vaccinia virus
augaggucgcaaaaaaac

SEQ ID NO: 3278826 - RNA, 17 nt, Vaccinia virus
ucaaagucacaaagcaa

SEQ ID NO: 3278827 - RNA, 22 nt, Vaccinia virus
ggaugucaucaauguagaaaau

SEQ ID NO: 3278828 - RNA, 23 nt, Vaccinia virus
uucuauaagguuucuuaaucagu

SEQ ID NO: 3278829 - RNA, 18 nt, Vaccinia virus
aaacaugaugagauguuu

SEQ ID NO: 3278830 - RNA, 20 nt, Vaccinia virus
aguuguauacuaucagaauc

SEQ ID NO: 3278831 - RNA, 16 nt, Vaccinia virus
ucagcggcaucuaaau

SEQ ID NO: 3278832 - RNA, 21 nt, Vaccinia virus
auacuguagaugguucuuuaa

SEQ ID NO: 3278833 - RNA, 17 nt, Vaccinia virus
auuucgaauacgauaau

SEQ ID NO: 3278834 - RNA, 19 nt, Vaccinia virus
agagccuguaacaucucaa

SEQ ID NO: 3278835 - RNA, 15 nt, Vaccinia virus
gacuggaguguauau

SEQ ID NO: 3278836 - RNA, 13 nt, Vaccinia virus
uaagacuuauucu

SEQ ID NO: 3278837 - RNA, 18 nt, Vaccinia virus
acacaguagaaaauaaua

SEQ ID NO: 3278838 - RNA, 16 nt, Vaccinia virus
aguauaugaacaaacg

SEQ ID NO: 3278839 - RNA, 16 nt, Vaccinia virus
auaauucuauucuagu

SEQ ID NO: 3278840 - RNA, 21 nt, Vaccinia virus
uccgcugccaaguuccuauua

SEQ ID NO: 3278841 - RNA, 15 nt, Vaccinia virus
gaaauugcaaaauau

SEQ ID NO: 3278842 - RNA, 14 nt, Vaccinia virus
acgucaaacaaugu

SEQ ID NO: 3278843 - RNA, 18 nt, Vaccinia virus
auacagacaauugacaaa

SEQ ID NO: 3278844 - RNA, 15 nt, Vaccinia virus
cugaaccuacuuuau

SEQ ID NO: 3278845 - RNA, 23 nt, Vaccinia virus
uaaacauuaucgagcaagcauug

SEQ ID NO: 3278846 - RNA, 22 nt, Vaccinia virus
uguuacaacuuuaccaaaauua

SEQ ID NO: 3278847 - RNA, 21 nt, Vaccinia virus
gaaggauuggucuuaaaagau

SEQ ID NO: 3278848 - RNA, 20 nt, Vaccinia virus
aacauguuacuauagcauua

SEQ ID NO: 3278849 - RNA, 15 nt, Vaccinia virus
uauacggauuucuau

SEQ ID NO: 3278850 - RNA, 15 nt, Vaccinia virus
aauuaggagaacuua

SEQ ID NO: 3278851 - RNA, 20 nt, Vaccinia virus
gaauuagucgucgaauauau

SEQ ID NO: 3278852 - RNA, 13 nt, Vaccinia virus
cuuguauuuugau

SEQ ID NO: 3278853 - RNA, 15 nt, Vaccinia virus
agaugaaauagcguu

SEQ ID NO: 3278854 - RNA, 14 nt, Vaccinia virus
auauaguuaaaggu

SEQ ID NO: 3278855 - RNA, 22 nt, Vaccinia virus
agaaauauauacuucaauugau

SEQ ID NO: 3278856 - RNA, 16 nt, Vaccinia virus
acaauaaaaaaaauug

SEQ ID NO: 3278857 - RNA, 22 nt, Vaccinia virus
gcaaaaaaucugauagaaagaa

SEQ ID NO: 3278858 - RNA, 20 nt, Vaccinia virus
auuaaacuaauucauuuuca

SEQ ID NO: 3278859 - RNA, 14 nt, Vaccinia virus
ucguguuaaauuuu

SEQ ID NO: 3278860 - RNA, 16 nt, Vaccinia virus
guuauugguauuucuu

SEQ ID NO: 3278861 - RNA, 20 nt, Vaccinia virus
uucgaauauaucaaaaucau

SEQ ID NO: 3278862 - RNA, 23 nt, Vaccinia virus
ccaaauuuuuuuuacaaacauca

SEQ ID NO: 3278863 - RNA, 14 nt, Vaccinia virus
aauaucuuauucca

SEQ ID NO: 3278864 - RNA, 12 nt, Vaccinia virus
acugaauuauua

SEQ ID NO: 3278865 - RNA, 15 nt, Vaccinia virus
auaacgucuucuaug

SEQ ID NO: 3278866 - RNA, 21 nt, Vaccinia virus
aggaauuacauagaugauauu

SEQ ID NO: 3278867 - RNA, 17 nt, Vaccinia virus
ccaauaaacuauuucua

SEQ ID NO: 3278868 - RNA, 20 nt, Vaccinia virus
uucuacaaaagcaauuauua

SEQ ID NO: 3278869 - RNA, 15 nt, Vaccinia virus
gacaacaaaaaauga

SEQ ID NO: 3278870 - RNA, 22 nt, Vaccinia virus
auacucuucaaaguuucugaaa

SEQ ID NO: 3278871 - RNA, 16 nt, Vaccinia virus
uccgaaugaauguuuu

SEQ ID NO: 3278872 - RNA, 21 nt, Vaccinia virus
ucaaaauuguaacaacaaugu

SEQ ID NO: 3278873 - RNA, 14 nt, Vaccinia virus
aaguuuuacauaag

SEQ ID NO: 3278874 - RNA, 17 nt, Vaccinia virus
cuacucuagguaacaaa

SEQ ID NO: 3278875 - RNA, 16 nt, Vaccinia virus
aucuguacuucuguac

SEQ ID NO: 3278876 - RNA, 17 nt, Vaccinia virus
ucaaccaccgaugaugc

SEQ ID NO: 3278877 - RNA, 13 nt, Vaccinia virus
augauacacguau

SEQ ID NO: 3278878 - RNA, 22 nt, Vaccinia virus
ucuggaaaaacaacacaaugua

SEQ ID NO: 3278879 - RNA, 22 nt, Vaccinia virus
gaauuguacccaaaucugaaaa

SEQ ID NO: 3278880 - RNA, 13 nt, Vaccinia virus
uauuauacaugug

SEQ ID NO: 3278881 - RNA, 13 nt, Vaccinia virus
cgauauagaguau

SEQ ID NO: 3278882 - RNA, 15 nt, Vaccinia virus
uggcuauuucaaaau

SEQ ID NO: 3278883 - RNA, 14 nt, Vaccinia virus
aauacuuaaaaaug

SEQ ID NO: 3278884 - RNA, 21 nt, Vaccinia virus
uaaacccucgaucaugaaugg

SEQ ID NO: 3278885 - RNA, 13 nt, Vaccinia virus
uauuucuuacaua

SEQ ID NO: 3278886 - RNA, 16 nt, Vaccinia virus
aaaacauucaaauguu

SEQ ID NO: 3278887 - RNA, 20 nt, Vaccinia virus
ugacuguagaacucaugaau

SEQ ID NO: 3278888 - RNA, 14 nt, Vaccinia virus
guuagacauaaaaa

SEQ ID NO: 3278889 - RNA, 17 nt, Vaccinia virus
aguuaacacaugucaca

SEQ ID NO: 3278890 - RNA, 23 nt, Vaccinia virus
auauguguuuacaguaguaauga

SEQ ID NO: 3278891 - RNA, 17 nt, Vaccinia virus
uauauagauauuaucua

SEQ ID NO: 3278892 - RNA, 15 nt, Vaccinia virus
ugcucaaacaaaaug

SEQ ID NO: 3278893 - RNA, 19 nt, Vaccinia virus
uaacucuuucgaauacuua

SEQ ID NO: 3278894 - RNA, 20 nt, Vaccinia virus
aaaaaaggagcagacccuaa

SEQ ID NO: 3278895 - RNA, 17 nt, Vaccinia virus
aaaucaggaaaaaagau

SEQ ID NO: 3278896 - RNA, 16 nt, Vaccinia virus
agaguaguauauuguc

SEQ ID NO: 3278897 - RNA, 13 nt, Vaccinia virus
ucuucucaaaaga

SEQ ID NO: 3278898 - RNA, 23 nt, Vaccinia virus
uuaaacaauacucuauuauuaau

SEQ ID NO: 3278899 - RNA, 14 nt, Vaccinia virus
gaaaaaaguuuauu

SEQ ID NO: 3278900 - RNA, 22 nt, Vaccinia virus
uucuggaaguggauauacauag

SEQ ID NO: 3278901 - RNA, 14 nt, Vaccinia virus
aauaguuucauaau

SEQ ID NO: 3278902 - RNA, 16 nt, Vaccinia virus
cauucauguacuaaca

SEQ ID NO: 3278903 - RNA, 20 nt, Vaccinia virus
uugaguuugucgcauacuuu

SEQ ID NO: 3278904 - RNA, 17 nt, Vaccinia virus
uaacauaucguuucuuu

SEQ ID NO: 3278905 - RNA, 22 nt, Vaccinia virus
uuauuggugcuucguacauaag

SEQ ID NO: 3278906 - RNA, 20 nt, Vaccinia virus
aauaaaguauauauaaguua

SEQ ID NO: 3278907 - RNA, 21 nt, Vaccinia virus
gauaaugauacaguaccauca

SEQ ID NO: 3278908 - RNA, 23 nt, Vaccinia virus
auguagagguguauuuccuauau

SEQ ID NO: 3278909 - RNA, 18 nt, Vaccinia virus
ucaaaugguaaauacugu

SEQ ID NO: 3278910 - RNA, 21 nt, Vaccinia virus
gauggaaacauuguuauugau

SEQ ID NO: 3278911 - RNA, 20 nt, Vaccinia virus
augucauggaaacaaaugaa

SEQ ID NO: 3278912 - RNA, 15 nt, Vaccinia virus
auuuauauaugcauu

SEQ ID NO: 3278913 - RNA, 16 nt, Vaccinia virus
cauaauauuaaacacu

SEQ ID NO: 3278914 - RNA, 19 nt, Vaccinia virus
uuaccagaagguguuguaa

SEQ ID NO: 3278915 - RNA, 14 nt, Vaccinia virus
acgugcuguaccaa

SEQ ID NO: 3278916 - RNA, 16 nt, Vaccinia virus
gagaugagauaagaac

SEQ ID NO: 3278917 - RNA, 23 nt, Vaccinia virus
augcuauccaucagaauguuucc

SEQ ID NO: 3278918 - RNA, 22 nt, Vaccinia virus
aauauaacuugguauaaagaua

SEQ ID NO: 3278919 - RNA, 17 nt, Vaccinia virus
uuaacgaggacuuauuc

SEQ ID NO: 3278920 - RNA, 15 nt, Vaccinia virus
caaaacucaaauguu

SEQ ID NO: 3278921 - RNA, 18 nt, Vaccinia virus
aaaugauaucuuagaaua

SEQ ID NO: 3278922 - RNA, 15 nt, Vaccinia virus
ucucauauguuuuaa

SEQ ID NO: 3278923 - RNA, 17 nt, Vaccinia virus
ucaucuacucauagaaa

SEQ ID NO: 3278924 - RNA, 13 nt, Vaccinia virus
aauugucuaauga

SEQ ID NO: 3278925 - RNA, 19 nt, Vaccinia virus
uaguaaaccgauaguguau

SEQ ID NO: 3278926 - RNA, 23 nt, Vaccinia virus
aaaaguuuuccaucuauguagaa

SEQ ID NO: 3278927 - RNA, 21 nt, Vaccinia virus
gaagcaacuaaacuaugugau

SEQ ID NO: 3278928 - RNA, 19 nt, Vaccinia virus
ugguuguugauggaucugu

SEQ ID NO: 3278929 - RNA, 22 nt, Vaccinia virus
aaugcgacgaguuaaaaagaua

SEQ ID NO: 3278930 - RNA, 15 nt, Vaccinia virus
acgauuuguuuaauu

SEQ ID NO: 3278931 - RNA, 16 nt, Vaccinia virus
ugcauuuuuauauaca

SEQ ID NO: 3278932 - RNA, 20 nt, Vaccinia virus
aguaucuuauguauauguuu

SEQ ID NO: 3278933 - RNA, 17 nt, Vaccinia virus
guagaaaauauauucua

SEQ ID NO: 3278934 - RNA, 16 nt, Vaccinia virus
guuuucuacaauaacu

SEQ ID NO: 3278935 - RNA, 16 nt, Vaccinia virus
uaauuugaguaagaau

SEQ ID NO: 3278936 - RNA, 13 nt, Vaccinia virus
uauaaaaaacuaa

SEQ ID NO: 3278937 - RNA, 20 nt, Vaccinia virus
uauaacuucugguaaauauu

SEQ ID NO: 3278938 - RNA, 19 nt, Vaccinia virus
uaggauuuuggacuuauau

SEQ ID NO: 3278939 - RNA, 20 nt, Vaccinia virus
agauuggguuaauaaauaca

SEQ ID NO: 3278940 - RNA, 17 nt, Vaccinia virus
gccgucuuuaucucuua

SEQ ID NO: 3278941 - RNA, 21 nt, Vaccinia virus
cguagagaaauaucuauaauu

SEQ ID NO: 3278942 - RNA, 22 nt, Vaccinia virus
ucuauagcgcuuuaguuccuua

SEQ ID NO: 3278943 - RNA, 15 nt, Vaccinia virus
aacauguuuagaaag

SEQ ID NO: 3278944 - RNA, 17 nt, Vaccinia virus
aucaucuguuuuaaaaa

SEQ ID NO: 3278945 - RNA, 17 nt, Vaccinia virus
uauaagacgauacuguu

SEQ ID NO: 3278946 - RNA, 19 nt, Vaccinia virus
gaaauggagagagacuguu

SEQ ID NO: 3278947 - RNA, 17 nt, Vaccinia virus
ucauccagaucauuaag

SEQ ID NO: 3278948 - RNA, 21 nt, Vaccinia virus
gccaagauaucuauauaauua

SEQ ID NO: 3278949 - RNA, 20 nt, Vaccinia virus
auaaucauuacuaacuuuau

SEQ ID NO: 3278950 - RNA, 16 nt, Vaccinia virus
acuccaauuaucuuua

SEQ ID NO: 3278951 - RNA, 20 nt, Vaccinia virus
aucauauucaucaucaauau

SEQ ID NO: 3278952 - RNA, 14 nt, Vaccinia virus
uuucagucauugau

SEQ ID NO: 3278953 - RNA, 16 nt, Vaccinia virus
gaaaguaaauaauaua

SEQ ID NO: 3278954 - RNA, 20 nt, Vaccinia virus
auuaaaaaauucgacaauga

SEQ ID NO: 3278955 - RNA, 15 nt, Vaccinia virus
uacuuucgguuucau

SEQ ID NO: 3278956 - RNA, 19 nt, Vaccinia virus
auaugaacagacauuguau

SEQ ID NO: 3278957 - RNA, 16 nt, Vaccinia virus
acgauuacuacauuau

SEQ ID NO: 3278958 - RNA, 20 nt, Vaccinia virus
ucacuauaagaaaucagaau

SEQ ID NO: 3278959 - RNA, 13 nt, Vaccinia virus
uuagauauucacg

SEQ ID NO: 3278960 - RNA, 22 nt, Vaccinia virus
aaccaguaucucuuaacgaugu

SEQ ID NO: 3278961 - RNA, 23 nt, Vaccinia virus
agcuaauauaaaaauauauuaau

SEQ ID NO: 3278962 - RNA, 20 nt, Vaccinia virus
cuaccacacuucuagauauc

SEQ ID NO: 3278963 - RNA, 20 nt, Vaccinia virus
cauaguuuguaucaauaaua

SEQ ID NO: 3278964 - RNA, 14 nt, Vaccinia virus
aacuguauaaaaug

SEQ ID NO: 3278965 - RNA, 13 nt, Vaccinia virus
aacuaauaaacau

SEQ ID NO: 3278966 - RNA, 13 nt, Vaccinia virus
agauauuaucuau

SEQ ID NO: 3278967 - RNA, 13 nt, Vaccinia virus
auguuucaaucau

SEQ ID NO: 3278968 - RNA, 10 nt, Vaccinia virus
uauuaucauc

SEQ ID NO: 3278969 - RNA, 15 nt, Vaccinia virus
ucaugaagagauguu

SEQ ID NO: 3278970 - RNA, 19 nt, Vaccinia virus
ggaaucgauuuuguaauau

SEQ ID NO: 3278971 - RNA, 20 nt, Vaccinia virus
acauuuauuaucaugaugac

SEQ ID NO: 3278972 - RNA, 20 nt, Vaccinia virus
aguuuggcaauuaaaaauua

SEQ ID NO: 3278973 - RNA, 18 nt, Vaccinia virus
cauccguuguuauauacc

SEQ ID NO: 3278974 - RNA, 15 nt, Vaccinia virus
uucuacuacuucauu

SEQ ID NO: 3278975 - RNA, 16 nt, Vaccinia virus
ugaugaguuagauauu

SEQ ID NO: 3278976 - RNA, 16 nt, Vaccinia virus
cucuaaguuaacacau

SEQ ID NO: 3278977 - RNA, 23 nt, Vaccinia virus
uuaaaucccaauucagaaaucaa

SEQ ID NO: 3278978 - RNA, 19 nt, Vaccinia virus
aguuucaucgauaaaggau

SEQ ID NO: 3278979 - RNA, 16 nt, Vaccinia virus
ucaacgucuaauguau

SEQ ID NO: 3278980 - RNA, 16 nt, Vaccinia virus
guauuucauuacccaa

SEQ ID NO: 3278981 - RNA, 13 nt, Vaccinia virus
aguuuauuagaca

SEQ ID NO: 3278982 - RNA, 22 nt, Vaccinia virus
cuuauuggucagaaauauugua

SEQ ID NO: 3278983 - RNA, 17 nt, Vaccinia virus
caaggaacuaaauagau

SEQ ID NO: 3278984 - RNA, 17 nt, Vaccinia virus
uagucauagaugaaaua

SEQ ID NO: 3278985 - RNA, 21 nt, Vaccinia virus
uagcauuguuauguauuucau

SEQ ID NO: 3278986 - RNA, 18 nt, Vaccinia virus
gaucaugcuguaaucaua

SEQ ID NO: 3278987 - RNA, 16 nt, Vaccinia virus
cugaaacaucacuaau

SEQ ID NO: 3278988 - RNA, 15 nt, Vaccinia virus
uaaaucuccuucaug

SEQ ID NO: 3278989 - RNA, 23 nt, Vaccinia virus
uaauccugaauauauugauuuuc

SEQ ID NO: 3278990 - RNA, 14 nt, Vaccinia virus
uuaacagauaaaaa

SEQ ID NO: 3278991 - RNA, 15 nt, Vaccinia virus
aacuuauccauuuau

SEQ ID NO: 3278992 - RNA, 11 nt, Vaccinia virus
auaaaaacaag

SEQ ID NO: 3278993 - RNA, 14 nt, Vaccinia virus
uaaaucauggauuu

SEQ ID NO: 3278994 - RNA, 16 nt, Vaccinia virus
aacgauuaaacaauau

SEQ ID NO: 3278995 - RNA, 16 nt, Vaccinia virus
ccacugucuaaaugua

SEQ ID NO: 3278996 - RNA, 22 nt, Vaccinia virus
gucuuauaugaagucuauacag

SEQ ID NO: 3278997 - RNA, 17 nt, Vaccinia virus
ugauaucuuuagauaua

SEQ ID NO: 3278998 - RNA, 16 nt, Vaccinia virus
cuccaaguucuauagu

SEQ ID NO: 3278999 - RNA, 21 nt, Vaccinia virus
cuagauaaaauacugaaucaa

SEQ ID NO: 3279000 - RNA, 16 nt, Vaccinia virus
aucuucauuaucugau

SEQ ID NO: 3279001 - RNA, 17 nt, Vaccinia virus
auuggucaaugugaaug

SEQ ID NO: 3279002 - RNA, 19 nt, Vaccinia virus
aauuguuuacuguauauac

SEQ ID NO: 3279003 - RNA, 22 nt, Vaccinia virus
agaagaaauacuaaaaaaugua

SEQ ID NO: 3279004 - RNA, 16 nt, Vaccinia virus
uaccgaacaggcauuu

SEQ ID NO: 3279005 - RNA, 17 nt, Vaccinia virus
gcaagaauuuauuucua

SEQ ID NO: 3279006 - RNA, 22 nt, Vaccinia virus
accuaucaaggaacaaauauug

SEQ ID NO: 3279007 - RNA, 20 nt, Vaccinia virus
auaucauuaaguucacuaga

SEQ ID NO: 3279008 - RNA, 19 nt, Vaccinia virus
uuuuuaaaaucauuauaua

SEQ ID NO: 3279009 - RNA, 21 nt, Vaccinia virus
aauguaugaacaucauggaau

SEQ ID NO: 3279010 - RNA, 15 nt, Vaccinia virus
gaaaauuagaaggau

SEQ ID NO: 3279011 - RNA, 15 nt, Vaccinia virus
auucgaauucaaaug

SEQ ID NO: 3279012 - RNA, 19 nt, Vaccinia virus
aacacgauuuaaaaucaaa

SEQ ID NO: 3279013 - RNA, 22 nt, Vaccinia virus
uuaaagcccauugaugcaaaua

SEQ ID NO: 3279014 - RNA, 19 nt, Vaccinia virus
gcaaucauuccucauaaga

SEQ ID NO: 3279015 - RNA, 19 nt, Vaccinia virus
cuucagacaacaucucaga

SEQ ID NO: 3279016 - RNA, 15 nt, Vaccinia virus
aaaaacgaggauauu

SEQ ID NO: 3279017 - RNA, 22 nt, Vaccinia virus
ggauacguccguccaagaauac

SEQ ID NO: 3279018 - RNA, 23 nt, Vaccinia virus
auaaagaugacgaugaaaaugau

SEQ ID NO: 3279019 - RNA, 15 nt, Vaccinia virus
caugucuacauuaua

SEQ ID NO: 3279020 - RNA, 15 nt, Vaccinia virus
auuucacaaauggau

SEQ ID NO: 3279021 - RNA, 21 nt, Vaccinia virus
acauuaauuccuuuuuaaauu

SEQ ID NO: 3279022 - RNA, 13 nt, Vaccinia virus
ucaacuacauaau

SEQ ID NO: 3279023 - RNA, 14 nt, Vaccinia virus
cuauagaaacaccu

SEQ ID NO: 3279024 - RNA, 12 nt, Vaccinia virus
agcauauguuua

SEQ ID NO: 3279025 - RNA, 16 nt, Vaccinia virus
aauguacauucgaaaa

SEQ ID NO: 3279026 - RNA, 20 nt, Vaccinia virus
uaaauguuuucucuguaaua

SEQ ID NO: 3279027 - RNA, 20 nt, Vaccinia virus
gaaaccacugucuaaaugua

SEQ ID NO: 3279028 - RNA, 21 nt, Vaccinia virus
ucaucauccucuggugguucg

SEQ ID NO: 3279029 - RNA, 20 nt, Vaccinia virus
ugauagugaaugaaucagau

SEQ ID NO: 3279030 - RNA, 13 nt, Vaccinia virus
uguucuacauauu

SEQ ID NO: 3279031 - RNA, 20 nt, Vaccinia virus
uauacauuacugaauuauua

SEQ ID NO: 3279032 - RNA, 13 nt, Vaccinia virus
acggcuauucugg

SEQ ID NO: 3279033 - RNA, 13 nt, Vaccinia virus
auguuuaucacac

SEQ ID NO: 3279034 - RNA, 15 nt, Vaccinia virus
ucaucuucuauauaa

SEQ ID NO: 3279035 - RNA, 19 nt, Vaccinia virus
agguguguuuuuuaccauu

SEQ ID NO: 3279036 - RNA, 16 nt, Vaccinia virus
auaaaaauuauguuuu

SEQ ID NO: 3279037 - RNA, 14 nt, Vaccinia virus
augauauaauuaau

SEQ ID NO: 3279038 - RNA, 13 nt, Vaccinia virus
ucauuaaacaucu

SEQ ID NO: 3279039 - RNA, 21 nt, Vaccinia virus
aauacauuucucaaaugaaua

SEQ ID NO: 3279040 - RNA, 12 nt, Vaccinia virus
agauuuagaaau

SEQ ID NO: 3279041 - RNA, 20 nt, Vaccinia virus
gagagcaugaaggagauuua

SEQ ID NO: 3279042 - RNA, 20 nt, Vaccinia virus
uggaggaauuuauagaugcu

SEQ ID NO: 3279043 - RNA, 15 nt, Vaccinia virus
acaccuauaagauua

SEQ ID NO: 3279044 - RNA, 17 nt, Vaccinia virus
aauauuuuaauagauua

SEQ ID NO: 3279045 - RNA, 13 nt, Vaccinia virus
auaucuagaauga

SEQ ID NO: 3279046 - RNA, 20 nt, Vaccinia virus
uuaucucaacaaaauucaga

SEQ ID NO: 3279047 - RNA, 21 nt, Vaccinia virus
auuacggcgaaauaaagaaaa

SEQ ID NO: 3279048 - RNA, 22 nt, Vaccinia virus
cccgagagaugcgauacaaaag

SEQ ID NO: 3279049 - RNA, 16 nt, Vaccinia virus
aauauuaaauaucugu

SEQ ID NO: 3279050 - RNA, 17 nt, Vaccinia virus
gaauaucugcaauauau

SEQ ID NO: 3279051 - RNA, 14 nt, Vaccinia virus
auagcuacaguaaa

SEQ ID NO: 3279052 - RNA, 12 nt, Vaccinia virus
aaaucuugugaa

SEQ ID NO: 3279053 - RNA, 20 nt, Vaccinia virus
agugcaggcuuaaagcaauu

SEQ ID NO: 3279054 - RNA, 22 nt, Vaccinia virus
gaacaucuugauuauaauauaa

SEQ ID NO: 3279055 - RNA, 19 nt, Vaccinia virus
aaacucuauuuuaaaauua

SEQ ID NO: 3279056 - RNA, 15 nt, Vaccinia virus
cuaccuuuucaauuu

SEQ ID NO: 3279057 - RNA, 19 nt, Vaccinia virus
uauuguuuagacuguuugu

SEQ ID NO: 3279058 - RNA, 15 nt, Vaccinia virus
agauugguacgaaau

SEQ ID NO: 3279059 - RNA, 22 nt, Vaccinia virus
gcuuccagauacagugauuuug

SEQ ID NO: 3279060 - RNA, 22 nt, Vaccinia virus
ucuacuaagcccaaaaccaaac

SEQ ID NO: 3279061 - RNA, 21 nt, Vaccinia virus
caucuauguagaauccaucag

SEQ ID NO: 3279062 - RNA, 15 nt, Vaccinia virus
augaaaaaaauacuu

SEQ ID NO: 3279063 - RNA, 14 nt, Vaccinia virus
uaucaguagaugca

SEQ ID NO: 3279064 - RNA, 17 nt, Vaccinia virus
aucuuagcgaacugaag

SEQ ID NO: 3279065 - RNA, 17 nt, Vaccinia virus
aucucagugcaaagauu

SEQ ID NO: 3279066 - RNA, 14 nt, Vaccinia virus
uugcaucuacauca

SEQ ID NO: 3279067 - RNA, 12 nt, Vaccinia virus
uucuuuauucuc

SEQ ID NO: 3279068 - RNA, 22 nt, Vaccinia virus
auaucuaguguuuuugugguau

SEQ ID NO: 3279069 - RNA, 20 nt, Vaccinia virus
auaaauauccuuggaauuga

SEQ ID NO: 3279070 - RNA, 21 nt, Vaccinia virus
accacaauaaaaaaaauugau

SEQ ID NO: 3279071 - RNA, 21 nt, Vaccinia virus
uaaaucauuccaucgauacau

SEQ ID NO: 3279072 - RNA, 13 nt, Vaccinia virus
uauugaguggaaa

SEQ ID NO: 3279073 - RNA, 14 nt, Vaccinia virus
augaauaaguacua

SEQ ID NO: 3279074 - RNA, 21 nt, Vaccinia virus
uuauacuucuccaacaucgau

SEQ ID NO: 3279075 - RNA, 22 nt, Vaccinia virus
uucuagaaguugauacaacaua

SEQ ID NO: 3279076 - RNA, 14 nt, Vaccinia virus
uaguaugguuucau

SEQ ID NO: 3279077 - RNA, 23 nt, Vaccinia virus
auaguaguacacagcauguuaua

SEQ ID NO: 3279078 - RNA, 13 nt, Vaccinia virus
cucaauaccccaa

SEQ ID NO: 3279079 - RNA, 20 nt, Vaccinia virus
ucaacgaucgucgauacaaa

SEQ ID NO: 3279080 - RNA, 21 nt, Vaccinia virus
cgauacauccuucuauguuga

SEQ ID NO: 3279081 - RNA, 18 nt, Vaccinia virus
cagugacggauauacaaa

SEQ ID NO: 3279082 - RNA, 15 nt, Vaccinia virus
augguucaaagacua

SEQ ID NO: 3279083 - RNA, 13 nt, Vaccinia virus
acauuguuucaua

SEQ ID NO: 3279084 - RNA, 16 nt, Vaccinia virus
caaaaauuacgauauu

SEQ ID NO: 3279085 - RNA, 22 nt, Vaccinia virus
acauaugcaucuauauaaucuu

SEQ ID NO: 3279086 - RNA, 14 nt, Vaccinia virus
aacuacaauauuuc

SEQ ID NO: 3279087 - RNA, 21 nt, Vaccinia virus
auauacaacucuuuaauacga

SEQ ID NO: 3279088 - RNA, 15 nt, Vaccinia virus
aauaaauaacaaugg

SEQ ID NO: 3279089 - RNA, 12 nt, Vaccinia virus
auuacuuaaaaa

SEQ ID NO: 3279090 - RNA, 15 nt, Vaccinia virus
uuagucuauuaucca

SEQ ID NO: 3279091 - RNA, 23 nt, Vaccinia virus
uuaucucuuuccuagauacugua

SEQ ID NO: 3279092 - RNA, 14 nt, Vaccinia virus
aauuauagacuuga

SEQ ID NO: 3279093 - RNA, 19 nt, Vaccinia virus
agucacugccguucuaaug

SEQ ID NO: 3279094 - RNA, 18 nt, Vaccinia virus
caucaguaucuucagaca

SEQ ID NO: 3279095 - RNA, 21 nt, Vaccinia virus
uucaaucucuaguuuuauuuu

SEQ ID NO: 3279096 - RNA, 17 nt, Vaccinia virus
guuguuaaaaaauuaag

SEQ ID NO: 3279097 - RNA, 16 nt, Vaccinia virus
uauaucauuuguacau

SEQ ID NO: 3279098 - RNA, 16 nt, Vaccinia virus
uucacauugaaacuau

SEQ ID NO: 3279099 - RNA, 22 nt, Vaccinia virus
caaugauugaagcauucuuucc

SEQ ID NO: 3279100 - RNA, 21 nt, Vaccinia virus
cacauauccacguucuacaaa

SEQ ID NO: 3279101 - RNA, 14 nt, Vaccinia virus
acgacuaaacauuu

SEQ ID NO: 3279102 - RNA, 19 nt, Vaccinia virus
aagacuuuguguugugcau

SEQ ID NO: 3279103 - RNA, 12 nt, Vaccinia virus
auuauuaaauau

SEQ ID NO: 3279104 - RNA, 21 nt, Vaccinia virus
uggucuagauguaaaaaaugu

SEQ ID NO: 3279105 - RNA, 15 nt, Vaccinia virus
caucuacauaaucua

SEQ ID NO: 3279106 - RNA, 17 nt, Vaccinia virus
cuuuccugggaaacucu

SEQ ID NO: 3279107 - RNA, 16 nt, Vaccinia virus
ucaauauugaaaauac

SEQ ID NO: 3279108 - RNA, 14 nt, Vaccinia virus
caaauaaaaaguau

SEQ ID NO: 3279109 - RNA, 19 nt, Vaccinia virus
acuaacgaaauuaauauga

SEQ ID NO: 3279110 - RNA, 19 nt, Vaccinia virus
agaugaggauagcaaaaua

SEQ ID NO: 3279111 - RNA, 18 nt, Vaccinia virus
gacuuuaaacagaaauau

SEQ ID NO: 3279112 - RNA, 18 nt, Vaccinia virus
cuauaauauccauuuugu

SEQ ID NO: 3279113 - RNA, 17 nt, Vaccinia virus
uuaaaauacuaaauuga

SEQ ID NO: 3279114 - RNA, 17 nt, Vaccinia virus
cuaauaaauuagauauu

SEQ ID NO: 3279115 - RNA, 20 nt, Vaccinia virus
gaauauacuucauaaaagaa

SEQ ID NO: 3279116 - RNA, 15 nt, Vaccinia virus
uaacgaugauauguu

SEQ ID NO: 3279117 - RNA, 18 nt, Vaccinia virus
uuaguuuuuuucucucaa

SEQ ID NO: 3279118 - RNA, 13 nt, Vaccinia virus
ccaugcagcauuu

SEQ ID NO: 3279119 - RNA, 21 nt, Vaccinia virus
aucacaacaucuauaaaagua

SEQ ID NO: 3279120 - RNA, 19 nt, Vaccinia virus
uaacacaaccaaauacuug

SEQ ID NO: 3279121 - RNA, 20 nt, Vaccinia virus
cugauaucauuaaugauaua

SEQ ID NO: 3279122 - RNA, 16 nt, Vaccinia virus
cugaguauuuggauuu

SEQ ID NO: 3279123 - RNA, 19 nt, Vaccinia virus
acguucuacuauagaauua

SEQ ID NO: 3279124 - RNA, 15 nt, Vaccinia virus
aacgaaguaaaaagu

SEQ ID NO: 3279125 - RNA, 22 nt, Vaccinia virus
gauuaaacuuuaaugauugcau

SEQ ID NO: 3279126 - RNA, 18 nt, Vaccinia virus
cuugguuuuaaucuauug

SEQ ID NO: 3279127 - RNA, 23 nt, Vaccinia virus
ggaagcaacuaaacuaugugaug

SEQ ID NO: 3279128 - RNA, 12 nt, Vaccinia virus
auaaaacuauau

SEQ ID NO: 3279129 - RNA, 15 nt, Vaccinia virus
uaacaauuucuauaa

SEQ ID NO: 3279130 - RNA, 21 nt, Vaccinia virus
uuauauacacauaauuauucu

SEQ ID NO: 3279131 - RNA, 17 nt, Vaccinia virus
agaagauuuaacuagau

SEQ ID NO: 3279132 - RNA, 23 nt, Vaccinia virus
aauugugucagaaacuuagaaga

SEQ ID NO: 3279133 - RNA, 18 nt, Vaccinia virus
uucaaugugcucuuuaca

SEQ ID NO: 3279134 - RNA, 11 nt, Vaccinia virus
uuuauauacau

SEQ ID NO: 3279135 - RNA, 17 nt, Vaccinia virus
uggaggauuauaugaua

SEQ ID NO: 3279136 - RNA, 20 nt, Vaccinia virus
aaccccauauaauguagaca

SEQ ID NO: 3279137 - RNA, 23 nt, Vaccinia virus
guucuagucgguauuucaucauu

SEQ ID NO: 3279138 - RNA, 13 nt, Vaccinia virus
gcgaaauaaagaa

SEQ ID NO: 3279139 - RNA, 22 nt, Vaccinia virus
auuauaacaucguaucuucaaa

SEQ ID NO: 3279140 - RNA, 17 nt, Vaccinia virus
auuagucauguuaaaaa

SEQ ID NO: 3279141 - RNA, 19 nt, Vaccinia virus
uccauuuauacauugaaua

SEQ ID NO: 3279142 - RNA, 13 nt, Vaccinia virus
auaugccuauaaa

SEQ ID NO: 3279143 - RNA, 14 nt, Vaccinia virus
auuacuuuaauagu

SEQ ID NO: 3279144 - RNA, 22 nt, Vaccinia virus
auuaggaucuacguucauaugu

SEQ ID NO: 3279145 - RNA, 14 nt, Vaccinia virus
agccaacaaauaua

SEQ ID NO: 3279146 - RNA, 22 nt, Vaccinia virus
uuucaucuuucuccaauacuaa

SEQ ID NO: 3279147 - RNA, 13 nt, Vaccinia virus
aauaacaggcuaa

SEQ ID NO: 3279148 - RNA, 20 nt, Vaccinia virus
ucgaaaauugcuauuucaga

SEQ ID NO: 3279149 - RNA, 16 nt, Vaccinia virus
uacuuuuguuacuaau

SEQ ID NO: 3279150 - RNA, 13 nt, Vaccinia virus
uguuaauuuugaa

SEQ ID NO: 3279151 - RNA, 22 nt, Vaccinia virus
caucuucuuugauuaaugauuu

SEQ ID NO: 3279152 - RNA, 17 nt, Vaccinia virus
ugguacgaaauauauug

SEQ ID NO: 3279153 - RNA, 13 nt, Vaccinia virus
auauguagcaaac

SEQ ID NO: 3279154 - RNA, 20 nt, Vaccinia virus
ucacugauuaauuauuugcc

SEQ ID NO: 3279155 - RNA, 16 nt, Vaccinia virus
aaucguuaagaaguuu

SEQ ID NO: 3279156 - RNA, 15 nt, Vaccinia virus
uguaauauucaucau

SEQ ID NO: 3279157 - RNA, 15 nt, Vaccinia virus
uuguaagguuguaaa

SEQ ID NO: 3279158 - RNA, 16 nt, Vaccinia virus
auuuauauaaaucauu

SEQ ID NO: 3279159 - RNA, 14 nt, Vaccinia virus
ccaaguagauaucc

SEQ ID NO: 3279160 - RNA, 18 nt, Vaccinia virus
caacaggucauauucuca

SEQ ID NO: 3279161 - RNA, 22 nt, Vaccinia virus
cuauagaguagacauuaauaga

SEQ ID NO: 3279162 - RNA, 20 nt, Vaccinia virus
aauuuucacaaguaugaaga

SEQ ID NO: 3279163 - RNA, 16 nt, Vaccinia virus
uccacaaauaguaaau

SEQ ID NO: 3279164 - RNA, 16 nt, Vaccinia virus
auaauuuuuauguuuu

SEQ ID NO: 3279165 - RNA, 19 nt, Vaccinia virus
ucagaguucagugaagaag

SEQ ID NO: 3279166 - RNA, 20 nt, Vaccinia virus
aaaaagcucuauauuacaaa

SEQ ID NO: 3279167 - RNA, 21 nt, Vaccinia virus
uaggaccacuagcaaaagaua

SEQ ID NO: 3279168 - RNA, 22 nt, Vaccinia virus
aaguuauccaaguuaaaggaua

SEQ ID NO: 3279169 - RNA, 15 nt, Vaccinia virus
caacucuaaucacuu

SEQ ID NO: 3279170 - RNA, 19 nt, Vaccinia virus
gaaaaugaugguacauaua

SEQ ID NO: 3279171 - RNA, 18 nt, Vaccinia virus
ugacgaacguauugcuau

SEQ ID NO: 3279172 - RNA, 19 nt, Vaccinia virus
uuuucuuucuaauacuaua

SEQ ID NO: 3279173 - RNA, 16 nt, Vaccinia virus
uauuucccuauaaaaa

SEQ ID NO: 3279174 - RNA, 13 nt, Vaccinia virus
aauacaugggaaa

SEQ ID NO: 3279175 - RNA, 20 nt, Vaccinia virus
ugccguguuuaaagauuucu

SEQ ID NO: 3279176 - RNA, 14 nt, Vaccinia virus
agugcaaugaauau

SEQ ID NO: 3279177 - RNA, 15 nt, Vaccinia virus
uaauaauuuaacaau

SEQ ID NO: 3279178 - RNA, 19 nt, Vaccinia virus
uaaucggagaauguuuccc

SEQ ID NO: 3279179 - RNA, 16 nt, Vaccinia virus
uucauaaaaaccaucg

SEQ ID NO: 3279180 - RNA, 17 nt, Vaccinia virus
aauaaauauccuuggaa

SEQ ID NO: 3279181 - RNA, 18 nt, Vaccinia virus
caaucaaaccuauaacau

SEQ ID NO: 3279182 - RNA, 14 nt, Vaccinia virus
cuaauuucuguaua

SEQ ID NO: 3279183 - RNA, 12 nt, Vaccinia virus
gaugauauuaac

SEQ ID NO: 3279184 - RNA, 13 nt, Vaccinia virus
ucaucuucauagg

SEQ ID NO: 3279185 - RNA, 18 nt, Vaccinia virus
agucugucaaaucaucuu

SEQ ID NO: 3279186 - RNA, 19 nt, Vaccinia virus
ucaucaaaagacuuaugau

SEQ ID NO: 3279187 - RNA, 23 nt, Vaccinia virus
uacuaagaggaugaucuguauua

SEQ ID NO: 3279188 - RNA, 14 nt, Vaccinia virus
auugguaaauccuu

SEQ ID NO: 3279189 - RNA, 17 nt, Vaccinia virus
uccaaaaagaaugagua

SEQ ID NO: 3279190 - RNA, 13 nt, Vaccinia virus
augaaaaaguaaa

SEQ ID NO: 3279191 - RNA, 22 nt, Vaccinia virus
gaaaucuauaauaucuuugaaa

SEQ ID NO: 3279192 - RNA, 16 nt, Vaccinia virus
gaacgauaaacaaauu

SEQ ID NO: 3279193 - RNA, 22 nt, Vaccinia virus
acaagugaaauguugucauuau

SEQ ID NO: 3279194 - RNA, 20 nt, Vaccinia virus
aauacuaaaaaauguagaaa

SEQ ID NO: 3279195 - RNA, 19 nt, Vaccinia virus
acagauagaucauuuugaa

SEQ ID NO: 3279196 - RNA, 16 nt, Vaccinia virus
aaacaacuaaacagua

SEQ ID NO: 3279197 - RNA, 18 nt, Vaccinia virus
ucaaauuaagcauuuugg

SEQ ID NO: 3279198 - RNA, 19 nt, Vaccinia virus
uauguugugauucuagaau

SEQ ID NO: 3279199 - RNA, 19 nt, Vaccinia virus
acaguaguaauuaaugaaa

SEQ ID NO: 3279200 - RNA, 17 nt, Vaccinia virus
uauauuagacaauacua

SEQ ID NO: 3279201 - RNA, 17 nt, Vaccinia virus
aauaaaagacaaaucuu

SEQ ID NO: 3279202 - RNA, 17 nt, Vaccinia virus
uauaugauauuccugga

SEQ ID NO: 3279203 - RNA, 17 nt, Vaccinia virus
aaauuguaacaacaaug

SEQ ID NO: 3279204 - RNA, 19 nt, Vaccinia virus
acccuggauaaaaaguaaa

SEQ ID NO: 3279205 - RNA, 14 nt, Vaccinia virus
aaauguuugaucaa

SEQ ID NO: 3279206 - RNA, 21 nt, Vaccinia virus
uaauacguuggucuaucuauu

SEQ ID NO: 3279207 - RNA, 22 nt, Vaccinia virus
gacacuaugcgacuuaauacaa

SEQ ID NO: 3279208 - RNA, 15 nt, Vaccinia virus
auaggagauauauau

SEQ ID NO: 3279209 - RNA, 22 nt, Vaccinia virus
aaugugauucucugaaaaugua

SEQ ID NO: 3279210 - RNA, 16 nt, Vaccinia virus
acuaauacaucugaaa

SEQ ID NO: 3279211 - RNA, 12 nt, Vaccinia virus
auaaacauagaa

SEQ ID NO: 3279212 - RNA, 17 nt, Vaccinia virus
aucuaucuuaucgaaug

SEQ ID NO: 3279213 - RNA, 14 nt, Vaccinia virus
aaaaagaauguaua

SEQ ID NO: 3279214 - RNA, 15 nt, Vaccinia virus
gucuggauuaaucug

SEQ ID NO: 3279215 - RNA, 15 nt, Vaccinia virus
cugcagcauuuugag

SEQ ID NO: 3279216 - RNA, 23 nt, Vaccinia virus
agaaaaucuuucuucuacuauau

SEQ ID NO: 3279217 - RNA, 21 nt, Vaccinia virus
cuucuuuuucugucucaauag

SEQ ID NO: 3279218 - RNA, 22 nt, Vaccinia virus
uucuauaccuuucgaaauuagu

SEQ ID NO: 3279219 - RNA, 18 nt, Vaccinia virus
uaaauguuguaauuguau

SEQ ID NO: 3279220 - RNA, 18 nt, Vaccinia virus
auuuuuguacauuaauaa

SEQ ID NO: 3279221 - RNA, 14 nt, Vaccinia virus
agcuaugaacuugu

SEQ ID NO: 3279222 - RNA, 23 nt, Vaccinia virus
uaaaugauucuaacgacaucucu

SEQ ID NO: 3279223 - RNA, 19 nt, Vaccinia virus
auaugccagaacuauuuuu

SEQ ID NO: 3279224 - RNA, 18 nt, Vaccinia virus
ucaucaaacaacugaaaa

SEQ ID NO: 3279225 - RNA, 19 nt, Vaccinia virus
acuuccaauaaaauuacuu

SEQ ID NO: 3279226 - RNA, 20 nt, Vaccinia virus
uagccaaaagacuaugggaa

SEQ ID NO: 3279227 - RNA, 22 nt, Vaccinia virus
augaagauagaucacaaaucac

SEQ ID NO: 3279228 - RNA, 17 nt, Vaccinia virus
guguauaaaauauacug

SEQ ID NO: 3279229 - RNA, 20 nt, Vaccinia virus
aauaaucucgucgauguaaa

SEQ ID NO: 3279230 - RNA, 19 nt, Vaccinia virus
gagaacuaacacaaccagc

SEQ ID NO: 3279231 - RNA, 14 nt, Vaccinia virus
cacaugauccauuu

SEQ ID NO: 3279232 - RNA, 14 nt, Vaccinia virus
aaaccaaaucuuga

SEQ ID NO: 3279233 - RNA, 13 nt, Vaccinia virus
uuaucaucauuau

SEQ ID NO: 3279234 - RNA, 20 nt, Vaccinia virus
aaauauauaguauuaaugau

SEQ ID NO: 3279235 - RNA, 13 nt, Vaccinia virus
aucuauucccuug

SEQ ID NO: 3279236 - RNA, 17 nt, Vaccinia virus
aaaacugguuaaaacag

SEQ ID NO: 3279237 - RNA, 20 nt, Vaccinia virus
uacaacagugauauguguaa

SEQ ID NO: 3279238 - RNA, 22 nt, Vaccinia virus
auacuuuaacaucacuaauauc

SEQ ID NO: 3279239 - RNA, 20 nt, Vaccinia virus
aggauuaucaaaucuuuaau

SEQ ID NO: 3279240 - RNA, 14 nt, Vaccinia virus
cagucuuuaaugaa

SEQ ID NO: 3279241 - RNA, 16 nt, Vaccinia virus
uacgaggauucaaaaa

SEQ ID NO: 3279242 - RNA, 11 nt, Vaccinia virus
gcguuaaacau

SEQ ID NO: 3279243 - RNA, 16 nt, Vaccinia virus
agucauguuaaaaaug

SEQ ID NO: 3279244 - RNA, 22 nt, Vaccinia virus
aagcuacuuguuuaacaaaguu

SEQ ID NO: 3279245 - RNA, 15 nt, Vaccinia virus
gaaucccuacauauu

SEQ ID NO: 3279246 - RNA, 15 nt, Vaccinia virus
agcuauauagaugac

SEQ ID NO: 3279247 - RNA, 18 nt, Vaccinia virus
aacagaaacuagaggaga

SEQ ID NO: 3279248 - RNA, 21 nt, Vaccinia virus
uaaacaucuuugcaucauacu

SEQ ID NO: 3279249 - RNA, 13 nt, Vaccinia virus
gaaugacauaacu

SEQ ID NO: 3279250 - RNA, 16 nt, Vaccinia virus
aaugaugucaggaaau

SEQ ID NO: 3279251 - RNA, 16 nt, Vaccinia virus
acuacaacuagugaag

SEQ ID NO: 3279252 - RNA, 14 nt, Vaccinia virus
ucuaauacauaauu

SEQ ID NO: 3279253 - RNA, 18 nt, Vaccinia virus
ucauaauuguuagcuguu

SEQ ID NO: 3279254 - RNA, 16 nt, Vaccinia virus
uuucugguuagauaac

SEQ ID NO: 3279255 - RNA, 17 nt, Vaccinia virus
aacuugaggucaaggau

SEQ ID NO: 3279256 - RNA, 20 nt, Vaccinia virus
uaagaaauuuagcaacgaua

SEQ ID NO: 3279257 - RNA, 16 nt, Vaccinia virus
auuauuacguauccuc

SEQ ID NO: 3279258 - RNA, 15 nt, Vaccinia virus
acgucauucuaaaag

SEQ ID NO: 3279259 - RNA, 18 nt, Vaccinia virus
uguauucacuuaacaguu

SEQ ID NO: 3279260 - RNA, 13 nt, Vaccinia virus
auucuaugauggu

SEQ ID NO: 3279261 - RNA, 16 nt, Vaccinia virus
agaaagugcaaaugag

SEQ ID NO: 3279262 - RNA, 18 nt, Vaccinia virus
acacauuuucaaauaaua

SEQ ID NO: 3279263 - RNA, 14 nt, Vaccinia virus
gacuagcauauuau

SEQ ID NO: 3279264 - RNA, 15 nt, Vaccinia virus
gugcaguauuagaau

SEQ ID NO: 3279265 - RNA, 19 nt, Vaccinia virus
acucuguuuuauuaaccga

SEQ ID NO: 3279266 - RNA, 15 nt, Vaccinia virus
aauauauacguugau

SEQ ID NO: 3279267 - RNA, 23 nt, Vaccinia virus
caaauucuuggauauaugauaua

SEQ ID NO: 3279268 - RNA, 16 nt, Vaccinia virus
auacauucuucuguua

SEQ ID NO: 3279269 - RNA, 16 nt, Vaccinia virus
ucauagaugaaauacu

SEQ ID NO: 3279270 - RNA, 13 nt, Vaccinia virus
auaaaauaauaca

SEQ ID NO: 3279271 - RNA, 17 nt, Vaccinia virus
uuacauuaguaaucuuu

SEQ ID NO: 3279272 - RNA, 12 nt, Vaccinia virus
aaucugaaaaua

SEQ ID NO: 3279273 - RNA, 17 nt, Vaccinia virus
gaugaaggaauaaucuc

SEQ ID NO: 3279274 - RNA, 19 nt, Vaccinia virus
augguuuacccuagaauac

SEQ ID NO: 3279275 - RNA, 17 nt, Vaccinia virus
aacaugucuucuauucu

SEQ ID NO: 3279276 - RNA, 18 nt, Vaccinia virus
gaaaacuagauacaaaau

SEQ ID NO: 3279277 - RNA, 15 nt, Vaccinia virus
acauauaguggauua

SEQ ID NO: 3279278 - RNA, 15 nt, Vaccinia virus
uuacaagcuguuuau

SEQ ID NO: 3279279 - RNA, 13 nt, Vaccinia virus
cauuuauacauau

SEQ ID NO: 3279280 - RNA, 13 nt, Vaccinia virus
ugauaauaugaaa

SEQ ID NO: 3279281 - RNA, 15 nt, Vaccinia virus
uagauauaaauucaa

SEQ ID NO: 3279282 - RNA, 21 nt, Vaccinia virus
cacguaaccauucuaaacaau

SEQ ID NO: 3279283 - RNA, 18 nt, Vaccinia virus
uagaucacccuaaucuua

SEQ ID NO: 3279284 - RNA, 19 nt, Vaccinia virus
gauaauagggagaaaugac

SEQ ID NO: 3279285 - RNA, 13 nt, Vaccinia virus
augucuaugaaua

SEQ ID NO: 3279286 - RNA, 18 nt, Vaccinia virus
auaauggaucuucuagua

SEQ ID NO: 3279287 - RNA, 23 nt, Vaccinia virus
ggaaagcuagacuugauuauucu

SEQ ID NO: 3279288 - RNA, 11 nt, Vaccinia virus
auaaaaaauua

SEQ ID NO: 3279289 - RNA, 16 nt, Vaccinia virus
ucaacuuauuaacauu

SEQ ID NO: 3279290 - RNA, 15 nt, Vaccinia virus
uuauaaaacauagau

SEQ ID NO: 3279291 - RNA, 23 nt, Vaccinia virus
cuaacauacgagacauguuagua

SEQ ID NO: 3279292 - RNA, 22 nt, Vaccinia virus
ugucaucuuguucagaaauaua

SEQ ID NO: 3279293 - RNA, 15 nt, Vaccinia virus
uuaacacucauaaau

SEQ ID NO: 3279294 - RNA, 19 nt, Vaccinia virus
uaaguauucacaaacggga

SEQ ID NO: 3279295 - RNA, 24 nt, Vaccinia virus
aaagagaacguauuuauuguuacu

SEQ ID NO: 3279296 - RNA, 12 nt, Vaccinia virus
gaaaauaaugac

SEQ ID NO: 3279297 - RNA, 20 nt, Vaccinia virus
cgagaaauaauaagaauaaa

SEQ ID NO: 3279298 - RNA, 13 nt, Vaccinia virus
acuagaagagaau

SEQ ID NO: 3279299 - RNA, 23 nt, Vaccinia virus
cuauuagaguauugcauuuugau

SEQ ID NO: 3279300 - RNA, 18 nt, Vaccinia virus
aucuacaaauuggagauc

SEQ ID NO: 3279301 - RNA, 21 nt, Vaccinia virus
ucuucaucuauaaaucaagau

SEQ ID NO: 3279302 - RNA, 13 nt, Vaccinia virus
gauaauuucuugu

SEQ ID NO: 3279303 - RNA, 13 nt, Vaccinia virus
caaauaugauaug

SEQ ID NO: 3279304 - RNA, 23 nt, Vaccinia virus
acaucuggccuguucauaaauaa

SEQ ID NO: 3279305 - RNA, 19 nt, Vaccinia virus
auuuaccguuacuaauaag

SEQ ID NO: 3279306 - RNA, 21 nt, Vaccinia virus
aauaagaucguccguaacaaa

SEQ ID NO: 3279307 - RNA, 17 nt, Vaccinia virus
aggauuauaaucucauu

SEQ ID NO: 3279308 - RNA, 17 nt, Vaccinia virus
aacugcauauuauacac

SEQ ID NO: 3279309 - RNA, 22 nt, Vaccinia virus
agcaugugaauauaauaauaca

SEQ ID NO: 3279310 - RNA, 15 nt, Vaccinia virus
cguguguuucaggau

SEQ ID NO: 3279311 - RNA, 21 nt, Vaccinia virus
uucuauccaaggacaaggaug

SEQ ID NO: 3279312 - RNA, 19 nt, Vaccinia virus
aaaaguacucaaucuguac

SEQ ID NO: 3279313 - RNA, 16 nt, Vaccinia virus
auauucuguuguguca

SEQ ID NO: 3279314 - RNA, 12 nt, Vaccinia virus
agauaaauaugg

SEQ ID NO: 3279315 - RNA, 13 nt, Vaccinia virus
augcauuaucauu

SEQ ID NO: 3279316 - RNA, 19 nt, Vaccinia virus
uuucacuacuaucuaugau

SEQ ID NO: 3279317 - RNA, 15 nt, Vaccinia virus
uaccauuucauugau

SEQ ID NO: 3279318 - RNA, 23 nt, Vaccinia virus
aaugaggcguuuaucauaucugu

SEQ ID NO: 3279319 - RNA, 19 nt, Vaccinia virus
aucuuuucacguuaaauga

SEQ ID NO: 3279320 - RNA, 18 nt, Vaccinia virus
gaaucccuacauauuuua

SEQ ID NO: 3279321 - RNA, 16 nt, Vaccinia virus
acuuggcgauucuaua

SEQ ID NO: 3279322 - RNA, 17 nt, Vaccinia virus
ucauaaauaaaaaugaa

SEQ ID NO: 3279323 - RNA, 22 nt, Vaccinia virus
auuaggcacagucaaacauuca

SEQ ID NO: 3279324 - RNA, 21 nt, Vaccinia virus
aauacuuuuguuacuaauauc

SEQ ID NO: 3279325 - RNA, 13 nt, Vaccinia virus
ccgacgaaaagau

SEQ ID NO: 3279326 - RNA, 19 nt, Vaccinia virus
uaaaacuuguaagaaguaa

SEQ ID NO: 3279327 - RNA, 17 nt, Vaccinia virus
gaaaacauuuuuaucau

SEQ ID NO: 3279328 - RNA, 13 nt, Vaccinia virus
acaaucucagaua

SEQ ID NO: 3279329 - RNA, 19 nt, Vaccinia virus
aagauuauuauggaaauca

SEQ ID NO: 3279330 - RNA, 21 nt, Vaccinia virus
guguauuguuuaguucauccu

SEQ ID NO: 3279331 - RNA, 19 nt, Vaccinia virus
cgaucaaagaauuaaugau

SEQ ID NO: 3279332 - RNA, 20 nt, Vaccinia virus
auuuggaauuuauuaauaca

SEQ ID NO: 3279333 - RNA, 16 nt, Vaccinia virus
caaaguuaguacagaa

SEQ ID NO: 3279334 - RNA, 22 nt, Vaccinia virus
uccagggaaauuaaagaagaag

SEQ ID NO: 3279335 - RNA, 23 nt, Vaccinia virus
acauuggcgccguuuaauuuccu

SEQ ID NO: 3279336 - RNA, 14 nt, Vaccinia virus
cuuacauaaaugaa

SEQ ID NO: 3279337 - RNA, 23 nt, Vaccinia virus
ugauuauucuauaaguauagaua

SEQ ID NO: 3279338 - RNA, 18 nt, Vaccinia virus
gaauugaugaguuguaca

SEQ ID NO: 3279339 - RNA, 15 nt, Vaccinia virus
auuaauucuguaaau

SEQ ID NO: 3279340 - RNA, 13 nt, Vaccinia virus
uauaauguuuccu

SEQ ID NO: 3279341 - RNA, 13 nt, Vaccinia virus
ucuaauauacuuu

SEQ ID NO: 3279342 - RNA, 17 nt, Vaccinia virus
cuuucaaacuuaaucuu

SEQ ID NO: 3279343 - RNA, 16 nt, Vaccinia virus
acgccgaucucugaau

SEQ ID NO: 3279344 - RNA, 16 nt, Vaccinia virus
uaaaucauggauuuua

SEQ ID NO: 3279345 - RNA, 18 nt, Vaccinia virus
aguuaucuaucuuaaaaa

SEQ ID NO: 3279346 - RNA, 17 nt, Vaccinia virus
gaacauuauaauaauca

SEQ ID NO: 3279347 - RNA, 17 nt, Vaccinia virus
acgauauaaauugauua

SEQ ID NO: 3279348 - RNA, 18 nt, Vaccinia virus
ugaggagaucuaaacaau

SEQ ID NO: 3279349 - RNA, 19 nt, Vaccinia virus
gucuucuaaaaauaaaagu

SEQ ID NO: 3279350 - RNA, 23 nt, Vaccinia virus
uauuaaaggaguaugucaugaau

SEQ ID NO: 3279351 - RNA, 12 nt, Vaccinia virus
aaacuaucugau

SEQ ID NO: 3279352 - RNA, 13 nt, Vaccinia virus
uagagaucuaauu

SEQ ID NO: 3279353 - RNA, 23 nt, Vaccinia virus
acaugcgguaaagauauuucuca

SEQ ID NO: 3279354 - RNA, 21 nt, Vaccinia virus
aucaagaguaacuauugacuu

SEQ ID NO: 3279355 - RNA, 20 nt, Vaccinia virus
auaaaucauauaaaaaauga

SEQ ID NO: 3279356 - RNA, 18 nt, Vaccinia virus
auagucgugaucaacauu

SEQ ID NO: 3279357 - RNA, 18 nt, Vaccinia virus
uuagucgugguaagaaag

SEQ ID NO: 3279358 - RNA, 21 nt, Vaccinia virus
augucugacaccuaaaaagaa

SEQ ID NO: 3279359 - RNA, 13 nt, Vaccinia virus
uuuacaguuucug

SEQ ID NO: 3279360 - RNA, 17 nt, Vaccinia virus
cauuauuuuuuuggaau

SEQ ID NO: 3279361 - RNA, 17 nt, Vaccinia virus
uauaucaaauacaucua

SEQ ID NO: 3279362 - RNA, 13 nt, Vaccinia virus
guuaaaaaaaaga

SEQ ID NO: 3279363 - RNA, 14 nt, Vaccinia virus
auaggcaucauuua

SEQ ID NO: 3279364 - RNA, 13 nt, Vaccinia virus
aagaugaugugaa

SEQ ID NO: 3279365 - RNA, 13 nt, Vaccinia virus
uuaagagauaucu

SEQ ID NO: 3279366 - RNA, 16 nt, Vaccinia virus
uaggaguuagaauaau

SEQ ID NO: 3279367 - RNA, 17 nt, Vaccinia virus
ccagcguguccccagga

SEQ ID NO: 3279368 - RNA, 19 nt, Vaccinia virus
uguauaacaugacauuuau

SEQ ID NO: 3279369 - RNA, 13 nt, Vaccinia virus
gcgcuauaguauu

SEQ ID NO: 3279370 - RNA, 19 nt, Vaccinia virus
aauaaugauucaacaaugu

SEQ ID NO: 3279371 - RNA, 15 nt, Vaccinia virus
cugaaaaagauauca

SEQ ID NO: 3279372 - RNA, 11 nt, Vaccinia virus
aacacaaauau

SEQ ID NO: 3279373 - RNA, 21 nt, Vaccinia virus
ccgguucuuaauauuguauug

SEQ ID NO: 3279374 - RNA, 22 nt, Vaccinia virus
auggauuuuuuuaaaaaggaaa

SEQ ID NO: 3279375 - RNA, 20 nt, Vaccinia virus
uaaaaaguucgaguuucuca

SEQ ID NO: 3279376 - RNA, 14 nt, Vaccinia virus
uagaaaucauauau

SEQ ID NO: 3279377 - RNA, 14 nt, Vaccinia virus
cauuaagucauuaa

SEQ ID NO: 3279378 - RNA, 22 nt, Vaccinia virus
ugauuaaugauuuagaaaugaa

SEQ ID NO: 3279379 - RNA, 14 nt, Vaccinia virus
gagugaagaaauaa

SEQ ID NO: 3279380 - RNA, 16 nt, Vaccinia virus
aaaaguaagauauuau

SEQ ID NO: 3279381 - RNA, 13 nt, Vaccinia virus
uguuauagaugug

SEQ ID NO: 3279382 - RNA, 14 nt, Vaccinia virus
ucuuaauacagauu

SEQ ID NO: 3279383 - RNA, 14 nt, Vaccinia virus
cuuaacaaaaauua

SEQ ID NO: 3279384 - RNA, 13 nt, Vaccinia virus
cgcaaaaaaacug

SEQ ID NO: 3279385 - RNA, 20 nt, Vaccinia virus
aaacacugauucagaaaugg

SEQ ID NO: 3279386 - RNA, 18 nt, Vaccinia virus
uaguaucguacaauucau

SEQ ID NO: 3279387 - RNA, 14 nt, Vaccinia virus
aacacagaacagua

SEQ ID NO: 3279388 - RNA, 12 nt, Vaccinia virus
ucauauuuagac

SEQ ID NO: 3279389 - RNA, 17 nt, Vaccinia virus
aguuuuuaggaaauauu

SEQ ID NO: 3279390 - RNA, 20 nt, Vaccinia virus
aaggacauuguaaauuuuau

SEQ ID NO: 3279391 - RNA, 14 nt, Vaccinia virus
aauuagauuucgaa

SEQ ID NO: 3279392 - RNA, 16 nt, Vaccinia virus
guacuuguacacauau

SEQ ID NO: 3279393 - RNA, 23 nt, Vaccinia virus
gaucuuuauuuuucguguauuuu

SEQ ID NO: 3279394 - RNA, 21 nt, Vaccinia virus
gaauaugaauucuaugaugaa

SEQ ID NO: 3279395 - RNA, 13 nt, Vaccinia virus
auaauuaauacaa

SEQ ID NO: 3279396 - RNA, 16 nt, Vaccinia virus
uggauauggguuucca

SEQ ID NO: 3279397 - RNA, 19 nt, Vaccinia virus
guuacauuuccaugucaau

SEQ ID NO: 3279398 - RNA, 15 nt, Vaccinia virus
auuagugacggaaaa

SEQ ID NO: 3279399 - RNA, 23 nt, Vaccinia virus
uuauuagucgccgucucuauaaa

SEQ ID NO: 3279400 - RNA, 14 nt, Vaccinia virus
ucgauccaauaaau

SEQ ID NO: 3279401 - RNA, 14 nt, Vaccinia virus
gagaauuaaaagag

SEQ ID NO: 3279402 - RNA, 16 nt, Vaccinia virus
auaucuaaaugaauac

SEQ ID NO: 3279403 - RNA, 14 nt, Vaccinia virus
agcgguguuauuau

SEQ ID NO: 3279404 - RNA, 12 nt, Vaccinia virus
aucaauguacau

SEQ ID NO: 3279405 - RNA, 17 nt, Vaccinia virus
cuacaguaauguccaaa

SEQ ID NO: 3279406 - RNA, 17 nt, Vaccinia virus
gcacuacuguuaagaau

SEQ ID NO: 3279407 - RNA, 14 nt, Vaccinia virus
aguaaguuuaugau

SEQ ID NO: 3279408 - RNA, 16 nt, Vaccinia virus
gauacaacaaauuaaa

SEQ ID NO: 3279409 - RNA, 20 nt, Vaccinia virus
auuuguaucuccuuucucuu

SEQ ID NO: 3279410 - RNA, 17 nt, Vaccinia virus
cgauaacggaauagacu

SEQ ID NO: 3279411 - RNA, 17 nt, Vaccinia virus
accauuuuaaaaucauu

SEQ ID NO: 3279412 - RNA, 16 nt, Vaccinia virus
uagcaauuucaaaaua

SEQ ID NO: 3279413 - RNA, 14 nt, Vaccinia virus
aucuauauauccuu

SEQ ID NO: 3279414 - RNA, 15 nt, Vaccinia virus
auuacgcucuacaaa

SEQ ID NO: 3279415 - RNA, 18 nt, Vaccinia virus
uaacccauuauaaaacuu

SEQ ID NO: 3279416 - RNA, 17 nt, Vaccinia virus
uauaaaaucuguaucga

SEQ ID NO: 3279417 - RNA, 15 nt, Vaccinia virus
ugcgacacuauucau

SEQ ID NO: 3279418 - RNA, 21 nt, Vaccinia virus
caagagaaugaaauauauaca

SEQ ID NO: 3279419 - RNA, 14 nt, Vaccinia virus
guucaaauauauga

SEQ ID NO: 3279420 - RNA, 18 nt, Vaccinia virus
auauaauacuuaaaaaug

SEQ ID NO: 3279421 - RNA, 13 nt, Vaccinia virus
uaccuguuuuuau

SEQ ID NO: 3279422 - RNA, 18 nt, Vaccinia virus
auacguaagaauauacua

SEQ ID NO: 3279423 - RNA, 23 nt, Vaccinia virus
cuauuauguuaacggaaaguauu

SEQ ID NO: 3279424 - RNA, 18 nt, Vaccinia virus
uauuaucguuuguaacau

SEQ ID NO: 3279425 - RNA, 12 nt, Vaccinia virus
gaauuucccaaa

SEQ ID NO: 3279426 - RNA, 19 nt, Vaccinia virus
aauccagcuagugaauaua

SEQ ID NO: 3279427 - RNA, 18 nt, Vaccinia virus
gucucagaauucuaaaug

SEQ ID NO: 3279428 - RNA, 22 nt, Vaccinia virus
aacauaauagucgaauacagua

SEQ ID NO: 3279429 - RNA, 18 nt, Vaccinia virus
uuauauacucuaaucuuu

SEQ ID NO: 3279430 - RNA, 21 nt, Vaccinia virus
uaucgacaauugcguggagau

SEQ ID NO: 3279431 - RNA, 18 nt, Vaccinia virus
aacauuaaccguuucauc

SEQ ID NO: 3279432 - RNA, 17 nt, Vaccinia virus
aauuuuuuuucuagaua

SEQ ID NO: 3279433 - RNA, 12 nt, Vaccinia virus
aauuuaucaugg

SEQ ID NO: 3279434 - RNA, 21 nt, Vaccinia virus
agcuagagugauaauuucguu

SEQ ID NO: 3279435 - RNA, 15 nt, Vaccinia virus
aauauaacaguaucu

SEQ ID NO: 3279436 - RNA, 16 nt, Vaccinia virus
uagauuuuccauccac

SEQ ID NO: 3279437 - RNA, 15 nt, Vaccinia virus
ucagauuauucuuaa

SEQ ID NO: 3279438 - RNA, 15 nt, Vaccinia virus
auaauauuagauuua

SEQ ID NO: 3279439 - RNA, 20 nt, Vaccinia virus
auacagcguuacauuauuau

SEQ ID NO: 3279440 - RNA, 22 nt, Vaccinia virus
ucagacgacccaaaacauagag

SEQ ID NO: 3279441 - RNA, 14 nt, Vaccinia virus
caaauuuuacuaca

SEQ ID NO: 3279442 - RNA, 19 nt, Vaccinia virus
ccgacuguaacauugacug

SEQ ID NO: 3279443 - RNA, 22 nt, Vaccinia virus
ucuuacacauucgcucauacau

SEQ ID NO: 3279444 - RNA, 15 nt, Vaccinia virus
guaauauuuuuaguu

SEQ ID NO: 3279445 - RNA, 12 nt, Vaccinia virus
auucauaacuaa

SEQ ID NO: 3279446 - RNA, 15 nt, Vaccinia virus
uuaauaauuguauug

SEQ ID NO: 3279447 - RNA, 20 nt, Vaccinia virus
aacuucugccugaaauccaa

SEQ ID NO: 3279448 - RNA, 16 nt, Vaccinia virus
auauauggauaaugcu

SEQ ID NO: 3279449 - RNA, 15 nt, Vaccinia virus
aauuguuguauuuau

SEQ ID NO: 3279450 - RNA, 13 nt, Vaccinia virus
auagaacaaaauc

SEQ ID NO: 3279451 - RNA, 16 nt, Vaccinia virus
cauucaccagaaacua

SEQ ID NO: 3279452 - RNA, 12 nt, Vaccinia virus
aaugaaaugaua

SEQ ID NO: 3279453 - RNA, 17 nt, Vaccinia virus
auaaacaaacuaauaaa

SEQ ID NO: 3279454 - RNA, 18 nt, Vaccinia virus
uauuaaugaucacaugcu

SEQ ID NO: 3279455 - RNA, 18 nt, Vaccinia virus
uuaaucucaaaauauguu

SEQ ID NO: 3279456 - RNA, 13 nt, Vaccinia virus
gccauccaaacaa

SEQ ID NO: 3279457 - RNA, 22 nt, Vaccinia virus
uguaaauucagcgguaaagaua

SEQ ID NO: 3279458 - RNA, 19 nt, Vaccinia virus
guuuagacggcaacauaga

SEQ ID NO: 3279459 - RNA, 16 nt, Vaccinia virus
caauucgguuauaaau

SEQ ID NO: 3279460 - RNA, 21 nt, Vaccinia virus
auaacucauuuuuugaauaua

SEQ ID NO: 3279461 - RNA, 15 nt, Vaccinia virus
ucagaugauguauua

SEQ ID NO: 3279462 - RNA, 18 nt, Vaccinia virus
gcaauauaucaucuuuuc

SEQ ID NO: 3279463 - RNA, 20 nt, Vaccinia virus
aguuguaaaguuaaaauugu

SEQ ID NO: 3279464 - RNA, 14 nt, Vaccinia virus
aggaaucaaugaua

SEQ ID NO: 3279465 - RNA, 20 nt, Vaccinia virus
agauaguagcuauaauauau

SEQ ID NO: 3279466 - RNA, 21 nt, Vaccinia virus
auguguuucccaaacaaaaug

SEQ ID NO: 3279467 - RNA, 17 nt, Vaccinia virus
acugaguuggcuacuau

SEQ ID NO: 3279468 - RNA, 12 nt, Vaccinia virus
cgucaguauuua

SEQ ID NO: 3279469 - RNA, 23 nt, Vaccinia virus
aauguccaaaucuaguuguggaa

SEQ ID NO: 3279470 - RNA, 21 nt, Vaccinia virus
ugcuuuucuauaaucaucuua

SEQ ID NO: 3279471 - RNA, 23 nt, Vaccinia virus
gaguaguaaacgcguacauaacu

SEQ ID NO: 3279472 - RNA, 21 nt, Vaccinia virus
agaaauaaaucagacaauaag

SEQ ID NO: 3279473 - RNA, 15 nt, Vaccinia virus
aauaacaucagaaaa

SEQ ID NO: 3279474 - RNA, 17 nt, Vaccinia virus
ggccuaaagaauaucuu

SEQ ID NO: 3279475 - RNA, 13 nt, Vaccinia virus
aaagguucuauca

SEQ ID NO: 3279476 - RNA, 18 nt, Vaccinia virus
uaaguaauaacuauguuu

SEQ ID NO: 3279477 - RNA, 13 nt, Vaccinia virus
acuguucaagaau

SEQ ID NO: 3279478 - RNA, 23 nt, Vaccinia virus
uggaaugacgaauccuguuucua

SEQ ID NO: 3279479 - RNA, 18 nt, Vaccinia virus
caaauuaaacucuggaau

SEQ ID NO: 3279480 - RNA, 16 nt, Vaccinia virus
uaaacacgaauacuau

SEQ ID NO: 3279481 - RNA, 12 nt, Vaccinia virus
ugucgguaaacg

SEQ ID NO: 3279482 - RNA, 16 nt, Vaccinia virus
caaaaugauauacagu

SEQ ID NO: 3279483 - RNA, 17 nt, Vaccinia virus
caauaaacaaaauacuc

SEQ ID NO: 3279484 - RNA, 21 nt, Vaccinia virus
uauaacagagccaucuguaaa

SEQ ID NO: 3279485 - RNA, 12 nt, Vaccinia virus
augcaaacauua

SEQ ID NO: 3279486 - RNA, 16 nt, Vaccinia virus
cuauacccaucaugua

SEQ ID NO: 3279487 - RNA, 12 nt, Vaccinia virus
uacuaucagaaa

SEQ ID NO: 3279488 - RNA, 17 nt, Vaccinia virus
cuagaagauauagcacc

SEQ ID NO: 3279489 - RNA, 17 nt, Vaccinia virus
auauaccgccucaaacu

SEQ ID NO: 3279490 - RNA, 16 nt, Vaccinia virus
cacaguauugacaaau

SEQ ID NO: 3279491 - RNA, 15 nt, Vaccinia virus
aucuaauauacuuug

SEQ ID NO: 3279492 - RNA, 17 nt, Vaccinia virus
uucccaaacauacaucu

SEQ ID NO: 3279493 - RNA, 17 nt, Vaccinia virus
auaucuuuuugaauugu

SEQ ID NO: 3279494 - RNA, 22 nt, Vaccinia virus
acaagaguggaaacucacauau

SEQ ID NO: 3279495 - RNA, 16 nt, Vaccinia virus
gaaaaaaaauuaucua

SEQ ID NO: 3279496 - RNA, 14 nt, Vaccinia virus
uagagcucgaugau

SEQ ID NO: 3279497 - RNA, 23 nt, Vaccinia virus
auaguaggucuggaucuggaaaa

SEQ ID NO: 3279498 - RNA, 13 nt, Vaccinia virus
uagauuuaucuag

SEQ ID NO: 3279499 - RNA, 15 nt, Vaccinia virus
guuauauauaaaaga

SEQ ID NO: 3279500 - RNA, 15 nt, Vaccinia virus
gcaauaauggaaucu

SEQ ID NO: 3279501 - RNA, 17 nt, Vaccinia virus
guauugcgcuacugauu

SEQ ID NO: 3279502 - RNA, 19 nt, Vaccinia virus
cauucuaauguucauaauu

SEQ ID NO: 3279503 - RNA, 11 nt, Vaccinia virus
cuauguuuaua

SEQ ID NO: 3279504 - RNA, 16 nt, Vaccinia virus
gcggaacaauaaacaa

SEQ ID NO: 3279505 - RNA, 20 nt, Vaccinia virus
aaugacaaaaucaacuacau

SEQ ID NO: 3279506 - RNA, 20 nt, Vaccinia virus
uugcacaauccaaacuuuuu

SEQ ID NO: 3279507 - RNA, 17 nt, Vaccinia virus
aguaaucauauaaaugu

SEQ ID NO: 3279508 - RNA, 22 nt, Vaccinia virus
ucaacaucugaugcgcuaagac

SEQ ID NO: 3279509 - RNA, 17 nt, Vaccinia virus
aaaucaaccaccgauga

SEQ ID NO: 3279510 - RNA, 15 nt, Vaccinia virus
aacacaucaauuucg

SEQ ID NO: 3279511 - RNA, 20 nt, Vaccinia virus
acggcuuuuaaacagucucc

SEQ ID NO: 3279512 - RNA, 16 nt, Vaccinia virus
uguacauuguuucaua

SEQ ID NO: 3279513 - RNA, 18 nt, Vaccinia virus
acaauggucgauuauaga

SEQ ID NO: 3279514 - RNA, 18 nt, Vaccinia virus
uaaaauuucauagacuuu

SEQ ID NO: 3279515 - RNA, 12 nt, Vaccinia virus
agaacucuuuuc

SEQ ID NO: 3279516 - RNA, 13 nt, Vaccinia virus
aacaaucuagaca

SEQ ID NO: 3279517 - RNA, 13 nt, Vaccinia virus
ugguguaaaucua

SEQ ID NO: 3279518 - RNA, 17 nt, Vaccinia virus
uacaaguuauacgucau

SEQ ID NO: 3279519 - RNA, 13 nt, Vaccinia virus
auaacaucauauu

SEQ ID NO: 3279520 - RNA, 14 nt, Vaccinia virus
uaaauacauuauca

SEQ ID NO: 3279521 - RNA, 16 nt, Vaccinia virus
cuuguuguuuauuuuc

SEQ ID NO: 3279522 - RNA, 20 nt, Vaccinia virus
ucguauuucauaaaaguuau

SEQ ID NO: 3279523 - RNA, 19 nt, Vaccinia virus
uacuaaugguaucaagaag

SEQ ID NO: 3279524 - RNA, 18 nt, Vaccinia virus
aguaaguaucuuauguau

SEQ ID NO: 3279525 - RNA, 20 nt, Vaccinia virus
auaucacauaucuaaaugaa

SEQ ID NO: 3279526 - RNA, 14 nt, Vaccinia virus
aucgacuauagaca

SEQ ID NO: 3279527 - RNA, 18 nt, Vaccinia virus
ucuaguuaucauguagua

SEQ ID NO: 3279528 - RNA, 21 nt, Vaccinia virus
caaauauaugcaaaauaauau

SEQ ID NO: 3279529 - RNA, 12 nt, Vaccinia virus
ucgucuuuagag

SEQ ID NO: 3279530 - RNA, 20 nt, Vaccinia virus
gcaugguaguucguagauuu

SEQ ID NO: 3279531 - RNA, 15 nt, Vaccinia virus
acaauauuacaaaau

SEQ ID NO: 3279532 - RNA, 19 nt, Vaccinia virus
aucugggaauaaaauacua

SEQ ID NO: 3279533 - RNA, 17 nt, Vaccinia virus
acggccauugcugccac

SEQ ID NO: 3279534 - RNA, 17 nt, Vaccinia virus
uugccguugucuguauu

SEQ ID NO: 3279535 - RNA, 20 nt, Vaccinia virus
auauagcggaugaaaaauuu

SEQ ID NO: 3279536 - RNA, 15 nt, Vaccinia virus
uuuauaucaauaaga

SEQ ID NO: 3279537 - RNA, 17 nt, Vaccinia virus
acaagcccgucaauaau

SEQ ID NO: 3279538 - RNA, 15 nt, Vaccinia virus
augaucacaaagaaa

SEQ ID NO: 3279539 - RNA, 17 nt, Vaccinia virus
uucugcgcaaugcauaa

SEQ ID NO: 3279540 - RNA, 22 nt, Vaccinia virus
guaucaaucaagaggauggaau

SEQ ID NO: 3279541 - RNA, 17 nt, Vaccinia virus
acuaaucgauuuugcau

SEQ ID NO: 3279542 - RNA, 16 nt, Vaccinia virus
aauaacaauuaacaau

SEQ ID NO: 3279543 - RNA, 20 nt, Vaccinia virus
agaacgaugucaaaauauga

SEQ ID NO: 3279544 - RNA, 15 nt, Vaccinia virus
ccaacucuuuaauaa

SEQ ID NO: 3279545 - RNA, 23 nt, Vaccinia virus
uaaauuuuuuuucaguuaucuau

SEQ ID NO: 3279546 - RNA, 19 nt, Vaccinia virus
aauguuagugaugaauauc

SEQ ID NO: 3279547 - RNA, 15 nt, Vaccinia virus
aaauacuucuuggaa

SEQ ID NO: 3279548 - RNA, 19 nt, Vaccinia virus
auuaucgcuaauugacaca

SEQ ID NO: 3279549 - RNA, 16 nt, Vaccinia virus
cauuguuuguauucuc

SEQ ID NO: 3279550 - RNA, 22 nt, Vaccinia virus
uagauaacggacaacaacuauc

SEQ ID NO: 3279551 - RNA, 22 nt, Vaccinia virus
ucagaauuuucauggauguaga

SEQ ID NO: 3279552 - RNA, 12 nt, Vaccinia virus
uccuccuaucaa

SEQ ID NO: 3279553 - RNA, 22 nt, Vaccinia virus
cgaaccagaaucagugaauaaa

SEQ ID NO: 3279554 - RNA, 18 nt, Vaccinia virus
uaagugauauaaaacuau

SEQ ID NO: 3279555 - RNA, 14 nt, Vaccinia virus
guuuaaaacuucua

SEQ ID NO: 3279556 - RNA, 23 nt, Vaccinia virus
aaaucuuuguucuaaaaacugua

SEQ ID NO: 3279557 - RNA, 16 nt, Vaccinia virus
uuaugccgaacuaaaa

SEQ ID NO: 3279558 - RNA, 20 nt, Vaccinia virus
gaauguaauuuuuguuuccg

SEQ ID NO: 3279559 - RNA, 18 nt, Vaccinia virus
uaaguaguuuaucaacau

SEQ ID NO: 3279560 - RNA, 20 nt, Vaccinia virus
aauaaaauguuaauacauca

SEQ ID NO: 3279561 - RNA, 20 nt, Vaccinia virus
auccuucagauaaucugaaa

SEQ ID NO: 3279562 - RNA, 12 nt, Vaccinia virus
gaaguaaugaag

SEQ ID NO: 3279563 - RNA, 16 nt, Vaccinia virus
agggaagcaaaugaug

SEQ ID NO: 3279564 - RNA, 19 nt, Vaccinia virus
aauccuauacucugaaaga

SEQ ID NO: 3279565 - RNA, 22 nt, Vaccinia virus
uucauaauuguuagcuguuuuc

SEQ ID NO: 3279566 - RNA, 15 nt, Vaccinia virus
auguuguuuuauaua

SEQ ID NO: 3279567 - RNA, 13 nt, Vaccinia virus
ucaucacauaucg

SEQ ID NO: 3279568 - RNA, 20 nt, Vaccinia virus
guuaaagaaauuaauaaaga

SEQ ID NO: 3279569 - RNA, 22 nt, Vaccinia virus
uagagugagucuagaauucauu

SEQ ID NO: 3279570 - RNA, 22 nt, Vaccinia virus
aucuagcugucuguaucauauu

SEQ ID NO: 3279571 - RNA, 21 nt, Vaccinia virus
gaaaucauuuuuuuaaaacug

SEQ ID NO: 3279572 - RNA, 15 nt, Vaccinia virus
gcguccgauuccguu

SEQ ID NO: 3279573 - RNA, 20 nt, Vaccinia virus
agacuaggugcuauggaugg

SEQ ID NO: 3279574 - RNA, 20 nt, Vaccinia virus
aaguccuaguuguauacuga

SEQ ID NO: 3279575 - RNA, 22 nt, Vaccinia virus
aucuagccauaucuaaagcuau

SEQ ID NO: 3279576 - RNA, 16 nt, Vaccinia virus
guaaauccuaguucug

SEQ ID NO: 3279577 - RNA, 20 nt, Vaccinia virus
acaauauauucucauaguau

SEQ ID NO: 3279578 - RNA, 13 nt, Vaccinia virus
accucgagaaugu

SEQ ID NO: 3279579 - RNA, 17 nt, Vaccinia virus
ucuauccaagauacuua

SEQ ID NO: 3279580 - RNA, 21 nt, Vaccinia virus
uagcacuacgcaauaugauca

SEQ ID NO: 3279581 - RNA, 21 nt, Vaccinia virus
uaccacuuuccaacuuaucau

SEQ ID NO: 3279582 - RNA, 11 nt, Vaccinia virus
auaucauauau

SEQ ID NO: 3279583 - RNA, 19 nt, Vaccinia virus
acuuuaaauaauuuacaaa

SEQ ID NO: 3279584 - RNA, 17 nt, Vaccinia virus
auguaauuaaauguuug

SEQ ID NO: 3279585 - RNA, 16 nt, Vaccinia virus
uacccauccaauacua

SEQ ID NO: 3279586 - RNA, 13 nt, Vaccinia virus
uuaucauacuguc

SEQ ID NO: 3279587 - RNA, 18 nt, Vaccinia virus
acugcuuuaggugcugaa

SEQ ID NO: 3279588 - RNA, 15 nt, Vaccinia virus
uaaucuuacuacgau

SEQ ID NO: 3279589 - RNA, 13 nt, Vaccinia virus
auucaucaacauu

SEQ ID NO: 3279590 - RNA, 19 nt, Vaccinia virus
cugcagcaacuugugcacu

SEQ ID NO: 3279591 - RNA, 21 nt, Vaccinia virus
ccaucgcuucuaucuuguuua

SEQ ID NO: 3279592 - RNA, 18 nt, Vaccinia virus
aauacgaugauauuaaaa

SEQ ID NO: 3279593 - RNA, 18 nt, Vaccinia virus
uagaacugccauauguug

SEQ ID NO: 3279594 - RNA, 15 nt, Vaccinia virus
aucgucucuaucuuu

SEQ ID NO: 3279595 - RNA, 18 nt, Vaccinia virus
uuaauaaauuucuuuuca

SEQ ID NO: 3279596 - RNA, 21 nt, Vaccinia virus
uaauauccucaauaacguuau

SEQ ID NO: 3279597 - RNA, 23 nt, Vaccinia virus
ucuugacugucgcuaauaucuaa

SEQ ID NO: 3279598 - RNA, 20 nt, Vaccinia virus
ucuuuuauuuuuuguaggaa

SEQ ID NO: 3279599 - RNA, 21 nt, Vaccinia virus
uauucacaagaugaauucagu

SEQ ID NO: 3279600 - RNA, 15 nt, Vaccinia virus
auccguucuuaacuu

SEQ ID NO: 3279601 - RNA, 21 nt, Vaccinia virus
cuucaucggcuuuaacaauug

SEQ ID NO: 3279602 - RNA, 16 nt, Vaccinia virus
ggcuccucucucaggc

SEQ ID NO: 3279603 - RNA, 23 nt, Vaccinia virus
gauuauaagauuaaauggcagac

SEQ ID NO: 3279604 - RNA, 17 nt, Vaccinia virus
aucgacgccuuagaaau

SEQ ID NO: 3279605 - RNA, 19 nt, Vaccinia virus
auuugguauauacauagau

SEQ ID NO: 3279606 - RNA, 20 nt, Vaccinia virus
ucaucggacuuugugcauau

SEQ ID NO: 3279607 - RNA, 17 nt, Vaccinia virus
gaaguacuauuaaaacc

SEQ ID NO: 3279608 - RNA, 13 nt, Vaccinia virus
uuaaauccuuaau

SEQ ID NO: 3279609 - RNA, 21 nt, Vaccinia virus
uaaaacuuccucauuaagauu

SEQ ID NO: 3279610 - RNA, 18 nt, Vaccinia virus
caauacgccaauaaugau

SEQ ID NO: 3279611 - RNA, 19 nt, Vaccinia virus
agaguuuuauucucauuau

SEQ ID NO: 3279612 - RNA, 10 nt, Vaccinia virus
uacuuuucua

SEQ ID NO: 3279613 - RNA, 14 nt, Vaccinia virus
ggcauguguuuccc

SEQ ID NO: 3279614 - RNA, 21 nt, Vaccinia virus
agaaauggagagagacuguuu

SEQ ID NO: 3279615 - RNA, 17 nt, Vaccinia virus
acaguaucauuuaaaca

SEQ ID NO: 3279616 - RNA, 17 nt, Vaccinia virus
augauugauuagaaaau

SEQ ID NO: 3279617 - RNA, 22 nt, Vaccinia virus
aucuuuuagaaaaguuaaacau

SEQ ID NO: 3279618 - RNA, 22 nt, Vaccinia virus
acauguauacuugacaaaaauu

SEQ ID NO: 3279619 - RNA, 16 nt, Vaccinia virus
auccauauuuucuggu

SEQ ID NO: 3279620 - RNA, 15 nt, Vaccinia virus
aggcauuaacuagau

SEQ ID NO: 3279621 - RNA, 14 nt, Vaccinia virus
cuauuuuuaauaua

SEQ ID NO: 3279622 - RNA, 23 nt, Vaccinia virus
uauucuaauacauaauucuucug

SEQ ID NO: 3279623 - RNA, 16 nt, Vaccinia virus
gauuauucuacuauca

SEQ ID NO: 3279624 - RNA, 13 nt, Vaccinia virus
auuaauacauauu

SEQ ID NO: 3279625 - RNA, 15 nt, Vaccinia virus
caguuucuguaauga

SEQ ID NO: 3279626 - RNA, 18 nt, Vaccinia virus
auguagccuugacuacau

SEQ ID NO: 3279627 - RNA, 12 nt, Vaccinia virus
ucaaaucuauau

SEQ ID NO: 3279628 - RNA, 15 nt, Vaccinia virus
aaguuucguacaaau

SEQ ID NO: 3279629 - RNA, 16 nt, Vaccinia virus
aucuuuucuguacuca

SEQ ID NO: 3279630 - RNA, 16 nt, Vaccinia virus
ccauuuuaaaaucauu

SEQ ID NO: 3279631 - RNA, 18 nt, Vaccinia virus
auuaacauaguugaauaa

SEQ ID NO: 3279632 - RNA, 20 nt, Vaccinia virus
uauaguucuuaacaucuauu

SEQ ID NO: 3279633 - RNA, 18 nt, Vaccinia virus
uaucagacuacuuauucu

SEQ ID NO: 3279634 - RNA, 17 nt, Vaccinia virus
gcaauugcauucccauc

SEQ ID NO: 3279635 - RNA, 18 nt, Vaccinia virus
gauguagugauagauaug

SEQ ID NO: 3279636 - RNA, 14 nt, Vaccinia virus
acugucuaaaugua

SEQ ID NO: 3279637 - RNA, 20 nt, Vaccinia virus
aguucaccaaacaacuuuua

SEQ ID NO: 3279638 - RNA, 15 nt, Vaccinia virus
auauuaauucuguaa

SEQ ID NO: 3279639 - RNA, 22 nt, Vaccinia virus
cuuaugaaacuuggaaacaucu

SEQ ID NO: 3279640 - RNA, 15 nt, Vaccinia virus
gccaccacuucucua

SEQ ID NO: 3279641 - RNA, 19 nt, Vaccinia virus
ucuaucuccaguauuuaca

SEQ ID NO: 3279642 - RNA, 12 nt, Vaccinia virus
cuaccuauuuca

SEQ ID NO: 3279643 - RNA, 15 nt, Vaccinia virus
acaucuugauacuuu

SEQ ID NO: 3279644 - RNA, 20 nt, Vaccinia virus
guuacauuaguaaucuuuuu

SEQ ID NO: 3279645 - RNA, 21 nt, Vaccinia virus
uuauuuuuugguauaauucua

SEQ ID NO: 3279646 - RNA, 17 nt, Vaccinia virus
auuaaaauuaacaagga

SEQ ID NO: 3279647 - RNA, 19 nt, Vaccinia virus
aaugaagaucuauuuccag

SEQ ID NO: 3279648 - RNA, 17 nt, Vaccinia virus
uaaacucuuuaguuucc

SEQ ID NO: 3279649 - RNA, 22 nt, Vaccinia virus
acaauuuuuuuauaauaauucu

SEQ ID NO: 3279650 - RNA, 22 nt, Vaccinia virus
caaguuuccuguaaauuuucua

SEQ ID NO: 3279651 - RNA, 12 nt, Vaccinia virus
aaguaauucaga

SEQ ID NO: 3279652 - RNA, 16 nt, Vaccinia virus
auacaauaaauguuua

SEQ ID NO: 3279653 - RNA, 18 nt, Vaccinia virus
uacauaggcaacauccga

SEQ ID NO: 3279654 - RNA, 12 nt, Vaccinia virus
aaucaauagcuu

SEQ ID NO: 3279655 - RNA, 14 nt, Vaccinia virus
aagaaaaugcagaa

SEQ ID NO: 3279656 - RNA, 20 nt, Vaccinia virus
uaguaaaauaaucauacaau

SEQ ID NO: 3279657 - RNA, 18 nt, Vaccinia virus
aaguaugauacaauacuu

SEQ ID NO: 3279658 - RNA, 22 nt, Vaccinia virus
uaauuugauucuucguucuuca

SEQ ID NO: 3279659 - RNA, 14 nt, Vaccinia virus
ggcauuuguauuuu

SEQ ID NO: 3279660 - RNA, 18 nt, Vaccinia virus
uuucuguaaauucaugau

SEQ ID NO: 3279661 - RNA, 14 nt, Vaccinia virus
auuauauauggauu

SEQ ID NO: 3279662 - RNA, 23 nt, Vaccinia virus
agucuauaugaucaaaaagagau

SEQ ID NO: 3279663 - RNA, 17 nt, Vaccinia virus
cauccuuuauuaaauca

SEQ ID NO: 3279664 - RNA, 23 nt, Vaccinia virus
ugugucuacaaccgcuacauaau

SEQ ID NO: 3279665 - RNA, 13 nt, Vaccinia virus
uagcggaugaaaa

SEQ ID NO: 3279666 - RNA, 17 nt, Vaccinia virus
uaugaauaaucuucauu

SEQ ID NO: 3279667 - RNA, 14 nt, Vaccinia virus
caaacaacugaaaa

SEQ ID NO: 3279668 - RNA, 16 nt, Vaccinia virus
aguguuauaaauggau

SEQ ID NO: 3279669 - RNA, 20 nt, Vaccinia virus
uaauaaccugacuaauuuga

SEQ ID NO: 3279670 - RNA, 23 nt, Vaccinia virus
cgucucugccauggauggaaaca

SEQ ID NO: 3279671 - RNA, 20 nt, Vaccinia virus
guagugcaggcuuaaagcaa

SEQ ID NO: 3279672 - RNA, 23 nt, Vaccinia virus
uagaaaauaucacgcuuuccauu

SEQ ID NO: 3279673 - RNA, 15 nt, Vaccinia virus
acuauuuuuuacauu

SEQ ID NO: 3279674 - RNA, 19 nt, Vaccinia virus
cuuagaaggaguguuuucu

SEQ ID NO: 3279675 - RNA, 19 nt, Vaccinia virus
gacuuugaacauuauugau

SEQ ID NO: 3279676 - RNA, 14 nt, Vaccinia virus
uuaucuaacucuuu

SEQ ID NO: 3279677 - RNA, 19 nt, Vaccinia virus
aaaucagaauguuacagca

SEQ ID NO: 3279678 - RNA, 14 nt, Vaccinia virus
agauguauacuccu

SEQ ID NO: 3279679 - RNA, 13 nt, Vaccinia virus
ggcauuguuucua

SEQ ID NO: 3279680 - RNA, 18 nt, Vaccinia virus
cgucuucccaaaauguua

SEQ ID NO: 3279681 - RNA, 15 nt, Vaccinia virus
aaauuauaaugaaua

SEQ ID NO: 3279682 - RNA, 12 nt, Vaccinia virus
cccauaacuggu

SEQ ID NO: 3279683 - RNA, 20 nt, Vaccinia virus
auuauugucauaaacauuau

SEQ ID NO: 3279684 - RNA, 19 nt, Vaccinia virus
auugguuacccuugucauu

SEQ ID NO: 3279685 - RNA, 11 nt, Vaccinia virus
uuauauuuugu

SEQ ID NO: 3279686 - RNA, 15 nt, Vaccinia virus
auaacuacauauucu

SEQ ID NO: 3279687 - RNA, 14 nt, Vaccinia virus
auuauccaauagau

SEQ ID NO: 3279688 - RNA, 17 nt, Vaccinia virus
cuauaagccuuuguuua

SEQ ID NO: 3279689 - RNA, 18 nt, Vaccinia virus
acgauccaaauuccggaa

SEQ ID NO: 3279690 - RNA, 20 nt, Vaccinia virus
uuagaauauauguauguaaa

SEQ ID NO: 3279691 - RNA, 17 nt, Vaccinia virus
uaaauguggcuacaaac

SEQ ID NO: 3279692 - RNA, 17 nt, Vaccinia virus
aguaaaugaaaaaaaac

SEQ ID NO: 3279693 - RNA, 15 nt, Vaccinia virus
auuauaaagauaugu

SEQ ID NO: 3279694 - RNA, 20 nt, Vaccinia virus
auuaugcauucguuuaaaga

SEQ ID NO: 3279695 - RNA, 20 nt, Vaccinia virus
guacauggaugauauagaua

SEQ ID NO: 3279696 - RNA, 15 nt, Vaccinia virus
uuaccagauaucuuc

SEQ ID NO: 3279697 - RNA, 12 nt, Vaccinia virus
augaaauguuug

SEQ ID NO: 3279698 - RNA, 19 nt, Vaccinia virus
uggauauuacaaauacuuu

SEQ ID NO: 3279699 - RNA, 21 nt, Vaccinia virus
uaccuaucaaggaacaaauau

SEQ ID NO: 3279700 - RNA, 16 nt, Vaccinia virus
auaaucaauguuguaa

SEQ ID NO: 3279701 - RNA, 14 nt, Vaccinia virus
agauauauagaauu

SEQ ID NO: 3279702 - RNA, 23 nt, Vaccinia virus
uuaaugucugcgccauuaucuau

SEQ ID NO: 3279703 - RNA, 14 nt, Vaccinia virus
aaugguuucgaaga

SEQ ID NO: 3279704 - RNA, 14 nt, Vaccinia virus
aguaaauucaagau

SEQ ID NO: 3279705 - RNA, 17 nt, Vaccinia virus
uauaucaauaagaaagu

SEQ ID NO: 3279706 - RNA, 13 nt, Vaccinia virus
aguauuuuuauca

SEQ ID NO: 3279707 - RNA, 19 nt, Vaccinia virus
cacauccuuuauuaauaau

SEQ ID NO: 3279708 - RNA, 19 nt, Vaccinia virus
auauagugaaacaaaauau

SEQ ID NO: 3279709 - RNA, 14 nt, Vaccinia virus
ucgauggucucaca

SEQ ID NO: 3279710 - RNA, 20 nt, Vaccinia virus
ccggacgacauauuaaucuu

SEQ ID NO: 3279711 - RNA, 17 nt, Vaccinia virus
uauacgaaaaaauagca

SEQ ID NO: 3279712 - RNA, 20 nt, Vaccinia virus
ugauuucguuagucauauua

SEQ ID NO: 3279713 - RNA, 21 nt, Vaccinia virus
uaacuaugcgauuauuuucau

SEQ ID NO: 3279714 - RNA, 18 nt, Vaccinia virus
aucagaauaaaucaauau

SEQ ID NO: 3279715 - RNA, 17 nt, Vaccinia virus
augcuauuagaaaugga

SEQ ID NO: 3279716 - RNA, 23 nt, Vaccinia virus
gauucuauuaagaguaacagcug

SEQ ID NO: 3279717 - RNA, 18 nt, Vaccinia virus
aucauaaauuauuucauu

SEQ ID NO: 3279718 - RNA, 18 nt, Vaccinia virus
caauaacgcaaucaugau

SEQ ID NO: 3279719 - RNA, 14 nt, Vaccinia virus
augaaauauauuaa

SEQ ID NO: 3279720 - RNA, 14 nt, Vaccinia virus
gacuagacauuuac

SEQ ID NO: 3279721 - RNA, 18 nt, Vaccinia virus
cauaaaacucauuguuua

SEQ ID NO: 3279722 - RNA, 17 nt, Vaccinia virus
aacuagaagucugaucu

SEQ ID NO: 3279723 - RNA, 21 nt, Vaccinia virus
acuucaucaugaguuaaauau

SEQ ID NO: 3279724 - RNA, 11 nt, Vaccinia virus
cuguggaauaa

SEQ ID NO: 3279725 - RNA, 15 nt, Vaccinia virus
guuugauaaauguag

SEQ ID NO: 3279726 - RNA, 22 nt, Vaccinia virus
cucucauuuucuuuaacaaauu

SEQ ID NO: 3279727 - RNA, 19 nt, Vaccinia virus
gcgauagcugauaauagaa

SEQ ID NO: 3279728 - RNA, 23 nt, Vaccinia virus
aauacauauuauucaaaauauga

SEQ ID NO: 3279729 - RNA, 19 nt, Vaccinia virus
acguuuuucgaaaaaauua

SEQ ID NO: 3279730 - RNA, 20 nt, Vaccinia virus
auuuuugacuuacauaaaug

SEQ ID NO: 3279731 - RNA, 22 nt, Vaccinia virus
agaaacuauagauaaugauaua

SEQ ID NO: 3279732 - RNA, 13 nt, Vaccinia virus
uaugaaucuggau

SEQ ID NO: 3279733 - RNA, 14 nt, Vaccinia virus
uuauuaucuguaga

SEQ ID NO: 3279734 - RNA, 14 nt, Vaccinia virus
acucccacaaauac

SEQ ID NO: 3279735 - RNA, 15 nt, Vaccinia virus
ugugaugauuguaca

SEQ ID NO: 3279736 - RNA, 14 nt, Vaccinia virus
aacuuuaucaucuu

SEQ ID NO: 3279737 - RNA, 23 nt, Vaccinia virus
aacaagaucaugaacacgaugau

SEQ ID NO: 3279738 - RNA, 13 nt, Vaccinia virus
aucauaauuacau

SEQ ID NO: 3279739 - RNA, 17 nt, Vaccinia virus
uaaucggagaauguuuc

SEQ ID NO: 3279740 - RNA, 21 nt, Vaccinia virus
acuauguuuuguauacauaaa

SEQ ID NO: 3279741 - RNA, 15 nt, Vaccinia virus
augagguuuugcaac

SEQ ID NO: 3279742 - RNA, 17 nt, Vaccinia virus
gccgcuauaaugaugau

SEQ ID NO: 3279743 - RNA, 18 nt, Vaccinia virus
uuaacgaggacuuauuca

SEQ ID NO: 3279744 - RNA, 16 nt, Vaccinia virus
uuuaaugugaaaucgu

SEQ ID NO: 3279745 - RNA, 19 nt, Vaccinia virus
cgccuccguugucauaaac

SEQ ID NO: 3279746 - RNA, 21 nt, Vaccinia virus
aaaaagauuaccguaugauau

SEQ ID NO: 3279747 - RNA, 13 nt, Vaccinia virus
guccaaugauugc

SEQ ID NO: 3279748 - RNA, 18 nt, Vaccinia virus
auaugaaccugacaugau

SEQ ID NO: 3279749 - RNA, 21 nt, Vaccinia virus
agaacauuuuuauaaacauga

SEQ ID NO: 3279750 - RNA, 17 nt, Vaccinia virus
uuauauuccucuauuaa

SEQ ID NO: 3279751 - RNA, 19 nt, Vaccinia virus
acccauuagguuaaaugau

SEQ ID NO: 3279752 - RNA, 16 nt, Vaccinia virus
cgguucuuuaaaagaa

SEQ ID NO: 3279753 - RNA, 15 nt, Vaccinia virus
aauauggauccucau

SEQ ID NO: 3279754 - RNA, 15 nt, Vaccinia virus
acuucaggaaauauc

SEQ ID NO: 3279755 - RNA, 19 nt, Vaccinia virus
aagaagugucuauaaaugu

SEQ ID NO: 3279756 - RNA, 16 nt, Vaccinia virus
auguuguuaaaauaua

SEQ ID NO: 3279757 - RNA, 23 nt, Vaccinia virus
caauauuguuaucguaauuggaa

SEQ ID NO: 3279758 - RNA, 13 nt, Vaccinia virus
ucuuuaauccaau

SEQ ID NO: 3279759 - RNA, 23 nt, Vaccinia virus
uuaaaaaguugacagaaccuugu

SEQ ID NO: 3279760 - RNA, 16 nt, Vaccinia virus
auuaacuuuguucauu

SEQ ID NO: 3279761 - RNA, 18 nt, Vaccinia virus
aauuacugauaauguaga

SEQ ID NO: 3279762 - RNA, 18 nt, Vaccinia virus
aauaaggaauauacuaau

SEQ ID NO: 3279763 - RNA, 17 nt, Vaccinia virus
guaaaggauaugauaug

SEQ ID NO: 3279764 - RNA, 12 nt, Vaccinia virus
aacacaaccaaa

SEQ ID NO: 3279765 - RNA, 20 nt, Vaccinia virus
acagcuaucaaaauauguag

SEQ ID NO: 3279766 - RNA, 14 nt, Vaccinia virus
acuguaaaaacaaa

SEQ ID NO: 3279767 - RNA, 22 nt, Vaccinia virus
aauaacauuuuuuguaaaugua

SEQ ID NO: 3279768 - RNA, 19 nt, Vaccinia virus
ucaaauacaucuauuagua

SEQ ID NO: 3279769 - RNA, 22 nt, Vaccinia virus
uauugcggcauauauaaaguug

SEQ ID NO: 3279770 - RNA, 13 nt, Vaccinia virus
gaaugaugauaua

SEQ ID NO: 3279771 - RNA, 14 nt, Vaccinia virus
uccagauaauaacc

SEQ ID NO: 3279772 - RNA, 21 nt, Vaccinia virus
cuacaucaguuuuguauucca

SEQ ID NO: 3279773 - RNA, 16 nt, Vaccinia virus
aaacguuuagagauua

SEQ ID NO: 3279774 - RNA, 20 nt, Vaccinia virus
uagguaugaucguuaagaau

SEQ ID NO: 3279775 - RNA, 21 nt, Vaccinia virus
uuaugggcauuuguauuuuga

SEQ ID NO: 3279776 - RNA, 15 nt, Vaccinia virus
uuaaaguuacaaaca

SEQ ID NO: 3279777 - RNA, 13 nt, Vaccinia virus
agugcaaugaaua

SEQ ID NO: 3279778 - RNA, 14 nt, Vaccinia virus
uauaauauauucua

SEQ ID NO: 3279779 - RNA, 15 nt, Vaccinia virus
ucuauacguuucuau

SEQ ID NO: 3279780 - RNA, 23 nt, Vaccinia virus
uacgcauuuuagcagucuaacau

SEQ ID NO: 3279781 - RNA, 20 nt, Vaccinia virus
cguauagcaauguaauggag

SEQ ID NO: 3279782 - RNA, 13 nt, Vaccinia virus
aucguauauuaag

SEQ ID NO: 3279783 - RNA, 12 nt, Vaccinia virus
agaauaauacag

SEQ ID NO: 3279784 - RNA, 22 nt, Vaccinia virus
ggaaaaucgucuucacaaagaa

SEQ ID NO: 3279785 - RNA, 19 nt, Vaccinia virus
uauggaaacuauaauuuug

SEQ ID NO: 3279786 - RNA, 22 nt, Vaccinia virus
ggaugaccauauauuuauuuuc

SEQ ID NO: 3279787 - RNA, 14 nt, Vaccinia virus
aaacauauucuaug

SEQ ID NO: 3279788 - RNA, 13 nt, Vaccinia virus
ccuaauaucauau

SEQ ID NO: 3279789 - RNA, 16 nt, Vaccinia virus
auuuauauauuaaaaa

SEQ ID NO: 3279790 - RNA, 14 nt, Vaccinia virus
caaauguagaagau

SEQ ID NO: 3279791 - RNA, 22 nt, Vaccinia virus
auggaguauuccaagaguuuua

SEQ ID NO: 3279792 - RNA, 23 nt, Vaccinia virus
gacuuguuagauagagaugagau

SEQ ID NO: 3279793 - RNA, 12 nt, Vaccinia virus
ucaucuguuuua

SEQ ID NO: 3279794 - RNA, 17 nt, Vaccinia virus
aagaugcaaacauuaug

SEQ ID NO: 3279795 - RNA, 23 nt, Vaccinia virus
ugcaucuauauaaucuuuuucau

SEQ ID NO: 3279796 - RNA, 17 nt, Vaccinia virus
ucuaauucuacauaugg

SEQ ID NO: 3279797 - RNA, 20 nt, Vaccinia virus
uuccauauagauauaauuuu

SEQ ID NO: 3279798 - RNA, 18 nt, Vaccinia virus
uucuuaaaagguuucaua

SEQ ID NO: 3279799 - RNA, 20 nt, Vaccinia virus
acaacauccuccagagaaga

SEQ ID NO: 3279800 - RNA, 13 nt, Vaccinia virus
auuuaacacuaua

SEQ ID NO: 3279801 - RNA, 17 nt, Vaccinia virus
caugagauugaaugcca

SEQ ID NO: 3279802 - RNA, 19 nt, Vaccinia virus
aacaggugguauauuauau

SEQ ID NO: 3279803 - RNA, 19 nt, Vaccinia virus
acuauuagaauuaaguaga

SEQ ID NO: 3279804 - RNA, 21 nt, Vaccinia virus
aaaacauaaaggaauauacaa

SEQ ID NO: 3279805 - RNA, 15 nt, Vaccinia virus
aaucuaugauauugu

SEQ ID NO: 3279806 - RNA, 20 nt, Vaccinia virus
aagauacuccuucaugaaca

SEQ ID NO: 3279807 - RNA, 15 nt, Vaccinia virus
ccucagguagguuua

SEQ ID NO: 3279808 - RNA, 18 nt, Vaccinia virus
uauaacacuuauguauua

SEQ ID NO: 3279809 - RNA, 23 nt, Vaccinia virus
guuucccuauuaaaauucuuaaa

SEQ ID NO: 3279810 - RNA, 17 nt, Vaccinia virus
gaacgaugucaaaauau

SEQ ID NO: 3279811 - RNA, 20 nt, Vaccinia virus
aaagauuaccguaugauaug

SEQ ID NO: 3279812 - RNA, 18 nt, Vaccinia virus
acuucuaucgauaauugu

SEQ ID NO: 3279813 - RNA, 15 nt, Vaccinia virus
auuucuauucaugaa

SEQ ID NO: 3279814 - RNA, 15 nt, Vaccinia virus
acauuguaugaugau

SEQ ID NO: 3279815 - RNA, 24 nt, Vaccinia virus
aucguauaucuucuucugugauag

SEQ ID NO: 3279816 - RNA, 22 nt, Vaccinia virus
acuauggacgcaugauaagaau

SEQ ID NO: 3279817 - RNA, 16 nt, Vaccinia virus
caucauccauuaauau

SEQ ID NO: 3279818 - RNA, 18 nt, Vaccinia virus
aucuaacagauacaaauu

SEQ ID NO: 3279819 - RNA, 12 nt, Vaccinia virus
uacuaagaaagu

SEQ ID NO: 3279820 - RNA, 22 nt, Vaccinia virus
caaaauucagauucuaucuuua

SEQ ID NO: 3279821 - RNA, 14 nt, Vaccinia virus
auauucuaugaauu

SEQ ID NO: 3279822 - RNA, 19 nt, Vaccinia virus
gauauacauuguauaaaaa

SEQ ID NO: 3279823 - RNA, 15 nt, Vaccinia virus
uaauaaaucaaaaua

SEQ ID NO: 3279824 - RNA, 22 nt, Vaccinia virus
acuacaaaaguuuucuuucaaa

SEQ ID NO: 3279825 - RNA, 14 nt, Vaccinia virus
aacugaaucuaaca

SEQ ID NO: 3279826 - RNA, 14 nt, Vaccinia virus
ucauauuaaugggu

SEQ ID NO: 3279827 - RNA, 14 nt, Vaccinia virus
auuuaucauggagu

SEQ ID NO: 3279828 - RNA, 14 nt, Vaccinia virus
uaauacuguuuucu

SEQ ID NO: 3279829 - RNA, 19 nt, Vaccinia virus
uuaucucagugcaaagauu

SEQ ID NO: 3279830 - RNA, 19 nt, Vaccinia virus
gacuagauccguuaguuua

SEQ ID NO: 3279831 - RNA, 21 nt, Vaccinia virus
cagaacgaauuaugauagaaa

SEQ ID NO: 3279832 - RNA, 18 nt, Vaccinia virus
agauagcuucaucuauau

SEQ ID NO: 3279833 - RNA, 13 nt, Vaccinia virus
caaaaaaugaauu

SEQ ID NO: 3279834 - RNA, 17 nt, Vaccinia virus
auuucaaagacuaacuu

SEQ ID NO: 3279835 - RNA, 21 nt, Vaccinia virus
agucacuauuuuuauaacuaa

SEQ ID NO: 3279836 - RNA, 12 nt, Vaccinia virus
ucauaguuuuua

SEQ ID NO: 3279837 - RNA, 22 nt, Vaccinia virus
auaacgaguacauucugcaaua

SEQ ID NO: 3279838 - RNA, 14 nt, Vaccinia virus
aauauaaaaugaca

SEQ ID NO: 3279839 - RNA, 17 nt, Vaccinia virus
aacgcucuuuugaugau

SEQ ID NO: 3279840 - RNA, 20 nt, Vaccinia virus
gugcaauuagauccaaagaa

SEQ ID NO: 3279841 - RNA, 16 nt, Vaccinia virus
augcaccuagagaauu

SEQ ID NO: 3279842 - RNA, 18 nt, Vaccinia virus
aguauucuauuuuggaaa

SEQ ID NO: 3279843 - RNA, 21 nt, Vaccinia virus
agauaacaacgacuuauaauu

SEQ ID NO: 3279844 - RNA, 21 nt, Vaccinia virus
uuagagauaauauccugaaca

SEQ ID NO: 3279845 - RNA, 20 nt, Vaccinia virus
agauuuuugacuuacauaaa

SEQ ID NO: 3279846 - RNA, 14 nt, Vaccinia virus
aaauuaaaaaagau

SEQ ID NO: 3279847 - RNA, 13 nt, Vaccinia virus
augcgaaggaagu

SEQ ID NO: 3279848 - RNA, 22 nt, Vaccinia virus
cauuaaacccucgaucaugaau

SEQ ID NO: 3279849 - RNA, 16 nt, Vaccinia virus
uaacaguauuauuaau

SEQ ID NO: 3279850 - RNA, 16 nt, Vaccinia virus
auuaucaaauguuguu

SEQ ID NO: 3279851 - RNA, 17 nt, Vaccinia virus
ugauugcagauuugcca

SEQ ID NO: 3279852 - RNA, 22 nt, Vaccinia virus
aaauuuguucguccgucaugau

SEQ ID NO: 3279853 - RNA, 19 nt, Vaccinia virus
uaaucuauaggcaacgaug

SEQ ID NO: 3279854 - RNA, 13 nt, Vaccinia virus
guguuaaaacaau

SEQ ID NO: 3279855 - RNA, 17 nt, Vaccinia virus
ucucuaugauccugaaa

SEQ ID NO: 3279856 - RNA, 22 nt, Vaccinia virus
gaucauuaauaugcucaugaac

SEQ ID NO: 3279857 - RNA, 18 nt, Vaccinia virus
cauacaucgccgucaucu

SEQ ID NO: 3279858 - RNA, 14 nt, Vaccinia virus
ucugauaauuuaga

SEQ ID NO: 3279859 - RNA, 22 nt, Vaccinia virus
guauacagcuggagauuaucau

SEQ ID NO: 3279860 - RNA, 10 nt, Vaccinia virus
gaaauacuua

SEQ ID NO: 3279861 - RNA, 17 nt, Vaccinia virus
caaguggcugcuauuuc

SEQ ID NO: 3279862 - RNA, 21 nt, Vaccinia virus
ucaccaauaaaaauaaacuag

SEQ ID NO: 3279863 - RNA, 15 nt, Vaccinia virus
uguaaaaaauauguu

SEQ ID NO: 3279864 - RNA, 14 nt, Vaccinia virus
aguuuucaucaaug

SEQ ID NO: 3279865 - RNA, 22 nt, Vaccinia virus
cuagacaccuuuucaauguuua

SEQ ID NO: 3279866 - RNA, 23 nt, Vaccinia virus
caaacuuugaagaauuuauauaa

SEQ ID NO: 3279867 - RNA, 22 nt, Vaccinia virus
gcaauauaaaugguauauuuua

SEQ ID NO: 3279868 - RNA, 17 nt, Vaccinia virus
ccauuagguuaaaugau

SEQ ID NO: 3279869 - RNA, 17 nt, Vaccinia virus
auguauuuugaggaaau

SEQ ID NO: 3279870 - RNA, 16 nt, Vaccinia virus
aacuuaaaagaauuac

SEQ ID NO: 3279871 - RNA, 13 nt, Vaccinia virus
gaagaaguuaaua

SEQ ID NO: 3279872 - RNA, 17 nt, Vaccinia virus
agguauuccuuuaucca

SEQ ID NO: 3279873 - RNA, 16 nt, Vaccinia virus
uuaaaauauauuauca

SEQ ID NO: 3279874 - RNA, 14 nt, Vaccinia virus
agcauaaacuauac

SEQ ID NO: 3279875 - RNA, 16 nt, Vaccinia virus
uuuaguuuauucauaa

SEQ ID NO: 3279876 - RNA, 14 nt, Vaccinia virus
uccauuuucuguaa

SEQ ID NO: 3279877 - RNA, 13 nt, Vaccinia virus
cauagaaaaugau

SEQ ID NO: 3279878 - RNA, 22 nt, Vaccinia virus
guguucauccaaggaucuucua

SEQ ID NO: 3279879 - RNA, 14 nt, Vaccinia virus
auuauuuuuggaag

SEQ ID NO: 3279880 - RNA, 17 nt, Vaccinia virus
cuccaccuucauauuua

SEQ ID NO: 3279881 - RNA, 13 nt, Vaccinia virus
gcggacauuuucu

SEQ ID NO: 3279882 - RNA, 19 nt, Vaccinia virus
cuucacauucggagauucu

SEQ ID NO: 3279883 - RNA, 17 nt, Vaccinia virus
cuauuucaacaaacugg

SEQ ID NO: 3279884 - RNA, 16 nt, Vaccinia virus
uagauaccauuaauca

SEQ ID NO: 3279885 - RNA, 16 nt, Vaccinia virus
uucuccaauacuaauu

SEQ ID NO: 3279886 - RNA, 17 nt, Vaccinia virus
uagcccucuucaagaac

SEQ ID NO: 3279887 - RNA, 13 nt, Vaccinia virus
cuacuuuuacagu

SEQ ID NO: 3279888 - RNA, 14 nt, Vaccinia virus
uuuugguucuucuc

SEQ ID NO: 3279889 - RNA, 19 nt, Vaccinia virus
ggcguguuauacggagaag

SEQ ID NO: 3279890 - RNA, 19 nt, Vaccinia virus
uugaccucucagaaucagu

SEQ ID NO: 3279891 - RNA, 14 nt, Vaccinia virus
acauguuacagaau

SEQ ID NO: 3279892 - RNA, 19 nt, Vaccinia virus
agugacacucuauaucuag

SEQ ID NO: 3279893 - RNA, 19 nt, Vaccinia virus
aaaguauccucuacucauu

SEQ ID NO: 3279894 - RNA, 18 nt, Vaccinia virus
aacauuccacauucagau

SEQ ID NO: 3279895 - RNA, 22 nt, Vaccinia virus
uucacgaaaaaugaugaaggca

SEQ ID NO: 3279896 - RNA, 23 nt, Vaccinia virus
uuuuguucacaaaaauacauaaa

SEQ ID NO: 3279897 - RNA, 16 nt, Vaccinia virus
aauacuucauuucuaa

SEQ ID NO: 3279898 - RNA, 17 nt, Vaccinia virus
uacauccgaaauacaaa

SEQ ID NO: 3279899 - RNA, 14 nt, Vaccinia virus
ucgcgauaauguag

SEQ ID NO: 3279900 - RNA, 14 nt, Vaccinia virus
augcaaucaaugau

SEQ ID NO: 3279901 - RNA, 17 nt, Vaccinia virus
gcccauagaguauuauu

SEQ ID NO: 3279902 - RNA, 23 nt, Vaccinia virus
uuagaaaacucucuauuucuuaa

SEQ ID NO: 3279903 - RNA, 15 nt, Vaccinia virus
agagauuuugaaaau

SEQ ID NO: 3279904 - RNA, 13 nt, Vaccinia virus
augacaaacauuu

SEQ ID NO: 3279905 - RNA, 13 nt, Vaccinia virus
cuaacaaaacuau

SEQ ID NO: 3279906 - RNA, 22 nt, Vaccinia virus
auguguauuaucagauauccaa

SEQ ID NO: 3279907 - RNA, 18 nt, Vaccinia virus
auauaaaccgcuauugaa

SEQ ID NO: 3279908 - RNA, 20 nt, Vaccinia virus
aagagauuucaacagacugu

SEQ ID NO: 3279909 - RNA, 22 nt, Vaccinia virus
caugucuaauguguuaaaaaaa

SEQ ID NO: 3279910 - RNA, 14 nt, Vaccinia virus
uuagucauugcaau

SEQ ID NO: 3279911 - RNA, 22 nt, Vaccinia virus
ucuuuuuauucucguuaaacag

SEQ ID NO: 3279912 - RNA, 17 nt, Vaccinia virus
augagugauaaguaaua

SEQ ID NO: 3279913 - RNA, 21 nt, Vaccinia virus
ucuauucgaaaacucuaagaa

SEQ ID NO: 3279914 - RNA, 19 nt, Vaccinia virus
agacuuugccacaacagaa

SEQ ID NO: 3279915 - RNA, 18 nt, Vaccinia virus
aucagaccguacauacau

SEQ ID NO: 3279916 - RNA, 23 nt, Vaccinia virus
acagagccaucuguaaaaagaua

SEQ ID NO: 3279917 - RNA, 18 nt, Vaccinia virus
aucuucuuauaagauugu

SEQ ID NO: 3279918 - RNA, 23 nt, Vaccinia virus
aggaacauuaucaauuuuuacau

SEQ ID NO: 3279919 - RNA, 13 nt, Vaccinia virus
uucacaaauacua

SEQ ID NO: 3279920 - RNA, 16 nt, Vaccinia virus
gagaaugacauaacua

SEQ ID NO: 3279921 - RNA, 21 nt, Vaccinia virus
aucuacgauccaucaaaaaac

SEQ ID NO: 3279922 - RNA, 13 nt, Vaccinia virus
acuauuugucuua

SEQ ID NO: 3279923 - RNA, 13 nt, Vaccinia virus
cuaagaaaacucu

SEQ ID NO: 3279924 - RNA, 14 nt, Vaccinia virus
caucaaaauauguu

SEQ ID NO: 3279925 - RNA, 20 nt, Vaccinia virus
acuacaauugucuaaugaua

SEQ ID NO: 3279926 - RNA, 15 nt, Vaccinia virus
cuucuuguauuuccu

SEQ ID NO: 3279927 - RNA, 20 nt, Vaccinia virus
cucauagucuauuaaguggu

SEQ ID NO: 3279928 - RNA, 22 nt, Vaccinia virus
aaacauuuuauauacuuuucua

SEQ ID NO: 3279929 - RNA, 13 nt, Vaccinia virus
aaugaauauagau

SEQ ID NO: 3279930 - RNA, 17 nt, Vaccinia virus
guugcaauaauaaaagu

SEQ ID NO: 3279931 - RNA, 19 nt, Vaccinia virus
uuuauaggcgguguauuua

SEQ ID NO: 3279932 - RNA, 16 nt, Vaccinia virus
acucaugauuaaaccu

SEQ ID NO: 3279933 - RNA, 15 nt, Vaccinia virus
ccagaacuauuuuua

SEQ ID NO: 3279934 - RNA, 21 nt, Vaccinia virus
uuccguuggaugguaauaaac

SEQ ID NO: 3279935 - RNA, 13 nt, Vaccinia virus
auuuuccauuuau

SEQ ID NO: 3279936 - RNA, 21 nt, Vaccinia virus
cuauuuuuuuauacuucuaau

SEQ ID NO: 3279937 - RNA, 15 nt, Vaccinia virus
uucucgaaaaaauua

SEQ ID NO: 3279938 - RNA, 20 nt, Vaccinia virus
auauagucuuggaucaaaua

SEQ ID NO: 3279939 - RNA, 22 nt, Vaccinia virus
acgucauccuuuccgaaagaua

SEQ ID NO: 3279940 - RNA, 14 nt, Vaccinia virus
uguauuuuggcaua

SEQ ID NO: 3279941 - RNA, 17 nt, Vaccinia virus
auauuugcacacauaau

SEQ ID NO: 3279942 - RNA, 19 nt, Vaccinia virus
auauagagauuagaggagg

SEQ ID NO: 3279943 - RNA, 13 nt, Vaccinia virus
aauagcucaauau

SEQ ID NO: 3279944 - RNA, 19 nt, Vaccinia virus
uuaaguagaucaucugaaa

SEQ ID NO: 3279945 - RNA, 16 nt, Vaccinia virus
caaaaauguucuuaau

SEQ ID NO: 3279946 - RNA, 11 nt, Vaccinia virus
gggaaucgaug

SEQ ID NO: 3279947 - RNA, 14 nt, Vaccinia virus
cuaucucuguaaac

SEQ ID NO: 3279948 - RNA, 19 nt, Vaccinia virus
gcacuaaugcaaauuacuu

SEQ ID NO: 3279949 - RNA, 22 nt, Vaccinia virus
aguuaggguucuuguuccauua

SEQ ID NO: 3279950 - RNA, 14 nt, Vaccinia virus
gugaaauuauuccu

SEQ ID NO: 3279951 - RNA, 18 nt, Vaccinia virus
aaacucguaaaaagauua

SEQ ID NO: 3279952 - RNA, 12 nt, Vaccinia virus
cagaaaugauuu

SEQ ID NO: 3279953 - RNA, 13 nt, Vaccinia virus
auuagaaauggau

SEQ ID NO: 3279954 - RNA, 18 nt, Vaccinia virus
auuaaaugcgucaaucau

SEQ ID NO: 3279955 - RNA, 19 nt, Vaccinia virus
uucuagaauaaguuucaua

SEQ ID NO: 3279956 - RNA, 17 nt, Vaccinia virus
gaaaauuauguaaaaca

SEQ ID NO: 3279957 - RNA, 23 nt, Vaccinia virus
uaaauccaaauucggaucuaauu

SEQ ID NO: 3279958 - RNA, 16 nt, Vaccinia virus
uucaucagauuauuua

SEQ ID NO: 3279959 - RNA, 15 nt, Vaccinia virus
uaaaccagacaaccc

SEQ ID NO: 3279960 - RNA, 21 nt, Vaccinia virus
cuauguuuccccuauaaucuu

SEQ ID NO: 3279961 - RNA, 13 nt, Vaccinia virus
acaaacuauacaa

SEQ ID NO: 3279962 - RNA, 19 nt, Vaccinia virus
acuauguuugguauacugu

SEQ ID NO: 3279963 - RNA, 13 nt, Vaccinia virus
aauuugacuacau

SEQ ID NO: 3279964 - RNA, 20 nt, Vaccinia virus
uauuccuaccaaacaaaauu

SEQ ID NO: 3279965 - RNA, 20 nt, Vaccinia virus
auauuacuauuggcaauugu

SEQ ID NO: 3279966 - RNA, 18 nt, Vaccinia virus
ggauuaucaaaucuuuaa

SEQ ID NO: 3279967 - RNA, 14 nt, Vaccinia virus
agauagaaaugaau

SEQ ID NO: 3279968 - RNA, 18 nt, Vaccinia virus
auucugauuggucaaugu

SEQ ID NO: 3279969 - RNA, 18 nt, Vaccinia virus
uguuuuacaacuaucaua

SEQ ID NO: 3279970 - RNA, 20 nt, Vaccinia virus
ccagugcuauaucucccugu

SEQ ID NO: 3279971 - RNA, 15 nt, Vaccinia virus
aucuauuuuaaauac

SEQ ID NO: 3279972 - RNA, 15 nt, Vaccinia virus
gucuaacauuuuuaa

SEQ ID NO: 3279973 - RNA, 16 nt, Vaccinia virus
aagacgauacuguuuc

SEQ ID NO: 3279974 - RNA, 22 nt, Vaccinia virus
gaaaaucuacuaccgaugaugu

SEQ ID NO: 3279975 - RNA, 14 nt, Vaccinia virus
augccuacauauca

SEQ ID NO: 3279976 - RNA, 14 nt, Vaccinia virus
auaccaacaugucu

SEQ ID NO: 3279977 - RNA, 15 nt, Vaccinia virus
ggcacuuauuucaug

SEQ ID NO: 3279978 - RNA, 13 nt, Vaccinia virus
accaaauuuuaca

SEQ ID NO: 3279979 - RNA, 17 nt, Vaccinia virus
auaucaguguccaucau

SEQ ID NO: 3279980 - RNA, 18 nt, Vaccinia virus
auucauauuaauacuuug

SEQ ID NO: 3279981 - RNA, 13 nt, Vaccinia virus
uaaaaaaacauua

SEQ ID NO: 3279982 - RNA, 17 nt, Vaccinia virus
acaauuuguauuaucca

SEQ ID NO: 3279983 - RNA, 22 nt, Vaccinia virus
ugaucauuuugauauugugaau

SEQ ID NO: 3279984 - RNA, 22 nt, Vaccinia virus
gacuugucaaaucuauauacca

SEQ ID NO: 3279985 - RNA, 21 nt, Vaccinia virus
uucuucuauaguccugucuuu

SEQ ID NO: 3279986 - RNA, 16 nt, Vaccinia virus
cuaaaaaauguagaaa

SEQ ID NO: 3279987 - RNA, 12 nt, Vaccinia virus
gacguagaaaac

SEQ ID NO: 3279988 - RNA, 11 nt, Vaccinia virus
gaguauuucuc

SEQ ID NO: 3279989 - RNA, 16 nt, Vaccinia virus
caucuauuuuaaauac

SEQ ID NO: 3279990 - RNA, 15 nt, Vaccinia virus
uaucguaucauuaaa

SEQ ID NO: 3279991 - RNA, 12 nt, Vaccinia virus
ccggaacaaaaa

SEQ ID NO: 3279992 - RNA, 15 nt, Vaccinia virus
ugucaugaauacguu

SEQ ID NO: 3279993 - RNA, 14 nt, Vaccinia virus
ugaugauagagaua

SEQ ID NO: 3279994 - RNA, 22 nt, Vaccinia virus
ccaaauuaucaucauuaaacau

SEQ ID NO: 3279995 - RNA, 20 nt, Vaccinia virus
guaucgacaucuuuauuauu

SEQ ID NO: 3279996 - RNA, 20 nt, Vaccinia virus
aucuuuacgaauuacuuuac

SEQ ID NO: 3279997 - RNA, 12 nt, Vaccinia virus
caacagaaaaag

SEQ ID NO: 3279998 - RNA, 23 nt, Vaccinia virus
cuacaucuuccuucuuauucuua

SEQ ID NO: 3279999 - RNA, 21 nt, Vaccinia virus
guucuagcccucuucaagaac

SEQ ID NO: 3280000 - RNA, 18 nt, Vaccinia virus
aaaugauguuaccacuuu

SEQ ID NO: 3280001 - RNA, 17 nt, Vaccinia virus
uuucgcgggauacauca

SEQ ID NO: 3280002 - RNA, 18 nt, Vaccinia virus
agauguaaguaugauguc

SEQ ID NO: 3280003 - RNA, 21 nt, Vaccinia virus
cuucagaauacaaucuguauu

SEQ ID NO: 3280004 - RNA, 12 nt, Vaccinia virus
aguucuggaaua

SEQ ID NO: 3280005 - RNA, 14 nt, Vaccinia virus
uaguaauguuuaug

SEQ ID NO: 3280006 - RNA, 19 nt, Vaccinia virus
cucauaaguguauauaucu

SEQ ID NO: 3280007 - RNA, 16 nt, Vaccinia virus
ugcaucuauaugucca

SEQ ID NO: 3280008 - RNA, 18 nt, Vaccinia virus
gccgaguuuaaaacuucu

SEQ ID NO: 3280009 - RNA, 21 nt, Vaccinia virus
aaucaguacguucuucauuua

SEQ ID NO: 3280010 - RNA, 13 nt, Vaccinia virus
auauuagauuuac

SEQ ID NO: 3280011 - RNA, 15 nt, Vaccinia virus
uaaaaaaaaugacuu

SEQ ID NO: 3280012 - RNA, 19 nt, Vaccinia virus
aucauaauuacauuuagac

SEQ ID NO: 3280013 - RNA, 20 nt, Vaccinia virus
uucgucaacaaguuggauga

SEQ ID NO: 3280014 - RNA, 20 nt, Vaccinia virus
auuuuaaaauuaaaaaggaa

SEQ ID NO: 3280015 - RNA, 21 nt, Vaccinia virus
agcuuccagauuuaaaaaggu

SEQ ID NO: 3280016 - RNA, 14 nt, Vaccinia virus
cacaacuuaaugaa

SEQ ID NO: 3280017 - RNA, 19 nt, Vaccinia virus
ucauauauuuauagaagau

SEQ ID NO: 3280018 - RNA, 14 nt, Vaccinia virus
auggaguuguaaau

SEQ ID NO: 3280019 - RNA, 19 nt, Vaccinia virus
guuuaacaaaguuauucau

SEQ ID NO: 3280020 - RNA, 18 nt, Vaccinia virus
gaaccaguaacauaugau

SEQ ID NO: 3280021 - RNA, 16 nt, Vaccinia virus
uucuuauucuuauucu

SEQ ID NO: 3280022 - RNA, 19 nt, Vaccinia virus
accguauuacucuacagua

SEQ ID NO: 3280023 - RNA, 16 nt, Vaccinia virus
cgggaauuaauguccu

SEQ ID NO: 3280024 - RNA, 24 nt, Vaccinia virus
agaagcugguaauaguuuacagau

SEQ ID NO: 3280025 - RNA, 19 nt, Vaccinia virus
cucucaacauuggaauaau

SEQ ID NO: 3280026 - RNA, 15 nt, Vaccinia virus
auggcacgaaauauc

SEQ ID NO: 3280027 - RNA, 20 nt, Vaccinia virus
acaaaauucguuagaauaua

SEQ ID NO: 3280028 - RNA, 16 nt, Vaccinia virus
guauucuauuuuggaa

SEQ ID NO: 3280029 - RNA, 18 nt, Vaccinia virus
aucuauuuuuuugucaug

SEQ ID NO: 3280030 - RNA, 19 nt, Vaccinia virus
auucugaauggauccacca

SEQ ID NO: 3280031 - RNA, 20 nt, Vaccinia virus
uucagaauuaauagauauau

SEQ ID NO: 3280032 - RNA, 15 nt, Vaccinia virus
uccaauuacaaaaac

SEQ ID NO: 3280033 - RNA, 19 nt, Vaccinia virus
agcauucacagauucuauu

SEQ ID NO: 3280034 - RNA, 10 nt, Vaccinia virus
guguuagcca

SEQ ID NO: 3280035 - RNA, 17 nt, Vaccinia virus
auuuccauuuuuaauuu

SEQ ID NO: 3280036 - RNA, 18 nt, Vaccinia virus
aaagaccgaauacauaac

SEQ ID NO: 3280037 - RNA, 14 nt, Vaccinia virus
ucgcuuucuagaau

SEQ ID NO: 3280038 - RNA, 21 nt, Vaccinia virus
ccauuauaaaacuuaugauua

SEQ ID NO: 3280039 - RNA, 19 nt, Vaccinia virus
guuuauuuagauacagaug

SEQ ID NO: 3280040 - RNA, 21 nt, Vaccinia virus
aucauacaaugaauuaauuaa

SEQ ID NO: 3280041 - RNA, 16 nt, Vaccinia virus
aaaugguuagauauua

SEQ ID NO: 3280042 - RNA, 17 nt, Vaccinia virus
uaucaugagauguguau

SEQ ID NO: 3280043 - RNA, 23 nt, Vaccinia virus
uaucaucauuuugauauuacuua

SEQ ID NO: 3280044 - RNA, 19 nt, Vaccinia virus
cauauuauuuuuauguuuu

SEQ ID NO: 3280045 - RNA, 22 nt, Vaccinia virus
auugcuagccucaucuucuaua

SEQ ID NO: 3280046 - RNA, 20 nt, Vaccinia virus
agaauuuucauggauguaga

SEQ ID NO: 3280047 - RNA, 15 nt, Vaccinia virus
ucuagagauuguacu

SEQ ID NO: 3280048 - RNA, 21 nt, Vaccinia virus
ccauccaagucaauaucuuua

SEQ ID NO: 3280049 - RNA, 17 nt, Vaccinia virus
cauuuuuuaaguauuug

SEQ ID NO: 3280050 - RNA, 19 nt, Vaccinia virus
aacgaugccuuuuguaaau

SEQ ID NO: 3280051 - RNA, 18 nt, Vaccinia virus
acuaaacacauuauuaau

SEQ ID NO: 3280052 - RNA, 22 nt, Vaccinia virus
acuuaaugaagaucuauuucca

SEQ ID NO: 3280053 - RNA, 14 nt, Vaccinia virus
cuaaaaucugcaua

SEQ ID NO: 3280054 - RNA, 17 nt, Vaccinia virus
aaaacauuauaauaaua

SEQ ID NO: 3280055 - RNA, 14 nt, Vaccinia virus
ucuacaugaaauag

SEQ ID NO: 3280056 - RNA, 15 nt, Vaccinia virus
uucaaccauucauaa

SEQ ID NO: 3280057 - RNA, 21 nt, Vaccinia virus
gaaaaugcagaaaugauuuug

SEQ ID NO: 3280058 - RNA, 22 nt, Vaccinia virus
gccuaaacccgacuuaguuaua

SEQ ID NO: 3280059 - RNA, 20 nt, Vaccinia virus
agagaaugaaauauauacau

SEQ ID NO: 3280060 - RNA, 19 nt, Vaccinia virus
aaaggauacuaaacauugu

SEQ ID NO: 3280061 - RNA, 22 nt, Vaccinia virus
acaauuuguauuuuuuaaucua

SEQ ID NO: 3280062 - RNA, 16 nt, Vaccinia virus
ucacucuucgaaaaga

SEQ ID NO: 3280063 - RNA, 21 nt, Vaccinia virus
aauagauuggaugguugacau

SEQ ID NO: 3280064 - RNA, 16 nt, Vaccinia virus
cauagggcuaaauguc

SEQ ID NO: 3280065 - RNA, 12 nt, Vaccinia virus
uuuuguaauaag

SEQ ID NO: 3280066 - RNA, 17 nt, Vaccinia virus
caauaugugaaucauuu

SEQ ID NO: 3280067 - RNA, 17 nt, Vaccinia virus
acuugagacuugauaga

SEQ ID NO: 3280068 - RNA, 18 nt, Vaccinia virus
auucuguucuauucaaag

SEQ ID NO: 3280069 - RNA, 21 nt, Vaccinia virus
auucuugaaacuuuuuagaau

SEQ ID NO: 3280070 - RNA, 18 nt, Vaccinia virus
uguacgauacauaauguu

SEQ ID NO: 3280071 - RNA, 20 nt, Vaccinia virus
agcuuucauaguuagauaca

SEQ ID NO: 3280072 - RNA, 13 nt, Vaccinia virus
ccauuuuuccaua

SEQ ID NO: 3280073 - RNA, 16 nt, Vaccinia virus
ucggauacucuauuaa

SEQ ID NO: 3280074 - RNA, 18 nt, Vaccinia virus
gaauaaaacucuacuaua

SEQ ID NO: 3280075 - RNA, 18 nt, Vaccinia virus
auggaugagaacacguau

SEQ ID NO: 3280076 - RNA, 20 nt, Vaccinia virus
aucuugaugcgguuuaauaa

SEQ ID NO: 3280077 - RNA, 12 nt, Vaccinia virus
aaugaacucauc

SEQ ID NO: 3280078 - RNA, 16 nt, Vaccinia virus
uuucaucuauaucauu

SEQ ID NO: 3280079 - RNA, 12 nt, Vaccinia virus
guaaaauaucua

SEQ ID NO: 3280080 - RNA, 13 nt, Vaccinia virus
uguagaacucaug

SEQ ID NO: 3280081 - RNA, 20 nt, Vaccinia virus
ucauagccgcucuuagaguu

SEQ ID NO: 3280082 - RNA, 16 nt, Vaccinia virus
ccaauuucaaggacaa

SEQ ID NO: 3280083 - RNA, 15 nt, Vaccinia virus
cauaaauaaaaacuu

SEQ ID NO: 3280084 - RNA, 13 nt, Vaccinia virus
acuagaagaaagu

SEQ ID NO: 3280085 - RNA, 14 nt, Vaccinia virus
uaguucgucauaac

SEQ ID NO: 3280086 - RNA, 23 nt, Vaccinia virus
uaauagcagaaagcuauaacuug

SEQ ID NO: 3280087 - RNA, 19 nt, Vaccinia virus
auagauguucaucauauaa

SEQ ID NO: 3280088 - RNA, 16 nt, Vaccinia virus
gugaugucuuggaauc

SEQ ID NO: 3280089 - RNA, 13 nt, Vaccinia virus
ugaagagaguucu

SEQ ID NO: 3280090 - RNA, 17 nt, Vaccinia virus
gaauaccauuaaacaau

SEQ ID NO: 3280091 - RNA, 13 nt, Vaccinia virus
aaauacauaaaga

SEQ ID NO: 3280092 - RNA, 19 nt, Vaccinia virus
ucuuaccaucuucuuugau

SEQ ID NO: 3280093 - RNA, 20 nt, Vaccinia virus
cuagucauaauaucuuuaau

SEQ ID NO: 3280094 - RNA, 13 nt, Vaccinia virus
aggaugaauuuga

SEQ ID NO: 3280095 - RNA, 16 nt, Vaccinia virus
gucugucaaaucaucu

SEQ ID NO: 3280096 - RNA, 12 nt, Vaccinia virus
auuuuguaacug

SEQ ID NO: 3280097 - RNA, 15 nt, Vaccinia virus
uguagaaaacaacaa

SEQ ID NO: 3280098 - RNA, 14 nt, Vaccinia virus
uuccacaauacgag

SEQ ID NO: 3280099 - RNA, 17 nt, Vaccinia virus
uacuucaccacccuugu

SEQ ID NO: 3280100 - RNA, 22 nt, Vaccinia virus
auaauguuucuauguuuucuac

SEQ ID NO: 3280101 - RNA, 23 nt, Vaccinia virus
uaucuccacucucgauaaaucua

SEQ ID NO: 3280102 - RNA, 16 nt, Vaccinia virus
ucgaugcauguuagau

SEQ ID NO: 3280103 - RNA, 17 nt, Vaccinia virus
auggaugucaucaaugu

SEQ ID NO: 3280104 - RNA, 14 nt, Vaccinia virus
uaaauaaauacuuu

SEQ ID NO: 3280105 - RNA, 13 nt, Vaccinia virus
uaucaauagcagu

SEQ ID NO: 3280106 - RNA, 13 nt, Vaccinia virus
auugaagaaggag

SEQ ID NO: 3280107 - RNA, 19 nt, Vaccinia virus
gaaugcuguuaugugcaua

SEQ ID NO: 3280108 - RNA, 21 nt, Vaccinia virus
aacgguuacuaucaauauuau

SEQ ID NO: 3280109 - RNA, 12 nt, Vaccinia virus
auuauaccaaaa

SEQ ID NO: 3280110 - RNA, 15 nt, Vaccinia virus
aaacgaauuacugaa

SEQ ID NO: 3280111 - RNA, 18 nt, Vaccinia virus
agaauugcugcaauauau

SEQ ID NO: 3280112 - RNA, 18 nt, Vaccinia virus
caguccgguucuuaauau

SEQ ID NO: 3280113 - RNA, 12 nt, Vaccinia virus
uuugcacacaua

SEQ ID NO: 3280114 - RNA, 20 nt, Vaccinia virus
acaaaauuuggguuuaauuu

SEQ ID NO: 3280115 - RNA, 23 nt, Vaccinia virus
caauuuauagucgcgcuuuacau

SEQ ID NO: 3280116 - RNA, 21 nt, Vaccinia virus
acguuguaaaacauaaaggaa

SEQ ID NO: 3280117 - RNA, 19 nt, Vaccinia virus
aucacauaucuaacaaugg

SEQ ID NO: 3280118 - RNA, 21 nt, Vaccinia virus
ugauacucucaaccauuauua

SEQ ID NO: 3280119 - RNA, 20 nt, Vaccinia virus
agaaucauugcuguaaacaa

SEQ ID NO: 3280120 - RNA, 15 nt, Vaccinia virus
agacgaauacauaua

SEQ ID NO: 3280121 - RNA, 22 nt, Vaccinia virus
agaaucagugaauaaauucaag

SEQ ID NO: 3280122 - RNA, 16 nt, Vaccinia virus
uguguaugaaaugcuu

SEQ ID NO: 3280123 - RNA, 23 nt, Vaccinia virus
aucaaaguggaaagaugcuguug

SEQ ID NO: 3280124 - RNA, 16 nt, Vaccinia virus
agaaagucagaaucua

SEQ ID NO: 3280125 - RNA, 14 nt, Vaccinia virus
ucuuuaaugugaaa

SEQ ID NO: 3280126 - RNA, 18 nt, Vaccinia virus
uauacuccucauuaacau

SEQ ID NO: 3280127 - RNA, 22 nt, Vaccinia virus
gguugccgcaaauagauagaac

SEQ ID NO: 3280128 - RNA, 18 nt, Vaccinia virus
gugauaucgaauauuuua

SEQ ID NO: 3280129 - RNA, 16 nt, Vaccinia virus
gaaguuaaacugugaa

SEQ ID NO: 3280130 - RNA, 14 nt, Vaccinia virus
gucuggauuaaucu

SEQ ID NO: 3280131 - RNA, 15 nt, Vaccinia virus
gauaaugaacauaua

SEQ ID NO: 3280132 - RNA, 16 nt, Vaccinia virus
auucgaaauuagaaag

SEQ ID NO: 3280133 - RNA, 16 nt, Vaccinia virus
uaucagacuacuuauu

SEQ ID NO: 3280134 - RNA, 21 nt, Vaccinia virus
aauuacggcgaaauaaagaaa

SEQ ID NO: 3280135 - RNA, 19 nt, Vaccinia virus
gggacgcguauauguuucu

SEQ ID NO: 3280136 - RNA, 17 nt, Vaccinia virus
gacuuuauaauuucauc

SEQ ID NO: 3280137 - RNA, 15 nt, Vaccinia virus
auuacuuaucauuua

SEQ ID NO: 3280138 - RNA, 23 nt, Vaccinia virus
uguacuucgaugagauugaucau

SEQ ID NO: 3280139 - RNA, 16 nt, Vaccinia virus
acaagaucaaaguaca

SEQ ID NO: 3280140 - RNA, 18 nt, Vaccinia virus
gaaacuauagauaaugau

SEQ ID NO: 3280141 - RNA, 16 nt, Vaccinia virus
caggaauaugacuauu

SEQ ID NO: 3280142 - RNA, 19 nt, Vaccinia virus
auuaauaguuuuauuugaa

SEQ ID NO: 3280143 - RNA, 22 nt, Vaccinia virus
uucaacaaguaggauuuuucca

SEQ ID NO: 3280144 - RNA, 23 nt, Vaccinia virus
uuuacacaguaaccaaaaugaaa

SEQ ID NO: 3280145 - RNA, 15 nt, Vaccinia virus
auuucauuaauuaau

SEQ ID NO: 3280146 - RNA, 23 nt, Vaccinia virus
guguauacaccaacaguaugaaa

SEQ ID NO: 3280147 - RNA, 17 nt, Vaccinia virus
ugaauucucauuuugca

SEQ ID NO: 3280148 - RNA, 16 nt, Vaccinia virus
uuaaaaaguuaucuuu

SEQ ID NO: 3280149 - RNA, 19 nt, Vaccinia virus
auauuguucuuaauagaca

SEQ ID NO: 3280150 - RNA, 18 nt, Vaccinia virus
aaacuguuuaauauugca

SEQ ID NO: 3280151 - RNA, 14 nt, Vaccinia virus
uauccauuggaaaa

SEQ ID NO: 3280152 - RNA, 21 nt, Vaccinia virus
aguagauacgcaaacuuagau

SEQ ID NO: 3280153 - RNA, 16 nt, Vaccinia virus
aucuaacagaaacguu

SEQ ID NO: 3280154 - RNA, 18 nt, Vaccinia virus
caaaugaaaaaaauacuu

SEQ ID NO: 3280155 - RNA, 18 nt, Vaccinia virus
auuaaacguauaaaaacg

SEQ ID NO: 3280156 - RNA, 15 nt, Vaccinia virus
auucaagucaaagaa

SEQ ID NO: 3280157 - RNA, 22 nt, Vaccinia virus
acagaauaaacaaaauaaugua

SEQ ID NO: 3280158 - RNA, 20 nt, Vaccinia virus
uuucuaacucgguaaaaaaa

SEQ ID NO: 3280159 - RNA, 14 nt, Vaccinia virus
augaucaaaaagag

SEQ ID NO: 3280160 - RNA, 17 nt, Vaccinia virus
uaaacauaagacuuauu

SEQ ID NO: 3280161 - RNA, 14 nt, Vaccinia virus
auacguaaugaagu

SEQ ID NO: 3280162 - RNA, 20 nt, Vaccinia virus
aagauacuugaagacauucc

SEQ ID NO: 3280163 - RNA, 20 nt, Vaccinia virus
aaguugugacacguuucaau

SEQ ID NO: 3280164 - RNA, 22 nt, Vaccinia virus
acugaagucugauauucagaaa

SEQ ID NO: 3280165 - RNA, 18 nt, Vaccinia virus
accuauagcaucaauaau

SEQ ID NO: 3280166 - RNA, 19 nt, Vaccinia virus
cguauaaaguuauauaauu

SEQ ID NO: 3280167 - RNA, 20 nt, Vaccinia virus
uuaccccucauaguauuaau

SEQ ID NO: 3280168 - RNA, 15 nt, Vaccinia virus
auauuguuuaauaua

SEQ ID NO: 3280169 - RNA, 15 nt, Vaccinia virus
aucauagucgaacau

SEQ ID NO: 3280170 - RNA, 22 nt, Vaccinia virus
uauauggaacacgauuauuaua

SEQ ID NO: 3280171 - RNA, 22 nt, Vaccinia virus
uucaucaauagacauaagaaau

SEQ ID NO: 3280172 - RNA, 23 nt, Vaccinia virus
aagaaacugacuugauaaaaaug

SEQ ID NO: 3280173 - RNA, 23 nt, Vaccinia virus
ucaaaucgcccaucuauuacaaa

SEQ ID NO: 3280174 - RNA, 13 nt, Vaccinia virus
aaaauaauaauua

SEQ ID NO: 3280175 - RNA, 17 nt, Vaccinia virus
guaacuauguaaaugau

SEQ ID NO: 3280176 - RNA, 14 nt, Vaccinia virus
uaaaguauuuggaa

SEQ ID NO: 3280177 - RNA, 15 nt, Vaccinia virus
uacguaaaaaagaua

SEQ ID NO: 3280178 - RNA, 15 nt, Vaccinia virus
aucucaucauuccau

SEQ ID NO: 3280179 - RNA, 22 nt, Vaccinia virus
aagcggaacaauaaacaaaaua

SEQ ID NO: 3280180 - RNA, 11 nt, Vaccinia virus
agaauuucauu

SEQ ID NO: 3280181 - RNA, 17 nt, Vaccinia virus
aaauuccccauauacca

SEQ ID NO: 3280182 - RNA, 23 nt, Vaccinia virus
uaucaggcgucuccauguuugau

SEQ ID NO: 3280183 - RNA, 11 nt, Vaccinia virus
aucauacuuac

SEQ ID NO: 3280184 - RNA, 23 nt, Vaccinia virus
caaaacgaggauaguugauuuau

SEQ ID NO: 3280185 - RNA, 21 nt, Vaccinia virus
ccaacauggugaauucuugca

SEQ ID NO: 3280186 - RNA, 19 nt, Vaccinia virus
ucauuucuccaaagaauau

SEQ ID NO: 3280187 - RNA, 22 nt, Vaccinia virus
uauuaauccacuauauauucua

SEQ ID NO: 3280188 - RNA, 15 nt, Vaccinia virus
uaguaauuugugcau

SEQ ID NO: 3280189 - RNA, 14 nt, Vaccinia virus
guuuaauucuucau

SEQ ID NO: 3280190 - RNA, 16 nt, Vaccinia virus
uaccgaagaauuaaau

SEQ ID NO: 3280191 - RNA, 16 nt, Vaccinia virus
ucaaaugguacaaaaa

SEQ ID NO: 3280192 - RNA, 21 nt, Vaccinia virus
uaaguauuuauaaaacucaua

SEQ ID NO: 3280193 - RNA, 16 nt, Vaccinia virus
gucaaaugucuauucu

SEQ ID NO: 3280194 - RNA, 23 nt, Vaccinia virus
guguaaacgaaaacuauauacua

SEQ ID NO: 3280195 - RNA, 23 nt, Vaccinia virus
caucuaucaucuccacacaguca

SEQ ID NO: 3280196 - RNA, 14 nt, Vaccinia virus
uaagaugucauaau

SEQ ID NO: 3280197 - RNA, 14 nt, Vaccinia virus
gcuauaaugaugau

SEQ ID NO: 3280198 - RNA, 16 nt, Vaccinia virus
auagugaaacaaaaua

SEQ ID NO: 3280199 - RNA, 21 nt, Vaccinia virus
uaaaauacuaaugcaucuauu

SEQ ID NO: 3280200 - RNA, 19 nt, Vaccinia virus
caguuaacgaaagcaaaga

SEQ ID NO: 3280201 - RNA, 19 nt, Vaccinia virus
cgaguugaguuuauccuua

SEQ ID NO: 3280202 - RNA, 13 nt, Vaccinia virus
auauguuuguaaa

SEQ ID NO: 3280203 - RNA, 21 nt, Vaccinia virus
aaaugaacuuuuacagaucua

SEQ ID NO: 3280204 - RNA, 15 nt, Vaccinia virus
ucugauaauuuagau

SEQ ID NO: 3280205 - RNA, 17 nt, Vaccinia virus
uguagaugguucuuuaa

SEQ ID NO: 3280206 - RNA, 22 nt, Vaccinia virus
guaaguaucuuauguauauguu

SEQ ID NO: 3280207 - RNA, 18 nt, Vaccinia virus
guuacauuuauacuucuu

SEQ ID NO: 3280208 - RNA, 18 nt, Vaccinia virus
ccucagaggauauguuug

SEQ ID NO: 3280209 - RNA, 17 nt, Vaccinia virus
aucaaaugguugauaau

SEQ ID NO: 3280210 - RNA, 17 nt, Vaccinia virus
uagaaacuauacgaaau

SEQ ID NO: 3280211 - RNA, 15 nt, Vaccinia virus
uagcgaagaaugcuu

SEQ ID NO: 3280212 - RNA, 13 nt, Vaccinia virus
uaaguucuuuaua

SEQ ID NO: 3280213 - RNA, 20 nt, Vaccinia virus
ugacauuuucacaaauacua

SEQ ID NO: 3280214 - RNA, 17 nt, Vaccinia virus
cuugauacuuuuucuag

SEQ ID NO: 3280215 - RNA, 15 nt, Vaccinia virus
aacuaucuaaaugua

SEQ ID NO: 3280216 - RNA, 20 nt, Vaccinia virus
agaaaaugcagaaaugauuu

SEQ ID NO: 3280217 - RNA, 15 nt, Vaccinia virus
ucaauaauauaucuu

SEQ ID NO: 3280218 - RNA, 16 nt, Vaccinia virus
ucaagaagauaucaga

SEQ ID NO: 3280219 - RNA, 12 nt, Vaccinia virus
agggaauuauug

SEQ ID NO: 3280220 - RNA, 13 nt, Vaccinia virus
ucuccuuucucuu

SEQ ID NO: 3280221 - RNA, 16 nt, Vaccinia virus
uguuuaauuuuuucua

SEQ ID NO: 3280222 - RNA, 19 nt, Vaccinia virus
auauuggagcaaaauccua

SEQ ID NO: 3280223 - RNA, 17 nt, Vaccinia virus
uccuucaguuugagaaa

SEQ ID NO: 3280224 - RNA, 17 nt, Vaccinia virus
agacuaugggaauauau

SEQ ID NO: 3280225 - RNA, 17 nt, Vaccinia virus
gauauaauuuuauuaau

SEQ ID NO: 3280226 - RNA, 19 nt, Vaccinia virus
aacuuauuuuauacagacu

SEQ ID NO: 3280227 - RNA, 20 nt, Vaccinia virus
guuaucaucguauaaauuaa

SEQ ID NO: 3280228 - RNA, 16 nt, Vaccinia virus
auuuagacaacaggau

SEQ ID NO: 3280229 - RNA, 14 nt, Vaccinia virus
acaucccuuuucca

SEQ ID NO: 3280230 - RNA, 14 nt, Vaccinia virus
cuucgauagauauu

SEQ ID NO: 3280231 - RNA, 13 nt, Vaccinia virus
cuuaacaauaaau

SEQ ID NO: 3280232 - RNA, 18 nt, Vaccinia virus
cuaccgcaucaucaucgu

SEQ ID NO: 3280233 - RNA, 12 nt, Vaccinia virus
uuaaaauuauua

SEQ ID NO: 3280234 - RNA, 20 nt, Vaccinia virus
gccauacucagaauuaugau

SEQ ID NO: 3280235 - RNA, 22 nt, Vaccinia virus
auaaaugguuucgaagaucuuc

SEQ ID NO: 3280236 - RNA, 20 nt, Vaccinia virus
uuucuguaaauucaugauug

SEQ ID NO: 3280237 - RNA, 21 nt, Vaccinia virus
ugcuguguguaugaaaugcuu

SEQ ID NO: 3280238 - RNA, 20 nt, Vaccinia virus
auuuacuuuuucaucuuuac

SEQ ID NO: 3280239 - RNA, 20 nt, Vaccinia virus
auuguacgucucaauagcug

SEQ ID NO: 3280240 - RNA, 14 nt, Vaccinia virus
uuucgcuauuucua

SEQ ID NO: 3280241 - RNA, 13 nt, Vaccinia virus
uuaauaauuguua

SEQ ID NO: 3280242 - RNA, 19 nt, Vaccinia virus
ucuguacuucuguacaaaa

SEQ ID NO: 3280243 - RNA, 17 nt, Vaccinia virus
auuucuauuucuguaua

SEQ ID NO: 3280244 - RNA, 15 nt, Vaccinia virus
uugcggcauauauaa

SEQ ID NO: 3280245 - RNA, 17 nt, Vaccinia virus
cguacaaggauuucaag

SEQ ID NO: 3280246 - RNA, 14 nt, Vaccinia virus
agggguauacuucu

SEQ ID NO: 3280247 - RNA, 18 nt, Vaccinia virus
gcauuaauacuguuuucu

SEQ ID NO: 3280248 - RNA, 13 nt, Vaccinia virus
guauaaaaauuaa

SEQ ID NO: 3280249 - RNA, 22 nt, Vaccinia virus
cuuuucauccaguugaauggau

SEQ ID NO: 3280250 - RNA, 14 nt, Vaccinia virus
auauuguagaauac

SEQ ID NO: 3280251 - RNA, 13 nt, Vaccinia virus
cauaauauauaca

SEQ ID NO: 3280252 - RNA, 18 nt, Vaccinia virus
auuuuaucgauucuaaug

SEQ ID NO: 3280253 - RNA, 19 nt, Vaccinia virus
uuaacucagaagauuauua

SEQ ID NO: 3280254 - RNA, 15 nt, Vaccinia virus
cuacaucuuuaagau

SEQ ID NO: 3280255 - RNA, 15 nt, Vaccinia virus
accgguaaucuuguc

SEQ ID NO: 3280256 - RNA, 15 nt, Vaccinia virus
uagaugauauuguaa

SEQ ID NO: 3280257 - RNA, 15 nt, Vaccinia virus
cauggacauacuaau

SEQ ID NO: 3280258 - RNA, 15 nt, Vaccinia virus
aguucauaacagaua

SEQ ID NO: 3280259 - RNA, 19 nt, Vaccinia virus
aauuuaaaguguaaauaua

SEQ ID NO: 3280260 - RNA, 15 nt, Vaccinia virus
aaaacgauuaaacaa

SEQ ID NO: 3280261 - RNA, 17 nt, Vaccinia virus
uaaaaaaguuaaaacuu

SEQ ID NO: 3280262 - RNA, 19 nt, Vaccinia virus
gauaguacagcguaguaca

SEQ ID NO: 3280263 - RNA, 22 nt, Vaccinia virus
auugauugcuguuauuaaugga

SEQ ID NO: 3280264 - RNA, 13 nt, Vaccinia virus
gugauaguuuaua

SEQ ID NO: 3280265 - RNA, 18 nt, Vaccinia virus
acgaugcugaguauuuca

SEQ ID NO: 3280266 - RNA, 19 nt, Vaccinia virus
ucaaguuaucgucuguauu

SEQ ID NO: 3280267 - RNA, 15 nt, Vaccinia virus
ugaguguagaugcug

SEQ ID NO: 3280268 - RNA, 16 nt, Vaccinia virus
caaaacucaaauguua

SEQ ID NO: 3280269 - RNA, 13 nt, Vaccinia virus
cgucuacaaaaaa

SEQ ID NO: 3280270 - RNA, 18 nt, Vaccinia virus
agauguuugagaauauau

SEQ ID NO: 3280271 - RNA, 19 nt, Vaccinia virus
aaaaagauuucagaaucua

SEQ ID NO: 3280272 - RNA, 14 nt, Vaccinia virus
uaggagaauuauuu

SEQ ID NO: 3280273 - RNA, 20 nt, Vaccinia virus
uaaauaccauacaauuuaug

SEQ ID NO: 3280274 - RNA, 18 nt, Vaccinia virus
aggaauaucugaugaugu

SEQ ID NO: 3280275 - RNA, 21 nt, Vaccinia virus
aucacccgcgugugagagaag

SEQ ID NO: 3280276 - RNA, 13 nt, Vaccinia virus
uaacaugaacgau

SEQ ID NO: 3280277 - RNA, 17 nt, Vaccinia virus
aaacugcaaauguagua

SEQ ID NO: 3280278 - RNA, 17 nt, Vaccinia virus
accuaagcaagaaagau

SEQ ID NO: 3280279 - RNA, 22 nt, Vaccinia virus
uacuccauuauauauuccuuga

SEQ ID NO: 3280280 - RNA, 11 nt, Vaccinia virus
uacuuaaugaa

SEQ ID NO: 3280281 - RNA, 14 nt, Vaccinia virus
acuuaaaaauggau

SEQ ID NO: 3280282 - RNA, 22 nt, Vaccinia virus
uggaagaugcuauaucaaaaua

SEQ ID NO: 3280283 - RNA, 14 nt, Vaccinia virus
ucaauaucaacaag

SEQ ID NO: 3280284 - RNA, 20 nt, Vaccinia virus
uacucuaaucuuuaauagau

SEQ ID NO: 3280285 - RNA, 19 nt, Vaccinia virus
augauaaaggagaauagcg

SEQ ID NO: 3280286 - RNA, 22 nt, Vaccinia virus
gaagaacguguauuaaauagaa

SEQ ID NO: 3280287 - RNA, 22 nt, Vaccinia virus
cagauuaauaguuuuauuugaa

SEQ ID NO: 3280288 - RNA, 20 nt, Vaccinia virus
aucuugguuauauuauuaga

SEQ ID NO: 3280289 - RNA, 14 nt, Vaccinia virus
uagaauaaauuagc

SEQ ID NO: 3280290 - RNA, 13 nt, Vaccinia virus
aacucuaaucaaa

SEQ ID NO: 3280291 - RNA, 20 nt, Vaccinia virus
ccaucagaauguuucccuga

SEQ ID NO: 3280292 - RNA, 21 nt, Vaccinia virus
auacaauaucuucgguaucuu

SEQ ID NO: 3280293 - RNA, 15 nt, Vaccinia virus
caugguauauggaua

SEQ ID NO: 3280294 - RNA, 18 nt, Vaccinia virus
uacaacauuccaaagauc

SEQ ID NO: 3280295 - RNA, 18 nt, Vaccinia virus
augaauuuuuaaaaucau

SEQ ID NO: 3280296 - RNA, 17 nt, Vaccinia virus
ucauguguucaaaguau

SEQ ID NO: 3280297 - RNA, 21 nt, Vaccinia virus
augcaaagauguuuaaugaua

SEQ ID NO: 3280298 - RNA, 15 nt, Vaccinia virus
cauaauuaauacaau

SEQ ID NO: 3280299 - RNA, 13 nt, Vaccinia virus
auacauguuuuau

SEQ ID NO: 3280300 - RNA, 15 nt, Vaccinia virus
uccaauaaauuauuu

SEQ ID NO: 3280301 - RNA, 20 nt, Vaccinia virus
aguuaaacugugaaugucaa

SEQ ID NO: 3280302 - RNA, 13 nt, Vaccinia virus
ugguuuucuaaau

SEQ ID NO: 3280303 - RNA, 17 nt, Vaccinia virus
ucgauaacacauuuuca

SEQ ID NO: 3280304 - RNA, 21 nt, Vaccinia virus
auuuucugacgaaacgaugaa

SEQ ID NO: 3280305 - RNA, 14 nt, Vaccinia virus
gaugcauaaguaca

SEQ ID NO: 3280306 - RNA, 21 nt, Vaccinia virus
auacucugcccuuuauuacau

SEQ ID NO: 3280307 - RNA, 23 nt, Vaccinia virus
auacgauaguuuguuucuggaau

SEQ ID NO: 3280308 - RNA, 15 nt, Vaccinia virus
agauuuccaaagaua

SEQ ID NO: 3280309 - RNA, 18 nt, Vaccinia virus
uaaaugaaaaaaaacuag

SEQ ID NO: 3280310 - RNA, 21 nt, Vaccinia virus
acuuucaaugagauaaauaug

SEQ ID NO: 3280311 - RNA, 20 nt, Vaccinia virus
gauaagauauguuuauucau

SEQ ID NO: 3280312 - RNA, 20 nt, Vaccinia virus
aaauaaguaguaauaaugau

SEQ ID NO: 3280313 - RNA, 19 nt, Vaccinia virus
gaauauacuucauaaaaga

SEQ ID NO: 3280314 - RNA, 20 nt, Vaccinia virus
cugccauuaauaucucuauu

SEQ ID NO: 3280315 - RNA, 21 nt, Vaccinia virus
uuaaauaucaaccgcaaauca

SEQ ID NO: 3280316 - RNA, 18 nt, Vaccinia virus
caccuaucuugugcauuu

SEQ ID NO: 3280317 - RNA, 16 nt, Vaccinia virus
cccacugaugagaugu

SEQ ID NO: 3280318 - RNA, 15 nt, Vaccinia virus
acaaaaucuaaacaa

SEQ ID NO: 3280319 - RNA, 17 nt, Vaccinia virus
aguaaguuuaugauggu

SEQ ID NO: 3280320 - RNA, 18 nt, Vaccinia virus
gaacuauaaaaacagaua

SEQ ID NO: 3280321 - RNA, 19 nt, Vaccinia virus
aaauguuaccggauuuaug

SEQ ID NO: 3280322 - RNA, 23 nt, Vaccinia virus
gaaaguauuuuuguguuaaaaca

SEQ ID NO: 3280323 - RNA, 19 nt, Vaccinia virus
agaaaucauauaugauauu

SEQ ID NO: 3280324 - RNA, 23 nt, Vaccinia virus
agaugcuauguauauauauuucu

SEQ ID NO: 3280325 - RNA, 20 nt, Vaccinia virus
auacaaaauuugcaucuaca

SEQ ID NO: 3280326 - RNA, 23 nt, Vaccinia virus
uaauuagagacuuuauaacagau

SEQ ID NO: 3280327 - RNA, 16 nt, Vaccinia virus
uauagauguucacauu

SEQ ID NO: 3280328 - RNA, 23 nt, Vaccinia virus
uacuaugaauaucuucuaugaaa

SEQ ID NO: 3280329 - RNA, 18 nt, Vaccinia virus
uuaucaucauccauuaau

SEQ ID NO: 3280330 - RNA, 15 nt, Vaccinia virus
uaauaucuucuggaa

SEQ ID NO: 3280331 - RNA, 14 nt, Vaccinia virus
uaggauuuaaacaa

SEQ ID NO: 3280332 - RNA, 14 nt, Vaccinia virus
uaauaugaguaaaa

SEQ ID NO: 3280333 - RNA, 16 nt, Vaccinia virus
guuauaagauuacuua

SEQ ID NO: 3280334 - RNA, 17 nt, Vaccinia virus
cagaaucaguauauauu

SEQ ID NO: 3280335 - RNA, 20 nt, Vaccinia virus
ucuuuaguaaacauaucaua

SEQ ID NO: 3280336 - RNA, 14 nt, Vaccinia virus
auucuaauggauga

SEQ ID NO: 3280337 - RNA, 22 nt, Vaccinia virus
auauuuaagugauauaaaacua

SEQ ID NO: 3280338 - RNA, 16 nt, Vaccinia virus
uaaauuuuacaaaucu

SEQ ID NO: 3280339 - RNA, 15 nt, Vaccinia virus
aaaagaccaauaaua

SEQ ID NO: 3280340 - RNA, 14 nt, Vaccinia virus
gcuacuaucuugua

SEQ ID NO: 3280341 - RNA, 14 nt, Vaccinia virus
agauacagauguua

SEQ ID NO: 3280342 - RNA, 21 nt, Vaccinia virus
aaauuuuaaagaguacacaau

SEQ ID NO: 3280343 - RNA, 13 nt, Vaccinia virus
uuguguuagauga

SEQ ID NO: 3280344 - RNA, 12 nt, Vaccinia virus
ucaaagaaauaa

SEQ ID NO: 3280345 - RNA, 17 nt, Vaccinia virus
aaugcgaggaaauguau

SEQ ID NO: 3280346 - RNA, 21 nt, Vaccinia virus
aaaccaaggacuuuguagaaa

SEQ ID NO: 3280347 - RNA, 23 nt, Vaccinia virus
uacuacuggucuuucucaaccau

SEQ ID NO: 3280348 - RNA, 22 nt, Vaccinia virus
gcauuugugccgcauacagauc

SEQ ID NO: 3280349 - RNA, 20 nt, Vaccinia virus
cuaauguauuaguuaaauau

SEQ ID NO: 3280350 - RNA, 18 nt, Vaccinia virus
auauaaaucuaaaauuga

SEQ ID NO: 3280351 - RNA, 14 nt, Vaccinia virus
gaggagguauauau

SEQ ID NO: 3280352 - RNA, 13 nt, Vaccinia virus
aaugauaaugaua

SEQ ID NO: 3280353 - RNA, 14 nt, Vaccinia virus
aaucaaucauauua

SEQ ID NO: 3280354 - RNA, 22 nt, Vaccinia virus
acaaucuaguuuugagaacauc

SEQ ID NO: 3280355 - RNA, 22 nt, Vaccinia virus
uauuacaagacgucauucuaaa

SEQ ID NO: 3280356 - RNA, 15 nt, Vaccinia virus
uauaauuauacuauu

SEQ ID NO: 3280357 - RNA, 20 nt, Vaccinia virus
gauucaaauccuucauucau

SEQ ID NO: 3280358 - RNA, 19 nt, Vaccinia virus
ugaacacacgaugaaaaug

SEQ ID NO: 3280359 - RNA, 12 nt, Vaccinia virus
acgaaacaaugu

SEQ ID NO: 3280360 - RNA, 14 nt, Vaccinia virus
ucaagucaauuauc

SEQ ID NO: 3280361 - RNA, 17 nt, Vaccinia virus
guucguugaugaggaau

SEQ ID NO: 3280362 - RNA, 23 nt, Vaccinia virus
uaaaaaaaugauugaagaaggag

SEQ ID NO: 3280363 - RNA, 23 nt, Vaccinia virus
agaauaguauuugagaaauaugu

SEQ ID NO: 3280364 - RNA, 16 nt, Vaccinia virus
ucugucauauuuagau

SEQ ID NO: 3280365 - RNA, 13 nt, Vaccinia virus
agaaacagaacua

SEQ ID NO: 3280366 - RNA, 12 nt, Vaccinia virus
gcauagaaauac

SEQ ID NO: 3280367 - RNA, 18 nt, Vaccinia virus
ugaagaucuauuuccaga

SEQ ID NO: 3280368 - RNA, 13 nt, Vaccinia virus
cuguaaugaugga

SEQ ID NO: 3280369 - RNA, 16 nt, Vaccinia virus
auauaaaauaacuaca

SEQ ID NO: 3280370 - RNA, 21 nt, Vaccinia virus
aaauauaaaacuugucuguau

SEQ ID NO: 3280371 - RNA, 20 nt, Vaccinia virus
gauaucgccuuuauuuccac

SEQ ID NO: 3280372 - RNA, 22 nt, Vaccinia virus
ugucagagcacaagauuuccaa

SEQ ID NO: 3280373 - RNA, 18 nt, Vaccinia virus
acugaguuuuuaggaaau

SEQ ID NO: 3280374 - RNA, 13 nt, Vaccinia virus
uuaauauguauga

SEQ ID NO: 3280375 - RNA, 12 nt, Vaccinia virus
ucgcaaauuccg

SEQ ID NO: 3280376 - RNA, 21 nt, Vaccinia virus
ucuucaaaguuucugaaauaa

SEQ ID NO: 3280377 - RNA, 14 nt, Vaccinia virus
acacuaucugaucu

SEQ ID NO: 3280378 - RNA, 19 nt, Vaccinia virus
aauuacgcucuacaaaaug

SEQ ID NO: 3280379 - RNA, 12 nt, Vaccinia virus
acggaauuauug

SEQ ID NO: 3280380 - RNA, 15 nt, Vaccinia virus
cuucgacaaaucguu

SEQ ID NO: 3280381 - RNA, 12 nt, Vaccinia virus
cuaaaguauuug

SEQ ID NO: 3280382 - RNA, 21 nt, Vaccinia virus
aguaucaugaacucuaaucaa

SEQ ID NO: 3280383 - RNA, 23 nt, Vaccinia virus
aauacuaauuuguuuuacucuau

SEQ ID NO: 3280384 - RNA, 15 nt, Vaccinia virus
acacgauauucaugg

SEQ ID NO: 3280385 - RNA, 15 nt, Vaccinia virus
aaggacuuuguagaa

SEQ ID NO: 3280386 - RNA, 17 nt, Vaccinia virus
aguuugagguuuuagau

SEQ ID NO: 3280387 - RNA, 15 nt, Vaccinia virus
uuagcaucugauuuu

SEQ ID NO: 3280388 - RNA, 21 nt, Vaccinia virus
cauuauacuuuuuuuuggaaa

SEQ ID NO: 3280389 - RNA, 17 nt, Vaccinia virus
gaauuaacgagauauau

SEQ ID NO: 3280390 - RNA, 19 nt, Vaccinia virus
aauuagucauacguaauga

SEQ ID NO: 3280391 - RNA, 13 nt, Vaccinia virus
auauuucuggaau

SEQ ID NO: 3280392 - RNA, 15 nt, Vaccinia virus
auguagaaaauggau

SEQ ID NO: 3280393 - RNA, 15 nt, Vaccinia virus
aauggaaucuagauc

SEQ ID NO: 3280394 - RNA, 13 nt, Vaccinia virus
uuccuccauaauu

SEQ ID NO: 3280395 - RNA, 14 nt, Vaccinia virus
ugagaauauguucc

SEQ ID NO: 3280396 - RNA, 19 nt, Vaccinia virus
auaaggaacuagaaucgua

SEQ ID NO: 3280397 - RNA, 16 nt, Vaccinia virus
auuucaaaaaaugauc

SEQ ID NO: 3280398 - RNA, 21 nt, Vaccinia virus
uguaauacuagcgugaacaac

SEQ ID NO: 3280399 - RNA, 22 nt, Vaccinia virus
aauaauuauaucacaacaucua

SEQ ID NO: 3280400 - RNA, 20 nt, Vaccinia virus
auuccucuaacgaacucaag

SEQ ID NO: 3280401 - RNA, 17 nt, Vaccinia virus
uaguguuggauaucuuc

SEQ ID NO: 3280402 - RNA, 17 nt, Vaccinia virus
aaccgcguuaauguuug

SEQ ID NO: 3280403 - RNA, 13 nt, Vaccinia virus
aaaaaggaaucua

SEQ ID NO: 3280404 - RNA, 17 nt, Vaccinia virus
uuaaaauauuauuuaga

SEQ ID NO: 3280405 - RNA, 12 nt, Vaccinia virus
ucagaguucagu

SEQ ID NO: 3280406 - RNA, 21 nt, Vaccinia virus
aggauacacucucaauauacu

SEQ ID NO: 3280407 - RNA, 21 nt, Vaccinia virus
gaaaauguacuucgaugagau

SEQ ID NO: 3280408 - RNA, 13 nt, Vaccinia virus
uggaguugaagau

SEQ ID NO: 3280409 - RNA, 15 nt, Vaccinia virus
gauuguuaacuauag

SEQ ID NO: 3280410 - RNA, 15 nt, Vaccinia virus
acuauuuucaguaau

SEQ ID NO: 3280411 - RNA, 16 nt, Vaccinia virus
aucguuaaauuuuaca

SEQ ID NO: 3280412 - RNA, 10 nt, Vaccinia virus
caaugauaua

SEQ ID NO: 3280413 - RNA, 15 nt, Vaccinia virus
uguaauuuagaugug

SEQ ID NO: 3280414 - RNA, 19 nt, Vaccinia virus
gacuacaaagaauguucua

SEQ ID NO: 3280415 - RNA, 20 nt, Vaccinia virus
uuuauaaacaugaaaccacu

SEQ ID NO: 3280416 - RNA, 12 nt, Vaccinia virus
uaaaauggauua

SEQ ID NO: 3280417 - RNA, 20 nt, Vaccinia virus
auagauagcguauaucucua

SEQ ID NO: 3280418 - RNA, 15 nt, Vaccinia virus
ucuuguaucauauau

SEQ ID NO: 3280419 - RNA, 12 nt, Vaccinia virus
aacuuucuagaa

SEQ ID NO: 3280420 - RNA, 19 nt, Vaccinia virus
cauuuuaggauaugcuuuc

SEQ ID NO: 3280421 - RNA, 12 nt, Vaccinia virus
gauaguuucauu

SEQ ID NO: 3280422 - RNA, 23 nt, Vaccinia virus
guucuaacgccgaucucugaaug

SEQ ID NO: 3280423 - RNA, 19 nt, Vaccinia virus
aacaucuagccucgguaau

SEQ ID NO: 3280424 - RNA, 17 nt, Vaccinia virus
auuuaggacuuugcaau

SEQ ID NO: 3280425 - RNA, 15 nt, Vaccinia virus
cuucaauaaaaugag

SEQ ID NO: 3280426 - RNA, 22 nt, Vaccinia virus
agacaaguauccguuugauauu

SEQ ID NO: 3280427 - RNA, 16 nt, Vaccinia virus
aacagucuaaacaaua

SEQ ID NO: 3280428 - RNA, 12 nt, Vaccinia virus
agaaauacuuag

SEQ ID NO: 3280429 - RNA, 14 nt, Vaccinia virus
aguauuuaacaaga

SEQ ID NO: 3280430 - RNA, 22 nt, Vaccinia virus
agaugaaucaaauguaacuauu

SEQ ID NO: 3280431 - RNA, 22 nt, Vaccinia virus
gucgagaacguuaaaauaaucg

SEQ ID NO: 3280432 - RNA, 18 nt, Vaccinia virus
uaucagaguuacaucaaa

SEQ ID NO: 3280433 - RNA, 15 nt, Vaccinia virus
aggaaauuaugagaa

SEQ ID NO: 3280434 - RNA, 17 nt, Vaccinia virus
gcuauguuuaauacuua

SEQ ID NO: 3280435 - RNA, 14 nt, Vaccinia virus
aggugaacaagaga

SEQ ID NO: 3280436 - RNA, 12 nt, Vaccinia virus
aauauuuucuau

SEQ ID NO: 3280437 - RNA, 20 nt, Vaccinia virus
aauaaggaagguguuaaaau

SEQ ID NO: 3280438 - RNA, 18 nt, Vaccinia virus
uguaaaaagauaaacuuu

SEQ ID NO: 3280439 - RNA, 12 nt, Vaccinia virus
uucauucguaaa

SEQ ID NO: 3280440 - RNA, 18 nt, Vaccinia virus
gauauagaacacauaacc

SEQ ID NO: 3280441 - RNA, 13 nt, Vaccinia virus
auauuucaaucau

SEQ ID NO: 3280442 - RNA, 21 nt, Vaccinia virus
auugguagaguuuuauaacga

SEQ ID NO: 3280443 - RNA, 14 nt, Vaccinia virus
uaguaaacauauca

SEQ ID NO: 3280444 - RNA, 20 nt, Vaccinia virus
auguuaaaacuacaaaaaug

SEQ ID NO: 3280445 - RNA, 14 nt, Vaccinia virus
uuguauaugauguu

SEQ ID NO: 3280446 - RNA, 19 nt, Vaccinia virus
ucaaauuuauauccuauau

SEQ ID NO: 3280447 - RNA, 19 nt, Vaccinia virus
acgucugauauucgaaaau

SEQ ID NO: 3280448 - RNA, 14 nt, Vaccinia virus
guuguauauuucuu

SEQ ID NO: 3280449 - RNA, 18 nt, Vaccinia virus
auuugugaguuuuccuua

SEQ ID NO: 3280450 - RNA, 23 nt, Vaccinia virus
uuaccucuucugauaucauuaau

SEQ ID NO: 3280451 - RNA, 22 nt, Vaccinia virus
caugauccuauucuaaauggau

SEQ ID NO: 3280452 - RNA, 17 nt, Vaccinia virus
uauauaccgauuucaca

SEQ ID NO: 3280453 - RNA, 22 nt, Vaccinia virus
uuaaaauaaaaaguaauauuca

SEQ ID NO: 3280454 - RNA, 16 nt, Vaccinia virus
uaauaaauugguaaau

SEQ ID NO: 3280455 - RNA, 22 nt, Vaccinia virus
auuuguauuauccaauacagaa

SEQ ID NO: 3280456 - RNA, 17 nt, Vaccinia virus
uaguuuauuccaaucau

SEQ ID NO: 3280457 - RNA, 17 nt, Vaccinia virus
aucauagauucauauag

SEQ ID NO: 3280458 - RNA, 21 nt, Vaccinia virus
caguaucgaaaaaugcugaag

SEQ ID NO: 3280459 - RNA, 22 nt, Vaccinia virus
ucaaauuugguaauucuauuaa

SEQ ID NO: 3280460 - RNA, 12 nt, Vaccinia virus
guuccauggcag

SEQ ID NO: 3280461 - RNA, 11 nt, Vaccinia virus
aacaauguuug

SEQ ID NO: 3280462 - RNA, 17 nt, Vaccinia virus
auuuuacccucaaucau

SEQ ID NO: 3280463 - RNA, 17 nt, Vaccinia virus
ggaaaguucaaaaaguc

SEQ ID NO: 3280464 - RNA, 17 nt, Vaccinia virus
aaacgauuaaacaauau

SEQ ID NO: 3280465 - RNA, 13 nt, Vaccinia virus
gaacuaagagaaa

SEQ ID NO: 3280466 - RNA, 16 nt, Vaccinia virus
auaaugauagaauaga

SEQ ID NO: 3280467 - RNA, 20 nt, Vaccinia virus
aauaauggaucagauguaga

SEQ ID NO: 3280468 - RNA, 13 nt, Vaccinia virus
acuuuguuaauga

SEQ ID NO: 3280469 - RNA, 16 nt, Vaccinia virus
acacgauuuaauccau

SEQ ID NO: 3280470 - RNA, 15 nt, Vaccinia virus
gauaaguaauaacua

SEQ ID NO: 3280471 - RNA, 15 nt, Vaccinia virus
auaacuauguuuuaa

SEQ ID NO: 3280472 - RNA, 21 nt, Vaccinia virus
cuuuuagaagugauucuuuga

SEQ ID NO: 3280473 - RNA, 19 nt, Vaccinia virus
guggaagcugaacacauua

SEQ ID NO: 3280474 - RNA, 20 nt, Vaccinia virus
uuuaauccaaauauaaugau

SEQ ID NO: 3280475 - RNA, 18 nt, Vaccinia virus
acaugagagaaacaauau

SEQ ID NO: 3280476 - RNA, 14 nt, Vaccinia virus
augugacuguuuuc

SEQ ID NO: 3280477 - RNA, 17 nt, Vaccinia virus
uucauuaauuucugaua

SEQ ID NO: 3280478 - RNA, 15 nt, Vaccinia virus
auauacacauaauua

SEQ ID NO: 3280479 - RNA, 15 nt, Vaccinia virus
aaagaaaaacacauu

SEQ ID NO: 3280480 - RNA, 15 nt, Vaccinia virus
cuguaaguauguuua

SEQ ID NO: 3280481 - RNA, 20 nt, Vaccinia virus
cucaaaguagauaaacccuc

SEQ ID NO: 3280482 - RNA, 21 nt, Vaccinia virus
agauagguauuuuaucucuau

SEQ ID NO: 3280483 - RNA, 16 nt, Vaccinia virus
acuuagauuaaauucu

SEQ ID NO: 3280484 - RNA, 23 nt, Vaccinia virus
augaaucacguguuaaacaaugg

SEQ ID NO: 3280485 - RNA, 14 nt, Vaccinia virus
cugguuuagauauu

SEQ ID NO: 3280486 - RNA, 18 nt, Vaccinia virus
uuuacacaugguuauuuu

SEQ ID NO: 3280487 - RNA, 19 nt, Vaccinia virus
agucauaaaaggauacuaa

SEQ ID NO: 3280488 - RNA, 15 nt, Vaccinia virus
auugcauuugaucag

SEQ ID NO: 3280489 - RNA, 17 nt, Vaccinia virus
aaagucaucucuuguau

SEQ ID NO: 3280490 - RNA, 20 nt, Vaccinia virus
gauuauaaaguggaagagua

SEQ ID NO: 3280491 - RNA, 23 nt, Vaccinia virus
guuaauguuugcuccauaaucua

SEQ ID NO: 3280492 - RNA, 15 nt, Vaccinia virus
aggggaaaaauuaua

SEQ ID NO: 3280493 - RNA, 13 nt, Vaccinia virus
cacguuugaacag

SEQ ID NO: 3280494 - RNA, 16 nt, Vaccinia virus
gaaguggauauacaua

SEQ ID NO: 3280495 - RNA, 19 nt, Vaccinia virus
agauccaaagaagauguuc

SEQ ID NO: 3280496 - RNA, 18 nt, Vaccinia virus
uaucgauuucuacauaua

SEQ ID NO: 3280497 - RNA, 14 nt, Vaccinia virus
uaauaauccagaau

SEQ ID NO: 3280498 - RNA, 18 nt, Vaccinia virus
auguucuuuuugugugaa

SEQ ID NO: 3280499 - RNA, 14 nt, Vaccinia virus
uagaacguggauau

SEQ ID NO: 3280500 - RNA, 14 nt, Vaccinia virus
auucuuaaaaucua

SEQ ID NO: 3280501 - RNA, 17 nt, Vaccinia virus
uauuagauuuuguauua

SEQ ID NO: 3280502 - RNA, 19 nt, Vaccinia virus
aaaucguuaguagauguuu

SEQ ID NO: 3280503 - RNA, 23 nt, Vaccinia virus
cgaaauaaaaaacauaauuuuaa

SEQ ID NO: 3280504 - RNA, 14 nt, Vaccinia virus
ucguauccacaaau

SEQ ID NO: 3280505 - RNA, 14 nt, Vaccinia virus
cucaauaagaugac

SEQ ID NO: 3280506 - RNA, 18 nt, Vaccinia virus
auaaucguauuuguguga

SEQ ID NO: 3280507 - RNA, 12 nt, Vaccinia virus
aaucuauaugac

SEQ ID NO: 3280508 - RNA, 14 nt, Vaccinia virus
ugcacucaugauuc

SEQ ID NO: 3280509 - RNA, 14 nt, Vaccinia virus
uuuuucgacauauu

SEQ ID NO: 3280510 - RNA, 12 nt, Vaccinia virus
gaugguauuauc

SEQ ID NO: 3280511 - RNA, 14 nt, Vaccinia virus
ugauauauuuucca

SEQ ID NO: 3280512 - RNA, 14 nt, Vaccinia virus
acgaucuauuagaa

SEQ ID NO: 3280513 - RNA, 17 nt, Vaccinia virus
ugauaguauuauucauu

SEQ ID NO: 3280514 - RNA, 21 nt, Vaccinia virus
aucuucuuauuuagaucuugu

SEQ ID NO: 3280515 - RNA, 18 nt, Vaccinia virus
uauaccgccucaaacucu

SEQ ID NO: 3280516 - RNA, 16 nt, Vaccinia virus
aguauguuuaauauga

SEQ ID NO: 3280517 - RNA, 20 nt, Vaccinia virus
cuccuaauauaacaguaucu

SEQ ID NO: 3280518 - RNA, 14 nt, Vaccinia virus
ugcauuucuacaaa

SEQ ID NO: 3280519 - RNA, 20 nt, Vaccinia virus
ugaaguuggugcauaucuuu

SEQ ID NO: 3280520 - RNA, 18 nt, Vaccinia virus
cuagcguuauaacaaaau

SEQ ID NO: 3280521 - RNA, 13 nt, Vaccinia virus
cauuaauuucuga

SEQ ID NO: 3280522 - RNA, 16 nt, Vaccinia virus
uuacuuuguggaugau

SEQ ID NO: 3280523 - RNA, 16 nt, Vaccinia virus
uagaucugaauuaaau

SEQ ID NO: 3280524 - RNA, 13 nt, Vaccinia virus
aucuaaaauccau

SEQ ID NO: 3280525 - RNA, 15 nt, Vaccinia virus
cauauuuuaaugaac

SEQ ID NO: 3280526 - RNA, 19 nt, Vaccinia virus
agaaaucaacgaucuaaua

SEQ ID NO: 3280527 - RNA, 14 nt, Vaccinia virus
uaaauuuuaaacau

SEQ ID NO: 3280528 - RNA, 23 nt, Vaccinia virus
guccuaaugccuaugauguguuu

SEQ ID NO: 3280529 - RNA, 21 nt, Vaccinia virus
agcuguucaagaauauacaag

SEQ ID NO: 3280530 - RNA, 19 nt, Vaccinia virus
acuagaaagggaaaaauua

SEQ ID NO: 3280531 - RNA, 18 nt, Vaccinia virus
aauaauugcgaauguuuu

SEQ ID NO: 3280532 - RNA, 19 nt, Vaccinia virus
aaauaauauaucaaacaug

SEQ ID NO: 3280533 - RNA, 17 nt, Vaccinia virus
uuaaugacaaacauuuu

SEQ ID NO: 3280534 - RNA, 14 nt, Vaccinia virus
gaacaauaaaagag

SEQ ID NO: 3280535 - RNA, 20 nt, Vaccinia virus
agagguucccaauuccaaag

SEQ ID NO: 3280536 - RNA, 14 nt, Vaccinia virus
ccgcauuaaaugau

SEQ ID NO: 3280537 - RNA, 13 nt, Vaccinia virus
guaaaacaaacuu

SEQ ID NO: 3280538 - RNA, 20 nt, Vaccinia virus
aacaucuuggggaaauaugg

SEQ ID NO: 3280539 - RNA, 18 nt, Vaccinia virus
uaaauauguguauuauca

SEQ ID NO: 3280540 - RNA, 12 nt, Vaccinia virus
aaauuauauucu

SEQ ID NO: 3280541 - RNA, 17 nt, Vaccinia virus
uccauuuuuaauuuaug

SEQ ID NO: 3280542 - RNA, 16 nt, Vaccinia virus
cagcgaacuugauauu

SEQ ID NO: 3280543 - RNA, 17 nt, Vaccinia virus
cuauaaaugaauucuca

SEQ ID NO: 3280544 - RNA, 20 nt, Vaccinia virus
ugaaagcgagaaauaaucau

SEQ ID NO: 3280545 - RNA, 16 nt, Vaccinia virus
auagcaaaauaaaguu

SEQ ID NO: 3280546 - RNA, 18 nt, Vaccinia virus
auaacaggggaaugaaca

SEQ ID NO: 3280547 - RNA, 18 nt, Vaccinia virus
uccuacaggaauaucuuu

SEQ ID NO: 3280548 - RNA, 22 nt, Vaccinia virus
augcuuaacuugacuaaauauu

SEQ ID NO: 3280549 - RNA, 13 nt, Vaccinia virus
guucgauagaaac

SEQ ID NO: 3280550 - RNA, 15 nt, Vaccinia virus
aucuacuauacuuua

SEQ ID NO: 3280551 - RNA, 11 nt, Vaccinia virus
uauauguuucu

SEQ ID NO: 3280552 - RNA, 14 nt, Vaccinia virus
aauaguuuacagau

SEQ ID NO: 3280553 - RNA, 21 nt, Vaccinia virus
uguuaauacaucaauggaaga

SEQ ID NO: 3280554 - RNA, 14 nt, Vaccinia virus
guucaaaauaaucc

SEQ ID NO: 3280555 - RNA, 20 nt, Vaccinia virus
uaaccaaaaugaaaauacuu

SEQ ID NO: 3280556 - RNA, 15 nt, Vaccinia virus
caacugaaaaaguua

SEQ ID NO: 3280557 - RNA, 17 nt, Vaccinia virus
acugcauccuucuaaga

SEQ ID NO: 3280558 - RNA, 15 nt, Vaccinia virus
gacacaaauuauggc

SEQ ID NO: 3280559 - RNA, 10 nt, Vaccinia virus
uucaacaaug

SEQ ID NO: 3280560 - RNA, 14 nt, Vaccinia virus
cugaucauuaauau

SEQ ID NO: 3280561 - RNA, 15 nt, Vaccinia virus
uuaaaagauauuaau

SEQ ID NO: 3280562 - RNA, 14 nt, Vaccinia virus
cuauagauuuugaa

SEQ ID NO: 3280563 - RNA, 15 nt, Vaccinia virus
aaauggauguuaaug

SEQ ID NO: 3280564 - RNA, 17 nt, Vaccinia virus
gauagacuagaagaaag

SEQ ID NO: 3280565 - RNA, 18 nt, Vaccinia virus
auuaucaaaagacaugau

SEQ ID NO: 3280566 - RNA, 18 nt, Vaccinia virus
cuaggaguaucuauuuua

SEQ ID NO: 3280567 - RNA, 14 nt, Vaccinia virus
uuaaaaaguuaucu

SEQ ID NO: 3280568 - RNA, 16 nt, Vaccinia virus
uacgauguuguaaagu

SEQ ID NO: 3280569 - RNA, 21 nt, Vaccinia virus
uaacuuccacauuaauacagc

SEQ ID NO: 3280570 - RNA, 14 nt, Vaccinia virus
ucuuagaacaacau

SEQ ID NO: 3280571 - RNA, 19 nt, Vaccinia virus
agucuagguucacaaugaa

SEQ ID NO: 3280572 - RNA, 18 nt, Vaccinia virus
auuaaugggcuuaguaaa

SEQ ID NO: 3280573 - RNA, 14 nt, Vaccinia virus
uauuucguacauuu

SEQ ID NO: 3280574 - RNA, 23 nt, Vaccinia virus
ucagaauauacaccuaacguuuu

SEQ ID NO: 3280575 - RNA, 17 nt, Vaccinia virus
uggcaauaaaguuuuua

SEQ ID NO: 3280576 - RNA, 15 nt, Vaccinia virus
gacucuagaugaaau

SEQ ID NO: 3280577 - RNA, 17 nt, Vaccinia virus
aauucuaggcucaguau

SEQ ID NO: 3280578 - RNA, 22 nt, Vaccinia virus
uuagaaagaaacgauuauuucu

SEQ ID NO: 3280579 - RNA, 22 nt, Vaccinia virus
uacuucuuccacuguccaaaau

SEQ ID NO: 3280580 - RNA, 18 nt, Vaccinia virus
aucaauuaaauaauuaau

SEQ ID NO: 3280581 - RNA, 17 nt, Vaccinia virus
auguaacuauagagaac

SEQ ID NO: 3280582 - RNA, 13 nt, Vaccinia virus
auaacuaaagaaa

SEQ ID NO: 3280583 - RNA, 21 nt, Vaccinia virus
agacacauaugcgaucagaua

SEQ ID NO: 3280584 - RNA, 17 nt, Vaccinia virus
uaacacuauacucauau

SEQ ID NO: 3280585 - RNA, 18 nt, Vaccinia virus
aacuaugucaaaaauugu

SEQ ID NO: 3280586 - RNA, 16 nt, Vaccinia virus
uaaaauaaauaucauu

SEQ ID NO: 3280587 - RNA, 13 nt, Vaccinia virus
caauuuacuucua

SEQ ID NO: 3280588 - RNA, 21 nt, Vaccinia virus
aaacaauggucgauuauagaa

SEQ ID NO: 3280589 - RNA, 16 nt, Vaccinia virus
aauguguuaaaaagaa

SEQ ID NO: 3280590 - RNA, 12 nt, Vaccinia virus
agcuaaaaaugc

SEQ ID NO: 3280591 - RNA, 16 nt, Vaccinia virus
ugacagcacagggagc

SEQ ID NO: 3280592 - RNA, 18 nt, Vaccinia virus
aauggauuaucggaaaua

SEQ ID NO: 3280593 - RNA, 19 nt, Vaccinia virus
uagagacagauuaaguucu

SEQ ID NO: 3280594 - RNA, 17 nt, Vaccinia virus
agauacagauacagaua

SEQ ID NO: 3280595 - RNA, 22 nt, Vaccinia virus
caaucacgcauaaaaauaucuu

SEQ ID NO: 3280596 - RNA, 14 nt, Vaccinia virus
aacuauuuagcaaa

SEQ ID NO: 3280597 - RNA, 15 nt, Vaccinia virus
auauauuuauuuuca

SEQ ID NO: 3280598 - RNA, 18 nt, Vaccinia virus
cuuaauacagauugcacu

SEQ ID NO: 3280599 - RNA, 22 nt, Vaccinia virus
uaaacaguuuccacuuugguaa

SEQ ID NO: 3280600 - RNA, 13 nt, Vaccinia virus
aguaccuggaaug

SEQ ID NO: 3280601 - RNA, 18 nt, Vaccinia virus
aacaagguaucgaaucua

SEQ ID NO: 3280602 - RNA, 20 nt, Vaccinia virus
uaugucgucuacuggaugaa

SEQ ID NO: 3280603 - RNA, 15 nt, Vaccinia virus
guaaauaaauacuuu

SEQ ID NO: 3280604 - RNA, 16 nt, Vaccinia virus
auucucgaaucuaaag

SEQ ID NO: 3280605 - RNA, 17 nt, Vaccinia virus
cuauguuccucguuucc

SEQ ID NO: 3280606 - RNA, 14 nt, Vaccinia virus
uaucacuccaugau

SEQ ID NO: 3280607 - RNA, 14 nt, Vaccinia virus
uuguuuauauuaaa

SEQ ID NO: 3280608 - RNA, 19 nt, Vaccinia virus
auucauacuuaacaaauug

SEQ ID NO: 3280609 - RNA, 18 nt, Vaccinia virus
caucaacagucacauaau

SEQ ID NO: 3280610 - RNA, 17 nt, Vaccinia virus
uuacuggaauuagacaa

SEQ ID NO: 3280611 - RNA, 18 nt, Vaccinia virus
cgauccacaaucaaagaa

SEQ ID NO: 3280612 - RNA, 18 nt, Vaccinia virus
acaaaucuauuuggauuu

SEQ ID NO: 3280613 - RNA, 19 nt, Vaccinia virus
aaacgcuauaaaaaacaua

SEQ ID NO: 3280614 - RNA, 16 nt, Vaccinia virus
ugauucgauaaauaga

SEQ ID NO: 3280615 - RNA, 19 nt, Vaccinia virus
uacccaaaucugaaaauaa

SEQ ID NO: 3280616 - RNA, 12 nt, Vaccinia virus
agaauaugagaa

SEQ ID NO: 3280617 - RNA, 15 nt, Vaccinia virus
ucaauugauaagaca

SEQ ID NO: 3280618 - RNA, 20 nt, Vaccinia virus
uauuauaaagccuuuaucua

SEQ ID NO: 3280619 - RNA, 22 nt, Vaccinia virus
cagaguccucuaauugaucaag

SEQ ID NO: 3280620 - RNA, 23 nt, Vaccinia virus
agauauacccgaagauauacaca

SEQ ID NO: 3280621 - RNA, 15 nt, Vaccinia virus
auuuuaucaaacaug

SEQ ID NO: 3280622 - RNA, 13 nt, Vaccinia virus
guuuaaaauuagc

SEQ ID NO: 3280623 - RNA, 13 nt, Vaccinia virus
cuguuuauacaag

SEQ ID NO: 3280624 - RNA, 19 nt, Vaccinia virus
uaaauuuagugagaauaau

SEQ ID NO: 3280625 - RNA, 17 nt, Vaccinia virus
auauggauauucauaga

SEQ ID NO: 3280626 - RNA, 16 nt, Vaccinia virus
gucauagaugaaauac

SEQ ID NO: 3280627 - RNA, 21 nt, Vaccinia virus
cauaaaacugaugagauauau

SEQ ID NO: 3280628 - RNA, 17 nt, Vaccinia virus
accauuacguuaacaga

SEQ ID NO: 3280629 - RNA, 12 nt, Vaccinia virus
cguauaaauuuu

SEQ ID NO: 3280630 - RNA, 14 nt, Vaccinia virus
uuauuaaguauaau

SEQ ID NO: 3280631 - RNA, 14 nt, Vaccinia virus
auuauaagaaauau

SEQ ID NO: 3280632 - RNA, 13 nt, Vaccinia virus
cugcaucacugac

SEQ ID NO: 3280633 - RNA, 15 nt, Vaccinia virus
guaauaaauaugauu

SEQ ID NO: 3280634 - RNA, 18 nt, Vaccinia virus
aaugcucaguaaauguau

SEQ ID NO: 3280635 - RNA, 21 nt, Vaccinia virus
aacgaguacuuuaaagaagua

SEQ ID NO: 3280636 - RNA, 18 nt, Vaccinia virus
cauguuugcucucugaau

SEQ ID NO: 3280637 - RNA, 15 nt, Vaccinia virus
cuaaucaauagcuua

SEQ ID NO: 3280638 - RNA, 14 nt, Vaccinia virus
ucccaauuccaaag

SEQ ID NO: 3280639 - RNA, 21 nt, Vaccinia virus
gaaauaauaggagguaaugau

SEQ ID NO: 3280640 - RNA, 21 nt, Vaccinia virus
gcuguagaaccagcugcucca

SEQ ID NO: 3280641 - RNA, 15 nt, Vaccinia virus
uucauuacuaucuuu

SEQ ID NO: 3280642 - RNA, 17 nt, Vaccinia virus
cauauauggauaaugcu

SEQ ID NO: 3280643 - RNA, 14 nt, Vaccinia virus
auaucuuguucuau

SEQ ID NO: 3280644 - RNA, 14 nt, Vaccinia virus
aagacuuaaaacuu

SEQ ID NO: 3280645 - RNA, 17 nt, Vaccinia virus
gacacugaaucaauuga

SEQ ID NO: 3280646 - RNA, 12 nt, Vaccinia virus
gaauguauauac

SEQ ID NO: 3280647 - RNA, 19 nt, Vaccinia virus
uuccauuggccucauuaac

SEQ ID NO: 3280648 - RNA, 14 nt, Vaccinia virus
auugcgacacuauu

SEQ ID NO: 3280649 - RNA, 15 nt, Vaccinia virus
agaauacgaugauau

SEQ ID NO: 3280650 - RNA, 18 nt, Vaccinia virus
uccauugauaaagaaguu

SEQ ID NO: 3280651 - RNA, 19 nt, Vaccinia virus
acaguaauguccaaaucua

SEQ ID NO: 3280652 - RNA, 11 nt, Vaccinia virus
gaauaagaaca

SEQ ID NO: 3280653 - RNA, 16 nt, Vaccinia virus
ucaugaaaugaugaua

SEQ ID NO: 3280654 - RNA, 23 nt, Vaccinia virus
aauaugucucuuaacuauuuccg

SEQ ID NO: 3280655 - RNA, 16 nt, Vaccinia virus
gacaaugaauugcaua

SEQ ID NO: 3280656 - RNA, 21 nt, Vaccinia virus
auaauaggagguaaugauaug

SEQ ID NO: 3280657 - RNA, 18 nt, Vaccinia virus
caauuaguuaauaaugau

SEQ ID NO: 3280658 - RNA, 15 nt, Vaccinia virus
gguccuauugcuucc

SEQ ID NO: 3280659 - RNA, 21 nt, Vaccinia virus
uuuaacgaggacuuauucaga

SEQ ID NO: 3280660 - RNA, 23 nt, Vaccinia virus
auguauaauauaaaaaaacauua

SEQ ID NO: 3280661 - RNA, 22 nt, Vaccinia virus
cuuauaaaacuauauuuggaau

SEQ ID NO: 3280662 - RNA, 15 nt, Vaccinia virus
ucacucaucgauuca

SEQ ID NO: 3280663 - RNA, 19 nt, Vaccinia virus
auaaauuagucauacguaa

SEQ ID NO: 3280664 - RNA, 12 nt, Vaccinia virus
gcacgaacaaaa

SEQ ID NO: 3280665 - RNA, 18 nt, Vaccinia virus
agucagacuguaguucua

SEQ ID NO: 3280666 - RNA, 15 nt, Vaccinia virus
aucccuuaaaaauua

SEQ ID NO: 3280667 - RNA, 20 nt, Vaccinia virus
aacauuuugcagaaaaaagu

SEQ ID NO: 3280668 - RNA, 18 nt, Vaccinia virus
aaguucauaaaaauaaua

SEQ ID NO: 3280669 - RNA, 22 nt, Vaccinia virus
ucgaauaaguuugcagacaaac

SEQ ID NO: 3280670 - RNA, 21 nt, Vaccinia virus
gaucuuaacuccucuauuaau

SEQ ID NO: 3280671 - RNA, 15 nt, Vaccinia virus
cggcuacuaaaagau

SEQ ID NO: 3280672 - RNA, 18 nt, Vaccinia virus
auacacuguuuaaaauua

SEQ ID NO: 3280673 - RNA, 21 nt, Vaccinia virus
ucaacaauuuuguauuauucu

SEQ ID NO: 3280674 - RNA, 19 nt, Vaccinia virus
auuuaacaagagaagagau

SEQ ID NO: 3280675 - RNA, 19 nt, Vaccinia virus
auggauuaucggaaauacu

SEQ ID NO: 3280676 - RNA, 13 nt, Vaccinia virus
gaaaggaauuaau

SEQ ID NO: 3280677 - RNA, 12 nt, Vaccinia virus
uaaaaugagcau

SEQ ID NO: 3280678 - RNA, 13 nt, Vaccinia virus
uaauuucuagaac

SEQ ID NO: 3280679 - RNA, 13 nt, Vaccinia virus
uguuuucauacau

SEQ ID NO: 3280680 - RNA, 20 nt, Vaccinia virus
augacuuaguucuuaaucca

SEQ ID NO: 3280681 - RNA, 14 nt, Vaccinia virus
caaacgugggaaga

SEQ ID NO: 3280682 - RNA, 16 nt, Vaccinia virus
auguagacaaaaugaa

SEQ ID NO: 3280683 - RNA, 16 nt, Vaccinia virus
auaagaagagaaaggu

SEQ ID NO: 3280684 - RNA, 15 nt, Vaccinia virus
ugauuagaauucauc

SEQ ID NO: 3280685 - RNA, 21 nt, Vaccinia virus
auggaugucaucaauguagaa

SEQ ID NO: 3280686 - RNA, 19 nt, Vaccinia virus
cagauguuggaggaugaag

SEQ ID NO: 3280687 - RNA, 14 nt, Vaccinia virus
ucuaccauuucauu

SEQ ID NO: 3280688 - RNA, 20 nt, Vaccinia virus
aauacucaauccuucagaau

SEQ ID NO: 3280689 - RNA, 19 nt, Vaccinia virus
augaacuuucaaggacuug

SEQ ID NO: 3280690 - RNA, 15 nt, Vaccinia virus
agauaucuauacuua

SEQ ID NO: 3280691 - RNA, 13 nt, Vaccinia virus
uuauuauuucagg

SEQ ID NO: 3280692 - RNA, 19 nt, Vaccinia virus
gcucuauauuacaaacuau

SEQ ID NO: 3280693 - RNA, 15 nt, Vaccinia virus
auaaacaugucuauu

SEQ ID NO: 3280694 - RNA, 14 nt, Vaccinia virus
agaauggaaauaua

SEQ ID NO: 3280695 - RNA, 17 nt, Vaccinia virus
uauugucucgucaaugu

SEQ ID NO: 3280696 - RNA, 17 nt, Vaccinia virus
uccaugauaaauuauuu

SEQ ID NO: 3280697 - RNA, 18 nt, Vaccinia virus
caguagcgagaaagcauc

SEQ ID NO: 3280698 - RNA, 23 nt, Vaccinia virus
uuauuauagugguggaauucagu

SEQ ID NO: 3280699 - RNA, 16 nt, Vaccinia virus
aaucacacaagccauu

SEQ ID NO: 3280700 - RNA, 19 nt, Vaccinia virus
uacauauaugcaauucgcu

SEQ ID NO: 3280701 - RNA, 13 nt, Vaccinia virus
ugagauaagaaca

SEQ ID NO: 3280702 - RNA, 23 nt, Vaccinia virus
aggauugauuacuauaaauggag

SEQ ID NO: 3280703 - RNA, 18 nt, Vaccinia virus
agcauuuguaauaauccu

SEQ ID NO: 3280704 - RNA, 19 nt, Vaccinia virus
aaauuauccuaucauguau

SEQ ID NO: 3280705 - RNA, 11 nt, Vaccinia virus
cacaaugaaug

SEQ ID NO: 3280706 - RNA, 21 nt, Vaccinia virus
uauagagcacuauuucuaaau

SEQ ID NO: 3280707 - RNA, 23 nt, Vaccinia virus
gagacuuguuaguuaaaaugaua

SEQ ID NO: 3280708 - RNA, 14 nt, Vaccinia virus
caauucguauaaau

SEQ ID NO: 3280709 - RNA, 20 nt, Vaccinia virus
acaaacaagcaucaugaaua

SEQ ID NO: 3280710 - RNA, 19 nt, Vaccinia virus
aguuuuggccauuauuaga

SEQ ID NO: 3280711 - RNA, 13 nt, Vaccinia virus
uacgcugauaaau

SEQ ID NO: 3280712 - RNA, 21 nt, Vaccinia virus
aauacuuuuuuuauuaaauga

SEQ ID NO: 3280713 - RNA, 20 nt, Vaccinia virus
auucagaauuucuacauaau

SEQ ID NO: 3280714 - RNA, 18 nt, Vaccinia virus
acaauguuucuuacauau

SEQ ID NO: 3280715 - RNA, 15 nt, Vaccinia virus
uaaacuacuggaaua

SEQ ID NO: 3280716 - RNA, 16 nt, Vaccinia virus
gaauagugccaucaga

SEQ ID NO: 3280717 - RNA, 14 nt, Vaccinia virus
agacguguuauuac

SEQ ID NO: 3280718 - RNA, 17 nt, Vaccinia virus
cugcuauaauuaagaua

SEQ ID NO: 3280719 - RNA, 14 nt, Vaccinia virus
ucucaagauuuuaa

SEQ ID NO: 3280720 - RNA, 15 nt, Vaccinia virus
uaauagcgucuacau

SEQ ID NO: 3280721 - RNA, 15 nt, Vaccinia virus
auauagguuacuaga

SEQ ID NO: 3280722 - RNA, 20 nt, Vaccinia virus
ucuuuuggguaauuguacaa

SEQ ID NO: 3280723 - RNA, 21 nt, Vaccinia virus
cgacuuauuuaacucuuuagu

SEQ ID NO: 3280724 - RNA, 16 nt, Vaccinia virus
guuuaucaacauggcu

SEQ ID NO: 3280725 - RNA, 21 nt, Vaccinia virus
auguaucauuagguaaaguag

SEQ ID NO: 3280726 - RNA, 18 nt, Vaccinia virus
uucucaugagaauggaaa

SEQ ID NO: 3280727 - RNA, 13 nt, Vaccinia virus
agaacaaauaaua

SEQ ID NO: 3280728 - RNA, 18 nt, Vaccinia virus
guuaaaagaauaauccua

SEQ ID NO: 3280729 - RNA, 20 nt, Vaccinia virus
uuguccagauugaacauaca

SEQ ID NO: 3280730 - RNA, 17 nt, Vaccinia virus
uuuaaaagucaacaucu

SEQ ID NO: 3280731 - RNA, 18 nt, Vaccinia virus
aauaagagacuuaaacaa

SEQ ID NO: 3280732 - RNA, 19 nt, Vaccinia virus
ccgauaaacuccaauaaaa

SEQ ID NO: 3280733 - RNA, 19 nt, Vaccinia virus
aaacaauguauacaaaugu

SEQ ID NO: 3280734 - RNA, 16 nt, Vaccinia virus
ugggcucaaugucuua

SEQ ID NO: 3280735 - RNA, 20 nt, Vaccinia virus
uccggauccuuuucuucaga

SEQ ID NO: 3280736 - RNA, 17 nt, Vaccinia virus
uugauccaguggaugau

SEQ ID NO: 3280737 - RNA, 21 nt, Vaccinia virus
guuaucaucguauaaauuaaa

SEQ ID NO: 3280738 - RNA, 20 nt, Vaccinia virus
uucagaaagacgaauacaua

SEQ ID NO: 3280739 - RNA, 15 nt, Vaccinia virus
uggauuuuuuguaca

SEQ ID NO: 3280740 - RNA, 22 nt, Vaccinia virus
cuucacagauagaucauuuuga

SEQ ID NO: 3280741 - RNA, 17 nt, Vaccinia virus
gaauucgaggaagaugu

SEQ ID NO: 3280742 - RNA, 17 nt, Vaccinia virus
uauaaugucuacauucu

SEQ ID NO: 3280743 - RNA, 21 nt, Vaccinia virus
caaguucuauaguuucuggau

SEQ ID NO: 3280744 - RNA, 21 nt, Vaccinia virus
uauguacaacagugauaugug

SEQ ID NO: 3280745 - RNA, 23 nt, Vaccinia virus
ucaacaauguuugucauauguau

SEQ ID NO: 3280746 - RNA, 19 nt, Vaccinia virus
uuuccaaauuaguuagccg

SEQ ID NO: 3280747 - RNA, 15 nt, Vaccinia virus
ccuuguauguuuuua

SEQ ID NO: 3280748 - RNA, 22 nt, Vaccinia virus
auaaagaaaugucuacauaaau

SEQ ID NO: 3280749 - RNA, 22 nt, Vaccinia virus
auugugauuuaguguaguauau

SEQ ID NO: 3280750 - RNA, 13 nt, Vaccinia virus
cggaaaguauuuu

SEQ ID NO: 3280751 - RNA, 19 nt, Vaccinia virus
auucucgaauccgaaauua

SEQ ID NO: 3280752 - RNA, 12 nt, Vaccinia virus
ccaaaaaaauuc

SEQ ID NO: 3280753 - RNA, 15 nt, Vaccinia virus
acaacuguuguaaau

SEQ ID NO: 3280754 - RNA, 15 nt, Vaccinia virus
auagacaaauuauuc

SEQ ID NO: 3280755 - RNA, 14 nt, Vaccinia virus
auacucucaaccau

SEQ ID NO: 3280756 - RNA, 16 nt, Vaccinia virus
uauacucuuauuauca

SEQ ID NO: 3280757 - RNA, 19 nt, Vaccinia virus
uguaaucuuauuaacuguu

SEQ ID NO: 3280758 - RNA, 15 nt, Vaccinia virus
aauuucuauucauga

SEQ ID NO: 3280759 - RNA, 15 nt, Vaccinia virus
uuuuuacuaaucaua

SEQ ID NO: 3280760 - RNA, 19 nt, Vaccinia virus
aucuuauguauauguuugu

SEQ ID NO: 3280761 - RNA, 11 nt, Vaccinia virus
cgccauaauac

SEQ ID NO: 3280762 - RNA, 15 nt, Vaccinia virus
aucacuguuguacau

SEQ ID NO: 3280763 - RNA, 13 nt, Vaccinia virus
uagauuaaaucca

SEQ ID NO: 3280764 - RNA, 19 nt, Vaccinia virus
aucuacgccuuuaaauccu

SEQ ID NO: 3280765 - RNA, 22 nt, Vaccinia virus
auuacauuuuuuauaaauagau

SEQ ID NO: 3280766 - RNA, 16 nt, Vaccinia virus
agaagcguguuauugu

SEQ ID NO: 3280767 - RNA, 13 nt, Vaccinia virus
gauuuugauuuug

SEQ ID NO: 3280768 - RNA, 16 nt, Vaccinia virus
agacgucaucuguucu

SEQ ID NO: 3280769 - RNA, 18 nt, Vaccinia virus
aaauacugacacaaacaa

SEQ ID NO: 3280770 - RNA, 19 nt, Vaccinia virus
guacagaauuaauuagacg

SEQ ID NO: 3280771 - RNA, 14 nt, Vaccinia virus
acagacuucaaagu

SEQ ID NO: 3280772 - RNA, 14 nt, Vaccinia virus
uucacaauucauuc

SEQ ID NO: 3280773 - RNA, 21 nt, Vaccinia virus
agauuccuucuacugcagcaa

SEQ ID NO: 3280774 - RNA, 17 nt, Vaccinia virus
gagcacuauuucuaaau

SEQ ID NO: 3280775 - RNA, 22 nt, Vaccinia virus
cauaccuauaggaauagucucu

SEQ ID NO: 3280776 - RNA, 15 nt, Vaccinia virus
agugaaauaagcuuu

SEQ ID NO: 3280777 - RNA, 16 nt, Vaccinia virus
uagaauauauguaugu

SEQ ID NO: 3280778 - RNA, 16 nt, Vaccinia virus
uaaauucgauaucuuu

SEQ ID NO: 3280779 - RNA, 18 nt, Vaccinia virus
aggaaugccacaaaugaa

SEQ ID NO: 3280780 - RNA, 16 nt, Vaccinia virus
gauucuaggaacaguu

SEQ ID NO: 3280781 - RNA, 11 nt, Vaccinia virus
aaacaaacauc

SEQ ID NO: 3280782 - RNA, 17 nt, Vaccinia virus
gaaacaguaugauuuua

SEQ ID NO: 3280783 - RNA, 15 nt, Vaccinia virus
uggccaauugucuuu

SEQ ID NO: 3280784 - RNA, 14 nt, Vaccinia virus
gauugccauaauaa

SEQ ID NO: 3280785 - RNA, 21 nt, Vaccinia virus
aacaaguaugacauuguaaaa

SEQ ID NO: 3280786 - RNA, 19 nt, Vaccinia virus
uauccuuuaccaccaaaua

SEQ ID NO: 3280787 - RNA, 17 nt, Vaccinia virus
ugacaauaauuauguag

SEQ ID NO: 3280788 - RNA, 21 nt, Vaccinia virus
ucgacuaucaacaauuuugua

SEQ ID NO: 3280789 - RNA, 18 nt, Vaccinia virus
ucauuuuuuuaaaacugu

SEQ ID NO: 3280790 - RNA, 22 nt, Vaccinia virus
auauaauguacuagaugauauu

SEQ ID NO: 3280791 - RNA, 18 nt, Vaccinia virus
cacauuguauauaguuua

SEQ ID NO: 3280792 - RNA, 19 nt, Vaccinia virus
aauaacuacaguuugaaaa

SEQ ID NO: 3280793 - RNA, 15 nt, Vaccinia virus
cucuggagaaaagau

SEQ ID NO: 3280794 - RNA, 23 nt, Vaccinia virus
auagauucauucguuauagaaug

SEQ ID NO: 3280795 - RNA, 22 nt, Vaccinia virus
cgaauaucguucucuaaauguc

SEQ ID NO: 3280796 - RNA, 16 nt, Vaccinia virus
cuacugcaucacugac

SEQ ID NO: 3280797 - RNA, 23 nt, Vaccinia virus
uaguguaauguuaacaaaaaugu

SEQ ID NO: 3280798 - RNA, 22 nt, Vaccinia virus
aaguaugaagaaaaauguugug

SEQ ID NO: 3280799 - RNA, 15 nt, Vaccinia virus
gaggcaauagaaaag

SEQ ID NO: 3280800 - RNA, 15 nt, Vaccinia virus
acccagcauacuuga

SEQ ID NO: 3280801 - RNA, 16 nt, Vaccinia virus
auaaaaacgaggauau

SEQ ID NO: 3280802 - RNA, 16 nt, Vaccinia virus
acaacgagauaucuug

SEQ ID NO: 3280803 - RNA, 15 nt, Vaccinia virus
guaauuaaauguuug

SEQ ID NO: 3280804 - RNA, 16 nt, Vaccinia virus
auuuaacguuaaagau

SEQ ID NO: 3280805 - RNA, 12 nt, Vaccinia virus
aaaugucaugau

SEQ ID NO: 3280806 - RNA, 16 nt, Vaccinia virus
aaucaagauucauuuu

SEQ ID NO: 3280807 - RNA, 22 nt, Vaccinia virus
auuucaucugugguauucuugu

SEQ ID NO: 3280808 - RNA, 17 nt, Vaccinia virus
gcuauauggauauucau

SEQ ID NO: 3280809 - RNA, 17 nt, Vaccinia virus
gugauaaguaauaacua

SEQ ID NO: 3280810 - RNA, 13 nt, Vaccinia virus
aauuuguuaaaaa

SEQ ID NO: 3280811 - RNA, 21 nt, Vaccinia virus
aagauuaacuccauaaugucu

SEQ ID NO: 3280812 - RNA, 13 nt, Vaccinia virus
uuaaauuauuuag

SEQ ID NO: 3280813 - RNA, 13 nt, Vaccinia virus
ugauauagaucuu

SEQ ID NO: 3280814 - RNA, 14 nt, Vaccinia virus
aaauucguaauaau

SEQ ID NO: 3280815 - RNA, 20 nt, Vaccinia virus
aauaugauuagaaguuauau

SEQ ID NO: 3280816 - RNA, 17 nt, Vaccinia virus
cugaaaauaaagauaaa

SEQ ID NO: 3280817 - RNA, 23 nt, Vaccinia virus
auccaaggauguaauuaaauguu

SEQ ID NO: 3280818 - RNA, 22 nt, Vaccinia virus
aaaacgaggagcggauaaugau

SEQ ID NO: 3280819 - RNA, 18 nt, Vaccinia virus
uuaacguaucgcauuaau

SEQ ID NO: 3280820 - RNA, 15 nt, Vaccinia virus
agugcaaugaauauc

SEQ ID NO: 3280821 - RNA, 14 nt, Vaccinia virus
uauaaaauauauug

SEQ ID NO: 3280822 - RNA, 14 nt, Vaccinia virus
uaacgcaacuauau

SEQ ID NO: 3280823 - RNA, 22 nt, Vaccinia virus
uccgggaacauacgcuuccaga

SEQ ID NO: 3280824 - RNA, 20 nt, Vaccinia virus
ucaagacguggcaaacaaug

SEQ ID NO: 3280825 - RNA, 16 nt, Vaccinia virus
uaauuaugauuuugau

SEQ ID NO: 3280826 - RNA, 14 nt, Vaccinia virus
cauaaaauuuaaga

SEQ ID NO: 3280827 - RNA, 16 nt, Vaccinia virus
uucacagaaacacuag

SEQ ID NO: 3280828 - RNA, 13 nt, Vaccinia virus
ugaauaauguacu

SEQ ID NO: 3280829 - RNA, 22 nt, Vaccinia virus
auuuaauuuggucauuauuaau

SEQ ID NO: 3280830 - RNA, 20 nt, Vaccinia virus
aauauucuaugacugaaugu

SEQ ID NO: 3280831 - RNA, 22 nt, Vaccinia virus
uacauacaucuccaaaacuauc

SEQ ID NO: 3280832 - RNA, 14 nt, Vaccinia virus
gaggaagaagaugg

SEQ ID NO: 3280833 - RNA, 13 nt, Vaccinia virus
uguauuccaaauu

SEQ ID NO: 3280834 - RNA, 16 nt, Vaccinia virus
aaagggauaacauguu

SEQ ID NO: 3280835 - RNA, 18 nt, Vaccinia virus
auaaagauaguguagcgu

SEQ ID NO: 3280836 - RNA, 19 nt, Vaccinia virus
uaauauuaaagauaaagcg

SEQ ID NO: 3280837 - RNA, 23 nt, Vaccinia virus
cauuaaguucacuagaauaucca

SEQ ID NO: 3280838 - RNA, 19 nt, Vaccinia virus
cuccaaacgaguuaaguuu

SEQ ID NO: 3280839 - RNA, 18 nt, Vaccinia virus
agcacguggaaaaaaagu

SEQ ID NO: 3280840 - RNA, 17 nt, Vaccinia virus
aucauguagaagaauuc

SEQ ID NO: 3280841 - RNA, 14 nt, Vaccinia virus
cauaugauguuugu

SEQ ID NO: 3280842 - RNA, 20 nt, Vaccinia virus
uucaucauccaccuguuuua

SEQ ID NO: 3280843 - RNA, 18 nt, Vaccinia virus
auuacaaguauuauugau

SEQ ID NO: 3280844 - RNA, 15 nt, Vaccinia virus
acagauguaaauaua

SEQ ID NO: 3280845 - RNA, 18 nt, Vaccinia virus
auaaauggagaucuaaau

SEQ ID NO: 3280846 - RNA, 17 nt, Vaccinia virus
aauauuacuaauugaua

SEQ ID NO: 3280847 - RNA, 14 nt, Vaccinia virus
aguuuucuaaagau

SEQ ID NO: 3280848 - RNA, 15 nt, Vaccinia virus
cauguuuagaaagaa

SEQ ID NO: 3280849 - RNA, 21 nt, Vaccinia virus
ucuagauagaguauuaaauau

SEQ ID NO: 3280850 - RNA, 23 nt, Vaccinia virus
uguuuucaauggccaucugaaau

SEQ ID NO: 3280851 - RNA, 17 nt, Vaccinia virus
cgaaauacaaaauguua

SEQ ID NO: 3280852 - RNA, 13 nt, Vaccinia virus
gaacuauauuaag

SEQ ID NO: 3280853 - RNA, 22 nt, Vaccinia virus
guuauguauuucauuguucauc

SEQ ID NO: 3280854 - RNA, 14 nt, Vaccinia virus
uaaaaaauauccuu

SEQ ID NO: 3280855 - RNA, 21 nt, Vaccinia virus
uucaaauccgaaauugucuga

SEQ ID NO: 3280856 - RNA, 13 nt, Vaccinia virus
acugacuuuagac

SEQ ID NO: 3280857 - RNA, 14 nt, Vaccinia virus
agagguaaugaugu

SEQ ID NO: 3280858 - RNA, 18 nt, Vaccinia virus
uaauugcuacacccacua

SEQ ID NO: 3280859 - RNA, 21 nt, Vaccinia virus
guucagauugggaucuuuuca

SEQ ID NO: 3280860 - RNA, 19 nt, Vaccinia virus
ucaauagcugagucuauau

SEQ ID NO: 3280861 - RNA, 19 nt, Vaccinia virus
uugaguuuuccguuagaaa

SEQ ID NO: 3280862 - RNA, 13 nt, Vaccinia virus
agaauauauguuu

SEQ ID NO: 3280863 - RNA, 19 nt, Vaccinia virus
accgcuagaucuguaauug

SEQ ID NO: 3280864 - RNA, 19 nt, Vaccinia virus
uacauaugacaaacauugu

SEQ ID NO: 3280865 - RNA, 15 nt, Vaccinia virus
guccaauaugaucau

SEQ ID NO: 3280866 - RNA, 13 nt, Vaccinia virus
ucauauaaauguu

SEQ ID NO: 3280867 - RNA, 14 nt, Vaccinia virus
aagaaaacaaacau

SEQ ID NO: 3280868 - RNA, 13 nt, Vaccinia virus
uccaaucauauag

SEQ ID NO: 3280869 - RNA, 18 nt, Vaccinia virus
uuaacauuauuauauucu

SEQ ID NO: 3280870 - RNA, 14 nt, Vaccinia virus
agaguguuuaucca

SEQ ID NO: 3280871 - RNA, 22 nt, Vaccinia virus
uaacuucgugaauaauguuucu

SEQ ID NO: 3280872 - RNA, 21 nt, Vaccinia virus
aaugcagauuuauugaaaaug

SEQ ID NO: 3280873 - RNA, 15 nt, Vaccinia virus
aauggagaaauacuu

SEQ ID NO: 3280874 - RNA, 23 nt, Vaccinia virus
ugauuuugaugauaauguuacca

SEQ ID NO: 3280875 - RNA, 18 nt, Vaccinia virus
cuuuaauagugucauuag

SEQ ID NO: 3280876 - RNA, 19 nt, Vaccinia virus
auaaagucugucaaaucau

SEQ ID NO: 3280877 - RNA, 15 nt, Vaccinia virus
aaagaaaauauggaa

SEQ ID NO: 3280878 - RNA, 14 nt, Vaccinia virus
auguuuauagaugu

SEQ ID NO: 3280879 - RNA, 16 nt, Vaccinia virus
gacuuuguagaaauau

SEQ ID NO: 3280880 - RNA, 19 nt, Vaccinia virus
uaguuuucaucagauaaga

SEQ ID NO: 3280881 - RNA, 20 nt, Vaccinia virus
cguauauaacauuguuuaug

SEQ ID NO: 3280882 - RNA, 15 nt, Vaccinia virus
auccauuuacaacuc

SEQ ID NO: 3280883 - RNA, 14 nt, Vaccinia virus
agguaaauguaaau

SEQ ID NO: 3280884 - RNA, 17 nt, Vaccinia virus
aaaaacuacuaugcucu

SEQ ID NO: 3280885 - RNA, 18 nt, Vaccinia virus
ucagaaaauaccauccaa

SEQ ID NO: 3280886 - RNA, 15 nt, Vaccinia virus
auccuuaaauguuuu

SEQ ID NO: 3280887 - RNA, 20 nt, Vaccinia virus
caaacuuaaucuuauuagaa

SEQ ID NO: 3280888 - RNA, 14 nt, Vaccinia virus
ugaaucaaauguaa

SEQ ID NO: 3280889 - RNA, 20 nt, Vaccinia virus
gaaagcuguaaugguuuaua

SEQ ID NO: 3280890 - RNA, 17 nt, Vaccinia virus
aucaugacguaaaugua

SEQ ID NO: 3280891 - RNA, 14 nt, Vaccinia virus
auaauauuaauauu

SEQ ID NO: 3280892 - RNA, 20 nt, Vaccinia virus
cuaggauacauaaaauuuaa

SEQ ID NO: 3280893 - RNA, 23 nt, Vaccinia virus
uauauagccgucgccaauugugu

SEQ ID NO: 3280894 - RNA, 23 nt, Vaccinia virus
ucuagcaaaaauucuaugucuaa

SEQ ID NO: 3280895 - RNA, 17 nt, Vaccinia virus
ugagaguagauaucauu

SEQ ID NO: 3280896 - RNA, 12 nt, Vaccinia virus
uccuucgucucu

SEQ ID NO: 3280897 - RNA, 12 nt, Vaccinia virus
aagaauuacuua

SEQ ID NO: 3280898 - RNA, 16 nt, Vaccinia virus
agacagugguuucaug

SEQ ID NO: 3280899 - RNA, 22 nt, Vaccinia virus
uaauaaucaauaauauaucuua

SEQ ID NO: 3280900 - RNA, 18 nt, Vaccinia virus
aucaucgaucuaauagau

SEQ ID NO: 3280901 - RNA, 22 nt, Vaccinia virus
auccauaguuuguaucaauaau

SEQ ID NO: 3280902 - RNA, 18 nt, Vaccinia virus
cuuuucuauaaucaucuu

SEQ ID NO: 3280903 - RNA, 17 nt, Vaccinia virus
auauuuuuuuuuaaaga

SEQ ID NO: 3280904 - RNA, 17 nt, Vaccinia virus
aaauccaaguuucuauu

SEQ ID NO: 3280905 - RNA, 13 nt, Vaccinia virus
cuauguaaaugau

SEQ ID NO: 3280906 - RNA, 22 nt, Vaccinia virus
auugagacgaauggcucuuccu

SEQ ID NO: 3280907 - RNA, 17 nt, Vaccinia virus
accaacacuuaucaauu

SEQ ID NO: 3280908 - RNA, 21 nt, Vaccinia virus
auucuaccuuacccauaaaca

SEQ ID NO: 3280909 - RNA, 23 nt, Vaccinia virus
cgguucgguaacgucuguggaug

SEQ ID NO: 3280910 - RNA, 21 nt, Vaccinia virus
uagauagacgaggaaacaaug

SEQ ID NO: 3280911 - RNA, 22 nt, Vaccinia virus
agaaaucaacgaucuaauacaa

SEQ ID NO: 3280912 - RNA, 20 nt, Vaccinia virus
uucacaacuuuacuguuuuu

SEQ ID NO: 3280913 - RNA, 20 nt, Vaccinia virus
uauuucaaaauuauuuacca

SEQ ID NO: 3280914 - RNA, 21 nt, Vaccinia virus
cauuaauuucugauauggaau

SEQ ID NO: 3280915 - RNA, 21 nt, Vaccinia virus
uauucgucgucgacuaucaac

SEQ ID NO: 3280916 - RNA, 23 nt, Vaccinia virus
aauucuauauauguuuucaucau

SEQ ID NO: 3280917 - RNA, 15 nt, Vaccinia virus
aucuuuuuaggaaug

SEQ ID NO: 3280918 - RNA, 15 nt, Vaccinia virus
ucaaaguuucugaaa

SEQ ID NO: 3280919 - RNA, 20 nt, Vaccinia virus
auauugauaucuuuuugaau

SEQ ID NO: 3280920 - RNA, 21 nt, Vaccinia virus
uaccguaguauauugagagug

SEQ ID NO: 3280921 - RNA, 12 nt, Vaccinia virus
uauauguagcaa

SEQ ID NO: 3280922 - RNA, 13 nt, Vaccinia virus
acaguuaaaacua

SEQ ID NO: 3280923 - RNA, 19 nt, Vaccinia virus
aauauuaauauuagaguua

SEQ ID NO: 3280924 - RNA, 17 nt, Vaccinia virus
caguuucucaucuuuua

SEQ ID NO: 3280925 - RNA, 14 nt, Vaccinia virus
cucuauucaucuga

SEQ ID NO: 3280926 - RNA, 23 nt, Vaccinia virus
auauagucuuggaucaaauagau

SEQ ID NO: 3280927 - RNA, 13 nt, Vaccinia virus
auuuuuuaucaua

SEQ ID NO: 3280928 - RNA, 17 nt, Vaccinia virus
guuuucccauacuaauu

SEQ ID NO: 3280929 - RNA, 13 nt, Vaccinia virus
accacuagcaaaa

SEQ ID NO: 3280930 - RNA, 14 nt, Vaccinia virus
agauacaaauaugu

SEQ ID NO: 3280931 - RNA, 14 nt, Vaccinia virus
gacucauuaaaacu

SEQ ID NO: 3280932 - RNA, 20 nt, Vaccinia virus
cauauuuaucaauucuucua

SEQ ID NO: 3280933 - RNA, 17 nt, Vaccinia virus
uuaauaaaguaugaaca

SEQ ID NO: 3280934 - RNA, 17 nt, Vaccinia virus
gagacgaucuacuauca

SEQ ID NO: 3280935 - RNA, 21 nt, Vaccinia virus
gcuaauaaugacuguagauau

SEQ ID NO: 3280936 - RNA, 13 nt, Vaccinia virus
aucacuucaauaa

SEQ ID NO: 3280937 - RNA, 16 nt, Vaccinia virus
uuacauuauaagaaau

SEQ ID NO: 3280938 - RNA, 23 nt, Vaccinia virus
uacaccaucaauagauaaaacga

SEQ ID NO: 3280939 - RNA, 14 nt, Vaccinia virus
auuaucaaauggau

SEQ ID NO: 3280940 - RNA, 14 nt, Vaccinia virus
uagaugguucuuua

SEQ ID NO: 3280941 - RNA, 23 nt, Vaccinia virus
uagugaugaauugaaaauuauuu

SEQ ID NO: 3280942 - RNA, 21 nt, Vaccinia virus
cuguaggaaauggaagauauu

SEQ ID NO: 3280943 - RNA, 12 nt, Vaccinia virus
aaggacaaaaug

SEQ ID NO: 3280944 - RNA, 18 nt, Vaccinia virus
auuaucaaaauuuggaaa

SEQ ID NO: 3280945 - RNA, 16 nt, Vaccinia virus
uuacuauagcauuaau

SEQ ID NO: 3280946 - RNA, 15 nt, Vaccinia virus
aacgccuuuagaaaa

SEQ ID NO: 3280947 - RNA, 13 nt, Vaccinia virus
aaagaauaauccu

SEQ ID NO: 3280948 - RNA, 17 nt, Vaccinia virus
caguacacgaaugauuu

SEQ ID NO: 3280949 - RNA, 16 nt, Vaccinia virus
aaugcccguaaagaua

SEQ ID NO: 3280950 - RNA, 18 nt, Vaccinia virus
auagaauuuauaacauga

SEQ ID NO: 3280951 - RNA, 18 nt, Vaccinia virus
cgacugugauaauaauac

SEQ ID NO: 3280952 - RNA, 23 nt, Vaccinia virus
uuagacauaaaaacuaauauuag

SEQ ID NO: 3280953 - RNA, 16 nt, Vaccinia virus
acauuuuuuguuuugg

SEQ ID NO: 3280954 - RNA, 12 nt, Vaccinia virus
cagaacuauuag

SEQ ID NO: 3280955 - RNA, 22 nt, Vaccinia virus
aauaaacuccguagagaaauau

SEQ ID NO: 3280956 - RNA, 19 nt, Vaccinia virus
uucgguauaaaaauuauug

SEQ ID NO: 3280957 - RNA, 14 nt, Vaccinia virus
agcaucuaacuuga

SEQ ID NO: 3280958 - RNA, 12 nt, Vaccinia virus
auaaauagagaa

SEQ ID NO: 3280959 - RNA, 16 nt, Vaccinia virus
gauccuuuucuucaga

SEQ ID NO: 3280960 - RNA, 23 nt, Vaccinia virus
caacgaauacaaacgccauaauu

SEQ ID NO: 3280961 - RNA, 15 nt, Vaccinia virus
uuguacauguaauga

SEQ ID NO: 3280962 - RNA, 19 nt, Vaccinia virus
gacaucuggauuucagaua

SEQ ID NO: 3280963 - RNA, 21 nt, Vaccinia virus
guaacucuaguaaaauaauca

SEQ ID NO: 3280964 - RNA, 13 nt, Vaccinia virus
auaauuugaucca

SEQ ID NO: 3280965 - RNA, 17 nt, Vaccinia virus
ucauaucacauaguguu

SEQ ID NO: 3280966 - RNA, 20 nt, Vaccinia virus
auguucuuaaucaauguaca

SEQ ID NO: 3280967 - RNA, 17 nt, Vaccinia virus
uagauacaauggaugau

SEQ ID NO: 3280968 - RNA, 18 nt, Vaccinia virus
acauggaauaaauuauua

SEQ ID NO: 3280969 - RNA, 16 nt, Vaccinia virus
auaccaguuauguuua

SEQ ID NO: 3280970 - RNA, 14 nt, Vaccinia virus
cccaaauaucuuua

SEQ ID NO: 3280971 - RNA, 21 nt, Vaccinia virus
aaaugaggucgcaaaaaaacu

SEQ ID NO: 3280972 - RNA, 18 nt, Vaccinia virus
aggccaagcgaauuauuu

SEQ ID NO: 3280973 - RNA, 15 nt, Vaccinia virus
ucauguuauaguguu

SEQ ID NO: 3280974 - RNA, 18 nt, Vaccinia virus
caucuucgucuauuucua

SEQ ID NO: 3280975 - RNA, 14 nt, Vaccinia virus
cuccaaucaugugu

SEQ ID NO: 3280976 - RNA, 14 nt, Vaccinia virus
aauuuaaaaugaua

SEQ ID NO: 3280977 - RNA, 18 nt, Vaccinia virus
uaucuuaaauaacucauu

SEQ ID NO: 3280978 - RNA, 19 nt, Vaccinia virus
gaaguuuuaaaaauacuua

SEQ ID NO: 3280979 - RNA, 20 nt, Vaccinia virus
agaguuaucaagagaaaauu

SEQ ID NO: 3280980 - RNA, 22 nt, Vaccinia virus
aucaaaaccauuucuaagagaa

SEQ ID NO: 3280981 - RNA, 20 nt, Vaccinia virus
gauccacaaaacguauauag

SEQ ID NO: 3280982 - RNA, 19 nt, Vaccinia virus
ccuguauucuuuuuaagau

SEQ ID NO: 3280983 - RNA, 16 nt, Vaccinia virus
cugcuauauggauauu

SEQ ID NO: 3280984 - RNA, 16 nt, Vaccinia virus
aacguacaaauggaua

SEQ ID NO: 3280985 - RNA, 16 nt, Vaccinia virus
aaacauacaucuguuu

SEQ ID NO: 3280986 - RNA, 23 nt, Vaccinia virus
auaaauuugucauuuaugauaua

SEQ ID NO: 3280987 - RNA, 13 nt, Vaccinia virus
uaacaaagaaaga

SEQ ID NO: 3280988 - RNA, 17 nt, Vaccinia virus
uguuuuagugauaucaa

SEQ ID NO: 3280989 - RNA, 17 nt, Vaccinia virus
uaucaauuaaauaauua

SEQ ID NO: 3280990 - RNA, 17 nt, Vaccinia virus
ccucaaacucuauuuua

SEQ ID NO: 3280991 - RNA, 15 nt, Vaccinia virus
auauaguauauagau

SEQ ID NO: 3280992 - RNA, 21 nt, Vaccinia virus
acgaaccagaaagugcaaaug

SEQ ID NO: 3280993 - RNA, 13 nt, Vaccinia virus
augguaaauacug

SEQ ID NO: 3280994 - RNA, 15 nt, Vaccinia virus
uuccauuuuuaauuu

SEQ ID NO: 3280995 - RNA, 17 nt, Vaccinia virus
uaucucaauaguuucau

SEQ ID NO: 3280996 - RNA, 19 nt, Vaccinia virus
uaauuguuauuauuucauu

SEQ ID NO: 3280997 - RNA, 16 nt, Vaccinia virus
auaaauaguucaacau

SEQ ID NO: 3280998 - RNA, 16 nt, Vaccinia virus
uuauauucucuggaau

SEQ ID NO: 3280999 - RNA, 14 nt, Vaccinia virus
aaacaaagaauugu

SEQ ID NO: 3281000 - RNA, 22 nt, Vaccinia virus
uucaauaauucuauucuaguau

SEQ ID NO: 3281001 - RNA, 19 nt, Vaccinia virus
uauaucugaguaugaugau

SEQ ID NO: 3281002 - RNA, 14 nt, Vaccinia virus
uauauaguuuuuua

SEQ ID NO: 3281003 - RNA, 16 nt, Vaccinia virus
agguauauuuauucca

SEQ ID NO: 3281004 - RNA, 16 nt, Vaccinia virus
auuuuuaauagcugcu

SEQ ID NO: 3281005 - RNA, 23 nt, Vaccinia virus
acuccuuauuuuuagacauuaga

SEQ ID NO: 3281006 - RNA, 15 nt, Vaccinia virus
ucauggcaucauaga

SEQ ID NO: 3281007 - RNA, 20 nt, Vaccinia virus
uugaaauuguuuuuuauuuu

SEQ ID NO: 3281008 - RNA, 16 nt, Vaccinia virus
augauugauuagaaaa

SEQ ID NO: 3281009 - RNA, 23 nt, Vaccinia virus
gauucaggaaucguuuauucgau

SEQ ID NO: 3281010 - RNA, 19 nt, Vaccinia virus
aucacuauauguuccagua

SEQ ID NO: 3281011 - RNA, 17 nt, Vaccinia virus
caaauagagcaauuacu

SEQ ID NO: 3281012 - RNA, 20 nt, Vaccinia virus
ugauagcaauucauguacca

SEQ ID NO: 3281013 - RNA, 22 nt, Vaccinia virus
cauuacuaucuuuaacauaagu

SEQ ID NO: 3281014 - RNA, 19 nt, Vaccinia virus
cuuugauggcugauagugu

SEQ ID NO: 3281015 - RNA, 12 nt, Vaccinia virus
cuuuaaauacuu

SEQ ID NO: 3281016 - RNA, 20 nt, Vaccinia virus
gacaacuuaaucugaugaau

SEQ ID NO: 3281017 - RNA, 20 nt, Vaccinia virus
gagcuaaacacauuagauau

SEQ ID NO: 3281018 - RNA, 15 nt, Vaccinia virus
ucucgaugaaaauaa

SEQ ID NO: 3281019 - RNA, 18 nt, Vaccinia virus
auucauauucuuaaaagg

SEQ ID NO: 3281020 - RNA, 19 nt, Vaccinia virus
auaacuucuaaucuuguaa

SEQ ID NO: 3281021 - RNA, 16 nt, Vaccinia virus
uagaguaucguugaga

SEQ ID NO: 3281022 - RNA, 20 nt, Vaccinia virus
accaacguauagagguauau

SEQ ID NO: 3281023 - RNA, 16 nt, Vaccinia virus
uacuuucgguuucaua

SEQ ID NO: 3281024 - RNA, 14 nt, Vaccinia virus
uuauacacugguua

SEQ ID NO: 3281025 - RNA, 21 nt, Vaccinia virus
uauaaaauacuaaugcaucua

SEQ ID NO: 3281026 - RNA, 21 nt, Vaccinia virus
gauuuauuugauaaucauguu

SEQ ID NO: 3281027 - RNA, 18 nt, Vaccinia virus
uaucgcuaaaauuuucau

SEQ ID NO: 3281028 - RNA, 22 nt, Vaccinia virus
uaacuaucuguaaaagcauaug

SEQ ID NO: 3281029 - RNA, 22 nt, Vaccinia virus
gauacguacugucuauaaugac

SEQ ID NO: 3281030 - RNA, 16 nt, Vaccinia virus
uucaaucugagauucu

SEQ ID NO: 3281031 - RNA, 21 nt, Vaccinia virus
cuuaggcggauucaguacaau

SEQ ID NO: 3281032 - RNA, 13 nt, Vaccinia virus
ggauuuucuagau

SEQ ID NO: 3281033 - RNA, 19 nt, Vaccinia virus
ugaaaucaguggaguagua

SEQ ID NO: 3281034 - RNA, 23 nt, Vaccinia virus
auuucuggaaugacgaauccugu

SEQ ID NO: 3281035 - RNA, 14 nt, Vaccinia virus
guaucgcacgcucu

SEQ ID NO: 3281036 - RNA, 15 nt, Vaccinia virus
auuaucaagaugugu

SEQ ID NO: 3281037 - RNA, 13 nt, Vaccinia virus
auuaauacauuua

SEQ ID NO: 3281038 - RNA, 21 nt, Vaccinia virus
gucuacaauuugggacaauga

SEQ ID NO: 3281039 - RNA, 14 nt, Vaccinia virus
guauuaauaauauc

SEQ ID NO: 3281040 - RNA, 22 nt, Vaccinia virus
guaacuaguuuuauacacaucu

SEQ ID NO: 3281041 - RNA, 22 nt, Vaccinia virus
auucuaaagagauuuagacaac

SEQ ID NO: 3281042 - RNA, 18 nt, Vaccinia virus
acuaaucguaauauucua

SEQ ID NO: 3281043 - RNA, 13 nt, Vaccinia virus
uacaaaaucgauu

SEQ ID NO: 3281044 - RNA, 14 nt, Vaccinia virus
ugagauauauacac

SEQ ID NO: 3281045 - RNA, 20 nt, Vaccinia virus
cuuuauaucguguucauuaa

SEQ ID NO: 3281046 - RNA, 15 nt, Vaccinia virus
aagaucauacagaca

SEQ ID NO: 3281047 - RNA, 15 nt, Vaccinia virus
acauuuuuauaaaca

SEQ ID NO: 3281048 - RNA, 22 nt, Vaccinia virus
ucauaacuccggauagagaaau

SEQ ID NO: 3281049 - RNA, 18 nt, Vaccinia virus
cauuacaaagaagaacug

SEQ ID NO: 3281050 - RNA, 16 nt, Vaccinia virus
aaagauuaauuauccg

SEQ ID NO: 3281051 - RNA, 22 nt, Vaccinia virus
gaggacuguuuuccugaaggaa

SEQ ID NO: 3281052 - RNA, 17 nt, Vaccinia virus
aauugggguauuaauaa

SEQ ID NO: 3281053 - RNA, 17 nt, Vaccinia virus
cuaccacacuucuagau

SEQ ID NO: 3281054 - RNA, 20 nt, Vaccinia virus
cacuaauaucgauauacaaa

SEQ ID NO: 3281055 - RNA, 16 nt, Vaccinia virus
acuaggagaauuauuu

SEQ ID NO: 3281056 - RNA, 18 nt, Vaccinia virus
uagcuccccuguuuucau

SEQ ID NO: 3281057 - RNA, 16 nt, Vaccinia virus
acauuucucaaaugaa

SEQ ID NO: 3281058 - RNA, 13 nt, Vaccinia virus
gcaauaucaucua

SEQ ID NO: 3281059 - RNA, 16 nt, Vaccinia virus
ucaaaauauguagaaa

SEQ ID NO: 3281060 - RNA, 14 nt, Vaccinia virus
auaaauaacaaugg

SEQ ID NO: 3281061 - RNA, 14 nt, Vaccinia virus
ucagaaucguauau

SEQ ID NO: 3281062 - RNA, 21 nt, Vaccinia virus
auuucaaauaggucuucgucu

SEQ ID NO: 3281063 - RNA, 18 nt, Vaccinia virus
uuuuaaacaacuaaacag

SEQ ID NO: 3281064 - RNA, 18 nt, Vaccinia virus
uaacugacuuaauaguag

SEQ ID NO: 3281065 - RNA, 16 nt, Vaccinia virus
uuuaagaaauggugua

SEQ ID NO: 3281066 - RNA, 14 nt, Vaccinia virus
uucaacauguuuaa

SEQ ID NO: 3281067 - RNA, 15 nt, Vaccinia virus
uaaugaaauuauuca

SEQ ID NO: 3281068 - RNA, 14 nt, Vaccinia virus
acaguuaacgaaag

SEQ ID NO: 3281069 - RNA, 18 nt, Vaccinia virus
uaacaaaaauuaugaaau

SEQ ID NO: 3281070 - RNA, 13 nt, Vaccinia virus
gacaaauacucua

SEQ ID NO: 3281071 - RNA, 19 nt, Vaccinia virus
uagguauuuuaucucuauu

SEQ ID NO: 3281072 - RNA, 23 nt, Vaccinia virus
aauuuuuugguagguuuuagaga

SEQ ID NO: 3281073 - RNA, 20 nt, Vaccinia virus
ucaacgaucuaauacaaaau

SEQ ID NO: 3281074 - RNA, 14 nt, Vaccinia virus
uaccaaucauuuau

SEQ ID NO: 3281075 - RNA, 16 nt, Vaccinia virus
uccggauccuuuucuu

SEQ ID NO: 3281076 - RNA, 14 nt, Vaccinia virus
uuacuccuuaaaaa

SEQ ID NO: 3281077 - RNA, 22 nt, Vaccinia virus
cuuuuagagguucccaauucca

SEQ ID NO: 3281078 - RNA, 13 nt, Vaccinia virus
aaaaaauuauacu

SEQ ID NO: 3281079 - RNA, 22 nt, Vaccinia virus
ucuccaugauuaaauauuuuaa

SEQ ID NO: 3281080 - RNA, 16 nt, Vaccinia virus
ucauacaugauauuca

SEQ ID NO: 3281081 - RNA, 19 nt, Vaccinia virus
gccaguccuccuacagauu

SEQ ID NO: 3281082 - RNA, 19 nt, Vaccinia virus
aacaaauucugcaauaucu

SEQ ID NO: 3281083 - RNA, 16 nt, Vaccinia virus
gaacagauaguuuauc

SEQ ID NO: 3281084 - RNA, 20 nt, Vaccinia virus
cuuuuaguaacguaugugaa

SEQ ID NO: 3281085 - RNA, 21 nt, Vaccinia virus
uggaauucaguuggaauauug

SEQ ID NO: 3281086 - RNA, 17 nt, Vaccinia virus
agcauuguuauguauuu

SEQ ID NO: 3281087 - RNA, 16 nt, Vaccinia virus
aaccugaucuggaaaa

SEQ ID NO: 3281088 - RNA, 14 nt, Vaccinia virus
uauaugauaucuuu

SEQ ID NO: 3281089 - RNA, 16 nt, Vaccinia virus
guuuaauuuucacaag

SEQ ID NO: 3281090 - RNA, 12 nt, Vaccinia virus
acacucucaaua

SEQ ID NO: 3281091 - RNA, 22 nt, Vaccinia virus
uagagccugugaaugcaaucaa

SEQ ID NO: 3281092 - RNA, 18 nt, Vaccinia virus
ucuaccguuguuaaauac

SEQ ID NO: 3281093 - RNA, 16 nt, Vaccinia virus
uuauuauuucauuaau

SEQ ID NO: 3281094 - RNA, 21 nt, Vaccinia virus
cuugauuaccuuacucaugau

SEQ ID NO: 3281095 - RNA, 18 nt, Vaccinia virus
caaacuuuuucacagagc

SEQ ID NO: 3281096 - RNA, 15 nt, Vaccinia virus
aaugucaaguuuauu

SEQ ID NO: 3281097 - RNA, 17 nt, Vaccinia virus
ucauaauugcuuuucua

SEQ ID NO: 3281098 - RNA, 14 nt, Vaccinia virus
uauuauuacguguu

SEQ ID NO: 3281099 - RNA, 15 nt, Vaccinia virus
cagauauuuuaguuu

SEQ ID NO: 3281100 - RNA, 13 nt, Vaccinia virus
cacauauugaugu

SEQ ID NO: 3281101 - RNA, 15 nt, Vaccinia virus
cgucuguuuuuguuu

SEQ ID NO: 3281102 - RNA, 21 nt, Vaccinia virus
cuauacauuguugcaucgugu

SEQ ID NO: 3281103 - RNA, 14 nt, Vaccinia virus
cuauacuaugaugu

SEQ ID NO: 3281104 - RNA, 22 nt, Vaccinia virus
cuauaguccugucuuucgaugu

SEQ ID NO: 3281105 - RNA, 12 nt, Vaccinia virus
cuauaucgaugu

SEQ ID NO: 3281106 - RNA, 20 nt, Vaccinia virus
cuauauuacgcggucgaugu

SEQ ID NO: 3281107 - RNA, 16 nt, Vaccinia virus
cuaguaucuuuuguuc

SEQ ID NO: 3281108 - RNA, 20 nt, Vaccinia virus
gauucaacaaaacucaaagc

SEQ ID NO: 3281109 - RNA, 14 nt, Vaccinia virus
aucuacaucuaugu

SEQ ID NO: 3281110 - RNA, 20 nt, Vaccinia virus
caucuuggacggaaucgauu

SEQ ID NO: 3281111 - RNA, 13 nt, Vaccinia virus
caugauaucaugu

SEQ ID NO: 3281112 - RNA, 20 nt, Vaccinia virus
caugauuucauuaucggugu

SEQ ID NO: 3281113 - RNA, 13 nt, Vaccinia virus
caucuaucgaugg

SEQ ID NO: 3281114 - RNA, 18 nt, Vaccinia virus
caucuauuaaguuuuuuu

SEQ ID NO: 3281115 - RNA, 22 nt, Vaccinia virus
caucuauuucaucguuuuguau

SEQ ID NO: 3281116 - RNA, 17 nt, Vaccinia virus
cauacagcucaucgauu

SEQ ID NO: 3281117 - RNA, 19 nt, Vaccinia virus
cauaaggaaacuuuuguuu

SEQ ID NO: 3281118 - RNA, 15 nt, Vaccinia virus
augcauaaucgauau

SEQ ID NO: 3281119 - RNA, 21 nt, Vaccinia virus
augauacuucacucaucgauu

SEQ ID NO: 3281120 - RNA, 18 nt, Vaccinia virus
aucugaaggugcaaccga

SEQ ID NO: 3281121 - RNA, 13 nt, Vaccinia virus
aucuauuuuuguu

SEQ ID NO: 3281122 - RNA, 13 nt, Vaccinia virus
aucuuaaucgagu

SEQ ID NO: 3281123 - RNA, 13 nt, Vaccinia virus
cgacuuuuuguuu

SEQ ID NO: 3281124 - RNA, 21 nt, Vaccinia virus
cgacuaucaacaauuuuguau

SEQ ID NO: 3281125 - RNA, 21 nt, Vaccinia virus
cgacaugauuaaguauuguuu

SEQ ID NO: 3281126 - RNA, 19 nt, Vaccinia virus
cgauguuuaacuuuuguuc

SEQ ID NO: 3281127 - RNA, 18 nt, Vaccinia virus
cgauauuucuuuucguuu

SEQ ID NO: 3281128 - RNA, 14 nt, Vaccinia virus
cgauagaucgaugg

SEQ ID NO: 3281129 - RNA, 16 nt, Vaccinia virus
cuuauauugaugaugu

SEQ ID NO: 3281130 - RNA, 19 nt, Vaccinia virus
cuucagaaauuaucgaugu

SEQ ID NO: 3281131 - RNA, 18 nt, Vaccinia virus
gucgacguuucucaaagu

SEQ ID NO: 3281132 - RNA, 18 nt, Vaccinia virus
aacucuuugauuuuguau

SEQ ID NO: 3281133 - RNA, 18 nt, Vaccinia virus
aacuauguucauuuuuuu

SEQ ID NO: 3281134 - RNA, 20 nt, Vaccinia virus
aacuauuaacuauuuugucu

SEQ ID NO: 3281135 - RNA, 15 nt, Vaccinia virus
aacuauuguuuuguu

SEQ ID NO: 3281136 - RNA, 12 nt, Vaccinia virus
aacuauuuuuuu

SEQ ID NO: 3281137 - RNA, 18 nt, Vaccinia virus
aacucucucauuuucuuu

SEQ ID NO: 3281138 - RNA, 16 nt, Vaccinia virus
aacguauauuuuauuu

SEQ ID NO: 3281139 - RNA, 19 nt, Vaccinia virus
aacuugguauuuuuugguu

SEQ ID NO: 3281140 - RNA, 23 nt, Vaccinia virus
aacuuugaaauuguuuuuuauuu

SEQ ID NO: 3281141 - RNA, 21 nt, Vaccinia virus
aacuuauaauccuuuuuauuu

SEQ ID NO: 3281142 - RNA, 20 nt, Vaccinia virus
caacaaagaaauuuuugguu

SEQ ID NO: 3281143 - RNA, 15 nt, Vaccinia virus
caacaauuuuuuguu

SEQ ID NO: 3281144 - RNA, 16 nt, Vaccinia virus
caaaucuauauuguuu

SEQ ID NO: 3281145 - RNA, 21 nt, Vaccinia virus
caaauaucggcauuuauguuu

SEQ ID NO: 3281146 - RNA, 16 nt, Vaccinia virus
caaaaguccaugauca

SEQ ID NO: 3281147 - RNA, 21 nt, Vaccinia virus
caaaaugauagauauuuuuuu

SEQ ID NO: 3281148 - RNA, 18 nt, Vaccinia virus
cauuuauaucauuuguuu

SEQ ID NO: 3281149 - RNA, 15 nt, Vaccinia virus
cauuauacuuuuuuu

SEQ ID NO: 3281150 - RNA, 14 nt, Vaccinia virus
cauuaucuuuguuu

SEQ ID NO: 3281151 - RNA, 14 nt, Vaccinia virus
cauucuaaugaugu

SEQ ID NO: 3281152 - RNA, 21 nt, Vaccinia virus
cgcuauugcacaauuuuguuu

SEQ ID NO: 3281153 - RNA, 15 nt, Vaccinia virus
aaaauccuccuauca

SEQ ID NO: 3281154 - RNA, 16 nt, Vaccinia virus
aaaaauuauccuauca

SEQ ID NO: 3281155 - RNA, 14 nt, Vaccinia virus
ccuaaauuuuguug

SEQ ID NO: 3281156 - RNA, 18 nt, Vaccinia virus
ccuauuccacauuuuguu

SEQ ID NO: 3281157 - RNA, 19 nt, Vaccinia virus
ccuauuccacauuuuguuu

SEQ ID NO: 3281158 - RNA, 22 nt, Vaccinia virus
ccuauugaucuucauuucguuu

SEQ ID NO: 3281159 - RNA, 17 nt, Vaccinia virus
cguuuauccuuuuguug

SEQ ID NO: 3281160 - RNA, 17 nt, Vaccinia virus
cuacaucaguuuuguau

SEQ ID NO: 3281161 - RNA, 15 nt, Vaccinia virus
cuaaaauaucgaugu

SEQ ID NO: 3281162 - RNA, 20 nt, Vaccinia virus
cagaaucuagauuccaauca

SEQ ID NO: 3281163 - RNA, 13 nt, Vaccinia virus
acuuguuuuguuc

SEQ ID NO: 3281164 - RNA, 18 nt, Vaccinia virus
caccuaccuuaaucaugu

SEQ ID NO: 3281165 - RNA, 16 nt, Vaccinia virus
cacgauuaauuuuuuu

SEQ ID NO: 3281166 - RNA, 21 nt, Vaccinia virus
cacuaaauaguuuuuuuguuu

SEQ ID NO: 3281167 - RNA, 18 nt, Vaccinia virus
cacugcuggcaucgaugu

SEQ ID NO: 3281168 - RNA, 17 nt, Vaccinia virus
auuauaaauauugaugu

SEQ ID NO: 3281169 - RNA, 14 nt, Vaccinia virus
auuauacaucgagu

SEQ ID NO: 3281170 - RNA, 17 nt, Vaccinia virus
auaauagccaaucgauu

SEQ ID NO: 3281171 - RNA, 20 nt, Vaccinia virus
auaauagguuugaucguugu

SEQ ID NO: 3281172 - RNA, 15 nt, Vaccinia virus
auaauaacaucgauu

SEQ ID NO: 3281173 - RNA, 19 nt, Vaccinia virus
auaauaaucucgucgaugu

SEQ ID NO: 3281174 - RNA, 16 nt, Vaccinia virus
auuguacuaucgaugu

SEQ ID NO: 3281175 - RNA, 20 nt, Vaccinia virus
cauaguagugagaucgacgu

SEQ ID NO: 3281176 - RNA, 22 nt, Vaccinia virus
cauauaauuauacuaucgauga

SEQ ID NO: 3281177 - RNA, 18 nt, Vaccinia virus
cauauagauauuuucuuu

SEQ ID NO: 3281178 - RNA, 20 nt, Vaccinia virus
cauauucuaccuuuuuauuu

SEQ ID NO: 3281179 - RNA, 14 nt, Vaccinia virus
cauauugacgaugu

SEQ ID NO: 3281180 - RNA, 20 nt, Vaccinia virus
cauaucgucuagauuuuguu

SEQ ID NO: 3281181 - RNA, 16 nt, Vaccinia virus
cauaugauguuuguuu

SEQ ID NO: 3281182 - RNA, 18 nt, Vaccinia virus
cauauuacaaaaucgauu

SEQ ID NO: 3281183 - RNA, 15 nt, Vaccinia virus
auuuggauuuuguug

SEQ ID NO: 3281184 - RNA, 15 nt, Vaccinia virus
cauacuaauagaugu

SEQ ID NO: 3281185 - RNA, 17 nt, Vaccinia virus
cauacuauguuuuguau

SEQ ID NO: 3281186 - RNA, 19 nt, Vaccinia virus
cauccauuuuaugcgaugu

SEQ ID NO: 3281187 - RNA, 22 nt, Vaccinia virus
caucaucgaagagcauuuuguu

SEQ ID NO: 3281188 - RNA, 20 nt, Vaccinia virus
caucauaugggaaucgaugu

SEQ ID NO: 3281189 - RNA, 18 nt, Vaccinia virus
caucgcauuguacgaugu

SEQ ID NO: 3281190 - RNA, 13 nt, Vaccinia virus
agaugccauauca

SEQ ID NO: 3281191 - RNA, 19 nt, Vaccinia virus
auaaacuuuauccauaucu

SEQ ID NO: 3281192 - RNA, 20 nt, Vaccinia virus
aauuauuuaguuuuuucuuu

SEQ ID NO: 3281193 - RNA, 15 nt, Vaccinia virus
aauuucauuuuguuu

SEQ ID NO: 3281194 - RNA, 13 nt, Vaccinia virus
aauguuuuuguuu

SEQ ID NO: 3281195 - RNA, 16 nt, Vaccinia virus
aauguaauuuuuguuu

SEQ ID NO: 3281196 - RNA, 13 nt, Vaccinia virus
aacauuuuuguug

SEQ ID NO: 3281197 - RNA, 14 nt, Vaccinia virus
aacauuuuuuguuu

SEQ ID NO: 3281198 - RNA, 19 nt, Vaccinia virus
gauacuaucggcucaaaga

SEQ ID NO: 3281199 - RNA, 20 nt, Vaccinia virus
cucauguucuuaaucaaugu

SEQ ID NO: 3281200 - RNA, 19 nt, Vaccinia virus
cucaguaaauguaucgugu

SEQ ID NO: 3281201 - RNA, 15 nt, Vaccinia virus
cucauaguaucgauu

SEQ ID NO: 3281202 - RNA, 23 nt, Vaccinia virus
cucauauggaucuccaucgauga

SEQ ID NO: 3281203 - RNA, 20 nt, Vaccinia virus
uucguugucuuuacacuuuc

SEQ ID NO: 3281204 - RNA, 20 nt, Vaccinia virus
cuuuagaauguuaucgauga

SEQ ID NO: 3281205 - RNA, 17 nt, Vaccinia virus
cuucuaccguuuuguuc

SEQ ID NO: 3281206 - RNA, 16 nt, Vaccinia virus
cuucuuccuuuuguuc

SEQ ID NO: 3281207 - RNA, 20 nt, Vaccinia virus
gaagcguauguucccggaca

SEQ ID NO: 3281208 - RNA, 22 nt, Vaccinia virus
cugauacaaucucuuaucaugu

SEQ ID NO: 3281209 - RNA, 18 nt, Vaccinia virus
auauagauuuuaucgauu

SEQ ID NO: 3281210 - RNA, 17 nt, Vaccinia virus
auauaguauauagaugu

SEQ ID NO: 3281211 - RNA, 16 nt, Vaccinia virus
auagauguaucgauga

SEQ ID NO: 3281212 - RNA, 16 nt, Vaccinia virus
aucagaugaucgauga

SEQ ID NO: 3281213 - RNA, 22 nt, Vaccinia virus
aucaaagaucuuguuaucgauu

SEQ ID NO: 3281214 - RNA, 23 nt, Vaccinia virus
aucaaguuggccauuaucgauau

SEQ ID NO: 3281215 - RNA, 16 nt, Vaccinia virus
aucauaagcaucaugu

SEQ ID NO: 3281216 - RNA, 22 nt, Vaccinia virus
aucauaucuauaucauccaugu

SEQ ID NO: 3281217 - RNA, 23 nt, Vaccinia virus
caaccagguaggcaguuuuauuu

SEQ ID NO: 3281218 - RNA, 16 nt, Vaccinia virus
caacauacuauuguuu

SEQ ID NO: 3281219 - RNA, 23 nt, Vaccinia virus
caacgauaaaaauaauauuguuu

SEQ ID NO: 3281220 - RNA, 17 nt, Vaccinia virus
caacgaucuuguuguuu

SEQ ID NO: 3281221 - RNA, 20 nt, Vaccinia virus
caacuaguuuucaucaaugu

SEQ ID NO: 3281222 - RNA, 19 nt, Vaccinia virus
caacuauccucguuuuguu

SEQ ID NO: 3281223 - RNA, 18 nt, Vaccinia virus
caacucuauaguuuguuu

SEQ ID NO: 3281224 - RNA, 14 nt, Vaccinia virus
caauauauuuuuuu

SEQ ID NO: 3281225 - RNA, 20 nt, Vaccinia virus
caauaucaauaaauuuuuuu

SEQ ID NO: 3281226 - RNA, 13 nt, Vaccinia virus
caauauuuaguuu

SEQ ID NO: 3281227 - RNA, 15 nt, Vaccinia virus
caauauuuuucguuu

SEQ ID NO: 3281228 - RNA, 23 nt, Vaccinia virus
caauaaaggagucuuauagaugu

SEQ ID NO: 3281229 - RNA, 15 nt, Vaccinia virus
caauaaauccgaugu

SEQ ID NO: 3281230 - RNA, 20 nt, Vaccinia virus
caauaagucuauaucgaugu

SEQ ID NO: 3281231 - RNA, 19 nt, Vaccinia virus
caaucuccauuauuuuuuu

SEQ ID NO: 3281232 - RNA, 17 nt, Vaccinia virus
caauguuuaauuuuuuu

SEQ ID NO: 3281233 - RNA, 17 nt, Vaccinia virus
caauuaucauuuugauu

SEQ ID NO: 3281234 - RNA, 15 nt, Vaccinia virus
caauuuauuuuguau

SEQ ID NO: 3281235 - RNA, 17 nt, Vaccinia virus
aauauuggcuuuucuuu

SEQ ID NO: 3281236 - RNA, 15 nt, Vaccinia virus
aauauuguauuguuu

SEQ ID NO: 3281237 - RNA, 14 nt, Vaccinia virus
aauagguuuuguuc

SEQ ID NO: 3281238 - RNA, 16 nt, Vaccinia virus
aauauccauuuuguuc

SEQ ID NO: 3281239 - RNA, 14 nt, Vaccinia virus
aauauuuuuaguuu

SEQ ID NO: 3281240 - RNA, 13 nt, Vaccinia virus
aauauuuuuauuu

SEQ ID NO: 3281241 - RNA, 23 nt, Variola virus
uuauuauagugguggaauucagu

SEQ ID NO: 3281242 - RNA, 19 nt, Variola virus
aauaaacuaaacaaaacug

SEQ ID NO: 3281243 - RNA, 17 nt, Variola virus
guauauacuuagauaua

SEQ ID NO: 3281244 - RNA, 17 nt, Variola virus
cauucuaauguucauaa

SEQ ID NO: 3281245 - RNA, 21 nt, Variola virus
uuccaucgguauaaaaaucau

SEQ ID NO: 3281246 - RNA, 21 nt, Variola virus
cuauauaaagguccuauucca

SEQ ID NO: 3281247 - RNA, 19 nt, Variola virus
auauauuuucacuuuaucu

SEQ ID NO: 3281248 - RNA, 11 nt, Variola virus
cuagauacauu

SEQ ID NO: 3281249 - RNA, 14 nt, Variola virus
gaggacguauauaa

SEQ ID NO: 3281250 - RNA, 17 nt, Variola virus
cugcuauaauuaagaua

SEQ ID NO: 3281251 - RNA, 19 nt, Variola virus
uuaguaucuagcucuguaa

SEQ ID NO: 3281252 - RNA, 14 nt, Variola virus
auaauauuaauauu

SEQ ID NO: 3281253 - RNA, 14 nt, Variola virus
gaggaagaagaugg

SEQ ID NO: 3281254 - RNA, 15 nt, Variola virus
ucucgaugaaaauaa

SEQ ID NO: 3281255 - RNA, 22 nt, Variola virus
acaguaaguacaucaucugaaa

SEQ ID NO: 3281256 - RNA, 20 nt, Variola virus
agaucgcguuaaucauguac

SEQ ID NO: 3281257 - RNA, 22 nt, Variola virus
uuaacguaucgcauuaauacug

SEQ ID NO: 3281258 - RNA, 17 nt, Variola virus
auuaaaccuaaauaauu

SEQ ID NO: 3281259 - RNA, 18 nt, Variola virus
caaauaagaagguacaau

SEQ ID NO: 3281260 - RNA, 15 nt, Variola virus
auugaguggaaaguu

SEQ ID NO: 3281261 - RNA, 13 nt, Variola virus
aaguuagaaucuc

SEQ ID NO: 3281262 - RNA, 24 nt, Variola virus
aauuguuuugaauuucuuagucau

SEQ ID NO: 3281263 - RNA, 19 nt, Variola virus
uaauucaaauuguuaaauu

SEQ ID NO: 3281264 - RNA, 12 nt, Variola virus
gaauuucccaaa

SEQ ID NO: 3281265 - RNA, 18 nt, Variola virus
auuuuggugccuauuuua

SEQ ID NO: 3281266 - RNA, 20 nt, Variola virus
gaaaacgagccaguaaucuu

SEQ ID NO: 3281267 - RNA, 20 nt, Variola virus
aguggauuaucucaaagaau

SEQ ID NO: 3281268 - RNA, 20 nt, Variola virus
uuacuuaauaggugaaaaga

SEQ ID NO: 3281269 - RNA, 23 nt, Variola virus
aauuucaaggacaaaaugaccag

SEQ ID NO: 3281270 - RNA, 14 nt, Variola virus
uauuuuuuaugaua

SEQ ID NO: 3281271 - RNA, 16 nt, Variola virus
ugaucucguguguaca

SEQ ID NO: 3281272 - RNA, 17 nt, Variola virus
gcuaauuauuucaucca

SEQ ID NO: 3281273 - RNA, 13 nt, Variola virus
acacaucaaaaua

SEQ ID NO: 3281274 - RNA, 14 nt, Variola virus
auuuaucuauuuua

SEQ ID NO: 3281275 - RNA, 22 nt, Variola virus
agcaugugaauauaauaauaca

SEQ ID NO: 3281276 - RNA, 20 nt, Variola virus
gcgacacgguauauuagaug

SEQ ID NO: 3281277 - RNA, 15 nt, Variola virus
uaauucuccugaaaa

SEQ ID NO: 3281278 - RNA, 17 nt, Variola virus
uuaauucuccuauuaca

SEQ ID NO: 3281279 - RNA, 16 nt, Variola virus
gaaaaauuuguagauu

SEQ ID NO: 3281280 - RNA, 12 nt, Variola virus
auaaaaucucca

SEQ ID NO: 3281281 - RNA, 15 nt, Variola virus
aucaugaaacaauau

SEQ ID NO: 3281282 - RNA, 15 nt, Variola virus
cguaucuaaaguauu

SEQ ID NO: 3281283 - RNA, 18 nt, Variola virus
uaauuucuuuauuaucua

SEQ ID NO: 3281284 - RNA, 15 nt, Variola virus
uaaguucauaaucau

SEQ ID NO: 3281285 - RNA, 17 nt, Variola virus
auuugguauaaaaauua

SEQ ID NO: 3281286 - RNA, 16 nt, Variola virus
cugauguuuguuuucg

SEQ ID NO: 3281287 - RNA, 22 nt, Variola virus
aggauauucucauggaaauauu

SEQ ID NO: 3281288 - RNA, 21 nt, Variola virus
ucacaaaaauaaauccacauu

SEQ ID NO: 3281289 - RNA, 23 nt, Variola virus
aaauaaaauauaaaauauuggaa

SEQ ID NO: 3281290 - RNA, 14 nt, Variola virus
ugucauuuguauuu

SEQ ID NO: 3281291 - RNA, 18 nt, Variola virus
aaagaagaucauacaguc

SEQ ID NO: 3281292 - RNA, 15 nt, Variola virus
cuuugaagagauauu

SEQ ID NO: 3281293 - RNA, 22 nt, Variola virus
cuauuauaccagaauuaauagg

SEQ ID NO: 3281294 - RNA, 20 nt, Variola virus
acaaugaugccaucauagau

SEQ ID NO: 3281295 - RNA, 13 nt, Variola virus
cuaagccaacaaa

SEQ ID NO: 3281296 - RNA, 13 nt, Variola virus
aguaguucauuau

SEQ ID NO: 3281297 - RNA, 21 nt, Variola virus
guguacuagucauaauaucuu

SEQ ID NO: 3281298 - RNA, 19 nt, Variola virus
gaauaaauuaucaacgaau

SEQ ID NO: 3281299 - RNA, 20 nt, Variola virus
uuaauaagacuuugaacauu

SEQ ID NO: 3281300 - RNA, 18 nt, Variola virus
gaagcugguaaaguaaau

SEQ ID NO: 3281301 - RNA, 20 nt, Variola virus
agauuauugucuuauauucu

SEQ ID NO: 3281302 - RNA, 22 nt, Variola virus
cuuauaaaacuauauuuggaau

SEQ ID NO: 3281303 - RNA, 16 nt, Variola virus
ucuaaaaaauccuuaa

SEQ ID NO: 3281304 - RNA, 21 nt, Variola virus
uuauauacacauaauuauucu

SEQ ID NO: 3281305 - RNA, 15 nt, Variola virus
uagaucaacgucauc

SEQ ID NO: 3281306 - RNA, 16 nt, Variola virus
acauuguauuaugaug

SEQ ID NO: 3281307 - RNA, 16 nt, Variola virus
aaguauauaaauacuu

SEQ ID NO: 3281308 - RNA, 17 nt, Variola virus
uuaaaggauauuaugca

SEQ ID NO: 3281309 - RNA, 21 nt, Variola virus
gguuuauauaacauagaaaaa

SEQ ID NO: 3281310 - RNA, 16 nt, Variola virus
uauuuucuucuacaua

SEQ ID NO: 3281311 - RNA, 18 nt, Variola virus
aacuacuuuaucaguaaa

SEQ ID NO: 3281312 - RNA, 14 nt, Variola virus
aauuuuagugaaau

SEQ ID NO: 3281313 - RNA, 17 nt, Variola virus
auuuaauaagacuuuga

SEQ ID NO: 3281314 - RNA, 22 nt, Variola virus
gaaaaagaauuuuuauaaauuu

SEQ ID NO: 3281315 - RNA, 16 nt, Variola virus
gguagacauagauauu

SEQ ID NO: 3281316 - RNA, 19 nt, Variola virus
gauaauauuagacauauga

SEQ ID NO: 3281317 - RNA, 16 nt, Variola virus
accaaagcaaccagaa

SEQ ID NO: 3281318 - RNA, 23 nt, Variola virus
aaauuaaaaaauaacuuaauuua

SEQ ID NO: 3281319 - RNA, 14 nt, Variola virus
aaacaacauauaca

SEQ ID NO: 3281320 - RNA, 15 nt, Variola virus
gaggauguuaaacaa

SEQ ID NO: 3281321 - RNA, 20 nt, Variola virus
gucuguaacucugauaaucu

SEQ ID NO: 3281322 - RNA, 13 nt, Variola virus
uucuauaaucauu

SEQ ID NO: 3281323 - RNA, 18 nt, Variola virus
auucuaacgauaauagau

SEQ ID NO: 3281324 - RNA, 18 nt, Variola virus
uacugaggggaaaaucaa

SEQ ID NO: 3281325 - RNA, 22 nt, Variola virus
auguuaauugggguauuaauaa

SEQ ID NO: 3281326 - RNA, 18 nt, Variola virus
gugcucaagcuaaacaag

SEQ ID NO: 3281327 - RNA, 18 nt, Variola virus
cuauagaaauuauuuuua

SEQ ID NO: 3281328 - RNA, 19 nt, Variola virus
cuuguauucaacaugcuuu

SEQ ID NO: 3281329 - RNA, 22 nt, Variola virus
ugccaucacucucauaauguaa

SEQ ID NO: 3281330 - RNA, 23 nt, Variola virus
aucuacaaguagucaauaaaaga

SEQ ID NO: 3281331 - RNA, 13 nt, Variola virus
uauuaaaaaaugu

SEQ ID NO: 3281332 - RNA, 17 nt, Variola virus
aaauuuccauuagauua

SEQ ID NO: 3281333 - RNA, 22 nt, Variola virus
acauccuacacggacucauuaa

SEQ ID NO: 3281334 - RNA, 12 nt, Variola virus
aaauagauguua

SEQ ID NO: 3281335 - RNA, 15 nt, Variola virus
agaaaaaauaucuug

SEQ ID NO: 3281336 - RNA, 18 nt, Variola virus
aauuuacaaauaaaaguc

SEQ ID NO: 3281337 - RNA, 22 nt, Variola virus
gaauauuuugauaaugaacgaa

SEQ ID NO: 3281338 - RNA, 22 nt, Variola virus
gccgcuuggaccauuauuuuua

SEQ ID NO: 3281339 - RNA, 20 nt, Variola virus
auuaacagauuaguaugaag

SEQ ID NO: 3281340 - RNA, 11 nt, Variola virus
cacaaugaaua

SEQ ID NO: 3281341 - RNA, 13 nt, Variola virus
guuuauuugaccu

SEQ ID NO: 3281342 - RNA, 16 nt, Variola virus
uaucaucuauuagaga

SEQ ID NO: 3281343 - RNA, 15 nt, Variola virus
aaggacagaaauaua

SEQ ID NO: 3281344 - RNA, 18 nt, Variola virus
ugaugcgaauagcagaua

SEQ ID NO: 3281345 - RNA, 23 nt, Variola virus
aucgauuguuuauuguauauacu

SEQ ID NO: 3281346 - RNA, 16 nt, Variola virus
acacuauuauaugauu

SEQ ID NO: 3281347 - RNA, 23 nt, Variola virus
aacagauauuacaaccaguguua

SEQ ID NO: 3281348 - RNA, 22 nt, Variola virus
aucaaacaaaaaagcucaauaa

SEQ ID NO: 3281349 - RNA, 12 nt, Variola virus
uuauauguaguu

SEQ ID NO: 3281350 - RNA, 20 nt, Variola virus
acaaaauccaucaaaaaugu

SEQ ID NO: 3281351 - RNA, 14 nt, Variola virus
gauauauuaaacaa

SEQ ID NO: 3281352 - RNA, 14 nt, Variola virus
aaaauuuugaucau

SEQ ID NO: 3281353 - RNA, 19 nt, Variola virus
agauauuccgacaaaggau

SEQ ID NO: 3281354 - RNA, 17 nt, Variola virus
aucaauagaauaaacca

SEQ ID NO: 3281355 - RNA, 17 nt, Variola virus
ugacguuagacauaaaa

SEQ ID NO: 3281356 - RNA, 23 nt, Variola virus
acuugauauuggauauaucacaa

SEQ ID NO: 3281357 - RNA, 16 nt, Variola virus
cuaaggaguaaaauag

SEQ ID NO: 3281358 - RNA, 14 nt, Variola virus
aagaaauauaugug

SEQ ID NO: 3281359 - RNA, 21 nt, Variola virus
acaugauaggaaauuuugugc

SEQ ID NO: 3281360 - RNA, 17 nt, Variola virus
ucaaccgcguuaacaua

SEQ ID NO: 3281361 - RNA, 21 nt, Variola virus
acucuguuucuguaucuauca

SEQ ID NO: 3281362 - RNA, 23 nt, Variola virus
uggcugaaauuagagcucaucua

SEQ ID NO: 3281363 - RNA, 14 nt, Variola virus
cugaucauuaauau

SEQ ID NO: 3281364 - RNA, 17 nt, Variola virus
cuagauucgaaaaucaa

SEQ ID NO: 3281365 - RNA, 14 nt, Variola virus
auaucguguucauu

SEQ ID NO: 3281366 - RNA, 14 nt, Variola virus
aauuuauuucuaaa

SEQ ID NO: 3281367 - RNA, 13 nt, Variola virus
aacuaucaaacaa

SEQ ID NO: 3281368 - RNA, 17 nt, Variola virus
acagaaauauaugagau

SEQ ID NO: 3281369 - RNA, 11 nt, Variola virus
ccacaauucau

SEQ ID NO: 3281370 - RNA, 22 nt, Variola virus
gaaagauuaaaucauuaaauga

SEQ ID NO: 3281371 - RNA, 15 nt, Variola virus
ucguugguagauauu

SEQ ID NO: 3281372 - RNA, 15 nt, Variola virus
aucuagacucuauau

SEQ ID NO: 3281373 - RNA, 16 nt, Variola virus
auauugucacaugucu

SEQ ID NO: 3281374 - RNA, 16 nt, Variola virus
cuauaguuuguuuuca

SEQ ID NO: 3281375 - RNA, 20 nt, Variola virus
cuauugaucaaguauacaau

SEQ ID NO: 3281376 - RNA, 18 nt, Variola virus
uucggaucguaaaucugu

SEQ ID NO: 3281377 - RNA, 11 nt, Variola virus
uuaaaacauuc

SEQ ID NO: 3281378 - RNA, 17 nt, Variola virus
cuauuagaauuuacaaa

SEQ ID NO: 3281379 - RNA, 23 nt, Variola virus
uaacuuuuuaccucauaugaacu

SEQ ID NO: 3281380 - RNA, 16 nt, Variola virus
agaguaguauauuguc

SEQ ID NO: 3281381 - RNA, 22 nt, Variola virus
aacaccuugugcauuauguaaa

SEQ ID NO: 3281382 - RNA, 14 nt, Variola virus
aaacuuuuuagaaa

SEQ ID NO: 3281383 - RNA, 13 nt, Variola virus
aaauauucaguau

SEQ ID NO: 3281384 - RNA, 16 nt, Variola virus
cagacuauaccuagug

SEQ ID NO: 3281385 - RNA, 19 nt, Variola virus
cauuaguaaggcuuuagaa

SEQ ID NO: 3281386 - RNA, 16 nt, Variola virus
acuacaguaaguacau

SEQ ID NO: 3281387 - RNA, 17 nt, Variola virus
uaacacaccuaaaugug

SEQ ID NO: 3281388 - RNA, 20 nt, Variola virus
uagaaaaaauagaacuuauc

SEQ ID NO: 3281389 - RNA, 21 nt, Variola virus
aucucaaaauagguacucugu

SEQ ID NO: 3281390 - RNA, 14 nt, Variola virus
ucauuuguauacac

SEQ ID NO: 3281391 - RNA, 13 nt, Variola virus
gguaagaaaguaa

SEQ ID NO: 3281392 - RNA, 18 nt, Variola virus
auuauacuuugguaaaug

SEQ ID NO: 3281393 - RNA, 18 nt, Variola virus
uuuggaaucguucaaaac

SEQ ID NO: 3281394 - RNA, 21 nt, Variola virus
auauuccgacaugcaaaaaug

SEQ ID NO: 3281395 - RNA, 15 nt, Variola virus
aaauguaaauccaau

SEQ ID NO: 3281396 - RNA, 16 nt, Variola virus
caaagauggcugaaau

SEQ ID NO: 3281397 - RNA, 14 nt, Variola virus
agguacuaggaaaa

SEQ ID NO: 3281398 - RNA, 18 nt, Variola virus
aguagguuuaagaaguug

SEQ ID NO: 3281399 - RNA, 16 nt, Variola virus
acucugaaaagaaagu

SEQ ID NO: 3281400 - RNA, 15 nt, Variola virus
ugcaucuacaucauc

SEQ ID NO: 3281401 - RNA, 19 nt, Variola virus
auuuuacaaauaauggcug

SEQ ID NO: 3281402 - RNA, 15 nt, Variola virus
aucggguucugcuuc

SEQ ID NO: 3281403 - RNA, 12 nt, Variola virus
uauugcuguauu

SEQ ID NO: 3281404 - RNA, 14 nt, Variola virus
cucgaauacaaauu

SEQ ID NO: 3281405 - RNA, 17 nt, Variola virus
ucaauagauugguaaau

SEQ ID NO: 3281406 - RNA, 16 nt, Variola virus
uuuaaauuuuguauuu

SEQ ID NO: 3281407 - RNA, 22 nt, Variola virus
uaaacaguuuccacuuugguaa

SEQ ID NO: 3281408 - RNA, 20 nt, Variola virus
uacuaaacgaucaaccaaaa

SEQ ID NO: 3281409 - RNA, 21 nt, Variola virus
gcuaauuuuuguaaauaacua

SEQ ID NO: 3281410 - RNA, 19 nt, Variola virus
cauuaggaaucuauccaau

SEQ ID NO: 3281411 - RNA, 15 nt, Variola virus
auagauaucaaaaua

SEQ ID NO: 3281412 - RNA, 14 nt, Variola virus
cuauagauaaugac

SEQ ID NO: 3281413 - RNA, 16 nt, Variola virus
uggaauaguaaaaucu

SEQ ID NO: 3281414 - RNA, 19 nt, Variola virus
auuagauuauaucauaaau

SEQ ID NO: 3281415 - RNA, 13 nt, Variola virus
ugaaacuaucuuu

SEQ ID NO: 3281416 - RNA, 13 nt, Variola virus
agaauaugugcau

SEQ ID NO: 3281417 - RNA, 19 nt, Variola virus
aggauggaauuaucaucaa

SEQ ID NO: 3281418 - RNA, 13 nt, Variola virus
uauaaaaugacau

SEQ ID NO: 3281419 - RNA, 18 nt, Variola virus
aaaauuuaagaaaaugau

SEQ ID NO: 3281420 - RNA, 14 nt, Variola virus
guucuuuuuccaau

SEQ ID NO: 3281421 - RNA, 20 nt, Variola virus
gaaacuuuucagaauaucua

SEQ ID NO: 3281422 - RNA, 24 nt, Variola virus
cuaaagcaaauugcgccacagaau

SEQ ID NO: 3281423 - RNA, 14 nt, Variola virus
acugacuuaauagu

SEQ ID NO: 3281424 - RNA, 14 nt, Variola virus
cucuuuuguagaac

SEQ ID NO: 3281425 - RNA, 20 nt, Variola virus
uaacaccuauaagauuauca

SEQ ID NO: 3281426 - RNA, 21 nt, Variola virus
uuccuuuacgugauaaaucau

SEQ ID NO: 3281427 - RNA, 17 nt, Variola virus
uccagaauguuucaaag

SEQ ID NO: 3281428 - RNA, 12 nt, Variola virus
auuuaacuagau

SEQ ID NO: 3281429 - RNA, 16 nt, Variola virus
uccaucaaaaaugucg

SEQ ID NO: 3281430 - RNA, 17 nt, Variola virus
caauucuaaucacuuua

SEQ ID NO: 3281431 - RNA, 19 nt, Variola virus
uuagaugagaaauuauucc

SEQ ID NO: 3281432 - RNA, 17 nt, Variola virus
gcauaagucauaacugu

SEQ ID NO: 3281433 - RNA, 20 nt, Variola virus
ccaagaaaauagaaauuugu

SEQ ID NO: 3281434 - RNA, 21 nt, Variola virus
uaauguugugaaccauguacu

SEQ ID NO: 3281435 - RNA, 17 nt, Variola virus
uuccaacuuaucauuau

SEQ ID NO: 3281436 - RNA, 15 nt, Variola virus
auaauaucagaaugc

SEQ ID NO: 3281437 - RNA, 16 nt, Variola virus
aauugauuaauguuuu

SEQ ID NO: 3281438 - RNA, 19 nt, Variola virus
uuguaagucggucgauucu

SEQ ID NO: 3281439 - RNA, 23 nt, Variola virus
gauacuauccaucagaauguuuc

SEQ ID NO: 3281440 - RNA, 17 nt, Variola virus
aauauuucauuagaugu

SEQ ID NO: 3281441 - RNA, 11 nt, Variola virus
uagacauagau

SEQ ID NO: 3281442 - RNA, 19 nt, Variola virus
aaucuaguacucgaaauaa

SEQ ID NO: 3281443 - RNA, 13 nt, Variola virus
ugccuccacauau

SEQ ID NO: 3281444 - RNA, 19 nt, Variola virus
uauaauaacaaguaugaca

SEQ ID NO: 3281445 - RNA, 19 nt, Variola virus
uuacuaucggcucaaagag

SEQ ID NO: 3281446 - RNA, 14 nt, Variola virus
cuuacauaaaugaa

SEQ ID NO: 3281447 - RNA, 14 nt, Variola virus
cauggaagaacuac

SEQ ID NO: 3281448 - RNA, 18 nt, Variola virus
auacugcaauaaaacauu

SEQ ID NO: 3281449 - RNA, 21 nt, Variola virus
uaucauaaauaaaaauaguag

SEQ ID NO: 3281450 - RNA, 20 nt, Variola virus
auauuguacgguagaauuga

SEQ ID NO: 3281451 - RNA, 20 nt, Variola virus
uucuuacauaaaugaaaaga

SEQ ID NO: 3281452 - RNA, 14 nt, Variola virus
auauucuguucuau

SEQ ID NO: 3281453 - RNA, 20 nt, Variola virus
cuggcgaauauuaaaacuau

SEQ ID NO: 3281454 - RNA, 23 nt, Variola virus
auuuuagaagaacgauaaugaau

SEQ ID NO: 3281455 - RNA, 23 nt, Variola virus
cugucgaaaaaguaggaauuaau

SEQ ID NO: 3281456 - RNA, 14 nt, Variola virus
gaauuaauaauauc

SEQ ID NO: 3281457 - RNA, 15 nt, Variola virus
auauaguauuaauga

SEQ ID NO: 3281458 - RNA, 21 nt, Variola virus
cuaagacguuguaucucuuuu

SEQ ID NO: 3281459 - RNA, 18 nt, Variola virus
agaucgucuauauaugaa

SEQ ID NO: 3281460 - RNA, 15 nt, Variola virus
uaauaaaauuauuca

SEQ ID NO: 3281461 - RNA, 13 nt, Variola virus
uuaucuguagacg

SEQ ID NO: 3281462 - RNA, 15 nt, Variola virus
acgucaucaaaaaua

SEQ ID NO: 3281463 - RNA, 15 nt, Variola virus
aauaagcuauauaau

SEQ ID NO: 3281464 - RNA, 14 nt, Variola virus
gaauauacaaguau

SEQ ID NO: 3281465 - RNA, 21 nt, Variola virus
auuucgaauacgauacuuaua

SEQ ID NO: 3281466 - RNA, 16 nt, Variola virus
auccgacuagaauuag

SEQ ID NO: 3281467 - RNA, 16 nt, Variola virus
uaauuugaguaagaau

SEQ ID NO: 3281468 - RNA, 14 nt, Variola virus
auaacauuguuuau

SEQ ID NO: 3281469 - RNA, 22 nt, Variola virus
agaaaucauauaugauauuccu

SEQ ID NO: 3281470 - RNA, 17 nt, Variola virus
gcucguggauacuuaug

SEQ ID NO: 3281471 - RNA, 20 nt, Variola virus
aaucuauaucauguagaaaa

SEQ ID NO: 3281472 - RNA, 14 nt, Variola virus
auaucaucaaaaua

SEQ ID NO: 3281473 - RNA, 17 nt, Variola virus
uaauguuguauuucauu

SEQ ID NO: 3281474 - RNA, 18 nt, Variola virus
ucaguguagauaguaaau

SEQ ID NO: 3281475 - RNA, 13 nt, Variola virus
guccaauauuaau

SEQ ID NO: 3281476 - RNA, 19 nt, Variola virus
auagauguucaucauauaa

SEQ ID NO: 3281477 - RNA, 16 nt, Variola virus
aaauagguacucuguu

SEQ ID NO: 3281478 - RNA, 19 nt, Variola virus
aaacuuuacgauagacuuu

SEQ ID NO: 3281479 - RNA, 19 nt, Variola virus
uuauauuuuuucauuauua

SEQ ID NO: 3281480 - RNA, 14 nt, Variola virus
uauuaauaagacuu

SEQ ID NO: 3281481 - RNA, 13 nt, Variola virus
aaugacaaacauu

SEQ ID NO: 3281482 - RNA, 14 nt, Variola virus
aaaaucaauccacu

SEQ ID NO: 3281483 - RNA, 16 nt, Variola virus
guucuuugaacaucuu

SEQ ID NO: 3281484 - RNA, 15 nt, Variola virus
aauuaagaacuauag

SEQ ID NO: 3281485 - RNA, 13 nt, Variola virus
aauuuuuuaaaaa

SEQ ID NO: 3281486 - RNA, 22 nt, Variola virus
uugaaucucuguggaaauuaga

SEQ ID NO: 3281487 - RNA, 22 nt, Variola virus
uguugguggcauugucuaaaac

SEQ ID NO: 3281488 - RNA, 21 nt, Variola virus
augaacacacgaugaaaaugu

SEQ ID NO: 3281489 - RNA, 16 nt, Variola virus
uccaacaauagcuuua

SEQ ID NO: 3281490 - RNA, 15 nt, Variola virus
aaucucagaaagaua

SEQ ID NO: 3281491 - RNA, 17 nt, Variola virus
uguauucuuuuuaagau

SEQ ID NO: 3281492 - RNA, 21 nt, Variola virus
aacauauagaacauaaccauu

SEQ ID NO: 3281493 - RNA, 13 nt, Variola virus
uagauaaacuauc

SEQ ID NO: 3281494 - RNA, 20 nt, Variola virus
uaaauaacaaugagauguau

SEQ ID NO: 3281495 - RNA, 15 nt, Variola virus
aauauccagaauguu

SEQ ID NO: 3281496 - RNA, 17 nt, Variola virus
cuuagaaaucaacaauc

SEQ ID NO: 3281497 - RNA, 12 nt, Variola virus
agaauauacucu

SEQ ID NO: 3281498 - RNA, 13 nt, Variola virus
gaagagguuauau

SEQ ID NO: 3281499 - RNA, 18 nt, Variola virus
uauguggaucugaagaag

SEQ ID NO: 3281500 - RNA, 15 nt, Variola virus
aaaaucgauaaacug

SEQ ID NO: 3281501 - RNA, 16 nt, Variola virus
auuuuuauaaauagau

SEQ ID NO: 3281502 - RNA, 16 nt, Variola virus
caaaaauguucuuaau

SEQ ID NO: 3281503 - RNA, 20 nt, Variola virus
uucgucaacaaguuggauga

SEQ ID NO: 3281504 - RNA, 19 nt, Variola virus
agcaucagcaaaacaguua

SEQ ID NO: 3281505 - RNA, 23 nt, Variola virus
uuuauuauauucaguaaccaaau

SEQ ID NO: 3281506 - RNA, 23 nt, Variola virus
cggcauuucuuuuuaaugauaua

SEQ ID NO: 3281507 - RNA, 19 nt, Variola virus
agugguuaaucuuagaaau

SEQ ID NO: 3281508 - RNA, 16 nt, Variola virus
aucguuuagaauacua

SEQ ID NO: 3281509 - RNA, 14 nt, Variola virus
uuaaaaauacgguu

SEQ ID NO: 3281510 - RNA, 14 nt, Variola virus
guuuuguaauaucu

SEQ ID NO: 3281511 - RNA, 16 nt, Variola virus
agaugaucaaaaagac

SEQ ID NO: 3281512 - RNA, 17 nt, Variola virus
agaucauuugaaauuau

SEQ ID NO: 3281513 - RNA, 20 nt, Variola virus
acaacuuaaucugaugaaua

SEQ ID NO: 3281514 - RNA, 17 nt, Variola virus
aauuuaagaaaaugauu

SEQ ID NO: 3281515 - RNA, 23 nt, Variola virus
uauuucuauggacuuaucuacau

SEQ ID NO: 3281516 - RNA, 21 nt, Variola virus
aauauuuguuaucaugaugac

SEQ ID NO: 3281517 - RNA, 14 nt, Variola virus
gaacgauaaugaau

SEQ ID NO: 3281518 - RNA, 16 nt, Variola virus
uauuacgguaucaaaa

SEQ ID NO: 3281519 - RNA, 12 nt, Variola virus
ucauauguagug

SEQ ID NO: 3281520 - RNA, 15 nt, Variola virus
ugacauucaaagauu

SEQ ID NO: 3281521 - RNA, 13 nt, Variola virus
gaaaaacacauuu

SEQ ID NO: 3281522 - RNA, 19 nt, Variola virus
auaguuacagaauuuguau

SEQ ID NO: 3281523 - RNA, 19 nt, Variola virus
agaauccaucgguuguuaa

SEQ ID NO: 3281524 - RNA, 14 nt, Variola virus
caauuaaugauauu

SEQ ID NO: 3281525 - RNA, 16 nt, Variola virus
cucucuuaauuucaga

SEQ ID NO: 3281526 - RNA, 15 nt, Variola virus
uaauggaucuucuag

SEQ ID NO: 3281527 - RNA, 21 nt, Variola virus
uaagaauucguuuuucaacau

SEQ ID NO: 3281528 - RNA, 21 nt, Variola virus
agaugaagucauuaacaauau

SEQ ID NO: 3281529 - RNA, 23 nt, Variola virus
aacacacacugagaaacagcaua

SEQ ID NO: 3281530 - RNA, 18 nt, Variola virus
ucaaguccaauguuuuua

SEQ ID NO: 3281531 - RNA, 15 nt, Variola virus
ucacguaaauacaaa

SEQ ID NO: 3281532 - RNA, 14 nt, Variola virus
gaaaauauauucua

SEQ ID NO: 3281533 - RNA, 14 nt, Variola virus
uauuaucucagugc

SEQ ID NO: 3281534 - RNA, 16 nt, Variola virus
ucuauauaauuauuuu

SEQ ID NO: 3281535 - RNA, 18 nt, Variola virus
uuuacuuuuucaucuuua

SEQ ID NO: 3281536 - RNA, 18 nt, Variola virus
aaugauaaaaucaaacuu

SEQ ID NO: 3281537 - RNA, 22 nt, Variola virus
guaucaaucaagaggauggaau

SEQ ID NO: 3281538 - RNA, 20 nt, Variola virus
aauuuguagauuuuguuaua

SEQ ID NO: 3281539 - RNA, 14 nt, Variola virus
aggcgucaaagaua

SEQ ID NO: 3281540 - RNA, 22 nt, Variola virus
uagguuguuuauugauauacua

SEQ ID NO: 3281541 - RNA, 15 nt, Variola virus
uggauccaaaugcug

SEQ ID NO: 3281542 - RNA, 22 nt, Variola virus
acguauuuggcagaguuaucca

SEQ ID NO: 3281543 - RNA, 15 nt, Variola virus
ccuuguauguuuuua

SEQ ID NO: 3281544 - RNA, 19 nt, Variola virus
uaauaauuuuuuaaauccu

SEQ ID NO: 3281545 - RNA, 17 nt, Variola virus
ugcuaauacgaauauua

SEQ ID NO: 3281546 - RNA, 20 nt, Variola virus
gaaauauauuuguaguacaa

SEQ ID NO: 3281547 - RNA, 13 nt, Variola virus
cucguccuugguu

SEQ ID NO: 3281548 - RNA, 22 nt, Variola virus
agaauuaauaauaucucuaaua

SEQ ID NO: 3281549 - RNA, 17 nt, Variola virus
ugaagauauagaugagg

SEQ ID NO: 3281550 - RNA, 15 nt, Variola virus
auuuacuacugaugu

SEQ ID NO: 3281551 - RNA, 14 nt, Variola virus
auuuauaaaaaugc

SEQ ID NO: 3281552 - RNA, 22 nt, Variola virus
cuaagacguuguaucucuuuuu

SEQ ID NO: 3281553 - RNA, 19 nt, Variola virus
aauacgaugauauuaaaau

SEQ ID NO: 3281554 - RNA, 18 nt, Variola virus
uggaucugugauguaugc

SEQ ID NO: 3281555 - RNA, 14 nt, Variola virus
uuuguauacacaua

SEQ ID NO: 3281556 - RNA, 23 nt, Variola virus
uuauccaaaauauuaauaacauu

SEQ ID NO: 3281557 - RNA, 15 nt, Variola virus
ucacauacuuuguaa

SEQ ID NO: 3281558 - RNA, 18 nt, Variola virus
aacgauaacgucauuaau

SEQ ID NO: 3281559 - RNA, 19 nt, Variola virus
aauuuguccacguucuuua

SEQ ID NO: 3281560 - RNA, 20 nt, Variola virus
aauaggguaucuaauuuccu

SEQ ID NO: 3281561 - RNA, 15 nt, Variola virus
ugcguuuagcaucua

SEQ ID NO: 3281562 - RNA, 14 nt, Variola virus
auauuagauuuacu

SEQ ID NO: 3281563 - RNA, 16 nt, Variola virus
gugauauuaucuucau

SEQ ID NO: 3281564 - RNA, 19 nt, Variola virus
caaauuauuucuucugaau

SEQ ID NO: 3281565 - RNA, 13 nt, Variola virus
aaaauuauucucc

SEQ ID NO: 3281566 - RNA, 14 nt, Variola virus
gauacgaugaugac

SEQ ID NO: 3281567 - RNA, 18 nt, Variola virus
auaacauucuaggaaugu

SEQ ID NO: 3281568 - RNA, 19 nt, Variola virus
gucaaauuuaucuauuuua

SEQ ID NO: 3281569 - RNA, 22 nt, Variola virus
uacuuuaacauguguauuacau

SEQ ID NO: 3281570 - RNA, 19 nt, Variola virus
aauugggaggauauacaaa

SEQ ID NO: 3281571 - RNA, 19 nt, Variola virus
aaugcauucguauucuaua

SEQ ID NO: 3281572 - RNA, 21 nt, Variola virus
ccaaacuuagaaccaaaugau

SEQ ID NO: 3281573 - RNA, 19 nt, Variola virus
uuuacccacuauaaaauaa

SEQ ID NO: 3281574 - RNA, 15 nt, Variola virus
aaaugguacaaucag

SEQ ID NO: 3281575 - RNA, 20 nt, Variola virus
caucuauauugcuacauaau

SEQ ID NO: 3281576 - RNA, 18 nt, Variola virus
auuauaauaguuuaucau

SEQ ID NO: 3281577 - RNA, 22 nt, Variola virus
acauuauaucguuaucauuaau

SEQ ID NO: 3281578 - RNA, 16 nt, Variola virus
auguagcaaacaugau

SEQ ID NO: 3281579 - RNA, 16 nt, Variola virus
aaauaauaauggaagu

SEQ ID NO: 3281580 - RNA, 15 nt, Variola virus
auccuucuagaauua

SEQ ID NO: 3281581 - RNA, 21 nt, Variola virus
ccagaguauuuguacacaucu

SEQ ID NO: 3281582 - RNA, 16 nt, Variola virus
cuuacaaauauucaca

SEQ ID NO: 3281583 - RNA, 14 nt, Variola virus
caguauaaugauuu

SEQ ID NO: 3281584 - RNA, 16 nt, Variola virus
ccuuggcuaauugucu

SEQ ID NO: 3281585 - RNA, 16 nt, Variola virus
aaagagaauuauauau

SEQ ID NO: 3281586 - RNA, 18 nt, Variola virus
acaauguuucuuacauau

SEQ ID NO: 3281587 - RNA, 13 nt, Variola virus
aucaaauacuuca

SEQ ID NO: 3281588 - RNA, 17 nt, Variola virus
agucuccagaaaucugu

SEQ ID NO: 3281589 - RNA, 15 nt, Variola virus
acuagcauauuugua

SEQ ID NO: 3281590 - RNA, 15 nt, Variola virus
auacuaaaacugaag

SEQ ID NO: 3281591 - RNA, 23 nt, Variola virus
aaauauuguauccauacauacau

SEQ ID NO: 3281592 - RNA, 18 nt, Variola virus
cuugaucucaucauucca

SEQ ID NO: 3281593 - RNA, 23 nt, Variola virus
uacucacggcuacggcauuagau

SEQ ID NO: 3281594 - RNA, 18 nt, Variola virus
uaacucaaagacaucaua

SEQ ID NO: 3281595 - RNA, 13 nt, Variola virus
cauacuauguuuu

SEQ ID NO: 3281596 - RNA, 17 nt, Variola virus
cugacauucagaaagag

SEQ ID NO: 3281597 - RNA, 20 nt, Variola virus
caucuuuugccaacacagag

SEQ ID NO: 3281598 - RNA, 17 nt, Variola virus
gcauauauuagaaauac

SEQ ID NO: 3281599 - RNA, 21 nt, Variola virus
gaauaaaguuaaacaacuauu

SEQ ID NO: 3281600 - RNA, 17 nt, Variola virus
aacuuaguguaaaacua

SEQ ID NO: 3281601 - RNA, 21 nt, Variola virus
cgaugugucugcguuaagauc

SEQ ID NO: 3281602 - RNA, 22 nt, Variola virus
ucaauuacacuauuugucuuaa

SEQ ID NO: 3281603 - RNA, 21 nt, Variola virus
aucaauucuauccaagauacu

SEQ ID NO: 3281604 - RNA, 23 nt, Variola virus
uaaccuuggcugucucauucaau

SEQ ID NO: 3281605 - RNA, 19 nt, Variola virus
caaguuuggagaaauggag

SEQ ID NO: 3281606 - RNA, 23 nt, Variola virus
agggaaaucaaagaagaaguuaa

SEQ ID NO: 3281607 - RNA, 23 nt, Variola virus
uacaccauuaauagauaaaacga

SEQ ID NO: 3281608 - RNA, 22 nt, Variola virus
auacucuuuaaaguuucugaaa

SEQ ID NO: 3281609 - RNA, 21 nt, Variola virus
auaaccuuauuauuauaguac

SEQ ID NO: 3281610 - RNA, 12 nt, Variola virus
auuauccuaauc

SEQ ID NO: 3281611 - RNA, 21 nt, Variola virus
cacugucuggcaauaaaugau

SEQ ID NO: 3281612 - RNA, 21 nt, Variola virus
aguacuuugaugauuuuucca

SEQ ID NO: 3281613 - RNA, 15 nt, Variola virus
auuguuuaagaucac

SEQ ID NO: 3281614 - RNA, 21 nt, Variola virus
caaguaugaagaaaaauguug

SEQ ID NO: 3281615 - RNA, 23 nt, Variola virus
cuucagauaaucugaaaaugaaa

SEQ ID NO: 3281616 - RNA, 20 nt, Variola virus
gugaauagauagguauuuua

SEQ ID NO: 3281617 - RNA, 18 nt, Variola virus
uguauucacuuaacaauu

SEQ ID NO: 3281618 - RNA, 19 nt, Variola virus
agaacauacauuuguaaaa

SEQ ID NO: 3281619 - RNA, 19 nt, Variola virus
uaugaugauuuacaaaugg

SEQ ID NO: 3281620 - RNA, 15 nt, Variola virus
uacaacacuuuucua

SEQ ID NO: 3281621 - RNA, 21 nt, Variola virus
acgucaucgcuucaucuauca

SEQ ID NO: 3281622 - RNA, 22 nt, Variola virus
auaaauaggaguuagaauaaua

SEQ ID NO: 3281623 - RNA, 11 nt, Variola virus
gauuaucauga

SEQ ID NO: 3281624 - RNA, 21 nt, Variola virus
aaguauauaugagauacacgu

SEQ ID NO: 3281625 - RNA, 22 nt, Variola virus
uacuagacugacuucuaacaaa

SEQ ID NO: 3281626 - RNA, 13 nt, Variola virus
aaagucaucucuu

SEQ ID NO: 3281627 - RNA, 17 nt, Variola virus
auacaagcgagugcuuc

SEQ ID NO: 3281628 - RNA, 17 nt, Variola virus
uaucucaauaguuucau

SEQ ID NO: 3281629 - RNA, 22 nt, Variola virus
auucauaauaagauaaauccau

SEQ ID NO: 3281630 - RNA, 21 nt, Variola virus
aaaagacgcuuguuaauaagu

SEQ ID NO: 3281631 - RNA, 13 nt, Variola virus
uuucccauacuaa

SEQ ID NO: 3281632 - RNA, 11 nt, Variola virus
uucauuagaau

SEQ ID NO: 3281633 - RNA, 17 nt, Variola virus
aauucuuuuaugaauau

SEQ ID NO: 3281634 - RNA, 16 nt, Variola virus
gaacgguuuauuucua

SEQ ID NO: 3281635 - RNA, 15 nt, Variola virus
uaagaaacuauaaag

SEQ ID NO: 3281636 - RNA, 15 nt, Variola virus
auauuuguaugagug

SEQ ID NO: 3281637 - RNA, 23 nt, Variola virus
uacaugaaauagaagauagauau

SEQ ID NO: 3281638 - RNA, 17 nt, Variola virus
uacucaaucaauagcaa

SEQ ID NO: 3281639 - RNA, 16 nt, Variola virus
aguaaucucaauaauu

SEQ ID NO: 3281640 - RNA, 17 nt, Variola virus
uuaaaauaaauauucuu

SEQ ID NO: 3281641 - RNA, 14 nt, Variola virus
accaaaaucaauau

SEQ ID NO: 3281642 - RNA, 18 nt, Variola virus
ucaaggaaaaagaugcua

SEQ ID NO: 3281643 - RNA, 17 nt, Variola virus
cuaacauuaaaaugucu

SEQ ID NO: 3281644 - RNA, 20 nt, Variola virus
caucugggaauaaaauacua

SEQ ID NO: 3281645 - RNA, 21 nt, Variola virus
gaaaauuuuuaauuauaauau

SEQ ID NO: 3281646 - RNA, 13 nt, Variola virus
cucuauuaaauac

SEQ ID NO: 3281647 - RNA, 19 nt, Variola virus
uuagguagcauuuucuuaa

SEQ ID NO: 3281648 - RNA, 16 nt, Variola virus
cuccaguagcaugugg

SEQ ID NO: 3281649 - RNA, 16 nt, Variola virus
agauccucucuucaac

SEQ ID NO: 3281650 - RNA, 14 nt, Variola virus
uagaacucuuuuca

SEQ ID NO: 3281651 - RNA, 19 nt, Variola virus
uaucuuuuucucaacgucg

SEQ ID NO: 3281652 - RNA, 16 nt, Variola virus
agaacgggucauuuau

SEQ ID NO: 3281653 - RNA, 17 nt, Variola virus
gauaaaauuaaugagau

SEQ ID NO: 3281654 - RNA, 15 nt, Variola virus
aaguauuuguuguau

SEQ ID NO: 3281655 - RNA, 22 nt, Variola virus
cuagauauguauuuaauaucaa

SEQ ID NO: 3281656 - RNA, 19 nt, Variola virus
aagaccaaacgaugauaca

SEQ ID NO: 3281657 - RNA, 13 nt, Variola virus
cauguguauuaca

SEQ ID NO: 3281658 - RNA, 22 nt, Variola virus
guaaauagaauaguauaauguc

SEQ ID NO: 3281659 - RNA, 15 nt, Variola virus
guauccauaaacaau

SEQ ID NO: 3281660 - RNA, 16 nt, Variola virus
uauacuucauaaaaga

SEQ ID NO: 3281661 - RNA, 15 nt, Variola virus
aacuauuuuaccguu

SEQ ID NO: 3281662 - RNA, 21 nt, Variola virus
aaacauugacggauaaaacaa

SEQ ID NO: 3281663 - RNA, 16 nt, Variola virus
uuacuguuucuucacu

SEQ ID NO: 3281664 - RNA, 13 nt, Variola virus
aguauaaaaauua

SEQ ID NO: 3281665 - RNA, 14 nt, Variola virus
auuauuacauagau

SEQ ID NO: 3281666 - RNA, 15 nt, Variola virus
uagauuuuguugaga

SEQ ID NO: 3281667 - RNA, 23 nt, Variola virus
gaauagcggauauagauauuaaa

SEQ ID NO: 3281668 - RNA, 15 nt, Variola virus
aaggcuuuaaaagua

SEQ ID NO: 3281669 - RNA, 17 nt, Variola virus
aggauauauuaaagucu

SEQ ID NO: 3281670 - RNA, 16 nt, Variola virus
uuacaucuaguucuuu

SEQ ID NO: 3281671 - RNA, 15 nt, Variola virus
caagucauaaaucau

SEQ ID NO: 3281672 - RNA, 16 nt, Variola virus
ggacaaauucuuuuga

SEQ ID NO: 3281673 - RNA, 14 nt, Variola virus
uccguuucuaaaaa

SEQ ID NO: 3281674 - RNA, 16 nt, Variola virus
aauguagaaaaucaua

SEQ ID NO: 3281675 - RNA, 12 nt, Variola virus
gaaaaaauagcu

SEQ ID NO: 3281676 - RNA, 21 nt, Variola virus
aauuuuaagauuuuaaaugua

SEQ ID NO: 3281677 - RNA, 22 nt, Variola virus
ucagaaauuaguuuagagucaa

SEQ ID NO: 3281678 - RNA, 15 nt, Variola virus
ucgauacauuuugca

SEQ ID NO: 3281679 - RNA, 11 nt, Variola virus
aaaauuauucu

SEQ ID NO: 3281680 - RNA, 12 nt, Variola virus
auauugugaaug

SEQ ID NO: 3281681 - RNA, 22 nt, Variola virus
gaaaaaaauugguguaaaagau

SEQ ID NO: 3281682 - RNA, 17 nt, Variola virus
auaugcuaguuaauagu

SEQ ID NO: 3281683 - RNA, 15 nt, Variola virus
gaacuguuuaagaga

SEQ ID NO: 3281684 - RNA, 21 nt, Variola virus
uagggagaguauaaaacauua

SEQ ID NO: 3281685 - RNA, 20 nt, Variola virus
acauuuuggcaaauugauua

SEQ ID NO: 3281686 - RNA, 18 nt, Variola virus
cacauuguauauaguuua

SEQ ID NO: 3281687 - RNA, 15 nt, Variola virus
uacuaucuuuaacau

SEQ ID NO: 3281688 - RNA, 20 nt, Variola virus
gcggagauaauaucagaaag

SEQ ID NO: 3281689 - RNA, 21 nt, Variola virus
aaaucaaacacaagaucuucu

SEQ ID NO: 3281690 - RNA, 18 nt, Variola virus
aucaacuuuauuagauaa

SEQ ID NO: 3281691 - RNA, 13 nt, Variola virus
caaaaaauacaau

SEQ ID NO: 3281692 - RNA, 16 nt, Variola virus
ccucuaacaucaucau

SEQ ID NO: 3281693 - RNA, 16 nt, Variola virus
auuuggucauaauaga

SEQ ID NO: 3281694 - RNA, 16 nt, Variola virus
uuacauuauaagaaau

SEQ ID NO: 3281695 - RNA, 16 nt, Variola virus
cugaauauauugauuu

SEQ ID NO: 3281696 - RNA, 19 nt, Variola virus
aaugauauacaaugcucag

SEQ ID NO: 3281697 - RNA, 20 nt, Variola virus
gauucacaaaacguauauag

SEQ ID NO: 3281698 - RNA, 17 nt, Variola virus
aauauuguauuguuaua

SEQ ID NO: 3281699 - RNA, 21 nt, Variola virus
uuuaacgaggauuuauucaga

SEQ ID NO: 3281700 - RNA, 14 nt, Variola virus
uuuuaguuuaucaa

SEQ ID NO: 3281701 - RNA, 20 nt, Variola virus
aauuaucaacguuuuacugg

SEQ ID NO: 3281702 - RNA, 16 nt, Variola virus
uauuuguauuuaucua

SEQ ID NO: 3281703 - RNA, 16 nt, Variola virus
gauguuaaacaaauaa

SEQ ID NO: 3281704 - RNA, 15 nt, Variola virus
acaaacuccauauau

SEQ ID NO: 3281705 - RNA, 13 nt, Variola virus
uauuaucuauaaa

SEQ ID NO: 3281706 - RNA, 18 nt, Variola virus
gacuccgggaccaauuac

SEQ ID NO: 3281707 - RNA, 16 nt, Variola virus
cgguguguagaaagug

SEQ ID NO: 3281708 - RNA, 18 nt, Variola virus
ugacaucuaucuuugcau

SEQ ID NO: 3281709 - RNA, 18 nt, Variola virus
auauauugcuuacuagau

SEQ ID NO: 3281710 - RNA, 14 nt, Variola virus
uaaauuuuaauauu

SEQ ID NO: 3281711 - RNA, 20 nt, Variola virus
acuuacauggacacauucuu

SEQ ID NO: 3281712 - RNA, 19 nt, Variola virus
uuucuugagagacaugauu

SEQ ID NO: 3281713 - RNA, 12 nt, Variola virus
auagcuaucaag

SEQ ID NO: 3281714 - RNA, 13 nt, Variola virus
aaucucuauuugu

SEQ ID NO: 3281715 - RNA, 17 nt, Variola virus
gcuuacauguauuaaag

SEQ ID NO: 3281716 - RNA, 15 nt, Variola virus
uuuauuccaaucauu

SEQ ID NO: 3281717 - RNA, 16 nt, Variola virus
aauaaacuauuucuaa

SEQ ID NO: 3281718 - RNA, 23 nt, Variola virus
auauaguauaaauaguuauuaga

SEQ ID NO: 3281719 - RNA, 18 nt, Variola virus
uucagaaagcuguggaug

SEQ ID NO: 3281720 - RNA, 20 nt, Variola virus
gaaagaaucaaaagaaugau

SEQ ID NO: 3281721 - RNA, 19 nt, Variola virus
auaucuacaaauuggagau

SEQ ID NO: 3281722 - RNA, 11 nt, Variola virus
uauacuuguca

SEQ ID NO: 3281723 - RNA, 17 nt, Variola virus
ucuauaauaauguagua

SEQ ID NO: 3281724 - RNA, 15 nt, Variola virus
gugcaguauuagaau

SEQ ID NO: 3281725 - RNA, 15 nt, Variola virus
uauagaaauuuugau

SEQ ID NO: 3281726 - RNA, 13 nt, Variola virus
uuauuucuaaaau

SEQ ID NO: 3281727 - RNA, 14 nt, Variola virus
guuagucauauuac

SEQ ID NO: 3281728 - RNA, 16 nt, Variola virus
aauagcgcugaaaaua

SEQ ID NO: 3281729 - RNA, 19 nt, Variola virus
gcaaccaugaauuuacaga

SEQ ID NO: 3281730 - RNA, 17 nt, Variola virus
ucaaaaaauaaauuaga

SEQ ID NO: 3281731 - RNA, 13 nt, Variola virus
uguaugagugaua

SEQ ID NO: 3281732 - RNA, 21 nt, Variola virus
ucagaaagaguucccacaugu

SEQ ID NO: 3281733 - RNA, 16 nt, Variola virus
caucaaaauauguuuc

SEQ ID NO: 3281734 - RNA, 17 nt, Variola virus
uacacggacucauuaaa

SEQ ID NO: 3281735 - RNA, 18 nt, Variola virus
ucaaaauaacaaauacua

SEQ ID NO: 3281736 - RNA, 23 nt, Variola virus
acauagagagcuucaucaauaga

SEQ ID NO: 3281737 - RNA, 22 nt, Variola virus
agaugaguccaugacuugguau

SEQ ID NO: 3281738 - RNA, 14 nt, Variola virus
cuugaaugucucaa

SEQ ID NO: 3281739 - RNA, 11 nt, Variola virus
uaccuguuuuu

SEQ ID NO: 3281740 - RNA, 19 nt, Variola virus
ugagauaaauaucaucaau

SEQ ID NO: 3281741 - RNA, 19 nt, Variola virus
aaagcaagaccaaacaccg

SEQ ID NO: 3281742 - RNA, 22 nt, Variola virus
uucaguauuuuuggaaucauaa

SEQ ID NO: 3281743 - RNA, 21 nt, Variola virus
cgugcacuuuuuuauaaagau

SEQ ID NO: 3281744 - RNA, 12 nt, Variola virus
guuuacauaaau

SEQ ID NO: 3281745 - RNA, 20 nt, Variola virus
aaagauucuauaauaaugaa

SEQ ID NO: 3281746 - RNA, 12 nt, Variola virus
uuucaucuucuu

SEQ ID NO: 3281747 - RNA, 22 nt, Variola virus
aauacacuuagguuuuuagaaa

SEQ ID NO: 3281748 - RNA, 19 nt, Variola virus
ucauuuauuauauauaaug

SEQ ID NO: 3281749 - RNA, 20 nt, Variola virus
gucacauaucgcuacaaaac

SEQ ID NO: 3281750 - RNA, 14 nt, Variola virus
auaguguauacaau

SEQ ID NO: 3281751 - RNA, 17 nt, Variola virus
aaguauaacacaaaaua

SEQ ID NO: 3281752 - RNA, 19 nt, Variola virus
ccgucaagagaguuaucug

SEQ ID NO: 3281753 - RNA, 14 nt, Variola virus
uuaguagacauuuu

SEQ ID NO: 3281754 - RNA, 12 nt, Variola virus
ucuauuugcuaa

SEQ ID NO: 3281755 - RNA, 21 nt, Variola virus
ucgacuaucaacaauuuugua

SEQ ID NO: 3281756 - RNA, 13 nt, Variola virus
gcagccauuuaac

SEQ ID NO: 3281757 - RNA, 20 nt, Variola virus
acuuuuaacacaccuaaaug

SEQ ID NO: 3281758 - RNA, 18 nt, Variola virus
gagaaggaauagaaauaa

SEQ ID NO: 3281759 - RNA, 14 nt, Variola virus
ucuauaaacugaau

SEQ ID NO: 3281760 - RNA, 17 nt, Variola virus
auauacagaauuuguaa

SEQ ID NO: 3281761 - RNA, 14 nt, Variola virus
aauuguuucuuuua

SEQ ID NO: 3281762 - RNA, 16 nt, Variola virus
caaaauacaaaauguu

SEQ ID NO: 3281763 - RNA, 22 nt, Variola virus
uaguuuguaucaauaauaguaa

SEQ ID NO: 3281764 - RNA, 17 nt, Variola virus
acuaaauacauuaucau

SEQ ID NO: 3281765 - RNA, 15 nt, Variola virus
uauaacauuaauauu

SEQ ID NO: 3281766 - RNA, 20 nt, Variola virus
cuggugauuggguagaagua

SEQ ID NO: 3281767 - RNA, 22 nt, Variola virus
auuaaaauaaauauucuucaua

SEQ ID NO: 3281768 - RNA, 15 nt, Variola virus
auuuaguauuaaaug

SEQ ID NO: 3281769 - RNA, 14 nt, Variola virus
agauuuagaaaugu

SEQ ID NO: 3281770 - RNA, 21 nt, Variola virus
aaaacgacuuacaauauguac

SEQ ID NO: 3281771 - RNA, 13 nt, Variola virus
ccuaauauaacag

SEQ ID NO: 3281772 - RNA, 23 nt, Variola virus
uaccaucuucuuugauuaaugau

SEQ ID NO: 3281773 - RNA, 15 nt, Variola virus
acgcaauaucucaau

SEQ ID NO: 3281774 - RNA, 18 nt, Variola virus
auaaggaacuagaauugu

SEQ ID NO: 3281775 - RNA, 18 nt, Variola virus
acuccauccguaaaaaug

SEQ ID NO: 3281776 - RNA, 12 nt, Variola virus
agugacaaguag

SEQ ID NO: 3281777 - RNA, 18 nt, Variola virus
aaacgcucuacgaauauc

SEQ ID NO: 3281778 - RNA, 18 nt, Variola virus
aaucuuacugaguuuauc

SEQ ID NO: 3281779 - RNA, 19 nt, Variola virus
auuuuacucauuuuuuaua

SEQ ID NO: 3281780 - RNA, 14 nt, Variola virus
auauccuuuuguau

SEQ ID NO: 3281781 - RNA, 22 nt, Variola virus
auuuuuuguucuauaaacugaa

SEQ ID NO: 3281782 - RNA, 20 nt, Variola virus
agacacuaacucuguuuuau

SEQ ID NO: 3281783 - RNA, 17 nt, Variola virus
auucaagauuuuauuau

SEQ ID NO: 3281784 - RNA, 15 nt, Variola virus
uuuuuacuaaucaua

SEQ ID NO: 3281785 - RNA, 13 nt, Variola virus
auaaagauauaca

SEQ ID NO: 3281786 - RNA, 15 nt, Variola virus
auaucauuaauacag

SEQ ID NO: 3281787 - RNA, 14 nt, Variola virus
caaacuuuacucuu

SEQ ID NO: 3281788 - RNA, 14 nt, Variola virus
uuucauggauguag

SEQ ID NO: 3281789 - RNA, 19 nt, Variola virus
uacuguugaguaaaucagu

SEQ ID NO: 3281790 - RNA, 15 nt, Variola virus
cauagggcuaaaugu

SEQ ID NO: 3281791 - RNA, 16 nt, Variola virus
acuccggauagagaaa

SEQ ID NO: 3281792 - RNA, 18 nt, Variola virus
acauacaaaaaaguggau

SEQ ID NO: 3281793 - RNA, 16 nt, Variola virus
caaacaggauaucuau

SEQ ID NO: 3281794 - RNA, 22 nt, Variola virus
ccaauuguuuuuguacauaaua

SEQ ID NO: 3281795 - RNA, 13 nt, Variola virus
augcugugcuaua

SEQ ID NO: 3281796 - RNA, 13 nt, Variola virus
acguacauggaaa

SEQ ID NO: 3281797 - RNA, 12 nt, Variola virus
aauacugaauuc

SEQ ID NO: 3281798 - RNA, 12 nt, Variola virus
aagucaauaaua

SEQ ID NO: 3281799 - RNA, 16 nt, Variola virus
uugaaaaugaaaucac

SEQ ID NO: 3281800 - RNA, 15 nt, Variola virus
gauaaagauaaaaga

SEQ ID NO: 3281801 - RNA, 14 nt, Variola virus
ucuuagcgaaugau

SEQ ID NO: 3281802 - RNA, 16 nt, Variola virus
aucaacagauagcuug

SEQ ID NO: 3281803 - RNA, 19 nt, Variola virus
agauauuuagcaauugcau

SEQ ID NO: 3281804 - RNA, 18 nt, Variola virus
gauagauaugauaaacaa

SEQ ID NO: 3281805 - RNA, 15 nt, Variola virus
auauaugacauaaua

SEQ ID NO: 3281806 - RNA, 22 nt, Variola virus
caauuuucaguaccauuaucuu

SEQ ID NO: 3281807 - RNA, 14 nt, Variola virus
auguaaucauauaa

SEQ ID NO: 3281808 - RNA, 19 nt, Variola virus
uaacaacugucaaugaauu

SEQ ID NO: 3281809 - RNA, 16 nt, Variola virus
ucuguuuuauuaaccg

SEQ ID NO: 3281810 - RNA, 14 nt, Variola virus
aauucauuagcaaa

SEQ ID NO: 3281811 - RNA, 22 nt, Variola virus
auuagaaauacacuuacagaaa

SEQ ID NO: 3281812 - RNA, 16 nt, Variola virus
aacaaaucuauuugga

SEQ ID NO: 3281813 - RNA, 18 nt, Variola virus
gucagaucguauaaucua

SEQ ID NO: 3281814 - RNA, 19 nt, Variola virus
uauuuauccguaaaaaugu

SEQ ID NO: 3281815 - RNA, 21 nt, Variola virus
agauuuaagaaaccagaauga

SEQ ID NO: 3281816 - RNA, 19 nt, Variola virus
uauuuccaguuuuauuaua

SEQ ID NO: 3281817 - RNA, 20 nt, Variola virus
ucuaggagcaccagaaguau

SEQ ID NO: 3281818 - RNA, 20 nt, Variola virus
uacauuauuacauagaugua

SEQ ID NO: 3281819 - RNA, 19 nt, Variola virus
acgagauugugaacauugu

SEQ ID NO: 3281820 - RNA, 19 nt, Variola virus
agagacuuuauaacagaua

SEQ ID NO: 3281821 - RNA, 13 nt, Variola virus
gaugaauuauuau

SEQ ID NO: 3281822 - RNA, 19 nt, Variola virus
guagacuuacuaaagucaa

SEQ ID NO: 3281823 - RNA, 18 nt, Variola virus
aacuccguagagaaauau

SEQ ID NO: 3281824 - RNA, 15 nt, Variola virus
uaucauaauuaaauu

SEQ ID NO: 3281825 - RNA, 13 nt, Variola virus
uaggauaucuauu

SEQ ID NO: 3281826 - RNA, 15 nt, Variola virus
auuauaccaauagau

SEQ ID NO: 3281827 - RNA, 16 nt, Variola virus
uauguuucuaaauuuu

SEQ ID NO: 3281828 - RNA, 20 nt, Variola virus
caucuaguccuuuaauucca

SEQ ID NO: 3281829 - RNA, 14 nt, Variola virus
auaauuacagaauu

SEQ ID NO: 3281830 - RNA, 15 nt, Variola virus
gguucuuuaaaagaa

SEQ ID NO: 3281831 - RNA, 20 nt, Variola virus
cuacgauuuuauuucuuucg

SEQ ID NO: 3281832 - RNA, 17 nt, Variola virus
uauugaaauuaaucaua

SEQ ID NO: 3281833 - RNA, 19 nt, Variola virus
acuaccaaccuacacuauu

SEQ ID NO: 3281834 - RNA, 20 nt, Variola virus
uauaaugcguauaauauguu

SEQ ID NO: 3281835 - RNA, 17 nt, Variola virus
agagaagucgucaagca

SEQ ID NO: 3281836 - RNA, 12 nt, Variola virus
uaugugauuuug

SEQ ID NO: 3281837 - RNA, 14 nt, Variola virus
uaaaauuacaaaca

SEQ ID NO: 3281838 - RNA, 23 nt, Variola virus
uucaucguuuagaauaaaaugau

SEQ ID NO: 3281839 - RNA, 19 nt, Variola virus
cuauuauuauuaauuuuag

SEQ ID NO: 3281840 - RNA, 14 nt, Variola virus
aucguaaaucuguu

SEQ ID NO: 3281841 - RNA, 13 nt, Variola virus
ucguuuacaaaau

SEQ ID NO: 3281842 - RNA, 15 nt, Variola virus
acagauguauuggau

SEQ ID NO: 3281843 - RNA, 20 nt, Variola virus
caaggaacuaaauagauuua

SEQ ID NO: 3281844 - RNA, 18 nt, Variola virus
accccauugaugacuuua

SEQ ID NO: 3281845 - RNA, 18 nt, Variola virus
uagguuuaguaucucaau

SEQ ID NO: 3281846 - RNA, 16 nt, Variola virus
aaugcgaggaaaugua

SEQ ID NO: 3281847 - RNA, 14 nt, Variola virus
aucucgccaaaaua

SEQ ID NO: 3281848 - RNA, 17 nt, Variola virus
acaaucuuauaucuucu

SEQ ID NO: 3281849 - RNA, 13 nt, Variola virus
caaaaaauguaua

SEQ ID NO: 3281850 - RNA, 14 nt, Variola virus
gcaaaauauaaugu

SEQ ID NO: 3281851 - RNA, 16 nt, Variola virus
accauuaucuuuguuu

SEQ ID NO: 3281852 - RNA, 22 nt, Variola virus
aucuaauaaguugcgaugaaau

SEQ ID NO: 3281853 - RNA, 17 nt, Variola virus
aaaugauagaaauauau

SEQ ID NO: 3281854 - RNA, 22 nt, Variola virus
aauuuaucaaaugguucauaau

SEQ ID NO: 3281855 - RNA, 18 nt, Variola virus
aauuaguagaguuuuaua

SEQ ID NO: 3281856 - RNA, 17 nt, Variola virus
aacuucucuaaaugagu

SEQ ID NO: 3281857 - RNA, 13 nt, Variola virus
cauaguuaaauaa

SEQ ID NO: 3281858 - RNA, 23 nt, Variola virus
auaccuuugguucuuuaaaagaa

SEQ ID NO: 3281859 - RNA, 20 nt, Variola virus
ccagucaugaaucaauuagu

SEQ ID NO: 3281860 - RNA, 20 nt, Variola virus
cuaauugucuuucucuuuua

SEQ ID NO: 3281861 - RNA, 13 nt, Variola virus
uuguuuuauucaa

SEQ ID NO: 3281862 - RNA, 18 nt, Variola virus
auaaauaguaucaucuau

SEQ ID NO: 3281863 - RNA, 16 nt, Variola virus
gcuacagaaacauaua

SEQ ID NO: 3281864 - RNA, 17 nt, Variola virus
agauauuggaugaugau

SEQ ID NO: 3281865 - RNA, 15 nt, Variola virus
aauguucucaagaac

SEQ ID NO: 3281866 - RNA, 15 nt, Variola virus
uauauucuguuuuaa

SEQ ID NO: 3281867 - RNA, 19 nt, Variola virus
caauaaaaaaguuaagaau

SEQ ID NO: 3281868 - RNA, 14 nt, Variola virus
acuuuacucuucua

SEQ ID NO: 3281869 - RNA, 17 nt, Variola virus
uugcuaauuaauagcau

SEQ ID NO: 3281870 - RNA, 19 nt, Variola virus
aauauucauuaauucuaua

SEQ ID NO: 3281871 - RNA, 14 nt, Variola virus
aaucguuuaauagu

SEQ ID NO: 3281872 - RNA, 16 nt, Variola virus
cuauaaaaaacauaau

SEQ ID NO: 3281873 - RNA, 17 nt, Variola virus
ccaauuuggauauagca

SEQ ID NO: 3281874 - RNA, 11 nt, Variola virus
aucaugucuaa

SEQ ID NO: 3281875 - RNA, 13 nt, Variola virus
ucuucucaaaaga

SEQ ID NO: 3281876 - RNA, 15 nt, Variola virus
caucuauaucaucua

SEQ ID NO: 3281877 - RNA, 13 nt, Variola virus
caaaaauaaugac

SEQ ID NO: 3281878 - RNA, 12 nt, Variola virus
aguauacucuac

SEQ ID NO: 3281879 - RNA, 17 nt, Variola virus
gauccaaacaauguuuc

SEQ ID NO: 3281880 - RNA, 14 nt, Variola virus
agauauaauacuug

SEQ ID NO: 3281881 - RNA, 18 nt, Variola virus
uuuccaaguagugugcuc

SEQ ID NO: 3281882 - RNA, 22 nt, Variola virus
ugaaguuaaugauacacacuau

SEQ ID NO: 3281883 - RNA, 19 nt, Variola virus
uccagaauuguaacaacaa

SEQ ID NO: 3281884 - RNA, 12 nt, Variola virus
ugucgguaaacg

SEQ ID NO: 3281885 - RNA, 17 nt, Variola virus
ucaagccggcuauauau

SEQ ID NO: 3281886 - RNA, 14 nt, Variola virus
uuauucauaauaag

SEQ ID NO: 3281887 - RNA, 14 nt, Variola virus
auuuacauuaaaug

SEQ ID NO: 3281888 - RNA, 16 nt, Variola virus
aauaaaugguuucgaa

SEQ ID NO: 3281889 - RNA, 13 nt, Variola virus
uuagcuauuucgg

SEQ ID NO: 3281890 - RNA, 16 nt, Variola virus
uagaugcaucuaaaag

SEQ ID NO: 3281891 - RNA, 21 nt, Variola virus
ucuucugauaucauuaaugau

SEQ ID NO: 3281892 - RNA, 23 nt, Variola virus
uaauugcucaaauaauacuauau

SEQ ID NO: 3281893 - RNA, 19 nt, Variola virus
aucuccacuuuugcuuuac

SEQ ID NO: 3281894 - RNA, 17 nt, Variola virus
ccuuuuccuuaucuuca

SEQ ID NO: 3281895 - RNA, 21 nt, Variola virus
aauucuaccagucuaggaaua

SEQ ID NO: 3281896 - RNA, 17 nt, Variola virus
auguaguagaaauaaua

SEQ ID NO: 3281897 - RNA, 14 nt, Variola virus
ucuuaucaauaaca

SEQ ID NO: 3281898 - RNA, 22 nt, Variola virus
caaaauuaucguuccugguaua

SEQ ID NO: 3281899 - RNA, 16 nt, Variola virus
ugcaagauacaugcua

SEQ ID NO: 3281900 - RNA, 13 nt, Variola virus
caauagaaucugu

SEQ ID NO: 3281901 - RNA, 20 nt, Variola virus
auuauugaguuaaaaucagu

SEQ ID NO: 3281902 - RNA, 14 nt, Variola virus
auuuauuugaugaa

SEQ ID NO: 3281903 - RNA, 16 nt, Variola virus
agcauccaguaugaau

SEQ ID NO: 3281904 - RNA, 21 nt, Variola virus
uucuacuacuucauuaaucuu

SEQ ID NO: 3281905 - RNA, 15 nt, Variola virus
uuucgaauacuuauu

SEQ ID NO: 3281906 - RNA, 16 nt, Variola virus
aggauccauuuauagu

SEQ ID NO: 3281907 - RNA, 21 nt, Variola virus
gaaaauaccauccaagucaau

SEQ ID NO: 3281908 - RNA, 15 nt, Variola virus
gaacuuguuaaagaa

SEQ ID NO: 3281909 - RNA, 22 nt, Variola virus
uauuacaauuaauaaguauaaa

SEQ ID NO: 3281910 - RNA, 18 nt, Variola virus
aaguucauaaaaauaaua

SEQ ID NO: 3281911 - RNA, 17 nt, Variola virus
gaauacacauguuuuaa

SEQ ID NO: 3281912 - RNA, 19 nt, Variola virus
uaagaacuggacuguauau

SEQ ID NO: 3281913 - RNA, 19 nt, Variola virus
uaaguucauuaucugaaau

SEQ ID NO: 3281914 - RNA, 15 nt, Variola virus
aaguuucguacaaau

SEQ ID NO: 3281915 - RNA, 17 nt, Variola virus
uuaccggucauauuaau

SEQ ID NO: 3281916 - RNA, 19 nt, Variola virus
aagucacgcgauuuacugg

SEQ ID NO: 3281917 - RNA, 19 nt, Variola virus
uaauaaauugguaaauccu

SEQ ID NO: 3281918 - RNA, 16 nt, Variola virus
ugguccuauugcuucc

SEQ ID NO: 3281919 - RNA, 19 nt, Variola virus
guaacauccucgugauuua

SEQ ID NO: 3281920 - RNA, 15 nt, Variola virus
uuagauuauucuuaa

SEQ ID NO: 3281921 - RNA, 21 nt, Variola virus
ugaacagacauuguauuauga

SEQ ID NO: 3281922 - RNA, 15 nt, Variola virus
agugauuuugaagau

SEQ ID NO: 3281923 - RNA, 19 nt, Variola virus
uauuacugacuuuaauauu

SEQ ID NO: 3281924 - RNA, 13 nt, Variola virus
gucuguacaaaag

SEQ ID NO: 3281925 - RNA, 16 nt, Variola virus
augcagacaaaaugaa

SEQ ID NO: 3281926 - RNA, 16 nt, Variola virus
ggaaacuuucuagaac

SEQ ID NO: 3281927 - RNA, 23 nt, Variola virus
gacaguaauuucuuuauuaucua

SEQ ID NO: 3281928 - RNA, 23 nt, Variola virus
agggucaaacuuaauaaaggaua

SEQ ID NO: 3281929 - RNA, 18 nt, Variola virus
guuauauuauuagauauc

SEQ ID NO: 3281930 - RNA, 17 nt, Variola virus
uauguugauuuauuaua

SEQ ID NO: 3281931 - RNA, 13 nt, Variola virus
guugauaaucauc

SEQ ID NO: 3281932 - RNA, 19 nt, Variola virus
acguccaucagcauuguuu

SEQ ID NO: 3281933 - RNA, 18 nt, Variola virus
ccaccuccgucaucaucu

SEQ ID NO: 3281934 - RNA, 20 nt, Variola virus
gaacaucaguacuauuguug

SEQ ID NO: 3281935 - RNA, 16 nt, Variola virus
ucucucaauacagauu

SEQ ID NO: 3281936 - RNA, 15 nt, Variola virus
aggacguaacuauaa

SEQ ID NO: 3281937 - RNA, 20 nt, Variola virus
auaaagucuuuaguaugaca

SEQ ID NO: 3281938 - RNA, 19 nt, Variola virus
uucccaaauaaucauucau

SEQ ID NO: 3281939 - RNA, 23 nt, Variola virus
aacgauugguauuuguacaggua

SEQ ID NO: 3281940 - RNA, 18 nt, Variola virus
aacuccauauauguuuuc

SEQ ID NO: 3281941 - RNA, 14 nt, Variola virus
cgauacauaauguu

SEQ ID NO: 3281942 - RNA, 16 nt, Variola virus
uagauauaccagaacu

SEQ ID NO: 3281943 - RNA, 15 nt, Variola virus
aaaggagagaaugua

SEQ ID NO: 3281944 - RNA, 19 nt, Variola virus
ugauauuuauuuugcuauc

SEQ ID NO: 3281945 - RNA, 20 nt, Variola virus
caaacuuagaaccaaaugau

SEQ ID NO: 3281946 - RNA, 14 nt, Variola virus
acaucuaaaaaugu

SEQ ID NO: 3281947 - RNA, 22 nt, Variola virus
augugcuaaaaucacugaacau

SEQ ID NO: 3281948 - RNA, 22 nt, Variola virus
uaauucuuaucaauaacauauu

SEQ ID NO: 3281949 - RNA, 15 nt, Variola virus
uauuaaaucaugaag

SEQ ID NO: 3281950 - RNA, 14 nt, Variola virus
auaauauacauaag

SEQ ID NO: 3281951 - RNA, 15 nt, Variola virus
aauguaacguuuaua

SEQ ID NO: 3281952 - RNA, 18 nt, Variola virus
aaguacagauuuuaaaaa

SEQ ID NO: 3281953 - RNA, 13 nt, Variola virus
uuacuuuuggaau

SEQ ID NO: 3281954 - RNA, 17 nt, Variola virus
uguguaguuuucacaau

SEQ ID NO: 3281955 - RNA, 23 nt, Variola virus
uccaaucuaagaaauuuaaaauu

SEQ ID NO: 3281956 - RNA, 16 nt, Variola virus
gucuacuuaaauguau

SEQ ID NO: 3281957 - RNA, 13 nt, Variola virus
aauuuaaauacuu

SEQ ID NO: 3281958 - RNA, 20 nt, Variola virus
uuuaucuaauucgauacaaa

SEQ ID NO: 3281959 - RNA, 18 nt, Variola virus
ucagaaaauaccauccaa

SEQ ID NO: 3281960 - RNA, 19 nt, Variola virus
aaucuagccauuauaaagu

SEQ ID NO: 3281961 - RNA, 14 nt, Variola virus
auuaauuauacuau

SEQ ID NO: 3281962 - RNA, 17 nt, Variola virus
guaucauaucuucgaaa

SEQ ID NO: 3281963 - RNA, 19 nt, Variola virus
cuccagauacauauggauc

SEQ ID NO: 3281964 - RNA, 13 nt, Variola virus
ugucuccuuuuca

SEQ ID NO: 3281965 - RNA, 21 nt, Variola virus
aucaauaccuuuucuggcuaa

SEQ ID NO: 3281966 - RNA, 23 nt, Variola virus
uuaucgauacacguuuucaaaau

SEQ ID NO: 3281967 - RNA, 20 nt, Variola virus
uccaucaugaucugguuuug

SEQ ID NO: 3281968 - RNA, 10 nt, Variola virus
aauuaaauau

SEQ ID NO: 3281969 - RNA, 15 nt, Variola virus
aauccaaaaaaugaa

SEQ ID NO: 3281970 - RNA, 14 nt, Variola virus
aucgcaauauccuu

SEQ ID NO: 3281971 - RNA, 12 nt, Variola virus
auauaaugaauu

SEQ ID NO: 3281972 - RNA, 21 nt, Variola virus
uuauaucuuuagcuaaaucgu

SEQ ID NO: 3281973 - RNA, 13 nt, Variola virus
agaaauaaaaauu

SEQ ID NO: 3281974 - RNA, 17 nt, Variola virus
aauaguuuauaacauua

SEQ ID NO: 3281975 - RNA, 20 nt, Variola virus
gacauuauguuguuaaaaua

SEQ ID NO: 3281976 - RNA, 20 nt, Variola virus
aagaguuaauaaauaucauu

SEQ ID NO: 3281977 - RNA, 21 nt, Variola virus
aauugguuuauaauguauaau

SEQ ID NO: 3281978 - RNA, 13 nt, Variola virus
uuuuauguaucca

SEQ ID NO: 3281979 - RNA, 19 nt, Variola virus
caauaagcauuaugauuug

SEQ ID NO: 3281980 - RNA, 21 nt, Variola virus
aaaugcucugcaauaacuaau

SEQ ID NO: 3281981 - RNA, 21 nt, Variola virus
auaaauuuuuccaagaaacua

SEQ ID NO: 3281982 - RNA, 23 nt, Variola virus
acugaauacauuaucaaaaagaa

SEQ ID NO: 3281983 - RNA, 21 nt, Variola virus
uggaaucagaagaugauucca

SEQ ID NO: 3281984 - RNA, 18 nt, Variola virus
auguguaaaaaguuuuaa

SEQ ID NO: 3281985 - RNA, 21 nt, Variola virus
gaacaucuugauuauaauaua

SEQ ID NO: 3281986 - RNA, 15 nt, Variola virus
aaaauuccuaaauua

SEQ ID NO: 3281987 - RNA, 15 nt, Variola virus
auacuuuuucuagaa

SEQ ID NO: 3281988 - RNA, 15 nt, Variola virus
ucuauagauggagua

SEQ ID NO: 3281989 - RNA, 22 nt, Variola virus
acaaauguuaaacauuaauuga

SEQ ID NO: 3281990 - RNA, 21 nt, Variola virus
agaugauagcuauuuaacuaa

SEQ ID NO: 3281991 - RNA, 22 nt, Variola virus
auauuaaugcagggugcauauu

SEQ ID NO: 3281992 - RNA, 22 nt, Variola virus
gaugucugaaacguauucucuu

SEQ ID NO: 3281993 - RNA, 19 nt, Variola virus
aaaagacaugauaauauua

SEQ ID NO: 3281994 - RNA, 14 nt, Variola virus
cucgauaauuauua

SEQ ID NO: 3281995 - RNA, 18 nt, Variola virus
ucuuauauagauuucgaa

SEQ ID NO: 3281996 - RNA, 15 nt, Variola virus
ccuuugcuauuucua

SEQ ID NO: 3281997 - RNA, 11 nt, Variola virus
uauccuuaucc

SEQ ID NO: 3281998 - RNA, 19 nt, Variola virus
uaguugcaauauacauaaa

SEQ ID NO: 3281999 - RNA, 22 nt, Variola virus
uaaaguauaugggcgauauucu

SEQ ID NO: 3282000 - RNA, 16 nt, Variola virus
auuugagagucuuaua

SEQ ID NO: 3282001 - RNA, 12 nt, Variola virus
ucuaaauuauuc

SEQ ID NO: 3282002 - RNA, 16 nt, Variola virus
acauacaucuaugaau

SEQ ID NO: 3282003 - RNA, 22 nt, Variola virus
auauuaucaucccauuguaaag

SEQ ID NO: 3282004 - RNA, 17 nt, Variola virus
uccagaugucaugauau

SEQ ID NO: 3282005 - RNA, 20 nt, Variola virus
auauuuuccauuauuaauaa

SEQ ID NO: 3282006 - RNA, 16 nt, Variola virus
auauuuaccaaagcaa

SEQ ID NO: 3282007 - RNA, 14 nt, Variola virus
agaugacuggaaau

SEQ ID NO: 3282008 - RNA, 12 nt, Variola virus
uuaacauuauua

SEQ ID NO: 3282009 - RNA, 19 nt, Variola virus
ucacuucuucaacuaccaa

SEQ ID NO: 3282010 - RNA, 15 nt, Variola virus
ucgcuaauuaugaaa

SEQ ID NO: 3282011 - RNA, 14 nt, Variola virus
uauucaucaucaaa

SEQ ID NO: 3282012 - RNA, 13 nt, Variola virus
uucuacauuuuca

SEQ ID NO: 3282013 - RNA, 16 nt, Variola virus
auugucuuaacuauaa

SEQ ID NO: 3282014 - RNA, 13 nt, Variola virus
uugcgacacuauu

SEQ ID NO: 3282015 - RNA, 22 nt, Variola virus
aaaguuaaggugcgaguauuaa

SEQ ID NO: 3282016 - RNA, 14 nt, Variola virus
cuuugauaaaaguu

SEQ ID NO: 3282017 - RNA, 18 nt, Variola virus
aagacaucauauauagaa

SEQ ID NO: 3282018 - RNA, 16 nt, Variola virus
cauuuaucacaaaaaa

SEQ ID NO: 3282019 - RNA, 22 nt, Variola virus
gaaugcuaaugucaaguuuauu

SEQ ID NO: 3282020 - RNA, 19 nt, Variola virus
aauggaugaggaagugaua

SEQ ID NO: 3282021 - RNA, 16 nt, Variola virus
uauuacgaauuacauu

SEQ ID NO: 3282022 - RNA, 16 nt, Variola virus
cuaucgcauguggaug

SEQ ID NO: 3282023 - RNA, 19 nt, Variola virus
aauuagucauacguaauga

SEQ ID NO: 3282024 - RNA, 17 nt, Variola virus
cuaguucucucucauaa

SEQ ID NO: 3282025 - RNA, 16 nt, Variola virus
auguaaucauuaucca

SEQ ID NO: 3282026 - RNA, 23 nt, Variola virus
auugauaacucugauuucuugaa

SEQ ID NO: 3282027 - RNA, 16 nt, Variola virus
auaacauuuuuuguaa

SEQ ID NO: 3282028 - RNA, 14 nt, Variola virus
cuauuuuuaauaua

SEQ ID NO: 3282029 - RNA, 16 nt, Variola virus
ucaucguuauuuuuaa

SEQ ID NO: 3282030 - RNA, 15 nt, Variola virus
cuuguuauaaacaca

SEQ ID NO: 3282031 - RNA, 15 nt, Variola virus
acuacuauuauugaa

SEQ ID NO: 3282032 - RNA, 17 nt, Variola virus
ugaucuaugacaucaug

SEQ ID NO: 3282033 - RNA, 15 nt, Variola virus
cuaaacaagcuaucu

SEQ ID NO: 3282034 - RNA, 14 nt, Variola virus
ucggucaacuuauu

SEQ ID NO: 3282035 - RNA, 12 nt, Variola virus
auuugacuagau

SEQ ID NO: 3282036 - RNA, 14 nt, Variola virus
agaccaauaauaaa

SEQ ID NO: 3282037 - RNA, 17 nt, Variola virus
agaaugcauaaauuugu

SEQ ID NO: 3282038 - RNA, 13 nt, Variola virus
ucuacaucuucaa

SEQ ID NO: 3282039 - RNA, 19 nt, Variola virus
aaugccuuccaaaguuuaa

SEQ ID NO: 3282040 - RNA, 16 nt, Variola virus
aucuaaucagaaucuu

SEQ ID NO: 3282041 - RNA, 16 nt, Variola virus
auuaaaaguuaaugag

SEQ ID NO: 3282042 - RNA, 18 nt, Variola virus
uucuaauacauaauucuu

SEQ ID NO: 3282043 - RNA, 13 nt, Variola virus
cguauuuaucuaa

SEQ ID NO: 3282044 - RNA, 16 nt, Variola virus
gugauuguucaaucaa

SEQ ID NO: 3282045 - RNA, 23 nt, Variola virus
aucgucauuuuuuucucuagauc

SEQ ID NO: 3282046 - RNA, 16 nt, Variola virus
ugaguucugugcagau

SEQ ID NO: 3282047 - RNA, 22 nt, Variola virus
caauacagauuguacuauacau

SEQ ID NO: 3282048 - RNA, 18 nt, Variola virus
accauggacauaaagaua

SEQ ID NO: 3282049 - RNA, 13 nt, Variola virus
augguaaaaagac

SEQ ID NO: 3282050 - RNA, 17 nt, Variola virus
aauuuuucuacagauau

SEQ ID NO: 3282051 - RNA, 15 nt, Variola virus
auucuuuuaugaaua

SEQ ID NO: 3282052 - RNA, 14 nt, Variola virus
aaauuauccuauca

SEQ ID NO: 3282053 - RNA, 12 nt, Variola virus
cauuuuuaggau

SEQ ID NO: 3282054 - RNA, 23 nt, Variola virus
uaauuuuauuaacgguaauacau

SEQ ID NO: 3282055 - RNA, 14 nt, Variola virus
caguauccuuuuug

SEQ ID NO: 3282056 - RNA, 13 nt, Variola virus
agggaaauuuaau

SEQ ID NO: 3282057 - RNA, 14 nt, Variola virus
auaaaauuuaagaa

SEQ ID NO: 3282058 - RNA, 17 nt, Variola virus
agacaauugacaaaauu

SEQ ID NO: 3282059 - RNA, 12 nt, Variola virus
ccagucaugaau

SEQ ID NO: 3282060 - RNA, 15 nt, Variola virus
auuaugauagaaauu

SEQ ID NO: 3282061 - RNA, 15 nt, Variola virus
augaauguuuucaau

SEQ ID NO: 3282062 - RNA, 22 nt, Variola virus
agaauuuuuucggguuccaaac

SEQ ID NO: 3282063 - RNA, 19 nt, Variola virus
acaaugcucaguaaaugua

SEQ ID NO: 3282064 - RNA, 14 nt, Variola virus
ugacaaaaauugug

SEQ ID NO: 3282065 - RNA, 14 nt, Variola virus
uuccacaauacgag

SEQ ID NO: 3282066 - RNA, 20 nt, Variola virus
ccucugccuuuuuauacaua

SEQ ID NO: 3282067 - RNA, 19 nt, Variola virus
gugaucacggguuuguaaa

SEQ ID NO: 3282068 - RNA, 17 nt, Variola virus
agaauacuauuugguaa

SEQ ID NO: 3282069 - RNA, 20 nt, Variola virus
gaaucugaaccaucaucugu

SEQ ID NO: 3282070 - RNA, 21 nt, Variola virus
cuguacacaugguguuacaaa

SEQ ID NO: 3282071 - RNA, 20 nt, Variola virus
gaggaguuauugauauuaac

SEQ ID NO: 3282072 - RNA, 18 nt, Variola virus
aauuuccugauucagaua

SEQ ID NO: 3282073 - RNA, 16 nt, Variola virus
aguagcaaauuuccua

SEQ ID NO: 3282074 - RNA, 15 nt, Variola virus
ccaucauccaagaaa

SEQ ID NO: 3282075 - RNA, 21 nt, Variola virus
uagcuauuuguagcaaaacua

SEQ ID NO: 3282076 - RNA, 15 nt, Variola virus
uccaaucuuaaacau

SEQ ID NO: 3282077 - RNA, 21 nt, Variola virus
acguccugcaggguauuguuu

SEQ ID NO: 3282078 - RNA, 20 nt, Variola virus
cugaaaaagauaucagagaa

SEQ ID NO: 3282079 - RNA, 23 nt, Variola virus
aauaguucucccuuuuuaaaggu

SEQ ID NO: 3282080 - RNA, 16 nt, Variola virus
ugaugcugguucugga

SEQ ID NO: 3282081 - RNA, 21 nt, Variola virus
augucuaacggcgaacauguu

SEQ ID NO: 3282082 - RNA, 17 nt, Variola virus
gguauacuaguagguaa

SEQ ID NO: 3282083 - RNA, 16 nt, Variola virus
ugauagaauuauacca

SEQ ID NO: 3282084 - RNA, 21 nt, Variola virus
aauguauccggccaauugaua

SEQ ID NO: 3282085 - RNA, 15 nt, Variola virus
auaucuauaggaaag

SEQ ID NO: 3282086 - RNA, 19 nt, Variola virus
aguaacgcguggaaaaagc

SEQ ID NO: 3282087 - RNA, 17 nt, Variola virus
aguaucuucuuuaucua

SEQ ID NO: 3282088 - RNA, 19 nt, Variola virus
aguauaguuuuaaacuaau

SEQ ID NO: 3282089 - RNA, 22 nt, Variola virus
uaguugauagaacaaaauacau

SEQ ID NO: 3282090 - RNA, 14 nt, Variola virus
uuaacaucacuaau

SEQ ID NO: 3282091 - RNA, 17 nt, Variola virus
aucacauauuaaaauuc

SEQ ID NO: 3282092 - RNA, 11 nt, Variola virus
cacaugaugau

SEQ ID NO: 3282093 - RNA, 12 nt, Variola virus
cuuaaaauguaa

SEQ ID NO: 3282094 - RNA, 15 nt, Variola virus
acaaacauauuacca

SEQ ID NO: 3282095 - RNA, 22 nt, Variola virus
auuaacgaguucaaauaugaaa

SEQ ID NO: 3282096 - RNA, 17 nt, Variola virus
auuauccaucuaacaaa

SEQ ID NO: 3282097 - RNA, 16 nt, Variola virus
uaaagaacaaauguug

SEQ ID NO: 3282098 - RNA, 18 nt, Variola virus
cuuuuguggacauuuucu

SEQ ID NO: 3282099 - RNA, 16 nt, Variola virus
uaaaaaccaaaucuug

SEQ ID NO: 3282100 - RNA, 16 nt, Variola virus
aauaggugaugaugca

SEQ ID NO: 3282101 - RNA, 23 nt, Variola virus
aaugaauuaauuaaaauauuguu

SEQ ID NO: 3282102 - RNA, 23 nt, Variola virus
uauuguagaaauuguuuuucaua

SEQ ID NO: 3282103 - RNA, 16 nt, Variola virus
aucaacaauuuuguau

SEQ ID NO: 3282104 - RNA, 22 nt, Variola virus
uuauaaagaccgaauacauaac

SEQ ID NO: 3282105 - RNA, 22 nt, Variola virus
ucucuauaaacgaugguuuaau

SEQ ID NO: 3282106 - RNA, 20 nt, Variola virus
uuugguacguugauuucuag

SEQ ID NO: 3282107 - RNA, 23 nt, Variola virus
acuauacauucuucuguuaauuu

SEQ ID NO: 3282108 - RNA, 15 nt, Variola virus
caggcucuauuuuca

SEQ ID NO: 3282109 - RNA, 16 nt, Variola virus
guuauugucaaaaucu

SEQ ID NO: 3282110 - RNA, 20 nt, Variola virus
gaccuuuuccuuaucuucau

SEQ ID NO: 3282111 - RNA, 14 nt, Variola virus
auaaaguguucauc

SEQ ID NO: 3282112 - RNA, 16 nt, Variola virus
uguuuaucuucuucca

SEQ ID NO: 3282113 - RNA, 23 nt, Variola virus
gcuauagcauuguuauguauuuc

SEQ ID NO: 3282114 - RNA, 13 nt, Variola virus
uugauuacucuuu

SEQ ID NO: 3282115 - RNA, 20 nt, Variola virus
auuguuuugaagaaaugaua

SEQ ID NO: 3282116 - RNA, 17 nt, Variola virus
uguacuuaacaugauua

SEQ ID NO: 3282117 - RNA, 22 nt, Variola virus
aacacuauuccaucuguggaaa

SEQ ID NO: 3282118 - RNA, 15 nt, Variola virus
aacuauagacaaaau

SEQ ID NO: 3282119 - RNA, 18 nt, Variola virus
uuauaucguuaucauuaa

SEQ ID NO: 3282120 - RNA, 14 nt, Variola virus
acugucuaaaugua

SEQ ID NO: 3282121 - RNA, 15 nt, Variola virus
auuagauaugccaaa

SEQ ID NO: 3282122 - RNA, 16 nt, Variola virus
guuaagagaaauuaga

SEQ ID NO: 3282123 - RNA, 17 nt, Variola virus
gacauuccuaugaugau

SEQ ID NO: 3282124 - RNA, 13 nt, Variola virus
uucaacaaacuaa

SEQ ID NO: 3282125 - RNA, 13 nt, Variola virus
cauaaaacauaau

SEQ ID NO: 3282126 - RNA, 14 nt, Variola virus
aguuuuuaacuagu

SEQ ID NO: 3282127 - RNA, 20 nt, Variola virus
aacgauuuuccaaaucagua

SEQ ID NO: 3282128 - RNA, 15 nt, Variola virus
guuauaguagauauc

SEQ ID NO: 3282129 - RNA, 14 nt, Variola virus
guuccaacaucaua

SEQ ID NO: 3282130 - RNA, 13 nt, Variola virus
ugaccaauuuauu

SEQ ID NO: 3282131 - RNA, 21 nt, Variola virus
guauuacgaagaagacaauga

SEQ ID NO: 3282132 - RNA, 12 nt, Variola virus
uguauacuguau

SEQ ID NO: 3282133 - RNA, 23 nt, Variola virus
uaacaugauaacugguguagaga

SEQ ID NO: 3282134 - RNA, 22 nt, Variola virus
auagcuacaguaaaaauaacua

SEQ ID NO: 3282135 - RNA, 16 nt, Variola virus
aguaaguauuuauaca

SEQ ID NO: 3282136 - RNA, 20 nt, Variola virus
augaugaaacacaagaucaa

SEQ ID NO: 3282137 - RNA, 20 nt, Variola virus
gaaaugucuacauaaaucua

SEQ ID NO: 3282138 - RNA, 22 nt, Variola virus
gaaaauaaauccaaaauaacua

SEQ ID NO: 3282139 - RNA, 20 nt, Variola virus
uggauuaagcaauagugaua

SEQ ID NO: 3282140 - RNA, 21 nt, Variola virus
ucuuuuccauuuuuaucagua

SEQ ID NO: 3282141 - RNA, 13 nt, Variola virus
ccggcgaaaagau

SEQ ID NO: 3282142 - RNA, 19 nt, Variola virus
auucacagacucucaagau

SEQ ID NO: 3282143 - RNA, 14 nt, Variola virus
auauaccucauuaa

SEQ ID NO: 3282144 - RNA, 17 nt, Variola virus
uauauauagauggagua

SEQ ID NO: 3282145 - RNA, 16 nt, Variola virus
aguauguuugacuuua

SEQ ID NO: 3282146 - RNA, 13 nt, Variola virus
auaugauccaugc

SEQ ID NO: 3282147 - RNA, 12 nt, Variola virus
uuacaaugacuc

SEQ ID NO: 3282148 - RNA, 20 nt, Variola virus
uaccagauauuauacaaaau

SEQ ID NO: 3282149 - RNA, 19 nt, Variola virus
ccucauuuaucauguuguc

SEQ ID NO: 3282150 - RNA, 20 nt, Variola virus
aaacuagaaaaacuuaguac

SEQ ID NO: 3282151 - RNA, 12 nt, Variola virus
uucaucuagaau

SEQ ID NO: 3282152 - RNA, 21 nt, Variola virus
auacuuugcccuuuaauacau

SEQ ID NO: 3282153 - RNA, 16 nt, Variola virus
ucuaucuuuagaguau

SEQ ID NO: 3282154 - RNA, 19 nt, Variola virus
auuaucgcuaauugacaca

SEQ ID NO: 3282155 - RNA, 18 nt, Variola virus
aaacgauauucuugaaau

SEQ ID NO: 3282156 - RNA, 19 nt, Variola virus
uguauaacaugacauuuau

SEQ ID NO: 3282157 - RNA, 24 nt, Variola virus
gaaaguaauuauuacaagucaaag

SEQ ID NO: 3282158 - RNA, 13 nt, Variola virus
ugucauucucaug

SEQ ID NO: 3282159 - RNA, 18 nt, Variola virus
cgucuucccaaaauguua

SEQ ID NO: 3282160 - RNA, 16 nt, Variola virus
cuacaauauauucuca

SEQ ID NO: 3282161 - RNA, 17 nt, Variola virus
uagccaucguuaauuau

SEQ ID NO: 3282162 - RNA, 17 nt, Variola virus
aucauuauaauaugaug

SEQ ID NO: 3282163 - RNA, 21 nt, Variola virus
aucaggauccaagcuuucuaa

SEQ ID NO: 3282164 - RNA, 18 nt, Variola virus
acuaugcgaugucuugga

SEQ ID NO: 3282165 - RNA, 17 nt, Variola virus
uauagucuggaacacua

SEQ ID NO: 3282166 - RNA, 17 nt, Variola virus
caguacucauuaucaua

SEQ ID NO: 3282167 - RNA, 23 nt, Variola virus
cuaaugacaauaauuauguagua

SEQ ID NO: 3282168 - RNA, 17 nt, Variola virus
uucagaggaauacagac

SEQ ID NO: 3282169 - RNA, 19 nt, Variola virus
augucaagaucuuuuguau

SEQ ID NO: 3282170 - RNA, 23 nt, Variola virus
uacuuuuucuuuaccuuaagaau

SEQ ID NO: 3282171 - RNA, 13 nt, Variola virus
aaagagacuacaa

SEQ ID NO: 3282172 - RNA, 14 nt, Variola virus
cuugauaaauugua

SEQ ID NO: 3282173 - RNA, 14 nt, Variola virus
gaaauauauacaua

SEQ ID NO: 3282174 - RNA, 15 nt, Variola virus
uuccaaauuauucuu

SEQ ID NO: 3282175 - RNA, 21 nt, Variola virus
aauucuagucuuaaccaagaa

SEQ ID NO: 3282176 - RNA, 18 nt, Variola virus
ccaugauggucauguuua

SEQ ID NO: 3282177 - RNA, 16 nt, Variola virus
gucugucaaaucaucu

SEQ ID NO: 3282178 - RNA, 16 nt, Variola virus
uaguauauggacaaac

SEQ ID NO: 3282179 - RNA, 18 nt, Variola virus
caauugauaguaaauaau

SEQ ID NO: 3282180 - RNA, 15 nt, Variola virus
ccagaacuauuuuua

SEQ ID NO: 3282181 - RNA, 22 nt, Variola virus
auacuguauauacuauuauaga

SEQ ID NO: 3282182 - RNA, 15 nt, Variola virus
cuaucuaucuguauu

SEQ ID NO: 3282183 - RNA, 19 nt, Variola virus
aguucauuguuuucaauau

SEQ ID NO: 3282184 - RNA, 12 nt, Variola virus
uuauaauuauua

SEQ ID NO: 3282185 - RNA, 12 nt, Variola virus
uuaaaauuauuu

SEQ ID NO: 3282186 - RNA, 14 nt, Variola virus
acaauacuaccaac

SEQ ID NO: 3282187 - RNA, 17 nt, Variola virus
cuauauuguaccaaauu

SEQ ID NO: 3282188 - RNA, 15 nt, Variola virus
auuuucuuucuaaua

SEQ ID NO: 3282189 - RNA, 19 nt, Variola virus
agaaugcuguuauauacau

SEQ ID NO: 3282190 - RNA, 22 nt, Variola virus
acgauauagacaacguagaauu

SEQ ID NO: 3282191 - RNA, 17 nt, Variola virus
aaucuuaauaucuucgu

SEQ ID NO: 3282192 - RNA, 19 nt, Variola virus
guucuucgcagaugaugau

SEQ ID NO: 3282193 - RNA, 18 nt, Variola virus
aagauggaguauaaucuu

SEQ ID NO: 3282194 - RNA, 21 nt, Variola virus
aauauuguuuuacugucucaa

SEQ ID NO: 3282195 - RNA, 22 nt, Variola virus
cgucaauguacuuaacaugauu

SEQ ID NO: 3282196 - RNA, 18 nt, Variola virus
aauacuuaccuaaugccu

SEQ ID NO: 3282197 - RNA, 23 nt, Variola virus
caacugauuaauaagaucuucua

SEQ ID NO: 3282198 - RNA, 14 nt, Variola virus
guauuccuacuuuu

SEQ ID NO: 3282199 - RNA, 14 nt, Variola virus
caaaaucuuaauau

SEQ ID NO: 3282200 - RNA, 23 nt, Variola virus
ugaguaagacuugacuaaaucgu

SEQ ID NO: 3282201 - RNA, 19 nt, Variola virus
uauggaagaagaaauaaag

SEQ ID NO: 3282202 - RNA, 15 nt, Variola virus
cuauuguauuuugug

SEQ ID NO: 3282203 - RNA, 17 nt, Variola virus
uuucgcgggauacauca

SEQ ID NO: 3282204 - RNA, 21 nt, Variola virus
uuugacaaagauggucugaaa

SEQ ID NO: 3282205 - RNA, 18 nt, Variola virus
acuuguuuaaugaugaau

SEQ ID NO: 3282206 - RNA, 22 nt, Variola virus
agcgacucuauuggauauggau

SEQ ID NO: 3282207 - RNA, 18 nt, Variola virus
aaacuaucugauguagga

SEQ ID NO: 3282208 - RNA, 19 nt, Variola virus
acguuaauugucuauaaau

SEQ ID NO: 3282209 - RNA, 22 nt, Variola virus
augauuuuaccgcaauauguau

SEQ ID NO: 3282210 - RNA, 14 nt, Variola virus
augaauugcauaca

SEQ ID NO: 3282211 - RNA, 13 nt, Variola virus
auauucauagagg

SEQ ID NO: 3282212 - RNA, 16 nt, Variola virus
acgaaaguaauuauua

SEQ ID NO: 3282213 - RNA, 18 nt, Variola virus
agcgaaaaauaauuauuc

SEQ ID NO: 3282214 - RNA, 20 nt, Variola virus
aggaaaguuuaucaaaaaua

SEQ ID NO: 3282215 - RNA, 20 nt, Variola virus
cguuagauuuucuacagaua

SEQ ID NO: 3282216 - RNA, 16 nt, Variola virus
caauaauauacuaauu

SEQ ID NO: 3282217 - RNA, 14 nt, Variola virus
guuuacauaaauga

SEQ ID NO: 3282218 - RNA, 15 nt, Variola virus
uauaauucuuuggua

SEQ ID NO: 3282219 - RNA, 22 nt, Variola virus
ccuuauagaggauguuaaacaa

SEQ ID NO: 3282220 - RNA, 16 nt, Variola virus
ucuaauaauuuggaua

SEQ ID NO: 3282221 - RNA, 15 nt, Variola virus
aaauuauauacugaa

SEQ ID NO: 3282222 - RNA, 16 nt, Variola virus
cgcauuaacaaaaucu

SEQ ID NO: 3282223 - RNA, 14 nt, Variola virus
uguuucgauuucaa

SEQ ID NO: 3282224 - RNA, 24 nt, Variola virus
uaauaguuuccaccaaaagacuau

SEQ ID NO: 3282225 - RNA, 13 nt, Variola virus
aacauuaaaaugu

SEQ ID NO: 3282226 - RNA, 15 nt, Variola virus
uuguuccuguagaua

SEQ ID NO: 3282227 - RNA, 13 nt, Variola virus
uuauccaauacag

SEQ ID NO: 3282228 - RNA, 15 nt, Variola virus
ugaagaaaaauguug

SEQ ID NO: 3282229 - RNA, 16 nt, Variola virus
cauaauauuaaacacu

SEQ ID NO: 3282230 - RNA, 17 nt, Variola virus
uucuuaaacuuauucuu

SEQ ID NO: 3282231 - RNA, 16 nt, Variola virus
cucguugguauuugaa

SEQ ID NO: 3282232 - RNA, 14 nt, Variola virus
auauauuuggauuu

SEQ ID NO: 3282233 - RNA, 13 nt, Variola virus
caacagaaaauau

SEQ ID NO: 3282234 - RNA, 19 nt, Variola virus
ugaugaacgacuggauguu

SEQ ID NO: 3282235 - RNA, 15 nt, Variola virus
uuucaaaacaaacag

SEQ ID NO: 3282236 - RNA, 13 nt, Variola virus
ucguacauccagg

SEQ ID NO: 3282237 - RNA, 17 nt, Variola virus
aauaacaggcuaaaaug

SEQ ID NO: 3282238 - RNA, 17 nt, Variola virus
auauccguuaugucuuc

SEQ ID NO: 3282239 - RNA, 16 nt, Variola virus
agaauaauauacuucu

SEQ ID NO: 3282240 - RNA, 19 nt, Variola virus
uucuauuauuauuaauuuu

SEQ ID NO: 3282241 - RNA, 22 nt, Variola virus
auuccaaauuuguggcaaugaa

SEQ ID NO: 3282242 - RNA, 19 nt, Variola virus
aucuccuuauuuuuaaaaa

SEQ ID NO: 3282243 - RNA, 17 nt, Variola virus
cagcaucuugaauagaa

SEQ ID NO: 3282244 - RNA, 23 nt, Variola virus
ucuaggcgguggauauuucugaa

SEQ ID NO: 3282245 - RNA, 19 nt, Variola virus
cuccguuuccauuaccauc

SEQ ID NO: 3282246 - RNA, 18 nt, Variola virus
uacaucuaguucuuugaa

SEQ ID NO: 3282247 - RNA, 19 nt, Variola virus
aguccuaguuguauacuga

SEQ ID NO: 3282248 - RNA, 20 nt, Variola virus
aacuucuggaaguuccaaac

SEQ ID NO: 3282249 - RNA, 20 nt, Variola virus
uauuccgacaaaggauugau

SEQ ID NO: 3282250 - RNA, 13 nt, Variola virus
ucaaagauaauag

SEQ ID NO: 3282251 - RNA, 21 nt, Variola virus
ugaauaagcaguguuaucuau

SEQ ID NO: 3282252 - RNA, 21 nt, Variola virus
caugaguagcauuaaauuccu

SEQ ID NO: 3282253 - RNA, 14 nt, Variola virus
uauaaaauaaacau

SEQ ID NO: 3282254 - RNA, 18 nt, Variola virus
acauguguacuuguacac

SEQ ID NO: 3282255 - RNA, 15 nt, Variola virus
cgguguauuguauuu

SEQ ID NO: 3282256 - RNA, 14 nt, Variola virus
caaucuuauaucuu

SEQ ID NO: 3282257 - RNA, 15 nt, Variola virus
aaugucuuucauguu

SEQ ID NO: 3282258 - RNA, 18 nt, Variola virus
aguuaaugcaucuaaaac

SEQ ID NO: 3282259 - RNA, 16 nt, Variola virus
cucuuucggacuuaua

SEQ ID NO: 3282260 - RNA, 13 nt, Variola virus
auaauuugaucca

SEQ ID NO: 3282261 - RNA, 15 nt, Variola virus
auucaguaguguuua

SEQ ID NO: 3282262 - RNA, 14 nt, Variola virus
aaacuaaacuuauu

SEQ ID NO: 3282263 - RNA, 18 nt, Variola virus
aacagaaaacaaagucua

SEQ ID NO: 3282264 - RNA, 17 nt, Variola virus
auuuauaccaugucaaa

SEQ ID NO: 3282265 - RNA, 16 nt, Variola virus
caauagcacaauuguu

SEQ ID NO: 3282266 - RNA, 21 nt, Variola virus
uauaaagucugucaaaucauc

SEQ ID NO: 3282267 - RNA, 14 nt, Variola virus
auuucuuacauaaa

SEQ ID NO: 3282268 - RNA, 19 nt, Variola virus
guugcugcucguauaaucu

SEQ ID NO: 3282269 - RNA, 19 nt, Variola virus
guaguucuguucuaucauc

SEQ ID NO: 3282270 - RNA, 22 nt, Variola virus
cuuuuagaagugauucuuugau

SEQ ID NO: 3282271 - RNA, 16 nt, Variola virus
uuguauuauucugaau

SEQ ID NO: 3282272 - RNA, 17 nt, Variola virus
ucagaaagcuguggaug

SEQ ID NO: 3282273 - RNA, 14 nt, Variola virus
uaagacgucucauu

SEQ ID NO: 3282274 - RNA, 12 nt, Variola virus
uuauauauguaa

SEQ ID NO: 3282275 - RNA, 18 nt, Variola virus
auguagauaaaaaagaua

SEQ ID NO: 3282276 - RNA, 19 nt, Variola virus
cucuauuggauauggauuu

SEQ ID NO: 3282277 - RNA, 14 nt, Variola virus
auaaaguauaugua

SEQ ID NO: 3282278 - RNA, 17 nt, Variola virus
cuggaaccucaacaauc

SEQ ID NO: 3282279 - RNA, 14 nt, Variola virus
auuaacuaucugua

SEQ ID NO: 3282280 - RNA, 22 nt, Variola virus
auuauacuuuuuuuuggaaaug

SEQ ID NO: 3282281 - RNA, 14 nt, Variola virus
auuuauuucuucuu

SEQ ID NO: 3282282 - RNA, 13 nt, Variola virus
uaaucugaugaau

SEQ ID NO: 3282283 - RNA, 15 nt, Variola virus
auccuuaaauguuuu

SEQ ID NO: 3282284 - RNA, 22 nt, Variola virus
agugguaggucauacuccauca

SEQ ID NO: 3282285 - RNA, 16 nt, Variola virus
uucaaaauagcuaucu

SEQ ID NO: 3282286 - RNA, 23 nt, Variola virus
cuagauauguauuuaauaucaaa

SEQ ID NO: 3282287 - RNA, 21 nt, Variola virus
aucacaacaucuauaaaagua

SEQ ID NO: 3282288 - RNA, 17 nt, Variola virus
uuagacuauaugugucu

SEQ ID NO: 3282289 - RNA, 20 nt, Variola virus
gauagaagauuuaucuuucu

SEQ ID NO: 3282290 - RNA, 13 nt, Variola virus
gcucuacgaauau

SEQ ID NO: 3282291 - RNA, 15 nt, Variola virus
gauaaguaauaacua

SEQ ID NO: 3282292 - RNA, 20 nt, Variola virus
aaaagacuauacauuuccga

SEQ ID NO: 3282293 - RNA, 23 nt, Variola virus
aauaucaaagagaugguuuccuu

SEQ ID NO: 3282294 - RNA, 14 nt, Variola virus
cucaucaucuguuu

SEQ ID NO: 3282295 - RNA, 15 nt, Variola virus
acgcuauuaaucuuu

SEQ ID NO: 3282296 - RNA, 22 nt, Variola virus
auuaaucaaaugguaaauacug

SEQ ID NO: 3282297 - RNA, 15 nt, Variola virus
acaaacauacucuaa

SEQ ID NO: 3282298 - RNA, 16 nt, Variola virus
guauacuugucaucau

SEQ ID NO: 3282299 - RNA, 22 nt, Variola virus
cauuaaacccucgaucaugaau

SEQ ID NO: 3282300 - RNA, 23 nt, Variola virus
augcaaacuuacagaaacaauga

SEQ ID NO: 3282301 - RNA, 13 nt, Variola virus
acaaauaauaggu

SEQ ID NO: 3282302 - RNA, 15 nt, Variola virus
gcuccaaauauacau

SEQ ID NO: 3282303 - RNA, 18 nt, Variola virus
uaauuuuauauuccucua

SEQ ID NO: 3282304 - RNA, 15 nt, Variola virus
auugacgaugucaau

SEQ ID NO: 3282305 - RNA, 23 nt, Variola virus
gucaucaaguaguagugauuuug

SEQ ID NO: 3282306 - RNA, 12 nt, Variola virus
ucguuaaauuuu

SEQ ID NO: 3282307 - RNA, 13 nt, Variola virus
uacugaauuauua

SEQ ID NO: 3282308 - RNA, 12 nt, Variola virus
uaauacuaaaua

SEQ ID NO: 3282309 - RNA, 19 nt, Variola virus
acuauuagaauuaaguaga

SEQ ID NO: 3282310 - RNA, 21 nt, Variola virus
auuacaacauggccaaaauuu

SEQ ID NO: 3282311 - RNA, 13 nt, Variola virus
gauguagaagaag

SEQ ID NO: 3282312 - RNA, 16 nt, Variola virus
aaagacuaugcaaaga

SEQ ID NO: 3282313 - RNA, 21 nt, Variola virus
cgauuauuauaaaauaacaau

SEQ ID NO: 3282314 - RNA, 14 nt, Variola virus
ugucauuaaaucuu

SEQ ID NO: 3282315 - RNA, 13 nt, Variola virus
acuaucuguaaaa

SEQ ID NO: 3282316 - RNA, 13 nt, Variola virus
acauuuuuaaaga

SEQ ID NO: 3282317 - RNA, 17 nt, Variola virus
cauacauacuaucuuua

SEQ ID NO: 3282318 - RNA, 17 nt, Variola virus
guaugaauaaucuucau

SEQ ID NO: 3282319 - RNA, 21 nt, Variola virus
acuuacagauggauaaaacuu

SEQ ID NO: 3282320 - RNA, 13 nt, Variola virus
gauguuagauaua

SEQ ID NO: 3282321 - RNA, 20 nt, Variola virus
auuuccagauauauaucuuu

SEQ ID NO: 3282322 - RNA, 18 nt, Variola virus
ugauuucagauacuauau

SEQ ID NO: 3282323 - RNA, 22 nt, Variola virus
guaacguauacauuuaaugaau

SEQ ID NO: 3282324 - RNA, 13 nt, Variola virus
ucauaauaaauuu

SEQ ID NO: 3282325 - RNA, 12 nt, Variola virus
cuaauauuagua

SEQ ID NO: 3282326 - RNA, 16 nt, Variola virus
augauaccugcauaug

SEQ ID NO: 3282327 - RNA, 19 nt, Variola virus
auauuuguucauuggauug

SEQ ID NO: 3282328 - RNA, 14 nt, Variola virus
acuuguuaaagaag

SEQ ID NO: 3282329 - RNA, 18 nt, Variola virus
uaguguaaagaacaaaug

SEQ ID NO: 3282330 - RNA, 15 nt, Variola virus
uaauuacagaauuau

SEQ ID NO: 3282331 - RNA, 19 nt, Variola virus
cguauuuacauuaaaugua

SEQ ID NO: 3282332 - RNA, 23 nt, Variola virus
cacgaagagaccgauacaugauu

SEQ ID NO: 3282333 - RNA, 21 nt, Variola virus
aucaauuuugaaaauacuuag

SEQ ID NO: 3282334 - RNA, 17 nt, Variola virus
ucaaguaaagauuucaa

SEQ ID NO: 3282335 - RNA, 17 nt, Variola virus
aacuccacccauuacau

SEQ ID NO: 3282336 - RNA, 12 nt, Variola virus
ucagaguucagu

SEQ ID NO: 3282337 - RNA, 22 nt, Variola virus
gaucugcucccgguacacauau

SEQ ID NO: 3282338 - RNA, 13 nt, Variola virus
gauucacaaauau

SEQ ID NO: 3282339 - RNA, 15 nt, Variola virus
uucuuggauaaaagc

SEQ ID NO: 3282340 - RNA, 17 nt, Variola virus
caauagucuuguaaaga

SEQ ID NO: 3282341 - RNA, 20 nt, Variola virus
gauauuuucguguuuuaguu

SEQ ID NO: 3282342 - RNA, 12 nt, Variola virus
uauauagaugua

SEQ ID NO: 3282343 - RNA, 22 nt, Variola virus
uugaaagcgagaaauaaucaua

SEQ ID NO: 3282344 - RNA, 23 nt, Variola virus
ugguguaauaaaaaaaauuauuu

SEQ ID NO: 3282345 - RNA, 17 nt, Variola virus
acccaugauaaugaaua

SEQ ID NO: 3282346 - RNA, 12 nt, Variola virus
uaagaauugucu

SEQ ID NO: 3282347 - RNA, 12 nt, Variola virus
caucugcauuau

SEQ ID NO: 3282348 - RNA, 15 nt, Variola virus
augaaucuaaaagaa

SEQ ID NO: 3282349 - RNA, 23 nt, Variola virus
auaaacuacucgaacagauaguu

SEQ ID NO: 3282350 - RNA, 18 nt, Variola virus
aguauaagaaauuuacca

SEQ ID NO: 3282351 - RNA, 18 nt, Variola virus
cuaucauuaccucaugaa

SEQ ID NO: 3282352 - RNA, 14 nt, Variola virus
agacauucuaaauc

SEQ ID NO: 3282353 - RNA, 14 nt, Variola virus
auaacguuaucauu

SEQ ID NO: 3282354 - RNA, 21 nt, Variola virus
aucauacaaugaauuaauuaa

SEQ ID NO: 3282355 - RNA, 19 nt, Variola virus
agauaaacuaggauuuaaa

SEQ ID NO: 3282356 - RNA, 15 nt, Variola virus
cgauuaaacuuuaau

SEQ ID NO: 3282357 - RNA, 15 nt, Variola virus
gcaacuaguaauaaa

SEQ ID NO: 3282358 - RNA, 13 nt, Variola virus
cgcgggauacauc

SEQ ID NO: 3282359 - RNA, 16 nt, Variola virus
aucuaaacaauaccuc

SEQ ID NO: 3282360 - RNA, 21 nt, Variola virus
ucuauucgaaaacucuaagaa

SEQ ID NO: 3282361 - RNA, 14 nt, Variola virus
aauucggaaaugua

SEQ ID NO: 3282362 - RNA, 19 nt, Variola virus
aacaaccuuggcauauuga

SEQ ID NO: 3282363 - RNA, 16 nt, Variola virus
auuuuucauuaacuaa

SEQ ID NO: 3282364 - RNA, 13 nt, Variola virus
gauaauaaacaaa

SEQ ID NO: 3282365 - RNA, 15 nt, Variola virus
cagugcaucaacuuc

SEQ ID NO: 3282366 - RNA, 23 nt, Variola virus
gcugguaauaguuuacagauauu

SEQ ID NO: 3282367 - RNA, 19 nt, Variola virus
aaugauacacuaaguauau

SEQ ID NO: 3282368 - RNA, 13 nt, Variola virus
auaccauguguau

SEQ ID NO: 3282369 - RNA, 14 nt, Variola virus
augugguaaaagaa

SEQ ID NO: 3282370 - RNA, 15 nt, Variola virus
auagguaucaaagau

SEQ ID NO: 3282371 - RNA, 16 nt, Variola virus
cauacacuacaguaag

SEQ ID NO: 3282372 - RNA, 16 nt, Variola virus
uuaauauuacauauuu

SEQ ID NO: 3282373 - RNA, 14 nt, Variola virus
aauaauuaaugccc

SEQ ID NO: 3282374 - RNA, 13 nt, Variola virus
ccgucuguaucau

SEQ ID NO: 3282375 - RNA, 13 nt, Variola virus
acgaguauagcau

SEQ ID NO: 3282376 - RNA, 14 nt, Variola virus
cuugacaaaaauua

SEQ ID NO: 3282377 - RNA, 20 nt, Variola virus
uucaaugucuccuuuucaga

SEQ ID NO: 3282378 - RNA, 19 nt, Variola virus
agaaaucauauaugauauu

SEQ ID NO: 3282379 - RNA, 17 nt, Variola virus
gaucuaaagauaaucuu

SEQ ID NO: 3282380 - RNA, 19 nt, Variola virus
gugcaaaugagguagcaaa

SEQ ID NO: 3282381 - RNA, 13 nt, Variola virus
ucaauuacuacaa

SEQ ID NO: 3282382 - RNA, 23 nt, Variola virus
cauuaguuaaugaaaauaacucu

SEQ ID NO: 3282383 - RNA, 15 nt, Variola virus
aaguuaaauagaaug

SEQ ID NO: 3282384 - RNA, 20 nt, Variola virus
ccaauauauaucaugaucuu

SEQ ID NO: 3282385 - RNA, 18 nt, Variola virus
uaucauuaauuaauacaa

SEQ ID NO: 3282386 - RNA, 14 nt, Variola virus
auguaaagaaggag

SEQ ID NO: 3282387 - RNA, 14 nt, Variola virus
cugaaaauaaagau

SEQ ID NO: 3282388 - RNA, 19 nt, Variola virus
uuuccuaguauuugucaaa

SEQ ID NO: 3282389 - RNA, 13 nt, Variola virus
auauaauacuuaa

SEQ ID NO: 3282390 - RNA, 15 nt, Variola virus
uaugaagauaaacac

SEQ ID NO: 3282391 - RNA, 12 nt, Variola virus
aaauuauauucu

SEQ ID NO: 3282392 - RNA, 13 nt, Variola virus
uuauuauuucagg

SEQ ID NO: 3282393 - RNA, 18 nt, Variola virus
acaaacacuacaacagau

SEQ ID NO: 3282394 - RNA, 16 nt, Variola virus
gcagggugcauauuau

SEQ ID NO: 3282395 - RNA, 22 nt, Variola virus
aaugacaucgaagauuguccaa

SEQ ID NO: 3282396 - RNA, 23 nt, Variola virus
cuggauuauuuuuauuauauuca

SEQ ID NO: 3282397 - RNA, 16 nt, Variola virus
uacuauuacagaaguu

SEQ ID NO: 3282398 - RNA, 19 nt, Variola virus
gcagucauuccaucauuua

SEQ ID NO: 3282399 - RNA, 21 nt, Variola virus
ccaugucaaaacuuguucaau

SEQ ID NO: 3282400 - RNA, 17 nt, Variola virus
uaaagaagaucauacag

SEQ ID NO: 3282401 - RNA, 11 nt, Variola virus
uuuaaaaucau

SEQ ID NO: 3282402 - RNA, 17 nt, Variola virus
acugcauccuucuaaga

SEQ ID NO: 3282403 - RNA, 16 nt, Variola virus
auggaaaaauauuaca

SEQ ID NO: 3282404 - RNA, 21 nt, Variola virus
aacaaauucuuuguugaacgu

SEQ ID NO: 3282405 - RNA, 12 nt, Variola virus
cuguaaacauuu

SEQ ID NO: 3282406 - RNA, 23 nt, Variola virus
ucaucgacuguacgauacauaau

SEQ ID NO: 3282407 - RNA, 19 nt, Variola virus
aaguuuucccauacuaacu

SEQ ID NO: 3282408 - RNA, 22 nt, Variola virus
uccauauguuuggagcaaauau

SEQ ID NO: 3282409 - RNA, 11 nt, Variola virus
gaaauauuaaa

SEQ ID NO: 3282410 - RNA, 12 nt, Variola virus
caauuuacaaau

SEQ ID NO: 3282411 - RNA, 14 nt, Variola virus
aggaagaauaucau

SEQ ID NO: 3282412 - RNA, 15 nt, Variola virus
aauaguuuauaacau

SEQ ID NO: 3282413 - RNA, 14 nt, Variola virus
acuuaaaaauggau

SEQ ID NO: 3282414 - RNA, 19 nt, Variola virus
auguuuaaacaucaaacau

SEQ ID NO: 3282415 - RNA, 21 nt, Variola virus
aucuuuauacgagcuacgaau

SEQ ID NO: 3282416 - RNA, 21 nt, Variola virus
acaauguuugacugaauauau

SEQ ID NO: 3282417 - RNA, 18 nt, Variola virus
uguuguaaggauccuggu

SEQ ID NO: 3282418 - RNA, 13 nt, Variola virus
uacuuacaucauu

SEQ ID NO: 3282419 - RNA, 10 nt, Variola virus
acaucaucua

SEQ ID NO: 3282420 - RNA, 17 nt, Variola virus
uauagaucuuagacauu

SEQ ID NO: 3282421 - RNA, 20 nt, Variola virus
aucacucuucgaaaagaaac

SEQ ID NO: 3282422 - RNA, 17 nt, Variola virus
augucgccgacaugaau

SEQ ID NO: 3282423 - RNA, 14 nt, Variola virus
guuuucaucuuuua

SEQ ID NO: 3282424 - RNA, 19 nt, Variola virus
uaucaccgucgcuagauaa

SEQ ID NO: 3282425 - RNA, 23 nt, Variola virus
auaguagguauggaucuggaaaa

SEQ ID NO: 3282426 - RNA, 21 nt, Variola virus
guacagcguaguacauggcau

SEQ ID NO: 3282427 - RNA, 13 nt, Variola virus
uauuccuagcauc

SEQ ID NO: 3282428 - RNA, 14 nt, Variola virus
uaguuaguagacau

SEQ ID NO: 3282429 - RNA, 15 nt, Variola virus
uuauuacuuuuggaa

SEQ ID NO: 3282430 - RNA, 14 nt, Variola virus
uaucuuucuuugaa

SEQ ID NO: 3282431 - RNA, 21 nt, Variola virus
aauugaauugcgauuauaaga

SEQ ID NO: 3282432 - RNA, 13 nt, Variola virus
auaguaucaaacu

SEQ ID NO: 3282433 - RNA, 14 nt, Variola virus
gaccacauccuuca

SEQ ID NO: 3282434 - RNA, 14 nt, Variola virus
aucuucguuaaaaa

SEQ ID NO: 3282435 - RNA, 15 nt, Variola virus
auucguucaaaaaua

SEQ ID NO: 3282436 - RNA, 20 nt, Variola virus
uauuuucuggaaguggauau

SEQ ID NO: 3282437 - RNA, 13 nt, Variola virus
aacgaaacaaugu

SEQ ID NO: 3282438 - RNA, 15 nt, Variola virus
uaauagaauuuauau

SEQ ID NO: 3282439 - RNA, 19 nt, Variola virus
uaagaguuaugacgcauua

SEQ ID NO: 3282440 - RNA, 18 nt, Variola virus
augucaaaaauuguagaa

SEQ ID NO: 3282441 - RNA, 22 nt, Variola virus
caucuuuaguaaacauaucaua

SEQ ID NO: 3282442 - RNA, 19 nt, Variola virus
auauucauacaccugcaua

SEQ ID NO: 3282443 - RNA, 16 nt, Variola virus
aauuuguaaucaucuu

SEQ ID NO: 3282444 - RNA, 14 nt, Variola virus
auauuauuaugaag

SEQ ID NO: 3282445 - RNA, 18 nt, Variola virus
auuaaccgauaaaaagac

SEQ ID NO: 3282446 - RNA, 10 nt, Variola virus
cuaguauaaa

SEQ ID NO: 3282447 - RNA, 22 nt, Variola virus
ugaacaggcauugcuaaaacuu

SEQ ID NO: 3282448 - RNA, 13 nt, Variola virus
guauucuuggaua

SEQ ID NO: 3282449 - RNA, 13 nt, Variola virus
uaacuauuugcau

SEQ ID NO: 3282450 - RNA, 16 nt, Variola virus
agcaguuuauuaucca

SEQ ID NO: 3282451 - RNA, 14 nt, Variola virus
uaaaauucacacau

SEQ ID NO: 3282452 - RNA, 17 nt, Variola virus
gaagguuggguagaugg

SEQ ID NO: 3282453 - RNA, 21 nt, Variola virus
auagaaaauaacagauauuac

SEQ ID NO: 3282454 - RNA, 20 nt, Variola virus
auuccagcuaucagauuaug

SEQ ID NO: 3282455 - RNA, 23 nt, Variola virus
gagaaguuuuauccaauaauuua

SEQ ID NO: 3282456 - RNA, 16 nt, Variola virus
ugaaugaauacagauc

SEQ ID NO: 3282457 - RNA, 18 nt, Variola virus
uauuucguuucuuaaaua

SEQ ID NO: 3282458 - RNA, 21 nt, Variola virus
ccaagucauaucuagaaugaa

SEQ ID NO: 3282459 - RNA, 16 nt, Variola virus
ucauauuauaaagaug

SEQ ID NO: 3282460 - RNA, 15 nt, Variola virus
auucauguugaacau

SEQ ID NO: 3282461 - RNA, 17 nt, Variola virus
cgauuuuaaaucaucuu

SEQ ID NO: 3282462 - RNA, 19 nt, Variola virus
guguuuuauuaaucaauca

SEQ ID NO: 3282463 - RNA, 18 nt, Variola virus
acuauccaauaaacaguc

SEQ ID NO: 3282464 - RNA, 18 nt, Variola virus
agaaauuuaccaacgaua

SEQ ID NO: 3282465 - RNA, 14 nt, Variola virus
aucugaauuaaaua

SEQ ID NO: 3282466 - RNA, 23 nt, Variola virus
caagauccucucuuaaaugaauc

SEQ ID NO: 3282467 - RNA, 13 nt, Variola virus
gaauauaguuaua

SEQ ID NO: 3282468 - RNA, 20 nt, Variola virus
agccaucuguauuaaagaua

SEQ ID NO: 3282469 - RNA, 18 nt, Variola virus
augauuuuuaaucaagau

SEQ ID NO: 3282470 - RNA, 13 nt, Variola virus
aucuagccauuau

SEQ ID NO: 3282471 - RNA, 21 nt, Variola virus
gaauaucuccucaaggaauac

SEQ ID NO: 3282472 - RNA, 17 nt, Variola virus
uaacgccuauucgaaau

SEQ ID NO: 3282473 - RNA, 16 nt, Variola virus
acuuuaaacagaaaua

SEQ ID NO: 3282474 - RNA, 14 nt, Variola virus
agguauuacucuag

SEQ ID NO: 3282475 - RNA, 21 nt, Variola virus
uauuccguguggcuuuccauu

SEQ ID NO: 3282476 - RNA, 16 nt, Variola virus
cuugaaauacauguaa

SEQ ID NO: 3282477 - RNA, 15 nt, Variola virus
ucuagccauaucuaa

SEQ ID NO: 3282478 - RNA, 12 nt, Variola virus
aacgauauuaac

SEQ ID NO: 3282479 - RNA, 14 nt, Variola virus
aagauauaaaugac

SEQ ID NO: 3282480 - RNA, 15 nt, Variola virus
agaaugacauaacua

SEQ ID NO: 3282481 - RNA, 18 nt, Variola virus
acaugcuacaaaauaugu

SEQ ID NO: 3282482 - RNA, 17 nt, Variola virus
aaaggacagaaauauau

SEQ ID NO: 3282483 - RNA, 20 nt, Variola virus
aaauccauguaaaaaaaugu

SEQ ID NO: 3282484 - RNA, 18 nt, Variola virus
cgauaauaacuuaguuua

SEQ ID NO: 3282485 - RNA, 22 nt, Variola virus
ccaaucuuuuguuuagaaugau

SEQ ID NO: 3282486 - RNA, 16 nt, Variola virus
caaaaccaauuccuuu

SEQ ID NO: 3282487 - RNA, 22 nt, Variola virus
augucauaaacuguaaaugauu

SEQ ID NO: 3282488 - RNA, 11 nt, Variola virus
auauaugggag

SEQ ID NO: 3282489 - RNA, 16 nt, Variola virus
agucauaucuagaaug

SEQ ID NO: 3282490 - RNA, 19 nt, Variola virus
ucguuuauaucacauugua

SEQ ID NO: 3282491 - RNA, 18 nt, Variola virus
cugcauuaucaauaaaua

SEQ ID NO: 3282492 - RNA, 18 nt, Variola virus
gucggaaaucuuaaccaa

SEQ ID NO: 3282493 - RNA, 15 nt, Variola virus
acuucucuaucaaug

SEQ ID NO: 3282494 - RNA, 15 nt, Variola virus
uuuuaaagguaucua

SEQ ID NO: 3282495 - RNA, 15 nt, Variola virus
uauccaugaugguca

SEQ ID NO: 3282496 - RNA, 15 nt, Variola virus
acuaucuuuaauaga

SEQ ID NO: 3282497 - RNA, 18 nt, Variola virus
auaauuuuuuuauugcau

SEQ ID NO: 3282498 - RNA, 17 nt, Variola virus
gaagauuaccucuaguu

SEQ ID NO: 3282499 - RNA, 19 nt, Variola virus
aguuuuggccauuauuaga

SEQ ID NO: 3282500 - RNA, 17 nt, Variola virus
agagacggaaaaauagu

SEQ ID NO: 3282501 - RNA, 19 nt, Variola virus
aaacgacuuaauuacagag

SEQ ID NO: 3282502 - RNA, 14 nt, Variola virus
ucgcuauauguucc

SEQ ID NO: 3282503 - RNA, 21 nt, Variola virus
aucaguacguucuucauuuau

SEQ ID NO: 3282504 - RNA, 22 nt, Variola virus
ucauaacuugagagcauccagu

SEQ ID NO: 3282505 - RNA, 14 nt, Variola virus
gcaauaaauaugau

SEQ ID NO: 3282506 - RNA, 15 nt, Variola virus
acgaaccaaaaugaa

SEQ ID NO: 3282507 - RNA, 18 nt, Variola virus
acgagccacuacuccucg

SEQ ID NO: 3282508 - RNA, 15 nt, Variola virus
uccauuuucccaaau

SEQ ID NO: 3282509 - RNA, 15 nt, Variola virus
uaugauaucauguaa

SEQ ID NO: 3282510 - RNA, 23 nt, Variola virus
uuuuuagccggaauaacaucauc

SEQ ID NO: 3282511 - RNA, 17 nt, Variola virus
ucuuucuaauacuauau

SEQ ID NO: 3282512 - RNA, 20 nt, Variola virus
uuacuuugacaaauguagua

SEQ ID NO: 3282513 - RNA, 13 nt, Variola virus
caaaagaacauga

SEQ ID NO: 3282514 - RNA, 19 nt, Variola virus
uauaaaacuacuacaauga

SEQ ID NO: 3282515 - RNA, 22 nt, Variola virus
uaguuuucucuuuuuauccuca

SEQ ID NO: 3282516 - RNA, 19 nt, Variola virus
acuuuuauuuuuagaaagu

SEQ ID NO: 3282517 - RNA, 18 nt, Variola virus
auucugauuggucaaugu

SEQ ID NO: 3282518 - RNA, 14 nt, Variola virus
guauaugaguaaau

SEQ ID NO: 3282519 - RNA, 14 nt, Variola virus
aauuuagaaauaua

SEQ ID NO: 3282520 - RNA, 22 nt, Variola virus
guuucaagauaaauaaucaaaa

SEQ ID NO: 3282521 - RNA, 17 nt, Variola virus
gaauuacauuucuuguu

SEQ ID NO: 3282522 - RNA, 19 nt, Variola virus
auuauauaauguauaaaug

SEQ ID NO: 3282523 - RNA, 13 nt, Variola virus
uuaaauguaucua

SEQ ID NO: 3282524 - RNA, 13 nt, Variola virus
ucauaaaaaccau

SEQ ID NO: 3282525 - RNA, 17 nt, Variola virus
cgguguaauagaauuua

SEQ ID NO: 3282526 - RNA, 22 nt, Variola virus
cagcauuugacuauuauguuua

SEQ ID NO: 3282527 - RNA, 15 nt, Variola virus
auuggcaaauuauuu

SEQ ID NO: 3282528 - RNA, 16 nt, Variola virus
uauuggauauaucaaa

SEQ ID NO: 3282529 - RNA, 19 nt, Variola virus
aguuuaagacugcuaaaug

SEQ ID NO: 3282530 - RNA, 21 nt, Variola virus
uagauauagcuuuuauuucca

SEQ ID NO: 3282531 - RNA, 17 nt, Variola virus
guaaguuuaaaaaagac

SEQ ID NO: 3282532 - RNA, 14 nt, Variola virus
aauuuccaucucua

SEQ ID NO: 3282533 - RNA, 12 nt, Variola virus
uuauaaaaauua

SEQ ID NO: 3282534 - RNA, 22 nt, Variola virus
cacuuagaacagauuuaacaau

SEQ ID NO: 3282535 - RNA, 13 nt, Variola virus
gacuauaaaugua

SEQ ID NO: 3282536 - RNA, 16 nt, Variola virus
ugauaauagauggaua

SEQ ID NO: 3282537 - RNA, 14 nt, Variola virus
gauaaauuguacaa

SEQ ID NO: 3282538 - RNA, 16 nt, Variola virus
uaaauaggacuauugu

SEQ ID NO: 3282539 - RNA, 14 nt, Variola virus
cuccuauauuuccc

SEQ ID NO: 3282540 - RNA, 19 nt, Variola virus
auuuuugauaacacuguau

SEQ ID NO: 3282541 - RNA, 16 nt, Variola virus
aaaguuuuauauguag

SEQ ID NO: 3282542 - RNA, 14 nt, Variola virus
ugcuuugaauaauu

SEQ ID NO: 3282543 - RNA, 17 nt, Variola virus
uauaaacucucaacauu

SEQ ID NO: 3282544 - RNA, 15 nt, Variola virus
uaacuuuugauuuua

SEQ ID NO: 3282545 - RNA, 20 nt, Variola virus
uagauacauuggccguaaua

SEQ ID NO: 3282546 - RNA, 19 nt, Variola virus
aaauuauccuaucauguau

SEQ ID NO: 3282547 - RNA, 16 nt, Variola virus
aaauaaguaaaaagug

SEQ ID NO: 3282548 - RNA, 22 nt, Variola virus
uuaguagaagaacucuguuucu

SEQ ID NO: 3282549 - RNA, 14 nt, Variola virus
agaauaaauuauau

SEQ ID NO: 3282550 - RNA, 17 nt, Variola virus
auuauuaaucagaauac

SEQ ID NO: 3282551 - RNA, 16 nt, Variola virus
uuaaaauacaacaaug

SEQ ID NO: 3282552 - RNA, 17 nt, Variola virus
uaauucauuaauuuuca

SEQ ID NO: 3282553 - RNA, 18 nt, Variola virus
cuguaaauguaguauuua

SEQ ID NO: 3282554 - RNA, 21 nt, Variola virus
auuaaaacuaccaauaagaag

SEQ ID NO: 3282555 - RNA, 14 nt, Variola virus
aauaguaaugauuc

SEQ ID NO: 3282556 - RNA, 12 nt, Variola virus
uuuccauaauaa

SEQ ID NO: 3282557 - RNA, 17 nt, Variola virus
aauauucuuuucuaaga

SEQ ID NO: 3282558 - RNA, 17 nt, Variola virus
aagauuccauuaucuaa

SEQ ID NO: 3282559 - RNA, 19 nt, Variola virus
aauauuaauauuagaguua

SEQ ID NO: 3282560 - RNA, 12 nt, Variola virus
ucuauucaagau

SEQ ID NO: 3282561 - RNA, 13 nt, Variola virus
uacauaaaugucu

SEQ ID NO: 3282562 - RNA, 17 nt, Variola virus
gcagacaaaaugaagau

SEQ ID NO: 3282563 - RNA, 17 nt, Variola virus
aaaauauauaaugaaua

SEQ ID NO: 3282564 - RNA, 16 nt, Variola virus
acccauguuuaagaua

SEQ ID NO: 3282565 - RNA, 19 nt, Variola virus
uauuuuaaaguuaaucaua

SEQ ID NO: 3282566 - RNA, 15 nt, Variola virus
aguaaagaaaagaua

SEQ ID NO: 3282567 - RNA, 11 nt, Variola virus
auauaguuuuu

SEQ ID NO: 3282568 - RNA, 16 nt, Variola virus
aaugauguuaggaaau

SEQ ID NO: 3282569 - RNA, 13 nt, Variola virus
guuauuaaauguu

SEQ ID NO: 3282570 - RNA, 15 nt, Variola virus
ugaagauaaugugaa

SEQ ID NO: 3282571 - RNA, 12 nt, Variola virus
guuacuauuauu

SEQ ID NO: 3282572 - RNA, 22 nt, Variola virus
uguuauacacggucuagagcau

SEQ ID NO: 3282573 - RNA, 20 nt, Variola virus
uuaacacguugucuuucaag

SEQ ID NO: 3282574 - RNA, 16 nt, Variola virus
uaucauuaauacagua

SEQ ID NO: 3282575 - RNA, 14 nt, Variola virus
uagaggaugaauuu

SEQ ID NO: 3282576 - RNA, 17 nt, Variola virus
uuuuguucuauaaacug

SEQ ID NO: 3282577 - RNA, 16 nt, Variola virus
ucuuauagcaugaauu

SEQ ID NO: 3282578 - RNA, 12 nt, Variola virus
uagaacaaaaua

SEQ ID NO: 3282579 - RNA, 14 nt, Variola virus
aguauauaauaaag

SEQ ID NO: 3282580 - RNA, 21 nt, Variola virus
aacaggucgcuauauccacca

SEQ ID NO: 3282581 - RNA, 20 nt, Variola virus
auccuuauaaagaaugaaug

SEQ ID NO: 3282582 - RNA, 20 nt, Variola virus
uucaauucucggauagucuu

SEQ ID NO: 3282583 - RNA, 16 nt, Variola virus
agugucuacuuaaaug

SEQ ID NO: 3282584 - RNA, 20 nt, Variola virus
caacuuauccauuuauacau

SEQ ID NO: 3282585 - RNA, 13 nt, Variola virus
uuaauuuguacau

SEQ ID NO: 3282586 - RNA, 23 nt, Variola virus
auggaauauaauaaucuauuuua

SEQ ID NO: 3282587 - RNA, 19 nt, Variola virus
acuagaaagggaaaaauua

SEQ ID NO: 3282588 - RNA, 16 nt, Variola virus
acuauguuaauacuua

SEQ ID NO: 3282589 - RNA, 18 nt, Variola virus
auaauauuaucaugaauu

SEQ ID NO: 3282590 - RNA, 16 nt, Variola virus
ccaagugcuuaaauau

SEQ ID NO: 3282591 - RNA, 14 nt, Variola virus
cucuaacagauauu

SEQ ID NO: 3282592 - RNA, 20 nt, Variola virus
auguauaaaacaacaaaauu

SEQ ID NO: 3282593 - RNA, 22 nt, Variola virus
cagauguaaauauaucuacaau

SEQ ID NO: 3282594 - RNA, 15 nt, Variola virus
gaucaaccucuggag

SEQ ID NO: 3282595 - RNA, 12 nt, Variola virus
auuuuuuguaaa

SEQ ID NO: 3282596 - RNA, 16 nt, Variola virus
ugauagcgguagaugu

SEQ ID NO: 3282597 - RNA, 15 nt, Variola virus
agaugaaauagcguu

SEQ ID NO: 3282598 - RNA, 14 nt, Variola virus
cuaacucuguuuua

SEQ ID NO: 3282599 - RNA, 18 nt, Variola virus
auacuacuauuugucuaa

SEQ ID NO: 3282600 - RNA, 17 nt, Variola virus
ucuucaaauuccaccau

SEQ ID NO: 3282601 - RNA, 18 nt, Variola virus
auuaucucagugcaaaga

SEQ ID NO: 3282602 - RNA, 17 nt, Variola virus
uaaucuuacugaguuua

SEQ ID NO: 3282603 - RNA, 23 nt, Variola virus
ccaauaacggaaaucccaaaugu

SEQ ID NO: 3282604 - RNA, 14 nt, Variola virus
auaucucaauaaug

SEQ ID NO: 3282605 - RNA, 23 nt, Variola virus
acuucuagcgcugauuuaacuaa

SEQ ID NO: 3282606 - RNA, 21 nt, Variola virus
aucaauaccaaagaaggaaga

SEQ ID NO: 3282607 - RNA, 15 nt, Variola virus
cauuaauacaguaag

SEQ ID NO: 3282608 - RNA, 23 nt, Variola virus
uuaaacaauaucacgaaaguaga

SEQ ID NO: 3282609 - RNA, 17 nt, Variola virus
guugcaauaauaaaagu

SEQ ID NO: 3282610 - RNA, 20 nt, Variola virus
auaucaaacaauccaaaaaa

SEQ ID NO: 3282611 - RNA, 14 nt, Variola virus
uaugucacguuuau

SEQ ID NO: 3282612 - RNA, 22 nt, Variola virus
aagauauccagaguuuagauua

SEQ ID NO: 3282613 - RNA, 18 nt, Variola virus
gucaauuggaguaucauc

SEQ ID NO: 3282614 - RNA, 13 nt, Variola virus
auaguaugucuua

SEQ ID NO: 3282615 - RNA, 20 nt, Variola virus
caauuguuuuuguacauaau

SEQ ID NO: 3282616 - RNA, 19 nt, Variola virus
auuuugcaauuucuucaua

SEQ ID NO: 3282617 - RNA, 11 nt, Variola virus
uauuguuuuca

SEQ ID NO: 3282618 - RNA, 17 nt, Variola virus
uaaauacaugucuaaug

SEQ ID NO: 3282619 - RNA, 14 nt, Variola virus
aagcuaacaaaauu

SEQ ID NO: 3282620 - RNA, 20 nt, Variola virus
aagucacaaagcaagaccaa

SEQ ID NO: 3282621 - RNA, 15 nt, Variola virus
auuacuuaucauuua

SEQ ID NO: 3282622 - RNA, 13 nt, Variola virus
aauuugauaaaga

SEQ ID NO: 3282623 - RNA, 20 nt, Variola virus
uguuuuauuaaucaaucauu

SEQ ID NO: 3282624 - RNA, 21 nt, Variola virus
ucacagcuccaucaguuuuau

SEQ ID NO: 3282625 - RNA, 15 nt, Variola virus
ugcucugcaauaacu

SEQ ID NO: 3282626 - RNA, 15 nt, Variola virus
agacgucacuauuac

SEQ ID NO: 3282627 - RNA, 13 nt, Variola virus
auuuaauauagau

SEQ ID NO: 3282628 - RNA, 15 nt, Variola virus
cagucauuccaucau

SEQ ID NO: 3282629 - RNA, 20 nt, Variola virus
cucuagauuaucuuagugaa

SEQ ID NO: 3282630 - RNA, 22 nt, Variola virus
uguaucaaucgguguguagaaa

SEQ ID NO: 3282631 - RNA, 16 nt, Variola virus
uugcguuuacaacacu

SEQ ID NO: 3282632 - RNA, 13 nt, Variola virus
acuauuauugaag

SEQ ID NO: 3282633 - RNA, 22 nt, Variola virus
uaaaauuaucuacacaaauaga

SEQ ID NO: 3282634 - RNA, 17 nt, Variola virus
uuuuauucacauaaaag

SEQ ID NO: 3282635 - RNA, 17 nt, Variola virus
caaaagauuaaggagau

SEQ ID NO: 3282636 - RNA, 15 nt, Variola virus
auuuucucuuaaaaa

SEQ ID NO: 3282637 - RNA, 16 nt, Variola virus
uaaaguuucugaaaua

SEQ ID NO: 3282638 - RNA, 23 nt, Variola virus
acuaauaucauuaguauacucua

SEQ ID NO: 3282639 - RNA, 14 nt, Variola virus
acuuuucucuaaau

SEQ ID NO: 3282640 - RNA, 24 nt, Variola virus
guauaaugugauuguauguuguua

SEQ ID NO: 3282641 - RNA, 22 nt, Variola virus
ucgauucuggcuauuucaaaau

SEQ ID NO: 3282642 - RNA, 11 nt, Variola virus
augaguauuuu

SEQ ID NO: 3282643 - RNA, 17 nt, Variola virus
uaacacauaccuuuuuc

SEQ ID NO: 3282644 - RNA, 15 nt, Variola virus
augucauaaauucuu

SEQ ID NO: 3282645 - RNA, 21 nt, Variola virus
agaucuuuucucaaagauguu

SEQ ID NO: 3282646 - RNA, 14 nt, Variola virus
uacuuuuuacuaau

SEQ ID NO: 3282647 - RNA, 22 nt, Variola virus
ucuggauauguuuuuaauaaag

SEQ ID NO: 3282648 - RNA, 21 nt, Variola virus
cuaguauagcagaaguuuaua

SEQ ID NO: 3282649 - RNA, 14 nt, Variola virus
uauuaaaauuauuu

SEQ ID NO: 3282650 - RNA, 22 nt, Variola virus
cacgaccaaaucgauuacuaug

SEQ ID NO: 3282651 - RNA, 22 nt, Variola virus
uauuaucauacugucaacuaua

SEQ ID NO: 3282652 - RNA, 20 nt, Variola virus
cggaauugccaacucucaaa

SEQ ID NO: 3282653 - RNA, 15 nt, Variola virus
acuccuugguuucaa

SEQ ID NO: 3282654 - RNA, 17 nt, Variola virus
aauauaucccuuaaaaa

SEQ ID NO: 3282655 - RNA, 13 nt, Variola virus
cuuaauaaauguu

SEQ ID NO: 3282656 - RNA, 18 nt, Variola virus
cuauaauauccauuuugu

SEQ ID NO: 3282657 - RNA, 19 nt, Variola virus
uguuaagaaugauuacuaa

SEQ ID NO: 3282658 - RNA, 19 nt, Variola virus
guuuauuuagauacagaug

SEQ ID NO: 3282659 - RNA, 15 nt, Variola virus
uagguuuacuaaaau

SEQ ID NO: 3282660 - RNA, 16 nt, Variola virus
uaugcaaagaauuugg

SEQ ID NO: 3282661 - RNA, 16 nt, Variola virus
auauaaaauaacuaca

SEQ ID NO: 3282662 - RNA, 18 nt, Variola virus
uguuaaaaacaguuauuu

SEQ ID NO: 3282663 - RNA, 17 nt, Variola virus
uacguuauugucaaaau

SEQ ID NO: 3282664 - RNA, 12 nt, Variola virus
ucuuacaauguu

SEQ ID NO: 3282665 - RNA, 22 nt, Variola virus
auucauuacucuugauaaauug

SEQ ID NO: 3282666 - RNA, 17 nt, Variola virus
gauagacuagaagaaag

SEQ ID NO: 3282667 - RNA, 13 nt, Variola virus
augauugcauauu

SEQ ID NO: 3282668 - RNA, 12 nt, Variola virus
aaucauugauau

SEQ ID NO: 3282669 - RNA, 22 nt, Variola virus
auuucaucuguaguauucuugu

SEQ ID NO: 3282670 - RNA, 23 nt, Variola virus
aaugccacgaauaaaaaauacuu

SEQ ID NO: 3282671 - RNA, 19 nt, Variola virus
aagaagugucuauaaaugu

SEQ ID NO: 3282672 - RNA, 20 nt, Variola virus
auuaguaaggcuuuagaaac

SEQ ID NO: 3282673 - RNA, 12 nt, Variola virus
ugguuucaauuc

SEQ ID NO: 3282674 - RNA, 14 nt, Variola virus
gauaaaauaucaua

SEQ ID NO: 3282675 - RNA, 19 nt, Variola virus
aaacuuguaagaaguaaau

SEQ ID NO: 3282676 - RNA, 15 nt, Variola virus
cuuguucguugacau

SEQ ID NO: 3282677 - RNA, 22 nt, Variola virus
cgaauaucguucucuaaauguc

SEQ ID NO: 3282678 - RNA, 18 nt, Variola virus
uucuucaauaaaaugaaa

SEQ ID NO: 3282679 - RNA, 15 nt, Variola virus
aauuguucaaaacug

SEQ ID NO: 3282680 - RNA, 14 nt, Variola virus
uuauuuaacucuuu

SEQ ID NO: 3282681 - RNA, 18 nt, Variola virus
aaucggguaauuauaaga

SEQ ID NO: 3282682 - RNA, 20 nt, Variola virus
auuugguuauuaaacaguau

SEQ ID NO: 3282683 - RNA, 20 nt, Variola virus
aucuuagacauuuuuagaga

SEQ ID NO: 3282684 - RNA, 16 nt, Variola virus
cagaggaugaaauaga

SEQ ID NO: 3282685 - RNA, 21 nt, Variola virus
ucuaauauaaucuuuaguauu

SEQ ID NO: 3282686 - RNA, 19 nt, Variola virus
uuaucucagugcaaagauu

SEQ ID NO: 3282687 - RNA, 17 nt, Variola virus
uauguaaguauuuacga

SEQ ID NO: 3282688 - RNA, 21 nt, Variola virus
auuuaauacguucauuaaaaa

SEQ ID NO: 3282689 - RNA, 16 nt, Variola virus
agauguguauaauucu

SEQ ID NO: 3282690 - RNA, 18 nt, Variola virus
auaugauucuaaccuaga

SEQ ID NO: 3282691 - RNA, 12 nt, Variola virus
auacuaaauaua

SEQ ID NO: 3282692 - RNA, 22 nt, Variola virus
cuuauauaccgccucaaacucu

SEQ ID NO: 3282693 - RNA, 16 nt, Variola virus
uaucgcauauuuauau

SEQ ID NO: 3282694 - RNA, 23 nt, Variola virus
uaaacgccuuuagaaaaacuuua

SEQ ID NO: 3282695 - RNA, 13 nt, Variola virus
uaauaacaaguau

SEQ ID NO: 3282696 - RNA, 13 nt, Variola virus
gcagacugugcau

SEQ ID NO: 3282697 - RNA, 23 nt, Variola virus
acccuuccuuaaacgugaaugau

SEQ ID NO: 3282698 - RNA, 12 nt, Variola virus
cuauuuuaauga

SEQ ID NO: 3282699 - RNA, 19 nt, Variola virus
aucaauguguguaacucca

SEQ ID NO: 3282700 - RNA, 16 nt, Variola virus
uacgucuauacagaua

SEQ ID NO: 3282701 - RNA, 13 nt, Variola virus
cacuaucauaauu

SEQ ID NO: 3282702 - RNA, 14 nt, Variola virus
uuauuuuuggaaga

SEQ ID NO: 3282703 - RNA, 22 nt, Variola virus
aguauaccaugaccuucuucau

SEQ ID NO: 3282704 - RNA, 14 nt, Variola virus
guguugauaauauc

SEQ ID NO: 3282705 - RNA, 21 nt, Variola virus
guuaaggucuuccauuuaaau

SEQ ID NO: 3282706 - RNA, 21 nt, Variola virus
auuugucuuccuuaacuauau

SEQ ID NO: 3282707 - RNA, 15 nt, Variola virus
auacauuucucaaau

SEQ ID NO: 3282708 - RNA, 14 nt, Variola virus
uacgauaugauuca

SEQ ID NO: 3282709 - RNA, 24 nt, Variola virus
agaucgcuuucugguaacaugaua

SEQ ID NO: 3282710 - RNA, 20 nt, Variola virus
uuaguguauaauuuugucau

SEQ ID NO: 3282711 - RNA, 19 nt, Variola virus
aauaggagugauagaacug

SEQ ID NO: 3282712 - RNA, 17 nt, Variola virus
uuacgauagaaauagau

SEQ ID NO: 3282713 - RNA, 19 nt, Variola virus
acuaaugcaucuauuucau

SEQ ID NO: 3282714 - RNA, 22 nt, Variola virus
ucuucgcccucaauuucccaaa

SEQ ID NO: 3282715 - RNA, 16 nt, Variola virus
gacauuuucacaaaua

SEQ ID NO: 3282716 - RNA, 22 nt, Variola virus
gaugaaagauaaacuagauaua

SEQ ID NO: 3282717 - RNA, 16 nt, Variola virus
aucugugauguaugca

SEQ ID NO: 3282718 - RNA, 22 nt, Variola virus
uucucucauaaauacagagaug

SEQ ID NO: 3282719 - RNA, 21 nt, Variola virus
cuucagaaaagucaaauauug

SEQ ID NO: 3282720 - RNA, 23 nt, Variola virus
agucuauaugaucaaaaagagau

SEQ ID NO: 3282721 - RNA, 18 nt, Variola virus
caguccgguucuuaauau

SEQ ID NO: 3282722 - RNA, 23 nt, Variola virus
cucaucguuccauaguuuuucua

SEQ ID NO: 3282723 - RNA, 17 nt, Variola virus
uauacgaaaaaauagca

SEQ ID NO: 3282724 - RNA, 15 nt, Variola virus
gaagaagaaaacaaa

SEQ ID NO: 3282725 - RNA, 20 nt, Variola virus
gaugugacagacugaccagu

SEQ ID NO: 3282726 - RNA, 22 nt, Variola virus
auuuaagagaucaaagcaucaa

SEQ ID NO: 3282727 - RNA, 21 nt, Variola virus
ccaacuguagacguaguucua

SEQ ID NO: 3282728 - RNA, 18 nt, Variola virus
ucaacuaaagggauuuua

SEQ ID NO: 3282729 - RNA, 14 nt, Variola virus
uguguacuuguaca

SEQ ID NO: 3282730 - RNA, 20 nt, Variola virus
uacuucucccauaauacuuu

SEQ ID NO: 3282731 - RNA, 14 nt, Variola virus
uaucuguuaccaua

SEQ ID NO: 3282732 - RNA, 23 nt, Variola virus
ucuauacagcgaauaaauucaga

SEQ ID NO: 3282733 - RNA, 21 nt, Variola virus
aaauauuuuuggacaguguuu

SEQ ID NO: 3282734 - RNA, 18 nt, Variola virus
guuuaacuagucuucucu

SEQ ID NO: 3282735 - RNA, 19 nt, Variola virus
guacauugcucguaaaaga

SEQ ID NO: 3282736 - RNA, 15 nt, Variola virus
caguauuuuuggaau

SEQ ID NO: 3282737 - RNA, 21 nt, Variola virus
agauccuuuucuucagaauaa

SEQ ID NO: 3282738 - RNA, 14 nt, Variola virus
aaucgcuuaauaga

SEQ ID NO: 3282739 - RNA, 17 nt, Variola virus
cuagaucaagaaacauu

SEQ ID NO: 3282740 - RNA, 22 nt, Variola virus
auagguuacuagauuaaaaaug

SEQ ID NO: 3282741 - RNA, 17 nt, Variola virus
augaugaauacauuuau

SEQ ID NO: 3282742 - RNA, 15 nt, Variola virus
ugcuuaauguuucca

SEQ ID NO: 3282743 - RNA, 12 nt, Variola virus
aggaauccaugu

SEQ ID NO: 3282744 - RNA, 23 nt, Variola virus
aauaccaaucauuuauugauaau

SEQ ID NO: 3282745 - RNA, 15 nt, Variola virus
cggauggaugauaua

SEQ ID NO: 3282746 - RNA, 17 nt, Variola virus
auaaggaacuagaauug

SEQ ID NO: 3282747 - RNA, 16 nt, Variola virus
acaauggaauacuuca

SEQ ID NO: 3282748 - RNA, 22 nt, Variola virus
ucuuuacuagagagaaagcuuu

SEQ ID NO: 3282749 - RNA, 19 nt, Variola virus
auaaucauaaccauuucua

SEQ ID NO: 3282750 - RNA, 22 nt, Variola virus
cuucacagauagaucauuuuga

SEQ ID NO: 3282751 - RNA, 14 nt, Variola virus
aacaagaaaguuau

SEQ ID NO: 3282752 - RNA, 18 nt, Variola virus
cuguuuuagcaucuuuuu

SEQ ID NO: 3282753 - RNA, 14 nt, Variola virus
uaagaaugugauaa

SEQ ID NO: 3282754 - RNA, 20 nt, Variola virus
aacuuggggauaaugauaca

SEQ ID NO: 3282755 - RNA, 22 nt, Variola virus
agcuuuuguucacaaaaauaca

SEQ ID NO: 3282756 - RNA, 22 nt, Variola virus
aaucuaguuaccuugaaaauaa

SEQ ID NO: 3282757 - RNA, 23 nt, Variola virus
auaacauaggauuaaaaauaaag

SEQ ID NO: 3282758 - RNA, 20 nt, Variola virus
aucaguauguauaucuauau

SEQ ID NO: 3282759 - RNA, 14 nt, Variola virus
aauguaguaaauau

SEQ ID NO: 3282760 - RNA, 23 nt, Variola virus
uuauaucguuaucauuaauaaag

SEQ ID NO: 3282761 - RNA, 16 nt, Variola virus
gaagagaaaagucaau

SEQ ID NO: 3282762 - RNA, 20 nt, Variola virus
auuaugcauucguuuaaaga

SEQ ID NO: 3282763 - RNA, 17 nt, Variola virus
agaucauguaacaauau

SEQ ID NO: 3282764 - RNA, 22 nt, Variola virus
guucgaggauaucauccaaaac

SEQ ID NO: 3282765 - RNA, 10 nt, Variola virus
uaacugaaga

SEQ ID NO: 3282766 - RNA, 15 nt, Variola virus
uaauaugaguaacau

SEQ ID NO: 3282767 - RNA, 17 nt, Variola virus
uuacucuauaaaauacu

SEQ ID NO: 3282768 - RNA, 19 nt, Variola virus
auguauuacgaagaagaca

SEQ ID NO: 3282769 - RNA, 14 nt, Variola virus
cgucucaaucuuua

SEQ ID NO: 3282770 - RNA, 20 nt, Variola virus
aaaaauugaauugaugauau

SEQ ID NO: 3282771 - RNA, 22 nt, Variola virus
auauuuaagugauauaaaacau

SEQ ID NO: 3282772 - RNA, 15 nt, Variola virus
aaccuaacacaaauu

SEQ ID NO: 3282773 - RNA, 19 nt, Variola virus
uuaaacuucgcaauauuca

SEQ ID NO: 3282774 - RNA, 23 nt, Variola virus
uaucaauaacacaaucaugauuu

SEQ ID NO: 3282775 - RNA, 23 nt, Variola virus
uucauuaggauuaucaaaucuuu

SEQ ID NO: 3282776 - RNA, 16 nt, Variola virus
acuauuauuuguuaua

SEQ ID NO: 3282777 - RNA, 22 nt, Variola virus
uguagaacucaugaaucuaaaa

SEQ ID NO: 3282778 - RNA, 16 nt, Variola virus
uguacaauacauguac

SEQ ID NO: 3282779 - RNA, 23 nt, Variola virus
auacuuaaaaauggauguugugu

SEQ ID NO: 3282780 - RNA, 20 nt, Variola virus
uaacuacgcgauuauuuuca

SEQ ID NO: 3282781 - RNA, 18 nt, Variola virus
auuuguauauacauagau

SEQ ID NO: 3282782 - RNA, 17 nt, Variola virus
aauaggugaugaugcaa

SEQ ID NO: 3282783 - RNA, 14 nt, Variola virus
aaauauaaacaguc

SEQ ID NO: 3282784 - RNA, 13 nt, Variola virus
uaugugauagcaa

SEQ ID NO: 3282785 - RNA, 18 nt, Variola virus
auauuaaaauucacacau

SEQ ID NO: 3282786 - RNA, 23 nt, Variola virus
aauaccaguuauguucaacuuug

SEQ ID NO: 3282787 - RNA, 23 nt, Variola virus
agauauacccgaagauauacaca

SEQ ID NO: 3282788 - RNA, 12 nt, Variola virus
aaaaaagaauca

SEQ ID NO: 3282789 - RNA, 20 nt, Variola virus
caagaaauauggauccucua

SEQ ID NO: 3282790 - RNA, 14 nt, Variola virus
aacauuaacauuuu

SEQ ID NO: 3282791 - RNA, 22 nt, Variola virus
gcaaaaauaauaugauuagaag

SEQ ID NO: 3282792 - RNA, 23 nt, Variola virus
auaaacucacauuucaaauauau

SEQ ID NO: 3282793 - RNA, 20 nt, Variola virus
aucgauggagcguaaaagua

SEQ ID NO: 3282794 - RNA, 14 nt, Variola virus
agauacauauggau

SEQ ID NO: 3282795 - RNA, 12 nt, Variola virus
uuaucaugaauu

SEQ ID NO: 3282796 - RNA, 15 nt, Variola virus
ucuugauuacaaaac

SEQ ID NO: 3282797 - RNA, 20 nt, Variola virus
gaaucugaaaauguauaaau

SEQ ID NO: 3282798 - RNA, 17 nt, Variola virus
aauaaauaguucaacau

SEQ ID NO: 3282799 - RNA, 15 nt, Variola virus
aauuauauaaaacau

SEQ ID NO: 3282800 - RNA, 18 nt, Variola virus
aacaaagauauuaccagu

SEQ ID NO: 3282801 - RNA, 12 nt, Variola virus
cgucucuguauu

SEQ ID NO: 3282802 - RNA, 17 nt, Variola virus
auaauuuguauauacau

SEQ ID NO: 3282803 - RNA, 17 nt, Variola virus
aucaauuuaucauauau

SEQ ID NO: 3282804 - RNA, 18 nt, Variola virus
acuacuuuccuaucccuc

SEQ ID NO: 3282805 - RNA, 16 nt, Variola virus
uccaaauuuaauucuu

SEQ ID NO: 3282806 - RNA, 20 nt, Variola virus
uguaaagaacaaauguugua

SEQ ID NO: 3282807 - RNA, 20 nt, Variola virus
gaaacacuuauuaaguucuu

SEQ ID NO: 3282808 - RNA, 23 nt, Variola virus
augcggugccauucaugaaaaug

SEQ ID NO: 3282809 - RNA, 16 nt, Variola virus
gauggcugaaauuaga

SEQ ID NO: 3282810 - RNA, 12 nt, Variola virus
aauuucaaaaua

SEQ ID NO: 3282811 - RNA, 13 nt, Variola virus
gagauuuucuauu

SEQ ID NO: 3282812 - RNA, 19 nt, Variola virus
uuagaguaguaucauuaaa

SEQ ID NO: 3282813 - RNA, 23 nt, Variola virus
auaauuacgagucucguguguaa

SEQ ID NO: 3282814 - RNA, 17 nt, Variola virus
gaauucauuugauguau

SEQ ID NO: 3282815 - RNA, 21 nt, Variola virus
aguccuauauauuugaaaauc

SEQ ID NO: 3282816 - RNA, 14 nt, Variola virus
auauaauccaucaa

SEQ ID NO: 3282817 - RNA, 14 nt, Variola virus
uuacaauacauaga

SEQ ID NO: 3282818 - RNA, 21 nt, Variola virus
uaaguuguggguaguaucauc

SEQ ID NO: 3282819 - RNA, 20 nt, Variola virus
cuaaagccgguguaacauuc

SEQ ID NO: 3282820 - RNA, 14 nt, Variola virus
cucucuaucucuua

SEQ ID NO: 3282821 - RNA, 22 nt, Variola virus
uuaaaggauggcgaaauuauug

SEQ ID NO: 3282822 - RNA, 14 nt, Variola virus
uacauaagaaucaa

SEQ ID NO: 3282823 - RNA, 21 nt, Variola virus
aaauugguacucuaucauaau

SEQ ID NO: 3282824 - RNA, 15 nt, Variola virus
auaauuuaacauuuu

SEQ ID NO: 3282825 - RNA, 21 nt, Variola virus
ccaagaaaucguauauaacua

SEQ ID NO: 3282826 - RNA, 14 nt, Variola virus
caaacucuauuuua

SEQ ID NO: 3282827 - RNA, 14 nt, Variola virus
acuuuaacaaucuc

SEQ ID NO: 3282828 - RNA, 12 nt, Variola virus
uuauaacuaaac

SEQ ID NO: 3282829 - RNA, 17 nt, Variola virus
ccauaacauaauuuucu

SEQ ID NO: 3282830 - RNA, 14 nt, Variola virus
acgcauccauccaa

SEQ ID NO: 3282831 - RNA, 17 nt, Variola virus
aaauuuauuaaaaaugu

SEQ ID NO: 3282832 - RNA, 20 nt, Variola virus
cauacuaggagccaucauuu

SEQ ID NO: 3282833 - RNA, 23 nt, Variola virus
agauuuugacuuacauaaauguc

SEQ ID NO: 3282834 - RNA, 21 nt, Variola virus
uaaaauuuaaaaaguauuuac

SEQ ID NO: 3282835 - RNA, 20 nt, Variola virus
acucuguugguuuucuuaua

SEQ ID NO: 3282836 - RNA, 14 nt, Variola virus
caaauaaaaaguau

SEQ ID NO: 3282837 - RNA, 18 nt, Variola virus
acaaucugucgaaaaagu

SEQ ID NO: 3282838 - RNA, 22 nt, Variola virus
uugcuguugaagaggcaaaaga

SEQ ID NO: 3282839 - RNA, 13 nt, Variola virus
aaagcuguuguau

SEQ ID NO: 3282840 - RNA, 15 nt, Variola virus
aaugcagaaaugauu

SEQ ID NO: 3282841 - RNA, 15 nt, Variola virus
uaaaaagauaaacuu

SEQ ID NO: 3282842 - RNA, 22 nt, Variola virus
aucuugcaaguuaaauagaaug

SEQ ID NO: 3282843 - RNA, 17 nt, Variola virus
gguguaggaguacauac

SEQ ID NO: 3282844 - RNA, 14 nt, Variola virus
uguaaacacagaua

SEQ ID NO: 3282845 - RNA, 21 nt, Variola virus
ucagccgcuacagaaacauau

SEQ ID NO: 3282846 - RNA, 21 nt, Variola virus
uaccccucauaguauuaauau

SEQ ID NO: 3282847 - RNA, 12 nt, Variola virus
caccuaaaugug

SEQ ID NO: 3282848 - RNA, 13 nt, Variola virus
uauaguaucuauu

SEQ ID NO: 3282849 - RNA, 17 nt, Variola virus
cauugaucuauuauuua

SEQ ID NO: 3282850 - RNA, 14 nt, Variola virus
guuauaauagagau

SEQ ID NO: 3282851 - RNA, 19 nt, Variola virus
aucuugucugcuuaauaca

SEQ ID NO: 3282852 - RNA, 21 nt, Variola virus
ccaucacuucuaucuuguuua

SEQ ID NO: 3282853 - RNA, 13 nt, Variola virus
uuuucaucuuuua

SEQ ID NO: 3282854 - RNA, 14 nt, Variola virus
uuauagagauagau

SEQ ID NO: 3282855 - RNA, 16 nt, Variola virus
aagaauuuuagacacu

SEQ ID NO: 3282856 - RNA, 22 nt, Variola virus
ucguuccaagucauaucuagaa

SEQ ID NO: 3282857 - RNA, 18 nt, Variola virus
uuaacgcaccuauaaaga

SEQ ID NO: 3282858 - RNA, 14 nt, Variola virus
guaaauaauaauau

SEQ ID NO: 3282859 - RNA, 16 nt, Variola virus
ucgcgcuaauuucuaa

SEQ ID NO: 3282860 - RNA, 21 nt, Variola virus
uccuuccaagaagaagacuua

SEQ ID NO: 3282861 - RNA, 12 nt, Variola virus
aaauauuguuaa

SEQ ID NO: 3282862 - RNA, 18 nt, Variola virus
aauucauagccaauggau

SEQ ID NO: 3282863 - RNA, 17 nt, Variola virus
uauucaagcaaaaacaa

SEQ ID NO: 3282864 - RNA, 17 nt, Variola virus
uuaauacguucauuaaa

SEQ ID NO: 3282865 - RNA, 23 nt, Variola virus
agaaaaaugaugcugguuauuac

SEQ ID NO: 3282866 - RNA, 23 nt, Variola virus
gaguaauauccucuauuauacau

SEQ ID NO: 3282867 - RNA, 16 nt, Variola virus
ucuuuuauuuuaucua

SEQ ID NO: 3282868 - RNA, 15 nt, Variola virus
ucgaauacaaauuuu

SEQ ID NO: 3282869 - RNA, 21 nt, Variola virus
aacacccauuuauuguacaaa

SEQ ID NO: 3282870 - RNA, 16 nt, Variola virus
auuaacuuuguucauu

SEQ ID NO: 3282871 - RNA, 12 nt, Variola virus
acuauuugucua

SEQ ID NO: 3282872 - RNA, 18 nt, Variola virus
uuuucauuagcaugaauc

SEQ ID NO: 3282873 - RNA, 12 nt, Variola virus
aaauauucauua

SEQ ID NO: 3282874 - RNA, 16 nt, Variola virus
cuaacgaguacauucu

SEQ ID NO: 3282875 - RNA, 19 nt, Variola virus
auaaaauucuuaguuauau

SEQ ID NO: 3282876 - RNA, 18 nt, Variola virus
uagauuuuuaguuacaga

SEQ ID NO: 3282877 - RNA, 23 nt, Variola virus
cucaauauuuaucuagagugagu

SEQ ID NO: 3282878 - RNA, 14 nt, Variola virus
uucacuuaacaauu

SEQ ID NO: 3282879 - RNA, 20 nt, Variola virus
uaaacgauuuuccaaaucag

SEQ ID NO: 3282880 - RNA, 18 nt, Variola virus
ucuauacagcgaauaaau

SEQ ID NO: 3282881 - RNA, 14 nt, Variola virus
auaagcucuauugu

SEQ ID NO: 3282882 - RNA, 20 nt, Variola virus
cguagugacaauacuauuag

SEQ ID NO: 3282883 - RNA, 13 nt, Variola virus
auauacacauaau

SEQ ID NO: 3282884 - RNA, 22 nt, Variola virus
acaaugcuaauauauucuuaca

SEQ ID NO: 3282885 - RNA, 13 nt, Variola virus
auuuaaaaugaua

SEQ ID NO: 3282886 - RNA, 14 nt, Variola virus
cauaacauuguuua

SEQ ID NO: 3282887 - RNA, 17 nt, Variola virus
aucaaaauaguaaagua

SEQ ID NO: 3282888 - RNA, 14 nt, Variola virus
aacuauuuagcaaa

SEQ ID NO: 3282889 - RNA, 11 nt, Variola virus
cauuuaaacau

SEQ ID NO: 3282890 - RNA, 16 nt, Variola virus
ccauuaaagaauucuu

SEQ ID NO: 3282891 - RNA, 17 nt, Variola virus
agacauaugauaaaacg

SEQ ID NO: 3282892 - RNA, 19 nt, Variola virus
guuccuguagauaauaacu

SEQ ID NO: 3282893 - RNA, 18 nt, Variola virus
ugucucagaaucaaauau

SEQ ID NO: 3282894 - RNA, 14 nt, Variola virus
aaaugaauuauuua

SEQ ID NO: 3282895 - RNA, 17 nt, Variola virus
cauauauuagaaauaca

SEQ ID NO: 3282896 - RNA, 17 nt, Variola virus
aagauauuuuucuaagc

SEQ ID NO: 3282897 - RNA, 20 nt, Variola virus
uauuaucucccauuaucuug

SEQ ID NO: 3282898 - RNA, 17 nt, Variola virus
aacauauaauuauaaga

SEQ ID NO: 3282899 - RNA, 23 nt, Variola virus
aauaucuuuaaagagguaauggc

SEQ ID NO: 3282900 - RNA, 14 nt, Variola virus
uauucauugggaag

SEQ ID NO: 3282901 - RNA, 16 nt, Variola virus
aggcuacacaauagua

SEQ ID NO: 3282902 - RNA, 13 nt, Variola virus
acaaaauaaugua

SEQ ID NO: 3282903 - RNA, 17 nt, Variola virus
uaguuucugguuuucua

SEQ ID NO: 3282904 - RNA, 16 nt, Variola virus
uuaacuuuucauuaau

SEQ ID NO: 3282905 - RNA, 12 nt, Variola virus
aauaaaauggau

SEQ ID NO: 3282906 - RNA, 12 nt, Variola virus
agaaaaaugauu

SEQ ID NO: 3282907 - RNA, 19 nt, Variola virus
agaauauagacaaaaauau

SEQ ID NO: 3282908 - RNA, 12 nt, Variola virus
auuaaguucuuu

SEQ ID NO: 3282909 - RNA, 16 nt, Variola virus
gacauugucagaaauu

SEQ ID NO: 3282910 - RNA, 16 nt, Variola virus
uuucaucuauaucauu

SEQ ID NO: 3282911 - RNA, 22 nt, Variola virus
gucuuauaugaagucuauacag

SEQ ID NO: 3282912 - RNA, 17 nt, Variola virus
augcugguuauuacaca

SEQ ID NO: 3282913 - RNA, 16 nt, Variola virus
auuaauauuuaugauu

SEQ ID NO: 3282914 - RNA, 20 nt, Variola virus
aacaagagaagagauuucaa

SEQ ID NO: 3282915 - RNA, 20 nt, Variola virus
ucauuucaaccagagaaguu

SEQ ID NO: 3282916 - RNA, 17 nt, Variola virus
cuauuaguuguuccaau

SEQ ID NO: 3282917 - RNA, 22 nt, Variola virus
ugcucuacaugcgguaaagaua

SEQ ID NO: 3282918 - RNA, 16 nt, Variola virus
uuaucuauuucaaaaa

SEQ ID NO: 3282919 - RNA, 20 nt, Variola virus
gaggaguugcugaugaugaa

SEQ ID NO: 3282920 - RNA, 22 nt, Variola virus
aaauccuuguuugauaaaugua

SEQ ID NO: 3282921 - RNA, 19 nt, Variola virus
auguauauauccaggaauu

SEQ ID NO: 3282922 - RNA, 12 nt, Variola virus
augaaauguuug

SEQ ID NO: 3282923 - RNA, 14 nt, Variola virus
uucuucauuauuuu

SEQ ID NO: 3282924 - RNA, 19 nt, Variola virus
augaauaaagagaaugcag

SEQ ID NO: 3282925 - RNA, 16 nt, Variola virus
uuaucguuuacauaag

SEQ ID NO: 3282926 - RNA, 17 nt, Variola virus
agguaacauaaaaacug

SEQ ID NO: 3282927 - RNA, 15 nt, Variola virus
ccauaauuuucucuc

SEQ ID NO: 3282928 - RNA, 15 nt, Variola virus
auccauucuaaugau

SEQ ID NO: 3282929 - RNA, 18 nt, Variola virus
caaaaggacguagacaau

SEQ ID NO: 3282930 - RNA, 21 nt, Variola virus
cuauuuagaucauuaacucua

SEQ ID NO: 3282931 - RNA, 15 nt, Variola virus
gaaacgauaccaucu

SEQ ID NO: 3282932 - RNA, 18 nt, Variola virus
ccuuguuugauaaaugua

SEQ ID NO: 3282933 - RNA, 20 nt, Variola virus
cauaaauuucuccaacgauu

SEQ ID NO: 3282934 - RNA, 18 nt, Variola virus
cuaagacgucucauuucu

SEQ ID NO: 3282935 - RNA, 21 nt, Variola virus
ugaagauucccaaauaaucau

SEQ ID NO: 3282936 - RNA, 22 nt, Variola virus
auaguuguaauaaaaagggaaa

SEQ ID NO: 3282937 - RNA, 12 nt, Variola virus
cuucuacauaaa

SEQ ID NO: 3282938 - RNA, 18 nt, Variola virus
uauccagucaacacuaug

SEQ ID NO: 3282939 - RNA, 20 nt, Variola virus
ucauaaaacgauuggaaucu

SEQ ID NO: 3282940 - RNA, 18 nt, Variola virus
acaaucuaguacucgaaa

SEQ ID NO: 3282941 - RNA, 14 nt, Variola virus
aauuuugaagcauu

SEQ ID NO: 3282942 - RNA, 21 nt, Variola virus
aauaaagaugccauuuagaga

SEQ ID NO: 3282943 - RNA, 13 nt, Variola virus
aauuuauacucau

SEQ ID NO: 3282944 - RNA, 19 nt, Variola virus
aucuuuucacguuaaauga

SEQ ID NO: 3282945 - RNA, 18 nt, Variola virus
agauuaaaucauuaaaug

SEQ ID NO: 3282946 - RNA, 15 nt, Variola virus
augagugaaggagac

SEQ ID NO: 3282947 - RNA, 22 nt, Variola virus
acaaacuguuguuaaggaauau

SEQ ID NO: 3282948 - RNA, 13 nt, Variola virus
agaagaauaugau

SEQ ID NO: 3282949 - RNA, 22 nt, Variola virus
auaacaaccucuuuaauagccg

SEQ ID NO: 3282950 - RNA, 19 nt, Variola virus
cuccugauugugucucaaa

SEQ ID NO: 3282951 - RNA, 14 nt, Variola virus
aauaaaaauguuuu

SEQ ID NO: 3282952 - RNA, 16 nt, Variola virus
ucagaaucacauagau

SEQ ID NO: 3282953 - RNA, 13 nt, Variola virus
uucaaaauuauuu

SEQ ID NO: 3282954 - RNA, 16 nt, Variola virus
acaaaaauuaugaaau

SEQ ID NO: 3282955 - RNA, 14 nt, Variola virus
aucacaaaccacca

SEQ ID NO: 3282956 - RNA, 16 nt, Variola virus
ccaaacaauguuucua

SEQ ID NO: 3282957 - RNA, 24 nt, Variola virus
uggacaacauuaauacaaacgaua

SEQ ID NO: 3282958 - RNA, 15 nt, Variola virus
uuaacuacauuauca

SEQ ID NO: 3282959 - RNA, 14 nt, Variola virus
caaaucaaaacaaa

SEQ ID NO: 3282960 - RNA, 17 nt, Variola virus
uuucccauagaacauaa

SEQ ID NO: 3282961 - RNA, 16 nt, Variola virus
agcuaagcaacuaaga

SEQ ID NO: 3282962 - RNA, 21 nt, Variola virus
ugaauguuuccuucuuuacca

SEQ ID NO: 3282963 - RNA, 22 nt, Variola virus
cuucauaggauuaacaacaaug

SEQ ID NO: 3282964 - RNA, 17 nt, Variola virus
auaccuuuccuggaaua

SEQ ID NO: 3282965 - RNA, 22 nt, Variola virus
uaaagaaugcuguuauauacau

SEQ ID NO: 3282966 - RNA, 19 nt, Variola virus
gaagaauggaacuaaaaaa

SEQ ID NO: 3282967 - RNA, 22 nt, Variola virus
aauuggagaaucguauaccauu

SEQ ID NO: 3282968 - RNA, 15 nt, Variola virus
agaauacaacuacau

SEQ ID NO: 3282969 - RNA, 16 nt, Variola virus
gaauauaaaauaacua

SEQ ID NO: 3282970 - RNA, 16 nt, Variola virus
agaguuuccucauuau

SEQ ID NO: 3282971 - RNA, 20 nt, Variola virus
acauuaacaucuugaaccau

SEQ ID NO: 3282972 - RNA, 15 nt, Variola virus
uccaauuuuauucua

SEQ ID NO: 3282973 - RNA, 18 nt, Variola virus
acauuagauacaauggau

SEQ ID NO: 3282974 - RNA, 15 nt, Variola virus
cuauuauaucuuuuu

SEQ ID NO: 3282975 - RNA, 16 nt, Variola virus
cacuagguacaucauu

SEQ ID NO: 3282976 - RNA, 14 nt, Variola virus
auauaauuguugua

SEQ ID NO: 3282977 - RNA, 21 nt, Variola virus
cuguagauaaacuaggauuua

SEQ ID NO: 3282978 - RNA, 16 nt, Variola virus
aguaugaauaaucuuc

SEQ ID NO: 3282979 - RNA, 15 nt, Variola virus
aauuacuuaaagaua

SEQ ID NO: 3282980 - RNA, 22 nt, Variola virus
auagaaguuaaacugugaaugu

SEQ ID NO: 3282981 - RNA, 14 nt, Variola virus
agagaugaaaaauu

SEQ ID NO: 3282982 - RNA, 17 nt, Variola virus
aaauaugucuuuguuaa

SEQ ID NO: 3282983 - RNA, 19 nt, Variola virus
aucaaucgguguguagaaa

SEQ ID NO: 3282984 - RNA, 17 nt, Variola virus
gauuuaucauauuucuc

SEQ ID NO: 3282985 - RNA, 23 nt, Variola virus
uuaauagggauuugauguacgua

SEQ ID NO: 3282986 - RNA, 21 nt, Variola virus
agacauuguacaauauguguu

SEQ ID NO: 3282987 - RNA, 13 nt, Variola virus
aaaaucaaugggu

SEQ ID NO: 3282988 - RNA, 15 nt, Variola virus
cagacaaaaugaaga

SEQ ID NO: 3282989 - RNA, 15 nt, Variola virus
acaauuacacuacau

SEQ ID NO: 3282990 - RNA, 14 nt, Variola virus
aaaagaauauguau

SEQ ID NO: 3282991 - RNA, 18 nt, Variola virus
auaaauguucaaugaauu

SEQ ID NO: 3282992 - RNA, 23 nt, Variola virus
uuauagcuucuggauauaauuca

SEQ ID NO: 3282993 - RNA, 16 nt, Variola virus
cuucagacaacaucuc

SEQ ID NO: 3282994 - RNA, 18 nt, Variola virus
aauguauuaguaggaaau

SEQ ID NO: 3282995 - RNA, 13 nt, Variola virus
cauuaaauuguga

SEQ ID NO: 3282996 - RNA, 15 nt, Variola virus
acccaagaacaaugu

SEQ ID NO: 3282997 - RNA, 15 nt, Variola virus
gauuacaagaaauau

SEQ ID NO: 3282998 - RNA, 20 nt, Variola virus
gauuuuccaaaucaguaacu

SEQ ID NO: 3282999 - RNA, 22 nt, Variola virus
guuggaagaugcgcauuaacaa

SEQ ID NO: 3283000 - RNA, 22 nt, Variola virus
augacaucaacuacaaaugaua

SEQ ID NO: 3283001 - RNA, 13 nt, Variola virus
cucaaacauccuc

SEQ ID NO: 3283002 - RNA, 20 nt, Variola virus
uacgucagcugcaucuaaau

SEQ ID NO: 3283003 - RNA, 21 nt, Variola virus
gccacgaauaaaaaauacuua

SEQ ID NO: 3283004 - RNA, 19 nt, Variola virus
cacuuaauggcauaaugau

SEQ ID NO: 3283005 - RNA, 19 nt, Variola virus
ccauuauuucuauauuuga

SEQ ID NO: 3283006 - RNA, 16 nt, Variola virus
aguuacaggaacuuaa

SEQ ID NO: 3283007 - RNA, 20 nt, Variola virus
ugacuaucuuuugaaaauau

SEQ ID NO: 3283008 - RNA, 14 nt, Variola virus
uggauuucauauaa

SEQ ID NO: 3283009 - RNA, 22 nt, Variola virus
acgggaaaggaauuaauuauuc

SEQ ID NO: 3283010 - RNA, 13 nt, Variola virus
aauauguauauau

SEQ ID NO: 3283011 - RNA, 13 nt, Variola virus
aauaaguauauaa

SEQ ID NO: 3283012 - RNA, 18 nt, Variola virus
auagcauuguuauuagca

SEQ ID NO: 3283013 - RNA, 22 nt, Variola virus
acguauauagaugucaaugaag

SEQ ID NO: 3283014 - RNA, 20 nt, Variola virus
uuccaccuagagauagucaa

SEQ ID NO: 3283015 - RNA, 22 nt, Variola virus
uagagcccacguuuaaacauuc

SEQ ID NO: 3283016 - RNA, 16 nt, Variola virus
uuucguacauuuuuaa

SEQ ID NO: 3283017 - RNA, 22 nt, Variola virus
uaauauccuuauccgacuuuau

SEQ ID NO: 3283018 - RNA, 22 nt, Variola virus
aauaucauuauguauaaucauu

SEQ ID NO: 3283019 - RNA, 16 nt, Variola virus
ucuccuuuuguagaua

SEQ ID NO: 3283020 - RNA, 14 nt, Variola virus
uaucauaauuaaau

SEQ ID NO: 3283021 - RNA, 14 nt, Variola virus
uaacuuaauuuauu

SEQ ID NO: 3283022 - RNA, 17 nt, Variola virus
acaaccgcuacauaauc

SEQ ID NO: 3283023 - RNA, 18 nt, Variola virus
auauguagcaaacaugau

SEQ ID NO: 3283024 - RNA, 23 nt, Variola virus
gccaaaaaauccuguaauacuuu

SEQ ID NO: 3283025 - RNA, 21 nt, Variola virus
uguuucaucuaucauagauuu

SEQ ID NO: 3283026 - RNA, 14 nt, Variola virus
gauacauuuugcau

SEQ ID NO: 3283027 - RNA, 16 nt, Variola virus
aaucuauaguauuauc

SEQ ID NO: 3283028 - RNA, 20 nt, Variola virus
ccauccuugggaguaguuua

SEQ ID NO: 3283029 - RNA, 12 nt, Variola virus
aaucaaaacaaa

SEQ ID NO: 3283030 - RNA, 16 nt, Variola virus
gaagaauggaugauau

SEQ ID NO: 3283031 - RNA, 13 nt, Variola virus
auuuaacacuaua

SEQ ID NO: 3283032 - RNA, 16 nt, Variola virus
augaacaaagaaaugg

SEQ ID NO: 3283033 - RNA, 21 nt, Variola virus
cccuaccugaugaaucagaca

SEQ ID NO: 3283034 - RNA, 15 nt, Variola virus
auagaaacuauagau

SEQ ID NO: 3283035 - RNA, 22 nt, Variola virus
agcaguugcgaacaacaacaaa

SEQ ID NO: 3283036 - RNA, 21 nt, Variola virus
ugauaugaugucguuaaauuu

SEQ ID NO: 3283037 - RNA, 20 nt, Variola virus
aguguaaagaacaaauguug

SEQ ID NO: 3283038 - RNA, 17 nt, Variola virus
aaauuuuacuacauagu

SEQ ID NO: 3283039 - RNA, 17 nt, Variola virus
auaaugauagacaagau

SEQ ID NO: 3283040 - RNA, 17 nt, Variola virus
caguccagaaauauuua

SEQ ID NO: 3283041 - RNA, 19 nt, Variola virus
ucgucaaaauauuuacuaa

SEQ ID NO: 3283042 - RNA, 20 nt, Variola virus
uauucaguaguguuuacaua

SEQ ID NO: 3283043 - RNA, 19 nt, Variola virus
auauuucuccacuacauau

SEQ ID NO: 3283044 - RNA, 20 nt, Variola virus
aucaacgaguuaaaaaagac

SEQ ID NO: 3283045 - RNA, 21 nt, Variola virus
acuacucuuccacuauugcca

SEQ ID NO: 3283046 - RNA, 23 nt, Variola virus
uagauaguuuuuuugagccauau

SEQ ID NO: 3283047 - RNA, 15 nt, Variola virus
uccagaugaaugggu

SEQ ID NO: 3283048 - RNA, 23 nt, Variola virus
augggcgccgaccagucugaaca

SEQ ID NO: 3283049 - RNA, 22 nt, Variola virus
aggaaauaucaucacaacuuaa

SEQ ID NO: 3283050 - RNA, 15 nt, Variola virus
ccaaugaguaaaauc

SEQ ID NO: 3283051 - RNA, 17 nt, Variola virus
aacaauaucguuauuau

SEQ ID NO: 3283052 - RNA, 15 nt, Variola virus
gauauggauuuccag

SEQ ID NO: 3283053 - RNA, 19 nt, Variola virus
uaaaauaguuuauaacauu

SEQ ID NO: 3283054 - RNA, 21 nt, Variola virus
agaugccauaucauacaugau

SEQ ID NO: 3283055 - RNA, 13 nt, Variola virus
agucauaucuaga

SEQ ID NO: 3283056 - RNA, 20 nt, Variola virus
auuuuuaucauaacacuacu

SEQ ID NO: 3283057 - RNA, 13 nt, Variola virus
auuuuacauuauu

SEQ ID NO: 3283058 - RNA, 19 nt, Variola virus
auugguuuauaauguauaa

SEQ ID NO: 3283059 - RNA, 17 nt, Variola virus
gaacaaacgcuacuaua

SEQ ID NO: 3283060 - RNA, 16 nt, Variola virus
auuacuaauaaagaag

SEQ ID NO: 3283061 - RNA, 13 nt, Variola virus
accacuagcaaaa

SEQ ID NO: 3283062 - RNA, 14 nt, Variola virus
uguuugagaauuaa

SEQ ID NO: 3283063 - RNA, 16 nt, Variola virus
gaaauaauuuuuaguu

SEQ ID NO: 3283064 - RNA, 14 nt, Variola virus
auacuauuguacau

SEQ ID NO: 3283065 - RNA, 15 nt, Variola virus
aauuagaaagugaua

SEQ ID NO: 3283066 - RNA, 14 nt, Variola virus
aucaacuacauaau

SEQ ID NO: 3283067 - RNA, 15 nt, Variola virus
cacgagaacuauuaa

SEQ ID NO: 3283068 - RNA, 21 nt, Variola virus
acuucagguuucuuagcuugu

SEQ ID NO: 3283069 - RNA, 19 nt, Variola virus
auuucucucauaaauacag

SEQ ID NO: 3283070 - RNA, 21 nt, Variola virus
gauuaauaguuuuauuugaag

SEQ ID NO: 3283071 - RNA, 16 nt, Variola virus
aacuugauuucaaaau

SEQ ID NO: 3283072 - RNA, 14 nt, Variola virus
aaaucgucaguagu

SEQ ID NO: 3283073 - RNA, 19 nt, Variola virus
uuaguuuuuuguuacugac

SEQ ID NO: 3283074 - RNA, 16 nt, Variola virus
uaucaugucuaaugau

SEQ ID NO: 3283075 - RNA, 12 nt, Variola virus
auuuuguaacug

SEQ ID NO: 3283076 - RNA, 21 nt, Variola virus
uauaccuuugguucuuuaaaa

SEQ ID NO: 3283077 - RNA, 23 nt, Variola virus
caguauugggacaacuuaaucug

SEQ ID NO: 3283078 - RNA, 22 nt, Variola virus
gcgguuaaaauaguuuauaaca

SEQ ID NO: 3283079 - RNA, 15 nt, Variola virus
auuacaagucaaaga

SEQ ID NO: 3283080 - RNA, 14 nt, Variola virus
uugauaauaaauca

SEQ ID NO: 3283081 - RNA, 14 nt, Variola virus
cuuuagaaaaacuu

SEQ ID NO: 3283082 - RNA, 15 nt, Variola virus
auacuagaacuauaa

SEQ ID NO: 3283083 - RNA, 14 nt, Variola virus
augaaauauauuaa

SEQ ID NO: 3283084 - RNA, 16 nt, Variola virus
gaaaauuauaaugaau

SEQ ID NO: 3283085 - RNA, 23 nt, Variola virus
aauuaucgacauagguauagaau

SEQ ID NO: 3283086 - RNA, 21 nt, Variola virus
uagaaaccacggaucguaaua

SEQ ID NO: 3283087 - RNA, 15 nt, Variola virus
acgucauucuaaaag

SEQ ID NO: 3283088 - RNA, 22 nt, Variola virus
uacuaaagacuaugucaaagua

SEQ ID NO: 3283089 - RNA, 23 nt, Variola virus
uaaauccuuguuugauaaaugua

SEQ ID NO: 3283090 - RNA, 23 nt, Variola virus
ccucucaccagaagaggagcuac

SEQ ID NO: 3283091 - RNA, 16 nt, Variola virus
ugcuuuuuugacauau

SEQ ID NO: 3283092 - RNA, 16 nt, Variola virus
acugucaaaaaaauag

SEQ ID NO: 3283093 - RNA, 14 nt, Variola virus
uuuaguuuaucaaa

SEQ ID NO: 3283094 - RNA, 14 nt, Variola virus
uggaggaauuuaua

SEQ ID NO: 3283095 - RNA, 17 nt, Variola virus
acgacuauuaaaauaaa

SEQ ID NO: 3283096 - RNA, 18 nt, Variola virus
uccgaggauaguaaaaua

SEQ ID NO: 3283097 - RNA, 19 nt, Variola virus
aauccaaauaaaauggaua

SEQ ID NO: 3283098 - RNA, 17 nt, Variola virus
aauagcugaugauagaa

SEQ ID NO: 3283099 - RNA, 13 nt, Variola virus
guuaauacuuauu

SEQ ID NO: 3283100 - RNA, 20 nt, Variola virus
auuuagcgauuaugaaaauu

SEQ ID NO: 3283101 - RNA, 21 nt, Variola virus
auuucaaauaggucuucgucu

SEQ ID NO: 3283102 - RNA, 15 nt, Variola virus
aguaugugaauagau

SEQ ID NO: 3283103 - RNA, 17 nt, Variola virus
auuuccgcauucuuccu

SEQ ID NO: 3283104 - RNA, 17 nt, Variola virus
gacaacauuaauacaaa

SEQ ID NO: 3283105 - RNA, 14 nt, Variola virus
uaaaucauggauuu

SEQ ID NO: 3283106 - RNA, 15 nt, Variola virus
aucagguaaaacaau

SEQ ID NO: 3283107 - RNA, 15 nt, Variola virus
aaucuuauuagaaua

SEQ ID NO: 3283108 - RNA, 14 nt, Variola virus
aauguaauucuaaa

SEQ ID NO: 3283109 - RNA, 19 nt, Variola virus
aaugaguuauuaagaaaua

SEQ ID NO: 3283110 - RNA, 15 nt, Variola virus
ugaucugguuuugag

SEQ ID NO: 3283111 - RNA, 17 nt, Variola virus
auauuaaacacuaguau

SEQ ID NO: 3283112 - RNA, 22 nt, Variola virus
caacaucuuaagcguagaaguu

SEQ ID NO: 3283113 - RNA, 13 nt, Variola virus
aaacaauacagug

SEQ ID NO: 3283114 - RNA, 13 nt, Variola virus
uaacaaauuaaag

SEQ ID NO: 3283115 - RNA, 21 nt, Variola virus
agaauagaaugcuaaugucaa

SEQ ID NO: 3283116 - RNA, 20 nt, Variola virus
aaaauaaacacauagaaaua

SEQ ID NO: 3283117 - RNA, 17 nt, Variola virus
uuaagcauauucuuaau

SEQ ID NO: 3283118 - RNA, 21 nt, Variola virus
uaaugauugcccauagaguau

SEQ ID NO: 3283119 - RNA, 23 nt, Variola virus
cauuguuuacggugauguuuauc

SEQ ID NO: 3283120 - RNA, 17 nt, Variola virus
auaucaucaucugaaau

SEQ ID NO: 3283121 - RNA, 20 nt, Variola virus
uaucuuuagcuucugaaaua

SEQ ID NO: 3283122 - RNA, 14 nt, Variola virus
uuauacaaaguuuu

SEQ ID NO: 3283123 - RNA, 18 nt, Variola virus
cauccuuuuuuauaucca

SEQ ID NO: 3283124 - RNA, 17 nt, Variola virus
uaucaacagauagcuug

SEQ ID NO: 3283125 - RNA, 18 nt, Variola virus
ucuauaaagucugucaaa

SEQ ID NO: 3283126 - RNA, 20 nt, Variola virus
aacacuuuauacuucuccaa

SEQ ID NO: 3283127 - RNA, 16 nt, Variola virus
auggagagauuuaacu

SEQ ID NO: 3283128 - RNA, 21 nt, Variola virus
cauuaauuucugauauggaau

SEQ ID NO: 3283129 - RNA, 18 nt, Variola virus
accgauaauaaaauuacu

SEQ ID NO: 3283130 - RNA, 18 nt, Variola virus
aaaacgauauuagaauuu

SEQ ID NO: 3283131 - RNA, 16 nt, Variola virus
agcucgcguuuaagag

SEQ ID NO: 3283132 - RNA, 17 nt, Variola virus
auaucguucuuaauaga

SEQ ID NO: 3283133 - RNA, 15 nt, Variola virus
gcuuuucucuuuuaa

SEQ ID NO: 3283134 - RNA, 17 nt, Variola virus
cauuaucauuuuguaau

SEQ ID NO: 3283135 - RNA, 15 nt, Variola virus
uagagauaauuuauc

SEQ ID NO: 3283136 - RNA, 18 nt, Variola virus
uaauuucaggaacaggau

SEQ ID NO: 3283137 - RNA, 16 nt, Variola virus
uaacaguaacuuguau

SEQ ID NO: 3283138 - RNA, 14 nt, Variola virus
ucuucgcagaugau

SEQ ID NO: 3283139 - RNA, 15 nt, Variola virus
acacaccuaaaugug

SEQ ID NO: 3283140 - RNA, 14 nt, Variola virus
uuccaaucauugau

SEQ ID NO: 3283141 - RNA, 14 nt, Variola virus
auauguucguguau

SEQ ID NO: 3283142 - RNA, 16 nt, Variola virus
ucaaauuguccuauau

SEQ ID NO: 3283143 - RNA, 21 nt, Variola virus
aauaacugccggauaaaagug

SEQ ID NO: 3283144 - RNA, 14 nt, Variola virus
auuauucuuuggau

SEQ ID NO: 3283145 - RNA, 19 nt, Variola virus
aacaggugguauauuauau

SEQ ID NO: 3283146 - RNA, 16 nt, Variola virus
aauguuagugaugaau

SEQ ID NO: 3283147 - RNA, 21 nt, Variola virus
augaagggaucguuaaugaac

SEQ ID NO: 3283148 - RNA, 20 nt, Variola virus
agaauucacaccuagagaca

SEQ ID NO: 3283149 - RNA, 18 nt, Variola virus
acugagaugacuggaaau

SEQ ID NO: 3283150 - RNA, 22 nt, Variola virus
uuucaccauauagaucaaucau

SEQ ID NO: 3283151 - RNA, 14 nt, Variola virus
auaaguaauaacua

SEQ ID NO: 3283152 - RNA, 14 nt, Variola virus
auauuaaaaauaca

SEQ ID NO: 3283153 - RNA, 15 nt, Variola virus
gaacauaaacaaauu

SEQ ID NO: 3283154 - RNA, 20 nt, Variola virus
agaaagauauauuaagaaua

SEQ ID NO: 3283155 - RNA, 14 nt, Variola virus
aguggauucuucua

SEQ ID NO: 3283156 - RNA, 21 nt, Variola virus
uuuucaacacucgacugaaua

SEQ ID NO: 3283157 - RNA, 15 nt, Variola virus
cagaaagcuguggau

SEQ ID NO: 3283158 - RNA, 14 nt, Variola virus
uggauuucauauag

SEQ ID NO: 3283159 - RNA, 20 nt, Variola virus
aaauagcguucgucaacaua

SEQ ID NO: 3283160 - RNA, 17 nt, Variola virus
gauacccugauauuaau

SEQ ID NO: 3283161 - RNA, 17 nt, Variola virus
gcuauguuaucaugaaa

SEQ ID NO: 3283162 - RNA, 15 nt, Variola virus
auaguuucuauuuuu

SEQ ID NO: 3283163 - RNA, 12 nt, Variola virus
agccuguaacug

SEQ ID NO: 3283164 - RNA, 17 nt, Variola virus
aaugugaguauuuuacu

SEQ ID NO: 3283165 - RNA, 16 nt, Variola virus
aucuaacaucuugauu

SEQ ID NO: 3283166 - RNA, 14 nt, Variola virus
aauauauugaucau

SEQ ID NO: 3283167 - RNA, 23 nt, Variola virus
aauccuucuagaauuagaauuac

SEQ ID NO: 3283168 - RNA, 13 nt, Variola virus
gauguguauacau

SEQ ID NO: 3283169 - RNA, 12 nt, Variola virus
aauguuagaauu

SEQ ID NO: 3283170 - RNA, 21 nt, Variola virus
guacauuagccggacaaauau

SEQ ID NO: 3283171 - RNA, 20 nt, Variola virus
gaacauaugguauuauucua

SEQ ID NO: 3283172 - RNA, 21 nt, Variola virus
auacuuuaaagcaaaaugguu

SEQ ID NO: 3283173 - RNA, 16 nt, Variola virus
aaaauauguauaacgu

SEQ ID NO: 3283174 - RNA, 19 nt, Variola virus
gaaauaaccgcaugauuau

SEQ ID NO: 3283175 - RNA, 17 nt, Variola virus
ucagaacuaucauagau

SEQ ID NO: 3283176 - RNA, 21 nt, Variola virus
guugcguacauugcucguaaa

SEQ ID NO: 3283177 - RNA, 16 nt, Variola virus
cuccuuuaaaauuaau

SEQ ID NO: 3283178 - RNA, 18 nt, Variola virus
uaguucguguacuaguca

SEQ ID NO: 3283179 - RNA, 14 nt, Variola virus
ucuagauacaaaau

SEQ ID NO: 3283180 - RNA, 14 nt, Variola virus
cacugcugaacagu

SEQ ID NO: 3283181 - RNA, 20 nt, Variola virus
auuaacgaguucaaauauga

SEQ ID NO: 3283182 - RNA, 16 nt, Variola virus
auauuagacaauacua

SEQ ID NO: 3283183 - RNA, 18 nt, Variola virus
aaacaacaaaauuauacu

SEQ ID NO: 3283184 - RNA, 16 nt, Variola virus
cuacugccucacugac

SEQ ID NO: 3283185 - RNA, 11 nt, Variola virus
uuaacaucuug

SEQ ID NO: 3283186 - RNA, 15 nt, Variola virus
auaguaaaaagacua

SEQ ID NO: 3283187 - RNA, 17 nt, Variola virus
uaguuuguuucuagaau

SEQ ID NO: 3283188 - RNA, 14 nt, Variola virus
gccauuuguuuugu

SEQ ID NO: 3283189 - RNA, 18 nt, Variola virus
auaacccaaguauugaaa

SEQ ID NO: 3283190 - RNA, 15 nt, Variola virus
auauacucuauuuca

SEQ ID NO: 3283191 - RNA, 14 nt, Variola virus
aguacuuauuaaaa

SEQ ID NO: 3283192 - RNA, 15 nt, Variola virus
ucugcggauuuauaa

SEQ ID NO: 3283193 - RNA, 15 nt, Variola virus
uauaauuuuaccauu

SEQ ID NO: 3283194 - RNA, 14 nt, Variola virus
gaucauucuuuuag

SEQ ID NO: 3283195 - RNA, 18 nt, Variola virus
uagaaugcucuuaaauaa

SEQ ID NO: 3283196 - RNA, 20 nt, Variola virus
aauauuuuuuauaaacauga

SEQ ID NO: 3283197 - RNA, 19 nt, Variola virus
aaucauauaaaaaaugauu

SEQ ID NO: 3283198 - RNA, 17 nt, Variola virus
acuaaacacacauuauu

SEQ ID NO: 3283199 - RNA, 12 nt, Variola virus
guacauaauaga

SEQ ID NO: 3283200 - RNA, 17 nt, Variola virus
uuauagauuuguaucuc

SEQ ID NO: 3283201 - RNA, 15 nt, Variola virus
agacgaacaaaauca

SEQ ID NO: 3283202 - RNA, 22 nt, Variola virus
uugccuccggagucauaaaagg

SEQ ID NO: 3283203 - RNA, 12 nt, Variola virus
uauuacuuuagu

SEQ ID NO: 3283204 - RNA, 19 nt, Variola virus
gaaauugguuuauaaugua

SEQ ID NO: 3283205 - RNA, 22 nt, Variola virus
augauuuugaaccguauuacuc

SEQ ID NO: 3283206 - RNA, 19 nt, Variola virus
auucuaugaauuuauaaaa

SEQ ID NO: 3283207 - RNA, 14 nt, Variola virus
uuauuaaguauaau

SEQ ID NO: 3283208 - RNA, 13 nt, Variola virus
auuaaucauauac

SEQ ID NO: 3283209 - RNA, 18 nt, Variola virus
auuaauaauuguuuugaa

SEQ ID NO: 3283210 - RNA, 15 nt, Variola virus
uaacgaugucuauau

SEQ ID NO: 3283211 - RNA, 22 nt, Variola virus
auuuuaauucuccuauuacaua

SEQ ID NO: 3283212 - RNA, 20 nt, Variola virus
uuuuaacaugauguaaucuc

SEQ ID NO: 3283213 - RNA, 14 nt, Variola virus
uuuccuuuaucauu

SEQ ID NO: 3283214 - RNA, 17 nt, Variola virus
auaugucuguacaaaug

SEQ ID NO: 3283215 - RNA, 18 nt, Variola virus
aauacucuuuaaaguuuc

SEQ ID NO: 3283216 - RNA, 16 nt, Variola virus
aaaguuaguacagaag

SEQ ID NO: 3283217 - RNA, 15 nt, Variola virus
aauaguguuagauaa

SEQ ID NO: 3283218 - RNA, 19 nt, Variola virus
auuaccacagccguauuuu

SEQ ID NO: 3283219 - RNA, 21 nt, Variola virus
aaaaucguguuuguguaguuu

SEQ ID NO: 3283220 - RNA, 15 nt, Variola virus
gauaaaaucaaacuu

SEQ ID NO: 3283221 - RNA, 15 nt, Variola virus
gcaauuauauaaugu

SEQ ID NO: 3283222 - RNA, 22 nt, Variola virus
guuccugguauauagauaaaga

SEQ ID NO: 3283223 - RNA, 12 nt, Variola virus
aauauuuaacuc

SEQ ID NO: 3283224 - RNA, 16 nt, Variola virus
auuaguaauuaaauau

SEQ ID NO: 3283225 - RNA, 16 nt, Variola virus
uacaucuucaauagau

SEQ ID NO: 3283226 - RNA, 14 nt, Variola virus
cugauuaacaaaug

SEQ ID NO: 3283227 - RNA, 17 nt, Variola virus
uuagaugguuucuuuuu

SEQ ID NO: 3283228 - RNA, 15 nt, Variola virus
uggaugaauucuaug

SEQ ID NO: 3283229 - RNA, 15 nt, Variola virus
caagugacuauuauc

SEQ ID NO: 3283230 - RNA, 23 nt, Variola virus
ucaaaaagggugcgguacuacag

SEQ ID NO: 3283231 - RNA, 14 nt, Variola virus
ugcaaugaauaucu

SEQ ID NO: 3283232 - RNA, 22 nt, Variola virus
cauuagcgcauguacauauuug

SEQ ID NO: 3283233 - RNA, 15 nt, Variola virus
cgauuauuauaaaau

SEQ ID NO: 3283234 - RNA, 14 nt, Variola virus
gaugcauaaguaca

SEQ ID NO: 3283235 - RNA, 22 nt, Variola virus
aagaugcaaacauuauguagua

SEQ ID NO: 3283236 - RNA, 18 nt, Variola virus
agcacauggaaaaaaagu

SEQ ID NO: 3283237 - RNA, 15 nt, Variola virus
augaccaaugaaugg

SEQ ID NO: 3283238 - RNA, 12 nt, Variola virus
uaucauagaugc

SEQ ID NO: 3283239 - RNA, 15 nt, Variola virus
gauaacaaauuaaag

SEQ ID NO: 3283240 - RNA, 15 nt, Variola virus
auaggaccauacauu

SEQ ID NO: 3283241 - RNA, 20 nt, Variola virus
cuauuacaccgccuccuaua

SEQ ID NO: 3283242 - RNA, 15 nt, Variola virus
cauagauuuccgaag

SEQ ID NO: 3283243 - RNA, 16 nt, Variola virus
caaguuugagauuuca

SEQ ID NO: 3283244 - RNA, 18 nt, Variola virus
caaaacuucacagaugau

SEQ ID NO: 3283245 - RNA, 14 nt, Variola virus
uuaaucauuaacuu

SEQ ID NO: 3283246 - RNA, 20 nt, Variola virus
auugucuagauaaaauacug

SEQ ID NO: 3283247 - RNA, 14 nt, Variola virus
cacuagaaaccacg

SEQ ID NO: 3283248 - RNA, 20 nt, Variola virus
aacaaucguuaauaaaucug

SEQ ID NO: 3283249 - RNA, 16 nt, Variola virus
aacuauuaauauuaac

SEQ ID NO: 3283250 - RNA, 15 nt, Variola virus
cuacaguaaugucca

SEQ ID NO: 3283251 - RNA, 17 nt, Variola virus
uuaacaaaaucuuuaau

SEQ ID NO: 3283252 - RNA, 17 nt, Variola virus
uaacaacaucuauucca

SEQ ID NO: 3283253 - RNA, 15 nt, Variola virus
aguauucaagucaaa

SEQ ID NO: 3283254 - RNA, 21 nt, Variola virus
cauuuuauggaaacuauaauu

SEQ ID NO: 3283255 - RNA, 15 nt, Variola virus
ucugucagaaaauac

SEQ ID NO: 3283256 - RNA, 16 nt, Variola virus
aaaugucccucauaau

SEQ ID NO: 3283257 - RNA, 20 nt, Variola virus
ugaauaucuacaaauuggag

SEQ ID NO: 3283258 - RNA, 14 nt, Variola virus
uaacucuguuuuau

SEQ ID NO: 3283259 - RNA, 18 nt, Variola virus
ugauuuucguaacagaua

SEQ ID NO: 3283260 - RNA, 23 nt, Variola virus
ugcagcaacuucuguacuagugg

SEQ ID NO: 3283261 - RNA, 24 nt, Variola virus
gcuagagauaaucagauuagcuuu

SEQ ID NO: 3283262 - RNA, 16 nt, Variola virus
aauuauaagaaauaua

SEQ ID NO: 3283263 - RNA, 21 nt, Variola virus
uauuuucgaaacucguaaaaa

SEQ ID NO: 3283264 - RNA, 23 nt, Variola virus
uuaaaaaaauuauccuaucaugu

SEQ ID NO: 3283265 - RNA, 21 nt, Variola virus
caaagaauuuuagacacuaac

SEQ ID NO: 3283266 - RNA, 20 nt, Variola virus
auacaccauuccauuuguau

SEQ ID NO: 3283267 - RNA, 14 nt, Variola virus
cauuuauagcauuu

SEQ ID NO: 3283268 - RNA, 23 nt, Variola virus
auguuugcugaagucaaauacga

SEQ ID NO: 3283269 - RNA, 14 nt, Variola virus
uagaaaucauauau

SEQ ID NO: 3283270 - RNA, 16 nt, Variola virus
agaauccauaaaacaa

SEQ ID NO: 3283271 - RNA, 17 nt, Variola virus
auuaauagauauaucuc

SEQ ID NO: 3283272 - RNA, 17 nt, Variola virus
cagacacagacgauauu

SEQ ID NO: 3283273 - RNA, 14 nt, Variola virus
auuacaauuaauaa

SEQ ID NO: 3283274 - RNA, 22 nt, Variola virus
uagcagcugauacgucauuaac

SEQ ID NO: 3283275 - RNA, 21 nt, Variola virus
uaacaucacuaauaucaauau

SEQ ID NO: 3283276 - RNA, 12 nt, Variola virus
gacaucaugaac

SEQ ID NO: 3283277 - RNA, 17 nt, Variola virus
aauaaauauccuuggaa

SEQ ID NO: 3283278 - RNA, 15 nt, Variola virus
cguguguuucaggau

SEQ ID NO: 3283279 - RNA, 17 nt, Variola virus
acaacaucuaacuauau

SEQ ID NO: 3283280 - RNA, 18 nt, Variola virus
auagauauaccagaacua

SEQ ID NO: 3283281 - RNA, 13 nt, Variola virus
aaaagagaauaua

SEQ ID NO: 3283282 - RNA, 12 nt, Variola virus
aguauacauguu

SEQ ID NO: 3283283 - RNA, 14 nt, Variola virus
uuaucuaucuuaaa

SEQ ID NO: 3283284 - RNA, 16 nt, Variola virus
auauccauuuuacauu

SEQ ID NO: 3283285 - RNA, 14 nt, Variola virus
auguuagaaaaaug

SEQ ID NO: 3283286 - RNA, 15 nt, Variola virus
acucacaaucacugu

SEQ ID NO: 3283287 - RNA, 19 nt, Variola virus
augugagagagaaauacuu

SEQ ID NO: 3283288 - RNA, 16 nt, Variola virus
auaccuuguaauuaaa

SEQ ID NO: 3283289 - RNA, 12 nt, Variola virus
ugccaauaauga

SEQ ID NO: 3283290 - RNA, 19 nt, Variola virus
agcauacaaauuacaauaa

SEQ ID NO: 3283291 - RNA, 22 nt, Variola virus
gucauccuucacucguuucaua

SEQ ID NO: 3283292 - RNA, 19 nt, Variola virus
acagaaauauaugagaugu

SEQ ID NO: 3283293 - RNA, 23 nt, Variola virus
aguuauggacauaguaauacaua

SEQ ID NO: 3283294 - RNA, 14 nt, Variola virus
uuuucaucauuuca

SEQ ID NO: 3283295 - RNA, 20 nt, Variola virus
gaauuguugucgguaaacga

SEQ ID NO: 3283296 - RNA, 17 nt, Variola virus
cauuuucacaaauacua

SEQ ID NO: 3283297 - RNA, 21 nt, Variola virus
gaucuagcaaaggaaauugug

SEQ ID NO: 3283298 - RNA, 18 nt, Variola virus
gaaacaucucuucuaguu

SEQ ID NO: 3283299 - RNA, 17 nt, Variola virus
aauuaacgaugagugca

SEQ ID NO: 3283300 - RNA, 17 nt, Variola virus
guaaauugguacauaga

SEQ ID NO: 3283301 - RNA, 17 nt, Variola virus
aagauacuguuuagaga

SEQ ID NO: 3283302 - RNA, 20 nt, Variola virus
uaacucauucuauauaugcu

SEQ ID NO: 3283303 - RNA, 15 nt, Variola virus
ugguaucaacagaua

SEQ ID NO: 3283304 - RNA, 16 nt, Variola virus
gcaucaaaaaauguaa

SEQ ID NO: 3283305 - RNA, 22 nt, Variola virus
uuuggcuaaauuauauaauucu

SEQ ID NO: 3283306 - RNA, 16 nt, Variola virus
cauguugucuauuuuc

SEQ ID NO: 3283307 - RNA, 15 nt, Variola virus
caauucaugcucuau

SEQ ID NO: 3283308 - RNA, 15 nt, Variola virus
uuaacuaucuguaaa

SEQ ID NO: 3283309 - RNA, 21 nt, Variola virus
aaaaauguaaaauauuuuucu

SEQ ID NO: 3283310 - RNA, 16 nt, Variola virus
guugauuacucuuuuu

SEQ ID NO: 3283311 - RNA, 11 nt, Variola virus
ugcgauacauu

SEQ ID NO: 3283312 - RNA, 12 nt, Variola virus
cuauucauguaa

SEQ ID NO: 3283313 - RNA, 19 nt, Variola virus
gcuauguuucguccaucau

SEQ ID NO: 3283314 - RNA, 19 nt, Variola virus
uuauaucguuaucauuaau

SEQ ID NO: 3283315 - RNA, 22 nt, Variola virus
gcucucguacaguagagauauu

SEQ ID NO: 3283316 - RNA, 15 nt, Variola virus
ccagaaguauuuuua

SEQ ID NO: 3283317 - RNA, 12 nt, Variola virus
auuuuuaucaua

SEQ ID NO: 3283318 - RNA, 15 nt, Variola virus
cuuauuauauuuccc

SEQ ID NO: 3283319 - RNA, 16 nt, Variola virus
uuagccguuguuugag

SEQ ID NO: 3283320 - RNA, 17 nt, Variola virus
augauucgauaaauaaa

SEQ ID NO: 3283321 - RNA, 12 nt, Variola virus
uuucgauuucaa

SEQ ID NO: 3283322 - RNA, 19 nt, Variola virus
ucuauaaucacuauucaga

SEQ ID NO: 3283323 - RNA, 15 nt, Variola virus
auuaacaucauacau

SEQ ID NO: 3283324 - RNA, 11 nt, Variola virus
aacaauguuuc

SEQ ID NO: 3283325 - RNA, 14 nt, Variola virus
uacucauuaucaua

SEQ ID NO: 3283326 - RNA, 16 nt, Variola virus
accagcggcuacuaaa

SEQ ID NO: 3283327 - RNA, 15 nt, Variola virus
aauguuauagaaaau

SEQ ID NO: 3283328 - RNA, 19 nt, Variola virus
auuacauccgaaaaaguug

SEQ ID NO: 3283329 - RNA, 18 nt, Variola virus
uaauauuucuauuucuau

SEQ ID NO: 3283330 - RNA, 13 nt, Variola virus
aucuauguagaau

SEQ ID NO: 3283331 - RNA, 12 nt, Variola virus
ucaauaaaugug

SEQ ID NO: 3283332 - RNA, 20 nt, Variola virus
aauacuuaccccuugaucgu

SEQ ID NO: 3283333 - RNA, 24 nt, Variola virus
cuagacgauuaguaauauaucuca

SEQ ID NO: 3283334 - RNA, 20 nt, Variola virus
acgaacauuuauaucauuug

SEQ ID NO: 3283335 - RNA, 16 nt, Variola virus
uacaguaauuaaugag

SEQ ID NO: 3283336 - RNA, 15 nt, Variola virus
gaucuaaaaauuaaa

SEQ ID NO: 3283337 - RNA, 23 nt, Variola virus
acgcagaaauugguauaaauguu

SEQ ID NO: 3283338 - RNA, 21 nt, Variola virus
gccaagauaucuauauaauua

SEQ ID NO: 3283339 - RNA, 19 nt, Variola virus
auaacuaaaguuaauacua

SEQ ID NO: 3283340 - RNA, 13 nt, Variola virus
gaacagaugauau

SEQ ID NO: 3283341 - RNA, 15 nt, Variola virus
auaaucguuaauauu

SEQ ID NO: 3283342 - RNA, 15 nt, Variola virus
aaguuuaaaaaagac

SEQ ID NO: 3283343 - RNA, 22 nt, Variola virus
auuuaggagugaucaucaaaug

SEQ ID NO: 3283344 - RNA, 18 nt, Variola virus
uucuaacaucauuauuuu

SEQ ID NO: 3283345 - RNA, 13 nt, Variola virus
cuaauggauguca

SEQ ID NO: 3283346 - RNA, 12 nt, Variola virus
uuaauauguaua

SEQ ID NO: 3283347 - RNA, 15 nt, Variola virus
aaaacgauuaaacaa

SEQ ID NO: 3283348 - RNA, 20 nt, Variola virus
aauccagucuuuaaugaauu

SEQ ID NO: 3283349 - RNA, 16 nt, Variola virus
auuaacaagucauuua

SEQ ID NO: 3283350 - RNA, 17 nt, Variola virus
agcacuguggaugugac

SEQ ID NO: 3283351 - RNA, 16 nt, Variola virus
caauaagcauuaugau

SEQ ID NO: 3283352 - RNA, 15 nt, Variola virus
uaauauuuuauuaca

SEQ ID NO: 3283353 - RNA, 16 nt, Variola virus
auaucgauguuaauaa

SEQ ID NO: 3283354 - RNA, 20 nt, Variola virus
gucuauccauuguuucacau

SEQ ID NO: 3283355 - RNA, 17 nt, Variola virus
gccaaucuauaauagau

SEQ ID NO: 3283356 - RNA, 13 nt, Variola virus
aacauuagaauua

SEQ ID NO: 3283357 - RNA, 21 nt, Variola virus
agacacauaugcgaucagaua

SEQ ID NO: 3283358 - RNA, 12 nt, Variola virus
uggaauauacau

SEQ ID NO: 3283359 - RNA, 23 nt, Variola virus
auguuuggaaugacgaauccugu

SEQ ID NO: 3283360 - RNA, 17 nt, Variola virus
aaaggugacacauguac

SEQ ID NO: 3283361 - RNA, 17 nt, Variola virus
auuuaagugaugcauuc

SEQ ID NO: 3283362 - RNA, 18 nt, Variola virus
caauuaguuaauaaugau

SEQ ID NO: 3283363 - RNA, 17 nt, Variola virus
auaauaaaaguuaucca

SEQ ID NO: 3283364 - RNA, 18 nt, Variola virus
aaagggauauauauugca

SEQ ID NO: 3283365 - RNA, 20 nt, Variola virus
uaagacacagaaauacugua

SEQ ID NO: 3283366 - RNA, 16 nt, Variola virus
auugugauaaauguuc

SEQ ID NO: 3283367 - RNA, 13 nt, Variola virus
acacuucuagaua

SEQ ID NO: 3283368 - RNA, 14 nt, Variola virus
cuucuacauuuuca

SEQ ID NO: 3283369 - RNA, 13 nt, Variola virus
auguuuucacaau

SEQ ID NO: 3283370 - RNA, 22 nt, Variola virus
gauaaguuucggcacauauuaa

SEQ ID NO: 3283371 - RNA, 21 nt, Variola virus
gaugaucuaguuacaacuauu

SEQ ID NO: 3283372 - RNA, 14 nt, Variola virus
auagagaacauaau

SEQ ID NO: 3283373 - RNA, 11 nt, Variola virus
ggaaacuauaa

SEQ ID NO: 3283374 - RNA, 18 nt, Variola virus
aagaagagaauuaaaaga

SEQ ID NO: 3283375 - RNA, 14 nt, Variola virus
caaacaauguuucu

SEQ ID NO: 3283376 - RNA, 13 nt, Variola virus
uaccuuaaucaug

SEQ ID NO: 3283377 - RNA, 19 nt, Variola virus
uacuaaauucaauaucuuu

SEQ ID NO: 3283378 - RNA, 18 nt, Variola virus
aauacauuaucaugcuug

SEQ ID NO: 3283379 - RNA, 20 nt, Variola virus
aaucugauagaaagaauaag

SEQ ID NO: 3283380 - RNA, 17 nt, Variola virus
guuucaaaaauauucau

SEQ ID NO: 3283381 - RNA, 15 nt, Variola virus
uagaugauauuguaa

SEQ ID NO: 3283382 - RNA, 14 nt, Variola virus
auaucuuguucuau

SEQ ID NO: 3283383 - RNA, 24 nt, Variola virus
guaucgcuggaagggacuauauga

SEQ ID NO: 3283384 - RNA, 22 nt, Variola virus
uccaggaucguuucuacaaaau

SEQ ID NO: 3283385 - RNA, 16 nt, Variola virus
gaauuguuucuuuuag

SEQ ID NO: 3283386 - RNA, 15 nt, Variola virus
auaaguaaaugaaaa

SEQ ID NO: 3283387 - RNA, 23 nt, Variola virus
augauucuaucuacaucuucaau

SEQ ID NO: 3283388 - RNA, 15 nt, Variola virus
cgauauuaguacaga

SEQ ID NO: 3283389 - RNA, 17 nt, Variola virus
caggauaaggaauugua

SEQ ID NO: 3283390 - RNA, 12 nt, Variola virus
acaaguuuucau

SEQ ID NO: 3283391 - RNA, 19 nt, Variola virus
aauaauuguuauuauuuca

SEQ ID NO: 3283392 - RNA, 14 nt, Variola virus
auacaaauuuuacu

SEQ ID NO: 3283393 - RNA, 15 nt, Variola virus
ugaauggauuuauca

SEQ ID NO: 3283394 - RNA, 23 nt, Variola virus
gucgcaacgggguaguucguaga

SEQ ID NO: 3283395 - RNA, 17 nt, Variola virus
ugaugacacuagaugau

SEQ ID NO: 3283396 - RNA, 16 nt, Variola virus
ucuuauccauuuauaa

SEQ ID NO: 3283397 - RNA, 15 nt, Variola virus
cuaauagacggcauu

SEQ ID NO: 3283398 - RNA, 16 nt, Variola virus
uagauacaacgucauc

SEQ ID NO: 3283399 - RNA, 19 nt, Variola virus
gcaaaucacucaauaucua

SEQ ID NO: 3283400 - RNA, 21 nt, Variola virus
ucuagugcuuguauguguuau

SEQ ID NO: 3283401 - RNA, 23 nt, Variola virus
auuaaagagauaguuuuuuucau

SEQ ID NO: 3283402 - RNA, 18 nt, Variola virus
auacuuuaaagcaaaaug

SEQ ID NO: 3283403 - RNA, 21 nt, Variola virus
aaacuauuacuaggagaauua

SEQ ID NO: 3283404 - RNA, 17 nt, Variola virus
aucuucauaauaaauaa

SEQ ID NO: 3283405 - RNA, 14 nt, Variola virus
caugaccuucuuca

SEQ ID NO: 3283406 - RNA, 22 nt, Variola virus
gaauaauaugacucaugaucua

SEQ ID NO: 3283407 - RNA, 22 nt, Variola virus
gucuacauucuugacuguuuua

SEQ ID NO: 3283408 - RNA, 21 nt, Variola virus
auccaaguuaaaggauauuau

SEQ ID NO: 3283409 - RNA, 17 nt, Variola virus
gaaugggugucaucuau

SEQ ID NO: 3283410 - RNA, 20 nt, Variola virus
guaacaacuaacgauaaaaa

SEQ ID NO: 3283411 - RNA, 22 nt, Variola virus
uagccaugggaacaguaaugau

SEQ ID NO: 3283412 - RNA, 13 nt, Variola virus
cuguuagaugagg

SEQ ID NO: 3283413 - RNA, 17 nt, Variola virus
gcuauaacuugcuucaa

SEQ ID NO: 3283414 - RNA, 18 nt, Variola virus
gcucaaagucgaauuaga

SEQ ID NO: 3283415 - RNA, 16 nt, Variola virus
auucagacacuucuua

SEQ ID NO: 3283416 - RNA, 15 nt, Variola virus
aaaguuucacaugaa

SEQ ID NO: 3283417 - RNA, 22 nt, Variola virus
aaagacuuucguuaauuugucu

SEQ ID NO: 3283418 - RNA, 19 nt, Variola virus
agauuuugacuuacauaaa

SEQ ID NO: 3283419 - RNA, 21 nt, Variola virus
uauuauguuaacggaaaguau

SEQ ID NO: 3283420 - RNA, 12 nt, Variola virus
aaauaauaauau

SEQ ID NO: 3283421 - RNA, 16 nt, Variola virus
uuagcaauuucugauu

SEQ ID NO: 3283422 - RNA, 16 nt, Variola virus
aucuuaccaucuucuu

SEQ ID NO: 3283423 - RNA, 13 nt, Variola virus
uagauuuaucuag

SEQ ID NO: 3283424 - RNA, 20 nt, Variola virus
guaauguucucgaugaugau

SEQ ID NO: 3283425 - RNA, 20 nt, Variola virus
auuaaacuaauucauuuuca

SEQ ID NO: 3283426 - RNA, 12 nt, Variola virus
cacuaucuucug

SEQ ID NO: 3283427 - RNA, 14 nt, Variola virus
aagggaaaaugcua

SEQ ID NO: 3283428 - RNA, 20 nt, Variola virus
uuaacauuuuggcaaauuga

SEQ ID NO: 3283429 - RNA, 19 nt, Variola virus
cugcuccagaauuaauaau

SEQ ID NO: 3283430 - RNA, 14 nt, Variola virus
aaaauucauuagaa

SEQ ID NO: 3283431 - RNA, 14 nt, Variola virus
augaguuagauuac

SEQ ID NO: 3283432 - RNA, 21 nt, Variola virus
uuauacgaaaaaaaucauuaa

SEQ ID NO: 3283433 - RNA, 13 nt, Variola virus
aucauuucucaau

SEQ ID NO: 3283434 - RNA, 16 nt, Variola virus
aguuccucaacgugau

SEQ ID NO: 3283435 - RNA, 22 nt, Variola virus
ugaaucaaauguaacuauucaa

SEQ ID NO: 3283436 - RNA, 22 nt, Variola virus
agaaugcagaaaugauuuugga

SEQ ID NO: 3283437 - RNA, 22 nt, Variola virus
aauuaauuuuuccuuacacaau

SEQ ID NO: 3283438 - RNA, 16 nt, Variola virus
uucuauaauaaacuuu

SEQ ID NO: 3283439 - RNA, 19 nt, Variola virus
agauuucaacagacuguuu

SEQ ID NO: 3283440 - RNA, 22 nt, Variola virus
aauaugcuaguuaauaguaaau

SEQ ID NO: 3283441 - RNA, 16 nt, Variola virus
cuaucuucaucauauu

SEQ ID NO: 3283442 - RNA, 20 nt, Variola virus
uaauacccugguagaagaau

SEQ ID NO: 3283443 - RNA, 21 nt, Variola virus
uuuacaaauugggaucaucca

SEQ ID NO: 3283444 - RNA, 11 nt, Variola virus
gacaugaugau

SEQ ID NO: 3283445 - RNA, 20 nt, Variola virus
aguauugucaucaucaugau

SEQ ID NO: 3283446 - RNA, 15 nt, Variola virus
ucauccaugguuuua

SEQ ID NO: 3283447 - RNA, 16 nt, Variola virus
aauugaaucuuaguaa

SEQ ID NO: 3283448 - RNA, 14 nt, Variola virus
aguggaguaauuua

SEQ ID NO: 3283449 - RNA, 14 nt, Variola virus
agaaugaauguuua

SEQ ID NO: 3283450 - RNA, 15 nt, Variola virus
gcugacuauaacaga

SEQ ID NO: 3283451 - RNA, 17 nt, Variola virus
augucaucgaaauggua

SEQ ID NO: 3283452 - RNA, 16 nt, Variola virus
aacucuugaagaugau

SEQ ID NO: 3283453 - RNA, 16 nt, Variola virus
cuuauucuuaaaaucu

SEQ ID NO: 3283454 - RNA, 16 nt, Variola virus
uauaacuucuaaucuu

SEQ ID NO: 3283455 - RNA, 12 nt, Variola virus
gcucuacaaaau

SEQ ID NO: 3283456 - RNA, 21 nt, Variola virus
gugauaccgauagugauuuug

SEQ ID NO: 3283457 - RNA, 15 nt, Variola virus
aauacuuaguuucca

SEQ ID NO: 3283458 - RNA, 15 nt, Variola virus
aaauauaaaauauau

SEQ ID NO: 3283459 - RNA, 19 nt, Variola virus
gccgguugccgcaaauaga

SEQ ID NO: 3283460 - RNA, 15 nt, Variola virus
aaaguuuuauaugua

SEQ ID NO: 3283461 - RNA, 18 nt, Variola virus
uuugauagggacaaagua

SEQ ID NO: 3283462 - RNA, 13 nt, Variola virus
uuacuauuacuag

SEQ ID NO: 3283463 - RNA, 21 nt, Variola virus
uuacugggauaagauuucuaa

SEQ ID NO: 3283464 - RNA, 14 nt, Variola virus
auauggauuuccag

SEQ ID NO: 3283465 - RNA, 18 nt, Variola virus
ccggaguaauugauuaua

SEQ ID NO: 3283466 - RNA, 15 nt, Variola virus
uuugcuuuuucuauu

SEQ ID NO: 3283467 - RNA, 20 nt, Variola virus
uauaagauuaucaaaaucuu

SEQ ID NO: 3283468 - RNA, 14 nt, Variola virus
ucaacaucuuuaau

SEQ ID NO: 3283469 - RNA, 21 nt, Variola virus
gauucucgauagagaugagau

SEQ ID NO: 3283470 - RNA, 17 nt, Variola virus
auaguuaucuaucuuaa

SEQ ID NO: 3283471 - RNA, 16 nt, Variola virus
gcacauguauaauaua

SEQ ID NO: 3283472 - RNA, 15 nt, Variola virus
uguuuguucauugga

SEQ ID NO: 3283473 - RNA, 19 nt, Variola virus
gaauaucacauaucauguu

SEQ ID NO: 3283474 - RNA, 18 nt, Variola virus
uauauauuagauacaguu

SEQ ID NO: 3283475 - RNA, 18 nt, Variola virus
gauuguuuaagaagagaa

SEQ ID NO: 3283476 - RNA, 21 nt, Variola virus
acaauuagaacagggaauuac

SEQ ID NO: 3283477 - RNA, 20 nt, Variola virus
aucauccaauauuauugaaa

SEQ ID NO: 3283478 - RNA, 15 nt, Variola virus
uuuaugcuucguaaa

SEQ ID NO: 3283479 - RNA, 17 nt, Variola virus
ucuuuaauagugucauu

SEQ ID NO: 3283480 - RNA, 18 nt, Variola virus
aaucauccuaagaugaua

SEQ ID NO: 3283481 - RNA, 20 nt, Variola virus
gaggaaguauaaaaauuaaa

SEQ ID NO: 3283482 - RNA, 17 nt, Variola virus
auuaaugcuacagauau

SEQ ID NO: 3283483 - RNA, 17 nt, Variola virus
gauucuaguaucuuuug

SEQ ID NO: 3283484 - RNA, 17 nt, Variola virus
uuaguaacucuaguaaa

SEQ ID NO: 3283485 - RNA, 15 nt, Variola virus
aucuauguuuaacuu

SEQ ID NO: 3283486 - RNA, 19 nt, Variola virus
uugacguaugcaguuacau

SEQ ID NO: 3283487 - RNA, 21 nt, Variola virus
gacucgcguuuagaggaguga

SEQ ID NO: 3283488 - RNA, 23 nt, Variola virus
agauaaauuuaucaauaaaugug

SEQ ID NO: 3283489 - RNA, 16 nt, Variola virus
acaaaagaguuaaguu

SEQ ID NO: 3283490 - RNA, 17 nt, Variola virus
auugauuacuauaaaug

SEQ ID NO: 3283491 - RNA, 17 nt, Variola virus
agcuugauaauuagaua

SEQ ID NO: 3283492 - RNA, 17 nt, Variola virus
acaugucucucucaaau

SEQ ID NO: 3283493 - RNA, 16 nt, Variola virus
acucaaacuaaauguc

SEQ ID NO: 3283494 - RNA, 15 nt, Variola virus
gaaucuaaugaugac

SEQ ID NO: 3283495 - RNA, 14 nt, Variola virus
aacgccuuuagaaa

SEQ ID NO: 3283496 - RNA, 16 nt, Variola virus
aaggagauauugaaac

SEQ ID NO: 3283497 - RNA, 14 nt, Variola virus
aaaugguguaacuc

SEQ ID NO: 3283498 - RNA, 23 nt, Variola virus
auaacucaauuaguuauugccaa

SEQ ID NO: 3283499 - RNA, 16 nt, Variola virus
aaccgacauuaccauc

SEQ ID NO: 3283500 - RNA, 17 nt, Variola virus
uaacuaucuuucaagau

SEQ ID NO: 3283501 - RNA, 22 nt, Variola virus
aguuucuugcguuuaauaaaca

SEQ ID NO: 3283502 - RNA, 21 nt, Variola virus
auacacaugauugacaaauua

SEQ ID NO: 3283503 - RNA, 16 nt, Variola virus
uugauguuacauuaua

SEQ ID NO: 3283504 - RNA, 15 nt, Variola virus
aauugcgguaucuau

SEQ ID NO: 3283505 - RNA, 17 nt, Variola virus
caauaauauuaugucua

SEQ ID NO: 3283506 - RNA, 20 nt, Variola virus
ggaucuccaucauccacaug

SEQ ID NO: 3283507 - RNA, 17 nt, Variola virus
cauuuaaauaucauaau

SEQ ID NO: 3283508 - RNA, 17 nt, Variola virus
uuuauaugguguuucua

SEQ ID NO: 3283509 - RNA, 22 nt, Variola virus
ugagaucccacaucauuucaac

SEQ ID NO: 3283510 - RNA, 18 nt, Variola virus
agcaagauuuuuaaacaa

SEQ ID NO: 3283511 - RNA, 17 nt, Variola virus
acagaucaaaaaauaua

SEQ ID NO: 3283512 - RNA, 12 nt, Variola virus
gacguaaaugug

SEQ ID NO: 3283513 - RNA, 14 nt, Variola virus
caacuuuuaaauac

SEQ ID NO: 3283514 - RNA, 23 nt, Variola virus
uuuucgguacucagauucaguuu

SEQ ID NO: 3283515 - RNA, 19 nt, Variola virus
auuguugccguaaauccug

SEQ ID NO: 3283516 - RNA, 19 nt, Variola virus
aaugaacaucggaaauaua

SEQ ID NO: 3283517 - RNA, 13 nt, Variola virus
aauuuuaaaugau

SEQ ID NO: 3283518 - RNA, 20 nt, Variola virus
cgaauaauguauagcauugc

SEQ ID NO: 3283519 - RNA, 16 nt, Variola virus
uauccaauacagaaug

SEQ ID NO: 3283520 - RNA, 22 nt, Variola virus
uuaauaaauccggaacuguaaa

SEQ ID NO: 3283521 - RNA, 14 nt, Variola virus
uacaugaaggacuu

SEQ ID NO: 3283522 - RNA, 17 nt, Variola virus
ucugauacaacaauaua

SEQ ID NO: 3283523 - RNA, 21 nt, Variola virus
agauaaagaguccuauauauu

SEQ ID NO: 3283524 - RNA, 13 nt, Variola virus
aucugaucuuguu

SEQ ID NO: 3283525 - RNA, 15 nt, Variola virus
ucucaauacaaccaa

SEQ ID NO: 3283526 - RNA, 13 nt, Variola virus
aguaucaaacucu

SEQ ID NO: 3283527 - RNA, 15 nt, Variola virus
aucugaugaauaauu

SEQ ID NO: 3283528 - RNA, 19 nt, Variola virus
augaacuagacaauaaugu

SEQ ID NO: 3283529 - RNA, 16 nt, Variola virus
uccuauccuuguacaa

SEQ ID NO: 3283530 - RNA, 14 nt, Variola virus
gauccuuuaagaga

SEQ ID NO: 3283531 - RNA, 16 nt, Variola virus
auacacauuuaauaaa

SEQ ID NO: 3283532 - RNA, 12 nt, Variola virus
ucuauguaucua

SEQ ID NO: 3283533 - RNA, 14 nt, Variola virus
ucccacaaauacug

SEQ ID NO: 3283534 - RNA, 20 nt, Variola virus
gaauccauuuucccaaauau

SEQ ID NO: 3283535 - RNA, 23 nt, Variola virus
gaaaguauuuuuguguuaaaaca

SEQ ID NO: 3283536 - RNA, 13 nt, Variola virus
cuuaguaacucua

SEQ ID NO: 3283537 - RNA, 14 nt, Variola virus
gauacuauaaugaa

SEQ ID NO: 3283538 - RNA, 13 nt, Variola virus
gaaucacaaacau

SEQ ID NO: 3283539 - RNA, 14 nt, Variola virus
cagaggaaauauca

SEQ ID NO: 3283540 - RNA, 12 nt, Variola virus
acaacaaaugau

SEQ ID NO: 3283541 - RNA, 15 nt, Variola virus
uuuuuggauuucaua

SEQ ID NO: 3283542 - RNA, 18 nt, Variola virus
aauggauauucgaacauu

SEQ ID NO: 3283543 - RNA, 18 nt, Variola virus
uuugauaaaucucuucuu

SEQ ID NO: 3283544 - RNA, 14 nt, Variola virus
ucucauguucuuaa

SEQ ID NO: 3283545 - RNA, 15 nt, Variola virus
ucucgucguccaaua

SEQ ID NO: 3283546 - RNA, 16 nt, Variola virus
aucuucauuaucugau

SEQ ID NO: 3283547 - RNA, 20 nt, Variola virus
caaaugauauaagacuaaca

SEQ ID NO: 3283548 - RNA, 21 nt, Variola virus
aauuauuccuaauuaagaaaa

SEQ ID NO: 3283549 - RNA, 19 nt, Variola virus
uaaauguuuaaacaucaaa

SEQ ID NO: 3283550 - RNA, 16 nt, Variola virus
uaaauuuuacaaaucu

SEQ ID NO: 3283551 - RNA, 20 nt, Variola virus
auucaaaaaggaauuuacca

SEQ ID NO: 3283552 - RNA, 11 nt, Variola virus
gguguauauaa

SEQ ID NO: 3283553 - RNA, 22 nt, Variola virus
uagaauguugagcuaauuuuug

SEQ ID NO: 3283554 - RNA, 23 nt, Variola virus
augauucauuuuuuaaguauuug

SEQ ID NO: 3283555 - RNA, 20 nt, Variola virus
agguaagauaucuacuagaa

SEQ ID NO: 3283556 - RNA, 12 nt, Variola virus
aacacagccaua

SEQ ID NO: 3283557 - RNA, 14 nt, Variola virus
ucguauaaauacug

SEQ ID NO: 3283558 - RNA, 23 nt, Variola virus
agaaaacucguuauuaacuaugu

SEQ ID NO: 3283559 - RNA, 14 nt, Variola virus
auauacagucuuaa

SEQ ID NO: 3283560 - RNA, 15 nt, Variola virus
uaauacgaguuauau

SEQ ID NO: 3283561 - RNA, 19 nt, Variola virus
aaugucuauuauaaagaua

SEQ ID NO: 3283562 - RNA, 15 nt, Variola virus
aauaaauaacaaugg

SEQ ID NO: 3283563 - RNA, 23 nt, Variola virus
aauacguccaucagcauuguuuc

SEQ ID NO: 3283564 - RNA, 14 nt, Variola virus
uuacucuucuaaau

SEQ ID NO: 3283565 - RNA, 16 nt, Variola virus
uugagcaguugaugca

SEQ ID NO: 3283566 - RNA, 20 nt, Variola virus
aguuaaauucauauaaagua

SEQ ID NO: 3283567 - RNA, 20 nt, Variola virus
aaucuagccauugucuuaua

SEQ ID NO: 3283568 - RNA, 20 nt, Variola virus
aaccucacuguuaaaaauau

SEQ ID NO: 3283569 - RNA, 19 nt, Variola virus
cuauaugacuguauuugga

SEQ ID NO: 3283570 - RNA, 16 nt, Variola virus
agaauuuauauaaauu

SEQ ID NO: 3283571 - RNA, 23 nt, Variola virus
ucaacaaugucugucauauguau

SEQ ID NO: 3283572 - RNA, 20 nt, Variola virus
uaguaauuaaauauaucaug

SEQ ID NO: 3283573 - RNA, 15 nt, Variola virus
augacucucaaauua

SEQ ID NO: 3283574 - RNA, 17 nt, Variola virus
cauuuuacuuuaacaau

SEQ ID NO: 3283575 - RNA, 20 nt, Variola virus
aacucaguuaacauacagga

SEQ ID NO: 3283576 - RNA, 17 nt, Variola virus
uagaaacuucaaagauu

SEQ ID NO: 3283577 - RNA, 16 nt, Variola virus
auauccuccuguagau

SEQ ID NO: 3283578 - RNA, 15 nt, Variola virus
uaacguuaaacauua

SEQ ID NO: 3283579 - RNA, 14 nt, Variola virus
uguaauaguuucca

SEQ ID NO: 3283580 - RNA, 18 nt, Variola virus
acugcuuuaggugcugaa

SEQ ID NO: 3283581 - RNA, 23 nt, Variola virus
ugauucuguagaugccauaucau

SEQ ID NO: 3283582 - RNA, 17 nt, Variola virus
gaugaggaagcauauuc

SEQ ID NO: 3283583 - RNA, 14 nt, Variola virus
agcuacucuagauu

SEQ ID NO: 3283584 - RNA, 21 nt, Variola virus
cuugcuagacaccuuuucaau

SEQ ID NO: 3283585 - RNA, 22 nt, Variola virus
guguuccggagaaucaguaaag

SEQ ID NO: 3283586 - RNA, 23 nt, Variola virus
uccauagacagcuucuagaaguu

SEQ ID NO: 3283587 - RNA, 15 nt, Variola virus
agaugaugcaaauaa

SEQ ID NO: 3283588 - RNA, 14 nt, Variola virus
gcuaauauauugau

SEQ ID NO: 3283589 - RNA, 17 nt, Variola virus
accaagaaaucguauau

SEQ ID NO: 3283590 - RNA, 19 nt, Variola virus
aguguauguggaaauguua

SEQ ID NO: 3283591 - RNA, 13 nt, Variola virus
uaacauguuaauu

SEQ ID NO: 3283592 - RNA, 18 nt, Variola virus
acguuguacguuaaagca

SEQ ID NO: 3283593 - RNA, 16 nt, Variola virus
agacacuaacucuguu

SEQ ID NO: 3283594 - RNA, 11 nt, Variola virus
aaccaaaucaa

SEQ ID NO: 3283595 - RNA, 18 nt, Variola virus
agccgcuggguuguaaac

SEQ ID NO: 3283596 - RNA, 14 nt, Variola virus
uugaaucuauuucu

SEQ ID NO: 3283597 - RNA, 21 nt, Variola virus
auguauuugagagucuuauau

SEQ ID NO: 3283598 - RNA, 19 nt, Variola virus
uauugugucuguuaauaga

SEQ ID NO: 3283599 - RNA, 20 nt, Variola virus
ucaucggacuuugugcauau

SEQ ID NO: 3283600 - RNA, 22 nt, Variola virus
auggagaagguuucgauuaucu

SEQ ID NO: 3283601 - RNA, 20 nt, Variola virus
aauauauacuucaauugaua

SEQ ID NO: 3283602 - RNA, 19 nt, Variola virus
auaaucggguucugcuuca

SEQ ID NO: 3283603 - RNA, 18 nt, Variola virus
auuuugacuuacauaaau

SEQ ID NO: 3283604 - RNA, 14 nt, Variola virus
aaguauauguagga

SEQ ID NO: 3283605 - RNA, 21 nt, Variola virus
uaguuuuuuuagaaaauucua

SEQ ID NO: 3283606 - RNA, 19 nt, Variola virus
acuuuaaagcaaaaugguu

SEQ ID NO: 3283607 - RNA, 14 nt, Variola virus
acuauagacauaau

SEQ ID NO: 3283608 - RNA, 16 nt, Variola virus
auuaauaaaaauaauu

SEQ ID NO: 3283609 - RNA, 18 nt, Variola virus
uaguauuuauacuacuaa

SEQ ID NO: 3283610 - RNA, 18 nt, Variola virus
uaaaucuauuauauuuua

SEQ ID NO: 3283611 - RNA, 19 nt, Variola virus
agauucauguuaacacucu

SEQ ID NO: 3283612 - RNA, 20 nt, Variola virus
uaguagucuaccgaucucuu

SEQ ID NO: 3283613 - RNA, 23 nt, Variola virus
gcguuccuugugcuuaauguuuc

SEQ ID NO: 3283614 - RNA, 17 nt, Variola virus
ugaauaccauuaaacaa

SEQ ID NO: 3283615 - RNA, 21 nt, Variola virus
guccgauaacguuagccacca

SEQ ID NO: 3283616 - RNA, 17 nt, Variola virus
uguuauuguauacuguc

SEQ ID NO: 3283617 - RNA, 14 nt, Variola virus
cgcagaaaauaucu

SEQ ID NO: 3283618 - RNA, 23 nt, Variola virus
guguauacaccaacuguaugaaa

SEQ ID NO: 3283619 - RNA, 18 nt, Variola virus
uaaauuauauauggauuu

SEQ ID NO: 3283620 - RNA, 15 nt, Variola virus
ugcgacacuauucau

SEQ ID NO: 3283621 - RNA, 15 nt, Variola virus
aaauauaauaaugau

SEQ ID NO: 3283622 - RNA, 20 nt, Variola virus
auugacuaauaaauuaaaua

SEQ ID NO: 3283623 - RNA, 16 nt, Variola virus
auuauaucguuaucau

SEQ ID NO: 3283624 - RNA, 22 nt, Variola virus
cauuggauuggauaauaauaca

SEQ ID NO: 3283625 - RNA, 13 nt, Variola virus
gaauaauguuucu

SEQ ID NO: 3283626 - RNA, 23 nt, Variola virus
ucugaaauaacguauuuaaacaa

SEQ ID NO: 3283627 - RNA, 18 nt, Variola virus
gauaaauaguaucaucua

SEQ ID NO: 3283628 - RNA, 15 nt, Variola virus
cagacuacuuuccua

SEQ ID NO: 3283629 - RNA, 17 nt, Variola virus
gcaaugcgcuggacagu

SEQ ID NO: 3283630 - RNA, 14 nt, Variola virus
uacugucuuuugug

SEQ ID NO: 3283631 - RNA, 12 nt, Variola virus
aaaaaaauaaua

SEQ ID NO: 3283632 - RNA, 17 nt, Variola virus
agauccacugagaugac

SEQ ID NO: 3283633 - RNA, 15 nt, Variola virus
gaauagauuacucau

SEQ ID NO: 3283634 - RNA, 19 nt, Variola virus
gacaucuggauuucagaua

SEQ ID NO: 3283635 - RNA, 17 nt, Variola virus
uaaaaucacugaacauu

SEQ ID NO: 3283636 - RNA, 16 nt, Variola virus
aaguaaagaaaagaua

SEQ ID NO: 3283637 - RNA, 16 nt, Variola virus
aggugcugauguaaau

SEQ ID NO: 3283638 - RNA, 13 nt, Variola virus
gaaacugauacaa

SEQ ID NO: 3283639 - RNA, 18 nt, Variola virus
gauaauauccugaacagc

SEQ ID NO: 3283640 - RNA, 16 nt, Variola virus
cagaugucaugauauu

SEQ ID NO: 3283641 - RNA, 14 nt, Variola virus
uuaaauaucauaau

SEQ ID NO: 3283642 - RNA, 15 nt, Variola virus
acaucuuuccuacau

SEQ ID NO: 3283643 - RNA, 14 nt, Variola virus
ccaucuuacaugau

SEQ ID NO: 3283644 - RNA, 11 nt, Variola virus
aauuaaugaaa

SEQ ID NO: 3283645 - RNA, 21 nt, Variola virus
uuacauuuguauaaucuuuaa

SEQ ID NO: 3283646 - RNA, 22 nt, Variola virus
auccuuauauuuguuaacuaca

SEQ ID NO: 3283647 - RNA, 13 nt, Variola virus
gaaucugugaaau

SEQ ID NO: 3283648 - RNA, 19 nt, Variola virus
augguuuuuauauguguuu

SEQ ID NO: 3283649 - RNA, 18 nt, Variola virus
auuaacuucguuauuuau

SEQ ID NO: 3283650 - RNA, 12 nt, Variola virus
uagacauaucug

SEQ ID NO: 3283651 - RNA, 19 nt, Variola virus
guugaucuucaaauuccac

SEQ ID NO: 3283652 - RNA, 13 nt, Variola virus
caucgucaucaag

SEQ ID NO: 3283653 - RNA, 14 nt, Variola virus
uucagaaauuauuc

SEQ ID NO: 3283654 - RNA, 18 nt, Variola virus
aacauaaauaauucuaga

SEQ ID NO: 3283655 - RNA, 12 nt, Variola virus
uaaauagaauau

SEQ ID NO: 3283656 - RNA, 15 nt, Variola virus
uaaugauagaauuau

SEQ ID NO: 3283657 - RNA, 20 nt, Variola virus
aaauuauaucuaguggauua

SEQ ID NO: 3283658 - RNA, 13 nt, Variola virus
ucuacauuuugcu

SEQ ID NO: 3283659 - RNA, 20 nt, Variola virus
cuaguguuccuaauaucaua

SEQ ID NO: 3283660 - RNA, 16 nt, Variola virus
acuacaacuagugaag

SEQ ID NO: 3283661 - RNA, 23 nt, Variola virus
uucaaccaugagugugaaacuaa

SEQ ID NO: 3283662 - RNA, 15 nt, Variola virus
aaaaaucgauuuuau

SEQ ID NO: 3283663 - RNA, 15 nt, Variola virus
uaaaggaugauacau

SEQ ID NO: 3283664 - RNA, 16 nt, Variola virus
uauuuugacauacuug

SEQ ID NO: 3283665 - RNA, 22 nt, Variola virus
aguacuguucauacaugaugag

SEQ ID NO: 3283666 - RNA, 14 nt, Variola virus
auaucucuaauaga

SEQ ID NO: 3283667 - RNA, 22 nt, Variola virus
gucuauacaagucgucuaaacg

SEQ ID NO: 3283668 - RNA, 15 nt, Variola virus
gaaaauauaaauuaa

SEQ ID NO: 3283669 - RNA, 18 nt, Variola virus
uguguacccaauaaaaug

SEQ ID NO: 3283670 - RNA, 21 nt, Variola virus
auacucuuuaaaguuucugaa

SEQ ID NO: 3283671 - RNA, 21 nt, Variola virus
agcugaggguguuaaaaauga

SEQ ID NO: 3283672 - RNA, 17 nt, Variola virus
agucauacguaaugaag

SEQ ID NO: 3283673 - RNA, 17 nt, Variola virus
cgauucaucuauacgau

SEQ ID NO: 3283674 - RNA, 23 nt, Variola virus
cuacgaaacugauacaaucucuu

SEQ ID NO: 3283675 - RNA, 18 nt, Variola virus
acaugucaucgaaauggu

SEQ ID NO: 3283676 - RNA, 13 nt, Variola virus
gcuaaugaugcag

SEQ ID NO: 3283677 - RNA, 21 nt, Variola virus
augguuuucuaaauagaauuc

SEQ ID NO: 3283678 - RNA, 22 nt, Variola virus
auguccaaaucuaguuguggaa

SEQ ID NO: 3283679 - RNA, 21 nt, Variola virus
ucaggacgaauaauucuaaua

SEQ ID NO: 3283680 - RNA, 21 nt, Variola virus
uauacuauauaguaauaccaa

SEQ ID NO: 3283681 - RNA, 14 nt, Variola virus
caguaauuaaugag

SEQ ID NO: 3283682 - RNA, 13 nt, Variola virus
auuggaauuauuu

SEQ ID NO: 3283683 - RNA, 15 nt, Variola virus
ucuuaauagacauau

SEQ ID NO: 3283684 - RNA, 19 nt, Variola virus
cuacaaaauguugauaauc

SEQ ID NO: 3283685 - RNA, 22 nt, Variola virus
acuacauaaucuucgucuggaa

SEQ ID NO: 3283686 - RNA, 17 nt, Variola virus
ucgaauacgauacuuau

SEQ ID NO: 3283687 - RNA, 18 nt, Variola virus
uuagacguaguucguaaa

SEQ ID NO: 3283688 - RNA, 19 nt, Variola virus
auuuuuacagcgacacuau

SEQ ID NO: 3283689 - RNA, 19 nt, Variola virus
uacccaaaucugaaaauaa

SEQ ID NO: 3283690 - RNA, 14 nt, Variola virus
aaugauuuagaaau

SEQ ID NO: 3283691 - RNA, 23 nt, Variola virus
caaauuuguuuuguuuauuaaca

SEQ ID NO: 3283692 - RNA, 18 nt, Variola virus
caauaaguuuuagauauu

SEQ ID NO: 3283693 - RNA, 23 nt, Variola virus
uacaaaauguugauaauccuuga

SEQ ID NO: 3283694 - RNA, 14 nt, Variola virus
aacuguuaaauguu

SEQ ID NO: 3283695 - RNA, 20 nt, Variola virus
caaauaauacuauauacaau

SEQ ID NO: 3283696 - RNA, 16 nt, Variola virus
uucuucagaauaauag

SEQ ID NO: 3283697 - RNA, 22 nt, Variola virus
caguggaucgguucagcauuua

SEQ ID NO: 3283698 - RNA, 17 nt, Variola virus
gagguagguauuacuuu

SEQ ID NO: 3283699 - RNA, 18 nt, Variola virus
uaucucauucaaauccau

SEQ ID NO: 3283700 - RNA, 13 nt, Variola virus
aaagguguguacu

SEQ ID NO: 3283701 - RNA, 12 nt, Variola virus
uaaucuauuuua

SEQ ID NO: 3283702 - RNA, 13 nt, Variola virus
caugaacauaauc

SEQ ID NO: 3283703 - RNA, 17 nt, Variola virus
aaaaugguaaacuuuug

SEQ ID NO: 3283704 - RNA, 21 nt, Variola virus
guuuaucuuuuuguuggaaaa

SEQ ID NO: 3283705 - RNA, 17 nt, Variola virus
auauucaacauguuuaa

SEQ ID NO: 3283706 - RNA, 14 nt, Variola virus
gaucagacaaauaa

SEQ ID NO: 3283707 - RNA, 16 nt, Variola virus
caacauuggaauaaua

SEQ ID NO: 3283708 - RNA, 15 nt, Variola virus
cuauaucuaacaucu

SEQ ID NO: 3283709 - RNA, 21 nt, Variola virus
uaacaacgacuuauaauuaau

SEQ ID NO: 3283710 - RNA, 20 nt, Variola virus
uuauggaucuauucaagaug

SEQ ID NO: 3283711 - RNA, 15 nt, Variola virus
augagcaaguagaaa

SEQ ID NO: 3283712 - RNA, 23 nt, Variola virus
cggaaaaucgucuucauaaagca

SEQ ID NO: 3283713 - RNA, 15 nt, Variola virus
uccuugcaaauuccg

SEQ ID NO: 3283714 - RNA, 15 nt, Variola virus
gaaucuaaacaaaau

SEQ ID NO: 3283715 - RNA, 15 nt, Variola virus
aacuuucaucuaaua

SEQ ID NO: 3283716 - RNA, 17 nt, Variola virus
uagaacagauuuaacaa

SEQ ID NO: 3283717 - RNA, 14 nt, Variola virus
uaugcucuagauac

SEQ ID NO: 3283718 - RNA, 19 nt, Variola virus
ucaaaguccggauguauua

SEQ ID NO: 3283719 - RNA, 12 nt, Variola virus
ggagaauguuuc

SEQ ID NO: 3283720 - RNA, 20 nt, Variola virus
acauaauuauucuaucaauu

SEQ ID NO: 3283721 - RNA, 13 nt, Variola virus
agguagcaaaaaa

SEQ ID NO: 3283722 - RNA, 21 nt, Variola virus
uuacauaaaaaaaauguaaua

SEQ ID NO: 3283723 - RNA, 16 nt, Variola virus
ucaucucuagauaugu

SEQ ID NO: 3283724 - RNA, 18 nt, Variola virus
auauaauuaucacauauu

SEQ ID NO: 3283725 - RNA, 20 nt, Variola virus
agccacuauagaguuucuaa

SEQ ID NO: 3283726 - RNA, 23 nt, Variola virus
aaaccuuugacuaguuguagaau

SEQ ID NO: 3283727 - RNA, 17 nt, Variola virus
uaugcacgaaauagcua

SEQ ID NO: 3283728 - RNA, 21 nt, Variola virus
acaaguuuaacaauaaaauua

SEQ ID NO: 3283729 - RNA, 23 nt, Variola virus
cauuguucgugauaguauguggu

SEQ ID NO: 3283730 - RNA, 17 nt, Variola virus
cacgaauauuacuaauu

SEQ ID NO: 3283731 - RNA, 16 nt, Variola virus
gaugaugcaacucuau

SEQ ID NO: 3283732 - RNA, 21 nt, Variola virus
aaauaguaaaugagagaucua

SEQ ID NO: 3283733 - RNA, 19 nt, Variola virus
aacuaaaugguauacacau

SEQ ID NO: 3283734 - RNA, 16 nt, Variola virus
auaguagguauggauc

SEQ ID NO: 3283735 - RNA, 22 nt, Variola virus
cuuccaaauaauauucucuuug

SEQ ID NO: 3283736 - RNA, 18 nt, Variola virus
aucagcacaugaagaaaa

SEQ ID NO: 3283737 - RNA, 16 nt, Variola virus
agaauacuauagacca

SEQ ID NO: 3283738 - RNA, 17 nt, Variola virus
aaaucuaacagauacaa

SEQ ID NO: 3283739 - RNA, 19 nt, Variola virus
uaauagacuauauaaaccg

SEQ ID NO: 3283740 - RNA, 15 nt, Variola virus
acuauuguacauuau

SEQ ID NO: 3283741 - RNA, 16 nt, Variola virus
uccaaaaacaauuuga

SEQ ID NO: 3283742 - RNA, 20 nt, Variola virus
ugauuccuaggucuacagaa

SEQ ID NO: 3283743 - RNA, 23 nt, Variola virus
auuucuuuaccacaggagaaugg

SEQ ID NO: 3283744 - RNA, 18 nt, Variola virus
auauguaaauauuaauaa

SEQ ID NO: 3283745 - RNA, 17 nt, Variola virus
aaugacuuagugauauc

SEQ ID NO: 3283746 - RNA, 11 nt, Variola virus
aauauucaugu

SEQ ID NO: 3283747 - RNA, 15 nt, Variola virus
caaaaguuaauaaca

SEQ ID NO: 3283748 - RNA, 17 nt, Variola virus
agaaucagcucuagcua

SEQ ID NO: 3283749 - RNA, 23 nt, Variola virus
cagauuguugccguaaauccugc

SEQ ID NO: 3283750 - RNA, 15 nt, Variola virus
cuugaaccaaacauu

SEQ ID NO: 3283751 - RNA, 18 nt, Variola virus
ccguuuuccccucucugu

SEQ ID NO: 3283752 - RNA, 16 nt, Variola virus
agaucccaaaucuucu

SEQ ID NO: 3283753 - RNA, 16 nt, Variola virus
cagguauacuguucag

SEQ ID NO: 3283754 - RNA, 21 nt, Variola virus
gacuaccuggcucauugauua

SEQ ID NO: 3283755 - RNA, 16 nt, Variola virus
acaaaauacuauauau

SEQ ID NO: 3283756 - RNA, 21 nt, Variola virus
aggaguucaguuuuauaugau

SEQ ID NO: 3283757 - RNA, 16 nt, Variola virus
aaaaguccuagaauua

SEQ ID NO: 3283758 - RNA, 18 nt, Variola virus
agacguaguucuaguaca

SEQ ID NO: 3283759 - RNA, 21 nt, Variola virus
augaauaccggaaucauagau

SEQ ID NO: 3283760 - RNA, 18 nt, Variola virus
uuuaagccaucuguauua

SEQ ID NO: 3283761 - RNA, 21 nt, Variola virus
uuaauaauuguuauuauuuca

SEQ ID NO: 3283762 - RNA, 16 nt, Variola virus
auugguagcugaaugu

SEQ ID NO: 3283763 - RNA, 13 nt, Variola virus
ucgauaauuauuu

SEQ ID NO: 3283764 - RNA, 15 nt, Variola virus
caugucuagaaagaa

SEQ ID NO: 3283765 - RNA, 14 nt, Variola virus
agaaaaaaugauuu

SEQ ID NO: 3283766 - RNA, 19 nt, Variola virus
acuucuguacuaguggcag

SEQ ID NO: 3283767 - RNA, 13 nt, Variola virus
cacugcagcauuu

SEQ ID NO: 3283768 - RNA, 22 nt, Variola virus
agaucugagaauggauaauucu

SEQ ID NO: 3283769 - RNA, 19 nt, Variola virus
auuaaaugauuguauuaac

SEQ ID NO: 3283770 - RNA, 18 nt, Variola virus
gaugaguuaauguauauu

SEQ ID NO: 3283771 - RNA, 19 nt, Variola virus
uauauggucuauauauaca

SEQ ID NO: 3283772 - RNA, 17 nt, Variola virus
auagaguauaagaaauu

SEQ ID NO: 3283773 - RNA, 17 nt, Variola virus
acuacguucauauucca

SEQ ID NO: 3283774 - RNA, 21 nt, Variola virus
auguaaccuacuagaaugaua

SEQ ID NO: 3283775 - RNA, 16 nt, Variola virus
auucacauaaaggaua

SEQ ID NO: 3283776 - RNA, 13 nt, Variola virus
agcggaugaaaaa

SEQ ID NO: 3283777 - RNA, 21 nt, Variola virus
caaaucugaaaauaaauaaug

SEQ ID NO: 3283778 - RNA, 13 nt, Variola virus
uuguacauuauua

SEQ ID NO: 3283779 - RNA, 17 nt, Variola virus
aguuagauacaaagaua

SEQ ID NO: 3283780 - RNA, 12 nt, Variola virus
auauaaagaaau

SEQ ID NO: 3283781 - RNA, 13 nt, Variola virus
cugcuuucuuuua

SEQ ID NO: 3283782 - RNA, 17 nt, Variola virus
aaucagaucugauaaua

SEQ ID NO: 3283783 - RNA, 15 nt, Variola virus
uucuauacauagaug

SEQ ID NO: 3283784 - RNA, 13 nt, Variola virus
caccaagaaagcu

SEQ ID NO: 3283785 - RNA, 20 nt, Variola virus
cauaucuccucuuccaucac

SEQ ID NO: 3283786 - RNA, 13 nt, Variola virus
auaguaaaaucua

SEQ ID NO: 3283787 - RNA, 17 nt, Variola virus
acgauauaaauugauua

SEQ ID NO: 3283788 - RNA, 14 nt, Variola virus
ugaauacauuauca

SEQ ID NO: 3283789 - RNA, 16 nt, Variola virus
ggaucuccuauuucuu

SEQ ID NO: 3283790 - RNA, 14 nt, Variola virus
ucuucuacauuauu

SEQ ID NO: 3283791 - RNA, 18 nt, Variola virus
auucuagcggcuagaaug

SEQ ID NO: 3283792 - RNA, 15 nt, Variola virus
acagcauuucuguca

SEQ ID NO: 3283793 - RNA, 21 nt, Variola virus
uagaucugauacaccuguaau

SEQ ID NO: 3283794 - RNA, 14 nt, Variola virus
uaaggaguugaaau

SEQ ID NO: 3283795 - RNA, 20 nt, Variola virus
uauuaauuaauuaauuaaac

SEQ ID NO: 3283796 - RNA, 14 nt, Variola virus
gaauaucuacaaua

SEQ ID NO: 3283797 - RNA, 18 nt, Variola virus
gucguguuuuauuaauca

SEQ ID NO: 3283798 - RNA, 21 nt, Variola virus
aucuauaauuugugaguuuuc

SEQ ID NO: 3283799 - RNA, 20 nt, Variola virus
aucuuauguuuuuaagagau

SEQ ID NO: 3283800 - RNA, 24 nt, Variola virus
cauccaugagauugaaugccauuu

SEQ ID NO: 3283801 - RNA, 15 nt, Variola virus
ccuauucccaacaau

SEQ ID NO: 3283802 - RNA, 13 nt, Variola virus
uucacaaauacua

SEQ ID NO: 3283803 - RNA, 12 nt, Variola virus
aucaaaaaauuu

SEQ ID NO: 3283804 - RNA, 12 nt, Variola virus
ucuauuuggauu

SEQ ID NO: 3283805 - RNA, 18 nt, Variola virus
auauucucuauuuuggug

SEQ ID NO: 3283806 - RNA, 20 nt, Variola virus
gacaagauauauauacucua

SEQ ID NO: 3283807 - RNA, 16 nt, Variola virus
cuaggugcuauggaug

SEQ ID NO: 3283808 - RNA, 15 nt, Variola virus
aucacaaaaaaaacu

SEQ ID NO: 3283809 - RNA, 15 nt, Variola virus
ucaaacucgauauau

SEQ ID NO: 3283810 - RNA, 15 nt, Variola virus
aucaaccacauaaua

SEQ ID NO: 3283811 - RNA, 21 nt, Variola virus
cuuuauaauuucaucuacaau

SEQ ID NO: 3283812 - RNA, 16 nt, Variola virus
uacaucuguuuccuau

SEQ ID NO: 3283813 - RNA, 22 nt, Variola virus
auuaguguauacaccaacugua

SEQ ID NO: 3283814 - RNA, 20 nt, Variola virus
gauaaugauacgauacuaua

SEQ ID NO: 3283815 - RNA, 17 nt, Variola virus
guaacucugauaaucuc

SEQ ID NO: 3283816 - RNA, 16 nt, Variola virus
agacguugccaaaaaa

SEQ ID NO: 3283817 - RNA, 16 nt, Variola virus
aagucugucaaaucau

SEQ ID NO: 3283818 - RNA, 12 nt, Variola virus
auuuaucuuucu

SEQ ID NO: 3283819 - RNA, 16 nt, Variola virus
uuccacuauugccauc

SEQ ID NO: 3283820 - RNA, 23 nt, Variola virus
ggucgucgauaacaaauuaaaga

SEQ ID NO: 3283821 - RNA, 18 nt, Variola virus
acaaaucaaaaguauuaa

SEQ ID NO: 3283822 - RNA, 17 nt, Variola virus
ucauucaauauuuacaa

SEQ ID NO: 3283823 - RNA, 15 nt, Variola virus
cauucauaaaaacca

SEQ ID NO: 3283824 - RNA, 15 nt, Variola virus
cuauauuaacaucua

SEQ ID NO: 3283825 - RNA, 16 nt, Variola virus
caagauuuuuaaacaa

SEQ ID NO: 3283826 - RNA, 14 nt, Variola virus
ugauauauuuucca

SEQ ID NO: 3283827 - RNA, 17 nt, Variola virus
aaaugacuaauuuugua

SEQ ID NO: 3283828 - RNA, 16 nt, Variola virus
uuaaugcuacagauau

SEQ ID NO: 3283829 - RNA, 22 nt, Variola virus
cuagauacccaaucucucucaa

SEQ ID NO: 3283830 - RNA, 21 nt, Variola virus
acaaacauguucaaugcaaua

SEQ ID NO: 3283831 - RNA, 14 nt, Variola virus
aaagugcaaaugag

SEQ ID NO: 3283832 - RNA, 16 nt, Variola virus
ggaucuaguauuauug

SEQ ID NO: 3283833 - RNA, 16 nt, Variola virus
auaugucauagaauuu

SEQ ID NO: 3283834 - RNA, 18 nt, Variola virus
aguauuuauacuacuaau

SEQ ID NO: 3283835 - RNA, 12 nt, Variola virus
agacucaguaau

SEQ ID NO: 3283836 - RNA, 20 nt, Variola virus
uucuacgaaaggagagaaug

SEQ ID NO: 3283837 - RNA, 17 nt, Variola virus
uauuguacaaaaagccc

SEQ ID NO: 3283838 - RNA, 13 nt, Variola virus
gaagacaaucaag

SEQ ID NO: 3283839 - RNA, 12 nt, Variola virus
aauaguaaauga

SEQ ID NO: 3283840 - RNA, 16 nt, Variola virus
uaaaugaauucucauu

SEQ ID NO: 3283841 - RNA, 19 nt, Variola virus
guguauuaaauagaauauu

SEQ ID NO: 3283842 - RNA, 16 nt, Variola virus
acuucugaagaaauug

SEQ ID NO: 3283843 - RNA, 23 nt, Variola virus
uaacagucuguucaaauuuauau

SEQ ID NO: 3283844 - RNA, 14 nt, Variola virus
uuaaagauggagua

SEQ ID NO: 3283845 - RNA, 21 nt, Variola virus
ugauaaucauccuaagaugau

SEQ ID NO: 3283846 - RNA, 19 nt, Variola virus
uauguuaacggaaaguauu

SEQ ID NO: 3283847 - RNA, 17 nt, Variola virus
auggaucugugauguau

SEQ ID NO: 3283848 - RNA, 16 nt, Variola virus
auaguauaucuacaca

SEQ ID NO: 3283849 - RNA, 15 nt, Variola virus
auucaugaaaaugua

SEQ ID NO: 3283850 - RNA, 12 nt, Variola virus
auaugacaugau

SEQ ID NO: 3283851 - RNA, 15 nt, Variola virus
acaaaaaauaaaaga

SEQ ID NO: 3283852 - RNA, 21 nt, Variola virus
augauacacuaaguauauaca

SEQ ID NO: 3283853 - RNA, 20 nt, Variola virus
auucaauuacuacaaaaauu

SEQ ID NO: 3283854 - RNA, 18 nt, Variola virus
acaaacgcuacuauauau

SEQ ID NO: 3283855 - RNA, 18 nt, Variola virus
aacaauagucuuguaaag

SEQ ID NO: 3283856 - RNA, 18 nt, Variola virus
cagauuuaacaauuucua

SEQ ID NO: 3283857 - RNA, 13 nt, Variola virus
agaauuaagauua

SEQ ID NO: 3283858 - RNA, 22 nt, Variola virus
uucaucaauagacauaagaaau

SEQ ID NO: 3283859 - RNA, 20 nt, Variola virus
aaaauuauuacuagaaucuc

SEQ ID NO: 3283860 - RNA, 18 nt, Variola virus
ucuuuuagcacauguaua

SEQ ID NO: 3283861 - RNA, 16 nt, Variola virus
gucucuauaaaaauga

SEQ ID NO: 3283862 - RNA, 17 nt, Variola virus
aguuagaaaaaaugauu

SEQ ID NO: 3283863 - RNA, 15 nt, Variola virus
aaaaaguuuuaacau

SEQ ID NO: 3283864 - RNA, 14 nt, Variola virus
acaauccaauaaua

SEQ ID NO: 3283865 - RNA, 13 nt, Variola virus
gauauaugaugaa

SEQ ID NO: 3283866 - RNA, 17 nt, Variola virus
acaacugucaaugaauu

SEQ ID NO: 3283867 - RNA, 12 nt, Variola virus
caaaaagagagu

SEQ ID NO: 3283868 - RNA, 17 nt, Variola virus
aguuaaucaauuuagau

SEQ ID NO: 3283869 - RNA, 23 nt, Variola virus
auuaauuucuaaaggagcaaaug

SEQ ID NO: 3283870 - RNA, 19 nt, Variola virus
aaucauucuaaaacuauaa

SEQ ID NO: 3283871 - RNA, 23 nt, Variola virus
uaaaacuaucguuauaucugucu

SEQ ID NO: 3283872 - RNA, 14 nt, Variola virus
uaaaacuuaaaauu

SEQ ID NO: 3283873 - RNA, 16 nt, Variola virus
acugauaauguagaaa

SEQ ID NO: 3283874 - RNA, 15 nt, Variola virus
aacaauaguuauuac

SEQ ID NO: 3283875 - RNA, 19 nt, Variola virus
uauaugcaugauagaagau

SEQ ID NO: 3283876 - RNA, 14 nt, Variola virus
cuucgauagauauu

SEQ ID NO: 3283877 - RNA, 16 nt, Variola virus
aguuuuaaacaaaaua

SEQ ID NO: 3283878 - RNA, 19 nt, Variola virus
cagugauagacuagaagaa

SEQ ID NO: 3283879 - RNA, 13 nt, Variola virus
uacuucuauacaa

SEQ ID NO: 3283880 - RNA, 23 nt, Variola virus
agaauaguauuugagaaauaugu

SEQ ID NO: 3283881 - RNA, 20 nt, Variola virus
aaugugauucucugaaaaug

SEQ ID NO: 3283882 - RNA, 21 nt, Variola virus
ucuggaacauuuaacucauug

SEQ ID NO: 3283883 - RNA, 14 nt, Variola virus
aggaaacgaaagac

SEQ ID NO: 3283884 - RNA, 17 nt, Variola virus
uacucccacaaauacug

SEQ ID NO: 3283885 - RNA, 19 nt, Variola virus
caauacaccaauagaugau

SEQ ID NO: 3283886 - RNA, 14 nt, Variola virus
guaguucuauaauc

SEQ ID NO: 3283887 - RNA, 17 nt, Variola virus
uugaucuuuauuaaauu

SEQ ID NO: 3283888 - RNA, 13 nt, Variola virus
ugcuaauauacaa

SEQ ID NO: 3283889 - RNA, 19 nt, Variola virus
acuaaacuaacuccuuggu

SEQ ID NO: 3283890 - RNA, 15 nt, Variola virus
ucguauaaauauccu

SEQ ID NO: 3283891 - RNA, 13 nt, Variola virus
aaauacauaaaga

SEQ ID NO: 3283892 - RNA, 17 nt, Variola virus
aauaacuaguauaaaau

SEQ ID NO: 3283893 - RNA, 14 nt, Variola virus
cuucuaaucuugua

SEQ ID NO: 3283894 - RNA, 13 nt, Variola virus
auaacuguaaaua

SEQ ID NO: 3283895 - RNA, 21 nt, Variola virus
uaggaaauuuugugcaacgaa

SEQ ID NO: 3283896 - RNA, 19 nt, Variola virus
uaacucgguaucuacuuua

SEQ ID NO: 3283897 - RNA, 15 nt, Variola virus
auggaauaguuuuua

SEQ ID NO: 3283898 - RNA, 16 nt, Variola virus
ugauaacacauauuca

SEQ ID NO: 3283899 - RNA, 12 nt, Variola virus
aacuuaaaauau

SEQ ID NO: 3283900 - RNA, 20 nt, Variola virus
aucuauaaaauuuuaauuaa

SEQ ID NO: 3283901 - RNA, 14 nt, Variola virus
auuacaacauaaua

SEQ ID NO: 3283902 - RNA, 17 nt, Variola virus
uuaauuuauuauacugu

SEQ ID NO: 3283903 - RNA, 15 nt, Variola virus
agaaaagauuaagau

SEQ ID NO: 3283904 - RNA, 20 nt, Variola virus
uuuuccauaggauacuuugu

SEQ ID NO: 3283905 - RNA, 17 nt, Variola virus
uuaaacauggcauuaau

SEQ ID NO: 3283906 - RNA, 20 nt, Variola virus
uaucaagauguaaaauacuu

SEQ ID NO: 3283907 - RNA, 15 nt, Variola virus
aacauaauuuucuaa

SEQ ID NO: 3283908 - RNA, 15 nt, Variola virus
aacauauuuuucuau

SEQ ID NO: 3283909 - RNA, 17 nt, Variola virus
acuauaauaguacuaga

SEQ ID NO: 3283910 - RNA, 13 nt, Variola virus
uaaauuuuguauu

SEQ ID NO: 3283911 - RNA, 21 nt, Variola virus
uaguaauaaugauucaacaau

SEQ ID NO: 3283912 - RNA, 19 nt, Variola virus
aagauauucuaaaauggua

SEQ ID NO: 3283913 - RNA, 21 nt, Variola virus
caauucauuccuauaaguuua

SEQ ID NO: 3283914 - RNA, 17 nt, Variola virus
auguuucgauuucaauu

SEQ ID NO: 3283915 - RNA, 13 nt, Variola virus
ucugaauaaacaa

SEQ ID NO: 3283916 - RNA, 11 nt, Variola virus
aauagaaucua

SEQ ID NO: 3283917 - RNA, 13 nt, Variola virus
uuauaacuaaaca

SEQ ID NO: 3283918 - RNA, 16 nt, Variola virus
uauuuuacauggauuu

SEQ ID NO: 3283919 - RNA, 16 nt, Variola virus
uauaacuauuaauauu

SEQ ID NO: 3283920 - RNA, 20 nt, Variola virus
guuaucaucguauaaauuaa

SEQ ID NO: 3283921 - RNA, 12 nt, Variola virus
uaauucuaaaac

SEQ ID NO: 3283922 - RNA, 19 nt, Variola virus
auaaggaagugugcaaaua

SEQ ID NO: 3283923 - RNA, 15 nt, Variola virus
aguguaaaacuauau

SEQ ID NO: 3283924 - RNA, 16 nt, Variola virus
uauuggcuuuucuuua

SEQ ID NO: 3283925 - RNA, 13 nt, Variola virus
uagcaaaauuaac

SEQ ID NO: 3283926 - RNA, 14 nt, Variola virus
aauucuaaaugaug

SEQ ID NO: 3283927 - RNA, 16 nt, Variola virus
gcagaauaauuagaaa

SEQ ID NO: 3283928 - RNA, 16 nt, Variola virus
aacaauuuugucagua

SEQ ID NO: 3283929 - RNA, 13 nt, Variola virus
agaaauaaauguc

SEQ ID NO: 3283930 - RNA, 21 nt, Variola virus
auuaaaauucuuaaaauaauu

SEQ ID NO: 3283931 - RNA, 20 nt, Variola virus
gaauauuagcacauucauug

SEQ ID NO: 3283932 - RNA, 22 nt, Variola virus
uuugacuagggaagauacauua

SEQ ID NO: 3283933 - RNA, 19 nt, Variola virus
auccacugcugaacaguua

SEQ ID NO: 3283934 - RNA, 16 nt, Variola virus
agauggaaauauuguu

SEQ ID NO: 3283935 - RNA, 20 nt, Variola virus
uagaauuuagcauaucucuu

SEQ ID NO: 3283936 - RNA, 22 nt, Variola virus
ugucaucuuguucagaaauaua

SEQ ID NO: 3283937 - RNA, 19 nt, Variola virus
cuaucuaugcuguagauag

SEQ ID NO: 3283938 - RNA, 17 nt, Variola virus
aaugauacugauaaagu

SEQ ID NO: 3283939 - RNA, 14 nt, Variola virus
uuucuauaaucauu

SEQ ID NO: 3283940 - RNA, 12 nt, Variola virus
ugacauggaaau

SEQ ID NO: 3283941 - RNA, 21 nt, Variola virus
auauaccgccucaaacucuau

SEQ ID NO: 3283942 - RNA, 16 nt, Variola virus
uaaaaaccaucgucug

SEQ ID NO: 3283943 - RNA, 14 nt, Variola virus
gcuauauaaaucau

SEQ ID NO: 3283944 - RNA, 17 nt, Variola virus
ugaucuauauguuuuau

SEQ ID NO: 3283945 - RNA, 13 nt, Variola virus
auccuaaucagga

SEQ ID NO: 3283946 - RNA, 20 nt, Variola virus
acacguuagguuucuuuauu

SEQ ID NO: 3283947 - RNA, 17 nt, Variola virus
aacaacucccggacuua

SEQ ID NO: 3283948 - RNA, 23 nt, Variola virus
uugucauugagugauaaacuugu

SEQ ID NO: 3283949 - RNA, 21 nt, Variola virus
auccagauccuuuucuucaga

SEQ ID NO: 3283950 - RNA, 14 nt, Variola virus
auuauacuuuguaa

SEQ ID NO: 3283951 - RNA, 17 nt, Variola virus
acuagauaaaucguuug

SEQ ID NO: 3283952 - RNA, 22 nt, Variola virus
acuaaacuaugcgaugucuugg

SEQ ID NO: 3283953 - RNA, 14 nt, Variola virus
uugauuuucguaac

SEQ ID NO: 3283954 - RNA, 12 nt, Variola virus
ugcucuuuacau

SEQ ID NO: 3283955 - RNA, 20 nt, Variola virus
uauagcauuguuauguauuu

SEQ ID NO: 3283956 - RNA, 23 nt, Variola virus
aucauucgauaagauagauucca

SEQ ID NO: 3283957 - RNA, 20 nt, Variola virus
auucauaaaacauaaucaag

SEQ ID NO: 3283958 - RNA, 15 nt, Variola virus
auaaagcgagacuau

SEQ ID NO: 3283959 - RNA, 19 nt, Variola virus
auuaacaaaagugaauaua

SEQ ID NO: 3283960 - RNA, 22 nt, Variola virus
cuuaacgaacgcggugugaaug

SEQ ID NO: 3283961 - RNA, 21 nt, Variola virus
auacucccuugcaucauauac

SEQ ID NO: 3283962 - RNA, 15 nt, Variola virus
acauuuccuacuacu

SEQ ID NO: 3283963 - RNA, 18 nt, Variola virus
acugauucagaaauggau

SEQ ID NO: 3283964 - RNA, 19 nt, Variola virus
auaauucuuuauaacugaa

SEQ ID NO: 3283965 - RNA, 19 nt, Variola virus
uucaguaguguuuacauaa

SEQ ID NO: 3283966 - RNA, 15 nt, Variola virus
agugaaauaagcuuu

SEQ ID NO: 3283967 - RNA, 13 nt, Variola virus
uagaggaucuauu

SEQ ID NO: 3283968 - RNA, 12 nt, Variola virus
auucauuucauu

SEQ ID NO: 3283969 - RNA, 21 nt, Variola virus
caacgugauuauucuccacca

SEQ ID NO: 3283970 - RNA, 18 nt, Variola virus
caaauucugcaauaucuu

SEQ ID NO: 3283971 - RNA, 20 nt, Variola virus
auauauuauuagagguauau

SEQ ID NO: 3283972 - RNA, 12 nt, Variola virus
uagauccaagga

SEQ ID NO: 3283973 - RNA, 18 nt, Variola virus
aaaaaugcauacuuguua

SEQ ID NO: 3283974 - RNA, 19 nt, Variola virus
uuccagaauggcauacaua

SEQ ID NO: 3283975 - RNA, 16 nt, Variola virus
agagacaaacuauuaa

SEQ ID NO: 3283976 - RNA, 15 nt, Variola virus
uaccucucuuaaaau

SEQ ID NO: 3283977 - RNA, 15 nt, Variola virus
ugccacgguuccaag

SEQ ID NO: 3283978 - RNA, 16 nt, Variola virus
cucaacauaaauaauu

SEQ ID NO: 3283979 - RNA, 14 nt, Variola virus
cuauacauuuccga

SEQ ID NO: 3283980 - RNA, 22 nt, Variola virus
uaucaaagagaaggccaaagaa

SEQ ID NO: 3283981 - RNA, 15 nt, Variola virus
caccguaguguauau

SEQ ID NO: 3283982 - RNA, 13 nt, Variola virus
cuguauagauaua

SEQ ID NO: 3283983 - RNA, 20 nt, Variola virus
aaauccacuugauacagcca

SEQ ID NO: 3283984 - RNA, 16 nt, Variola virus
aaaggccuuguaacuu

SEQ ID NO: 3283985 - RNA, 16 nt, Variola virus
cugaaauaauuagaac

SEQ ID NO: 3283986 - RNA, 20 nt, Variola virus
auuucagauacuauauuugu

SEQ ID NO: 3283987 - RNA, 22 nt, Variola virus
cugaagaagagguaagauaucu

SEQ ID NO: 3283988 - RNA, 22 nt, Variola virus
cugugagaacuuguuaaagaag

SEQ ID NO: 3283989 - RNA, 18 nt, Variola virus
cugauacguuauaaaggu

SEQ ID NO: 3283990 - RNA, 16 nt, Variola virus
caaacucuauuuuaaa

SEQ ID NO: 3283991 - RNA, 21 nt, Variola virus
uagacauaauagucaauagau

SEQ ID NO: 3283992 - RNA, 13 nt, Variola virus
uaucuacaucuuc

SEQ ID NO: 3283993 - RNA, 13 nt, Variola virus
ugcuagaacaacu

SEQ ID NO: 3283994 - RNA, 16 nt, Variola virus
aguaaugguauguauu

SEQ ID NO: 3283995 - RNA, 13 nt, Variola virus
ucacaacauuucu

SEQ ID NO: 3283996 - RNA, 17 nt, Variola virus
gauaacaauuuguuaau

SEQ ID NO: 3283997 - RNA, 13 nt, Variola virus
acaucaaacggau

SEQ ID NO: 3283998 - RNA, 18 nt, Variola virus
acuauaaacuaaaaauua

SEQ ID NO: 3283999 - RNA, 18 nt, Variola virus
uuuaccagugauuaucca

SEQ ID NO: 3284000 - RNA, 19 nt, Variola virus
agggaaaucaaagaagaag

SEQ ID NO: 3284001 - RNA, 16 nt, Variola virus
uuauguaaauaucuuu

SEQ ID NO: 3284002 - RNA, 22 nt, Variola virus
aaaacagggacguguuaauaaa

SEQ ID NO: 3284003 - RNA, 21 nt, Variola virus
gacuauggacgcaugauaaga

SEQ ID NO: 3284004 - RNA, 14 nt, Variola virus
aucuguuuaucauu

SEQ ID NO: 3284005 - RNA, 20 nt, Variola virus
acuggucauagaaaaugauu

SEQ ID NO: 3284006 - RNA, 18 nt, Variola virus
acucauaagaaagagaau

SEQ ID NO: 3284007 - RNA, 23 nt, Variola virus
gcaacuauauaguuuaaauuaag

SEQ ID NO: 3284008 - RNA, 17 nt, Variola virus
uuaucaaaauuuggaaa

SEQ ID NO: 3284009 - RNA, 18 nt, Variola virus
acucauugcuuucuagaa

SEQ ID NO: 3284010 - RNA, 13 nt, Variola virus
ugugucuguuaau

SEQ ID NO: 3284011 - RNA, 13 nt, Variola virus
aacuaauaaacau

SEQ ID NO: 3284012 - RNA, 19 nt, Variola virus
gccauugcuggauuacauc

SEQ ID NO: 3284013 - RNA, 18 nt, Variola virus
cgaaacacgucaaagguu

SEQ ID NO: 3284014 - RNA, 20 nt, Variola virus
acuaauguauacauuuucca

SEQ ID NO: 3284015 - RNA, 21 nt, Variola virus
uuuuaacguaucauagaugcc

SEQ ID NO: 3284016 - RNA, 15 nt, Variola virus
auacaagaacaauua

SEQ ID NO: 3284017 - RNA, 21 nt, Variola virus
auguacaaauucuuggauaua

SEQ ID NO: 3284018 - RNA, 18 nt, Variola virus
caaaaauuuaaaaugagu

SEQ ID NO: 3284019 - RNA, 17 nt, Variola virus
agacuccguuccagaua

SEQ ID NO: 3284020 - RNA, 16 nt, Variola virus
gaaauauauuguuaaa

SEQ ID NO: 3284021 - RNA, 21 nt, Variola virus
gauggaucugugauguaugca

SEQ ID NO: 3284022 - RNA, 15 nt, Variola virus
guguccauaauccuc

SEQ ID NO: 3284023 - RNA, 20 nt, Variola virus
auaauagguggaacguauau

SEQ ID NO: 3284024 - RNA, 18 nt, Variola virus
uaaggguccuacaaccau

SEQ ID NO: 3284025 - RNA, 15 nt, Variola virus
auagagaacauaaug

SEQ ID NO: 3284026 - RNA, 20 nt, Variola virus
guacgggcgcuguaauuaau

SEQ ID NO: 3284027 - RNA, 13 nt, Variola virus
auaucuggauaau

SEQ ID NO: 3284028 - RNA, 11 nt, Variola virus
uuucuagauac

SEQ ID NO: 3284029 - RNA, 14 nt, Variola virus
auauucuuucuugu

SEQ ID NO: 3284030 - RNA, 19 nt, Variola virus
gauaccucauuuaucaugu

SEQ ID NO: 3284031 - RNA, 16 nt, Variola virus
cuucauuaaucuuuuc

SEQ ID NO: 3284032 - RNA, 17 nt, Variola virus
ucaugacuucauugaua

SEQ ID NO: 3284033 - RNA, 23 nt, Variola virus
uauuuuuaauagcugcucuuugu

SEQ ID NO: 3284034 - RNA, 19 nt, Variola virus
aauauaucaauaagcauua

SEQ ID NO: 3284035 - RNA, 16 nt, Variola virus
uaauuuguauauacau

SEQ ID NO: 3284036 - RNA, 12 nt, Variola virus
acacacuuuucu

SEQ ID NO: 3284037 - RNA, 17 nt, Variola virus
uugacuauuguguguaa

SEQ ID NO: 3284038 - RNA, 12 nt, Variola virus
cauaaaaguugu

SEQ ID NO: 3284039 - RNA, 22 nt, Variola virus
uuaucaaaucuuuaaucuuauu

SEQ ID NO: 3284040 - RNA, 17 nt, Variola virus
aguauguauaucuauau

SEQ ID NO: 3284041 - RNA, 17 nt, Variola virus
guaugauagcuccacca

SEQ ID NO: 3284042 - RNA, 15 nt, Variola virus
acagauguaaauaua

SEQ ID NO: 3284043 - RNA, 12 nt, Variola virus
uuacaugugauu

SEQ ID NO: 3284044 - RNA, 20 nt, Variola virus
uaaauucagaauuucuacau

SEQ ID NO: 3284045 - RNA, 22 nt, Variola virus
uucuagcucccggauugaaaac

SEQ ID NO: 3284046 - RNA, 18 nt, Variola virus
caaaucuucuuauaagau

SEQ ID NO: 3284047 - RNA, 14 nt, Variola virus
cuccaaucaugugu

SEQ ID NO: 3284048 - RNA, 21 nt, Variola virus
ucuaauacuuuaacaugugua

SEQ ID NO: 3284049 - RNA, 17 nt, Variola virus
aagaauagaggcacuua

SEQ ID NO: 3284050 - RNA, 22 nt, Variola virus
uuaaucuuggcuccauacugua

SEQ ID NO: 3284051 - RNA, 18 nt, Variola virus
acaauuugaccaaaucua

SEQ ID NO: 3284052 - RNA, 22 nt, Variola virus
ugaauagcaaaauuuuuacuau

SEQ ID NO: 3284053 - RNA, 12 nt, Variola virus
gccaaaaugaua

SEQ ID NO: 3284054 - RNA, 20 nt, Variola virus
uguuaaauguacuguauaua

SEQ ID NO: 3284055 - RNA, 22 nt, Variola virus
uacaucugaaacauacaacaaa

SEQ ID NO: 3284056 - RNA, 19 nt, Variola virus
cauuuauaacggucaauau

SEQ ID NO: 3284057 - RNA, 15 nt, Variola virus
uuccaguauuuucca

SEQ ID NO: 3284058 - RNA, 16 nt, Variola virus
cuguaauuacauacuu

SEQ ID NO: 3284059 - RNA, 18 nt, Variola virus
agcugugguguaaucuua

SEQ ID NO: 3284060 - RNA, 19 nt, Variola virus
cacagcgaagaauucuaga

SEQ ID NO: 3284061 - RNA, 17 nt, Variola virus
ucuugaaacuuuucaga

SEQ ID NO: 3284062 - RNA, 22 nt, Variola virus
aaaaugguguauuggaccuggu

SEQ ID NO: 3284063 - RNA, 15 nt, Variola virus
auauuguuacagcca

SEQ ID NO: 3284064 - RNA, 20 nt, Variola virus
gacugaugaccauuuaaaaa

SEQ ID NO: 3284065 - RNA, 21 nt, Variola virus
augauucuaaccuagaauuac

SEQ ID NO: 3284066 - RNA, 18 nt, Variola virus
aaugaugauaaaauggau

SEQ ID NO: 3284067 - RNA, 23 nt, Variola virus
aguuuucccuaccaguuuauccc

SEQ ID NO: 3284068 - RNA, 17 nt, Variola virus
ucguaaaucuuuucacg

SEQ ID NO: 3284069 - RNA, 23 nt, Variola virus
aaugaugccucugccuuuuuaua

SEQ ID NO: 3284070 - RNA, 15 nt, Variola virus
aacuaugucaaaaau

SEQ ID NO: 3284071 - RNA, 22 nt, Variola virus
ugauaucuacaucguuuggauu

SEQ ID NO: 3284072 - RNA, 14 nt, Variola virus
uggagaucuaaaga

SEQ ID NO: 3284073 - RNA, 15 nt, Variola virus
aauuucauccauuua

SEQ ID NO: 3284074 - RNA, 18 nt, Variola virus
aaacaaguuuucauauca

SEQ ID NO: 3284075 - RNA, 21 nt, Variola virus
caauggaugaggaagugauau

SEQ ID NO: 3284076 - RNA, 13 nt, Variola virus
aauuagagaauua

SEQ ID NO: 3284077 - RNA, 16 nt, Variola virus
aguauauacacagaau

SEQ ID NO: 3284078 - RNA, 18 nt, Variola virus
auuaccgacgauugucca

SEQ ID NO: 3284079 - RNA, 22 nt, Variola virus
uauauuuucacuuuaucucauu

SEQ ID NO: 3284080 - RNA, 21 nt, Variola virus
ucuuugauuaaugauuuagaa

SEQ ID NO: 3284081 - RNA, 17 nt, Variola virus
uacuaauacuaauacua

SEQ ID NO: 3284082 - RNA, 12 nt, Variola virus
uagugaccauau

SEQ ID NO: 3284083 - RNA, 14 nt, Variola virus
ucauucauuccucc

SEQ ID NO: 3284084 - RNA, 23 nt, Variola virus
auacacguuagauuauucucaaa

SEQ ID NO: 3284085 - RNA, 18 nt, Variola virus
acucucuaucucuuaaug

SEQ ID NO: 3284086 - RNA, 16 nt, Variola virus
aucuugacugucuauc

SEQ ID NO: 3284087 - RNA, 23 nt, Variola virus
gucucaugucgcaauaaauauga

SEQ ID NO: 3284088 - RNA, 18 nt, Variola virus
cauuagguuaaaugauuu

SEQ ID NO: 3284089 - RNA, 17 nt, Variola virus
agauuaggaaauguuuc

SEQ ID NO: 3284090 - RNA, 12 nt, Variola virus
aauauaaaacua

SEQ ID NO: 3284091 - RNA, 15 nt, Variola virus
ucuauuagaugugua

SEQ ID NO: 3284092 - RNA, 14 nt, Variola virus
caauagauagucua

SEQ ID NO: 3284093 - RNA, 23 nt, Variola virus
uaccauggaaaaauauuacagau

SEQ ID NO: 3284094 - RNA, 16 nt, Variola virus
gaucuaauagaugaau

SEQ ID NO: 3284095 - RNA, 22 nt, Variola virus
ugauaugaacagacauuguauu

SEQ ID NO: 3284096 - RNA, 14 nt, Variola virus
cuaacuuuaaacaa

SEQ ID NO: 3284097 - RNA, 13 nt, Variola virus
gaagguauuucca

SEQ ID NO: 3284098 - RNA, 17 nt, Variola virus
aguuuuaccuucuaaug

SEQ ID NO: 3284099 - RNA, 22 nt, Variola virus
aacuuauaauccuuuuuauuua

SEQ ID NO: 3284100 - RNA, 23 nt, Variola virus
uucaaaacaaacagacuauucuu

SEQ ID NO: 3284101 - RNA, 17 nt, Variola virus
acaaaaguuaauaacaa

SEQ ID NO: 3284102 - RNA, 18 nt, Variola virus
aaccaaguacuacaaauu

SEQ ID NO: 3284103 - RNA, 20 nt, Variola virus
caagaaacaccaaguagaaa

SEQ ID NO: 3284104 - RNA, 19 nt, Variola virus
uagaauuuauauaucuauu

SEQ ID NO: 3284105 - RNA, 23 nt, Variola virus
aaucagacugggaggaucacugu

SEQ ID NO: 3284106 - RNA, 22 nt, Variola virus
agauuuauuugauaaucauguu

SEQ ID NO: 3284107 - RNA, 21 nt, Variola virus
gacauuuuuagagagaacuac

SEQ ID NO: 3284108 - RNA, 13 nt, Variola virus
agaaaucugaaga

SEQ ID NO: 3284109 - RNA, 21 nt, Variola virus
aaugauaucuaugauuuuacc

SEQ ID NO: 3284110 - RNA, 18 nt, Variola virus
ucauguguggaugcuacu

SEQ ID NO: 3284111 - RNA, 21 nt, Variola virus
uaaaauacuaaugcaucuauu

SEQ ID NO: 3284112 - RNA, 19 nt, Variola virus
acaucgaugccuuaacauc

SEQ ID NO: 3284113 - RNA, 20 nt, Variola virus
ugucacauacacuagugaua

SEQ ID NO: 3284114 - RNA, 14 nt, Variola virus
auaauccagauuuu

SEQ ID NO: 3284115 - RNA, 18 nt, Variola virus
aauuaaucuaguagaaaa

SEQ ID NO: 3284116 - RNA, 19 nt, Variola virus
auaauauauacgaagacag

SEQ ID NO: 3284117 - RNA, 18 nt, Variola virus
aggauggaaagauaucag

SEQ ID NO: 3284118 - RNA, 22 nt, Variola virus
ugaucuucaucuaccaaagaaa

SEQ ID NO: 3284119 - RNA, 22 nt, Variola virus
aauagaaaccaaaucaaaacaa

SEQ ID NO: 3284120 - RNA, 22 nt, Variola virus
aauuuaccagauauaggagaau

SEQ ID NO: 3284121 - RNA, 17 nt, Variola virus
uugaugucguuauucug

SEQ ID NO: 3284122 - RNA, 14 nt, Variola virus
gauguuuguucauu

SEQ ID NO: 3284123 - RNA, 20 nt, Variola virus
uaucuuccgucaaggaucau

SEQ ID NO: 3284124 - RNA, 19 nt, Variola virus
uuuaggagugaucaucaaa

SEQ ID NO: 3284125 - RNA, 23 nt, Variola virus
aucucuaaauaccucauaaaaca

SEQ ID NO: 3284126 - RNA, 20 nt, Variola virus
acauaaaggcgcccauuuca

SEQ ID NO: 3284127 - RNA, 12 nt, Variola virus
guguauuaucau

SEQ ID NO: 3284128 - RNA, 14 nt, Variola virus
aauauuauuaucca

SEQ ID NO: 3284129 - RNA, 15 nt, Variola virus
uaaugaauagauguc

SEQ ID NO: 3284130 - RNA, 16 nt, Variola virus
aacuaaaaaucaaacu

SEQ ID NO: 3284131 - RNA, 18 nt, Variola virus
uaaacagaaucccuuucc

SEQ ID NO: 3284132 - RNA, 15 nt, Variola virus
auaccgaaucuacau

SEQ ID NO: 3284133 - RNA, 14 nt, Variola virus
caaguauccaucau

SEQ ID NO: 3284134 - RNA, 11 nt, Variola virus
uuuccauccac

SEQ ID NO: 3284135 - RNA, 21 nt, Variola virus
auuccagauguuguaaaauua

SEQ ID NO: 3284136 - RNA, 14 nt, Variola virus
uuauauuuuucuua

SEQ ID NO: 3284137 - RNA, 19 nt, Variola virus
auguuucuuuaaaagucaa

SEQ ID NO: 3284138 - RNA, 15 nt, Variola virus
acaugauauucaugu

SEQ ID NO: 3284139 - RNA, 16 nt, Variola virus
uuaucauaucuguaau

SEQ ID NO: 3284140 - RNA, 21 nt, Variola virus
gauaauucgcacaccaacaau

SEQ ID NO: 3284141 - RNA, 22 nt, Variola virus
uucccauauccagacaacaauc

SEQ ID NO: 3284142 - RNA, 21 nt, Variola virus
augaugauacucucaaccauu

SEQ ID NO: 3284143 - RNA, 23 nt, Variola virus
ggacacgguguauuguauuucuc

SEQ ID NO: 3284144 - RNA, 17 nt, Variola virus
acaaucuaauacaaaau

SEQ ID NO: 3284145 - RNA, 19 nt, Variola virus
uacucuagauaaaaucacu

SEQ ID NO: 3284146 - RNA, 18 nt, Variola virus
uuauacuaugucauuaac

SEQ ID NO: 3284147 - RNA, 16 nt, Variola virus
uggauuaccauggaua

SEQ ID NO: 3284148 - RNA, 21 nt, Variola virus
aaauagcucuuaguaugggaa

SEQ ID NO: 3284149 - RNA, 17 nt, Variola virus
uaccauuuuaaaaucau

SEQ ID NO: 3284150 - RNA, 13 nt, Variola virus
aaaauuaugugaa

SEQ ID NO: 3284151 - RNA, 22 nt, Variola virus
uaagaucuucuauuuuaucauu

SEQ ID NO: 3284152 - RNA, 22 nt, Variola virus
uuaauacccguuuguuuaaauu

SEQ ID NO: 3284153 - RNA, 18 nt, Variola virus
cucaucggaucuguaaaa

SEQ ID NO: 3284154 - RNA, 18 nt, Variola virus
gauauacaguauaaugau

SEQ ID NO: 3284155 - RNA, 15 nt, Variola virus
caaaacugaaaauau

SEQ ID NO: 3284156 - RNA, 23 nt, Variola virus
uauuugcgugguuguuuaucaca

SEQ ID NO: 3284157 - RNA, 18 nt, Variola virus
uguugugcuguuguacau

SEQ ID NO: 3284158 - RNA, 12 nt, Variola virus
uagagaugaugc

SEQ ID NO: 3284159 - RNA, 18 nt, Variola virus
auaauuauuauaauacag

SEQ ID NO: 3284160 - RNA, 13 nt, Variola virus
aauucaaauagau

SEQ ID NO: 3284161 - RNA, 19 nt, Variola virus
aauaaaaguggaagucauu

SEQ ID NO: 3284162 - RNA, 20 nt, Variola virus
acacacugagaaacagcaua

SEQ ID NO: 3284163 - RNA, 16 nt, Variola virus
uaaaaagacuaaaucu

SEQ ID NO: 3284164 - RNA, 21 nt, Variola virus
uugauaguuguuccuagauau

SEQ ID NO: 3284165 - RNA, 19 nt, Variola virus
gcucccgccgauccuguau

SEQ ID NO: 3284166 - RNA, 15 nt, Variola virus
auuauagauuuucca

SEQ ID NO: 3284167 - RNA, 22 nt, Variola virus
ucaucugggaauaaaauacuac

SEQ ID NO: 3284168 - RNA, 20 nt, Variola virus
aaacuuccucauuaagauug

SEQ ID NO: 3284169 - RNA, 21 nt, Variola virus
aacagauauaguuuuucugga

SEQ ID NO: 3284170 - RNA, 15 nt, Variola virus
caauuaguuaauaau

SEQ ID NO: 3284171 - RNA, 21 nt, Variola virus
cgaaaaacuuuaauguagaua

SEQ ID NO: 3284172 - RNA, 21 nt, Variola virus
acaucguaaucaaaagaauug

SEQ ID NO: 3284173 - RNA, 15 nt, Variola virus
aacuuauccauuuau

SEQ ID NO: 3284174 - RNA, 14 nt, Variola virus
uucuuuuucaaaga

SEQ ID NO: 3284175 - RNA, 17 nt, Variola virus
ucaaaguauuugguauu

SEQ ID NO: 3284176 - RNA, 15 nt, Variola virus
aauaucagaaaggau

SEQ ID NO: 3284177 - RNA, 19 nt, Variola virus
cuaagagaaaucuuuagac

SEQ ID NO: 3284178 - RNA, 22 nt, Variola virus
uagagauaaaacaaguuuucau

SEQ ID NO: 3284179 - RNA, 19 nt, Variola virus
auauuaucucaacaaaauu

SEQ ID NO: 3284180 - RNA, 15 nt, Variola virus
uuuaguauuaaacag

SEQ ID NO: 3284181 - RNA, 14 nt, Variola virus
aaauuauucguuua

SEQ ID NO: 3284182 - RNA, 19 nt, Variola virus
uguauugauuacaguguau

SEQ ID NO: 3284183 - RNA, 13 nt, Variola virus
guaguauugauuc

SEQ ID NO: 3284184 - RNA, 20 nt, Variola virus
cguccaauguuagaguaucu

SEQ ID NO: 3284185 - RNA, 20 nt, Variola virus
auacauuauuacuaaacauu

SEQ ID NO: 3284186 - RNA, 16 nt, Variola virus
auagggaaucauauau

SEQ ID NO: 3284187 - RNA, 17 nt, Variola virus
auaugaaaaacaugucu

SEQ ID NO: 3284188 - RNA, 21 nt, Variola virus
auuuugucuuuaaguauauac

SEQ ID NO: 3284189 - RNA, 19 nt, Variola virus
uauucuuaaaagguuucau

SEQ ID NO: 3284190 - RNA, 22 nt, Variola virus
caaaagacuaugggaauauauu

SEQ ID NO: 3284191 - RNA, 15 nt, Variola virus
gaaaaaguaaaugau

SEQ ID NO: 3284192 - RNA, 15 nt, Variola virus
auuaacugaggauga

SEQ ID NO: 3284193 - RNA, 13 nt, Variola virus
auguaaguauuua

SEQ ID NO: 3284194 - RNA, 18 nt, Variola virus
uuacgaauauauaaaaga

SEQ ID NO: 3284195 - RNA, 22 nt, Variola virus
cauaugauccaaauucuggaau

SEQ ID NO: 3284196 - RNA, 20 nt, Variola virus
acaaugccaucuuacaugau

SEQ ID NO: 3284197 - RNA, 22 nt, Variola virus
auguagaauuuuuuaaaaaguu

SEQ ID NO: 3284198 - RNA, 13 nt, Variola virus
caccaaacauauu

SEQ ID NO: 3284199 - RNA, 14 nt, Variola virus
uaaaaauaugugcu

SEQ ID NO: 3284200 - RNA, 15 nt, Variola virus
aguaauaaaacuaau

SEQ ID NO: 3284201 - RNA, 22 nt, Variola virus
acaaugaaccguaauauaucua

SEQ ID NO: 3284202 - RNA, 21 nt, Variola virus
cucaguacauagauuauccaa

SEQ ID NO: 3284203 - RNA, 18 nt, Variola virus
cauaauauggauccucau

SEQ ID NO: 3284204 - RNA, 17 nt, Variola virus
aaguuauuguacuaucg

SEQ ID NO: 3284205 - RNA, 22 nt, Variola virus
ggcuaauugucuuucucuuuua

SEQ ID NO: 3284206 - RNA, 17 nt, Variola virus
uccggagauagauuucc

SEQ ID NO: 3284207 - RNA, 20 nt, Variola virus
aaguuuggacaguucccauu

SEQ ID NO: 3284208 - RNA, 14 nt, Variola virus
auacaauaaauguu

SEQ ID NO: 3284209 - RNA, 17 nt, Variola virus
aucacuaucuuugaaaa

SEQ ID NO: 3284210 - RNA, 12 nt, Variola virus
uggcaauguuuc

SEQ ID NO: 3284211 - RNA, 22 nt, Variola virus
uaauacuuauucauauuuuagu

SEQ ID NO: 3284212 - RNA, 18 nt, Variola virus
acuaaacaguuuauugau

SEQ ID NO: 3284213 - RNA, 15 nt, Variola virus
cauuauuaacaaauu

SEQ ID NO: 3284214 - RNA, 16 nt, Variola virus
uuacauguauuaaaga

SEQ ID NO: 3284215 - RNA, 22 nt, Variola virus
agaauugauaauauaaauauga

SEQ ID NO: 3284216 - RNA, 14 nt, Variola virus
auaauagcacuguu

SEQ ID NO: 3284217 - RNA, 17 nt, Variola virus
aacauuuuauuucuaga

SEQ ID NO: 3284218 - RNA, 18 nt, Variola virus
aucuauugacuauaacuc

SEQ ID NO: 3284219 - RNA, 20 nt, Variola virus
gcuaacauacgagacauguu

SEQ ID NO: 3284220 - RNA, 22 nt, Variola virus
cggaguaaguguugagcucccu

SEQ ID NO: 3284221 - RNA, 13 nt, Variola virus
aucaaaaaguaag

SEQ ID NO: 3284222 - RNA, 21 nt, Variola virus
aguauccacaaauaguaaaug

SEQ ID NO: 3284223 - RNA, 21 nt, Variola virus
ccauuauaaaacuuaugauua

SEQ ID NO: 3284224 - RNA, 19 nt, Variola virus
acaucguuuaauauuacau

SEQ ID NO: 3284225 - RNA, 21 nt, Variola virus
uaccacuuauuacuccauuau

SEQ ID NO: 3284226 - RNA, 14 nt, Variola virus
aaacaauacucuac

SEQ ID NO: 3284227 - RNA, 21 nt, Variola virus
uuuaucaaaaauaaaauacau

SEQ ID NO: 3284228 - RNA, 18 nt, Variola virus
ucauuuuuuuaggaguau

SEQ ID NO: 3284229 - RNA, 17 nt, Variola virus
auuaaauauuuuaaaau

SEQ ID NO: 3284230 - RNA, 14 nt, Variola virus
ucgugaauaauguu

SEQ ID NO: 3284231 - RNA, 12 nt, Variola virus
cguuuauggauc

SEQ ID NO: 3284232 - RNA, 13 nt, Variola virus
cuaauucuuuaau

SEQ ID NO: 3284233 - RNA, 22 nt, Variola virus
cuuuuagagguucccaauucca

SEQ ID NO: 3284234 - RNA, 14 nt, Variola virus
auacgaaaauagau

SEQ ID NO: 3284235 - RNA, 21 nt, Variola virus
aucaagaguaacuauugacuu

SEQ ID NO: 3284236 - RNA, 20 nt, Variola virus
aucucaugucuaagaauuac

SEQ ID NO: 3284237 - RNA, 15 nt, Variola virus
aacuaauauuaggaa

SEQ ID NO: 3284238 - RNA, 23 nt, Variola virus
uuuuuauucaugguaucauagaa

SEQ ID NO: 3284239 - RNA, 23 nt, Variola virus
agauaauagggagaaaugacauu

SEQ ID NO: 3284240 - RNA, 15 nt, Variola virus
aauuuagcauuucua

SEQ ID NO: 3284241 - RNA, 14 nt, Variola virus
uagaacauguguga

SEQ ID NO: 3284242 - RNA, 19 nt, Variola virus
agaucugaauuaaauaugu

SEQ ID NO: 3284243 - RNA, 13 nt, Variola virus
agaaaaaauaucu

SEQ ID NO: 3284244 - RNA, 17 nt, Variola virus
auaacauguaucaauau

SEQ ID NO: 3284245 - RNA, 17 nt, Variola virus
ugagagucaauaucauu

SEQ ID NO: 3284246 - RNA, 12 nt, Variola virus
aucgaguuuauc

SEQ ID NO: 3284247 - RNA, 16 nt, Variola virus
auaacucuucgucaaa

SEQ ID NO: 3284248 - RNA, 16 nt, Variola virus
acuaggagaauuauuu

SEQ ID NO: 3284249 - RNA, 15 nt, Variola virus
gaacaauuacagaca

SEQ ID NO: 3284250 - RNA, 15 nt, Variola virus
auaaaacucauauag

SEQ ID NO: 3284251 - RNA, 14 nt, Variola virus
augaucaaaaagac

SEQ ID NO: 3284252 - RNA, 16 nt, Variola virus
auggacgcaaaugauc

SEQ ID NO: 3284253 - RNA, 16 nt, Variola virus
aacuaaaauuaaacau

SEQ ID NO: 3284254 - RNA, 19 nt, Variola virus
cuugucauguugauacauc

SEQ ID NO: 3284255 - RNA, 14 nt, Variola virus
auguggguauuuau

SEQ ID NO: 3284256 - RNA, 23 nt, Variola virus
gaaaacgagaagcggauaaugau

SEQ ID NO: 3284257 - RNA, 19 nt, Variola virus
aaauccauguucuaccaac

SEQ ID NO: 3284258 - RNA, 18 nt, Variola virus
uagaaauaaaaauuauua

SEQ ID NO: 3284259 - RNA, 18 nt, Variola virus
auguuuucugucagaaaa

SEQ ID NO: 3284260 - RNA, 20 nt, Variola virus
gcauacgaaauaaauaauga

SEQ ID NO: 3284261 - RNA, 16 nt, Variola virus
auuccaacgauauuaa

SEQ ID NO: 3284262 - RNA, 14 nt, Variola virus
gaaauguuaaaacu

SEQ ID NO: 3284263 - RNA, 21 nt, Variola virus
aucuauaacaugcuaaaccuu

SEQ ID NO: 3284264 - RNA, 20 nt, Variola virus
uaccaaaaagugugauuaau

SEQ ID NO: 3284265 - RNA, 23 nt, Variola virus
agauguauuacagccucauauau

SEQ ID NO: 3284266 - RNA, 17 nt, Variola virus
aaucuuuuucaucuugu

SEQ ID NO: 3284267 - RNA, 12 nt, Variola virus
cauauaucacau

SEQ ID NO: 3284268 - RNA, 21 nt, Variola virus
uaaauaucaaccgcaaaucaa

SEQ ID NO: 3284269 - RNA, 14 nt, Variola virus
agcuauguuaucau

SEQ ID NO: 3284270 - RNA, 13 nt, Variola virus
cauuuucuucaac

SEQ ID NO: 3284271 - RNA, 15 nt, Variola virus
guccuuagcuauaau

SEQ ID NO: 3284272 - RNA, 14 nt, Variola virus
aauacaaaauaaua

SEQ ID NO: 3284273 - RNA, 16 nt, Variola virus
cugcuauauggauauu

SEQ ID NO: 3284274 - RNA, 22 nt, Variola virus
gauuaucguuuucaucuuuuau

SEQ ID NO: 3284275 - RNA, 13 nt, Variola virus
uucuuaauaaucg

SEQ ID NO: 3284276 - RNA, 17 nt, Variola virus
uagcuaaaaaaauagua

SEQ ID NO: 3284277 - RNA, 13 nt, Variola virus
gagaauaauagau

SEQ ID NO: 3284278 - RNA, 22 nt, Variola virus
uacaaccguuuccuccguuucc

SEQ ID NO: 3284279 - RNA, 13 nt, Variola virus
cucaacaauaaau

SEQ ID NO: 3284280 - RNA, 16 nt, Variola virus
uauuagcacuaucaua

SEQ ID NO: 3284281 - RNA, 12 nt, Variola virus
gauccaaucaaa

SEQ ID NO: 3284282 - RNA, 15 nt, Variola virus
uauucauucaacaac

SEQ ID NO: 3284283 - RNA, 14 nt, Variola virus
acauuguuaauuga

SEQ ID NO: 3284284 - RNA, 12 nt, Variola virus
auuccaaagauc

SEQ ID NO: 3284285 - RNA, 23 nt, Variola virus
agauaugguaaaauuaaauagua

SEQ ID NO: 3284286 - RNA, 12 nt, Variola virus
aacuuaaaagaa

SEQ ID NO: 3284287 - RNA, 14 nt, Variola virus
uuucaucuagauac

SEQ ID NO: 3284288 - RNA, 23 nt, Variola virus
agauacaaauuuuaagaaauggu

SEQ ID NO: 3284289 - RNA, 15 nt, Variola virus
accggucauauuaau

SEQ ID NO: 3284290 - RNA, 20 nt, Variola virus
uucuaccgcauacgaaauaa

SEQ ID NO: 3284291 - RNA, 20 nt, Variola virus
ugauacacuaaguauauaca

SEQ ID NO: 3284292 - RNA, 22 nt, Variola virus
aauuaaaacguccucuauacau

SEQ ID NO: 3284293 - RNA, 22 nt, Variola virus
uucgaagcaguuacaaugacuc

SEQ ID NO: 3284294 - RNA, 14 nt, Variola virus
uggcuucuuccaua

SEQ ID NO: 3284295 - RNA, 16 nt, Variola virus
agaacacacuuuucuc

SEQ ID NO: 3284296 - RNA, 17 nt, Variola virus
ugucuuugaacaacauu

SEQ ID NO: 3284297 - RNA, 19 nt, Variola virus
uaaagauacaaauaugucu

SEQ ID NO: 3284298 - RNA, 12 nt, Variola virus
aagauauaugau

SEQ ID NO: 3284299 - RNA, 14 nt, Variola virus
aaacauucauguac

SEQ ID NO: 3284300 - RNA, 18 nt, Variola virus
agauaaacuuuauguauu

SEQ ID NO: 3284301 - RNA, 13 nt, Variola virus
aagaauucuuaug

SEQ ID NO: 3284302 - RNA, 20 nt, Variola virus
ucaagaucuaauauucuaga

SEQ ID NO: 3284303 - RNA, 13 nt, Variola virus
cuaguucucuuuu

SEQ ID NO: 3284304 - RNA, 22 nt, Variola virus
ugaauugcauacacuacaugac

SEQ ID NO: 3284305 - RNA, 23 nt, Variola virus
uuuuacauggauuuaucauauca

SEQ ID NO: 3284306 - RNA, 18 nt, Variola virus
agaaccauuacaaauauu

SEQ ID NO: 3284307 - RNA, 15 nt, Variola virus
gauucacaauuuaua

SEQ ID NO: 3284308 - RNA, 16 nt, Variola virus
uucaucagauuauuua

SEQ ID NO: 3284309 - RNA, 16 nt, Variola virus
uucgucgaauaaugua

SEQ ID NO: 3284310 - RNA, 15 nt, Variola virus
aaaaugcuaauauua

SEQ ID NO: 3284311 - RNA, 17 nt, Variola virus
ucagcauccacucauau

SEQ ID NO: 3284312 - RNA, 13 nt, Variola virus
uaccuguuuuuau

SEQ ID NO: 3284313 - RNA, 19 nt, Variola virus
agaaaaaugcuaauauuaa

SEQ ID NO: 3284314 - RNA, 13 nt, Variola virus
ccaaacuuuuuua

SEQ ID NO: 3284315 - RNA, 13 nt, Variola virus
auuauagauguau

SEQ ID NO: 3284316 - RNA, 17 nt, Variola virus
uauuaacgaguuccauu

SEQ ID NO: 3284317 - RNA, 19 nt, Variola virus
ugaugucguuauucugaaa

SEQ ID NO: 3284318 - RNA, 18 nt, Variola virus
auguguuuuaauauauau

SEQ ID NO: 3284319 - RNA, 16 nt, Variola virus
acggacaaucuaaaaa

SEQ ID NO: 3284320 - RNA, 17 nt, Variola virus
aauaagacuuugaacau

SEQ ID NO: 3284321 - RNA, 19 nt, Variola virus
aauaaguuuuagauauuca

SEQ ID NO: 3284322 - RNA, 18 nt, Variola virus
ucgaaucagaagucauac

SEQ ID NO: 3284323 - RNA, 14 nt, Variola virus
uaacauaccaugga

SEQ ID NO: 3284324 - RNA, 19 nt, Variola virus
cacuuaacuaucuuucaag

SEQ ID NO: 3284325 - RNA, 21 nt, Variola virus
guggauaaucagaauauacac

SEQ ID NO: 3284326 - RNA, 20 nt, Variola virus
uuauagaugccaagauaucu

SEQ ID NO: 3284327 - RNA, 16 nt, Variola virus
uucuuaaacuuauucu

SEQ ID NO: 3284328 - RNA, 17 nt, Variola virus
guuaaacugugaauguc

SEQ ID NO: 3284329 - RNA, 13 nt, Variola virus
uaaccuuuuuagu

SEQ ID NO: 3284330 - RNA, 14 nt, Variola virus
guauugacaaauau

SEQ ID NO: 3284331 - RNA, 17 nt, Variola virus
uuuguaaauaacuaucu

SEQ ID NO: 3284332 - RNA, 16 nt, Variola virus
aaucacuauagaaaau

SEQ ID NO: 3284333 - RNA, 19 nt, Variola virus
uuugaauuaguuuauaauu

SEQ ID NO: 3284334 - RNA, 18 nt, Variola virus
aauacugcaauaauuuuc

SEQ ID NO: 3284335 - RNA, 21 nt, Variola virus
acuuucuucuauaaaauggau

SEQ ID NO: 3284336 - RNA, 17 nt, Variola virus
acaaacgccauaaucug

SEQ ID NO: 3284337 - RNA, 16 nt, Variola virus
uucuuaugaaacuugg

SEQ ID NO: 3284338 - RNA, 14 nt, Variola virus
auuugaaguauuug

SEQ ID NO: 3284339 - RNA, 15 nt, Variola virus
uuguuauuaacguga

SEQ ID NO: 3284340 - RNA, 14 nt, Variola virus
gagggaaaagucau

SEQ ID NO: 3284341 - RNA, 14 nt, Variola virus
auaaaaauaauauu

SEQ ID NO: 3284342 - RNA, 13 nt, Variola virus
auucaauaacuaa

SEQ ID NO: 3284343 - RNA, 13 nt, Variola virus
aucaucuuuauca

SEQ ID NO: 3284344 - RNA, 14 nt, Variola virus
ccaacaaacauauu

SEQ ID NO: 3284345 - RNA, 23 nt, Variola virus
caaguaauacgugagaauauacu

SEQ ID NO: 3284346 - RNA, 22 nt, Variola virus
uguaugugcauucuuuaugaca

SEQ ID NO: 3284347 - RNA, 18 nt, Variola virus
auuaacgaguucaaauau

SEQ ID NO: 3284348 - RNA, 17 nt, Variola virus
agaguaggaaguuuaau

SEQ ID NO: 3284349 - RNA, 14 nt, Variola virus
uagaugguucuuua

SEQ ID NO: 3284350 - RNA, 13 nt, Variola virus
cuuaacuuuuucu

SEQ ID NO: 3284351 - RNA, 13 nt, Variola virus
acaagauauauau

SEQ ID NO: 3284352 - RNA, 15 nt, Variola virus
aaagacaucauauau

SEQ ID NO: 3284353 - RNA, 20 nt, Variola virus
aacgucuccaauauaugaua

SEQ ID NO: 3284354 - RNA, 19 nt, Variola virus
uacagauguaaauauaucu

SEQ ID NO: 3284355 - RNA, 19 nt, Variola virus
gauauacgaagaauaaugu

SEQ ID NO: 3284356 - RNA, 16 nt, Variola virus
ucauagcugagaauau

SEQ ID NO: 3284357 - RNA, 23 nt, Variola virus
uaguugauagaacaaaauacaua

SEQ ID NO: 3284358 - RNA, 19 nt, Variola virus
cucgaucaugaauggauuu

SEQ ID NO: 3284359 - RNA, 14 nt, Variola virus
ucauaucuguaauu

SEQ ID NO: 3284360 - RNA, 14 nt, Variola virus
ccaugauaaugaau

SEQ ID NO: 3284361 - RNA, 13 nt, Variola virus
uacaaaaacauac

SEQ ID NO: 3284362 - RNA, 16 nt, Variola virus
cuaugucuuuauccaa

SEQ ID NO: 3284363 - RNA, 12 nt, Variola virus
uuuaaacugaaa

SEQ ID NO: 3284364 - RNA, 23 nt, Variola virus
cugcuggaaaauaaaucacugac

SEQ ID NO: 3284365 - RNA, 14 nt, Variola virus
ucuaauacauaauu

SEQ ID NO: 3284366 - RNA, 12 nt, Variola virus
aaaauauguaga

SEQ ID NO: 3284367 - RNA, 13 nt, Variola virus
accgaaauuauca

SEQ ID NO: 3284368 - RNA, 15 nt, Variola virus
augaauaucacauau

SEQ ID NO: 3284369 - RNA, 14 nt, Variola virus
acagauaaauggaa

SEQ ID NO: 3284370 - RNA, 14 nt, Variola virus
ugaacauuauuaau

SEQ ID NO: 3284371 - RNA, 19 nt, Variola virus
uauccguauuuccauaaua

SEQ ID NO: 3284372 - RNA, 16 nt, Variola virus
uaacaaauuaaagaua

SEQ ID NO: 3284373 - RNA, 22 nt, Variola virus
aaaauuauuaaacaauacucua

SEQ ID NO: 3284374 - RNA, 14 nt, Variola virus
uaacaauuaaugau

SEQ ID NO: 3284375 - RNA, 17 nt, Variola virus
agauauaguauauucca

SEQ ID NO: 3284376 - RNA, 14 nt, Variola virus
guuuuaaauuggua

SEQ ID NO: 3284377 - RNA, 23 nt, Variola virus
aaaugugguaugucuccauuaca

SEQ ID NO: 3284378 - RNA, 20 nt, Variola virus
ucaugguaaggucuuagaaa

SEQ ID NO: 3284379 - RNA, 12 nt, Variola virus
caucuaugaaug

SEQ ID NO: 3284380 - RNA, 15 nt, Variola virus
uuuacacguaaccau

SEQ ID NO: 3284381 - RNA, 20 nt, Variola virus
auucuaugaugguauugaag

SEQ ID NO: 3284382 - RNA, 21 nt, Variola virus
ucagaauauucuuuucuaaga

SEQ ID NO: 3284383 - RNA, 14 nt, Variola virus
guuuucucuauucu

SEQ ID NO: 3284384 - RNA, 14 nt, Variola virus
uccaauuuuucaga

SEQ ID NO: 3284385 - RNA, 20 nt, Variola virus
ucuagauucgagaucucuaa

SEQ ID NO: 3284386 - RNA, 18 nt, Variola virus
gauucucuacucuagaua

SEQ ID NO: 3284387 - RNA, 18 nt, Variola virus
auauuaaugacgaauuga

SEQ ID NO: 3284388 - RNA, 17 nt, Variola virus
aggaaacuuaaaauaua

SEQ ID NO: 3284389 - RNA, 14 nt, Variola virus
cagagaaguauuuu

SEQ ID NO: 3284390 - RNA, 18 nt, Variola virus
agacaaugcuuuaauaaa

SEQ ID NO: 3284391 - RNA, 22 nt, Variola virus
aaauaucuuaaggagaaugaaa

SEQ ID NO: 3284392 - RNA, 18 nt, Variola virus
uauacuccggucgaugau

SEQ ID NO: 3284393 - RNA, 14 nt, Variola virus
aauuauuuuuacua

SEQ ID NO: 3284394 - RNA, 15 nt, Variola virus
aacaccaaguagaaa

SEQ ID NO: 3284395 - RNA, 18 nt, Variola virus
gacaauaguguucugaau

SEQ ID NO: 3284396 - RNA, 23 nt, Variola virus
cuaacauacgagacauguuagua

SEQ ID NO: 3284397 - RNA, 19 nt, Variola virus
gaaaauagaaauuuguaaa

SEQ ID NO: 3284398 - RNA, 18 nt, Variola virus
aucuauggaauuaccacu

SEQ ID NO: 3284399 - RNA, 17 nt, Variola virus
uuagauaaaugcgguaa

SEQ ID NO: 3284400 - RNA, 18 nt, Variola virus
aauuaaguagaucaucug

SEQ ID NO: 3284401 - RNA, 18 nt, Variola virus
guuguaaauuuuaauauu

SEQ ID NO: 3284402 - RNA, 14 nt, Variola virus
uuauuaugaagacu

SEQ ID NO: 3284403 - RNA, 21 nt, Variola virus
aucuauacgaccgauaagaga

SEQ ID NO: 3284404 - RNA, 17 nt, Variola virus
uaaaguacguaaaucua

SEQ ID NO: 3284405 - RNA, 14 nt, Variola virus
gcaucuguaaaaga

SEQ ID NO: 3284406 - RNA, 18 nt, Variola virus
auauuaaaguaaaaucua

SEQ ID NO: 3284407 - RNA, 14 nt, Variola virus
agagauaucuaucu

SEQ ID NO: 3284408 - RNA, 14 nt, Variola virus
gauuauucuacuau

SEQ ID NO: 3284409 - RNA, 18 nt, Variola virus
gugcucaaacaaaaugug

SEQ ID NO: 3284410 - RNA, 16 nt, Variola virus
augauauuagaacuac

SEQ ID NO: 3284411 - RNA, 13 nt, Variola virus
uuaauacaucauc

SEQ ID NO: 3284412 - RNA, 14 nt, Variola virus
cuucuuauuuagau

SEQ ID NO: 3284413 - RNA, 16 nt, Variola virus
uccuuugauuaucauc

SEQ ID NO: 3284414 - RNA, 18 nt, Variola virus
gaaauuugaaagaacuac

SEQ ID NO: 3284415 - RNA, 13 nt, Variola virus
aaugaaaauggau

SEQ ID NO: 3284416 - RNA, 21 nt, Variola virus
ggcaauaauugcgaauguuuu

SEQ ID NO: 3284417 - RNA, 18 nt, Variola virus
agcaacggggaugaugau

SEQ ID NO: 3284418 - RNA, 15 nt, Variola virus
aguaugucuuaauaa

SEQ ID NO: 3284419 - RNA, 12 nt, Variola virus
gcucaaacaaaa

SEQ ID NO: 3284420 - RNA, 22 nt, Variola virus
auagaaacauauucuaugaauu

SEQ ID NO: 3284421 - RNA, 15 nt, Variola virus
auuauaauauuuccu

SEQ ID NO: 3284422 - RNA, 22 nt, Variola virus
aguuuucuuucaaaauagcuau

SEQ ID NO: 3284423 - RNA, 15 nt, Variola virus
uauuaauucuguaaa

SEQ ID NO: 3284424 - RNA, 12 nt, Variola virus
aaauuaaagucu

SEQ ID NO: 3284425 - RNA, 15 nt, Variola virus
aucauucgguaacuu

SEQ ID NO: 3284426 - RNA, 19 nt, Variola virus
acuuguguucuaaauggau

SEQ ID NO: 3284427 - RNA, 21 nt, Variola virus
caaaguaaugccuguaaaaau

SEQ ID NO: 3284428 - RNA, 21 nt, Variola virus
guuauaucacaugaugauuua

SEQ ID NO: 3284429 - RNA, 19 nt, Variola virus
uaagauuuccuccuccgcu

SEQ ID NO: 3284430 - RNA, 13 nt, Variola virus
cagaugucauuau

SEQ ID NO: 3284431 - RNA, 23 nt, Variola virus
aauaguaucgaaaacagaauauc

SEQ ID NO: 3284432 - RNA, 22 nt, Variola virus
uuaagagauccgauaaacauug

SEQ ID NO: 3284433 - RNA, 19 nt, Variola virus
auuacuaaaucuguauauc

SEQ ID NO: 3284434 - RNA, 15 nt, Variola virus
acuaauacaucugaa

SEQ ID NO: 3284435 - RNA, 18 nt, Variola virus
agaaagcguguaauacga

SEQ ID NO: 3284436 - RNA, 18 nt, Variola virus
gugacagauauacaaaac

SEQ ID NO: 3284437 - RNA, 19 nt, Variola virus
uccaccaucuaccauaauc

SEQ ID NO: 3284438 - RNA, 14 nt, Variola virus
ucgcaacugucuuu

SEQ ID NO: 3284439 - RNA, 19 nt, Variola virus
ucagauuauuaaguauaau

SEQ ID NO: 3284440 - RNA, 17 nt, Variola virus
uaaacaaaaauauaaag

SEQ ID NO: 3284441 - RNA, 22 nt, Variola virus
agaaagauauauuaagaauaau

SEQ ID NO: 3284442 - RNA, 19 nt, Variola virus
gaagauucccaaauaauca

SEQ ID NO: 3284443 - RNA, 13 nt, Variola virus
cgcgagucaauuc

SEQ ID NO: 3284444 - RNA, 17 nt, Variola virus
ucauguguucaaaguau

SEQ ID NO: 3284445 - RNA, 14 nt, Variola virus
guuuucuauuuuua

SEQ ID NO: 3284446 - RNA, 13 nt, Variola virus
aguauuuuucuaa

SEQ ID NO: 3284447 - RNA, 14 nt, Variola virus
uugugauuguauuu

SEQ ID NO: 3284448 - RNA, 20 nt, Variola virus
uaccugcaguggaguuauau

SEQ ID NO: 3284449 - RNA, 15 nt, Variola virus
acgcauccauccaaa

SEQ ID NO: 3284450 - RNA, 15 nt, Variola virus
auuaguaaaaaauuu

SEQ ID NO: 3284451 - RNA, 17 nt, Variola virus
uuauccgcuaaaaauuu

SEQ ID NO: 3284452 - RNA, 15 nt, Variola virus
uggacaaaucuggaa

SEQ ID NO: 3284453 - RNA, 13 nt, Variola virus
caauuuguuaaua

SEQ ID NO: 3284454 - RNA, 12 nt, Variola virus
uuucuacauaau

SEQ ID NO: 3284455 - RNA, 14 nt, Variola virus
gucaauauucuguu

SEQ ID NO: 3284456 - RNA, 19 nt, Variola virus
uaaacucagauaauagcaa

SEQ ID NO: 3284457 - RNA, 13 nt, Variola virus
ugguauuauucua

SEQ ID NO: 3284458 - RNA, 20 nt, Variola virus
uuuauuaucuugucuuggug

SEQ ID NO: 3284459 - RNA, 13 nt, Variola virus
uuaaaaauuauua

SEQ ID NO: 3284460 - RNA, 21 nt, Variola virus
uaauuccguuaauauuaaaaa

SEQ ID NO: 3284461 - RNA, 21 nt, Variola virus
caggauuccuauucauuuuga

SEQ ID NO: 3284462 - RNA, 15 nt, Variola virus
uuguccggcauauca

SEQ ID NO: 3284463 - RNA, 13 nt, Variola virus
uaacuccuugguu

SEQ ID NO: 3284464 - RNA, 19 nt, Variola virus
gauucuucacaagugaaau

SEQ ID NO: 3284465 - RNA, 14 nt, Variola virus
auguuauuaaaugu

SEQ ID NO: 3284466 - RNA, 17 nt, Variola virus
auaucauaaucuaaaau

SEQ ID NO: 3284467 - RNA, 14 nt, Variola virus
acugaaucauauau

SEQ ID NO: 3284468 - RNA, 14 nt, Variola virus
agagacaaacuauu

SEQ ID NO: 3284469 - RNA, 22 nt, Variola virus
uaauauuuaugauuuaauguau

SEQ ID NO: 3284470 - RNA, 21 nt, Variola virus
aauaauuguaaaacauacaau

SEQ ID NO: 3284471 - RNA, 18 nt, Variola virus
cauauguaguguuaauuu

SEQ ID NO: 3284472 - RNA, 15 nt, Variola virus
uaucuucuuuaucua

SEQ ID NO: 3284473 - RNA, 18 nt, Variola virus
uuacauaguugauaaaaa

SEQ ID NO: 3284474 - RNA, 21 nt, Variola virus
uauuuccuguuccguuaacau

SEQ ID NO: 3284475 - RNA, 18 nt, Variola virus
auggaccaaauuaucauc

SEQ ID NO: 3284476 - RNA, 23 nt, Variola virus
aauauccaaguauuuuaauucua

SEQ ID NO: 3284477 - RNA, 17 nt, Variola virus
gauccaaucaaaaaaua

SEQ ID NO: 3284478 - RNA, 16 nt, Variola virus
uaaauaccauuaauca

SEQ ID NO: 3284479 - RNA, 11 nt, Variola virus
guaaguuuauu

SEQ ID NO: 3284480 - RNA, 19 nt, Variola virus
cgauaugccuccagaaguu

SEQ ID NO: 3284481 - RNA, 12 nt, Variola virus
agguauaugcau

SEQ ID NO: 3284482 - RNA, 13 nt, Variola virus
ucuucauuaauaa

SEQ ID NO: 3284483 - RNA, 22 nt, Variola virus
caaauaucggcauuuauguuuc

SEQ ID NO: 3284484 - RNA, 13 nt, Variola virus
uuaaauccuuaau

SEQ ID NO: 3284485 - RNA, 18 nt, Variola virus
acuaggauuagagaagau

SEQ ID NO: 3284486 - RNA, 21 nt, Variola virus
gauauaauucguggauaauca

SEQ ID NO: 3284487 - RNA, 19 nt, Variola virus
auaaguaguaauaaugauu

SEQ ID NO: 3284488 - RNA, 19 nt, Variola virus
gauuaaaaauaaaguuauc

SEQ ID NO: 3284489 - RNA, 21 nt, Variola virus
aaaauuaauauuuaugauuua

SEQ ID NO: 3284490 - RNA, 16 nt, Variola virus
cguagaaaacuauuac

SEQ ID NO: 3284491 - RNA, 20 nt, Variola virus
cugaauaaucguuauuauca

SEQ ID NO: 3284492 - RNA, 22 nt, Variola virus
aguauuaaccaugaaagaaaga

SEQ ID NO: 3284493 - RNA, 15 nt, Variola virus
ucgaacauacaaaaa

SEQ ID NO: 3284494 - RNA, 23 nt, Variola virus
uuuuacuccucuccuuccguaaa

SEQ ID NO: 3284495 - RNA, 20 nt, Variola virus
aaauaaguaguaauaaugau

SEQ ID NO: 3284496 - RNA, 14 nt, Variola virus
uauucauucaauau

SEQ ID NO: 3284497 - RNA, 18 nt, Variola virus
cagaagaauaugaugauu

SEQ ID NO: 3284498 - RNA, 19 nt, Variola virus
caucaaacgaauaaacaau

SEQ ID NO: 3284499 - RNA, 19 nt, Variola virus
uuaaacgauggauuuucca

SEQ ID NO: 3284500 - RNA, 12 nt, Variola virus
cauuuaaaguua

SEQ ID NO: 3284501 - RNA, 18 nt, Variola virus
ugacaucauacuagauaa

SEQ ID NO: 3284502 - RNA, 20 nt, Variola virus
uuccacgaaaguaauuauua

SEQ ID NO: 3284503 - RNA, 18 nt, Variola virus
auuuugcauaacauguau

SEQ ID NO: 3284504 - RNA, 20 nt, Variola virus
cagucuuuaaguucuggaau

SEQ ID NO: 3284505 - RNA, 22 nt, Variola virus
ucuuuuuauccucauuaaacag

SEQ ID NO: 3284506 - RNA, 18 nt, Variola virus
uggauaagcguaugaaau

SEQ ID NO: 3284507 - RNA, 14 nt, Variola virus
agugcuuguaugug

SEQ ID NO: 3284508 - RNA, 23 nt, Variola virus
ucuaaauauuuuagaacacuguu

SEQ ID NO: 3284509 - RNA, 14 nt, Variola virus
acaaaguacucaau

SEQ ID NO: 3284510 - RNA, 13 nt, Variola virus
caauaaacaaaau

SEQ ID NO: 3284511 - RNA, 22 nt, Variola virus
agagucgacaaugaaaauggau

SEQ ID NO: 3284512 - RNA, 13 nt, Variola virus
uaauaaugauuca

SEQ ID NO: 3284513 - RNA, 20 nt, Variola virus
aguucaaauaugaaaugcua

SEQ ID NO: 3284514 - RNA, 19 nt, Variola virus
acuauugcaucaaaaggau

SEQ ID NO: 3284515 - RNA, 14 nt, Variola virus
auguuaauauguau

SEQ ID NO: 3284516 - RNA, 17 nt, Variola virus
uuaauacaguaaguaca

SEQ ID NO: 3284517 - RNA, 16 nt, Variola virus
gauauacuacuucucc

SEQ ID NO: 3284518 - RNA, 20 nt, Variola virus
gucauaaacuguaaaugauu

SEQ ID NO: 3284519 - RNA, 13 nt, Variola virus
aaauuguuuaguu

SEQ ID NO: 3284520 - RNA, 21 nt, Variola virus
acacacuuaccuucaacagua

SEQ ID NO: 3284521 - RNA, 18 nt, Variola virus
uuccaaucuauaauaucu

SEQ ID NO: 3284522 - RNA, 20 nt, Variola virus
aucuagucaccgagggaaaa

SEQ ID NO: 3284523 - RNA, 12 nt, Variola virus
guguauuuccau

SEQ ID NO: 3284524 - RNA, 22 nt, Variola virus
ucacucucauaauguaaagaua

SEQ ID NO: 3284525 - RNA, 17 nt, Variola virus
uucuuuagcgaaacagu

SEQ ID NO: 3284526 - RNA, 17 nt, Variola virus
acuagacugauuucucu

SEQ ID NO: 3284527 - RNA, 15 nt, Variola virus
auuuagauacuaaca

SEQ ID NO: 3284528 - RNA, 16 nt, Variola virus
guuauagucaaauuaa

SEQ ID NO: 3284529 - RNA, 14 nt, Variola virus
uucugauaauagau

SEQ ID NO: 3284530 - RNA, 16 nt, Variola virus
cauauagaucaaucau

SEQ ID NO: 3284531 - RNA, 21 nt, Variola virus
uuuacauggcucguaccaaca

SEQ ID NO: 3284532 - RNA, 16 nt, Variola virus
agaacaaaauaaacaa

SEQ ID NO: 3284533 - RNA, 12 nt, Variola virus
auaugugcauua

SEQ ID NO: 3284534 - RNA, 14 nt, Variola virus
acaagucuaauaau

SEQ ID NO: 3284535 - RNA, 15 nt, Variola virus
uaaaauauauuauca

SEQ ID NO: 3284536 - RNA, 22 nt, Variola virus
aacuacuuguaauauugaaauc

SEQ ID NO: 3284537 - RNA, 13 nt, Variola virus
agauaaugauaua

SEQ ID NO: 3284538 - RNA, 17 nt, Variola virus
auauaccgauauguaca

SEQ ID NO: 3284539 - RNA, 20 nt, Variola virus
uauuuacugaacaggcauuu

SEQ ID NO: 3284540 - RNA, 13 nt, Variola virus
aaacuugcaaaga

SEQ ID NO: 3284541 - RNA, 19 nt, Variola virus
acuaucguuggaaaaugau

SEQ ID NO: 3284542 - RNA, 17 nt, Variola virus
ucacugaguuuacagau

SEQ ID NO: 3284543 - RNA, 15 nt, Variola virus
uuuggauuuggaaaa

SEQ ID NO: 3284544 - RNA, 12 nt, Variola virus
uauauagauguc

SEQ ID NO: 3284545 - RNA, 21 nt, Variola virus
uuguaacaucgguacggguau

SEQ ID NO: 3284546 - RNA, 16 nt, Variola virus
agaaagucagaaucua

SEQ ID NO: 3284547 - RNA, 14 nt, Variola virus
gcaugauagaagau

SEQ ID NO: 3284548 - RNA, 15 nt, Variola virus
aucugaauaaaacau

SEQ ID NO: 3284549 - RNA, 18 nt, Variola virus
gcgauuguagauaaugaa

SEQ ID NO: 3284550 - RNA, 16 nt, Variola virus
uaguuuuacuaucaua

SEQ ID NO: 3284551 - RNA, 16 nt, Variola virus
cagauuauuuaacaau

SEQ ID NO: 3284552 - RNA, 19 nt, Variola virus
agcauauuguaauaucuua

SEQ ID NO: 3284553 - RNA, 21 nt, Variola virus
cuucgauagauauucuucaga

SEQ ID NO: 3284554 - RNA, 19 nt, Variola virus
aaacacuuggauauuguau

SEQ ID NO: 3284555 - RNA, 24 nt, Variola virus
uuuauaaagaaauacauaucgcac

SEQ ID NO: 3284556 - RNA, 17 nt, Variola virus
cucauaaaauaguucuc

SEQ ID NO: 3284557 - RNA, 23 nt, Variola virus
uauguauacauaauauuaucaug

SEQ ID NO: 3284558 - RNA, 23 nt, Variola virus
auacgaagacagacauacaguag

SEQ ID NO: 3284559 - RNA, 22 nt, Variola virus
ucucuguaauaguuuccaccaa

SEQ ID NO: 3284560 - RNA, 19 nt, Variola virus
uuauaucguguucauuaac

SEQ ID NO: 3284561 - RNA, 23 nt, Variola virus
ucaaauauagaucuuauuuagua

SEQ ID NO: 3284562 - RNA, 17 nt, Variola virus
gcgguaaacauucaugu

SEQ ID NO: 3284563 - RNA, 23 nt, Variola virus
ucgaucuuuggauauucuaacga

SEQ ID NO: 3284564 - RNA, 20 nt, Variola virus
uacgcucucuggaggauugu

SEQ ID NO: 3284565 - RNA, 19 nt, Variola virus
cgauugauuuggaauucuu

SEQ ID NO: 3284566 - RNA, 15 nt, Variola virus
aguauucuuauguau

SEQ ID NO: 3284567 - RNA, 23 nt, Variola virus
ucgacucauaagaaagagaauag

SEQ ID NO: 3284568 - RNA, 21 nt, Variola virus
aagaucguuggacauuggaua

SEQ ID NO: 3284569 - RNA, 21 nt, Variola virus
ggauucauccuuaaauguuuu

SEQ ID NO: 3284570 - RNA, 12 nt, Variola virus
acggagaagaau

SEQ ID NO: 3284571 - RNA, 13 nt, Variola virus
acuucuaucuugu

SEQ ID NO: 3284572 - RNA, 16 nt, Variola virus
uaaaaaaugaaaauaa

SEQ ID NO: 3284573 - RNA, 22 nt, Variola virus
uaaacgacuauaaaauuauuga

SEQ ID NO: 3284574 - RNA, 20 nt, Variola virus
auauacauuuucaaauaaua

SEQ ID NO: 3284575 - RNA, 15 nt, Variola virus
gcgaacuuuaaacag

SEQ ID NO: 3284576 - RNA, 12 nt, Variola virus
auuacuuaaaaa

SEQ ID NO: 3284577 - RNA, 15 nt, Variola virus
auacaacaaagaaaa

SEQ ID NO: 3284578 - RNA, 15 nt, Variola virus
aauucuucaaaugaa

SEQ ID NO: 3284579 - RNA, 17 nt, Variola virus
augaauuccucugaaaa

SEQ ID NO: 3284580 - RNA, 21 nt, Variola virus
aguaucugagcacuacaguca

SEQ ID NO: 3284581 - RNA, 13 nt, Variola virus
uuagaucauuaac

SEQ ID NO: 3284582 - RNA, 20 nt, Variola virus
cggcgauucuuuuucuuucg

SEQ ID NO: 3284583 - RNA, 12 nt, Variola virus
uacuaucaaaau

SEQ ID NO: 3284584 - RNA, 14 nt, Variola virus
caucugcucaacaa

SEQ ID NO: 3284585 - RNA, 18 nt, Variola virus
gauaguaaaacaaaauua

SEQ ID NO: 3284586 - RNA, 14 nt, Variola virus
auuaagacauauau

SEQ ID NO: 3284587 - RNA, 15 nt, Variola virus
caacugucuuucaag

SEQ ID NO: 3284588 - RNA, 22 nt, Variola virus
aaaguauccaucacuucuaucu

SEQ ID NO: 3284589 - RNA, 14 nt, Variola virus
auaaucauguugau

SEQ ID NO: 3284590 - RNA, 15 nt, Variola virus
agucucuccuuccaa

SEQ ID NO: 3284591 - RNA, 16 nt, Variola virus
acucuauucuucaaga

SEQ ID NO: 3284592 - RNA, 15 nt, Variola virus
uuaauagaacucuuu

SEQ ID NO: 3284593 - RNA, 20 nt, Variola virus
gauaagauauguuuauucau

SEQ ID NO: 3284594 - RNA, 23 nt, Variola virus
cuauuucaaaaguuuuuaagaga

SEQ ID NO: 3284595 - RNA, 17 nt, Variola virus
gauaaguccuucaaaau

SEQ ID NO: 3284596 - RNA, 12 nt, Variola virus
acuguuuaagag

SEQ ID NO: 3284597 - RNA, 13 nt, Variola virus
gauaauuauccau

SEQ ID NO: 3284598 - RNA, 14 nt, Variola virus
auaucauacaugau

SEQ ID NO: 3284599 - RNA, 22 nt, Variola virus
aauaguuuacagauauuuucca

SEQ ID NO: 3284600 - RNA, 21 nt, Variola virus
gcgccuuauauagcacuuuua

SEQ ID NO: 3284601 - RNA, 14 nt, Variola virus
aaauuuauuauuua

SEQ ID NO: 3284602 - RNA, 14 nt, Variola virus
gaagaagaaaacaa

SEQ ID NO: 3284603 - RNA, 17 nt, Variola virus
uauuccuaguuuggauu

SEQ ID NO: 3284604 - RNA, 18 nt, Variola virus
agaacaaaccaaauauau

SEQ ID NO: 3284605 - RNA, 13 nt, Variola virus
uuuuuuaugauuu

SEQ ID NO: 3284606 - RNA, 13 nt, Variola virus
gaauauauuuaua

SEQ ID NO: 3284607 - RNA, 21 nt, Variola virus
uagagcccacguuuaaacauu

SEQ ID NO: 3284608 - RNA, 17 nt, Variola virus
caagaguaacuauugac

SEQ ID NO: 3284609 - RNA, 23 nt, Variola virus
gauauauauggucuuaugaaaga

SEQ ID NO: 3284610 - RNA, 13 nt, Variola virus
agacuaaagaaac

SEQ ID NO: 3284611 - RNA, 22 nt, Variola virus
uuguagaacuuaacuuuuucuu

SEQ ID NO: 3284612 - RNA, 15 nt, Variola virus
ugcuguuguacauac

SEQ ID NO: 3284613 - RNA, 14 nt, Variola virus
acugaauauauuua

SEQ ID NO: 3284614 - RNA, 16 nt, Variola virus
uguagccgauaaacaa

SEQ ID NO: 3284615 - RNA, 22 nt, Variola virus
auugguaaauuccauagaauau

SEQ ID NO: 3284616 - RNA, 15 nt, Variola virus
cuuccaacucuguuu

SEQ ID NO: 3284617 - RNA, 20 nt, Variola virus
aguuaugacauucaucaaug

SEQ ID NO: 3284618 - RNA, 17 nt, Variola virus
cgaguuuaaaacuucua

SEQ ID NO: 3284619 - RNA, 22 nt, Variola virus
agcgacuaucaucuaaacagua

SEQ ID NO: 3284620 - RNA, 23 nt, Variola virus
ugugaaugguaaagaaugcuguu

SEQ ID NO: 3284621 - RNA, 17 nt, Variola virus
acuaaguucugcauuca

SEQ ID NO: 3284622 - RNA, 16 nt, Variola virus
ucaaauuagauuucga

SEQ ID NO: 3284623 - RNA, 21 nt, Variola virus
ccauauuaugggaucagguaa

SEQ ID NO: 3284624 - RNA, 20 nt, Variola virus
uauucauuaggauuaucaaa

SEQ ID NO: 3284625 - RNA, 15 nt, Variola virus
uucgauauauguucc

SEQ ID NO: 3284626 - RNA, 21 nt, Variola virus
aaaucaaaacaaaauucauua

SEQ ID NO: 3284627 - RNA, 14 nt, Variola virus
cggcacauauuaau

SEQ ID NO: 3284628 - RNA, 21 nt, Variola virus
cuaggacggcgauucuuuuuc

SEQ ID NO: 3284629 - RNA, 16 nt, Variola virus
aguaaucauguaaaug

SEQ ID NO: 3284630 - RNA, 14 nt, Variola virus
aaauaucucaaaga

SEQ ID NO: 3284631 - RNA, 20 nt, Variola virus
agacuuuauaauuucaucua

SEQ ID NO: 3284632 - RNA, 14 nt, Variola virus
aaaguaaaaaagaa

SEQ ID NO: 3284633 - RNA, 14 nt, Variola virus
auguaaaaauguua

SEQ ID NO: 3284634 - RNA, 13 nt, Variola virus
uauugaugauguc

SEQ ID NO: 3284635 - RNA, 22 nt, Variola virus
guaaacauugacggauaaaaca

SEQ ID NO: 3284636 - RNA, 19 nt, Variola virus
gucucauuucuaucuguuu

SEQ ID NO: 3284637 - RNA, 22 nt, Variola virus
gauuguccggcauaucauguag

SEQ ID NO: 3284638 - RNA, 16 nt, Variola virus
ucuaacaaacaucuca

SEQ ID NO: 3284639 - RNA, 18 nt, Variola virus
uauuuguguauucuucua

SEQ ID NO: 3284640 - RNA, 12 nt, Variola virus
caucuaucaucu

SEQ ID NO: 3284641 - RNA, 14 nt, Variola virus
ucuauuguuuggaa

SEQ ID NO: 3284642 - RNA, 23 nt, Variola virus
aaugaacaucggaaauauagaau

SEQ ID NO: 3284643 - RNA, 17 nt, Variola virus
guuaacauuuuauuauu

SEQ ID NO: 3284644 - RNA, 15 nt, Variola virus
agcuaagucuauuau

SEQ ID NO: 3284645 - RNA, 19 nt, Variola virus
ugacucgcaacaauuguaa

SEQ ID NO: 3284646 - RNA, 23 nt, Variola virus
ugagauuuguuuuguuaaacaau

SEQ ID NO: 3284647 - RNA, 18 nt, Variola virus
acuguucccgucaauaga

SEQ ID NO: 3284648 - RNA, 14 nt, Variola virus
ugguguuacaguua

SEQ ID NO: 3284649 - RNA, 14 nt, Variola virus
uucaccaauaaaaa

SEQ ID NO: 3284650 - RNA, 20 nt, Variola virus
agaugguggccacaauauau

SEQ ID NO: 3284651 - RNA, 18 nt, Variola virus
auuuuaccucuucugaua

SEQ ID NO: 3284652 - RNA, 21 nt, Variola virus
guauaaaacaacaaaauuaua

SEQ ID NO: 3284653 - RNA, 15 nt, Variola virus
acugauaccaugaaa

SEQ ID NO: 3284654 - RNA, 20 nt, Variola virus
aacauuuuauauacuuuucu

SEQ ID NO: 3284655 - RNA, 23 nt, Variola virus
uguaucgauugcguuguaacauu

SEQ ID NO: 3284656 - RNA, 20 nt, Variola virus
aaugaguauauguauuuucu

SEQ ID NO: 3284657 - RNA, 15 nt, Variola virus
acaacgugaaauacu

SEQ ID NO: 3284658 - RNA, 18 nt, Variola virus
auauaagacuaacaguau

SEQ ID NO: 3284659 - RNA, 22 nt, Variola virus
aauucuuuugauuugcuuugaa

SEQ ID NO: 3284660 - RNA, 23 nt, Variola virus
uguuuaucgcacgcguuuggauc

SEQ ID NO: 3284661 - RNA, 20 nt, Variola virus
uuagacugacagacagaaca

SEQ ID NO: 3284662 - RNA, 15 nt, Variola virus
gaccaauuacugaua

SEQ ID NO: 3284663 - RNA, 18 nt, Variola virus
uauaaucugaugaacaau

SEQ ID NO: 3284664 - RNA, 16 nt, Variola virus
cuuaauagacaaacug

SEQ ID NO: 3284665 - RNA, 20 nt, Variola virus
gaucuagcaaaggaaauugu

SEQ ID NO: 3284666 - RNA, 13 nt, Variola virus
agauaaacuuuau

SEQ ID NO: 3284667 - RNA, 22 nt, Variola virus
gucaucuuauguuuuuaagaga

SEQ ID NO: 3284668 - RNA, 21 nt, Variola virus
cucuaaaugagucuacugcua

SEQ ID NO: 3284669 - RNA, 17 nt, Variola virus
cuauucaguaguguuua

SEQ ID NO: 3284670 - RNA, 13 nt, Variola virus
ugucuauaucuuc

SEQ ID NO: 3284671 - RNA, 19 nt, Variola virus
auacauuauuacuaaacau

SEQ ID NO: 3284672 - RNA, 20 nt, Variola virus
aauaaaggcagaaauacaau

SEQ ID NO: 3284673 - RNA, 18 nt, Variola virus
uaguauauaauaaagaua

SEQ ID NO: 3284674 - RNA, 19 nt, Variola virus
ucuguaaaccacaauuugc

SEQ ID NO: 3284675 - RNA, 19 nt, Variola virus
uuaauauugaaaauacuaa

SEQ ID NO: 3284676 - RNA, 22 nt, Variola virus
aaaacugguuuagcuaauacua

SEQ ID NO: 3284677 - RNA, 18 nt, Variola virus
agaaagcuguggauguuu

SEQ ID NO: 3284678 - RNA, 17 nt, Variola virus
uuagaauagucucuuua

SEQ ID NO: 3284679 - RNA, 16 nt, Variola virus
uuggcuaauugucuuu

SEQ ID NO: 3284680 - RNA, 15 nt, Variola virus
ccauucagacuacca

SEQ ID NO: 3284681 - RNA, 19 nt, Variola virus
aagauagcugaaacaaaga

SEQ ID NO: 3284682 - RNA, 22 nt, Variola virus
agaauugggcaagcauaagaca

SEQ ID NO: 3284683 - RNA, 15 nt, Variola virus
uaaauagacaaacaa

SEQ ID NO: 3284684 - RNA, 19 nt, Variola virus
gaauaguuuguuuuggaaa

SEQ ID NO: 3284685 - RNA, 18 nt, Variola virus
cugguacaggaguucagu

SEQ ID NO: 3284686 - RNA, 17 nt, Variola virus
uccguauuauacuugua

SEQ ID NO: 3284687 - RNA, 18 nt, Variola virus
agcaucaugaauacagua

SEQ ID NO: 3284688 - RNA, 18 nt, Variola virus
cacaacaauuuauuucua

SEQ ID NO: 3284689 - RNA, 12 nt, Variola virus
agugaaacauuc

SEQ ID NO: 3284690 - RNA, 12 nt, Variola virus
aauaauuauucu

SEQ ID NO: 3284691 - RNA, 22 nt, Variola virus
gauaguuuucucuauucugaaa

SEQ ID NO: 3284692 - RNA, 16 nt, Variola virus
aaaaaggagaauacua

SEQ ID NO: 3284693 - RNA, 23 nt, Variola virus
acugaaaauuaaaauaacacuau

SEQ ID NO: 3284694 - RNA, 21 nt, Variola virus
aauucgaggaagauguaaaga

SEQ ID NO: 3284695 - RNA, 14 nt, Variola virus
aaccagucaugaau

SEQ ID NO: 3284696 - RNA, 19 nt, Variola virus
ucgguaucugaaguacuua

SEQ ID NO: 3284697 - RNA, 19 nt, Variola virus
aauuucuggacguucacca

SEQ ID NO: 3284698 - RNA, 15 nt, Variola virus
aauuuuaccagaaua

SEQ ID NO: 3284699 - RNA, 22 nt, Variola virus
uauauagcuauucuucuuuaaa

SEQ ID NO: 3284700 - RNA, 19 nt, Variola virus
aucgacuugggucuucuca

SEQ ID NO: 3284701 - RNA, 18 nt, Variola virus
auuuuagcagugaaauaa

SEQ ID NO: 3284702 - RNA, 22 nt, Variola virus
aguguauuagacgacucauguu

SEQ ID NO: 3284703 - RNA, 18 nt, Variola virus
aacgauaauuuauacgua

SEQ ID NO: 3284704 - RNA, 18 nt, Variola virus
uccuacaggaauaucuuu

SEQ ID NO: 3284705 - RNA, 15 nt, Variola virus
acuucauuaaucuuu

SEQ ID NO: 3284706 - RNA, 15 nt, Variola virus
uugcggcauauauaa

SEQ ID NO: 3284707 - RNA, 13 nt, Variola virus
agacauaauauaa

SEQ ID NO: 3284708 - RNA, 22 nt, Variola virus
ugugaaacagacuuguaauucu

SEQ ID NO: 3284709 - RNA, 23 nt, Variola virus
auaguauggcauucauugucuaa

SEQ ID NO: 3284710 - RNA, 21 nt, Variola virus
aauagcaucaucuuuaucauu

SEQ ID NO: 3284711 - RNA, 15 nt, Variola virus
uuccauuuuuaauuu

SEQ ID NO: 3284712 - RNA, 19 nt, Variola virus
gccaguccuccuacagauu

SEQ ID NO: 3284713 - RNA, 15 nt, Variola virus
aucacucuucgaaaa

SEQ ID NO: 3284714 - RNA, 20 nt, Variola virus
aaucaccgucuaagaugaua

SEQ ID NO: 3284715 - RNA, 9 nt, Variola virus
cuauuugga

SEQ ID NO: 3284716 - RNA, 22 nt, Variola virus
acuggauauucgauaacagcau

SEQ ID NO: 3284717 - RNA, 13 nt, Variola virus
guguccauuuuua

SEQ ID NO: 3284718 - RNA, 17 nt, Variola virus
acauaauuauucuauca

SEQ ID NO: 3284719 - RNA, 16 nt, Variola virus
cgcuauuguagaaauu

SEQ ID NO: 3284720 - RNA, 19 nt, Variola virus
auacgucuuuauuuucuau

SEQ ID NO: 3284721 - RNA, 14 nt, Variola virus
guuucuacuaacuu

SEQ ID NO: 3284722 - RNA, 18 nt, Variola virus
cuuaaccauauauccaau

SEQ ID NO: 3284723 - RNA, 18 nt, Variola virus
uacuaauuacaaaccugu

SEQ ID NO: 3284724 - RNA, 17 nt, Variola virus
agacaaacgcugauaga

SEQ ID NO: 3284725 - RNA, 20 nt, Variola virus
cuucuauuuuaucauuuucc

SEQ ID NO: 3284726 - RNA, 16 nt, Variola virus
uaauagauauaucucu

SEQ ID NO: 3284727 - RNA, 16 nt, Variola virus
auagauggaguaagua

SEQ ID NO: 3284728 - RNA, 17 nt, Variola virus
caauguauacaaaugua

SEQ ID NO: 3284729 - RNA, 16 nt, Variola virus
ugaaaugauaacuguu

SEQ ID NO: 3284730 - RNA, 18 nt, Variola virus
auccaaaauacaaaaugu

SEQ ID NO: 3284731 - RNA, 20 nt, Variola virus
uuucaaugaguuuaauaacu

SEQ ID NO: 3284732 - RNA, 19 nt, Variola virus
uaccuugaaaauaaauaca

SEQ ID NO: 3284733 - RNA, 23 nt, Variola virus
cuucuggaagguuuguauucuga

SEQ ID NO: 3284734 - RNA, 20 nt, Variola virus
gguuaauguuguauuucauu

SEQ ID NO: 3284735 - RNA, 20 nt, Variola virus
caaacggaguaaaauaaaua

SEQ ID NO: 3284736 - RNA, 16 nt, Variola virus
uaaaauuccuacucau

SEQ ID NO: 3284737 - RNA, 19 nt, Variola virus
acuauuuugguaucuucca

SEQ ID NO: 3284738 - RNA, 14 nt, Variola virus
uggcgaaauuauug

SEQ ID NO: 3284739 - RNA, 14 nt, Variola virus
ccagugcuauaucu

SEQ ID NO: 3284740 - RNA, 14 nt, Variola virus
aggcgucaaaauua

SEQ ID NO: 3284741 - RNA, 17 nt, Variola virus
uaacacuauacuuauau

SEQ ID NO: 3284742 - RNA, 22 nt, Variola virus
uuaauaaugaucaucuagauaa

SEQ ID NO: 3284743 - RNA, 20 nt, Variola virus
ggucaguuuaugauugauuu

SEQ ID NO: 3284744 - RNA, 13 nt, Variola virus
uccaauguauuua

SEQ ID NO: 3284745 - RNA, 17 nt, Variola virus
cacacacgauuaauuuu

SEQ ID NO: 3284746 - RNA, 12 nt, Variola virus
uucauuaaggag

SEQ ID NO: 3284747 - RNA, 22 nt, Variola virus
gauaacuacaauauuucaucau

SEQ ID NO: 3284748 - RNA, 23 nt, Variola virus
auuuauauccuauauacgaaaaa

SEQ ID NO: 3284749 - RNA, 21 nt, Variola virus
aacuucuugcgugucuuucug

SEQ ID NO: 3284750 - RNA, 23 nt, Variola virus
agucagcuggucuaaaauuucca

SEQ ID NO: 3284751 - RNA, 12 nt, Variola virus
uauaaauuaaag

SEQ ID NO: 3284752 - RNA, 22 nt, Variola virus
guucugggaauagaaaccaaau

SEQ ID NO: 3284753 - RNA, 18 nt, Variola virus
ugauuguuugacaaauca

SEQ ID NO: 3284754 - RNA, 21 nt, Variola virus
agacaaaauauuagaaaaagu

SEQ ID NO: 3284755 - RNA, 16 nt, Variola virus
cauaauaugaucacau

SEQ ID NO: 3284756 - RNA, 22 nt, Variola virus
auacuugauaagauaaaaucua

SEQ ID NO: 3284757 - RNA, 20 nt, Variola virus
uaauaauaaacggaagagau

SEQ ID NO: 3284758 - RNA, 16 nt, Variola virus
agcauuuaaauccgaa

SEQ ID NO: 3284759 - RNA, 15 nt, Variola virus
ucauauaacaacaaa

SEQ ID NO: 3284760 - RNA, 24 nt, Variola virus
aguugaauauauuaaaguuauuua

SEQ ID NO: 3284761 - RNA, 22 nt, Variola virus
aacgcguaauugguauauguau

SEQ ID NO: 3284762 - RNA, 22 nt, Variola virus
uccuaucgaaugugacucugau

SEQ ID NO: 3284763 - RNA, 13 nt, Variola virus
gaaaaaauaucua

SEQ ID NO: 3284764 - RNA, 16 nt, Variola virus
uuccuuuaucauuaau

SEQ ID NO: 3284765 - RNA, 20 nt, Variola virus
cacauagaccuccuccacca

SEQ ID NO: 3284766 - RNA, 21 nt, Variola virus
uucuacccccguuacauuugu

SEQ ID NO: 3284767 - RNA, 15 nt, Variola virus
cuuaguaaacagucc

SEQ ID NO: 3284768 - RNA, 22 nt, Variola virus
ucuagacuccgcaucaacacca

SEQ ID NO: 3284769 - RNA, 18 nt, Variola virus
uucacagaugauaauaga

SEQ ID NO: 3284770 - RNA, 15 nt, Variola virus
agacauaagaaauuu

SEQ ID NO: 3284771 - RNA, 23 nt, Variola virus
cuuaacgaaagaaguuguaucau

SEQ ID NO: 3284772 - RNA, 21 nt, Variola virus
gaguuuagauuaguuaauaca

SEQ ID NO: 3284773 - RNA, 12 nt, Variola virus
caaauuaaacau

SEQ ID NO: 3284774 - RNA, 17 nt, Variola virus
cuugauacgaucauuaa

SEQ ID NO: 3284775 - RNA, 18 nt, Variola virus
agaagugaguauacuugu

SEQ ID NO: 3284776 - RNA, 15 nt, Variola virus
agaugcaaacauuau

SEQ ID NO: 3284777 - RNA, 22 nt, Variola virus
ugaauuacuaaaauauacaaac

SEQ ID NO: 3284778 - RNA, 16 nt, Variola virus
gaacaauaaacaaaau

SEQ ID NO: 3284779 - RNA, 17 nt, Variola virus
acgaauucuaugaugaa

SEQ ID NO: 3284780 - RNA, 17 nt, Variola virus
uagaauauuguaacaau

SEQ ID NO: 3284781 - RNA, 14 nt, Variola virus
uccaauguguuuaa

SEQ ID NO: 3284782 - RNA, 24 nt, Variola virus
uugucuuuaaguauauacgauaag

SEQ ID NO: 3284783 - RNA, 14 nt, Variola virus
cuguucaucguuua

SEQ ID NO: 3284784 - RNA, 19 nt, Variola virus
ugauacucuuauagaugua

SEQ ID NO: 3284785 - RNA, 14 nt, Variola virus
ucaaaauauguaga

SEQ ID NO: 3284786 - RNA, 18 nt, Variola virus
acaguguauguaaaaaug

SEQ ID NO: 3284787 - RNA, 14 nt, Variola virus
auuguaacaauaug

SEQ ID NO: 3284788 - RNA, 21 nt, Variola virus
ucagaaucaaauauagaucuu

SEQ ID NO: 3284789 - RNA, 16 nt, Variola virus
ccauuucaaaauguua

SEQ ID NO: 3284790 - RNA, 20 nt, Variola virus
aauuacgacgagcauauuca

SEQ ID NO: 3284791 - RNA, 16 nt, Variola virus
cgauguggaaauuaca

SEQ ID NO: 3284792 - RNA, 14 nt, Variola virus
auggucauguuuau

SEQ ID NO: 3284793 - RNA, 22 nt, Variola virus
cgauacauuuugcauuagauuu

SEQ ID NO: 3284794 - RNA, 13 nt, Variola virus
aucaauaaaugug

SEQ ID NO: 3284795 - RNA, 22 nt, Variola virus
acuauuuuaacgucuaaaugua

SEQ ID NO: 3284796 - RNA, 16 nt, Variola virus
auaguacuaaagacua

SEQ ID NO: 3284797 - RNA, 20 nt, Variola virus
gccucuagauauagcuuuua

SEQ ID NO: 3284798 - RNA, 16 nt, Variola virus
aguauaucuacuauau

SEQ ID NO: 3284799 - RNA, 13 nt, Variola virus
acuaaacacauua

SEQ ID NO: 3284800 - RNA, 17 nt, Variola virus
cuaaaauuuugaucauc

SEQ ID NO: 3284801 - RNA, 18 nt, Variola virus
auaaaauuaauaauagaa

SEQ ID NO: 3284802 - RNA, 19 nt, Variola virus
gacaagauccguuaguuua

SEQ ID NO: 3284803 - RNA, 18 nt, Variola virus
gaugucuacucguauauu

SEQ ID NO: 3284804 - RNA, 11 nt, Variola virus
cagucuggaaa

SEQ ID NO: 3284805 - RNA, 16 nt, Variola virus
auaaaaucaaaauuac

SEQ ID NO: 3284806 - RNA, 22 nt, Variola virus
ucuccaugauuaaauauuuuaa

SEQ ID NO: 3284807 - RNA, 18 nt, Variola virus
acacuggaucuaugguuu

SEQ ID NO: 3284808 - RNA, 14 nt, Variola virus
uagaggagaaguaa

SEQ ID NO: 3284809 - RNA, 23 nt, Variola virus
uguggccucgaauacaaauuuua

SEQ ID NO: 3284810 - RNA, 15 nt, Variola virus
acuauccaucagaau

SEQ ID NO: 3284811 - RNA, 15 nt, Variola virus
cuuuaaccuauacau

SEQ ID NO: 3284812 - RNA, 17 nt, Variola virus
ucguaaaaagauucuug

SEQ ID NO: 3284813 - RNA, 16 nt, Variola virus
cuauuuguauaauaau

SEQ ID NO: 3284814 - RNA, 14 nt, Variola virus
uagcauaaaugcua

SEQ ID NO: 3284815 - RNA, 16 nt, Variola virus
guaugauacaaucaag

SEQ ID NO: 3284816 - RNA, 15 nt, Variola virus
uacuugaaauaaucg

SEQ ID NO: 3284817 - RNA, 13 nt, Variola virus
uggagaagguuuc

SEQ ID NO: 3284818 - RNA, 21 nt, Variola virus
acuaucuccucuauucauaau

SEQ ID NO: 3284819 - RNA, 14 nt, Variola virus
uaauugcuuuucua

SEQ ID NO: 3284820 - RNA, 16 nt, Variola virus
acaaauggucaaugau

SEQ ID NO: 3284821 - RNA, 17 nt, Variola virus
acaccucaaugucuuua

SEQ ID NO: 3284822 - RNA, 14 nt, Variola virus
aaguacaaaauaua

SEQ ID NO: 3284823 - RNA, 15 nt, Variola virus
aucauauauagaaug

SEQ ID NO: 3284824 - RNA, 23 nt, Variola virus
aagaucacuaauucuagucuuua

SEQ ID NO: 3284825 - RNA, 20 nt, Variola virus
cauuaauauaugcucuagau

SEQ ID NO: 3284826 - RNA, 16 nt, Variola virus
ugauaaggauuccucc

SEQ ID NO: 3284827 - RNA, 18 nt, Variola virus
cccguaguuuuaacugga

SEQ ID NO: 3284828 - RNA, 19 nt, Variola virus
ucguaauuagguucuaaug

SEQ ID NO: 3284829 - RNA, 23 nt, Variola virus
acgccauagacauugaaaaugaa

SEQ ID NO: 3284830 - RNA, 14 nt, Variola virus
auauuuuaguuuug

SEQ ID NO: 3284831 - RNA, 15 nt, Variola virus
acuuuaagcuaaaau

SEQ ID NO: 3284832 - RNA, 17 nt, Variola virus
uaucaauuaaauaauua

SEQ ID NO: 3284833 - RNA, 21 nt, Variola virus
uaacuuucuucggcaaacuua

SEQ ID NO: 3284834 - RNA, 14 nt, Variola virus
cucuacaaauaucu

SEQ ID NO: 3284835 - RNA, 18 nt, Variola virus
cuuuguagagaaaaauuc

SEQ ID NO: 3284836 - RNA, 11 nt, Variola virus
uaccauacuua

SEQ ID NO: 3284837 - RNA, 18 nt, Variola virus
auaguauuaaugauugcc

SEQ ID NO: 3284838 - RNA, 17 nt, Variola virus
cuuauuuuuaacaaaug

SEQ ID NO: 3284839 - RNA, 16 nt, Variola virus
cuguuucgaaacuuua

SEQ ID NO: 3284840 - RNA, 14 nt, Variola virus
auugaaaauacuaa

SEQ ID NO: 3284841 - RNA, 17 nt, Variola virus
uaauuuuauauuccucu

SEQ ID NO: 3284842 - RNA, 17 nt, Variola virus
gauagacgcaaauuaga

SEQ ID NO: 3284843 - RNA, 11 nt, Variola virus
uaucaaagaua

SEQ ID NO: 3284844 - RNA, 23 nt, Variola virus
cacuacaguaaguacaucaucug

SEQ ID NO: 3284845 - RNA, 16 nt, Variola virus
ugaugaugaaaugaua

SEQ ID NO: 3284846 - RNA, 16 nt, Variola virus
uuuauaaaaaacuuuu

SEQ ID NO: 3284847 - RNA, 23 nt, Variola virus
auacgggaaauuacaaaaggaag

SEQ ID NO: 3284848 - RNA, 14 nt, Variola virus
augauauuguugau

SEQ ID NO: 3284849 - RNA, 14 nt, Variola virus
cauuguccuauuuc

SEQ ID NO: 3284850 - RNA, 14 nt, Variola virus
auaacaaauguaua

SEQ ID NO: 3284851 - RNA, 22 nt, Variola virus
uuacauaggcaacaucagaaac

SEQ ID NO: 3284852 - RNA, 20 nt, Variola virus
uacagagauguacagcuucc

SEQ ID NO: 3284853 - RNA, 21 nt, Variola virus
gaaguuccgguugccauguau

SEQ ID NO: 3284854 - RNA, 14 nt, Variola virus
ugcuaaauuuucau

SEQ ID NO: 3284855 - RNA, 19 nt, Variola virus
uauuauugauccaaucaaa

SEQ ID NO: 3284856 - RNA, 22 nt, Variola virus
guaaaauggccaagaaaauaga

SEQ ID NO: 3284857 - RNA, 19 nt, Variola virus
auacgaauguaucaaacag

SEQ ID NO: 3284858 - RNA, 16 nt, Variola virus
cugaguaugaugauuu

SEQ ID NO: 3284859 - RNA, 22 nt, Variola virus
uuuuuaacgcaauggucuuaga

SEQ ID NO: 3284860 - RNA, 20 nt, Variola virus
agauuggguuaauaaauaca

SEQ ID NO: 3284861 - RNA, 23 nt, Variola virus
gucuauuguuaaucaugccacca

SEQ ID NO: 3284862 - RNA, 18 nt, Variola virus
cuuguaagaaguaaaugc

SEQ ID NO: 3284863 - RNA, 20 nt, Variola virus
gaaauucuaucucuaagacg

SEQ ID NO: 3284864 - RNA, 13 nt, Variola virus
uaauaaauuuauu

SEQ ID NO: 3284865 - RNA, 13 nt, Variola virus
auguguagaauua

SEQ ID NO: 3284866 - RNA, 22 nt, Variola virus
aauagaauauacucuauucuuc

SEQ ID NO: 3284867 - RNA, 14 nt, Variola virus
gauaauauuaucua

SEQ ID NO: 3284868 - RNA, 13 nt, Variola virus
aauucauuuccau

SEQ ID NO: 3284869 - RNA, 23 nt, Variola virus
aaauagaucucugguucuauguu

SEQ ID NO: 3284870 - RNA, 16 nt, Variola virus
auuuucauucacuauu

SEQ ID NO: 3284871 - RNA, 17 nt, Variola virus
uauguguagaauuaaau

SEQ ID NO: 3284872 - RNA, 14 nt, Variola virus
aacgguaucuucuu

SEQ ID NO: 3284873 - RNA, 20 nt, Variola virus
guuuucagaagauaauuauc

SEQ ID NO: 3284874 - RNA, 15 nt, Variola virus
cugccgaauuuagag

SEQ ID NO: 3284875 - RNA, 13 nt, Variola virus
aacacuauuagaa

SEQ ID NO: 3284876 - RNA, 20 nt, Variola virus
ugacuuuaucagaucaaaau

SEQ ID NO: 3284877 - RNA, 13 nt, Variola virus
uaaacuauucucg

SEQ ID NO: 3284878 - RNA, 21 nt, Variola virus
cuaugaauaccauuaaacaau

SEQ ID NO: 3284879 - RNA, 14 nt, Variola virus
aaaaaugaugaauu

SEQ ID NO: 3284880 - RNA, 23 nt, Variola virus
acagaucaaaaaauauaguucca

SEQ ID NO: 3284881 - RNA, 12 nt, Variola virus
uuuuauaaacag

SEQ ID NO: 3284882 - RNA, 23 nt, Variola virus
agucauuugacuagauaaacuau

SEQ ID NO: 3284883 - RNA, 14 nt, Variola virus
caaugaauggauua

SEQ ID NO: 3284884 - RNA, 18 nt, Variola virus
auauaauacuuaaaaaug

SEQ ID NO: 3284885 - RNA, 15 nt, Variola virus
cucuucucugcauuu

SEQ ID NO: 3284886 - RNA, 22 nt, Variola virus
uuagauuuauuuuuauaaaguu

SEQ ID NO: 3284887 - RNA, 15 nt, Variola virus
aaaugcguacauaac

SEQ ID NO: 3284888 - RNA, 15 nt, Variola virus
acaagcuguuuaucu

SEQ ID NO: 3284889 - RNA, 16 nt, Variola virus
uaauguuuaauuuauc

SEQ ID NO: 3284890 - RNA, 13 nt, Variola virus
ggauucaaaaaga

SEQ ID NO: 3284891 - RNA, 18 nt, Variola virus
uaucaaauagcucaauau

SEQ ID NO: 3284892 - RNA, 15 nt, Variola virus
auugcucaaauaaua

SEQ ID NO: 3284893 - RNA, 21 nt, Variola virus
auccagcuagugaauauauau

SEQ ID NO: 3284894 - RNA, 13 nt, Variola virus
uauacgaauauga

SEQ ID NO: 3284895 - RNA, 17 nt, Variola virus
uuuguuaagaauuuaga

SEQ ID NO: 3284896 - RNA, 19 nt, Variola virus
uauaugacuaacuuaucua

SEQ ID NO: 3284897 - RNA, 22 nt, Variola virus
auucugccguguuuaaaaauuc

SEQ ID NO: 3284898 - RNA, 19 nt, Variola virus
ucuuuguccauuauuucua

SEQ ID NO: 3284899 - RNA, 18 nt, Variola virus
uaaauguccacuauacau

SEQ ID NO: 3284900 - RNA, 14 nt, Variola virus
aacuaacuauugaa

SEQ ID NO: 3284901 - RNA, 23 nt, Variola virus
guucuagucgguauuucaucauu

SEQ ID NO: 3284902 - RNA, 15 nt, Variola virus
auauucauagauuga

SEQ ID NO: 3284903 - RNA, 14 nt, Variola virus
uguuaaaaaugauu

SEQ ID NO: 3284904 - RNA, 22 nt, Variola virus
cuguacaauaguuuuuaucuau

SEQ ID NO: 3284905 - RNA, 23 nt, Variola virus
uugacguaugcaguuacaucguu

SEQ ID NO: 3284906 - RNA, 13 nt, Variola virus
cucuaauagauuu

SEQ ID NO: 3284907 - RNA, 13 nt, Variola virus
uaaagaugcuauu

SEQ ID NO: 3284908 - RNA, 16 nt, Variola virus
ucuaauacuuuaacau

SEQ ID NO: 3284909 - RNA, 14 nt, Variola virus
cacaaucaugauuu

SEQ ID NO: 3284910 - RNA, 15 nt, Variola virus
aauuguuugagauau

SEQ ID NO: 3284911 - RNA, 15 nt, Variola virus
uagaucaucugaaaa

SEQ ID NO: 3284912 - RNA, 16 nt, Variola virus
agccaaguaucuuguc

SEQ ID NO: 3284913 - RNA, 15 nt, Variola virus
aacuacuugaaauuc

SEQ ID NO: 3284914 - RNA, 21 nt, Variola virus
cugauuuuuuaugauuuugug

SEQ ID NO: 3284915 - RNA, 18 nt, Variola virus
uuauaaagauauguaugu

SEQ ID NO: 3284916 - RNA, 20 nt, Variola virus
uuucaucuagauacacuaga

SEQ ID NO: 3284917 - RNA, 14 nt, Variola virus
gcauuaauaacauc

SEQ ID NO: 3284918 - RNA, 22 nt, Variola virus
auucacaccuagagacaaugaa

SEQ ID NO: 3284919 - RNA, 23 nt, Variola virus
auuucgauaauauacgguaaucu

SEQ ID NO: 3284920 - RNA, 19 nt, Variola virus
aggauauaaguagauguuc

SEQ ID NO: 3284921 - RNA, 17 nt, Variola virus
guacccacugaugagau

SEQ ID NO: 3284922 - RNA, 20 nt, Variola virus
cuuaagacaaguuuaacaau

SEQ ID NO: 3284923 - RNA, 13 nt, Variola virus
aacaaaaauugau

SEQ ID NO: 3284924 - RNA, 15 nt, Variola virus
uaccuggaauguaaa

SEQ ID NO: 3284925 - RNA, 13 nt, Variola virus
cuaccaucauguc

SEQ ID NO: 3284926 - RNA, 10 nt, Variola virus
auuaauuaaa

SEQ ID NO: 3284927 - RNA, 21 nt, Variola virus
aguuauauuuucgucuaucca

SEQ ID NO: 3284928 - RNA, 13 nt, Variola virus
ucuuauagaugug

SEQ ID NO: 3284929 - RNA, 12 nt, Variola virus
aaaaauggaugu

SEQ ID NO: 3284930 - RNA, 18 nt, Variola virus
gcauucgguucuaccaac

SEQ ID NO: 3284931 - RNA, 21 nt, Variola virus
gauaucuuuagauauauccac

SEQ ID NO: 3284932 - RNA, 16 nt, Variola virus
auuauacuguuaaaug

SEQ ID NO: 3284933 - RNA, 19 nt, Variola virus
uccauacauguuauuauca

SEQ ID NO: 3284934 - RNA, 19 nt, Variola virus
gcauuaacaaaaucuuuaa

SEQ ID NO: 3284935 - RNA, 20 nt, Variola virus
agacugugcaucaacaguua

SEQ ID NO: 3284936 - RNA, 15 nt, Variola virus
agaaaauaucauguu

SEQ ID NO: 3284937 - RNA, 13 nt, Variola virus
aaucccaauucag

SEQ ID NO: 3284938 - RNA, 23 nt, Variola virus
uauuaauaagaaugacuccuaua

SEQ ID NO: 3284939 - RNA, 22 nt, Variola virus
acaauaucauaaacaaacuaau

SEQ ID NO: 3284940 - RNA, 20 nt, Variola virus
uuaaauaguaguacacaaca

SEQ ID NO: 3284941 - RNA, 14 nt, Variola virus
caaacaauaaugac

SEQ ID NO: 3284942 - RNA, 23 nt, Variola virus
acgaauauaaaucauauuuagaa

SEQ ID NO: 3284943 - RNA, 22 nt, Variola virus
agaacuggacuguauaucucau

SEQ ID NO: 3284944 - RNA, 22 nt, Variola virus
auaugggauuuuacuuaauaua

SEQ ID NO: 3284945 - RNA, 23 nt, Variola virus
ugugucuacaaccgcuacauaau

SEQ ID NO: 3284946 - RNA, 15 nt, Variola virus
auaaauaaucaaaau

SEQ ID NO: 3284947 - RNA, 17 nt, Variola virus
auuuuauguacagaggu

SEQ ID NO: 3284948 - RNA, 16 nt, Variola virus
aucucauuugaaaaua

SEQ ID NO: 3284949 - RNA, 20 nt, Variola virus
auacaaauuuuaagaaaugg

SEQ ID NO: 3284950 - RNA, 19 nt, Variola virus
guaaauguuuaauguuuua

SEQ ID NO: 3284951 - RNA, 18 nt, Variola virus
uaaagauagaaaugaauu

SEQ ID NO: 3284952 - RNA, 14 nt, Variola virus
aauuauuucuaaua

SEQ ID NO: 3284953 - RNA, 21 nt, Variola virus
cagauuagcagaauagauauu

SEQ ID NO: 3284954 - RNA, 12 nt, Variola virus
cuaauucucaga

SEQ ID NO: 3284955 - RNA, 16 nt, Variola virus
aaaacauucaaauguu

SEQ ID NO: 3284956 - RNA, 15 nt, Variola virus
aggacgguauaugua

SEQ ID NO: 3284957 - RNA, 15 nt, Variola virus
ucacuaauaaauugg

SEQ ID NO: 3284958 - RNA, 16 nt, Variola virus
guuuauuccaauaaau

SEQ ID NO: 3284959 - RNA, 18 nt, Variola virus
ucauucuuaagacacauu

SEQ ID NO: 3284960 - RNA, 12 nt, Variola virus
gacauuagaccg

SEQ ID NO: 3284961 - RNA, 11 nt, Variola virus
aauaaaaauua

SEQ ID NO: 3284962 - RNA, 21 nt, Variola virus
auucgaagcaguuacaaugac

SEQ ID NO: 3284963 - RNA, 14 nt, Variola virus
ucuaacaucaucau

SEQ ID NO: 3284964 - RNA, 21 nt, Variola virus
uccuccaguagcaugugguuc

SEQ ID NO: 3284965 - RNA, 17 nt, Variola virus
ugucaucauuucuaaug

SEQ ID NO: 3284966 - RNA, 20 nt, Variola virus
uagagcccacguuuaaacau

SEQ ID NO: 3284967 - RNA, 17 nt, Variola virus
agauaagaacauaauaa

SEQ ID NO: 3284968 - RNA, 16 nt, Variola virus
auaaauguucaaugaa

SEQ ID NO: 3284969 - RNA, 15 nt, Variola virus
ucguucucugaaaau

SEQ ID NO: 3284970 - RNA, 21 nt, Variola virus
aucaagucuuuauacaaugac

SEQ ID NO: 3284971 - RNA, 17 nt, Variola virus
uagucauagaugaaaua

SEQ ID NO: 3284972 - RNA, 18 nt, Variola virus
uaccacuuauuacuccau

SEQ ID NO: 3284973 - RNA, 18 nt, Variola virus
caauaacacaaucaugau

SEQ ID NO: 3284974 - RNA, 15 nt, Variola virus
agauuucgucuaaua

SEQ ID NO: 3284975 - RNA, 18 nt, Variola virus
uacgguugauucaaaaau

SEQ ID NO: 3284976 - RNA, 21 nt, Variola virus
uaauuaaaaguuuuacuauau

SEQ ID NO: 3284977 - RNA, 19 nt, Variola virus
aagacucagaagaggauua

SEQ ID NO: 3284978 - RNA, 16 nt, Variola virus
acucauuuaacagaug

SEQ ID NO: 3284979 - RNA, 13 nt, Variola virus
ucuuaaauaacuc

SEQ ID NO: 3284980 - RNA, 19 nt, Variola virus
accguauuacucuacagua

SEQ ID NO: 3284981 - RNA, 11 nt, Variola virus
cauucaugaaa

SEQ ID NO: 3284982 - RNA, 23 nt, Variola virus
auuaaacuuaccacguaaaacuu

SEQ ID NO: 3284983 - RNA, 16 nt, Variola virus
acuaauguauauuuua

SEQ ID NO: 3284984 - RNA, 22 nt, Variola virus
aucauuucgacauuaauuccuu

SEQ ID NO: 3284985 - RNA, 19 nt, Variola virus
acaaaugcaccaaaguuau

SEQ ID NO: 3284986 - RNA, 19 nt, Variola virus
guaaucauguaaauguuua

SEQ ID NO: 3284987 - RNA, 21 nt, Variola virus
acuucuaaaacagcugugaau

SEQ ID NO: 3284988 - RNA, 15 nt, Variola virus
cuaucgauaauuguu

SEQ ID NO: 3284989 - RNA, 22 nt, Variola virus
ugagauauuacucaaaauacua

SEQ ID NO: 3284990 - RNA, 13 nt, Variola virus
aagaaaaaugauu

SEQ ID NO: 3284991 - RNA, 20 nt, Variola virus
ucuucaguucuaucuucuaa

SEQ ID NO: 3284992 - RNA, 21 nt, Variola virus
aauuuccccauugauagaaaa

SEQ ID NO: 3284993 - RNA, 17 nt, Variola virus
cuauguuccucguuucc

SEQ ID NO: 3284994 - RNA, 15 nt, Variola virus
aauagaguauuccaa

SEQ ID NO: 3284995 - RNA, 17 nt, Variola virus
cuaaaucgucaguagua

SEQ ID NO: 3284996 - RNA, 20 nt, Variola virus
acuguggaugugacagacug

SEQ ID NO: 3284997 - RNA, 18 nt, Variola virus
auccuuuaagaucaacau

SEQ ID NO: 3284998 - RNA, 13 nt, Variola virus
uuuguacauguaa

SEQ ID NO: 3284999 - RNA, 16 nt, Variola virus
ccagauagaaaauauc

SEQ ID NO: 3285000 - RNA, 23 nt, Variola virus
cuugcacguaaagucuacauugu

SEQ ID NO: 3285001 - RNA, 12 nt, Variola virus
gugauuuuggua

SEQ ID NO: 3285002 - RNA, 24 nt, Variola virus
gaaucuagaucgaugauaacuucu

SEQ ID NO: 3285003 - RNA, 23 nt, Variola virus
auacuauccaucagaauguuucc

SEQ ID NO: 3285004 - RNA, 18 nt, Variola virus
aucuucuuauaagauugu

SEQ ID NO: 3285005 - RNA, 12 nt, Variola virus
ugacuucaucau

SEQ ID NO: 3285006 - RNA, 20 nt, Variola virus
ccagggaaaucaaagaagaa

SEQ ID NO: 3285007 - RNA, 22 nt, Variola virus
cuaccauggacggagacaaauu

SEQ ID NO: 3285008 - RNA, 12 nt, Variola virus
gaugauauuaac

SEQ ID NO: 3285009 - RNA, 24 nt, Variola virus
auauauucuuacaguacauaguau

SEQ ID NO: 3285010 - RNA, 14 nt, Variola virus
cgaagaauaauguu

SEQ ID NO: 3285011 - RNA, 15 nt, Variola virus
ugacaucaacuacaa

SEQ ID NO: 3285012 - RNA, 22 nt, Variola virus
gacauauuucgacaaaaagaua

SEQ ID NO: 3285013 - RNA, 23 nt, Variola virus
caucgcuaaucaacacuauuuua

SEQ ID NO: 3285014 - RNA, 15 nt, Variola virus
gaugcuauuagaauu

SEQ ID NO: 3285015 - RNA, 20 nt, Variola virus
aucaguuauaaaaaauaaag

SEQ ID NO: 3285016 - RNA, 21 nt, Variola virus
cgguuaauguuguauuucauu

SEQ ID NO: 3285017 - RNA, 21 nt, Variola virus
auucugaauagugaaaaccuu

SEQ ID NO: 3285018 - RNA, 22 nt, Variola virus
uuaaaggauaaaauauuaucca

SEQ ID NO: 3285019 - RNA, 13 nt, Variola virus
cauagaaaaugau

SEQ ID NO: 3285020 - RNA, 20 nt, Variola virus
agaacaugugugaaaauauu

SEQ ID NO: 3285021 - RNA, 17 nt, Variola virus
acauuaacauuuugaaa

SEQ ID NO: 3285022 - RNA, 19 nt, Variola virus
ucaaauggauaauuuaaga

SEQ ID NO: 3285023 - RNA, 21 nt, Variola virus
uuaaacagauauaguuuuucu

SEQ ID NO: 3285024 - RNA, 13 nt, Variola virus
aacuugaucuuua

SEQ ID NO: 3285025 - RNA, 15 nt, Variola virus
caaauaauacuauau

SEQ ID NO: 3285026 - RNA, 22 nt, Variola virus
uuauuaaaguacguaaaucuag

SEQ ID NO: 3285027 - RNA, 14 nt, Variola virus
aguaauuauaagaa

SEQ ID NO: 3285028 - RNA, 18 nt, Variola virus
agacguggcaaacaaugu

SEQ ID NO: 3285029 - RNA, 21 nt, Variola virus
aucucugacaccaaccuguau

SEQ ID NO: 3285030 - RNA, 18 nt, Variola virus
ugauuuauaauguggaua

SEQ ID NO: 3285031 - RNA, 14 nt, Variola virus
augcuuaaaaugcu

SEQ ID NO: 3285032 - RNA, 15 nt, Variola virus
caaauaacaaaaucc

SEQ ID NO: 3285033 - RNA, 23 nt, Variola virus
ucuaaauaauaucuauuguuugg

SEQ ID NO: 3285034 - RNA, 18 nt, Variola virus
agaaguuuucccaaaaaa

SEQ ID NO: 3285035 - RNA, 22 nt, Variola virus
aaugcagaucuaauaaauggag

SEQ ID NO: 3285036 - RNA, 14 nt, Variola virus
uauuguuuuauaua

SEQ ID NO: 3285037 - RNA, 15 nt, Variola virus
uuaugacgauuucaa

SEQ ID NO: 3285038 - RNA, 13 nt, Variola virus
uauaagaaugauu

SEQ ID NO: 3285039 - RNA, 15 nt, Variola virus
ccaguuauguucaac

SEQ ID NO: 3285040 - RNA, 18 nt, Variola virus
caauuuuaucaucuucua

SEQ ID NO: 3285041 - RNA, 17 nt, Variola virus
acuuacgauagaaauag

SEQ ID NO: 3285042 - RNA, 15 nt, Variola virus
auaauucucauauau

SEQ ID NO: 3285043 - RNA, 21 nt, Variola virus
ucaaauucucauucauguaua

SEQ ID NO: 3285044 - RNA, 13 nt, Variola virus
aacauguuaaaau

SEQ ID NO: 3285045 - RNA, 21 nt, Variola virus
uauggcgccauuggcaucuug

SEQ ID NO: 3285046 - RNA, 14 nt, Variola virus
acaaucguuaauaa

SEQ ID NO: 3285047 - RNA, 19 nt, Variola virus
auuuguugacgacauauau

SEQ ID NO: 3285048 - RNA, 19 nt, Variola virus
aaucaccauccuuuaaaaa

SEQ ID NO: 3285049 - RNA, 21 nt, Variola virus
cuagauaaaauacugaaucaa

SEQ ID NO: 3285050 - RNA, 16 nt, Variola virus
uauuucuccacuacau

SEQ ID NO: 3285051 - RNA, 14 nt, Variola virus
uuuuaaggggaaaa

SEQ ID NO: 3285052 - RNA, 13 nt, Variola virus
cguaguaacucua

SEQ ID NO: 3285053 - RNA, 15 nt, Variola virus
uagacacgcguaaua

SEQ ID NO: 3285054 - RNA, 15 nt, Variola virus
gaucgguucagcauu

SEQ ID NO: 3285055 - RNA, 18 nt, Variola virus
aauguuugacugaauaua

SEQ ID NO: 3285056 - RNA, 17 nt, Variola virus
aucaauauaucaucuau

SEQ ID NO: 3285057 - RNA, 16 nt, Variola virus
uacaucaaucuuacag

SEQ ID NO: 3285058 - RNA, 20 nt, Variola virus
uagaggaacauuaaacaucg

SEQ ID NO: 3285059 - RNA, 21 nt, Variola virus
uuugucuuugaacaacauuuu

SEQ ID NO: 3285060 - RNA, 20 nt, Variola virus
auaccucauaaaacaaaaaa

SEQ ID NO: 3285061 - RNA, 18 nt, Variola virus
ucuguucaaaaauuuaga

SEQ ID NO: 3285062 - RNA, 21 nt, Variola virus
uaccuaucaaggaacaaauau

SEQ ID NO: 3285063 - RNA, 16 nt, Variola virus
ucucacugaauacgag

SEQ ID NO: 3285064 - RNA, 16 nt, Variola virus
cuauaucuaacaucuu

SEQ ID NO: 3285065 - RNA, 22 nt, Variola virus
ucuauacgucuuuauuuucuau

SEQ ID NO: 3285066 - RNA, 18 nt, Variola virus
gcaguaacauagauuauu

SEQ ID NO: 3285067 - RNA, 16 nt, Variola virus
aaagauuaauuauccg

SEQ ID NO: 3285068 - RNA, 14 nt, Variola virus
cucauaauccauuu

SEQ ID NO: 3285069 - RNA, 13 nt, Variola virus
uccuguaauaucu

SEQ ID NO: 3285070 - RNA, 17 nt, Variola virus
uguuauccaacauauca

SEQ ID NO: 3285071 - RNA, 16 nt, Variola virus
ugauuaggcaugucga

SEQ ID NO: 3285072 - RNA, 17 nt, Variola virus
caauauuaauauuucua

SEQ ID NO: 3285073 - RNA, 23 nt, Variola virus
acaauauuuuucguuuacaaaau

SEQ ID NO: 3285074 - RNA, 14 nt, Variola virus
accaucgauuguuu

SEQ ID NO: 3285075 - RNA, 19 nt, Variola virus
auuuauuuaguauuaaaug

SEQ ID NO: 3285076 - RNA, 19 nt, Variola virus
uauuacauaauauauacag

SEQ ID NO: 3285077 - RNA, 18 nt, Variola virus
auaaacuaacauuguuaa

SEQ ID NO: 3285078 - RNA, 17 nt, Variola virus
ucuuugaacuguuuaag

SEQ ID NO: 3285079 - RNA, 21 nt, Variola virus
auauaguuuuuacacauagau

SEQ ID NO: 3285080 - RNA, 11 nt, Variola virus
ggaaaaugaug

SEQ ID NO: 3285081 - RNA, 22 nt, Variola virus
auaauguuguccauuguaguau

SEQ ID NO: 3285082 - RNA, 14 nt, Variola virus
gagaauuaaaagag

SEQ ID NO: 3285083 - RNA, 19 nt, Variola virus
aaaaagaccaguucauuca

SEQ ID NO: 3285084 - RNA, 22 nt, Variola virus
uuaucgguaacaucuuuguaaa

SEQ ID NO: 3285085 - RNA, 23 nt, Variola virus
acaucuggccuguucauaaauaa

SEQ ID NO: 3285086 - RNA, 18 nt, Variola virus
cgauucuggcuauuucaa

SEQ ID NO: 3285087 - RNA, 18 nt, Variola virus
auaaacguucacguaaau

SEQ ID NO: 3285088 - RNA, 12 nt, Variola virus
agccaauacuuu

SEQ ID NO: 3285089 - RNA, 20 nt, Variola virus
auguggaaauuacacuguau

SEQ ID NO: 3285090 - RNA, 12 nt, Variola virus
aaggaacuagaa

SEQ ID NO: 3285091 - RNA, 14 nt, Variola virus
cgcauguggaugga

SEQ ID NO: 3285092 - RNA, 20 nt, Variola virus
uaggagucagacuuguauuc

SEQ ID NO: 3285093 - RNA, 13 nt, Variola virus
auucuaugauggu

SEQ ID NO: 3285094 - RNA, 18 nt, Variola virus
auuuagauacaucuauau

SEQ ID NO: 3285095 - RNA, 12 nt, Variola virus
cuaaaugaugau

SEQ ID NO: 3285096 - RNA, 23 nt, Variola virus
augugauuguucaaucaauauua

SEQ ID NO: 3285097 - RNA, 22 nt, Variola virus
aacggcgagaagacaauauuau

SEQ ID NO: 3285098 - RNA, 16 nt, Variola virus
guaucaagaauaucca

SEQ ID NO: 3285099 - RNA, 16 nt, Variola virus
aggauacugaucuucu

SEQ ID NO: 3285100 - RNA, 21 nt, Variola virus
uucggguuccaaacauuaaca

SEQ ID NO: 3285101 - RNA, 18 nt, Variola virus
gauaucucauuaaaauau

SEQ ID NO: 3285102 - RNA, 12 nt, Variola virus
agaaauacuucu

SEQ ID NO: 3285103 - RNA, 15 nt, Variola virus
guuaauuucuauuca

SEQ ID NO: 3285104 - RNA, 18 nt, Variola virus
auuuuuguacauuaauaa

SEQ ID NO: 3285105 - RNA, 14 nt, Variola virus
uuauccucauuaaa

SEQ ID NO: 3285106 - RNA, 11 nt, Variola virus
ugaagaaauga

SEQ ID NO: 3285107 - RNA, 14 nt, Variola virus
cuuuaagcagaucu

SEQ ID NO: 3285108 - RNA, 18 nt, Variola virus
ucccaccaaauuaaugaa

SEQ ID NO: 3285109 - RNA, 17 nt, Variola virus
caugcauccaaauggau

SEQ ID NO: 3285110 - RNA, 14 nt, Variola virus
uuuaucgauguaca

SEQ ID NO: 3285111 - RNA, 19 nt, Variola virus
cuacugcguccgcuuuagu

SEQ ID NO: 3285112 - RNA, 21 nt, Variola virus
uuauaaaaauuaaaaaaucac

SEQ ID NO: 3285113 - RNA, 14 nt, Variola virus
auauaguuuaaauu

SEQ ID NO: 3285114 - RNA, 19 nt, Variola virus
auuaaauuuuuuuauuaau

SEQ ID NO: 3285115 - RNA, 15 nt, Variola virus
uaucuaacucguaaa

SEQ ID NO: 3285116 - RNA, 12 nt, Variola virus
uuccaauguuua

SEQ ID NO: 3285117 - RNA, 21 nt, Variola virus
acucaacauaaauaauucuag

SEQ ID NO: 3285118 - RNA, 15 nt, Variola virus
caucauuccauaauu

SEQ ID NO: 3285119 - RNA, 15 nt, Variola virus
auaauuauuuuguaa

SEQ ID NO: 3285120 - RNA, 19 nt, Variola virus
auuguagcuauuuaaaugg

SEQ ID NO: 3285121 - RNA, 14 nt, Variola virus
aucaaauucauuau

SEQ ID NO: 3285122 - RNA, 11 nt, Variola virus
guauuuaagag

SEQ ID NO: 3285123 - RNA, 15 nt, Variola virus
uucugauuuauccuu

SEQ ID NO: 3285124 - RNA, 22 nt, Variola virus
aagauaugguaaaauuaaauag

SEQ ID NO: 3285125 - RNA, 14 nt, Variola virus
ugacgucuguggau

SEQ ID NO: 3285126 - RNA, 23 nt, Variola virus
cucuauuggauauggauuuccag

SEQ ID NO: 3285127 - RNA, 14 nt, Variola virus
aguauacuaccuau

SEQ ID NO: 3285128 - RNA, 23 nt, Variola virus
uauuugagaaauauguauacaua

SEQ ID NO: 3285129 - RNA, 15 nt, Variola virus
caaaucaaaaguauu

SEQ ID NO: 3285130 - RNA, 20 nt, Variola virus
auaaaacaauggaacaauua

SEQ ID NO: 3285131 - RNA, 15 nt, Variola virus
uucuuuuucauuaac

SEQ ID NO: 3285132 - RNA, 21 nt, Variola virus
uguaguuguugguaacgucug

SEQ ID NO: 3285133 - RNA, 22 nt, Variola virus
agaaaaugucccucauaauaaa

SEQ ID NO: 3285134 - RNA, 21 nt, Variola virus
aggaugacucucaaauuauua

SEQ ID NO: 3285135 - RNA, 14 nt, Variola virus
gcauaacucuauca

SEQ ID NO: 3285136 - RNA, 21 nt, Variola virus
gaauuguuucuuuuagaagug

SEQ ID NO: 3285137 - RNA, 14 nt, Variola virus
auaucuauguuuaa

SEQ ID NO: 3285138 - RNA, 18 nt, Variola virus
aaggauucauugacauau

SEQ ID NO: 3285139 - RNA, 21 nt, Variola virus
cguucaacaacguacauacua

SEQ ID NO: 3285140 - RNA, 22 nt, Variola virus
uugaugugaucaauuuccaaca

SEQ ID NO: 3285141 - RNA, 17 nt, Variola virus
uauaacauucauuagua

SEQ ID NO: 3285142 - RNA, 16 nt, Variola virus
caagagauauauugga

SEQ ID NO: 3285143 - RNA, 22 nt, Variola virus
cauauaguauucuuguauucua

SEQ ID NO: 3285144 - RNA, 15 nt, Variola virus
augaguucugugcag

SEQ ID NO: 3285145 - RNA, 19 nt, Variola virus
auuacaaacuauagaaauu

SEQ ID NO: 3285146 - RNA, 15 nt, Variola virus
accaaaaaaaauaac

SEQ ID NO: 3285147 - RNA, 12 nt, Variola virus
guacauacuaga

SEQ ID NO: 3285148 - RNA, 17 nt, Variola virus
ugaucgccauggauggu

SEQ ID NO: 3285149 - RNA, 21 nt, Variola virus
ugcacagcgaagaauucuaga

SEQ ID NO: 3285150 - RNA, 15 nt, Variola virus
auaguuauaucacau

SEQ ID NO: 3285151 - RNA, 11 nt, Variola virus
aaauacuagua

SEQ ID NO: 3285152 - RNA, 13 nt, Variola virus
guucguaaacgaa

SEQ ID NO: 3285153 - RNA, 22 nt, Variola virus
ccguuuauuaucuuguuccaua

SEQ ID NO: 3285154 - RNA, 16 nt, Variola virus
uauaggaaaaaaacaa

SEQ ID NO: 3285155 - RNA, 12 nt, Variola virus
uucuuacaauua

SEQ ID NO: 3285156 - RNA, 13 nt, Variola virus
agcuauucaagau

SEQ ID NO: 3285157 - RNA, 18 nt, Variola virus
aucuauuuucuugucaug

SEQ ID NO: 3285158 - RNA, 16 nt, Variola virus
uaaaauaaauaucauu

SEQ ID NO: 3285159 - RNA, 15 nt, Variola virus
ucuauaucauguaga

SEQ ID NO: 3285160 - RNA, 20 nt, Variola virus
gauauaauauauuagauauu

SEQ ID NO: 3285161 - RNA, 18 nt, Variola virus
uccaucuguggaaaauaa

SEQ ID NO: 3285162 - RNA, 16 nt, Variola virus
auaauagauuuaucua

SEQ ID NO: 3285163 - RNA, 16 nt, Variola virus
cuauuacguacauaac

SEQ ID NO: 3285164 - RNA, 11 nt, Variola virus
cucuagaaaaa

SEQ ID NO: 3285165 - RNA, 17 nt, Variola virus
auauucaagcgaauuac

SEQ ID NO: 3285166 - RNA, 20 nt, Variola virus
cugguguuaguuuauuccaa

SEQ ID NO: 3285167 - RNA, 20 nt, Variola virus
ucugaacccguuaauguaua

SEQ ID NO: 3285168 - RNA, 22 nt, Variola virus
augcugguuauuacacaugugu

SEQ ID NO: 3285169 - RNA, 19 nt, Variola virus
agaauauuccucuaacaga

SEQ ID NO: 3285170 - RNA, 13 nt, Variola virus
uauuauaaucauu

SEQ ID NO: 3285171 - RNA, 22 nt, Variola virus
auaaucuaaaauaguucuguaa

SEQ ID NO: 3285172 - RNA, 17 nt, Variola virus
aauguuugacugaauau

SEQ ID NO: 3285173 - RNA, 20 nt, Variola virus
auauucaguaaccaaauaca

SEQ ID NO: 3285174 - RNA, 14 nt, Variola virus
auuauuuuuggaag

SEQ ID NO: 3285175 - RNA, 14 nt, Variola virus
gaacauuuaagaga

SEQ ID NO: 3285176 - RNA, 17 nt, Variola virus
gaacaauaaaagagaau

SEQ ID NO: 3285177 - RNA, 13 nt, Variola virus
agacgcuuauuau

SEQ ID NO: 3285178 - RNA, 13 nt, Variola virus
uuaauaauuguua

SEQ ID NO: 3285179 - RNA, 16 nt, Variola virus
uccagauagaaaauau

SEQ ID NO: 3285180 - RNA, 14 nt, Variola virus
gauucuaaugauuu

SEQ ID NO: 3285181 - RNA, 14 nt, Variola virus
auauaguuaauagu

SEQ ID NO: 3285182 - RNA, 15 nt, Variola virus
uaaugaacaaauccu

SEQ ID NO: 3285183 - RNA, 22 nt, Variola virus
augggugacauaauuacauaua

SEQ ID NO: 3285184 - RNA, 22 nt, Variola virus
cagaagucauacuagaauaaag

SEQ ID NO: 3285185 - RNA, 13 nt, Variola virus
uuuaaucuaucua

SEQ ID NO: 3285186 - RNA, 14 nt, Variola virus
gcaaugaauaucua

SEQ ID NO: 3285187 - RNA, 22 nt, Variola virus
aaguuaaugagagcaaaauaua

SEQ ID NO: 3285188 - RNA, 19 nt, Variola virus
cauuggcuagguauaugca

SEQ ID NO: 3285189 - RNA, 17 nt, Variola virus
agaugaacugacauaua

SEQ ID NO: 3285190 - RNA, 18 nt, Variola virus
cugucuuucgauguucau

SEQ ID NO: 3285191 - RNA, 17 nt, Variola virus
cugaauagcaaaauuuu

SEQ ID NO: 3285192 - RNA, 17 nt, Variola virus
agaaugacauaacuaau

SEQ ID NO: 3285193 - RNA, 22 nt, Variola virus
uucaacguauggaauauaauaa

SEQ ID NO: 3285194 - RNA, 16 nt, Variola virus
uagguauuguuuucac

SEQ ID NO: 3285195 - RNA, 14 nt, Variola virus
uccagauaauaacc

SEQ ID NO: 3285196 - RNA, 17 nt, Variola virus
aaacaauacagugauug

SEQ ID NO: 3285197 - RNA, 20 nt, Variola virus
aaugauaacuguuuagaaau

SEQ ID NO: 3285198 - RNA, 13 nt, Variola virus
gcuauauccacca

SEQ ID NO: 3285199 - RNA, 19 nt, Variola virus
aaaguauccucuacucauu

SEQ ID NO: 3285200 - RNA, 20 nt, Variola virus
uuugaaugaaugaauacaga

SEQ ID NO: 3285201 - RNA, 22 nt, Variola virus
uuucuucauuuauuauauauaa

SEQ ID NO: 3285202 - RNA, 17 nt, Variola virus
acuaaucucuguaagau

SEQ ID NO: 3285203 - RNA, 20 nt, Variola virus
aaacaucguuaucagauaac

SEQ ID NO: 3285204 - RNA, 21 nt, Variola virus
cuguauugaugguaucuguua

SEQ ID NO: 3285205 - RNA, 19 nt, Variola virus
aaauauaaaaccaacuaau

SEQ ID NO: 3285206 - RNA, 17 nt, Variola virus
agguguguuuuuuacca

SEQ ID NO: 3285207 - RNA, 17 nt, Variola virus
gacauuuucacaaauac

SEQ ID NO: 3285208 - RNA, 14 nt, Variola virus
auaguccauagcaa

SEQ ID NO: 3285209 - RNA, 19 nt, Variola virus
acauguuacuauagcauua

SEQ ID NO: 3285210 - RNA, 20 nt, Variola virus
ucgaaaauugcuauuucaga

SEQ ID NO: 3285211 - RNA, 13 nt, Variola virus
caauuacaaaaac

SEQ ID NO: 3285212 - RNA, 22 nt, Variola virus
caaaaccccaugguguaacaac

SEQ ID NO: 3285213 - RNA, 14 nt, Variola virus
uaauauucuaaaac

SEQ ID NO: 3285214 - RNA, 18 nt, Variola virus
auaccaucgauuguuuau

SEQ ID NO: 3285215 - RNA, 19 nt, Variola virus
cuuggauuugacgaaauca

SEQ ID NO: 3285216 - RNA, 15 nt, Variola virus
cuuuuauaauucaua

SEQ ID NO: 3285217 - RNA, 23 nt, Variola virus
uagcaagauuuuuaaacaacaau

SEQ ID NO: 3285218 - RNA, 20 nt, Variola virus
uagaaacuauacgaaauaga

SEQ ID NO: 3285219 - RNA, 18 nt, Variola virus
aucacuuuuuauacuaau

SEQ ID NO: 3285220 - RNA, 18 nt, Variola virus
agauaauuguaacaauau

SEQ ID NO: 3285221 - RNA, 21 nt, Variola virus
auuauuaauaauuuguauaua

SEQ ID NO: 3285222 - RNA, 21 nt, Variola virus
uuuccaaaucaguaacuaugu

SEQ ID NO: 3285223 - RNA, 16 nt, Variola virus
aaacaacuaaacagua

SEQ ID NO: 3285224 - RNA, 18 nt, Variola virus
guucucaauauuacuuuu

SEQ ID NO: 3285225 - RNA, 16 nt, Variola virus
acucuuuuauuuucca

SEQ ID NO: 3285226 - RNA, 15 nt, Variola virus
uacuuaugacaaagu

SEQ ID NO: 3285227 - RNA, 18 nt, Variola virus
ucauuuucuauuuaaaau

SEQ ID NO: 3285228 - RNA, 22 nt, Variola virus
cgaauacgauacuuauaaggcu

SEQ ID NO: 3285229 - RNA, 23 nt, Variola virus
uuauccacaauaaauauaaacaa

SEQ ID NO: 3285230 - RNA, 15 nt, Variola virus
cuaucacuguagaaa

SEQ ID NO: 3285231 - RNA, 16 nt, Variola virus
uuucgaggaauaauaa

SEQ ID NO: 3285232 - RNA, 18 nt, Variola virus
aauuaauaguuuugauau

SEQ ID NO: 3285233 - RNA, 15 nt, Variola virus
gauauauaucuuuuc

SEQ ID NO: 3285234 - RNA, 14 nt, Variola virus
ccguucucugaaua

SEQ ID NO: 3285235 - RNA, 22 nt, Variola virus
aaauauuucuacuacuucauua

SEQ ID NO: 3285236 - RNA, 21 nt, Variola virus
agacaucaacacuuauauucu

SEQ ID NO: 3285237 - RNA, 16 nt, Variola virus
uagauagaaauuuaua

SEQ ID NO: 3285238 - RNA, 21 nt, Variola virus
uauuuacgaaacuaucaaaau

SEQ ID NO: 3285239 - RNA, 20 nt, Variola virus
uuguuuauuguauauacuua

SEQ ID NO: 3285240 - RNA, 22 nt, Variola virus
auacuauccaucagaauguuuc

SEQ ID NO: 3285241 - RNA, 22 nt, Variola virus
acaauuauuagcaaaaauauau

SEQ ID NO: 3285242 - RNA, 18 nt, Variola virus
uacuuuauaauuaaugaa

SEQ ID NO: 3285243 - RNA, 16 nt, Variola virus
accuguauuauuugcg

SEQ ID NO: 3285244 - RNA, 20 nt, Variola virus
uauuuguaauuuuucucaua

SEQ ID NO: 3285245 - RNA, 18 nt, Variola virus
uacauaggcaacaucaga

SEQ ID NO: 3285246 - RNA, 23 nt, Variola virus
ggugccgcggcaagcauacagac

SEQ ID NO: 3285247 - RNA, 19 nt, Variola virus
ucgaaauaauauuauccuu

SEQ ID NO: 3285248 - RNA, 12 nt, Variola virus
gcugucauguau

SEQ ID NO: 3285249 - RNA, 19 nt, Variola virus
cuauguuaauauguauaua

SEQ ID NO: 3285250 - RNA, 13 nt, Variola virus
aaucauccuaaga

SEQ ID NO: 3285251 - RNA, 21 nt, Variola virus
uuaauuuuuccuuacacaauc

SEQ ID NO: 3285252 - RNA, 19 nt, Variola virus
uaugccugagaguaaacau

SEQ ID NO: 3285253 - RNA, 14 nt, Variola virus
uauuucuaauaaca

SEQ ID NO: 3285254 - RNA, 20 nt, Variola virus
auauuuacggaacuucuaaa

SEQ ID NO: 3285255 - RNA, 16 nt, Variola virus
acuuucaucuaauaag

SEQ ID NO: 3285256 - RNA, 12 nt, Variola virus
acaauauuuccg

SEQ ID NO: 3285257 - RNA, 23 nt, Variola virus
uagcuuuguuagacuaaauacua

SEQ ID NO: 3285258 - RNA, 17 nt, Variola virus
auaguuccauuaucuaa

SEQ ID NO: 3285259 - RNA, 17 nt, Variola virus
acuagacauuuaccaug

SEQ ID NO: 3285260 - RNA, 16 nt, Variola virus
ggucauaacaaguuuc

SEQ ID NO: 3285261 - RNA, 17 nt, Variola virus
aaaauauaguagaauuu

SEQ ID NO: 3285262 - RNA, 22 nt, Variola virus
uaaaaauuuuuuagauguagua

SEQ ID NO: 3285263 - RNA, 12 nt, Variola virus
cgaauaaaagaa

SEQ ID NO: 3285264 - RNA, 20 nt, Variola virus
cauuaauugccauaauaauu

SEQ ID NO: 3285265 - RNA, 19 nt, Variola virus
agcuauugcauaauacaag

SEQ ID NO: 3285266 - RNA, 17 nt, Variola virus
acuauugacuuaauagg

SEQ ID NO: 3285267 - RNA, 18 nt, Variola virus
gaaacuauagauaaugau

SEQ ID NO: 3285268 - RNA, 13 nt, Variola virus
aauccaaauauga

SEQ ID NO: 3285269 - RNA, 13 nt, Variola virus
aucaugaugauuu

SEQ ID NO: 3285270 - RNA, 22 nt, Variola virus
acauuucuuauguuauuaauga

SEQ ID NO: 3285271 - RNA, 13 nt, Variola virus
caaaaaucuauca

SEQ ID NO: 3285272 - RNA, 17 nt, Variola virus
ucuuacuuuguucuauu

SEQ ID NO: 3285273 - RNA, 18 nt, Variola virus
gucaucuccagaggaaau

SEQ ID NO: 3285274 - RNA, 20 nt, Variola virus
uaaaucauggaguggaugua

SEQ ID NO: 3285275 - RNA, 18 nt, Variola virus
auauacucugagauaaaa

SEQ ID NO: 3285276 - RNA, 19 nt, Variola virus
cgaugccuuuuguaaauau

SEQ ID NO: 3285277 - RNA, 17 nt, Variola virus
auuaccugugguuaaaa

SEQ ID NO: 3285278 - RNA, 22 nt, Variola virus
guugaugaggcacauaauaucu

SEQ ID NO: 3285279 - RNA, 20 nt, Variola virus
aaaccaggcgaguguagaaa

SEQ ID NO: 3285280 - RNA, 12 nt, Variola virus
auaaaucauauu

SEQ ID NO: 3285281 - RNA, 17 nt, Variola virus
aauuguuaaauuaauaa

SEQ ID NO: 3285282 - RNA, 16 nt, Variola virus
auggaucuauucaaga

SEQ ID NO: 3285283 - RNA, 18 nt, Variola virus
ucguguauaacaucuuug

SEQ ID NO: 3285284 - RNA, 13 nt, Variola virus
gaaucuaaacaaa

SEQ ID NO: 3285285 - RNA, 16 nt, Variola virus
ucagcugaaaaacuau

SEQ ID NO: 3285286 - RNA, 20 nt, Variola virus
aaaauucuuaaaauaauuua

SEQ ID NO: 3285287 - RNA, 14 nt, Variola virus
cguuaaaucaucua

SEQ ID NO: 3285288 - RNA, 15 nt, Variola virus
auuucaaaauuauuu

SEQ ID NO: 3285289 - RNA, 21 nt, Variola virus
cacauccuuuauuuuaucuau

SEQ ID NO: 3285290 - RNA, 14 nt, Variola virus
uaagaugcaaacau

SEQ ID NO: 3285291 - RNA, 22 nt, Variola virus
uguuuugaauuucuuagucaua

SEQ ID NO: 3285292 - RNA, 15 nt, Variola virus
aguucauuaucugaa

SEQ ID NO: 3285293 - RNA, 15 nt, Variola virus
cacauaauuauucua

SEQ ID NO: 3285294 - RNA, 22 nt, Variola virus
cagacacugucacauacacuag

SEQ ID NO: 3285295 - RNA, 16 nt, Variola virus
aaucuauucccuugau

SEQ ID NO: 3285296 - RNA, 14 nt, Variola virus
auaagauuaucaaa

SEQ ID NO: 3285297 - RNA, 16 nt, Variola virus
agucgaaacauauucu

SEQ ID NO: 3285298 - RNA, 16 nt, Variola virus
gacacaccaaaaaaga

SEQ ID NO: 3285299 - RNA, 18 nt, Variola virus
uuugguaauggcaaugua

SEQ ID NO: 3285300 - RNA, 14 nt, Variola virus
uagauaaauuuauc

SEQ ID NO: 3285301 - RNA, 21 nt, Variola virus
uaccacaauaaaaaaaauuga

SEQ ID NO: 3285302 - RNA, 20 nt, Variola virus
uuagaaauuggucuguguua

SEQ ID NO: 3285303 - RNA, 21 nt, Variola virus
uagaacuuacugacaaaguua

SEQ ID NO: 3285304 - RNA, 23 nt, Variola virus
agacguccauaucugauuauuau

SEQ ID NO: 3285305 - RNA, 12 nt, Variola virus
gaauauaugauu

SEQ ID NO: 3285306 - RNA, 18 nt, Variola virus
uuggaaaggcguuaucua

SEQ ID NO: 3285307 - RNA, 15 nt, Variola virus
aacagaaaaaacaau

SEQ ID NO: 3285308 - RNA, 13 nt, Variola virus
uaccgguguauau

SEQ ID NO: 3285309 - RNA, 14 nt, Variola virus
gugaauaauguuuc

SEQ ID NO: 3285310 - RNA, 13 nt, Variola virus
uacaauauuuccg

SEQ ID NO: 3285311 - RNA, 22 nt, Variola virus
auagagcccacguuuaaacauu

SEQ ID NO: 3285312 - RNA, 14 nt, Variola virus
ucagcgugauuuuc

SEQ ID NO: 3285313 - RNA, 13 nt, Variola virus
uagcaaauauucu

SEQ ID NO: 3285314 - RNA, 14 nt, Variola virus
gaugccucuuuuag

SEQ ID NO: 3285315 - RNA, 21 nt, Variola virus
agcuauguuaucaugaaaugu

SEQ ID NO: 3285316 - RNA, 14 nt, Variola virus
uuaucuauacuauu

SEQ ID NO: 3285317 - RNA, 14 nt, Variola virus
uguuuucaucauuu

SEQ ID NO: 3285318 - RNA, 22 nt, Variola virus
aguauaaacgacauaauacuca

SEQ ID NO: 3285319 - RNA, 19 nt, Variola virus
uccagaacaucuuccauag

SEQ ID NO: 3285320 - RNA, 13 nt, Variola virus
agaauucuagauc

SEQ ID NO: 3285321 - RNA, 23 nt, Variola virus
uuuuguucacaaaaauacauaaa

SEQ ID NO: 3285322 - RNA, 13 nt, Variola virus
agaacaaaguaau

SEQ ID NO: 3285323 - RNA, 13 nt, Variola virus
gugauuguauguu

SEQ ID NO: 3285324 - RNA, 19 nt, Variola virus
aaaacuauaucuauguuga

SEQ ID NO: 3285325 - RNA, 19 nt, Variola virus
aagauguuccguuaccguu

SEQ ID NO: 3285326 - RNA, 18 nt, Variola virus
uuauaagacuuuacucuu

SEQ ID NO: 3285327 - RNA, 13 nt, Variola virus
cugauauucagaa

SEQ ID NO: 3285328 - RNA, 16 nt, Variola virus
uaauuaggaucuucua

SEQ ID NO: 3285329 - RNA, 14 nt, Variola virus
uagagagauucauu

SEQ ID NO: 3285330 - RNA, 14 nt, Variola virus
augagauugaucau

SEQ ID NO: 3285331 - RNA, 17 nt, Variola virus
agugcuacaaaacagaa

SEQ ID NO: 3285332 - RNA, 14 nt, Variola virus
uaauucauaagaau

SEQ ID NO: 3285333 - RNA, 22 nt, Variola virus
uaauuuucuauaacugaacgau

SEQ ID NO: 3285334 - RNA, 16 nt, Variola virus
ccacuaguuuccuuua

SEQ ID NO: 3285335 - RNA, 14 nt, Variola virus
ucccaaugaaucaa

SEQ ID NO: 3285336 - RNA, 13 nt, Variola virus
cagaacuauuuuu

SEQ ID NO: 3285337 - RNA, 18 nt, Variola virus
aaguuagaaaaaaugauu

SEQ ID NO: 3285338 - RNA, 17 nt, Variola virus
auuagucauguuaaaaa

SEQ ID NO: 3285339 - RNA, 20 nt, Variola virus
ugucaaaugaucggaucuaa

SEQ ID NO: 3285340 - RNA, 13 nt, Variola virus
uaguuuuucugga

SEQ ID NO: 3285341 - RNA, 22 nt, Variola virus
cagaaagaggaucguacaucca

SEQ ID NO: 3285342 - RNA, 18 nt, Variola virus
uaaauuuuaaacauaaag

SEQ ID NO: 3285343 - RNA, 22 nt, Variola virus
uggaauugauuucgucaaugua

SEQ ID NO: 3285344 - RNA, 18 nt, Variola virus
ucuauaaaaaauaaguau

SEQ ID NO: 3285345 - RNA, 18 nt, Variola virus
uuccacagauaauauuag

SEQ ID NO: 3285346 - RNA, 10 nt, Variola virus
cucaaaugua

SEQ ID NO: 3285347 - RNA, 13 nt, Variola virus
ucugcauucaauu

SEQ ID NO: 3285348 - RNA, 12 nt, Variola virus
caacuacaguag

SEQ ID NO: 3285349 - RNA, 20 nt, Variola virus
gaaauauagaauauacuuca

SEQ ID NO: 3285350 - RNA, 20 nt, Variola virus
agaacuaucauagaugagaa

SEQ ID NO: 3285351 - RNA, 16 nt, Variola virus
agacuuuaucuagauc

SEQ ID NO: 3285352 - RNA, 18 nt, Variola virus
accaaaaucaauauauca

SEQ ID NO: 3285353 - RNA, 14 nt, Variola virus
auaaucauuacugu

SEQ ID NO: 3285354 - RNA, 14 nt, Variola virus
uacacaaauaauua

SEQ ID NO: 3285355 - RNA, 16 nt, Variola virus
uucaagcgaauuacuc

SEQ ID NO: 3285356 - RNA, 13 nt, Variola virus
agagagaaauacu

SEQ ID NO: 3285357 - RNA, 20 nt, Variola virus
aacgaguucaaauaugaaau

SEQ ID NO: 3285358 - RNA, 17 nt, Variola virus
ccuggaguauggaauac

SEQ ID NO: 3285359 - RNA, 15 nt, Variola virus
aacaaucugucgaaa

SEQ ID NO: 3285360 - RNA, 15 nt, Variola virus
caaacauguucaaug

SEQ ID NO: 3285361 - RNA, 14 nt, Variola virus
uucuacaauaacua

SEQ ID NO: 3285362 - RNA, 19 nt, Variola virus
uuucauaguuagauacaua

SEQ ID NO: 3285363 - RNA, 12 nt, Variola virus
auauuauacaaa

SEQ ID NO: 3285364 - RNA, 19 nt, Variola virus
auuauugguucauuggaau

SEQ ID NO: 3285365 - RNA, 15 nt, Variola virus
guugucuauuuccaa

SEQ ID NO: 3285366 - RNA, 18 nt, Variola virus
aacuuaaaaaaaauaaua

SEQ ID NO: 3285367 - RNA, 18 nt, Variola virus
uccaugauacaacucugc

SEQ ID NO: 3285368 - RNA, 15 nt, Variola virus
aaauuuaaauacuuu

SEQ ID NO: 3285369 - RNA, 19 nt, Variola virus
auaaauaucauuaauauau

SEQ ID NO: 3285370 - RNA, 19 nt, Variola virus
agcaauagugauagauuuu

SEQ ID NO: 3285371 - RNA, 16 nt, Variola virus
uagauuuccaaagaua

SEQ ID NO: 3285372 - RNA, 18 nt, Variola virus
uaguauauggacaaacgu

SEQ ID NO: 3285373 - RNA, 14 nt, Variola virus
auuugaacuuaacu

SEQ ID NO: 3285374 - RNA, 22 nt, Variola virus
gcaauuuugugguugauaauca

SEQ ID NO: 3285375 - RNA, 17 nt, Variola virus
gcaacuguaaauuucuc

SEQ ID NO: 3285376 - RNA, 19 nt, Variola virus
auuaaauauagguauauuu

SEQ ID NO: 3285377 - RNA, 23 nt, Variola virus
uacuuuaugaauggauaccugua

SEQ ID NO: 3285378 - RNA, 21 nt, Variola virus
acagaguuagaaauagauaau

SEQ ID NO: 3285379 - RNA, 15 nt, Variola virus
acuaauuauacuuug

SEQ ID NO: 3285380 - RNA, 20 nt, Variola virus
uugaguggaaaguucaaaaa

SEQ ID NO: 3285381 - RNA, 23 nt, Variola virus
ucuauccuuuuccggaagcaaug

SEQ ID NO: 3285382 - RNA, 23 nt, Variola virus
auacaacggcguuaauuaucuaa

SEQ ID NO: 3285383 - RNA, 22 nt, Variola virus
uuaucacaaugaaauauuuugg

SEQ ID NO: 3285384 - RNA, 17 nt, Variola virus
agucauguuaaaaauga

SEQ ID NO: 3285385 - RNA, 22 nt, Variola virus
guacuaaauucaauaucuuuuu

SEQ ID NO: 3285386 - RNA, 14 nt, Variola virus
uuaaauucuuuaau

SEQ ID NO: 3285387 - RNA, 16 nt, Variola virus
aaaggaugauacauua

SEQ ID NO: 3285388 - RNA, 20 nt, Variola virus
uauacaaugaacuaauauga

SEQ ID NO: 3285389 - RNA, 19 nt, Variola virus
aauucacaccuagagacaa

SEQ ID NO: 3285390 - RNA, 14 nt, Variola virus
aaauagauccugaa

SEQ ID NO: 3285391 - RNA, 21 nt, Variola virus
aaauccuguaauacuuuuagu

SEQ ID NO: 3285392 - RNA, 16 nt, Variola virus
guauuucauuacccaa

SEQ ID NO: 3285393 - RNA, 18 nt, Variola virus
uaaaauaguucuguaaua

SEQ ID NO: 3285394 - RNA, 19 nt, Variola virus
auugauaucgcauagaaau

SEQ ID NO: 3285395 - RNA, 12 nt, Variola virus
cuauucucucuu

SEQ ID NO: 3285396 - RNA, 17 nt, Variola virus
uccauauauguuuucau

SEQ ID NO: 3285397 - RNA, 20 nt, Variola virus
gcgugaacaacuuacagaug

SEQ ID NO: 3285398 - RNA, 23 nt, Variola virus
gcacuacuguuaagaaugauuac

SEQ ID NO: 3285399 - RNA, 12 nt, Variola virus
ccuguguuuaua

SEQ ID NO: 3285400 - RNA, 21 nt, Variola virus
uagauguaguaauaucugauu

SEQ ID NO: 3285401 - RNA, 12 nt, Variola virus
auuucuaucugu

SEQ ID NO: 3285402 - RNA, 15 nt, Variola virus
auauguuauaauaga

SEQ ID NO: 3285403 - RNA, 22 nt, Variola virus
uauaauuuaccgcuauagcauu

SEQ ID NO: 3285404 - RNA, 20 nt, Variola virus
acaauauauguaaucauuau

SEQ ID NO: 3285405 - RNA, 14 nt, Variola virus
acuuugauaauaag

SEQ ID NO: 3285406 - RNA, 23 nt, Variola virus
aauagcaaccaauguuugaucau

SEQ ID NO: 3285407 - RNA, 11 nt, Variola virus
aggacauguaa

SEQ ID NO: 3285408 - RNA, 18 nt, Variola virus
agcauccucaaaaaauau

SEQ ID NO: 3285409 - RNA, 20 nt, Variola virus
caaugauuucaaggauguca

SEQ ID NO: 3285410 - RNA, 22 nt, Variola virus
aggagaugauagcuauuuaacu

SEQ ID NO: 3285411 - RNA, 16 nt, Variola virus
uaaacauaagacguau

SEQ ID NO: 3285412 - RNA, 20 nt, Variola virus
aaugacguuaauaacaaaaa

SEQ ID NO: 3285413 - RNA, 22 nt, Variola virus
guuucucaucuuuuacuugauu

SEQ ID NO: 3285414 - RNA, 15 nt, Variola virus
caugguauauggaua

SEQ ID NO: 3285415 - RNA, 18 nt, Variola virus
cuuaacaucuucuacauu

SEQ ID NO: 3285416 - RNA, 13 nt, Variola virus
ucaaauagauguu

SEQ ID NO: 3285417 - RNA, 20 nt, Variola virus
auuuguagcaaaacuauuuc

SEQ ID NO: 3285418 - RNA, 19 nt, Variola virus
aguuuaaacugaaaaugac

SEQ ID NO: 3285419 - RNA, 12 nt, Variola virus
cgcauuaaugag

SEQ ID NO: 3285420 - RNA, 14 nt, Variola virus
aaccaauacaaugu

SEQ ID NO: 3285421 - RNA, 17 nt, Variola virus
uauaucuauaucuacau

SEQ ID NO: 3285422 - RNA, 20 nt, Variola virus
gaaauggcguauuuaagagu

SEQ ID NO: 3285423 - RNA, 17 nt, Variola virus
uacuugacaucuaaaaa

SEQ ID NO: 3285424 - RNA, 12 nt, Variola virus
agaauuuucuaa

SEQ ID NO: 3285425 - RNA, 14 nt, Variola virus
acauuaauugauua

SEQ ID NO: 3285426 - RNA, 13 nt, Variola virus
guugguagauauu

SEQ ID NO: 3285427 - RNA, 17 nt, Variola virus
auucaugauaaacuuaa

SEQ ID NO: 3285428 - RNA, 23 nt, Variola virus
cagaaaugauuuuggaaaaauug

SEQ ID NO: 3285429 - RNA, 21 nt, Variola virus
auuacuauaaauggagaaugu

SEQ ID NO: 3285430 - RNA, 18 nt, Variola virus
aguaauucagacacuucu

SEQ ID NO: 3285431 - RNA, 16 nt, Variola virus
ucaaaaucaucauuau

SEQ ID NO: 3285432 - RNA, 14 nt, Variola virus
gaauaucaaaucua

SEQ ID NO: 3285433 - RNA, 19 nt, Variola virus
caauuuugauguauaacaa

SEQ ID NO: 3285434 - RNA, 15 nt, Variola virus
uauguucaacuuuga

SEQ ID NO: 3285435 - RNA, 17 nt, Variola virus
gucaucgcguuguuuua

SEQ ID NO: 3285436 - RNA, 12 nt, Variola virus
uguuauauacau

SEQ ID NO: 3285437 - RNA, 22 nt, Variola virus
acgauuacaucaccucuaacau

SEQ ID NO: 3285438 - RNA, 16 nt, Variola virus
aacguuccguaucugu

SEQ ID NO: 3285439 - RNA, 13 nt, Variola virus
cacuaauaucaau

SEQ ID NO: 3285440 - RNA, 20 nt, Variola virus
acacuauucuuaaaugucau

SEQ ID NO: 3285441 - RNA, 20 nt, Variola virus
aucaacgauucuagaacguc

SEQ ID NO: 3285442 - RNA, 12 nt, Variola virus
agucauacuaga

SEQ ID NO: 3285443 - RNA, 17 nt, Variola virus
acauauaauaaugaaua

SEQ ID NO: 3285444 - RNA, 16 nt, Variola virus
uaaacauaaacaacau

SEQ ID NO: 3285445 - RNA, 13 nt, Variola virus
aauuuaucaucug

SEQ ID NO: 3285446 - RNA, 14 nt, Variola virus
agaaaccugauuau

SEQ ID NO: 3285447 - RNA, 19 nt, Variola virus
gauguacugaagguauuau

SEQ ID NO: 3285448 - RNA, 14 nt, Variola virus
auaguaaaauauua

SEQ ID NO: 3285449 - RNA, 22 nt, Variola virus
gaaacaauguuucuuacauauu

SEQ ID NO: 3285450 - RNA, 13 nt, Variola virus
gguauuucaucau

SEQ ID NO: 3285451 - RNA, 12 nt, Variola virus
gaaaauauuaaa

SEQ ID NO: 3285452 - RNA, 12 nt, Variola virus
gaauauauuaau

SEQ ID NO: 3285453 - RNA, 21 nt, Variola virus
aggauauuucaaaaaauaaua

SEQ ID NO: 3285454 - RNA, 17 nt, Variola virus
aaguuuggagaaaugga

SEQ ID NO: 3285455 - RNA, 14 nt, Variola virus
ugaguuuaauaacu

SEQ ID NO: 3285456 - RNA, 12 nt, Variola virus
uuggaauuauuu

SEQ ID NO: 3285457 - RNA, 22 nt, Variola virus
guugacacguuuauuucguaua

SEQ ID NO: 3285458 - RNA, 22 nt, Variola virus
cuaaagcacaacgagagauauu

SEQ ID NO: 3285459 - RNA, 18 nt, Variola virus
auaguuugggaaaagaaa

SEQ ID NO: 3285460 - RNA, 14 nt, Variola virus
agauuaaaaauggu

SEQ ID NO: 3285461 - RNA, 20 nt, Variola virus
uaguuuccuuuuuauaaaau

SEQ ID NO: 3285462 - RNA, 11 nt, Variola virus
cuguggaauaa

SEQ ID NO: 3285463 - RNA, 12 nt, Variola virus
uauuucuuacau

SEQ ID NO: 3285464 - RNA, 20 nt, Variola virus
auuacuuuacauauaauauc

SEQ ID NO: 3285465 - RNA, 16 nt, Variola virus
gaauaucuuuauucau

SEQ ID NO: 3285466 - RNA, 20 nt, Variola virus
guuauuuuguuuuauucaaa

SEQ ID NO: 3285467 - RNA, 16 nt, Variola virus
caauugucuauacaag

SEQ ID NO: 3285468 - RNA, 20 nt, Variola virus
aacgucuuccaauaaauguc

SEQ ID NO: 3285469 - RNA, 21 nt, Variola virus
ucuaaaaauguuaauuuugaa

SEQ ID NO: 3285470 - RNA, 22 nt, Variola virus
auucagaauuucuacauaauua

SEQ ID NO: 3285471 - RNA, 20 nt, Variola virus
uaccuauauucuugauguag

SEQ ID NO: 3285472 - RNA, 14 nt, Variola virus
uuugaacauguaga

SEQ ID NO: 3285473 - RNA, 21 nt, Variola virus
guuaaacuuggggauaaugau

SEQ ID NO: 3285474 - RNA, 19 nt, Variola virus
auuaaauguauauuuucca

SEQ ID NO: 3285475 - RNA, 12 nt, Variola virus
cuuuuauuucca

SEQ ID NO: 3285476 - RNA, 19 nt, Variola virus
ucauauauuuauagaagau

SEQ ID NO: 3285477 - RNA, 18 nt, Variola virus
uacuuauuaguaaaacua

SEQ ID NO: 3285478 - RNA, 19 nt, Variola virus
caaucggauacagacacuc

SEQ ID NO: 3285479 - RNA, 19 nt, Variola virus
uguuauuuccuuguuuuua

SEQ ID NO: 3285480 - RNA, 19 nt, Variola virus
auauccuuaagauguuuga

SEQ ID NO: 3285481 - RNA, 23 nt, Variola virus
uucccauagcugguucaaaauua

SEQ ID NO: 3285482 - RNA, 17 nt, Variola virus
uuuuucuuucgaauuca

SEQ ID NO: 3285483 - RNA, 17 nt, Variola virus
acaaaauucagauucua

SEQ ID NO: 3285484 - RNA, 15 nt, Variola virus
ucuuccuucaaacag

SEQ ID NO: 3285485 - RNA, 17 nt, Variola virus
aguauagaucaaaagaa

SEQ ID NO: 3285486 - RNA, 16 nt, Variola virus
aucugaaaauaaauaa

SEQ ID NO: 3285487 - RNA, 22 nt, Variola virus
uguaagugaugauguaagucau

SEQ ID NO: 3285488 - RNA, 19 nt, Variola virus
ucucucaaucacuacaucu

SEQ ID NO: 3285489 - RNA, 14 nt, Variola virus
gaaauuaauaugau

SEQ ID NO: 3285490 - RNA, 14 nt, Variola virus
auaucuaguauuga

SEQ ID NO: 3285491 - RNA, 14 nt, Variola virus
auuaacauuuugaa

SEQ ID NO: 3285492 - RNA, 18 nt, Variola virus
augauaaacuuaaugaaa

SEQ ID NO: 3285493 - RNA, 14 nt, Variola virus
acuuuucuauuugu

SEQ ID NO: 3285494 - RNA, 19 nt, Variola virus
aauuacgcucuacaaaaug

SEQ ID NO: 3285495 - RNA, 14 nt, Variola virus
cagaguuauccauu

SEQ ID NO: 3285496 - RNA, 12 nt, Variola virus
aucaauauuaac

SEQ ID NO: 3285497 - RNA, 22 nt, Variola virus
gaaauguccguuauauaaucua

SEQ ID NO: 3285498 - RNA, 19 nt, Variola virus
agaaauugguauaaauguu

SEQ ID NO: 3285499 - RNA, 16 nt, Variola virus
aaguaaguaugucgaa

SEQ ID NO: 3285500 - RNA, 13 nt, Variola virus
aagaccaauaaua

SEQ ID NO: 3285501 - RNA, 18 nt, Variola virus
aaugaugaugaaaugaua

SEQ ID NO: 3285502 - RNA, 21 nt, Variola virus
uuguauaauaaguauaguuuu

SEQ ID NO: 3285503 - RNA, 15 nt, Variola virus
acaguuuuuuucuag

SEQ ID NO: 3285504 - RNA, 20 nt, Variola virus
gaauuugaucuauugcccua

SEQ ID NO: 3285505 - RNA, 14 nt, Variola virus
gaguauauauuaag

SEQ ID NO: 3285506 - RNA, 14 nt, Variola virus
gccauuacaagaua

SEQ ID NO: 3285507 - RNA, 12 nt, Variola virus
aaagaucauauu

SEQ ID NO: 3285508 - RNA, 17 nt, Variola virus
cuucucuguuuaaugaa

SEQ ID NO: 3285509 - RNA, 19 nt, Variola virus
cauuuuuuauaaaaaacuu

SEQ ID NO: 3285510 - RNA, 19 nt, Variola virus
ugaguucugugcagaucau

SEQ ID NO: 3285511 - RNA, 14 nt, Variola virus
aaugaauaucuaca

SEQ ID NO: 3285512 - RNA, 16 nt, Variola virus
cacuauguuagcauuu

SEQ ID NO: 3285513 - RNA, 13 nt, Variola virus
guauauagauaug

SEQ ID NO: 3285514 - RNA, 22 nt, Variola virus
gucgucgaaauaucuuuccaac

SEQ ID NO: 3285515 - RNA, 23 nt, Variola virus
cuaccgucgucgaaauaucuuuc

SEQ ID NO: 3285516 - RNA, 17 nt, Variola virus
aauuuauuucagaaauu

SEQ ID NO: 3285517 - RNA, 19 nt, Variola virus
caucguuguugaaucuauu

SEQ ID NO: 3285518 - RNA, 12 nt, Variola virus
acacuaauuaag

SEQ ID NO: 3285519 - RNA, 19 nt, Variola virus
agagugaucaaaucauuau

SEQ ID NO: 3285520 - RNA, 16 nt, Variola virus
auagugaaacaaaaua

SEQ ID NO: 3285521 - RNA, 18 nt, Variola virus
cucuucaacaucuuuaau

SEQ ID NO: 3285522 - RNA, 16 nt, Variola virus
auacacacaaaguaau

SEQ ID NO: 3285523 - RNA, 14 nt, Variola virus
uuuccccucucugu

SEQ ID NO: 3285524 - RNA, 21 nt, Variola virus
auacauaucgcacauuauacu

SEQ ID NO: 3285525 - RNA, 16 nt, Variola virus
gcuugugauuuuuucu

SEQ ID NO: 3285526 - RNA, 13 nt, Variola virus
uaguuucuguaac

SEQ ID NO: 3285527 - RNA, 21 nt, Variola virus
aaaaucgucuucauaaagcau

SEQ ID NO: 3285528 - RNA, 18 nt, Variola virus
aaaaacauaauagcuccc

SEQ ID NO: 3285529 - RNA, 13 nt, Variola virus
agacguuguacaa

SEQ ID NO: 3285530 - RNA, 15 nt, Variola virus
auauacauuguauaa

SEQ ID NO: 3285531 - RNA, 17 nt, Variola virus
agaagugugaauaugau

SEQ ID NO: 3285532 - RNA, 18 nt, Variola virus
aaucagaagaugauucca

SEQ ID NO: 3285533 - RNA, 23 nt, Variola virus
acucauuucauuauaauaguuua

SEQ ID NO: 3285534 - RNA, 16 nt, Variola virus
agauaaagaguucuaa

SEQ ID NO: 3285535 - RNA, 15 nt, Variola virus
cuauuaaagauggag

SEQ ID NO: 3285536 - RNA, 19 nt, Variola virus
caggugcugauguaaaugg

SEQ ID NO: 3285537 - RNA, 15 nt, Variola virus
gugguagauauauag

SEQ ID NO: 3285538 - RNA, 17 nt, Variola virus
uucaacuuugaaauugu

SEQ ID NO: 3285539 - RNA, 17 nt, Variola virus
uaaguauuuauacaaac

SEQ ID NO: 3285540 - RNA, 14 nt, Variola virus
cuuaaauguuuucu

SEQ ID NO: 3285541 - RNA, 21 nt, Variola virus
cuaaaauauuaucuaauguug

SEQ ID NO: 3285542 - RNA, 18 nt, Variola virus
aacucuuucgaauacuua

SEQ ID NO: 3285543 - RNA, 15 nt, Variola virus
uugaucauguagaaa

SEQ ID NO: 3285544 - RNA, 19 nt, Variola virus
auccggauuuccaaagaau

SEQ ID NO: 3285545 - RNA, 14 nt, Variola virus
cuuuaauagauaua

SEQ ID NO: 3285546 - RNA, 14 nt, Variola virus
ucucauaaaauagu

SEQ ID NO: 3285547 - RNA, 13 nt, Variola virus
gaauagaaaucuu

SEQ ID NO: 3285548 - RNA, 22 nt, Variola virus
ucauuaacucuagaaaucugaa

SEQ ID NO: 3285549 - RNA, 18 nt, Variola virus
uagauuuguaucucuuuu

SEQ ID NO: 3285550 - RNA, 19 nt, Variola virus
auaguuugggaaaagaaau

SEQ ID NO: 3285551 - RNA, 15 nt, Variola virus
guucaaaucuagauu

SEQ ID NO: 3285552 - RNA, 19 nt, Variola virus
agaaaaaaauaucgauauu

SEQ ID NO: 3285553 - RNA, 23 nt, Variola virus
uuuaauuuuguuauaguagauau

SEQ ID NO: 3285554 - RNA, 22 nt, Variola virus
ugaagaagugucuauaaaugua

SEQ ID NO: 3285555 - RNA, 16 nt, Variola virus
gaaugcccgcauauau

SEQ ID NO: 3285556 - RNA, 14 nt, Variola virus
aauccauugauaau

SEQ ID NO: 3285557 - RNA, 13 nt, Variola virus
gaugaauauauca

SEQ ID NO: 3285558 - RNA, 18 nt, Variola virus
auacuaauacuaauacua

SEQ ID NO: 3285559 - RNA, 19 nt, Variola virus
auaaaauuauucacuauau

SEQ ID NO: 3285560 - RNA, 15 nt, Variola virus
auaaauuaaaauaca

SEQ ID NO: 3285561 - RNA, 13 nt, Variola virus
caucgaauacuuu

SEQ ID NO: 3285562 - RNA, 14 nt, Variola virus
uaccaaucauuuau

SEQ ID NO: 3285563 - RNA, 12 nt, Variola virus
ucaaagaaauaa

SEQ ID NO: 3285564 - RNA, 17 nt, Variola virus
uaaagcuaaaauagucu

SEQ ID NO: 3285565 - RNA, 21 nt, Variola virus
ggauugguuucuaaauucaug

SEQ ID NO: 3285566 - RNA, 19 nt, Variola virus
acaucuaaagaaaaaugau

SEQ ID NO: 3285567 - RNA, 14 nt, Variola virus
aucugauagaaaga

SEQ ID NO: 3285568 - RNA, 23 nt, Variola virus
uaacuuuaaauaauuuacaaaaa

SEQ ID NO: 3285569 - RNA, 18 nt, Variola virus
ucucuaacgguaccauaa

SEQ ID NO: 3285570 - RNA, 19 nt, Variola virus
auccaugggugacauaauu

SEQ ID NO: 3285571 - RNA, 22 nt, Variola virus
ugaauauagaacaucauuucca

SEQ ID NO: 3285572 - RNA, 14 nt, Variola virus
aucaaaagaagaau

SEQ ID NO: 3285573 - RNA, 19 nt, Variola virus
gacuauagacauaauacua

SEQ ID NO: 3285574 - RNA, 16 nt, Variola virus
acuauuccaaaugaug

SEQ ID NO: 3285575 - RNA, 22 nt, Variola virus
uacuuauucuauuuuacaaaua

SEQ ID NO: 3285576 - RNA, 17 nt, Variola virus
ucauaaaaaaaaguuuu

SEQ ID NO: 3285577 - RNA, 19 nt, Variola virus
aauuuaccagauaucuucu

SEQ ID NO: 3285578 - RNA, 14 nt, Variola virus
cgugauagcucccg

SEQ ID NO: 3285579 - RNA, 15 nt, Variola virus
agugacaaaaugcua

SEQ ID NO: 3285580 - RNA, 16 nt, Variola virus
uguaauagaauuuaua

SEQ ID NO: 3285581 - RNA, 20 nt, Variola virus
uaguacuaaaauuuguauuu

SEQ ID NO: 3285582 - RNA, 17 nt, Variola virus
ugauuacauuuuugaua

SEQ ID NO: 3285583 - RNA, 19 nt, Variola virus
ucaaacggugcagacguau

SEQ ID NO: 3285584 - RNA, 17 nt, Variola virus
uguaucgaaaaacuuua

SEQ ID NO: 3285585 - RNA, 12 nt, Variola virus
gauaauuuccau

SEQ ID NO: 3285586 - RNA, 17 nt, Variola virus
cuguaucaguugcauuu

SEQ ID NO: 3285587 - RNA, 16 nt, Variola virus
uaacaggucauauucu

SEQ ID NO: 3285588 - RNA, 21 nt, Variola virus
caucaucaaaagacuuaugau

SEQ ID NO: 3285589 - RNA, 14 nt, Variola virus
cauauaauaaugaa

SEQ ID NO: 3285590 - RNA, 15 nt, Variola virus
uacuuaaaaaaugaa

SEQ ID NO: 3285591 - RNA, 15 nt, Variola virus
ccuuuuuauuuucua

SEQ ID NO: 3285592 - RNA, 18 nt, Variola virus
ucauuacuaauagaguau

SEQ ID NO: 3285593 - RNA, 16 nt, Variola virus
ugcgguacuacagaua

SEQ ID NO: 3285594 - RNA, 19 nt, Variola virus
aaaauguauagauaaacua

SEQ ID NO: 3285595 - RNA, 12 nt, Variola virus
uaucaucuuuuc

SEQ ID NO: 3285596 - RNA, 20 nt, Variola virus
cucaagauuuuaaaaaacug

SEQ ID NO: 3285597 - RNA, 23 nt, Variola virus
acuagaguaguauauugucacau

SEQ ID NO: 3285598 - RNA, 19 nt, Variola virus
aacuuuuaaauacaaauau

SEQ ID NO: 3285599 - RNA, 16 nt, Variola virus
guaucaugaacucuaa

SEQ ID NO: 3285600 - RNA, 19 nt, Variola virus
uagaaaauaauauagauuu

SEQ ID NO: 3285601 - RNA, 20 nt, Variola virus
auauacuauucuugugauaa

SEQ ID NO: 3285602 - RNA, 19 nt, Variola virus
ugguacagaaaauaucaug

SEQ ID NO: 3285603 - RNA, 16 nt, Variola virus
ugaauuuauaaaaugc

SEQ ID NO: 3285604 - RNA, 19 nt, Variola virus
acuucauaaaagaaaauac

SEQ ID NO: 3285605 - RNA, 23 nt, Variola virus
aaggaugcaaacuuacagaaaca

SEQ ID NO: 3285606 - RNA, 18 nt, Variola virus
ugcuaaacuuuauguacu

SEQ ID NO: 3285607 - RNA, 15 nt, Variola virus
uggucaaaaacugaa

SEQ ID NO: 3285608 - RNA, 14 nt, Variola virus
cuauaaaaaugaag

SEQ ID NO: 3285609 - RNA, 21 nt, Variola virus
uuauaauagguguaaaucuag

SEQ ID NO: 3285610 - RNA, 15 nt, Variola virus
agguacaauaccuuu

SEQ ID NO: 3285611 - RNA, 16 nt, Variola virus
acgaaaggagagaaug

SEQ ID NO: 3285612 - RNA, 20 nt, Variola virus
uacauguaaugauuuaaaau

SEQ ID NO: 3285613 - RNA, 17 nt, Variola virus
guuagaagucuuaaaaa

SEQ ID NO: 3285614 - RNA, 16 nt, Variola virus
auagcaugugaauaua

SEQ ID NO: 3285615 - RNA, 21 nt, Variola virus
acuaauagaacaugugugaaa

SEQ ID NO: 3285616 - RNA, 18 nt, Variola virus
aauccaauuguuugauau

SEQ ID NO: 3285617 - RNA, 20 nt, Variola virus
uauaacuggauauagaacug

SEQ ID NO: 3285618 - RNA, 16 nt, Variola virus
caguacuaauuuccaa

SEQ ID NO: 3285619 - RNA, 20 nt, Variola virus
auaauacacacguaauagau

SEQ ID NO: 3285620 - RNA, 13 nt, Variola virus
uaauuaaugucca

SEQ ID NO: 3285621 - RNA, 14 nt, Variola virus
uuugcaaauacagc

SEQ ID NO: 3285622 - RNA, 16 nt, Variola virus
auaacauuaauaucaa

SEQ ID NO: 3285623 - RNA, 22 nt, Variola virus
ugcuuaauacaccguuaacaau

SEQ ID NO: 3285624 - RNA, 20 nt, Variola virus
guucuaaugccgaucuuuga

SEQ ID NO: 3285625 - RNA, 16 nt, Variola virus
ucuauguuauuuguau

SEQ ID NO: 3285626 - RNA, 22 nt, Variola virus
uuuacuccucuccuuccguaaa

SEQ ID NO: 3285627 - RNA, 14 nt, Variola virus
auagugauaaguaa

SEQ ID NO: 3285628 - RNA, 14 nt, Variola virus
aacgucuaaaugua

SEQ ID NO: 3285629 - RNA, 14 nt, Variola virus
uacauaacaucuuu

SEQ ID NO: 3285630 - RNA, 18 nt, Variola virus
acuacaauauuucaucau

SEQ ID NO: 3285631 - RNA, 18 nt, Variola virus
cuguaucauccaguuugc

SEQ ID NO: 3285632 - RNA, 13 nt, Variola virus
acaagucuaauaa

SEQ ID NO: 3285633 - RNA, 21 nt, Variola virus
agagaauugcugcaauauauu

SEQ ID NO: 3285634 - RNA, 17 nt, Variola virus
uucuagacacaacacua

SEQ ID NO: 3285635 - RNA, 18 nt, Variola virus
aaacauuuuauuucuaga

SEQ ID NO: 3285636 - RNA, 18 nt, Variola virus
ucuaccguuguuaaauac

SEQ ID NO: 3285637 - RNA, 14 nt, Variola virus
auuucuaauguuuc

SEQ ID NO: 3285638 - RNA, 20 nt, Variola virus
auagugucuacuuaaaugua

SEQ ID NO: 3285639 - RNA, 14 nt, Variola virus
ucuaguucugaacg

SEQ ID NO: 3285640 - RNA, 21 nt, Variola virus
uuuaaauuuuucuacagauau

SEQ ID NO: 3285641 - RNA, 20 nt, Variola virus
uaaaaaguuuaaguuucuca

SEQ ID NO: 3285642 - RNA, 15 nt, Variola virus
auauucgaguucauu

SEQ ID NO: 3285643 - RNA, 20 nt, Variola virus
aguauuugagaaauauguau

SEQ ID NO: 3285644 - RNA, 22 nt, Variola virus
cgaacuccauaaauuucuccaa

SEQ ID NO: 3285645 - RNA, 12 nt, Variola virus
aaagauauuguu

SEQ ID NO: 3285646 - RNA, 13 nt, Variola virus
uugcaauugguaa

SEQ ID NO: 3285647 - RNA, 22 nt, Variola virus
caucuguaggauaucuauuuuc

SEQ ID NO: 3285648 - RNA, 16 nt, Variola virus
aguuagaaaaaaugau

SEQ ID NO: 3285649 - RNA, 22 nt, Variola virus
aaaugaagauccaagauuugua

SEQ ID NO: 3285650 - RNA, 12 nt, Variola virus
cauuugaugcac

SEQ ID NO: 3285651 - RNA, 16 nt, Variola virus
auaguuuaucuuuccc

SEQ ID NO: 3285652 - RNA, 22 nt, Variola virus
uacaagauugaaauuauauucu

SEQ ID NO: 3285653 - RNA, 21 nt, Variola virus
aaccauucauuaauuucugau

SEQ ID NO: 3285654 - RNA, 15 nt, Variola virus
caaugggucguugga

SEQ ID NO: 3285655 - RNA, 15 nt, Variola virus
auauaaguaauacau

SEQ ID NO: 3285656 - RNA, 16 nt, Variola virus
aguugcauagauguau

SEQ ID NO: 3285657 - RNA, 17 nt, Variola virus
augcgagagacaaaaug

SEQ ID NO: 3285658 - RNA, 17 nt, Variola virus
agugggcuuacauguau

SEQ ID NO: 3285659 - RNA, 20 nt, Variola virus
gucaucuuguucagaaauau

SEQ ID NO: 3285660 - RNA, 20 nt, Variola virus
uaaucgucgaacguucuagu

SEQ ID NO: 3285661 - RNA, 16 nt, Variola virus
uaguaucuaaaacuac

SEQ ID NO: 3285662 - RNA, 14 nt, Variola virus
cacaacuuaaugaa

SEQ ID NO: 3285663 - RNA, 22 nt, Variola virus
cucuaacaacgacgaaccaaaa

SEQ ID NO: 3285664 - RNA, 18 nt, Variola virus
acucaggaagauauuuua

SEQ ID NO: 3285665 - RNA, 15 nt, Variola virus
uuauaguagauauca

SEQ ID NO: 3285666 - RNA, 19 nt, Variola virus
gauccuagaacuagauaua

SEQ ID NO: 3285667 - RNA, 15 nt, Variola virus
uggaauaucaaaucu

SEQ ID NO: 3285668 - RNA, 14 nt, Variola virus
agcuucugaaauaa

SEQ ID NO: 3285669 - RNA, 18 nt, Variola virus
aagaagaugguuaaaaau

SEQ ID NO: 3285670 - RNA, 20 nt, Variola virus
uaaauguuuucucuguaaua

SEQ ID NO: 3285671 - RNA, 13 nt, Variola virus
acgugauagcucc

SEQ ID NO: 3285672 - RNA, 19 nt, Variola virus
cguacaugagucugaguuc

SEQ ID NO: 3285673 - RNA, 19 nt, Variola virus
aggaaguuuaauaauacaa

SEQ ID NO: 3285674 - RNA, 12 nt, Variola virus
ugauauuuguau

SEQ ID NO: 3285675 - RNA, 13 nt, Variola virus
uaucugaugauau

SEQ ID NO: 3285676 - RNA, 20 nt, Variola virus
gguacauacgucuauuucua

SEQ ID NO: 3285677 - RNA, 12 nt, Variola virus
ucucgauuucua

SEQ ID NO: 3285678 - RNA, 23 nt, Variola virus
aauaguuuguuuuggaaauagau

SEQ ID NO: 3285679 - RNA, 21 nt, Variola virus
gcaaauuauuucuucugaauu

SEQ ID NO: 3285680 - RNA, 14 nt, Variola virus
uuaacgauauuuug

SEQ ID NO: 3285681 - RNA, 18 nt, Variola virus
aggauucuccuaaauacg

SEQ ID NO: 3285682 - RNA, 22 nt, Variola virus
uauuuaaugauucauuaucaua

SEQ ID NO: 3285683 - RNA, 19 nt, Variola virus
uucuaguauacggaaacac

SEQ ID NO: 3285684 - RNA, 22 nt, Variola virus
caaaacguaauuauagaugaau

SEQ ID NO: 3285685 - RNA, 15 nt, Variola virus
auaaagaaaauaugg

SEQ ID NO: 3285686 - RNA, 18 nt, Variola virus
uaugaacgauaauaacuu

SEQ ID NO: 3285687 - RNA, 15 nt, Variola virus
gucugaagaauaucu

SEQ ID NO: 3285688 - RNA, 21 nt, Variola virus
ugucaaagauuguguagaaau

SEQ ID NO: 3285689 - RNA, 16 nt, Variola virus
gaaugcgauacauuga

SEQ ID NO: 3285690 - RNA, 20 nt, Variola virus
cauaauuaggaucuucuaau

SEQ ID NO: 3285691 - RNA, 20 nt, Variola virus
uaucagagcagucuuucuaa

SEQ ID NO: 3285692 - RNA, 21 nt, Variola virus
uagaauccauaaaacaaaauc

SEQ ID NO: 3285693 - RNA, 15 nt, Variola virus
acucucgaaaucaca

SEQ ID NO: 3285694 - RNA, 14 nt, Variola virus
aauugucuguaaac

SEQ ID NO: 3285695 - RNA, 16 nt, Variola virus
aaucguauaaauacug

SEQ ID NO: 3285696 - RNA, 17 nt, Variola virus
ucucagguacagauuuu

SEQ ID NO: 3285697 - RNA, 19 nt, Variola virus
uuaugucauaaacuguaaa

SEQ ID NO: 3285698 - RNA, 16 nt, Variola virus
gcugucacucauaaau

SEQ ID NO: 3285699 - RNA, 14 nt, Variola virus
uacuuuuaggaaau

SEQ ID NO: 3285700 - RNA, 23 nt, Variola virus
cuauucaguaguguuuacauaaa

SEQ ID NO: 3285701 - RNA, 17 nt, Variola virus
uaaacaucuugauacuu

SEQ ID NO: 3285702 - RNA, 13 nt, Variola virus
uauucgacacauc

SEQ ID NO: 3285703 - RNA, 23 nt, Variola virus
uuuauauaauuuuuggacaaaug

SEQ ID NO: 3285704 - RNA, 16 nt, Variola virus
uauacaccacccaaug

SEQ ID NO: 3285705 - RNA, 16 nt, Variola virus
augacauggaaauauc

SEQ ID NO: 3285706 - RNA, 23 nt, Variola virus
ucauuaaacagcauuucugucaa

SEQ ID NO: 3285707 - RNA, 22 nt, Variola virus
agauaugauaaaacuauuguuu

SEQ ID NO: 3285708 - RNA, 23 nt, Variola virus
gauccacaugcuguacaggccag

SEQ ID NO: 3285709 - RNA, 21 nt, Variola virus
ggauauuuguucauuggauug

SEQ ID NO: 3285710 - RNA, 22 nt, Variola virus
caaauaacucuugcaccaucag

SEQ ID NO: 3285711 - RNA, 13 nt, Variola virus
auucuuucaauuc

SEQ ID NO: 3285712 - RNA, 14 nt, Variola virus
ccaaaaugaugaua

SEQ ID NO: 3285713 - RNA, 22 nt, Variola virus
uugaaauuguuuuuuauuuucu

SEQ ID NO: 3285714 - RNA, 16 nt, Variola virus
accaacaacuguaaaa

SEQ ID NO: 3285715 - RNA, 17 nt, Variola virus
uaucaucgacacaaaug

SEQ ID NO: 3285716 - RNA, 18 nt, Variola virus
guuacauuuauacuucuu

SEQ ID NO: 3285717 - RNA, 22 nt, Variola virus
uauucuuaauucuuuaacaaaa

SEQ ID NO: 3285718 - RNA, 21 nt, Variola virus
uaaagucauuauauaggguug

SEQ ID NO: 3285719 - RNA, 23 nt, Variola virus
gcaauagucagacuguaguucua

SEQ ID NO: 3285720 - RNA, 15 nt, Variola virus
uauuaguguuuagau

SEQ ID NO: 3285721 - RNA, 15 nt, Variola virus
auauuguagcauuac

SEQ ID NO: 3285722 - RNA, 20 nt, Variola virus
cauaagcuugacuacauuug

SEQ ID NO: 3285723 - RNA, 14 nt, Variola virus
caauucuauccauu

SEQ ID NO: 3285724 - RNA, 12 nt, Variola virus
uuuauacaagau

SEQ ID NO: 3285725 - RNA, 12 nt, Variola virus
auuauacaugau

SEQ ID NO: 3285726 - RNA, 21 nt, Variola virus
uaacaagaucgauagacacug

SEQ ID NO: 3285727 - RNA, 14 nt, Variola virus
acuacaauauuuca

SEQ ID NO: 3285728 - RNA, 21 nt, Variola virus
uagauacucuaccauuucugc

SEQ ID NO: 3285729 - RNA, 22 nt, Variola virus
caaagagaugaucgauuauauu

SEQ ID NO: 3285730 - RNA, 17 nt, Variola virus
accauuuuaaaaucauu

SEQ ID NO: 3285731 - RNA, 13 nt, Variola virus
uguggguauacaa

SEQ ID NO: 3285732 - RNA, 18 nt, Variola virus
gaauaucacauaucaugu

SEQ ID NO: 3285733 - RNA, 15 nt, Variola virus
gcaaagaaugaugac

SEQ ID NO: 3285734 - RNA, 22 nt, Variola virus
gacauaguuucaaaacaaacag

SEQ ID NO: 3285735 - RNA, 15 nt, Variola virus
uaaaaaauucccauu

SEQ ID NO: 3285736 - RNA, 16 nt, Variola virus
cuauuggcaauuguag

SEQ ID NO: 3285737 - RNA, 19 nt, Variola virus
uuaagauuuuaaauguaua

SEQ ID NO: 3285738 - RNA, 12 nt, Variola virus
gugauagauaug

SEQ ID NO: 3285739 - RNA, 16 nt, Variola virus
ucauguuuauuucuag

SEQ ID NO: 3285740 - RNA, 19 nt, Variola virus
uuaaguagaucaucugaaa

SEQ ID NO: 3285741 - RNA, 13 nt, Variola virus
aauucuaaaugau

SEQ ID NO: 3285742 - RNA, 20 nt, Variola virus
uucugcuaguucuugagaca

SEQ ID NO: 3285743 - RNA, 12 nt, Variola virus
aagguucuuaua

SEQ ID NO: 3285744 - RNA, 23 nt, Variola virus
ggauuuuauucguagaaaguauc

SEQ ID NO: 3285745 - RNA, 21 nt, Variola virus
auaguggauacgaagauacua

SEQ ID NO: 3285746 - RNA, 17 nt, Variola virus
uuaucucauuugaaaau

SEQ ID NO: 3285747 - RNA, 14 nt, Variola virus
aagacggggauuuc

SEQ ID NO: 3285748 - RNA, 21 nt, Variola virus
auauuucuguaucaaaugcua

SEQ ID NO: 3285749 - RNA, 20 nt, Variola virus
acaaaauucauuagaauaua

SEQ ID NO: 3285750 - RNA, 21 nt, Variola virus
ucuuuaccauaacuguauaaa

SEQ ID NO: 3285751 - RNA, 22 nt, Variola virus
cuaugaucguuuuaauauugug

SEQ ID NO: 3285752 - RNA, 23 nt, Variola virus
uggaaugacgaauccuguuucua

SEQ ID NO: 3285753 - RNA, 15 nt, Variola virus
ugccuccacauaucg

SEQ ID NO: 3285754 - RNA, 15 nt, Variola virus
caaaauacaauuguu

SEQ ID NO: 3285755 - RNA, 15 nt, Variola virus
auauuaauaggagau

SEQ ID NO: 3285756 - RNA, 24 nt, Variola virus
uuacuaucuuuaacauauguauca

SEQ ID NO: 3285757 - RNA, 21 nt, Variola virus
aucauccaccuguuuuaacau

SEQ ID NO: 3285758 - RNA, 17 nt, Variola virus
aauuggcauuuaacaga

SEQ ID NO: 3285759 - RNA, 19 nt, Variola virus
guaauacgaucuauaaaaa

SEQ ID NO: 3285760 - RNA, 18 nt, Variola virus
aauaaauagauauaaaau

SEQ ID NO: 3285761 - RNA, 21 nt, Variola virus
uaugccacaccaucuucauaa

SEQ ID NO: 3285762 - RNA, 12 nt, Variola virus
cuuaaucaugug

SEQ ID NO: 3285763 - RNA, 22 nt, Variola virus
caauuauaacaauuauaacaau

SEQ ID NO: 3285764 - RNA, 17 nt, Variola virus
auauacguguacuguau

SEQ ID NO: 3285765 - RNA, 22 nt, Variola virus
ucaguugcauuuucaacacucg

SEQ ID NO: 3285766 - RNA, 14 nt, Variola virus
ugucaaaggaugaa

SEQ ID NO: 3285767 - RNA, 18 nt, Variola virus
acucucuauaacaaaugu

SEQ ID NO: 3285768 - RNA, 15 nt, Variola virus
cauuccuuauacaau

SEQ ID NO: 3285769 - RNA, 19 nt, Variola virus
ccuugaaaauaaauacagu

SEQ ID NO: 3285770 - RNA, 15 nt, Variola virus
ugaaauugagaagau

SEQ ID NO: 3285771 - RNA, 23 nt, Variola virus
uaaguaccggguaauauaucuuu

SEQ ID NO: 3285772 - RNA, 19 nt, Variola virus
uucacuauaucuaagaaac

SEQ ID NO: 3285773 - RNA, 13 nt, Variola virus
aucaacauauuaa

SEQ ID NO: 3285774 - RNA, 17 nt, Variola virus
aauaucacauaucaugu

SEQ ID NO: 3285775 - RNA, 19 nt, Variola virus
cauuuuccagaugauaugu

SEQ ID NO: 3285776 - RNA, 14 nt, Variola virus
acgaucuauuagaa

SEQ ID NO: 3285777 - RNA, 21 nt, Variola virus
auauuaacgaguuccauuuau

SEQ ID NO: 3285778 - RNA, 13 nt, Variola virus
auauauugucuaa

SEQ ID NO: 3285779 - RNA, 18 nt, Variola virus
ucugaaauuccaucuaga

SEQ ID NO: 3285780 - RNA, 16 nt, Variola virus
auauuuaaaauaucua

SEQ ID NO: 3285781 - RNA, 19 nt, Variola virus
caauuuauacggauuucua

SEQ ID NO: 3285782 - RNA, 22 nt, Variola virus
acaacgucaucgcuucaucuau

SEQ ID NO: 3285783 - RNA, 12 nt, Variola virus
uuaaaaugagua

SEQ ID NO: 3285784 - RNA, 19 nt, Variola virus
caaguuuucauaucaucuu

SEQ ID NO: 3285785 - RNA, 21 nt, Variola virus
uauucaauuuuuguauaucua

SEQ ID NO: 3285786 - RNA, 16 nt, Variola virus
auuuacauuaaaugua

SEQ ID NO: 3285787 - RNA, 19 nt, Variola virus
ugcaaauaaaauauacugu

SEQ ID NO: 3285788 - RNA, 16 nt, Variola virus
aguuuguuuucauuau

SEQ ID NO: 3285789 - RNA, 18 nt, Variola virus
acggagccccaggaucuc

SEQ ID NO: 3285790 - RNA, 18 nt, Variola virus
ucaaacaugacauuuucc

SEQ ID NO: 3285791 - RNA, 20 nt, Variola virus
caaucugggcguauaaugaa

SEQ ID NO: 3285792 - RNA, 20 nt, Variola virus
gacaacuuaaucugaugaau

SEQ ID NO: 3285793 - RNA, 13 nt, Variola virus
auaaaaaaaauua

SEQ ID NO: 3285794 - RNA, 15 nt, Variola virus
cagagaccauguauu

SEQ ID NO: 3285795 - RNA, 15 nt, Variola virus
uaacagccaauauga

SEQ ID NO: 3285796 - RNA, 18 nt, Variola virus
caacaaguuggaugauau

SEQ ID NO: 3285797 - RNA, 14 nt, Variola virus
auaaguaaaugaaa

SEQ ID NO: 3285798 - RNA, 13 nt, Variola virus
cugcaguaauauu

SEQ ID NO: 3285799 - RNA, 13 nt, Variola virus
caggaacuaugac

SEQ ID NO: 3285800 - RNA, 16 nt, Variola virus
auuaacgguaauacau

SEQ ID NO: 3285801 - RNA, 22 nt, Variola virus
aacacuaaaaaauaaacacaua

SEQ ID NO: 3285802 - RNA, 18 nt, Variola virus
aguuaagagaauaauaga

SEQ ID NO: 3285803 - RNA, 13 nt, Variola virus
uauaguuuggauu

SEQ ID NO: 3285804 - RNA, 20 nt, Variola virus
ugaagaauuuauauaaauua

SEQ ID NO: 3285805 - RNA, 17 nt, Variola virus
gaaaauacuaaaucaga

SEQ ID NO: 3285806 - RNA, 16 nt, Variola virus
ggacaaauauaugcaa

SEQ ID NO: 3285807 - RNA, 12 nt, Variola virus
uaaaauggauua

SEQ ID NO: 3285808 - RNA, 18 nt, Variola virus
aguaaguaucuuauguau

SEQ ID NO: 3285809 - RNA, 14 nt, Variola virus
aucugaagaaagua

SEQ ID NO: 3285810 - RNA, 11 nt, Variola virus
ucgaaaacuag

SEQ ID NO: 3285811 - RNA, 22 nt, Variola virus
uaaccgauaaaaagacuuuuau

SEQ ID NO: 3285812 - RNA, 18 nt, Variola virus
auuauuaaguauaauaga

SEQ ID NO: 3285813 - RNA, 20 nt, Variola virus
uuauugcacgcuauuaauca

SEQ ID NO: 3285814 - RNA, 18 nt, Variola virus
cacuuuuuuauaaagaug

SEQ ID NO: 3285815 - RNA, 15 nt, Variola virus
uuuauuaaguguauu

SEQ ID NO: 3285816 - RNA, 11 nt, Variola virus
aauauuuuacg

SEQ ID NO: 3285817 - RNA, 16 nt, Variola virus
auauauuuuucuagau

SEQ ID NO: 3285818 - RNA, 17 nt, Variola virus
uggaucaucgugugaua

SEQ ID NO: 3285819 - RNA, 17 nt, Variola virus
gaaaacugguuaaaaca

SEQ ID NO: 3285820 - RNA, 17 nt, Variola virus
uuuagacgguugagaaa

SEQ ID NO: 3285821 - RNA, 18 nt, Variola virus
uaauacccguuuguuuaa

SEQ ID NO: 3285822 - RNA, 17 nt, Variola virus
ugaugcuuaaaaugcuc

SEQ ID NO: 3285823 - RNA, 18 nt, Variola virus
uacccaaucucucucaaa

SEQ ID NO: 3285824 - RNA, 15 nt, Variola virus
uggaucguuuagaau

SEQ ID NO: 3285825 - RNA, 23 nt, Variola virus
cuaguaaacuucgcguauacagu

SEQ ID NO: 3285826 - RNA, 14 nt, Variola virus
uuaauacauuauua

SEQ ID NO: 3285827 - RNA, 13 nt, Variola virus
aucggcucaaaga

SEQ ID NO: 3285828 - RNA, 18 nt, Variola virus
uauugcuguauuuguaau

SEQ ID NO: 3285829 - RNA, 12 nt, Variola virus
auucuaaugaug

SEQ ID NO: 3285830 - RNA, 20 nt, Variola virus
augaguuauuaagaaauaca

SEQ ID NO: 3285831 - RNA, 19 nt, Variola virus
cacuaguuaagaacauguc

SEQ ID NO: 3285832 - RNA, 20 nt, Variola virus
aguaaucauguaaauguuua

SEQ ID NO: 3285833 - RNA, 20 nt, Variola virus
ggauuugguaagacuauuac

SEQ ID NO: 3285834 - RNA, 21 nt, Variola virus
uagauuauaauccuuauacau

SEQ ID NO: 3285835 - RNA, 20 nt, Variola virus
cuaucauccaucauguuaag

SEQ ID NO: 3285836 - RNA, 14 nt, Variola virus
auuagaucuuuuac

SEQ ID NO: 3285837 - RNA, 18 nt, Variola virus
uaacauuacauauuauau

SEQ ID NO: 3285838 - RNA, 14 nt, Variola virus
uauuauaaacucuc

SEQ ID NO: 3285839 - RNA, 21 nt, Variola virus
gaauucuuuuucgacuuuuug

SEQ ID NO: 3285840 - RNA, 14 nt, Variola virus
gaauauauaaaaga

SEQ ID NO: 3285841 - RNA, 16 nt, Variola virus
auuuugaggaaauuga

SEQ ID NO: 3285842 - RNA, 22 nt, Variola virus
guauuuggaucuuuuguacauc

SEQ ID NO: 3285843 - RNA, 13 nt, Variola virus
auuacaaaaacua

SEQ ID NO: 3285844 - RNA, 22 nt, Variola virus
uaaccggcgcugucauguaucc

SEQ ID NO: 3285845 - RNA, 13 nt, Variola virus
cuaauacucuggg

SEQ ID NO: 3285846 - RNA, 23 nt, Variola virus
aauuaguguauaauuuugucaua

SEQ ID NO: 3285847 - RNA, 13 nt, Variola virus
agagcaaacaucu

SEQ ID NO: 3285848 - RNA, 18 nt, Variola virus
aggauguuauuaugaauc

SEQ ID NO: 3285849 - RNA, 18 nt, Variola virus
uaugauagaaauuagcaa

SEQ ID NO: 3285850 - RNA, 14 nt, Variola virus
ccaguuccuuuucu

SEQ ID NO: 3285851 - RNA, 21 nt, Variola virus
aauuuaaaauuagaucuuuua

SEQ ID NO: 3285852 - RNA, 16 nt, Variola virus
ugauacuaaguauaau

SEQ ID NO: 3285853 - RNA, 15 nt, Variola virus
auauucuaaaauggu

SEQ ID NO: 3285854 - RNA, 23 nt, Variola virus
ugauuaacagaaaaaacaauguu

SEQ ID NO: 3285855 - RNA, 17 nt, Variola virus
gcagucggauuggaaca

SEQ ID NO: 3285856 - RNA, 21 nt, Variola virus
auauuaacaaaagugaauaua

SEQ ID NO: 3285857 - RNA, 17 nt, Variola virus
guuuucuagauggaaau

SEQ ID NO: 3285858 - RNA, 18 nt, Variola virus
gaaaauccagcuacuaua

SEQ ID NO: 3285859 - RNA, 19 nt, Variola virus
auaucuagacuuucuguua

SEQ ID NO: 3285860 - RNA, 15 nt, Variola virus
auaucaaauggauau

SEQ ID NO: 3285861 - RNA, 21 nt, Variola virus
auaucauugaaugagauacua

SEQ ID NO: 3285862 - RNA, 18 nt, Variola virus
aucugauaauauuaaaaa

SEQ ID NO: 3285863 - RNA, 18 nt, Variola virus
aagaacauugcagccauu

SEQ ID NO: 3285864 - RNA, 19 nt, Variola virus
acuaauuaguaacgacuau

SEQ ID NO: 3285865 - RNA, 14 nt, Variola virus
uuaaaaauaguuuu

SEQ ID NO: 3285866 - RNA, 15 nt, Variola virus
uuaccagaauacuau

SEQ ID NO: 3285867 - RNA, 12 nt, Variola virus
ugucuccauuac

SEQ ID NO: 3285868 - RNA, 16 nt, Variola virus
aauaucaggaaaugua

SEQ ID NO: 3285869 - RNA, 20 nt, Variola virus
aacauuuugcagaaaaaagu

SEQ ID NO: 3285870 - RNA, 19 nt, Variola virus
uaauaaauaaaucugaacc

SEQ ID NO: 3285871 - RNA, 22 nt, Variola virus
guacaacaucuaacuauaugau

SEQ ID NO: 3285872 - RNA, 18 nt, Variola virus
auucucucauuuaucaaa

SEQ ID NO: 3285873 - RNA, 16 nt, Variola virus
aagcuaggcuggaaac

SEQ ID NO: 3285874 - RNA, 12 nt, Variola virus
gaccguguuucu

SEQ ID NO: 3285875 - RNA, 18 nt, Variola virus
acuuggagguagguauua

SEQ ID NO: 3285876 - RNA, 13 nt, Variola virus
aagauauucuaaa

SEQ ID NO: 3285877 - RNA, 16 nt, Variola virus
aaauuauucacuauau

SEQ ID NO: 3285878 - RNA, 13 nt, Variola virus
uuuacccacuaua

SEQ ID NO: 3285879 - RNA, 21 nt, Variola virus
aaauucuuaguuauauauacu

SEQ ID NO: 3285880 - RNA, 16 nt, Variola virus
guuaaaaauaaucauc

SEQ ID NO: 3285881 - RNA, 22 nt, Variola virus
ucuuuaaguuuuccguuagaaa

SEQ ID NO: 3285882 - RNA, 17 nt, Variola virus
aucuggauuucagauau

SEQ ID NO: 3285883 - RNA, 19 nt, Variola virus
aauacaccaauagaugaua

SEQ ID NO: 3285884 - RNA, 19 nt, Variola virus
auuguauccauacauacau

SEQ ID NO: 3285885 - RNA, 21 nt, Variola virus
aaauacgcaaucgauguguca

SEQ ID NO: 3285886 - RNA, 17 nt, Variola virus
ccauuuguguaucuaua

SEQ ID NO: 3285887 - RNA, 15 nt, Variola virus
aguaaguaugucgaa

SEQ ID NO: 3285888 - RNA, 22 nt, Variola virus
gauaucaacauggaguauauca

SEQ ID NO: 3285889 - RNA, 16 nt, Variola virus
gacuaugggaauauau

SEQ ID NO: 3285890 - RNA, 15 nt, Variola virus
ccgucuuuaucucuu

SEQ ID NO: 3285891 - RNA, 19 nt, Variola virus
uauuuuucuaauacuauau

SEQ ID NO: 3285892 - RNA, 14 nt, Variola virus
uauggcuucuccag

SEQ ID NO: 3285893 - RNA, 22 nt, Variola virus
cguagaaaguaucuuauauaca

SEQ ID NO: 3285894 - RNA, 13 nt, Variola virus
ucuuaauaucaga

SEQ ID NO: 3285895 - RNA, 17 nt, Variola virus
gcucuuucgaugauaau

SEQ ID NO: 3285896 - RNA, 18 nt, Variola virus
ucuauuagauguguauaa

SEQ ID NO: 3285897 - RNA, 19 nt, Variola virus
aguugucuauauuaacucu

SEQ ID NO: 3285898 - RNA, 19 nt, Variola virus
cucuuugacauauuuugag

SEQ ID NO: 3285899 - RNA, 14 nt, Variola virus
uaggagaauuauuu

SEQ ID NO: 3285900 - RNA, 21 nt, Variola virus
auccguuaguuuaauauccuu

SEQ ID NO: 3285901 - RNA, 20 nt, Variola virus
ucgcugaucgucuagaugau

SEQ ID NO: 3285902 - RNA, 17 nt, Variola virus
auaauauuaucaugaau

SEQ ID NO: 3285903 - RNA, 20 nt, Variola virus
auuagccgaacauauagcug

SEQ ID NO: 3285904 - RNA, 16 nt, Variola virus
uauucagauuaucaug

SEQ ID NO: 3285905 - RNA, 14 nt, Variola virus
acuauguuagcauu

SEQ ID NO: 3285906 - RNA, 18 nt, Variola virus
uaauauauugaucauaau

SEQ ID NO: 3285907 - RNA, 12 nt, Variola virus
aaggcagaaaua

SEQ ID NO: 3285908 - RNA, 15 nt, Variola virus
cuaauuaaaaguuuu

SEQ ID NO: 3285909 - RNA, 16 nt, Variola virus
ucauacaugauauuca

SEQ ID NO: 3285910 - RNA, 14 nt, Variola virus
aggaacauaaacaa

SEQ ID NO: 3285911 - RNA, 20 nt, Variola virus
auuuauuaaugcuuuaguga

SEQ ID NO: 3285912 - RNA, 16 nt, Variola virus
guguaauguaaucaua

SEQ ID NO: 3285913 - RNA, 18 nt, Variola virus
gacauggcuucuuccaua

SEQ ID NO: 3285914 - RNA, 16 nt, Variola virus
uaaacaugaauuuauu

SEQ ID NO: 3285915 - RNA, 18 nt, Variola virus
uucccaucauuucucaau

SEQ ID NO: 3285916 - RNA, 13 nt, Variola virus
uauggaacucaug

SEQ ID NO: 3285917 - RNA, 14 nt, Variola virus
agauacaaauaugu

SEQ ID NO: 3285918 - RNA, 12 nt, Variola virus
cuaaauccucau

SEQ ID NO: 3285919 - RNA, 18 nt, Variola virus
ucuaguuaucauguagua

SEQ ID NO: 3285920 - RNA, 13 nt, Variola virus
gauauuugcuaau

SEQ ID NO: 3285921 - RNA, 13 nt, Variola virus
uacaguucuuggc

SEQ ID NO: 3285922 - RNA, 18 nt, Variola virus
uaacugacuuaauaguag

SEQ ID NO: 3285923 - RNA, 14 nt, Variola virus
uccauaaacugaua

SEQ ID NO: 3285924 - RNA, 14 nt, Variola virus
guacccaaguuauu

SEQ ID NO: 3285925 - RNA, 13 nt, Variola virus
aggauaaaguaaa

SEQ ID NO: 3285926 - RNA, 23 nt, Variola virus
aacucuacauaaucauaaccauu

SEQ ID NO: 3285927 - RNA, 23 nt, Variola virus
caaacaucacucuucgaaaagaa

SEQ ID NO: 3285928 - RNA, 23 nt, Variola virus
uuaacaaaugguucaaagacuag

SEQ ID NO: 3285929 - RNA, 16 nt, Variola virus
agauuauucuuaaaug

SEQ ID NO: 3285930 - RNA, 20 nt, Variola virus
gaucuauagaaaacuacagg

SEQ ID NO: 3285931 - RNA, 13 nt, Variola virus
gcuaaauuuucau

SEQ ID NO: 3285932 - RNA, 18 nt, Variola virus
augaaguaguugcauaga

SEQ ID NO: 3285933 - RNA, 20 nt, Variola virus
ugaucauuggcaaaauccua

SEQ ID NO: 3285934 - RNA, 20 nt, Variola virus
auaguauacgcagaaaagau

SEQ ID NO: 3285935 - RNA, 21 nt, Variola virus
uuccacaauacgagucauuau

SEQ ID NO: 3285936 - RNA, 17 nt, Variola virus
aucucauucaaauccau

SEQ ID NO: 3285937 - RNA, 21 nt, Variola virus
uccaucauuguccuauuucaa

SEQ ID NO: 3285938 - RNA, 19 nt, Variola virus
aauaacuauguuuuaaaaa

SEQ ID NO: 3285939 - RNA, 16 nt, Variola virus
aacguacaaauggaua

SEQ ID NO: 3285940 - RNA, 19 nt, Variola virus
gucaauggaccccaacauc

SEQ ID NO: 3285941 - RNA, 19 nt, Variola virus
guuagaguaucuacaucag

SEQ ID NO: 3285942 - RNA, 14 nt, Variola virus
aucuagacauagau

SEQ ID NO: 3285943 - RNA, 19 nt, Variola virus
augcaucuauauaaucuuu

SEQ ID NO: 3285944 - RNA, 12 nt, Variola virus
uaaacuuuaaug

SEQ ID NO: 3285945 - RNA, 22 nt, Variola virus
ucacaaguaugaagaaaaaugu

SEQ ID NO: 3285946 - RNA, 16 nt, Variola virus
uggauccuaacaauga

SEQ ID NO: 3285947 - RNA, 15 nt, Variola virus
cuaaguuucuuuccu

SEQ ID NO: 3285948 - RNA, 21 nt, Variola virus
cggaauaaguguuuucucaau

SEQ ID NO: 3285949 - RNA, 14 nt, Variola virus
ugcaugacgugaua

SEQ ID NO: 3285950 - RNA, 18 nt, Variola virus
uauacaaguguagaugau

SEQ ID NO: 3285951 - RNA, 15 nt, Variola virus
cucuguuucuguauc

SEQ ID NO: 3285952 - RNA, 17 nt, Variola virus
cuuaauucuagcaucuu

SEQ ID NO: 3285953 - RNA, 18 nt, Variola virus
uaaacaguuuaauagucu

SEQ ID NO: 3285954 - RNA, 12 nt, Variola virus
cuuacaauaaac

SEQ ID NO: 3285955 - RNA, 18 nt, Variola virus
gaauaucaggaaauguau

SEQ ID NO: 3285956 - RNA, 21 nt, Variola virus
aaaaagauuaccguaugauau

SEQ ID NO: 3285957 - RNA, 19 nt, Variola virus
acauuauuaaaucaugaag

SEQ ID NO: 3285958 - RNA, 16 nt, Variola virus
uugcaaaauaugcucu

SEQ ID NO: 3285959 - RNA, 17 nt, Variola virus
aaaaaugauagaaauau

SEQ ID NO: 3285960 - RNA, 17 nt, Variola virus
uaauucagauacuacag

SEQ ID NO: 3285961 - RNA, 21 nt, Variola virus
ucaaaugccacaucaaagaua

SEQ ID NO: 3285962 - RNA, 13 nt, Variola virus
auuuguucuugua

SEQ ID NO: 3285963 - RNA, 14 nt, Variola virus
uaauauuagaauau

SEQ ID NO: 3285964 - RNA, 14 nt, Variola virus
aaccuagaaaauau

SEQ ID NO: 3285965 - RNA, 15 nt, Variola virus
aaaaguuaagaauua

SEQ ID NO: 3285966 - RNA, 17 nt, Variola virus
acacgagccuuuauuau

SEQ ID NO: 3285967 - RNA, 17 nt, Variola virus
uauaauccgauauauga

SEQ ID NO: 3285968 - RNA, 17 nt, Variola virus
uauacguuauugucaaa

SEQ ID NO: 3285969 - RNA, 18 nt, Variola virus
auguagagguaaaaagac

SEQ ID NO: 3285970 - RNA, 15 nt, Variola virus
uaacuguuaucucuu

SEQ ID NO: 3285971 - RNA, 14 nt, Variola virus
uaugacuaaaucua

SEQ ID NO: 3285972 - RNA, 19 nt, Variola virus
ugauaucauuaauacagua

SEQ ID NO: 3285973 - RNA, 14 nt, Variola virus
gaauugacaaauaa

SEQ ID NO: 3285974 - RNA, 15 nt, Variola virus
cugauacgucauuaa

SEQ ID NO: 3285975 - RNA, 18 nt, Variola virus
uuaaaauucacacauuuu

SEQ ID NO: 3285976 - RNA, 20 nt, Variola virus
aguguuaauuuuaaaugaug

SEQ ID NO: 3285977 - RNA, 17 nt, Variola virus
ucuaccuauuucaucag

SEQ ID NO: 3285978 - RNA, 17 nt, Variola virus
gugcagaagcucuggcu

SEQ ID NO: 3285979 - RNA, 18 nt, Variola virus
aaaacauggauuugguaa

SEQ ID NO: 3285980 - RNA, 23 nt, Variola virus
uauuaacacuaaaaaauaaacac

SEQ ID NO: 3285981 - RNA, 14 nt, Variola virus
agggguauacuucu

SEQ ID NO: 3285982 - RNA, 15 nt, Variola virus
guucagaauauguua

SEQ ID NO: 3285983 - RNA, 19 nt, Variola virus
uguuaccauaauaccuuuu

SEQ ID NO: 3285984 - RNA, 13 nt, Variola virus
cuauuaaaacuaa

SEQ ID NO: 3285985 - RNA, 17 nt, Variola virus
cugguagccguuucaau

SEQ ID NO: 3285986 - RNA, 12 nt, Variola virus
aauucuagcauc

SEQ ID NO: 3285987 - RNA, 14 nt, Variola virus
auauaucaaaauua

SEQ ID NO: 3285988 - RNA, 15 nt, Variola virus
ucuauuuaauacuuu

SEQ ID NO: 3285989 - RNA, 21 nt, Variola virus
aaacuuucuagaacauacuga

SEQ ID NO: 3285990 - RNA, 17 nt, Variola virus
ucauccagaucauuaag

SEQ ID NO: 3285991 - RNA, 14 nt, Variola virus
ucugaaaauguaua

SEQ ID NO: 3285992 - RNA, 16 nt, Variola virus
ugggaggcuugaagug

SEQ ID NO: 3285993 - RNA, 14 nt, Variola virus
agaaaguaugauau

SEQ ID NO: 3285994 - RNA, 16 nt, Variola virus
acaucucgcaauaauc

SEQ ID NO: 3285995 - RNA, 20 nt, Variola virus
ucaaucauccuaaagaguau

SEQ ID NO: 3285996 - RNA, 19 nt, Variola virus
uguuugcugcguguauaac

SEQ ID NO: 3285997 - RNA, 19 nt, Variola virus
uuagucauacguaaugaag

SEQ ID NO: 3285998 - RNA, 19 nt, Variola virus
aucucguccuugguuuaca

SEQ ID NO: 3285999 - RNA, 17 nt, Variola virus
guaaucauguaaauguu

SEQ ID NO: 3286000 - RNA, 21 nt, Variola virus
uguauuuggaucuuuuguaca

SEQ ID NO: 3286001 - RNA, 23 nt, Variola virus
caucgauugugauuguauuuccu

SEQ ID NO: 3286002 - RNA, 17 nt, Variola virus
gcaggcaaauguuuaua

SEQ ID NO: 3286003 - RNA, 21 nt, Variola virus
auaagacuuuacucuucuaaa

SEQ ID NO: 3286004 - RNA, 16 nt, Variola virus
aaaacagauaaugaua

SEQ ID NO: 3286005 - RNA, 17 nt, Variola virus
cauuuauuauauauaau

SEQ ID NO: 3286006 - RNA, 20 nt, Variola virus
uugguauaaauguuguaauu

SEQ ID NO: 3286007 - RNA, 15 nt, Variola virus
cugcguuaaacauuc

SEQ ID NO: 3286008 - RNA, 23 nt, Variola virus
cugagauuuguuuuguuaaacaa

SEQ ID NO: 3286009 - RNA, 21 nt, Variola virus
agucuuauauguagcaaacau

SEQ ID NO: 3286010 - RNA, 16 nt, Variola virus
ccaacggaaaugguag

SEQ ID NO: 3286011 - RNA, 17 nt, Variola virus
auaugccuccagaaguu

SEQ ID NO: 3286012 - RNA, 21 nt, Variola virus
auuaauacaggaucuagcaaa

SEQ ID NO: 3286013 - RNA, 12 nt, Variola virus
uuuguacauuuu

SEQ ID NO: 3286014 - RNA, 23 nt, Variola virus
cacaugucacacaggauccauuu

SEQ ID NO: 3286015 - RNA, 21 nt, Variola virus
uaauauaaaaacuuauuacau

SEQ ID NO: 3286016 - RNA, 15 nt, Variola virus
acaaaccuaagacaa

SEQ ID NO: 3286017 - RNA, 15 nt, Variola virus
uguacauacaucacu

SEQ ID NO: 3286018 - RNA, 22 nt, Variola virus
auaaagacguggcaaacaaugu

SEQ ID NO: 3286019 - RNA, 14 nt, Variola virus
aacuuaaacaaaau

SEQ ID NO: 3286020 - RNA, 13 nt, Variola virus
aacauaugauauu

SEQ ID NO: 3286021 - RNA, 23 nt, Variola virus
uaaacggcaaaccaaaaacauuu

SEQ ID NO: 3286022 - RNA, 17 nt, Variola virus
aucucagugcaaagauu

SEQ ID NO: 3286023 - RNA, 21 nt, Variola virus
auucuggcuauuucaaaauaa

SEQ ID NO: 3286024 - RNA, 11 nt, Variola virus
uuuauuucuaa

SEQ ID NO: 3286025 - RNA, 19 nt, Variola virus
ugacuaguccaaagacuua

SEQ ID NO: 3286026 - RNA, 18 nt, Variola virus
auuccugacugauuaaca

SEQ ID NO: 3286027 - RNA, 22 nt, Variola virus
uaaauguuuaaacaucaaacau

SEQ ID NO: 3286028 - RNA, 11 nt, Variola virus
guuaaauuaau

SEQ ID NO: 3286029 - RNA, 20 nt, Variola virus
acuacauuaaaacuuaaaaa

SEQ ID NO: 3286030 - RNA, 15 nt, Variola virus
acaaaaucuaaacaa

SEQ ID NO: 3286031 - RNA, 18 nt, Variola virus
uguaaaaguaaaaaagaa

SEQ ID NO: 3286032 - RNA, 21 nt, Variola virus
ggaauuaaucuaguagaaaag

SEQ ID NO: 3286033 - RNA, 15 nt, Variola virus
uccuauacucugaaa

SEQ ID NO: 3286034 - RNA, 16 nt, Variola virus
aauauuucuauuucua

SEQ ID NO: 3286035 - RNA, 20 nt, Variola virus
ugauccaucugcucaacaau

SEQ ID NO: 3286036 - RNA, 14 nt, Variola virus
caugaugagauguu

SEQ ID NO: 3286037 - RNA, 14 nt, Variola virus
ccaaauguuggaaa

SEQ ID NO: 3286038 - RNA, 17 nt, Variola virus
acuguacgauacauaau

SEQ ID NO: 3286039 - RNA, 19 nt, Variola virus
gauguauauaggucagaua

SEQ ID NO: 3286040 - RNA, 12 nt, Variola virus
auugacaaaauu

SEQ ID NO: 3286041 - RNA, 23 nt, Variola virus
uaucucgcauccauauguuugga

SEQ ID NO: 3286042 - RNA, 14 nt, Variola virus
ugaaccaaacauuc

SEQ ID NO: 3286043 - RNA, 20 nt, Variola virus
aauaguuagauacaaagaua

SEQ ID NO: 3286044 - RNA, 16 nt, Variola virus
uaaaaaguuuaauuug

SEQ ID NO: 3286045 - RNA, 22 nt, Variola virus
gaguaguaaaugcguacauaac

SEQ ID NO: 3286046 - RNA, 22 nt, Variola virus
cauuuaucgcuaacaugcauuu

SEQ ID NO: 3286047 - RNA, 17 nt, Variola virus
gccauaucauacaugau

SEQ ID NO: 3286048 - RNA, 15 nt, Variola virus
ugccaucuuacauga

SEQ ID NO: 3286049 - RNA, 20 nt, Variola virus
gauucauccuuaaauguuuu

SEQ ID NO: 3286050 - RNA, 20 nt, Variola virus
aaauuauuccuaauuaagaa

SEQ ID NO: 3286051 - RNA, 14 nt, Variola virus
augguaaaggauaa

SEQ ID NO: 3286052 - RNA, 18 nt, Variola virus
acuccagaacaucuucca

SEQ ID NO: 3286053 - RNA, 22 nt, Variola virus
uacguuugauucguucaaaaau

SEQ ID NO: 3286054 - RNA, 13 nt, Variola virus
gaaaacauaucua

SEQ ID NO: 3286055 - RNA, 21 nt, Variola virus
ucauuaucgguguauuuucca

SEQ ID NO: 3286056 - RNA, 15 nt, Variola virus
cuaauuuuuguaaau

SEQ ID NO: 3286057 - RNA, 19 nt, Variola virus
acaauaacuacauauucua

SEQ ID NO: 3286058 - RNA, 16 nt, Variola virus
ucuuccauuuaaauau

SEQ ID NO: 3286059 - RNA, 14 nt, Variola virus
ucaaaauauuucaa

SEQ ID NO: 3286060 - RNA, 16 nt, Variola virus
auaagaagagaaaagu

SEQ ID NO: 3286061 - RNA, 16 nt, Variola virus
aucacauaugcaaaga

SEQ ID NO: 3286062 - RNA, 21 nt, Variola virus
cauaaaauaacucuguagacg

SEQ ID NO: 3286063 - RNA, 18 nt, Variola virus
uuagaucucauaugugcu

SEQ ID NO: 3286064 - RNA, 18 nt, Variola virus
aaauaguaucaucuauca

SEQ ID NO: 3286065 - RNA, 17 nt, Variola virus
auuuuaaguuuauugac

SEQ ID NO: 3286066 - RNA, 14 nt, Variola virus
uaaaaaaaugauug

SEQ ID NO: 3286067 - RNA, 20 nt, Variola virus
aauggacuccaauacgaaau

SEQ ID NO: 3286068 - RNA, 18 nt, Variola virus
ucgaaugccauagaauaa

SEQ ID NO: 3286069 - RNA, 19 nt, Variola virus
auauaggaccacuagcaaa

SEQ ID NO: 3286070 - RNA, 17 nt, Variola virus
aacaaauguuggagaaa

SEQ ID NO: 3286071 - RNA, 21 nt, Variola virus
ugaaauagcguucgucaacau

SEQ ID NO: 3286072 - RNA, 15 nt, Variola virus
uaaucaaaauugucu

SEQ ID NO: 3286073 - RNA, 22 nt, Variola virus
ucuggaaaaacaacacaaugua

SEQ ID NO: 3286074 - RNA, 17 nt, Variola virus
uaaucggagaauguuuc

SEQ ID NO: 3286075 - RNA, 15 nt, Variola virus
uacaaaauauguucg

SEQ ID NO: 3286076 - RNA, 15 nt, Variola virus
agucaagaugaugaa

SEQ ID NO: 3286077 - RNA, 18 nt, Variola virus
acgucauaaaaauguuua

SEQ ID NO: 3286078 - RNA, 17 nt, Variola virus
augaccaguuugcaaua

SEQ ID NO: 3286079 - RNA, 19 nt, Variola virus
uauauuucgugauauacau

SEQ ID NO: 3286080 - RNA, 12 nt, Variola virus
cuuugacaaaug

SEQ ID NO: 3286081 - RNA, 14 nt, Variola virus
auucuuaucaauaa

SEQ ID NO: 3286082 - RNA, 21 nt, Variola virus
cagauaauaaccuccugaaaa

SEQ ID NO: 3286083 - RNA, 23 nt, Variola virus
uucuuacaguacauaguauugac

SEQ ID NO: 3286084 - RNA, 18 nt, Variola virus
aaucacucaauaucuaga

SEQ ID NO: 3286085 - RNA, 19 nt, Variola virus
agauuucagaaucuagauu

SEQ ID NO: 3286086 - RNA, 16 nt, Variola virus
uguacuuaacaugauu

SEQ ID NO: 3286087 - RNA, 12 nt, Variola virus
aaagcauauucc

SEQ ID NO: 3286088 - RNA, 17 nt, Variola virus
uauauccuuauuaacuu

SEQ ID NO: 3286089 - RNA, 20 nt, Variola virus
uauaaccaccgauaaaucua

SEQ ID NO: 3286090 - RNA, 19 nt, Variola virus
aauacuauuacagaaguuu

SEQ ID NO: 3286091 - RNA, 16 nt, Variola virus
gcuguacuaaauucaa

SEQ ID NO: 3286092 - RNA, 17 nt, Variola virus
gaaagaaaguaugauau

SEQ ID NO: 3286093 - RNA, 17 nt, Variola virus
uucaguuucucaucuuu

SEQ ID NO: 3286094 - RNA, 15 nt, Variola virus
uuauaaucaaagauu

SEQ ID NO: 3286095 - RNA, 19 nt, Variola virus
ucuaauugaccgucucuaa

SEQ ID NO: 3286096 - RNA, 15 nt, Variola virus
uauaauaucuuugaa

SEQ ID NO: 3286097 - RNA, 14 nt, Variola virus
gaaucauacaauga

SEQ ID NO: 3286098 - RNA, 18 nt, Variola virus
guaauuuuuuuuuccaaa

SEQ ID NO: 3286099 - RNA, 18 nt, Variola virus
guagcuaaguauacgauc

SEQ ID NO: 3286100 - RNA, 18 nt, Variola virus
uuuaaguauauacgauaa

SEQ ID NO: 3286101 - RNA, 18 nt, Variola virus
uaaaggaccuaauccauu

SEQ ID NO: 3286102 - RNA, 16 nt, Variola virus
uacguugauuucuagc

SEQ ID NO: 3286103 - RNA, 16 nt, Variola virus
auaacaacucaaacau

SEQ ID NO: 3286104 - RNA, 12 nt, Variola virus
caaaauuacaau

SEQ ID NO: 3286105 - RNA, 15 nt, Variola virus
auggcacgaaauauc

SEQ ID NO: 3286106 - RNA, 16 nt, Variola virus
cauaguaaauucuguu

SEQ ID NO: 3286107 - RNA, 20 nt, Variola virus
uauuaucaaaauuuggaaac

SEQ ID NO: 3286108 - RNA, 21 nt, Variola virus
uugacuacauucaggaaacua

SEQ ID NO: 3286109 - RNA, 14 nt, Variola virus
acuuguauaauaag

SEQ ID NO: 3286110 - RNA, 15 nt, Variola virus
aacuuugauuauccu

SEQ ID NO: 3286111 - RNA, 21 nt, Variola virus
agacaaauggucaaugauaug

SEQ ID NO: 3286112 - RNA, 22 nt, Variola virus
auuuuauaacguuaguuaauaa

SEQ ID NO: 3286113 - RNA, 22 nt, Variola virus
cuaguccaaagacuuacaggaa

SEQ ID NO: 3286114 - RNA, 19 nt, Variola virus
ucguauuggauucugaaau

SEQ ID NO: 3286115 - RNA, 23 nt, Variola virus
gacauucccacaguguugccauu

SEQ ID NO: 3286116 - RNA, 22 nt, Variola virus
aaauguauguguugaacaucag

SEQ ID NO: 3286117 - RNA, 16 nt, Variola virus
aaauuuuuaauccaaa

SEQ ID NO: 3286118 - RNA, 18 nt, Variola virus
auuggaaaucauuaacgg

SEQ ID NO: 3286119 - RNA, 19 nt, Variola virus
gucggcauaggugccacca

SEQ ID NO: 3286120 - RNA, 14 nt, Variola virus
gcuugauauuaaag

SEQ ID NO: 3286121 - RNA, 15 nt, Variola virus
acaaaucuauuugga

SEQ ID NO: 3286122 - RNA, 13 nt, Variola virus
cacagucaucaag

SEQ ID NO: 3286123 - RNA, 13 nt, Variola virus
acugauucagaaa

SEQ ID NO: 3286124 - RNA, 15 nt, Variola virus
aacgaauaaacaauu

SEQ ID NO: 3286125 - RNA, 14 nt, Variola virus
acgacgagaaucuu

SEQ ID NO: 3286126 - RNA, 14 nt, Variola virus
auguauacauuuau

SEQ ID NO: 3286127 - RNA, 13 nt, Variola virus
acaauaaauggau

SEQ ID NO: 3286128 - RNA, 16 nt, Variola virus
aacucuuuaaacgaua

SEQ ID NO: 3286129 - RNA, 17 nt, Variola virus
uaguguuuacauaaaug

SEQ ID NO: 3286130 - RNA, 19 nt, Variola virus
acccaaagagaccaaugaa

SEQ ID NO: 3286131 - RNA, 17 nt, Variola virus
uccaucagaauguuucc

SEQ ID NO: 3286132 - RNA, 21 nt, Variola virus
gcuucaauuacaauagauauc

SEQ ID NO: 3286133 - RNA, 17 nt, Variola virus
uauauccuuuagaguau

SEQ ID NO: 3286134 - RNA, 13 nt, Variola virus
agauauguaugug

SEQ ID NO: 3286135 - RNA, 23 nt, Variola virus
auguaauaauugcucaaauaaua

SEQ ID NO: 3286136 - RNA, 15 nt, Variola virus
cuaaaaaaaauaacu

SEQ ID NO: 3286137 - RNA, 11 nt, Variola virus
ggaauugauuu

SEQ ID NO: 3286138 - RNA, 16 nt, Variola virus
cucagugcaaagauua

SEQ ID NO: 3286139 - RNA, 16 nt, Variola virus
cuuuuguauucauaga

SEQ ID NO: 3286140 - RNA, 14 nt, Variola virus
ucgaauaaugagua

SEQ ID NO: 3286141 - RNA, 20 nt, Variola virus
gacacauucuuuagaacuuc

SEQ ID NO: 3286142 - RNA, 19 nt, Variola virus
cuaauacaucucuggaaau

SEQ ID NO: 3286143 - RNA, 22 nt, Variola virus
gaacacgauuauuauaaaauaa

SEQ ID NO: 3286144 - RNA, 17 nt, Variola virus
cgaugugucuacauaaa

SEQ ID NO: 3286145 - RNA, 12 nt, Variola virus
uagcuaauauua

SEQ ID NO: 3286146 - RNA, 20 nt, Variola virus
ggaaguagaaucauaaagaa

SEQ ID NO: 3286147 - RNA, 17 nt, Variola virus
caaggaacuaaauagau

SEQ ID NO: 3286148 - RNA, 23 nt, Variola virus
uagcauuucuaccaaccaagaau

SEQ ID NO: 3286149 - RNA, 16 nt, Variola virus
cucauuaaacagcauu

SEQ ID NO: 3286150 - RNA, 18 nt, Variola virus
aaaauccaucaaaaaugu

SEQ ID NO: 3286151 - RNA, 16 nt, Variola virus
gaugucuugacuaccu

SEQ ID NO: 3286152 - RNA, 24 nt, Variola virus
aaauccaaauugcgacacuauuca

SEQ ID NO: 3286153 - RNA, 17 nt, Variola virus
ccaaacuguaaauguag

SEQ ID NO: 3286154 - RNA, 15 nt, Variola virus
gaauacauggaagaa

SEQ ID NO: 3286155 - RNA, 14 nt, Variola virus
uugcucguaaaaga

SEQ ID NO: 3286156 - RNA, 21 nt, Variola virus
accauccuuuaaaaaaaauga

SEQ ID NO: 3286157 - RNA, 17 nt, Variola virus
cgaucauauuauuuuua

SEQ ID NO: 3286158 - RNA, 16 nt, Variola virus
auacaaacuguuguua

SEQ ID NO: 3286159 - RNA, 22 nt, Variola virus
agacauuagaccguuuaauaga

SEQ ID NO: 3286160 - RNA, 22 nt, Variola virus
ccaugucugaaacgagacgcua

SEQ ID NO: 3286161 - RNA, 17 nt, Variola virus
uuccacagacucauuau

SEQ ID NO: 3286162 - RNA, 13 nt, Variola virus
auacuauaucuuc

SEQ ID NO: 3286163 - RNA, 21 nt, Variola virus
uagaaacgauaccaucuucug

SEQ ID NO: 3286164 - RNA, 13 nt, Variola virus
uguaauuaaauuu

SEQ ID NO: 3286165 - RNA, 14 nt, Variola virus
aagcguagaaguug

SEQ ID NO: 3286166 - RNA, 19 nt, Variola virus
ugaaccguaauauaucuag

SEQ ID NO: 3286167 - RNA, 11 nt, Variola virus
uuccaaacauu

SEQ ID NO: 3286168 - RNA, 13 nt, Variola virus
uaauaguaggaac

SEQ ID NO: 3286169 - RNA, 21 nt, Variola virus
aucuuuuuguuggaaaaauga

SEQ ID NO: 3286170 - RNA, 12 nt, Variola virus
caaaaauauauu

SEQ ID NO: 3286171 - RNA, 23 nt, Variola virus
uauuaauccuuuuuucuugagau

SEQ ID NO: 3286172 - RNA, 20 nt, Variola virus
aaacuaacauuguuaauuga

SEQ ID NO: 3286173 - RNA, 18 nt, Variola virus
uuacuaacgugauuauua

SEQ ID NO: 3286174 - RNA, 16 nt, Variola virus
gaaaaccgauaacgau

SEQ ID NO: 3286175 - RNA, 17 nt, Variola virus
ucaaucacuacaucuuu

SEQ ID NO: 3286176 - RNA, 21 nt, Variola virus
agacgauccacaaucaaaaaa

SEQ ID NO: 3286177 - RNA, 22 nt, Variola virus
cgggucaaacaauuuuaacaga

SEQ ID NO: 3286178 - RNA, 19 nt, Variola virus
auuuauucaucaucaaaag

SEQ ID NO: 3286179 - RNA, 17 nt, Variola virus
aggauacuuuaugaaug

SEQ ID NO: 3286180 - RNA, 13 nt, Variola virus
ccauauauguuuu

SEQ ID NO: 3286181 - RNA, 16 nt, Variola virus
uauuucuaauaacacu

SEQ ID NO: 3286182 - RNA, 13 nt, Variola virus
uuaccagauaucu

SEQ ID NO: 3286183 - RNA, 23 nt, Variola virus
augucuuaaaguuauuaauuaau

SEQ ID NO: 3286184 - RNA, 20 nt, Variola virus
aacaauaguuauuacuuuuc

SEQ ID NO: 3286185 - RNA, 20 nt, Variola virus
acugaagaacuaaaagugac

SEQ ID NO: 3286186 - RNA, 17 nt, Variola virus
uuaugauagaaauuagc

SEQ ID NO: 3286187 - RNA, 21 nt, Variola virus
gaaauauaugagauguaguua

SEQ ID NO: 3286188 - RNA, 16 nt, Variola virus
uuagucuguacaaaag

SEQ ID NO: 3286189 - RNA, 18 nt, Variola virus
aaucuagaaauuacauaa

SEQ ID NO: 3286190 - RNA, 17 nt, Variola virus
ggaaaguucaaaaaguc

SEQ ID NO: 3286191 - RNA, 17 nt, Variola virus
cagaugcuguaaauuau

SEQ ID NO: 3286192 - RNA, 12 nt, Variola virus
aucaaacaaacu

SEQ ID NO: 3286193 - RNA, 15 nt, Variola virus
cuagucauauguuua

SEQ ID NO: 3286194 - RNA, 15 nt, Variola virus
uuaauuuuuuaaauu

SEQ ID NO: 3286195 - RNA, 17 nt, Variola virus
aauauccauuuuacauu

SEQ ID NO: 3286196 - RNA, 20 nt, Variola virus
uuacaauauauguaaucauu

SEQ ID NO: 3286197 - RNA, 13 nt, Variola virus
ggaguuagaaaac

SEQ ID NO: 3286198 - RNA, 18 nt, Variola virus
guauuaccguuaacuaca

SEQ ID NO: 3286199 - RNA, 13 nt, Variola virus
acaugguuaaagu

SEQ ID NO: 3286200 - RNA, 21 nt, Variola virus
cauaaucaucacugucaucag

SEQ ID NO: 3286201 - RNA, 15 nt, Variola virus
uugacaucuauauau

SEQ ID NO: 3286202 - RNA, 14 nt, Variola virus
gguaaguucauuau

SEQ ID NO: 3286203 - RNA, 15 nt, Variola virus
guuaaugaacaaauc

SEQ ID NO: 3286204 - RNA, 19 nt, Variola virus
cauauaagaaacuauaaag

SEQ ID NO: 3286205 - RNA, 18 nt, Variola virus
agaucuaaggaugaugag

SEQ ID NO: 3286206 - RNA, 16 nt, Variola virus
uuaaaucguuguucua

SEQ ID NO: 3286207 - RNA, 13 nt, Variola virus
uuauaaauagaug

SEQ ID NO: 3286208 - RNA, 18 nt, Variola virus
acaaauggauguuaaugu

SEQ ID NO: 3286209 - RNA, 22 nt, Variola virus
auggauaucuucagggaaaucg

SEQ ID NO: 3286210 - RNA, 22 nt, Variola virus
auauuuggcuaaauuauauaau

SEQ ID NO: 3286211 - RNA, 18 nt, Variola virus
gcuaaaucguauauguua

SEQ ID NO: 3286212 - RNA, 24 nt, Variola virus
accuuuuccuuaucuucauaaaau

SEQ ID NO: 3286213 - RNA, 15 nt, Variola virus
uucccaaauaguuuu

SEQ ID NO: 3286214 - RNA, 15 nt, Variola virus
auauuacaaauacuu

SEQ ID NO: 3286215 - RNA, 18 nt, Variola virus
caucaaccgucacauaau

SEQ ID NO: 3286216 - RNA, 20 nt, Variola virus
cauaguuuguaucaauaaua

SEQ ID NO: 3286217 - RNA, 17 nt, Variola virus
aacauccauuucuagaa

SEQ ID NO: 3286218 - RNA, 17 nt, Variola virus
ucuaaaaacaauacagu

SEQ ID NO: 3286219 - RNA, 12 nt, Variola virus
gacaauaaucuc

SEQ ID NO: 3286220 - RNA, 14 nt, Variola virus
acuugauaaaaaug

SEQ ID NO: 3286221 - RNA, 21 nt, Variola virus
acuuauuaaguucuuuuucca

SEQ ID NO: 3286222 - RNA, 18 nt, Variola virus
auagugaaacaaaauaua

SEQ ID NO: 3286223 - RNA, 19 nt, Variola virus
ugauccaaauucuggaaua

SEQ ID NO: 3286224 - RNA, 19 nt, Variola virus
cuacuacacuucuagauau

SEQ ID NO: 3286225 - RNA, 13 nt, Variola virus
agauauuuauccu

SEQ ID NO: 3286226 - RNA, 19 nt, Variola virus
ccauggacucauaaucucu

SEQ ID NO: 3286227 - RNA, 23 nt, Variola virus
aucaacagaggaacgccauauau

SEQ ID NO: 3286228 - RNA, 17 nt, Variola virus
acauaucuaaaugaaua

SEQ ID NO: 3286229 - RNA, 15 nt, Variola virus
augaucauacauuau

SEQ ID NO: 3286230 - RNA, 22 nt, Variola virus
gauaucaaauggauauugccac

SEQ ID NO: 3286231 - RNA, 17 nt, Variola virus
augcaucgguaaauaua

SEQ ID NO: 3286232 - RNA, 21 nt, Variola virus
accuauaacauuaauaucaaa

SEQ ID NO: 3286233 - RNA, 17 nt, Variola virus
uguauuaguuaaauauu

SEQ ID NO: 3286234 - RNA, 14 nt, Variola virus
uaagaaauacauac

SEQ ID NO: 3286235 - RNA, 18 nt, Variola virus
aauuugaguaagaauaag

SEQ ID NO: 3286236 - RNA, 14 nt, Variola virus
ugauauaauacuua

SEQ ID NO: 3286237 - RNA, 17 nt, Variola virus
uguaugucuuauguaua

SEQ ID NO: 3286238 - RNA, 16 nt, Variola virus
uaagaugcaaacauua

SEQ ID NO: 3286239 - RNA, 15 nt, Variola virus
acucuacuaguucca

SEQ ID NO: 3286240 - RNA, 19 nt, Variola virus
cguucuacauaaaacauca

SEQ ID NO: 3286241 - RNA, 13 nt, Variola virus
uugccguaaaucc

SEQ ID NO: 3286242 - RNA, 23 nt, Variola virus
ucguuccaagucauaucuagaau

SEQ ID NO: 3286243 - RNA, 20 nt, Variola virus
ucuuuguugaacguuucaaa

SEQ ID NO: 3286244 - RNA, 16 nt, Variola virus
auaauauuaucuauau

SEQ ID NO: 3286245 - RNA, 19 nt, Variola virus
ucuauaugugagagaauau

SEQ ID NO: 3286246 - RNA, 19 nt, Variola virus
uauuaugucuagcaaugau

SEQ ID NO: 3286247 - RNA, 18 nt, Variola virus
gguucccaauuccaaaga

SEQ ID NO: 3286248 - RNA, 12 nt, Variola virus
gaauauaaucuu

SEQ ID NO: 3286249 - RNA, 21 nt, Variola virus
gaaguuuuguauuguauauac

SEQ ID NO: 3286250 - RNA, 23 nt, Variola virus
caaauaucuuuaugaauuacuuu

SEQ ID NO: 3286251 - RNA, 12 nt, Variola virus
ccauaauucuca

SEQ ID NO: 3286252 - RNA, 13 nt, Variola virus
aacggcuaucacu

SEQ ID NO: 3286253 - RNA, 15 nt, Variola virus
uuugauuucuuaucu

SEQ ID NO: 3286254 - RNA, 13 nt, Variola virus
cuauguaaaugau

SEQ ID NO: 3286255 - RNA, 13 nt, Variola virus
uuaaaaaaauuaa

SEQ ID NO: 3286256 - RNA, 13 nt, Variola virus
aguuaaaaugaua

SEQ ID NO: 3286257 - RNA, 21 nt, Variola virus
uacucagauucaguuucucau

SEQ ID NO: 3286258 - RNA, 14 nt, Variola virus
ucucuaaguuucuu

SEQ ID NO: 3286259 - RNA, 16 nt, Variola virus
gaauauaucuauaauu

SEQ ID NO: 3286260 - RNA, 22 nt, Variola virus
uaggcuuccaaaaauuuuucau

SEQ ID NO: 3286261 - RNA, 16 nt, Variola virus
auguuuccgagaaaua

SEQ ID NO: 3286262 - RNA, 12 nt, Variola virus
uauuaucaagau

SEQ ID NO: 3286263 - RNA, 19 nt, Variola virus
aaaccaauuaacaagaaua

SEQ ID NO: 3286264 - RNA, 14 nt, Variola virus
aguacagaauuuuc

SEQ ID NO: 3286265 - RNA, 19 nt, Variola virus
acguauacauuuaaugaau

SEQ ID NO: 3286266 - RNA, 20 nt, Variola virus
agaaugcucuuaaauaaugu

SEQ ID NO: 3286267 - RNA, 15 nt, Variola virus
acuccauauauguuu

SEQ ID NO: 3286268 - RNA, 21 nt, Variola virus
uucauuaaaaacaaacuuuuu

SEQ ID NO: 3286269 - RNA, 17 nt, Variola virus
cagagccaucuguaaaa

SEQ ID NO: 3286270 - RNA, 18 nt, Variola virus
aauauaaugauauacaau

SEQ ID NO: 3286271 - RNA, 22 nt, Variola virus
uaacaguaucauuuaaacauuu

SEQ ID NO: 3286272 - RNA, 15 nt, Variola virus
uugaaaacuauuucu

SEQ ID NO: 3286273 - RNA, 16 nt, Variola virus
uucuacuccuuucuua

SEQ ID NO: 3286274 - RNA, 17 nt, Variola virus
auugauuauuucaaaga

SEQ ID NO: 3286275 - RNA, 23 nt, Variola virus
acuagauaaacuaucaguaaguu

SEQ ID NO: 3286276 - RNA, 15 nt, Variola virus
agugaccaacucauc

SEQ ID NO: 3286277 - RNA, 15 nt, Variola virus
uggaagguauuucca

SEQ ID NO: 3286278 - RNA, 21 nt, Variola virus
gucuugauauuguuacagcca

SEQ ID NO: 3286279 - RNA, 13 nt, Variola virus
ucguagauuuuaa

SEQ ID NO: 3286280 - RNA, 14 nt, Variola virus
cuaggucuacagaa

SEQ ID NO: 3286281 - RNA, 17 nt, Variola virus
cuaucgaguuuaucaga

SEQ ID NO: 3286282 - RNA, 22 nt, Variola virus
aaauuaauuuaccaucguguau

SEQ ID NO: 3286283 - RNA, 17 nt, Variola virus
aucaaauagcucaauau

SEQ ID NO: 3286284 - RNA, 17 nt, Variola virus
gaaauuagaaaguaaug

SEQ ID NO: 3286285 - RNA, 23 nt, Variola virus
uaauuacgcucuacaaaauguca

SEQ ID NO: 3286286 - RNA, 21 nt, Variola virus
auaugaaaaacaugucucucu

SEQ ID NO: 3286287 - RNA, 19 nt, Variola virus
aagaauaauccagaaugua

SEQ ID NO: 3286288 - RNA, 23 nt, Variola virus
acauguaucgacgguaaauggaa

SEQ ID NO: 3286289 - RNA, 21 nt, Variola virus
aauauacuuuuaauugaacaa

SEQ ID NO: 3286290 - RNA, 13 nt, Variola virus
aaaucaguaacua

SEQ ID NO: 3286291 - RNA, 12 nt, Variola virus
uugcguauacau

SEQ ID NO: 3286292 - RNA, 17 nt, Variola virus
aucguuucuacaaaauc

SEQ ID NO: 3286293 - RNA, 13 nt, Variola virus
gaacgccauaaua

SEQ ID NO: 3286294 - RNA, 21 nt, Variola virus
uaguauccaguuccuuuucua

SEQ ID NO: 3286295 - RNA, 20 nt, Variola virus
acaacaucuauuccaaauau

SEQ ID NO: 3286296 - RNA, 15 nt, Variola virus
aucuguaaaaguugu

SEQ ID NO: 3286297 - RNA, 14 nt, Variola virus
auacuuuaugaaug

SEQ ID NO: 3286298 - RNA, 15 nt, Variola virus
agauaauauuagaca

SEQ ID NO: 3286299 - RNA, 23 nt, Variola virus
ccaaaaauuuuuaaaguauaucu

SEQ ID NO: 3286300 - RNA, 15 nt, Variola virus
ugauugauucuucca

SEQ ID NO: 3286301 - RNA, 14 nt, Variola virus
aaaaacgaugauau

SEQ ID NO: 3286302 - RNA, 14 nt, Variola virus
acccauuacauaua

SEQ ID NO: 3286303 - RNA, 20 nt, Variola virus
gacuaucaacaauuuuguau

SEQ ID NO: 3286304 - RNA, 22 nt, Variola virus
aacuucuagucuagaaauaaua

SEQ ID NO: 3286305 - RNA, 14 nt, Variola virus
auaauaaaguauau

SEQ ID NO: 3286306 - RNA, 22 nt, Variola virus
augauucuccggccacuauuau

SEQ ID NO: 3286307 - RNA, 14 nt, Variola virus
acagaaaagagaau

SEQ ID NO: 3286308 - RNA, 18 nt, Variola virus
agaaacuaauauaguuaa

SEQ ID NO: 3286309 - RNA, 21 nt, Variola virus
aauucuauccaagauacuuau

SEQ ID NO: 3286310 - RNA, 13 nt, Variola virus
auggaguauauau

SEQ ID NO: 3286311 - RNA, 18 nt, Variola virus
uuaucauuuuuuuauuca

SEQ ID NO: 3286312 - RNA, 18 nt, Variola virus
caagaucgauagacacug

SEQ ID NO: 3286313 - RNA, 22 nt, Variola virus
caacguguuagaucgucuauau

SEQ ID NO: 3286314 - RNA, 20 nt, Variola virus
aucuaucagagaccauguau

SEQ ID NO: 3286315 - RNA, 17 nt, Variola virus
auuauugauauucaugg

SEQ ID NO: 3286316 - RNA, 22 nt, Variola virus
auguugggauuauugcaugaua

SEQ ID NO: 3286317 - RNA, 23 nt, Variola virus
uauacugcauggaaucauagaug

SEQ ID NO: 3286318 - RNA, 13 nt, Variola virus
acaguaguuuaac

SEQ ID NO: 3286319 - RNA, 20 nt, Variola virus
ucaacaaucuaauacaaaau

SEQ ID NO: 3286320 - RNA, 22 nt, Variola virus
gaauacucuacagaguugauug

SEQ ID NO: 3286321 - RNA, 15 nt, Variola virus
uaaaauuacuuaaag

SEQ ID NO: 3286322 - RNA, 23 nt, Variola virus
uuacauacuuuguccguaaaaca

SEQ ID NO: 3286323 - RNA, 22 nt, Variola virus
acaaaagguauuacaagaauau

SEQ ID NO: 3286324 - RNA, 21 nt, Variola virus
ucuuuuauacaagaacaauua

SEQ ID NO: 3286325 - RNA, 17 nt, Variola virus
cauugaugacacuagau

SEQ ID NO: 3286326 - RNA, 22 nt, Variola virus
ucguaauuggaaaauuaguguu

SEQ ID NO: 3286327 - RNA, 20 nt, Variola virus
cauagauauaauuaucacau

SEQ ID NO: 3286328 - RNA, 16 nt, Variola virus
cauuaauuaauacaau

SEQ ID NO: 3286329 - RNA, 16 nt, Variola virus
uuuaucaguauguaua

SEQ ID NO: 3286330 - RNA, 14 nt, Variola virus
caauguuagaguau

SEQ ID NO: 3286331 - RNA, 16 nt, Variola virus
auaugaucaaaaagag

SEQ ID NO: 3286332 - RNA, 22 nt, Variola virus
ggauuauuuuuauuauauucag

SEQ ID NO: 3286333 - RNA, 15 nt, Variola virus
uguugacgacauaua

SEQ ID NO: 3286334 - RNA, 19 nt, Variola virus
uaauaaugauucaacaaug

SEQ ID NO: 3286335 - RNA, 21 nt, Variola virus
ucaauauacuauucuugugau

SEQ ID NO: 3286336 - RNA, 12 nt, Variola virus
agaauuuucuag

SEQ ID NO: 3286337 - RNA, 20 nt, Variola virus
gaaagcuguaaugguuuaua

SEQ ID NO: 3286338 - RNA, 13 nt, Variola virus
auugcugcauaug

SEQ ID NO: 3286339 - RNA, 18 nt, Variola virus
gcuaauuuuuguaaauaa

SEQ ID NO: 3286340 - RNA, 20 nt, Variola virus
auaucauuaggauuuaacuc

SEQ ID NO: 3286341 - RNA, 16 nt, Variola virus
auaucuuugguguaaa

SEQ ID NO: 3286342 - RNA, 16 nt, Variola virus
uguuuaccacaaugua

SEQ ID NO: 3286343 - RNA, 20 nt, Variola virus
agaugccaagauaucuauau

SEQ ID NO: 3286344 - RNA, 15 nt, Variola virus
auuagcauccuuaua

SEQ ID NO: 3286345 - RNA, 23 nt, Variola virus
uauaauuaucacauauuaaaauu

SEQ ID NO: 3286346 - RNA, 20 nt, Variola virus
agaauuuauauaaauuauuc

SEQ ID NO: 3286347 - RNA, 15 nt, Variola virus
uauacaauuaaugau

SEQ ID NO: 3286348 - RNA, 13 nt, Variola virus
ucuaucaauaacu

SEQ ID NO: 3286349 - RNA, 18 nt, Variola virus
auuucucucauaaauaca

SEQ ID NO: 3286350 - RNA, 15 nt, Variola virus
auuccaacaaacgaa

SEQ ID NO: 3286351 - RNA, 23 nt, Variola virus
gauuuuuuuaaaaaauagaaaaa

SEQ ID NO: 3286352 - RNA, 14 nt, Variola virus
aucauaaagaacag

SEQ ID NO: 3286353 - RNA, 22 nt, Variola virus
cuuauuaguaacugacuuaaua

SEQ ID NO: 3286354 - RNA, 13 nt, Variola virus
augagauguuauu

SEQ ID NO: 3286355 - RNA, 16 nt, Variola virus
auucuagauacaagau

SEQ ID NO: 3286356 - RNA, 20 nt, Variola virus
acucucuaucucuuaaugag

SEQ ID NO: 3286357 - RNA, 17 nt, Variola virus
uacuggagccauugucu

SEQ ID NO: 3286358 - RNA, 15 nt, Variola virus
ucugcuuucuuuuaa

SEQ ID NO: 3286359 - RNA, 16 nt, Variola virus
cguuaauaacaaaaau

SEQ ID NO: 3286360 - RNA, 23 nt, Variola virus
uuugauauaucaguuaaugcauc

SEQ ID NO: 3286361 - RNA, 13 nt, Variola virus
auaacaaagaaag

SEQ ID NO: 3286362 - RNA, 14 nt, Variola virus
cauuaaauguauuu

SEQ ID NO: 3286363 - RNA, 14 nt, Variola virus
guauacucuauucg

SEQ ID NO: 3286364 - RNA, 16 nt, Variola virus
cauauacguauccaug

SEQ ID NO: 3286365 - RNA, 21 nt, Variola virus
agcauauuccuaaauacaucu

SEQ ID NO: 3286366 - RNA, 21 nt, Variola virus
uggacaacggugagaaugacg

SEQ ID NO: 3286367 - RNA, 18 nt, Variola virus
uucuauaaagucugucaa

SEQ ID NO: 3286368 - RNA, 15 nt, Variola virus
cuaauacuaaauaca

SEQ ID NO: 3286369 - RNA, 15 nt, Variola virus
ugaagaaaguaauua

SEQ ID NO: 3286370 - RNA, 16 nt, Variola virus
ucacaaucacugugag

SEQ ID NO: 3286371 - RNA, 19 nt, Variola virus
aguauaugggcgauauucu

SEQ ID NO: 3286372 - RNA, 16 nt, Variola virus
gcucaaacaaaaugug

SEQ ID NO: 3286373 - RNA, 13 nt, Variola virus
augaauugauucu

SEQ ID NO: 3286374 - RNA, 13 nt, Variola virus
ucaacacuuauau

SEQ ID NO: 3286375 - RNA, 14 nt, Variola virus
auaguuuuggauca

SEQ ID NO: 3286376 - RNA, 19 nt, Variola virus
uacgcauucacucauacau

SEQ ID NO: 3286377 - RNA, 17 nt, Variola virus
agcauuauucuugaauu

SEQ ID NO: 3286378 - RNA, 19 nt, Variola virus
uuccauuguacaaacgaag

SEQ ID NO: 3286379 - RNA, 22 nt, Variola virus
cuugaggagaucuaaacgaucu

SEQ ID NO: 3286380 - RNA, 11 nt, Variola virus
aaacuuuaucu

SEQ ID NO: 3286381 - RNA, 12 nt, Variola virus
uacuaagaaagu

SEQ ID NO: 3286382 - RNA, 15 nt, Variola virus
aucauacaaugaauu

SEQ ID NO: 3286383 - RNA, 12 nt, Variola virus
uuuauucucaaa

SEQ ID NO: 3286384 - RNA, 15 nt, Variola virus
uagaugagaacagaa

SEQ ID NO: 3286385 - RNA, 17 nt, Variola virus
caauuaguuuauuggua

SEQ ID NO: 3286386 - RNA, 18 nt, Variola virus
uaucucagugcaaagauu

SEQ ID NO: 3286387 - RNA, 17 nt, Variola virus
gaaccagauaguuuaua

SEQ ID NO: 3286388 - RNA, 13 nt, Variola virus
aaaauauuuuacu

SEQ ID NO: 3286389 - RNA, 19 nt, Variola virus
uauuucauugacggaugau

SEQ ID NO: 3286390 - RNA, 22 nt, Variola virus
augcuaguuaauaguaaaugaa

SEQ ID NO: 3286391 - RNA, 20 nt, Variola virus
auuucaucuccguaaauaua

SEQ ID NO: 3286392 - RNA, 17 nt, Variola virus
cauuucucaaaugaaua

SEQ ID NO: 3286393 - RNA, 14 nt, Variola virus
uaucaucuauauga

SEQ ID NO: 3286394 - RNA, 18 nt, Variola virus
gucaaugauaugauuuuu

SEQ ID NO: 3286395 - RNA, 23 nt, Variola virus
cuuuuagagguucccaauuccaa

SEQ ID NO: 3286396 - RNA, 12 nt, Variola virus
uauauuuugcau

SEQ ID NO: 3286397 - RNA, 18 nt, Variola virus
cuagacuugauuauucua

SEQ ID NO: 3286398 - RNA, 16 nt, Variola virus
ucgcuaaaaucuucau

SEQ ID NO: 3286399 - RNA, 14 nt, Variola virus
caauuacugucucc

SEQ ID NO: 3286400 - RNA, 11 nt, Variola virus
aauuuagaaaa

SEQ ID NO: 3286401 - RNA, 15 nt, Variola virus
uccaauaaauuauuu

SEQ ID NO: 3286402 - RNA, 19 nt, Variola virus
aaugaugcgcacaaugaua

SEQ ID NO: 3286403 - RNA, 21 nt, Variola virus
cuauaaaauuguauauucaga

SEQ ID NO: 3286404 - RNA, 21 nt, Variola virus
agcauacgccaaauaucucaa

SEQ ID NO: 3286405 - RNA, 19 nt, Variola virus
caauaugccacaccaucuu

SEQ ID NO: 3286406 - RNA, 17 nt, Variola virus
uuaauaaauaucauuaa

SEQ ID NO: 3286407 - RNA, 23 nt, Variola virus
aaacacguuuauuuuauauguca

SEQ ID NO: 3286408 - RNA, 20 nt, Variola virus
cgaaagauuuuauuucacau

SEQ ID NO: 3286409 - RNA, 19 nt, Variola virus
cuuaacaauuccacaaauu

SEQ ID NO: 3286410 - RNA, 18 nt, Variola virus
uguaagacuugugggaaa

SEQ ID NO: 3286411 - RNA, 16 nt, Variola virus
uaacaguauuauuaau

SEQ ID NO: 3286412 - RNA, 21 nt, Variola virus
uaguuagcgucaacuuucaua

SEQ ID NO: 3286413 - RNA, 23 nt, Variola virus
augaaucacguguuuaacaaugg

SEQ ID NO: 3286414 - RNA, 22 nt, Variola virus
gauuaaggacuuuuauauccca

SEQ ID NO: 3286415 - RNA, 19 nt, Variola virus
uauuaugaugauuaugaua

SEQ ID NO: 3286416 - RNA, 13 nt, Variola virus
agaaauuaauaaa

SEQ ID NO: 3286417 - RNA, 19 nt, Variola virus
uagagaaucgcuagaugcu

SEQ ID NO: 3286418 - RNA, 12 nt, Variola virus
cuaaacuagugg

SEQ ID NO: 3286419 - RNA, 13 nt, Variola virus
ugauaauuuccag

SEQ ID NO: 3286420 - RNA, 13 nt, Variola virus
cguaccagcauuu

SEQ ID NO: 3286421 - RNA, 12 nt, Variola virus
uaugaauuuaua

SEQ ID NO: 3286422 - RNA, 18 nt, Variola virus
cugcgaacuuuaaacaga

SEQ ID NO: 3286423 - RNA, 13 nt, Variola virus
aacaguuacuauu

SEQ ID NO: 3286424 - RNA, 16 nt, Variola virus
auaaagaguccuauau

SEQ ID NO: 3286425 - RNA, 12 nt, Variola virus
ugaaaauuauuu

SEQ ID NO: 3286426 - RNA, 23 nt, Variola virus
auauuacgaauuacauuucuugu

SEQ ID NO: 3286427 - RNA, 16 nt, Variola virus
aaacacagauagugaa

SEQ ID NO: 3286428 - RNA, 22 nt, Variola virus
ugaacacuuuauacuucuccaa

SEQ ID NO: 3286429 - RNA, 18 nt, Variola virus
uguacccuguuuaacaug

SEQ ID NO: 3286430 - RNA, 19 nt, Variola virus
auagaagguuuauauaaca

SEQ ID NO: 3286431 - RNA, 19 nt, Variola virus
aucauauguagugguguaa

SEQ ID NO: 3286432 - RNA, 16 nt, Variola virus
uggauuaaacauacua

SEQ ID NO: 3286433 - RNA, 18 nt, Variola virus
ucaaaaucuuaauaucuu

SEQ ID NO: 3286434 - RNA, 11 nt, Variola virus
uccauuucuag

SEQ ID NO: 3286435 - RNA, 22 nt, Variola virus
guguucauccaaggaucuucua

SEQ ID NO: 3286436 - RNA, 20 nt, Variola virus
caagguaaccucuuaggaag

SEQ ID NO: 3286437 - RNA, 17 nt, Variola virus
uuauuagagauuucagc

SEQ ID NO: 3286438 - RNA, 19 nt, Variola virus
augagauguuaaaugaauu

SEQ ID NO: 3286439 - RNA, 13 nt, Variola virus
guauaaucuuuaa

SEQ ID NO: 3286440 - RNA, 15 nt, Variola virus
augucauauacucaa

SEQ ID NO: 3286441 - RNA, 17 nt, Variola virus
uauuauccguauuucca

SEQ ID NO: 3286442 - RNA, 17 nt, Variola virus
uauagcuaaaaauguca

SEQ ID NO: 3286443 - RNA, 14 nt, Variola virus
aucaucaaauggau

SEQ ID NO: 3286444 - RNA, 17 nt, Variola virus
cauaguccucguguggu

SEQ ID NO: 3286445 - RNA, 14 nt, Variola virus
caaaaugugauauu

SEQ ID NO: 3286446 - RNA, 14 nt, Variola virus
augacauuguaaaa

SEQ ID NO: 3286447 - RNA, 14 nt, Variola virus
uauaaucaaagauu

SEQ ID NO: 3286448 - RNA, 16 nt, Variola virus
aucaauaacuggcaca

SEQ ID NO: 3286449 - RNA, 16 nt, Variola virus
cgaugaugcugcuaua

SEQ ID NO: 3286450 - RNA, 23 nt, Variola virus
auccaauuguuugauauauaauu

SEQ ID NO: 3286451 - RNA, 23 nt, Variola virus
aauaacuucgugaauaauguuuc

SEQ ID NO: 3286452 - RNA, 11 nt, Variola virus
aaguaaauacu

SEQ ID NO: 3286453 - RNA, 16 nt, Variola virus
acucuacguaucucgu

SEQ ID NO: 3286454 - RNA, 15 nt, Variola virus
gucugucucagaauc

SEQ ID NO: 3286455 - RNA, 15 nt, Variola virus
uauuacgguaucaaa

SEQ ID NO: 3286456 - RNA, 12 nt, Variola virus
cgcuauacagua

SEQ ID NO: 3286457 - RNA, 14 nt, Variola virus
uacuauuaaucagu

SEQ ID NO: 3286458 - RNA, 20 nt, Variola virus
uucaauuucccguuuguauu

SEQ ID NO: 3286459 - RNA, 18 nt, Variola virus
gaaagauaccgaucacgu

SEQ ID NO: 3286460 - RNA, 21 nt, Variola virus
caauuuuucagauuuuugaau

SEQ ID NO: 3286461 - RNA, 15 nt, Variola virus
accuaugauaaagga

SEQ ID NO: 3286462 - RNA, 17 nt, Variola virus
uuuugccaacacagagg

SEQ ID NO: 3286463 - RNA, 21 nt, Variola virus
uguucauaauugcuuuucuaa

SEQ ID NO: 3286464 - RNA, 16 nt, Variola virus
aacguuacucaaacac

SEQ ID NO: 3286465 - RNA, 19 nt, Variola virus
cuauugcuuccaugcuacc

SEQ ID NO: 3286466 - RNA, 18 nt, Variola virus
uaaaaaauauauuguucu

SEQ ID NO: 3286467 - RNA, 15 nt, Variola virus
uuuuccaaaguuuua

SEQ ID NO: 3286468 - RNA, 23 nt, Variola virus
gaagaauggaaaccuuuaaucua

SEQ ID NO: 3286469 - RNA, 19 nt, Variola virus
gucacugaguuuacagaua

SEQ ID NO: 3286470 - RNA, 22 nt, Variola virus
agauacguauuagauaaaugga

SEQ ID NO: 3286471 - RNA, 18 nt, Variola virus
cuucaggagauccugcau

SEQ ID NO: 3286472 - RNA, 14 nt, Variola virus
aaaagauuauacaa

SEQ ID NO: 3286473 - RNA, 22 nt, Variola virus
augccacgaauaaaaaauacuu

SEQ ID NO: 3286474 - RNA, 15 nt, Variola virus
gacaaugaauugcau

SEQ ID NO: 3286475 - RNA, 13 nt, Variola virus
auauuaaaaaaug

SEQ ID NO: 3286476 - RNA, 15 nt, Variola virus
agacguggagaucua

SEQ ID NO: 3286477 - RNA, 19 nt, Variola virus
ugauaacucguuuuucuua

SEQ ID NO: 3286478 - RNA, 12 nt, Variola virus
uauuuuacacau

SEQ ID NO: 3286479 - RNA, 12 nt, Variola virus
auggaaauacuu

SEQ ID NO: 3286480 - RNA, 12 nt, Variola virus
ugaagaacacau

SEQ ID NO: 3286481 - RNA, 22 nt, Variola virus
gaaugcggugccauucaugaaa

SEQ ID NO: 3286482 - RNA, 18 nt, Variola virus
acugauaauguagaaaau

SEQ ID NO: 3286483 - RNA, 21 nt, Variola virus
uaacaagaaaauuagaaggau

SEQ ID NO: 3286484 - RNA, 20 nt, Variola virus
acaaaacagaaauaugugaa

SEQ ID NO: 3286485 - RNA, 14 nt, Variola virus
agcuaugaacuugu

SEQ ID NO: 3286486 - RNA, 14 nt, Variola virus
acauauuaaugcag

SEQ ID NO: 3286487 - RNA, 18 nt, Variola virus
aucaauuaaauaauuaau

SEQ ID NO: 3286488 - RNA, 15 nt, Variola virus
agaauggaugauauu

SEQ ID NO: 3286489 - RNA, 14 nt, Variola virus
auuagguacagaaa

SEQ ID NO: 3286490 - RNA, 12 nt, Variola virus
cuguuccaucaa

SEQ ID NO: 3286491 - RNA, 15 nt, Variola virus
aaucugauaaauaua

SEQ ID NO: 3286492 - RNA, 23 nt, Variola virus
uuaaaugaguguccauauuuugc

SEQ ID NO: 3286493 - RNA, 23 nt, Variola virus
gaagagcuguacaauaguuuuua

SEQ ID NO: 3286494 - RNA, 21 nt, Variola virus
gugauagauaugauaaacaaa

SEQ ID NO: 3286495 - RNA, 21 nt, Variola virus
uaaagguauaaaauacuuauu

SEQ ID NO: 3286496 - RNA, 19 nt, Variola virus
ucgcauuaauacuguuuuc

SEQ ID NO: 3286497 - RNA, 18 nt, Variola virus
uuccaaauauauuacuag

SEQ ID NO: 3286498 - RNA, 16 nt, Variola virus
aauauaaugaaagaua

SEQ ID NO: 3286499 - RNA, 18 nt, Variola virus
caaucaaaccuauaacau

SEQ ID NO: 3286500 - RNA, 17 nt, Variola virus
cuuuucuaguucugaac

SEQ ID NO: 3286501 - RNA, 15 nt, Variola virus
gaauccuauacucug

SEQ ID NO: 3286502 - RNA, 18 nt, Variola virus
aucaacagaaguuaauaa

SEQ ID NO: 3286503 - RNA, 17 nt, Variola virus
cgacaaaaagauauaaa

SEQ ID NO: 3286504 - RNA, 18 nt, Variola virus
aggaauucuuuuaugaau

SEQ ID NO: 3286505 - RNA, 16 nt, Variola virus
cuuugauuucuuaucu

SEQ ID NO: 3286506 - RNA, 16 nt, Variola virus
gcaucucuuaauccaa

SEQ ID NO: 3286507 - RNA, 16 nt, Variola virus
aagauucuacaaguaa

SEQ ID NO: 3286508 - RNA, 19 nt, Variola virus
uucuacgauuuuauuucuu

SEQ ID NO: 3286509 - RNA, 14 nt, Variola virus
gauaaaaaauuaua

SEQ ID NO: 3286510 - RNA, 19 nt, Variola virus
aucaaagucacaaagcaag

SEQ ID NO: 3286511 - RNA, 13 nt, Variola virus
gacauuuucuagu

SEQ ID NO: 3286512 - RNA, 19 nt, Variola virus
uaauauuaaagauaaagcg

SEQ ID NO: 3286513 - RNA, 20 nt, Variola virus
uuaucuucauaaaauacuaa

SEQ ID NO: 3286514 - RNA, 22 nt, Variola virus
uuccuguuccguuaacaucucu

SEQ ID NO: 3286515 - RNA, 18 nt, Variola virus
ucauccguggauauuuga

SEQ ID NO: 3286516 - RNA, 13 nt, Variola virus
aguauuugucaaa

SEQ ID NO: 3286517 - RNA, 20 nt, Variola virus
guuuuaccuauuuuaucauc

SEQ ID NO: 3286518 - RNA, 17 nt, Variola virus
uaguauuccaauaucug

SEQ ID NO: 3286519 - RNA, 19 nt, Variola virus
uauuggauauggauuucca

SEQ ID NO: 3286520 - RNA, 19 nt, Variola virus
acuccugguaauacugaug

SEQ ID NO: 3286521 - RNA, 20 nt, Variola virus
ucaauggaccccaacaucuu

SEQ ID NO: 3286522 - RNA, 23 nt, Variola virus
augauuuucugggacuauuggaa

SEQ ID NO: 3286523 - RNA, 14 nt, Variola virus
ccguagaaauacua

SEQ ID NO: 3286524 - RNA, 16 nt, Variola virus
aacacuggcuagaaaa

SEQ ID NO: 3286525 - RNA, 22 nt, Variola virus
agguguuauuuuguuuuauuca

SEQ ID NO: 3286526 - RNA, 21 nt, Variola virus
agaacuguuuuagaagucaag

SEQ ID NO: 3286527 - RNA, 18 nt, Variola virus
auuaaaugaugaaacuaa

SEQ ID NO: 3286528 - RNA, 16 nt, Variola virus
uuacucaaaauacuau

SEQ ID NO: 3286529 - RNA, 15 nt, Variola virus
uaguuuuauauacau

SEQ ID NO: 3286530 - RNA, 14 nt, Variola virus
aucagauaacaugu

SEQ ID NO: 3286531 - RNA, 23 nt, Variola virus
uauccauuauuugccuguuaauc

SEQ ID NO: 3286532 - RNA, 15 nt, Variola virus
uaacaacuuccguaa

SEQ ID NO: 3286533 - RNA, 15 nt, Variola virus
aauguaaagucuaua

SEQ ID NO: 3286534 - RNA, 17 nt, Variola virus
ugacuccuauauuuccc

SEQ ID NO: 3286535 - RNA, 16 nt, Variola virus
ucugacauaagaacag

SEQ ID NO: 3286536 - RNA, 15 nt, Variola virus
cugaaaaagauauca

SEQ ID NO: 3286537 - RNA, 16 nt, Variola virus
aucuaacauaguuuua

SEQ ID NO: 3286538 - RNA, 17 nt, Variola virus
augaggcguuuaucaua

SEQ ID NO: 3286539 - RNA, 14 nt, Variola virus
aauaacuagaucau

SEQ ID NO: 3286540 - RNA, 14 nt, Variola virus
uuaaaaaguuaucu

SEQ ID NO: 3286541 - RNA, 17 nt, Variola virus
ucuauaaauaaaagaca

SEQ ID NO: 3286542 - RNA, 15 nt, Variola virus
uuguauagaaauuuu

SEQ ID NO: 3286543 - RNA, 12 nt, Variola virus
uaauccaaauau

SEQ ID NO: 3286544 - RNA, 20 nt, Variola virus
caaaaaauaaaagaugauuu

SEQ ID NO: 3286545 - RNA, 17 nt, Variola virus
uuuggaaacuucaaaaa

SEQ ID NO: 3286546 - RNA, 15 nt, Variola virus
uuacagccaagaaac

SEQ ID NO: 3286547 - RNA, 14 nt, Variola virus
ucuauaaauguaga

SEQ ID NO: 3286548 - RNA, 15 nt, Variola virus
ugagguuuuuggaga

SEQ ID NO: 3286549 - RNA, 14 nt, Variola virus
cuauagauuuugaa

SEQ ID NO: 3286550 - RNA, 20 nt, Variola virus
aaguauagcuaaugaugcag

SEQ ID NO: 3286551 - RNA, 22 nt, Variola virus
uauauuacgguaucuacuagau

SEQ ID NO: 3286552 - RNA, 22 nt, Variola virus
gaaucuucauuaucugauauau

SEQ ID NO: 3286553 - RNA, 18 nt, Variola virus
acgacucuugagacuuua

SEQ ID NO: 3286554 - RNA, 13 nt, Variola virus
ucuuaaaaugguu

SEQ ID NO: 3286555 - RNA, 14 nt, Variola virus
cuugaagaugauuu

SEQ ID NO: 3286556 - RNA, 12 nt, Variola virus
uaacaucauuau

SEQ ID NO: 3286557 - RNA, 20 nt, Variola virus
cuggaacauuaaauguauuu

SEQ ID NO: 3286558 - RNA, 16 nt, Variola virus
acauauaauaaugaau

SEQ ID NO: 3286559 - RNA, 19 nt, Variola virus
aguaauuauaagaaauaua

SEQ ID NO: 3286560 - RNA, 22 nt, Variola virus
agacgaggagauuuagaaaugu

SEQ ID NO: 3286561 - RNA, 12 nt, Variola virus
uaacaaacaucu

SEQ ID NO: 3286562 - RNA, 19 nt, Variola virus
ugaauacaacuaaggagaa

SEQ ID NO: 3286563 - RNA, 18 nt, Variola virus
uaccauggaaaaauauua

SEQ ID NO: 3286564 - RNA, 17 nt, Variola virus
auacccuccuguauaug

SEQ ID NO: 3286565 - RNA, 17 nt, Variola virus
uaucaaacaauccaaaa

SEQ ID NO: 3286566 - RNA, 17 nt, Variola virus
aaacagucuuuaaguuc

SEQ ID NO: 3286567 - RNA, 12 nt, Variola virus
aauauacucuau

SEQ ID NO: 3286568 - RNA, 17 nt, Variola virus
augaacgagaugcagaa

SEQ ID NO: 3286569 - RNA, 18 nt, Variola virus
uggaauagcgaauguaug

SEQ ID NO: 3286570 - RNA, 21 nt, Variola virus
ugauuuuaacgacgacauauu

SEQ ID NO: 3286571 - RNA, 14 nt, Variola virus
auaccaaucauuua

SEQ ID NO: 3286572 - RNA, 16 nt, Variola virus
accauagaagauguua

SEQ ID NO: 3286573 - RNA, 14 nt, Variola virus
auaaucauucuuaa

SEQ ID NO: 3286574 - RNA, 15 nt, Variola virus
ucugaguauaguguu

SEQ ID NO: 3286575 - RNA, 23 nt, Variola virus
ggaaagcuagacuugauuauucu

SEQ ID NO: 3286576 - RNA, 22 nt, Variola virus
cauaccgucccaaaacauggau

SEQ ID NO: 3286577 - RNA, 17 nt, Variola virus
auaaacauuguuuguau

SEQ ID NO: 3286578 - RNA, 22 nt, Variola virus
auaccacuuaaugacaaaauca

SEQ ID NO: 3286579 - RNA, 18 nt, Variola virus
uuaauaaauaucauuaac

SEQ ID NO: 3286580 - RNA, 17 nt, Variola virus
uuuagcguggcuagaau

SEQ ID NO: 3286581 - RNA, 13 nt, Variola virus
ucauguaaauguu

SEQ ID NO: 3286582 - RNA, 15 nt, Variola virus
aagacuaugcaaaga

SEQ ID NO: 3286583 - RNA, 16 nt, Variola virus
auuguagauaaugaaa

SEQ ID NO: 3286584 - RNA, 15 nt, Variola virus
uaaaaugguaaacuu

SEQ ID NO: 3286585 - RNA, 13 nt, Variola virus
auauaguuauaga

SEQ ID NO: 3286586 - RNA, 15 nt, Variola virus
uagauuuauuugaua

SEQ ID NO: 3286587 - RNA, 15 nt, Variola virus
cagucggucaacuua

SEQ ID NO: 3286588 - RNA, 16 nt, Variola virus
uuaugaauugauucuu

SEQ ID NO: 3286589 - RNA, 19 nt, Variola virus
gagagucaauaucauuaau

SEQ ID NO: 3286590 - RNA, 13 nt, Variola virus
auuacugcauauu

SEQ ID NO: 3286591 - RNA, 18 nt, Variola virus
acaaaaguuaauaaucuc

SEQ ID NO: 3286592 - RNA, 20 nt, Variola virus
guaaaaaaaccuauaaugau

SEQ ID NO: 3286593 - RNA, 21 nt, Variola virus
guauauacuauuauagaucaa

SEQ ID NO: 3286594 - RNA, 23 nt, Variola virus
gcucuacaugcgguaaagauauu

SEQ ID NO: 3286595 - RNA, 20 nt, Variola virus
cuaauuccgcauuaaaugau

SEQ ID NO: 3286596 - RNA, 19 nt, Variola virus
auauccuccuuuaaaauua

SEQ ID NO: 3286597 - RNA, 15 nt, Variola virus
ugaauauauaugaca

SEQ ID NO: 3286598 - RNA, 12 nt, Variola virus
uaaguguuuaua

SEQ ID NO: 3286599 - RNA, 18 nt, Variola virus
caaaaucguuaagaaguu

SEQ ID NO: 3286600 - RNA, 13 nt, Variola virus
uaccaauaugucu

SEQ ID NO: 3286601 - RNA, 20 nt, Variola virus
acauuaguagggauagaaug

SEQ ID NO: 3286602 - RNA, 13 nt, Variola virus
uauaucaauauca

SEQ ID NO: 3286603 - RNA, 16 nt, Variola virus
uguucuauaaacugaa

SEQ ID NO: 3286604 - RNA, 20 nt, Variola virus
aauaaaguuaaacaacuauu

SEQ ID NO: 3286605 - RNA, 22 nt, Variola virus
uaaucaaauuugguguuguuaa

SEQ ID NO: 3286606 - RNA, 18 nt, Variola virus
ugucaucaguuauguacg

SEQ ID NO: 3286607 - RNA, 13 nt, Variola virus
auucuaaaugaug

SEQ ID NO: 3286608 - RNA, 16 nt, Variola virus
agucaaauauauuaaa

SEQ ID NO: 3286609 - RNA, 15 nt, Variola virus
aaauuaucaaauguu

SEQ ID NO: 3286610 - RNA, 15 nt, Variola virus
auucacaaauaugac

SEQ ID NO: 3286611 - RNA, 21 nt, Variola virus
uuuccggagauagauuuccaa

SEQ ID NO: 3286612 - RNA, 15 nt, Variola virus
ucucugguuugcuac

SEQ ID NO: 3286613 - RNA, 16 nt, Variola virus
uaaaauuuauaacauu

SEQ ID NO: 3286614 - RNA, 12 nt, Variola virus
ugugauggauuu

SEQ ID NO: 3286615 - RNA, 19 nt, Variola virus
gauuccauggaagaacuac

SEQ ID NO: 3286616 - RNA, 16 nt, Variola virus
gaaugagauacuaaca

SEQ ID NO: 3286617 - RNA, 16 nt, Variola virus
auuaacguuccuaauu

SEQ ID NO: 3286618 - RNA, 23 nt, Variola virus
agauaucucuggauauaucacaa

SEQ ID NO: 3286619 - RNA, 15 nt, Variola virus
uaaagacuaugucaa

SEQ ID NO: 3286620 - RNA, 19 nt, Variola virus
ggacaaccuuaauugguug

SEQ ID NO: 3286621 - RNA, 17 nt, Variola virus
aguaaaugaaaaaaaac

SEQ ID NO: 3286622 - RNA, 20 nt, Variola virus
cauuagcgcauguacauauu

SEQ ID NO: 3286623 - RNA, 21 nt, Variola virus
uggucuagauguaaaaaaugu

SEQ ID NO: 3286624 - RNA, 17 nt, Variola virus
caaugcucaguaaaugu

SEQ ID NO: 3286625 - RNA, 12 nt, Variola virus
cauguucauagg

SEQ ID NO: 3286626 - RNA, 22 nt, Variola virus
gacuaauaaauuaaauauuaau

SEQ ID NO: 3286627 - RNA, 22 nt, Variola virus
caaaugauaaucaaacacaucu

SEQ ID NO: 3286628 - RNA, 18 nt, Variola virus
uuuuagauguaguaucua

SEQ ID NO: 3286629 - RNA, 17 nt, Variola virus
cauauacuauuacuuau

SEQ ID NO: 3286630 - RNA, 13 nt, Variola virus
cggauacgacauc

SEQ ID NO: 3286631 - RNA, 16 nt, Variola virus
aacucucaaaaugcug

SEQ ID NO: 3286632 - RNA, 18 nt, Variola virus
aacucacauuucaaauau

SEQ ID NO: 3286633 - RNA, 15 nt, Variola virus
uccagauuucauaau

SEQ ID NO: 3286634 - RNA, 19 nt, Variola virus
gcuauugaaacugacggau

SEQ ID NO: 3286635 - RNA, 21 nt, Variola virus
aagauacucuaccagcuaaag

SEQ ID NO: 3286636 - RNA, 16 nt, Variola virus
auuuuuguccauuacu

SEQ ID NO: 3286637 - RNA, 24 nt, Variola virus
ucucauaauguaaagauauucuaa

SEQ ID NO: 3286638 - RNA, 19 nt, Variola virus
uuauaaaaaauuuuauuca

SEQ ID NO: 3286639 - RNA, 19 nt, Variola virus
uuaauaaaaauaauauuca

SEQ ID NO: 3286640 - RNA, 15 nt, Variola virus
ucuagauagaaguau

SEQ ID NO: 3286641 - RNA, 20 nt, Variola virus
ucuauuagaguauugcauuu

SEQ ID NO: 3286642 - RNA, 12 nt, Variola virus
caucaaauggau

SEQ ID NO: 3286643 - RNA, 11 nt, Variola virus
gaguauuucuc

SEQ ID NO: 3286644 - RNA, 15 nt, Variola virus
auaguaaaaaauaua

SEQ ID NO: 3286645 - RNA, 18 nt, Variola virus
ccaaaauacaaaauguua

SEQ ID NO: 3286646 - RNA, 17 nt, Variola virus
gacuauaaaauauucua

SEQ ID NO: 3286647 - RNA, 14 nt, Variola virus
uuuguaauugacau

SEQ ID NO: 3286648 - RNA, 15 nt, Variola virus
uaauaaucucaucau

SEQ ID NO: 3286649 - RNA, 21 nt, Variola virus
uuuaccaugugaugcuaauau

SEQ ID NO: 3286650 - RNA, 20 nt, Variola virus
cuauaaaaagauuauacaaa

SEQ ID NO: 3286651 - RNA, 15 nt, Variola virus
gauucaacauuuaua

SEQ ID NO: 3286652 - RNA, 17 nt, Variola virus
uuaguuuauuacuauua

SEQ ID NO: 3286653 - RNA, 13 nt, Variola virus
aacuuaucaaaga

SEQ ID NO: 3286654 - RNA, 15 nt, Variola virus
cucuggagaaaagau

SEQ ID NO: 3286655 - RNA, 20 nt, Variola virus
acucauguagcauagguaau

SEQ ID NO: 3286656 - RNA, 14 nt, Variola virus
aauuggacaaguau

SEQ ID NO: 3286657 - RNA, 21 nt, Variola virus
auaaacucacauuucaaauau

SEQ ID NO: 3286658 - RNA, 19 nt, Variola virus
ugacgucguucuacauaaa

SEQ ID NO: 3286659 - RNA, 14 nt, Variola virus
auaaacucagauaa

SEQ ID NO: 3286660 - RNA, 18 nt, Variola virus
uuaucaucccauuguaaa

SEQ ID NO: 3286661 - RNA, 22 nt, Variola virus
aauaguauacgcagaaaagaua

SEQ ID NO: 3286662 - RNA, 16 nt, Variola virus
aauucaucucuagaua

SEQ ID NO: 3286663 - RNA, 17 nt, Variola virus
auaggagcuagaagaac

SEQ ID NO: 3286664 - RNA, 23 nt, Variola virus
aauuuuuugguagguuuuagaga

SEQ ID NO: 3286665 - RNA, 13 nt, Variola virus
uagauuuacuaau

SEQ ID NO: 3286666 - RNA, 14 nt, Variola virus
cuaucauaaguuua

SEQ ID NO: 3286667 - RNA, 21 nt, Variola virus
agaugccaagauaucuauaua

SEQ ID NO: 3286668 - RNA, 21 nt, Variola virus
uuacuuugacaaauguaguaa

SEQ ID NO: 3286669 - RNA, 12 nt, Variola virus
aaaguuaaaagu

SEQ ID NO: 3286670 - RNA, 21 nt, Variola virus
guucuauaagauguuagaauu

SEQ ID NO: 3286671 - RNA, 18 nt, Variola virus
auauuuauaaaaaugcua

SEQ ID NO: 3286672 - RNA, 23 nt, Variola virus
guuaauauagacaauucuuuugu

SEQ ID NO: 3286673 - RNA, 19 nt, Variola virus
uacacaugguguuacaaaa

SEQ ID NO: 3286674 - RNA, 14 nt, Variola virus
acuaaauugaacac

SEQ ID NO: 3286675 - RNA, 20 nt, Variola virus
aguuguauacuaucggaauc

SEQ ID NO: 3286676 - RNA, 14 nt, Variola virus
cucuuggaauuaau

SEQ ID NO: 3286677 - RNA, 17 nt, Variola virus
aguucuuugaucucuuu

SEQ ID NO: 3286678 - RNA, 13 nt, Variola virus
uauucuuaauauu

SEQ ID NO: 3286679 - RNA, 20 nt, Variola virus
agaugguaaaauacaaaaua

SEQ ID NO: 3286680 - RNA, 21 nt, Variola virus
aauuaaaaccaaguacuacaa

SEQ ID NO: 3286681 - RNA, 20 nt, Variola virus
cauuauagauguguauacau

SEQ ID NO: 3286682 - RNA, 13 nt, Variola virus
ucauaagaacuau

SEQ ID NO: 3286683 - RNA, 13 nt, Variola virus
uaauaagaaauau

SEQ ID NO: 3286684 - RNA, 20 nt, Variola virus
gaauuagucgucgaauauau

SEQ ID NO: 3286685 - RNA, 21 nt, Variola virus
acuuuaacacguugucuuuca

SEQ ID NO: 3286686 - RNA, 17 nt, Variola virus
ucauauacucaauuagu

SEQ ID NO: 3286687 - RNA, 16 nt, Variola virus
uuauacaguguaugua

SEQ ID NO: 3286688 - RNA, 12 nt, Variola virus
ccaaaugaugau

SEQ ID NO: 3286689 - RNA, 16 nt, Variola virus
agcaaaagaaucauca

SEQ ID NO: 3286690 - RNA, 22 nt, Variola virus
gaaacauccaucgauacauaua

SEQ ID NO: 3286691 - RNA, 21 nt, Variola virus
auuauuguguuuguguaguuc

SEQ ID NO: 3286692 - RNA, 17 nt, Variola virus
cuauagaccaaacugua

SEQ ID NO: 3286693 - RNA, 17 nt, Variola virus
auccggauauucuucua

SEQ ID NO: 3286694 - RNA, 13 nt, Variola virus
uagaaaaaugcua

SEQ ID NO: 3286695 - RNA, 12 nt, Variola virus
gaauuguauauu

SEQ ID NO: 3286696 - RNA, 19 nt, Variola virus
auguaacccuuuuuaucga

SEQ ID NO: 3286697 - RNA, 12 nt, Variola virus
ucaauagaagau

SEQ ID NO: 3286698 - RNA, 24 nt, Variola virus
aauaauuacuuuacaaacgaugua

SEQ ID NO: 3286699 - RNA, 16 nt, Variola virus
aguugucggucuaaag

SEQ ID NO: 3286700 - RNA, 16 nt, Variola virus
cuuucucaacauuuca

SEQ ID NO: 3286701 - RNA, 14 nt, Variola virus
gucuguaaaccaca

SEQ ID NO: 3286702 - RNA, 23 nt, Variola virus
uuauuuuaaaccuaaagaugcua

SEQ ID NO: 3286703 - RNA, 14 nt, Variola virus
uuaaagaauguaua

SEQ ID NO: 3286704 - RNA, 13 nt, Variola virus
accaaauuuuaca

SEQ ID NO: 3286705 - RNA, 19 nt, Variola virus
uuuacaacacuuuucuauu

SEQ ID NO: 3286706 - RNA, 15 nt, Variola virus
uaccgauuuaucauc

SEQ ID NO: 3286707 - RNA, 14 nt, Variola virus
auguauauuuucca

SEQ ID NO: 3286708 - RNA, 16 nt, Variola virus
uguguaugaaaugcuu

SEQ ID NO: 3286709 - RNA, 15 nt, Variola virus
auucauaagaaucua

SEQ ID NO: 3286710 - RNA, 20 nt, Variola virus
caauauaaucgcuucaucau

SEQ ID NO: 3286711 - RNA, 16 nt, Variola virus
auuccacuuuaacauc

SEQ ID NO: 3286712 - RNA, 15 nt, Variola virus
augaguaaugggguu

SEQ ID NO: 3286713 - RNA, 19 nt, Variola virus
uagagauaccaaagacuuu

SEQ ID NO: 3286714 - RNA, 15 nt, Variola virus
uaccuuuaaaauaua

SEQ ID NO: 3286715 - RNA, 17 nt, Variola virus
auguuagaaaaaugaug

SEQ ID NO: 3286716 - RNA, 17 nt, Variola virus
caauuggaguaucaucu

SEQ ID NO: 3286717 - RNA, 18 nt, Variola virus
ugcacagcgaagaauucu

SEQ ID NO: 3286718 - RNA, 20 nt, Variola virus
acuguuuuccggaaggaaau

SEQ ID NO: 3286719 - RNA, 22 nt, Variola virus
gaaauauauacauauuuuaguu

SEQ ID NO: 3286720 - RNA, 23 nt, Variola virus
ucaucugaaauugucacuacuaa

SEQ ID NO: 3286721 - RNA, 14 nt, Variola virus
ccauauguuggaaa

SEQ ID NO: 3286722 - RNA, 20 nt, Variola virus
auguuaucaugaaauguuug

SEQ ID NO: 3286723 - RNA, 12 nt, Variola virus
caaugaguaaaa

SEQ ID NO: 3286724 - RNA, 15 nt, Variola virus
cauaacauguaucaa

SEQ ID NO: 3286725 - RNA, 19 nt, Variola virus
uuauuucagaaauuauucg

SEQ ID NO: 3286726 - RNA, 19 nt, Variola virus
aaaaacuguuuaacaaggu

SEQ ID NO: 3286727 - RNA, 17 nt, Variola virus
auaauauuuuaauagau

SEQ ID NO: 3286728 - RNA, 22 nt, Variola virus
cguaccaacucauuuaaauauc

SEQ ID NO: 3286729 - RNA, 11 nt, Variola virus
ggaaaaagcuc

SEQ ID NO: 3286730 - RNA, 23 nt, Variola virus
ggaccuaaaucuaacauugauuu

SEQ ID NO: 3286731 - RNA, 13 nt, Variola virus
aguuaauuuauca

SEQ ID NO: 3286732 - RNA, 21 nt, Variola virus
uuuacgcgcacacaauacaga

SEQ ID NO: 3286733 - RNA, 20 nt, Variola virus
acgaaauaucucaucaagaa

SEQ ID NO: 3286734 - RNA, 16 nt, Variola virus
uaauccagucuuuaau

SEQ ID NO: 3286735 - RNA, 12 nt, Variola virus
uagguaauaacu

SEQ ID NO: 3286736 - RNA, 12 nt, Variola virus
cuguuauauaca

SEQ ID NO: 3286737 - RNA, 22 nt, Variola virus
ccaagauccucucuuaaaugaa

SEQ ID NO: 3286738 - RNA, 23 nt, Variola virus
agaagucguuuauauaacaauga

SEQ ID NO: 3286739 - RNA, 14 nt, Variola virus
uaaauaaauucauu

SEQ ID NO: 3286740 - RNA, 13 nt, Variola virus
agaaucaaaggau

SEQ ID NO: 3286741 - RNA, 13 nt, Variola virus
aaauauguagaaa

SEQ ID NO: 3286742 - RNA, 20 nt, Variola virus
uguauaugugaucuaugaca

SEQ ID NO: 3286743 - RNA, 19 nt, Variola virus
ccauuaagaaacuaguuua

SEQ ID NO: 3286744 - RNA, 17 nt, Variola virus
uaacacauuucaacaau

SEQ ID NO: 3286745 - RNA, 17 nt, Variola virus
cguaucuauaaucaucu

SEQ ID NO: 3286746 - RNA, 14 nt, Variola virus
cuaaauaaguagua

SEQ ID NO: 3286747 - RNA, 15 nt, Variola virus
caacaacauauaauu

SEQ ID NO: 3286748 - RNA, 16 nt, Variola virus
ucaaauaggagauauu

SEQ ID NO: 3286749 - RNA, 14 nt, Variola virus
aauacguuagagaa

SEQ ID NO: 3286750 - RNA, 14 nt, Variola virus
ucuauaucuaaaau

SEQ ID NO: 3286751 - RNA, 15 nt, Variola virus
aucuuguucagaaau

SEQ ID NO: 3286752 - RNA, 14 nt, Variola virus
uugaaccaaacauu

SEQ ID NO: 3286753 - RNA, 15 nt, Variola virus
cauuucacaauucau

SEQ ID NO: 3286754 - RNA, 15 nt, Variola virus
aguuuggauuaauaa

SEQ ID NO: 3286755 - RNA, 16 nt, Variola virus
ugaacauauucaucgu

SEQ ID NO: 3286756 - RNA, 22 nt, Variola virus
uucuagaauuagaauuacaaaa

SEQ ID NO: 3286757 - RNA, 20 nt, Variola virus
uaauauccucuauuauacau

SEQ ID NO: 3286758 - RNA, 16 nt, Variola virus
auccuguaauacuuuu

SEQ ID NO: 3286759 - RNA, 19 nt, Variola virus
aauucuuggauauaugaua

SEQ ID NO: 3286760 - RNA, 19 nt, Variola virus
uaguaaaccgauaguguau

SEQ ID NO: 3286761 - RNA, 17 nt, Variola virus
augcauuuuuauauaca

SEQ ID NO: 3286762 - RNA, 18 nt, Variola virus
auucugcaauaucuucgu

SEQ ID NO: 3286763 - RNA, 20 nt, Variola virus
uuuacagauauauucauagu

SEQ ID NO: 3286764 - RNA, 15 nt, Variola virus
guuaguaaucaugua

SEQ ID NO: 3286765 - RNA, 21 nt, Variola virus
agcgucuagucuuaaauggag

SEQ ID NO: 3286766 - RNA, 12 nt, Variola virus
auuaauccaugg

SEQ ID NO: 3286767 - RNA, 18 nt, Variola virus
uuaauauauuuaaacuag

SEQ ID NO: 3286768 - RNA, 15 nt, Variola virus
aauccauccuauccu

SEQ ID NO: 3286769 - RNA, 17 nt, Variola virus
gacgaugauuucugaau

SEQ ID NO: 3286770 - RNA, 21 nt, Variola virus
aacuuaggcauggacauacua

SEQ ID NO: 3286771 - RNA, 15 nt, Variola virus
uuuguauauacauag

SEQ ID NO: 3286772 - RNA, 23 nt, Variola virus
aagcguguuauauauacaagucu

SEQ ID NO: 3286773 - RNA, 13 nt, Variola virus
auugauagauuac

SEQ ID NO: 3286774 - RNA, 17 nt, Variola virus
auaauccuuauacaucu

SEQ ID NO: 3286775 - RNA, 18 nt, Variola virus
aagaucuaauauucuaga

SEQ ID NO: 3286776 - RNA, 16 nt, Variola virus
auauuucuauuucuau

SEQ ID NO: 3286777 - RNA, 20 nt, Variola virus
guuuaauauccuuagucauc

SEQ ID NO: 3286778 - RNA, 20 nt, Variola virus
aaccaacgucauaaaaaugu

SEQ ID NO: 3286779 - RNA, 14 nt, Variola virus
aagaaauuaauaga

SEQ ID NO: 3286780 - RNA, 15 nt, Variola virus
uaguuuaucaaaaau

SEQ ID NO: 3286781 - RNA, 22 nt, Variola virus
cuauuguuacaaaaguuaauaa

SEQ ID NO: 3286782 - RNA, 17 nt, Variola virus
aaaaucuaaacaaauau

SEQ ID NO: 3286783 - RNA, 13 nt, Variola virus
gauucuaucuuua

SEQ ID NO: 3286784 - RNA, 15 nt, Variola virus
aagauuuaaauccua

SEQ ID NO: 3286785 - RNA, 19 nt, Variola virus
cuagaucggcaaucuuucu

SEQ ID NO: 3286786 - RNA, 14 nt, Variola virus
agaacucaacaaua

SEQ ID NO: 3286787 - RNA, 13 nt, Variola virus
aucagagaacuuc

SEQ ID NO: 3286788 - RNA, 21 nt, Variola virus
aucaucaccuaucuuguguau

SEQ ID NO: 3286789 - RNA, 14 nt, Variola virus
agauaaugugaauu

SEQ ID NO: 3286790 - RNA, 22 nt, Variola virus
acauaugcaucuauauaaucuu

SEQ ID NO: 3286791 - RNA, 17 nt, Variola virus
guaaucaugaaauuaag

SEQ ID NO: 3286792 - RNA, 15 nt, Variola virus
ucuauuauacauuua

SEQ ID NO: 3286793 - RNA, 21 nt, Variola virus
auaauguuauuacuuguggua

SEQ ID NO: 3286794 - RNA, 14 nt, Variola virus
uucaagauuaucuu

SEQ ID NO: 3286795 - RNA, 21 nt, Variola virus
uaccuuugguucuuuaaaaga

SEQ ID NO: 3286796 - RNA, 23 nt, Variola virus
ucuuaguaacucuaguaaaauaa

SEQ ID NO: 3286797 - RNA, 17 nt, Variola virus
gaaaacauuauauccuc

SEQ ID NO: 3286798 - RNA, 21 nt, Variola virus
uagguauuguuuucacgguau

SEQ ID NO: 3286799 - RNA, 14 nt, Variola virus
agauagaugaugau

SEQ ID NO: 3286800 - RNA, 19 nt, Variola virus
aacucauuuauauauuaaa

SEQ ID NO: 3286801 - RNA, 16 nt, Variola virus
acuguccaaaaugaug

SEQ ID NO: 3286802 - RNA, 20 nt, Variola virus
uagguaugaucguuaagaau

SEQ ID NO: 3286803 - RNA, 16 nt, Variola virus
auaaauggaauacuaa

SEQ ID NO: 3286804 - RNA, 17 nt, Variola virus
auucgaaauuagaaagu

SEQ ID NO: 3286805 - RNA, 16 nt, Variola virus
auuuaauuuuagauaa

SEQ ID NO: 3286806 - RNA, 19 nt, Variola virus
cuuguuaauaaguaaauga

SEQ ID NO: 3286807 - RNA, 21 nt, Variola virus
uuaaugcuacagauauuauca

SEQ ID NO: 3286808 - RNA, 13 nt, Variola virus
uccgguuaauuuu

SEQ ID NO: 3286809 - RNA, 17 nt, Variola virus
aaguuucguacaaauac

SEQ ID NO: 3286810 - RNA, 18 nt, Variola virus
caaagguacuauuucuac

SEQ ID NO: 3286811 - RNA, 16 nt, Variola virus
uaugaaguacgauguu

SEQ ID NO: 3286812 - RNA, 14 nt, Variola virus
auuauaauuauuau

SEQ ID NO: 3286813 - RNA, 12 nt, Variola virus
acguugucuuuc

SEQ ID NO: 3286814 - RNA, 22 nt, Variola virus
agaccuacagugauaugauguc

SEQ ID NO: 3286815 - RNA, 19 nt, Variola virus
aucuaugguuuccauaauu

SEQ ID NO: 3286816 - RNA, 17 nt, Variola virus
aauaaacaauuucacaa

SEQ ID NO: 3286817 - RNA, 23 nt, Variola virus
ugaauuuauuucagaaauuauuc

SEQ ID NO: 3286818 - RNA, 14 nt, Variola virus
uaguuuucuaaaau

SEQ ID NO: 3286819 - RNA, 14 nt, Variola virus
aucauauaucugaa

SEQ ID NO: 3286820 - RNA, 19 nt, Variola virus
acauugcuaugugaugaau

SEQ ID NO: 3286821 - RNA, 15 nt, Variola virus
aucaauaaaacagga

SEQ ID NO: 3286822 - RNA, 15 nt, Variola virus
augguucaaagacua

SEQ ID NO: 3286823 - RNA, 23 nt, Variola virus
gacauguucgugguguuaugaaa

SEQ ID NO: 3286824 - RNA, 13 nt, Variola virus
aucacuaauucca

SEQ ID NO: 3286825 - RNA, 15 nt, Variola virus
cgaaaauacacaaau

SEQ ID NO: 3286826 - RNA, 14 nt, Variola virus
caucuacuuuucca

SEQ ID NO: 3286827 - RNA, 18 nt, Variola virus
uacucauuuaacagaugu

SEQ ID NO: 3286828 - RNA, 20 nt, Variola virus
gagauuggguuaauaaauac

SEQ ID NO: 3286829 - RNA, 11 nt, Variola virus
aaccuuuguug

SEQ ID NO: 3286830 - RNA, 18 nt, Variola virus
auuuuaaauuuuaaacau

SEQ ID NO: 3286831 - RNA, 13 nt, Variola virus
gcuuccauaauau

SEQ ID NO: 3286832 - RNA, 16 nt, Variola virus
agcugaaaaacuaugu

SEQ ID NO: 3286833 - RNA, 15 nt, Variola virus
agcuaauaccaauuu

SEQ ID NO: 3286834 - RNA, 18 nt, Variola virus
cuuguagacgaacauaau

SEQ ID NO: 3286835 - RNA, 13 nt, Variola virus
uaauaaaauguca

SEQ ID NO: 3286836 - RNA, 15 nt, Variola virus
auuauacaaaaauuu

SEQ ID NO: 3286837 - RNA, 20 nt, Variola virus
uauguuaauacuuauucaua

SEQ ID NO: 3286838 - RNA, 12 nt, Variola virus
aggaaauacuug

SEQ ID NO: 3286839 - RNA, 19 nt, Variola virus
gaccguccauaguuuguau

SEQ ID NO: 3286840 - RNA, 16 nt, Variola virus
agaauacgaugauauu

SEQ ID NO: 3286841 - RNA, 18 nt, Variola virus
agccauauuccacagaua

SEQ ID NO: 3286842 - RNA, 21 nt, Variola virus
gcggguguuauucacaacauc

SEQ ID NO: 3286843 - RNA, 15 nt, Variola virus
aaaugauaacuagau

SEQ ID NO: 3286844 - RNA, 17 nt, Variola virus
augguaaaauuaaauag

SEQ ID NO: 3286845 - RNA, 13 nt, Variola virus
caaaaguauacau

SEQ ID NO: 3286846 - RNA, 20 nt, Variola virus
cuaccuuacccauaaacaau

SEQ ID NO: 3286847 - RNA, 19 nt, Variola virus
uaaccaccgauaaaucuag

SEQ ID NO: 3286848 - RNA, 20 nt, Variola virus
guacaagaaauacuuccauc

SEQ ID NO: 3286849 - RNA, 21 nt, Variola virus
caaacaaguuaaugagauauu

SEQ ID NO: 3286850 - RNA, 11 nt, Variola virus
gauacaaauau

SEQ ID NO: 3286851 - RNA, 20 nt, Variola virus
uuaccaucaaaagcauuaau

SEQ ID NO: 3286852 - RNA, 20 nt, Variola virus
auuacgaauauauaaaagac

SEQ ID NO: 3286853 - RNA, 15 nt, Variola virus
aaguauuuauacaaa

SEQ ID NO: 3286854 - RNA, 13 nt, Variola virus
agaggaaacuaau

SEQ ID NO: 3286855 - RNA, 16 nt, Variola virus
gauaauauaaauauga

SEQ ID NO: 3286856 - RNA, 20 nt, Variola virus
aguaauaagaaauaugaaau

SEQ ID NO: 3286857 - RNA, 24 nt, Variola virus
aacuuauucuuagcgucacagaau

SEQ ID NO: 3286858 - RNA, 17 nt, Variola virus
aaacuguaaauguagua

SEQ ID NO: 3286859 - RNA, 19 nt, Variola virus
agcauauuccauuaaugac

SEQ ID NO: 3286860 - RNA, 17 nt, Variola virus
agaaaauacuauauauu

SEQ ID NO: 3286861 - RNA, 21 nt, Variola virus
uauugccacguaccuuuaaaa

SEQ ID NO: 3286862 - RNA, 14 nt, Variola virus
agauucaacauuua

SEQ ID NO: 3286863 - RNA, 22 nt, Variola virus
ucagaauuuucauggauguaga

SEQ ID NO: 3286864 - RNA, 21 nt, Variola virus
aaugccacgguugacaauaac

SEQ ID NO: 3286865 - RNA, 13 nt, Variola virus
ccaagacacauau

SEQ ID NO: 3286866 - RNA, 14 nt, Variola virus
ugccauaauaauua

SEQ ID NO: 3286867 - RNA, 20 nt, Variola virus
agaucauagagagauucauu

SEQ ID NO: 3286868 - RNA, 18 nt, Variola virus
uacuaaugacaauaauua

SEQ ID NO: 3286869 - RNA, 16 nt, Variola virus
aacaauguauacaaau

SEQ ID NO: 3286870 - RNA, 15 nt, Variola virus
uuagcacuaucauaa

SEQ ID NO: 3286871 - RNA, 20 nt, Variola virus
ugauaucgcauagaaauaca

SEQ ID NO: 3286872 - RNA, 17 nt, Variola virus
aucauaaauaaaaauag

SEQ ID NO: 3286873 - RNA, 17 nt, Variola virus
uaaaaguaucaaaucuu

SEQ ID NO: 3286874 - RNA, 17 nt, Variola virus
aauuagucgguuaaugu

SEQ ID NO: 3286875 - RNA, 17 nt, Variola virus
auugcauauuuaucuuu

SEQ ID NO: 3286876 - RNA, 16 nt, Variola virus
acaucgaugccuuaac

SEQ ID NO: 3286877 - RNA, 18 nt, Variola virus
cauuaaaucuauuauauu

SEQ ID NO: 3286878 - RNA, 21 nt, Variola virus
uaacgccuauucgaaauuaga

SEQ ID NO: 3286879 - RNA, 23 nt, Variola virus
uauauucuuuaaauggaacagac

SEQ ID NO: 3286880 - RNA, 22 nt, Variola virus
auuuucggguuuaaauucuuua

SEQ ID NO: 3286881 - RNA, 16 nt, Variola virus
uauacucuuauuauca

SEQ ID NO: 3286882 - RNA, 19 nt, Variola virus
uuaaaaaaaaauacuuauu

SEQ ID NO: 3286883 - RNA, 20 nt, Variola virus
ccaacuucgccacccuugaa

SEQ ID NO: 3286884 - RNA, 18 nt, Variola virus
auaauuuuaccagaauac

SEQ ID NO: 3286885 - RNA, 20 nt, Variola virus
guauaaucaauucuaaucac

SEQ ID NO: 3286886 - RNA, 13 nt, Variola virus
uaugaaauuuaag

SEQ ID NO: 3286887 - RNA, 12 nt, Variola virus
augcaaacauua

SEQ ID NO: 3286888 - RNA, 19 nt, Variola virus
caaugauaaugaaccaucu

SEQ ID NO: 3286889 - RNA, 12 nt, Variola virus
aucuguauucuc

SEQ ID NO: 3286890 - RNA, 23 nt, Variola virus
uuaucuauuucaaaaaaugauca

SEQ ID NO: 3286891 - RNA, 17 nt, Variola virus
acgccaauacauguuuu

SEQ ID NO: 3286892 - RNA, 19 nt, Variola virus
uucgucuucccaaaauguu

SEQ ID NO: 3286893 - RNA, 17 nt, Variola virus
ucuauccaagauacuua

SEQ ID NO: 3286894 - RNA, 14 nt, Variola virus
gaacugaugccuau

SEQ ID NO: 3286895 - RNA, 23 nt, Variola virus
aauaugucucuuaacuauuuccg

SEQ ID NO: 3286896 - RNA, 16 nt, Variola virus
auaucaucgacaaaga

SEQ ID NO: 3286897 - RNA, 21 nt, Variola virus
uugacauauguaaauauuaau

SEQ ID NO: 3286898 - RNA, 18 nt, Variola virus
cugauuuugcauguagug

SEQ ID NO: 3286899 - RNA, 14 nt, Variola virus
cuauuauuaccaua

SEQ ID NO: 3286900 - RNA, 16 nt, Variola virus
auucaauuaguuuauu

SEQ ID NO: 3286901 - RNA, 14 nt, Variola virus
acuuacuuaauagg

SEQ ID NO: 3286902 - RNA, 22 nt, Variola virus
cgaauauuauaauaccaugacu

SEQ ID NO: 3286903 - RNA, 16 nt, Variola virus
uacgaggauucaaaaa

SEQ ID NO: 3286904 - RNA, 16 nt, Variola virus
gaaaguuuuauaugua

SEQ ID NO: 3286905 - RNA, 20 nt, Variola virus
uaaucguguauaacaucuuu

SEQ ID NO: 3286906 - RNA, 19 nt, Variola virus
uaacuaaaguuaauacuac

SEQ ID NO: 3286907 - RNA, 20 nt, Variola virus
accaaguaaugaucaucuau

SEQ ID NO: 3286908 - RNA, 14 nt, Variola virus
aucaaaagaaaucu

SEQ ID NO: 3286909 - RNA, 16 nt, Variola virus
gauguuuuuagaaaau

SEQ ID NO: 3286910 - RNA, 20 nt, Variola virus
aguuugccuuuuuuaguaga

SEQ ID NO: 3286911 - RNA, 20 nt, Variola virus
ggauguuguucgauugauuu

SEQ ID NO: 3286912 - RNA, 15 nt, Variola virus
agagauuuugaaaau

SEQ ID NO: 3286913 - RNA, 18 nt, Variola virus
acaucguaaucaaaagaa

SEQ ID NO: 3286914 - RNA, 16 nt, Variola virus
ucauguuauagaugug

SEQ ID NO: 3286915 - RNA, 19 nt, Variola virus
uuucuucuacauacauaag

SEQ ID NO: 3286916 - RNA, 21 nt, Variola virus
uaccgauuuaucaucauacac

SEQ ID NO: 3286917 - RNA, 16 nt, Variola virus
aucuaacagaaacguu

SEQ ID NO: 3286918 - RNA, 20 nt, Variola virus
aaauuuauuuaucaauuuua

SEQ ID NO: 3286919 - RNA, 15 nt, Variola virus
cauuaauaacauccu

SEQ ID NO: 3286920 - RNA, 17 nt, Variola virus
guuuauguacuaugcca

SEQ ID NO: 3286921 - RNA, 17 nt, Variola virus
auuuugugcaaauagau

SEQ ID NO: 3286922 - RNA, 21 nt, Variola virus
uucuauccaaggacaaggaug

SEQ ID NO: 3286923 - RNA, 16 nt, Variola virus
aucuuuaaagaacuaa

SEQ ID NO: 3286924 - RNA, 21 nt, Variola virus
ccauaucuaaagcuauguuua

SEQ ID NO: 3286925 - RNA, 18 nt, Variola virus
uuuccagacauuguugaa

SEQ ID NO: 3286926 - RNA, 14 nt, Variola virus
acaugcauuugaaa

SEQ ID NO: 3286927 - RNA, 17 nt, Variola virus
guaauuggaaaauuagu

SEQ ID NO: 3286928 - RNA, 20 nt, Variola virus
auuauugucauaaacauuau

SEQ ID NO: 3286929 - RNA, 18 nt, Variola virus
uauuuggcuagucaagau

SEQ ID NO: 3286930 - RNA, 15 nt, Variola virus
auuuauacuacuaau

SEQ ID NO: 3286931 - RNA, 16 nt, Variola virus
uggaguaucaucuauu

SEQ ID NO: 3286932 - RNA, 14 nt, Variola virus
uggaguacagaauu

SEQ ID NO: 3286933 - RNA, 14 nt, Variola virus
ucauauuuagauuu

SEQ ID NO: 3286934 - RNA, 17 nt, Variola virus
cuuuuuauccuuuagau

SEQ ID NO: 3286935 - RNA, 19 nt, Variola virus
cguucaacauuuuauggaa

SEQ ID NO: 3286936 - RNA, 23 nt, Variola virus
acaucgguacggguauucauuua

SEQ ID NO: 3286937 - RNA, 22 nt, Variola virus
agcaucauguccauuuaacuaa

SEQ ID NO: 3286938 - RNA, 22 nt, Variola virus
caugucuaauguguuaaaaaaa

SEQ ID NO: 3286939 - RNA, 16 nt, Variola virus
acuauuuggauagaca

SEQ ID NO: 3286940 - RNA, 12 nt, Variola virus
uauauacugaaa

SEQ ID NO: 3286941 - RNA, 18 nt, Variola virus
caacauaauauuaaacac

SEQ ID NO: 3286942 - RNA, 22 nt, Variola virus
cggauacuaguaguuucacaaa

SEQ ID NO: 3286943 - RNA, 19 nt, Variola virus
acaaugucaaaauaugagu

SEQ ID NO: 3286944 - RNA, 18 nt, Variola virus
uuugccaaccaauacaua

SEQ ID NO: 3286945 - RNA, 14 nt, Variola virus
aagucauaaaucau

SEQ ID NO: 3286946 - RNA, 20 nt, Variola virus
cucauagacccguaguuuua

SEQ ID NO: 3286947 - RNA, 16 nt, Variola virus
aauauuuuuuauaaaa

SEQ ID NO: 3286948 - RNA, 23 nt, Variola virus
cacggauccguaucuccaacaag

SEQ ID NO: 3286949 - RNA, 18 nt, Variola virus
ucccacaguguugccauu

SEQ ID NO: 3286950 - RNA, 12 nt, Variola virus
cauuaacagcuu

SEQ ID NO: 3286951 - RNA, 12 nt, Variola virus
cuuuaacuucug

SEQ ID NO: 3286952 - RNA, 19 nt, Variola virus
guauuguuaauagauauau

SEQ ID NO: 3286953 - RNA, 23 nt, Variola virus
ccaauaugucuguacaaauguua

SEQ ID NO: 3286954 - RNA, 20 nt, Variola virus
uuagacauaugauaaaacga

SEQ ID NO: 3286955 - RNA, 20 nt, Variola virus
acuugaaucaccauccuuua

SEQ ID NO: 3286956 - RNA, 17 nt, Variola virus
aucuauucauaaaacau

SEQ ID NO: 3286957 - RNA, 18 nt, Variola virus
uauccauaaacaauauua

SEQ ID NO: 3286958 - RNA, 16 nt, Variola virus
acaauaaugagaaugu

SEQ ID NO: 3286959 - RNA, 16 nt, Variola virus
guacuaucuagagauu

SEQ ID NO: 3286960 - RNA, 19 nt, Variola virus
uauguuuuuacagagacuu

SEQ ID NO: 3286961 - RNA, 23 nt, Variola virus
acagucuaucaucgacacaaaug

SEQ ID NO: 3286962 - RNA, 21 nt, Variola virus
cuagacugaugaccauuuaaa

SEQ ID NO: 3286963 - RNA, 15 nt, Variola virus
cagagguuguauuua

SEQ ID NO: 3286964 - RNA, 18 nt, Variola virus
auauauuguagauaagaa

SEQ ID NO: 3286965 - RNA, 20 nt, Variola virus
aaaaugcuacuuuagcuaag

SEQ ID NO: 3286966 - RNA, 21 nt, Variola virus
aauucauccguccuucagaca

SEQ ID NO: 3286967 - RNA, 22 nt, Variola virus
uaacacguuuuuuagaucucau

SEQ ID NO: 3286968 - RNA, 18 nt, Variola virus
guaaaccgauuaaacguc

SEQ ID NO: 3286969 - RNA, 13 nt, Variola virus
auucaaaaaagaa

SEQ ID NO: 3286970 - RNA, 20 nt, Variola virus
gaauauaaaauaacuacagu

SEQ ID NO: 3286971 - RNA, 13 nt, Variola virus
uaguaucuaaaac

SEQ ID NO: 3286972 - RNA, 21 nt, Variola virus
agauaaugacguuaauaacaa

SEQ ID NO: 3286973 - RNA, 14 nt, Variola virus
uucauauacugaua

SEQ ID NO: 3286974 - RNA, 13 nt, Variola virus
uuguauaugugau

SEQ ID NO: 3286975 - RNA, 19 nt, Variola virus
auuuuucuauguuaggaau

SEQ ID NO: 3286976 - RNA, 18 nt, Variola virus
aauauuaaagauaaagcg

SEQ ID NO: 3286977 - RNA, 23 nt, Variola virus
aaauaaaccuuuggaauuaguau

SEQ ID NO: 3286978 - RNA, 20 nt, Variola virus
aucuucacauuguaacuauu

SEQ ID NO: 3286979 - RNA, 14 nt, Variola virus
gauauauauugcac

SEQ ID NO: 3286980 - RNA, 22 nt, Variola virus
aaauaucauuauguauaaucau

SEQ ID NO: 3286981 - RNA, 20 nt, Variola virus
ucuccgcaauacauuucuca

SEQ ID NO: 3286982 - RNA, 13 nt, Variola virus
gacauucaucaau

SEQ ID NO: 3286983 - RNA, 16 nt, Variola virus
auuuaucuaacauagu

SEQ ID NO: 3286984 - RNA, 19 nt, Variola virus
caaaaauauuguacaguac

SEQ ID NO: 3286985 - RNA, 14 nt, Variola virus
ucaaauacuucaaa

SEQ ID NO: 3286986 - RNA, 19 nt, Variola virus
augcuagugcucaaacaaa

SEQ ID NO: 3286987 - RNA, 16 nt, Variola virus
cauguucgaaaaagug

SEQ ID NO: 3286988 - RNA, 18 nt, Variola virus
aaauaauccugaauauau

SEQ ID NO: 3286989 - RNA, 23 nt, Variola virus
agaaaguaugauauaauacuuac

SEQ ID NO: 3286990 - RNA, 18 nt, Variola virus
auuuuaacacuaauuaag

SEQ ID NO: 3286991 - RNA, 14 nt, Variola virus
auacuaguaugaug

SEQ ID NO: 3286992 - RNA, 19 nt, Variola virus
uguaaagacgaaacaaaau

SEQ ID NO: 3286993 - RNA, 14 nt, Variola virus
agauacuguauaua

SEQ ID NO: 3286994 - RNA, 16 nt, Variola virus
guaauaucuuaaauaa

SEQ ID NO: 3286995 - RNA, 22 nt, Variola virus
ugaagaaauuguuauaaugcua

SEQ ID NO: 3286996 - RNA, 15 nt, Variola virus
auucgguuaugaaug

SEQ ID NO: 3286997 - RNA, 13 nt, Variola virus
aaugcuaauguuc

SEQ ID NO: 3286998 - RNA, 18 nt, Variola virus
aaaaucuaaacaaauauu

SEQ ID NO: 3286999 - RNA, 18 nt, Variola virus
gaaaagcuuaaaauagcu

SEQ ID NO: 3287000 - RNA, 14 nt, Variola virus
gaacgauaaacaaa

SEQ ID NO: 3287001 - RNA, 19 nt, Variola virus
gauuguuuauuguauauac

SEQ ID NO: 3287002 - RNA, 14 nt, Variola virus
uauuacuaaacauu

SEQ ID NO: 3287003 - RNA, 13 nt, Variola virus
agaauaauuagaa

SEQ ID NO: 3287004 - RNA, 13 nt, Variola virus
accucgagaaugu

SEQ ID NO: 3287005 - RNA, 15 nt, Variola virus
gaauuccucugaaaa

SEQ ID NO: 3287006 - RNA, 14 nt, Variola virus
uggagaucuagaaa

SEQ ID NO: 3287007 - RNA, 16 nt, Variola virus
ugacacuaucuucugu

SEQ ID NO: 3287008 - RNA, 15 nt, Variola virus
agcuucguauacucu

SEQ ID NO: 3287009 - RNA, 18 nt, Variola virus
auuaucaaaauuuggaaa

SEQ ID NO: 3287010 - RNA, 18 nt, Variola virus
uauaaacgaguauagcau

SEQ ID NO: 3287011 - RNA, 16 nt, Variola virus
aaauagauagaacuac

SEQ ID NO: 3287012 - RNA, 13 nt, Variola virus
cacuagaugauuu

SEQ ID NO: 3287013 - RNA, 14 nt, Variola virus
aaugaaaauggaua

SEQ ID NO: 3287014 - RNA, 17 nt, Variola virus
uuaucaaagucacaaag

SEQ ID NO: 3287015 - RNA, 19 nt, Variola virus
gaauauacuucauaaaaga

SEQ ID NO: 3287016 - RNA, 23 nt, Variola virus
uauucggagcgcgcaauuuuuaa

SEQ ID NO: 3287017 - RNA, 23 nt, Variola virus
cuguucuaucaucuacaucacug

SEQ ID NO: 3287018 - RNA, 15 nt, Variola virus
auuuuaauauagcug

SEQ ID NO: 3287019 - RNA, 13 nt, Variola virus
cauaguuggauuu

SEQ ID NO: 3287020 - RNA, 17 nt, Variola virus
ucugaauagauccacca

SEQ ID NO: 3287021 - RNA, 21 nt, Variola virus
acgaugguuaaaauuaacaag

SEQ ID NO: 3287022 - RNA, 20 nt, Variola virus
uaguaucaauccaacaaaug

SEQ ID NO: 3287023 - RNA, 16 nt, Variola virus
ucacuucugucuacau

SEQ ID NO: 3287024 - RNA, 24 nt, Variola virus
ucacgcucucuacguagacuuucu

SEQ ID NO: 3287025 - RNA, 16 nt, Variola virus
caauuuagcugcauua

SEQ ID NO: 3287026 - RNA, 20 nt, Variola virus
auauuccgacaaaggauuga

SEQ ID NO: 3287027 - RNA, 13 nt, Variola virus
aaaacauaaucaa

SEQ ID NO: 3287028 - RNA, 17 nt, Variola virus
uaugaugucguuaaauu

SEQ ID NO: 3287029 - RNA, 20 nt, Variola virus
aauuucuuagucauagacaa

SEQ ID NO: 3287030 - RNA, 15 nt, Variola virus
cuauuccuauuuccu

SEQ ID NO: 3287031 - RNA, 20 nt, Variola virus
aauaauaucacuauuacaau

SEQ ID NO: 3287032 - RNA, 15 nt, Variola virus
uauauaguuaagauu

SEQ ID NO: 3287033 - RNA, 21 nt, Variola virus
aucuucuuauuuagaucuugu

SEQ ID NO: 3287034 - RNA, 12 nt, Variola virus
gcucuagauauu

SEQ ID NO: 3287035 - RNA, 20 nt, Variola virus
auuuaaggcuuuaaaauuga

SEQ ID NO: 3287036 - RNA, 17 nt, Variola virus
uguacaauacauguaca

SEQ ID NO: 3287037 - RNA, 15 nt, Variola virus
auccaaaauauuaau

SEQ ID NO: 3287038 - RNA, 23 nt, Variola virus
uugacaucuaaaaaauccuuaau

SEQ ID NO: 3287039 - RNA, 14 nt, Variola virus
auagaaaaugaauc

SEQ ID NO: 3287040 - RNA, 18 nt, Variola virus
uaaaguauccguguauag

SEQ ID NO: 3287041 - RNA, 14 nt, Variola virus
gaaauauaccgaua

SEQ ID NO: 3287042 - RNA, 17 nt, Variola virus
uucuauuuuuaauauag

SEQ ID NO: 3287043 - RNA, 16 nt, Variola virus
cagaaggaaacuucuu

SEQ ID NO: 3287044 - RNA, 16 nt, Variola virus
gguggccaaauuuauu

SEQ ID NO: 3287045 - RNA, 17 nt, Variola virus
uauuucacaucguauuu

SEQ ID NO: 3287046 - RNA, 15 nt, Variola virus
uaaauaauuauuuca

SEQ ID NO: 3287047 - RNA, 11 nt, Variola virus
ucguuaaugaa

SEQ ID NO: 3287048 - RNA, 19 nt, Variola virus
acagacguuaauauagaca

SEQ ID NO: 3287049 - RNA, 13 nt, Variola virus
cuaacaaaacuau

SEQ ID NO: 3287050 - RNA, 18 nt, Variola virus
uaaacaauuucacaaaug

SEQ ID NO: 3287051 - RNA, 19 nt, Variola virus
aauuacuaaaauauacaaa

SEQ ID NO: 3287052 - RNA, 21 nt, Variola virus
uuccgccguauccauaaacaa

SEQ ID NO: 3287053 - RNA, 18 nt, Variola virus
uggagacauccauugaua

SEQ ID NO: 3287054 - RNA, 16 nt, Variola virus
gacgcuuauuauuaau

SEQ ID NO: 3287055 - RNA, 21 nt, Variola virus
aacuaauucauuuucaauaau

SEQ ID NO: 3287056 - RNA, 22 nt, Variola virus
augacuccucuucauacagccu

SEQ ID NO: 3287057 - RNA, 16 nt, Variola virus
guccauuaucaguaau

SEQ ID NO: 3287058 - RNA, 16 nt, Variola virus
ucucuaagaggaugag

SEQ ID NO: 3287059 - RNA, 14 nt, Variola virus
aauacaaaauguua

SEQ ID NO: 3287060 - RNA, 17 nt, Variola virus
ugaugauauguuuggaa

SEQ ID NO: 3287061 - RNA, 21 nt, Variola virus
aaucauuacugucgcuaucau

SEQ ID NO: 3287062 - RNA, 22 nt, Variola virus
auaacuuuuuaccucauaugaa

SEQ ID NO: 3287063 - RNA, 23 nt, Variola virus
acaauauuuaguuuauucauaau

SEQ ID NO: 3287064 - RNA, 20 nt, Variola virus
acuuaacuaucuuucaagau

SEQ ID NO: 3287065 - RNA, 13 nt, Variola virus
cauguuaaaaaug

SEQ ID NO: 3287066 - RNA, 13 nt, Variola virus
ucauuaucugaaa

SEQ ID NO: 3287067 - RNA, 13 nt, Variola virus
cguauaauagaca

SEQ ID NO: 3287068 - RNA, 13 nt, Variola virus
uuuauuucuaauu

SEQ ID NO: 3287069 - RNA, 14 nt, Variola virus
uaacgcaacuauau

SEQ ID NO: 3287070 - RNA, 22 nt, Variola virus
uaaauacuuuuuauuuacggua

SEQ ID NO: 3287071 - RNA, 16 nt, Variola virus
agaauauaaauuauau

SEQ ID NO: 3287072 - RNA, 13 nt, Variola virus
uuucuuucgaauu

SEQ ID NO: 3287073 - RNA, 15 nt, Variola virus
agauaauacaaaauu

SEQ ID NO: 3287074 - RNA, 17 nt, Variola virus
uauauagauauuaucua

SEQ ID NO: 3287075 - RNA, 20 nt, Variola virus
aaguaauuauaguauaaugu

SEQ ID NO: 3287076 - RNA, 22 nt, Variola virus
cauaaauaguaaauacaauaau

SEQ ID NO: 3287077 - RNA, 14 nt, Variola virus
uaauaauuaaccaa

SEQ ID NO: 3287078 - RNA, 16 nt, Variola virus
auuuguacacaucuau

SEQ ID NO: 3287079 - RNA, 17 nt, Variola virus
guuggauuaucuauagu

SEQ ID NO: 3287080 - RNA, 21 nt, Variola virus
acaauauuacaauacauagau

SEQ ID NO: 3287081 - RNA, 16 nt, Variola virus
auuucaaaaaaugauc

SEQ ID NO: 3287082 - RNA, 16 nt, Variola virus
uaaaacgauuaaacaa

SEQ ID NO: 3287083 - RNA, 19 nt, Variola virus
cugugaauucguaaauaca

SEQ ID NO: 3287084 - RNA, 14 nt, Variola virus
auuauauauggauu

SEQ ID NO: 3287085 - RNA, 14 nt, Variola virus
ucacagucuguuuu

SEQ ID NO: 3287086 - RNA, 21 nt, Variola virus
gacugccacguuagaggauga

SEQ ID NO: 3287087 - RNA, 20 nt, Variola virus
auuuuaaaaucaaaaaggag

SEQ ID NO: 3287088 - RNA, 16 nt, Variola virus
auuagagguaaugaug

SEQ ID NO: 3287089 - RNA, 16 nt, Variola virus
ucauaaccauuucuau

SEQ ID NO: 3287090 - RNA, 21 nt, Variola virus
accugccauaaauaaaugcuu

SEQ ID NO: 3287091 - RNA, 17 nt, Variola virus
uacaauacgauaaacau

SEQ ID NO: 3287092 - RNA, 17 nt, Variola virus
gcggcuuaauaaauguu

SEQ ID NO: 3287093 - RNA, 11 nt, Variola virus
aaaauauugug

SEQ ID NO: 3287094 - RNA, 20 nt, Variola virus
agauccugcauagaaauauc

SEQ ID NO: 3287095 - RNA, 19 nt, Variola virus
uauuaaaguacguaaaucu

SEQ ID NO: 3287096 - RNA, 19 nt, Variola virus
uuugcaauuucuucauagg

SEQ ID NO: 3287097 - RNA, 16 nt, Variola virus
guuacaauuuuaucau

SEQ ID NO: 3287098 - RNA, 14 nt, Variola virus
caaagugaaacaau

SEQ ID NO: 3287099 - RNA, 16 nt, Variola virus
aaucuaauauuaagaa

SEQ ID NO: 3287100 - RNA, 16 nt, Variola virus
uaaaaguuuuacuaua

SEQ ID NO: 3287101 - RNA, 13 nt, Variola virus
acuuccauggaaa

SEQ ID NO: 3287102 - RNA, 15 nt, Variola virus
auaaacuagauauau

SEQ ID NO: 3287103 - RNA, 16 nt, Variola virus
gcaucuuaauccuucu

SEQ ID NO: 3287104 - RNA, 17 nt, Variola virus
cugaaaauaaagauaaa

SEQ ID NO: 3287105 - RNA, 17 nt, Variola virus
uuagaagagucauuaaa

SEQ ID NO: 3287106 - RNA, 13 nt, Variola virus
auagauauacaau

SEQ ID NO: 3287107 - RNA, 23 nt, Variola virus
agaaauuuuugguucuucucuaa

SEQ ID NO: 3287108 - RNA, 21 nt, Variola virus
ugacgaagugacgucauuaaa

SEQ ID NO: 3287109 - RNA, 16 nt, Variola virus
ggaaaaauaacaaauc

SEQ ID NO: 3287110 - RNA, 13 nt, Variola virus
acaaaccaaauau

SEQ ID NO: 3287111 - RNA, 18 nt, Variola virus
acguacauaacauuguuu

SEQ ID NO: 3287112 - RNA, 16 nt, Variola virus
cugaaaagaagugagu

SEQ ID NO: 3287113 - RNA, 18 nt, Variola virus
ucguagauuuuaauguau

SEQ ID NO: 3287114 - RNA, 18 nt, Variola virus
ggauaggagauuguauug

SEQ ID NO: 3287115 - RNA, 23 nt, Variola virus
auaugccgugggaugaugucaaa

SEQ ID NO: 3287116 - RNA, 20 nt, Variola virus
aauuuuuaacgauuuacugu

SEQ ID NO: 3287117 - RNA, 14 nt, Variola virus
gaaaugguacagaa

SEQ ID NO: 3287118 - RNA, 17 nt, Variola virus
uaaauagguuucuauaa

SEQ ID NO: 3287119 - RNA, 20 nt, Variola virus
gcaaucuuuuagaugaugau

SEQ ID NO: 3287120 - RNA, 16 nt, Variola virus
auacaacuaaggagaa

SEQ ID NO: 3287121 - RNA, 24 nt, Variola virus
agauuaucuagucagaacuaucau

SEQ ID NO: 3287122 - RNA, 24 nt, Variola virus
augcucuagauacugcaaaacuua

SEQ ID NO: 3287123 - RNA, 14 nt, Variola virus
acuuauuuuaagau

SEQ ID NO: 3287124 - RNA, 14 nt, Variola virus
uggauaauuuccau

SEQ ID NO: 3287125 - RNA, 21 nt, Variola virus
uuagaggaacauuaaacaucg

SEQ ID NO: 3287126 - RNA, 17 nt, Variola virus
uuccgccguauccauaa

SEQ ID NO: 3287127 - RNA, 23 nt, Variola virus
ugucuuaauaagaaguguaagag

SEQ ID NO: 3287128 - RNA, 14 nt, Variola virus
caucugauuccaua

SEQ ID NO: 3287129 - RNA, 16 nt, Variola virus
augaugucuauguaug

SEQ ID NO: 3287130 - RNA, 21 nt, Variola virus
cauuaacaucauacaucaauu

SEQ ID NO: 3287131 - RNA, 15 nt, Variola virus
uaguauauacguuau

SEQ ID NO: 3287132 - RNA, 15 nt, Variola virus
cugaacccguuaaug

SEQ ID NO: 3287133 - RNA, 18 nt, Variola virus
guaauuuuuguuucaguu

SEQ ID NO: 3287134 - RNA, 14 nt, Variola virus
acagccucauauau

SEQ ID NO: 3287135 - RNA, 20 nt, Variola virus
cuaaaggaucugacccuaau

SEQ ID NO: 3287136 - RNA, 17 nt, Variola virus
ugcaaugaauaucuaca

SEQ ID NO: 3287137 - RNA, 22 nt, Variola virus
acacaccaaaaaagaaaaggau

SEQ ID NO: 3287138 - RNA, 16 nt, Variola virus
ugguuuaaaaauacuc

SEQ ID NO: 3287139 - RNA, 22 nt, Variola virus
auaugcaaagucuaaauauuuu

SEQ ID NO: 3287140 - RNA, 23 nt, Variola virus
cuaaauaccucauaaaacaaaaa

SEQ ID NO: 3287141 - RNA, 16 nt, Variola virus
auguuguuaaaauaua

SEQ ID NO: 3287142 - RNA, 16 nt, Variola virus
aucugggaauaaaaua

SEQ ID NO: 3287143 - RNA, 18 nt, Variola virus
agagaaaagucaauuaug

SEQ ID NO: 3287144 - RNA, 14 nt, Variola virus
acagacugaaagua

SEQ ID NO: 3287145 - RNA, 16 nt, Variola virus
acuuuucauuaauagg

SEQ ID NO: 3287146 - RNA, 19 nt, Variola virus
auaucacaaccuuuguuaa

SEQ ID NO: 3287147 - RNA, 16 nt, Variola virus
gacuucuaacaaacau

SEQ ID NO: 3287148 - RNA, 14 nt, Variola virus
aggaagcauauucu

SEQ ID NO: 3287149 - RNA, 13 nt, Variola virus
uaucuuucaagau

SEQ ID NO: 3287150 - RNA, 20 nt, Variola virus
acgaauauugggcaaagaua

SEQ ID NO: 3287151 - RNA, 23 nt, Variola virus
uuaaacagaaauauaugagaugu

SEQ ID NO: 3287152 - RNA, 16 nt, Variola virus
aucuaguuagcaauuu

SEQ ID NO: 3287153 - RNA, 19 nt, Variola virus
acuaccgaguuuaaaacuu

SEQ ID NO: 3287154 - RNA, 14 nt, Variola virus
gacuagacauuuac

SEQ ID NO: 3287155 - RNA, 14 nt, Variola virus
uucaaaucuagauu

SEQ ID NO: 3287156 - RNA, 20 nt, Variola virus
gagacuugauagauauuaau

SEQ ID NO: 3287157 - RNA, 23 nt, Variola virus
augaagaugacgaugaaaaugau

SEQ ID NO: 3287158 - RNA, 18 nt, Variola virus
uuagucgugguaagaaag

SEQ ID NO: 3287159 - RNA, 19 nt, Variola virus
uucugaauagauccaccau

SEQ ID NO: 3287160 - RNA, 20 nt, Variola virus
aauaaaauguuaauacauca

SEQ ID NO: 3287161 - RNA, 16 nt, Variola virus
uaaagauauuguuaca

SEQ ID NO: 3287162 - RNA, 14 nt, Variola virus
ugauacauuuugaa

SEQ ID NO: 3287163 - RNA, 20 nt, Variola virus
uauaguaauaaaauuucuau

SEQ ID NO: 3287164 - RNA, 23 nt, Variola virus
augauugcauauuuaucuuucuu

SEQ ID NO: 3287165 - RNA, 23 nt, Variola virus
uaaacaacaaugccaucuuacau

SEQ ID NO: 3287166 - RNA, 13 nt, Variola virus
aauacaauacaua

SEQ ID NO: 3287167 - RNA, 13 nt, Variola virus
ucgaaauaucuuu

SEQ ID NO: 3287168 - RNA, 22 nt, Variola virus
gauaauaauguuguuauaucua

SEQ ID NO: 3287169 - RNA, 14 nt, Variola virus
auacguauccauga

SEQ ID NO: 3287170 - RNA, 22 nt, Variola virus
aacugacguauuggaugaugca

SEQ ID NO: 3287171 - RNA, 15 nt, Variola virus
uauuuuuuucuaaau

SEQ ID NO: 3287172 - RNA, 23 nt, Variola virus
cuaauuauacuuugguaaauguu

SEQ ID NO: 3287173 - RNA, 21 nt, Variola virus
guuucuuagcuugugauuuuu

SEQ ID NO: 3287174 - RNA, 16 nt, Variola virus
uaaacucagauaauag

SEQ ID NO: 3287175 - RNA, 16 nt, Variola virus
caucgaugaugcauuu

SEQ ID NO: 3287176 - RNA, 17 nt, Variola virus
cggaaauguaauucuaa

SEQ ID NO: 3287177 - RNA, 18 nt, Variola virus
uauuucuauauuugacuc

SEQ ID NO: 3287178 - RNA, 13 nt, Variola virus
cauuuuauuucua

SEQ ID NO: 3287179 - RNA, 19 nt, Variola virus
acuuuagcauugaaaauac

SEQ ID NO: 3287180 - RNA, 16 nt, Variola virus
ucgacauauguaugua

SEQ ID NO: 3287181 - RNA, 11 nt, Variola virus
uuuuuauucuu

SEQ ID NO: 3287182 - RNA, 14 nt, Variola virus
auuacuuuaauagu

SEQ ID NO: 3287183 - RNA, 21 nt, Variola virus
uuauaugauaucuuuacuaag

SEQ ID NO: 3287184 - RNA, 11 nt, Variola virus
gguaauaacua

SEQ ID NO: 3287185 - RNA, 22 nt, Variola virus
aaaccauguugugaaagaguuu

SEQ ID NO: 3287186 - RNA, 18 nt, Variola virus
aguagaaauuccauugga

SEQ ID NO: 3287187 - RNA, 14 nt, Variola virus
uuauauaauguaua

SEQ ID NO: 3287188 - RNA, 14 nt, Variola virus
aaaacaauacagug

SEQ ID NO: 3287189 - RNA, 22 nt, Variola virus
uauuuaugauauauauuauaua

SEQ ID NO: 3287190 - RNA, 20 nt, Variola virus
aacaauuaauuaauacagua

SEQ ID NO: 3287191 - RNA, 20 nt, Variola virus
cgucgucaaaauauuuacua

SEQ ID NO: 3287192 - RNA, 12 nt, Variola virus
uaaaauaucuua

SEQ ID NO: 3287193 - RNA, 14 nt, Variola virus
uucaauucuagaaa

SEQ ID NO: 3287194 - RNA, 21 nt, Variola virus
uucuaucuuuaguaguguuuc

SEQ ID NO: 3287195 - RNA, 13 nt, Variola virus
aaacuagauacaa

SEQ ID NO: 3287196 - RNA, 23 nt, Variola virus
uucucgauagagaugagaugcuu

SEQ ID NO: 3287197 - RNA, 18 nt, Variola virus
gaaaugccugauaaagau

SEQ ID NO: 3287198 - RNA, 15 nt, Variola virus
acucaauuaguauau

SEQ ID NO: 3287199 - RNA, 20 nt, Variola virus
uacucuaaucuuuaauagau

SEQ ID NO: 3287200 - RNA, 16 nt, Variola virus
acaaauauaaaaugau

SEQ ID NO: 3287201 - RNA, 18 nt, Variola virus
gacagaaccuugugucau

SEQ ID NO: 3287202 - RNA, 19 nt, Variola virus
uauggaaacuauaauuuug

SEQ ID NO: 3287203 - RNA, 22 nt, Variola virus
uggauauaauauauuagauauu

SEQ ID NO: 3287204 - RNA, 23 nt, Variola virus
uuaugaaacuuggaaacaucucu

SEQ ID NO: 3287205 - RNA, 15 nt, Variola virus
auuacgcucuacaaa

SEQ ID NO: 3287206 - RNA, 15 nt, Variola virus
aauuauuucuaacau

SEQ ID NO: 3287207 - RNA, 16 nt, Variola virus
uugacggccgucauca

SEQ ID NO: 3287208 - RNA, 17 nt, Variola virus
aucuauuauugaugcaa

SEQ ID NO: 3287209 - RNA, 14 nt, Variola virus
gauucgauuuugau

SEQ ID NO: 3287210 - RNA, 23 nt, Variola virus
auuaacacuccggaaaaauaauu

SEQ ID NO: 3287211 - RNA, 13 nt, Variola virus
acuuuguuaauga

SEQ ID NO: 3287212 - RNA, 13 nt, Variola virus
agaggauaaagua

SEQ ID NO: 3287213 - RNA, 13 nt, Variola virus
auuaguuaaauau

SEQ ID NO: 3287214 - RNA, 20 nt, Variola virus
aucugguuuaggaaagacag

SEQ ID NO: 3287215 - RNA, 22 nt, Variola virus
gcauaauaccuaucuauaagau

SEQ ID NO: 3287216 - RNA, 15 nt, Variola virus
agaacucaacucauc

SEQ ID NO: 3287217 - RNA, 21 nt, Variola virus
uauuuugauaggaucuauaau

SEQ ID NO: 3287218 - RNA, 15 nt, Variola virus
aaugauaaacaaaaa

SEQ ID NO: 3287219 - RNA, 23 nt, Variola virus
ucgacguaacuauauuccaaauu

SEQ ID NO: 3287220 - RNA, 20 nt, Variola virus
uacgaagggauugaaaauag

SEQ ID NO: 3287221 - RNA, 19 nt, Variola virus
aaauguguggauuuuggug

SEQ ID NO: 3287222 - RNA, 12 nt, Variola virus
cuaaauuagaac

SEQ ID NO: 3287223 - RNA, 20 nt, Variola virus
aaguagaucaucugaaaauc

SEQ ID NO: 3287224 - RNA, 14 nt, Variola virus
acggcgucauauag

SEQ ID NO: 3287225 - RNA, 21 nt, Variola virus
uuaugacgcaguaacauagau

SEQ ID NO: 3287226 - RNA, 12 nt, Variola virus
auuauuaaauau

SEQ ID NO: 3287227 - RNA, 20 nt, Variola virus
agauaugugauaaaaaucgu

SEQ ID NO: 3287228 - RNA, 16 nt, Variola virus
uacaauacacacaaua

SEQ ID NO: 3287229 - RNA, 18 nt, Variola virus
caaaaguaguauagcaau

SEQ ID NO: 3287230 - RNA, 20 nt, Variola virus
uagacuuuaauggauauaca

SEQ ID NO: 3287231 - RNA, 14 nt, Variola virus
cugauaagauaucu

SEQ ID NO: 3287232 - RNA, 14 nt, Variola virus
guuuaauacauuga

SEQ ID NO: 3287233 - RNA, 21 nt, Variola virus
gacugcgaauccuauauuaaa

SEQ ID NO: 3287234 - RNA, 17 nt, Variola virus
uuaaaauauuauuuaga

SEQ ID NO: 3287235 - RNA, 13 nt, Variola virus
gagucacaaauaa

SEQ ID NO: 3287236 - RNA, 21 nt, Variola virus
aaauacgaagguccuuuuacu

SEQ ID NO: 3287237 - RNA, 17 nt, Variola virus
aacauuuccuacauaua

SEQ ID NO: 3287238 - RNA, 17 nt, Variola virus
agcaaaacaguuacuau

SEQ ID NO: 3287239 - RNA, 20 nt, Variola virus
agaguauccacuaaacuauu

SEQ ID NO: 3287240 - RNA, 16 nt, Variola virus
uuguaacaacaauguu

SEQ ID NO: 3287241 - RNA, 21 nt, Variola virus
uuucuugauuagcccaucauu

SEQ ID NO: 3287242 - RNA, 23 nt, Variola virus
uguacucuuccaaaguugggaua

SEQ ID NO: 3287243 - RNA, 14 nt, Variola virus
cuugucaucuuguu

SEQ ID NO: 3287244 - RNA, 23 nt, Variola virus
auagaagauguuagaaaaaugau

SEQ ID NO: 3287245 - RNA, 15 nt, Variola virus
caugauguaaucucu

SEQ ID NO: 3287246 - RNA, 16 nt, Variola virus
cagucuaauauccauu

SEQ ID NO: 3287247 - RNA, 22 nt, Variola virus
aauugcuguuuauuuuagaaga

SEQ ID NO: 3287248 - RNA, 12 nt, Variola virus
cuaaaaaacuaa

SEQ ID NO: 3287249 - RNA, 14 nt, Variola virus
uauuuguucaagau

SEQ ID NO: 3287250 - RNA, 17 nt, Variola virus
aaucguuuuugaaggau

SEQ ID NO: 3287251 - RNA, 18 nt, Variola virus
aacaagagcagauaucua

SEQ ID NO: 3287252 - RNA, 22 nt, Variola virus
acuucgacagccaucuuaaaau

SEQ ID NO: 3287253 - RNA, 19 nt, Variola virus
auaagaugucuaugaauau

SEQ ID NO: 3287254 - RNA, 22 nt, Variola virus
caucaaaaauaaguaaaaagug

SEQ ID NO: 3287255 - RNA, 18 nt, Variola virus
auuuauuguaacaguauu

SEQ ID NO: 3287256 - RNA, 16 nt, Variola virus
cguuuaaagucauuau

SEQ ID NO: 3287257 - RNA, 17 nt, Variola virus
uaguggaucucaaugac

SEQ ID NO: 3287258 - RNA, 16 nt, Variola virus
uagaauuugaucuauu

SEQ ID NO: 3287259 - RNA, 13 nt, Variola virus
ucuacaauuauug

SEQ ID NO: 3287260 - RNA, 16 nt, Variola virus
cauuagcaaucuuuua

SEQ ID NO: 3287261 - RNA, 21 nt, Variola virus
uuauuccacacacucuacaau

SEQ ID NO: 3287262 - RNA, 16 nt, Variola virus
cauaauagaauguauu

SEQ ID NO: 3287263 - RNA, 16 nt, Variola virus
caaauaaaauucugau

SEQ ID NO: 3287264 - RNA, 13 nt, Variola virus
caacacuauguua

SEQ ID NO: 3287265 - RNA, 17 nt, Variola virus
ucaauagauuauacauc

SEQ ID NO: 3287266 - RNA, 20 nt, Variola virus
aacauugcagccauuuucua

SEQ ID NO: 3287267 - RNA, 14 nt, Variola virus
uaugacuuaauagc

SEQ ID NO: 3287268 - RNA, 15 nt, Variola virus
auuggauuggauaau

SEQ ID NO: 3287269 - RNA, 22 nt, Variola virus
aaacucuuuagcgguauaauua

SEQ ID NO: 3287270 - RNA, 15 nt, Variola virus
uacaucgcauacaaa

SEQ ID NO: 3287271 - RNA, 16 nt, Variola virus
cauuaaucuauuagaa

SEQ ID NO: 3287272 - RNA, 16 nt, Variola virus
uugauaaaaauuaaaa

SEQ ID NO: 3287273 - RNA, 20 nt, Variola virus
uguucaaugcaauagaugcc

SEQ ID NO: 3287274 - RNA, 15 nt, Variola virus
auuuuauuucaaaau

SEQ ID NO: 3287275 - RNA, 17 nt, Variola virus
uacauccaaaauacaaa

SEQ ID NO: 3287276 - RNA, 11 nt, Variola virus
uuuuuuggaau

SEQ ID NO: 3287277 - RNA, 16 nt, Variola virus
aauuauuauuaaauau

SEQ ID NO: 3287278 - RNA, 18 nt, Variola virus
cuaugucaaaaauuguag

SEQ ID NO: 3287279 - RNA, 17 nt, Variola virus
uuuaacuagucuucucu

SEQ ID NO: 3287280 - RNA, 17 nt, Variola virus
guaacuauguaaaugau

SEQ ID NO: 3287281 - RNA, 20 nt, Variola virus
aauauagaacaucauuucca

SEQ ID NO: 3287282 - RNA, 19 nt, Variola virus
cuuuaacauauguaucaau

SEQ ID NO: 3287283 - RNA, 14 nt, Variola virus
acagacauacagua

SEQ ID NO: 3287284 - RNA, 17 nt, Variola virus
uguagauggauguagca

SEQ ID NO: 3287285 - RNA, 21 nt, Variola virus
augaccauuuaaaaaaacacu

SEQ ID NO: 3287286 - RNA, 16 nt, Variola virus
ggucuucggaaaaaga

SEQ ID NO: 3287287 - RNA, 19 nt, Variola virus
gauacuaauuguagcuauu

SEQ ID NO: 3287288 - RNA, 22 nt, Variola virus
guauuuuuguuagaguauauaa

SEQ ID NO: 3287289 - RNA, 20 nt, Variola virus
uacaauaauuauaauuauua

SEQ ID NO: 3287290 - RNA, 14 nt, Variola virus
aaauuaauauuucu

SEQ ID NO: 3287291 - RNA, 14 nt, Variola virus
uuaucuauuauuua

SEQ ID NO: 3287292 - RNA, 21 nt, Variola virus
gaaaguaugauauaauacuua

SEQ ID NO: 3287293 - RNA, 15 nt, Variola virus
aaaaagcuauuauca

SEQ ID NO: 3287294 - RNA, 20 nt, Variola virus
auucaagcgaauuacucugu

SEQ ID NO: 3287295 - RNA, 22 nt, Variola virus
agauucucauuugauaaaaauu

SEQ ID NO: 3287296 - RNA, 17 nt, Variola virus
uccaguccaguguauaa

SEQ ID NO: 3287297 - RNA, 19 nt, Variola virus
cuauauucuugauguagua

SEQ ID NO: 3287298 - RNA, 13 nt, Variola virus
agcuauuuaaaug

SEQ ID NO: 3287299 - RNA, 17 nt, Variola virus
uaauccugguacauacg

SEQ ID NO: 3287300 - RNA, 23 nt, Variola virus
auuucuacauaauuauauauugu

SEQ ID NO: 3287301 - RNA, 21 nt, Variola virus
gacuuauuaaaaaacauauau

SEQ ID NO: 3287302 - RNA, 12 nt, Variola virus
aauuuuuagagg

SEQ ID NO: 3287303 - RNA, 21 nt, Variola virus
gacauuauaauuuuaccaaua

SEQ ID NO: 3287304 - RNA, 11 nt, Variola virus
ggaauauacaa

SEQ ID NO: 3287305 - RNA, 20 nt, Variola virus
ucauuaagguucuuauaauc

SEQ ID NO: 3287306 - RNA, 12 nt, Variola virus
gcauagaaauac

SEQ ID NO: 3287307 - RNA, 17 nt, Variola virus
cuuuaaguauauacgau

SEQ ID NO: 3287308 - RNA, 15 nt, Variola virus
aauuugauaaagaua

SEQ ID NO: 3287309 - RNA, 20 nt, Variola virus
auguuaaaacuacaaaaaug

SEQ ID NO: 3287310 - RNA, 19 nt, Variola virus
aaauaagaucaguaacagu

SEQ ID NO: 3287311 - RNA, 19 nt, Variola virus
gaaccauuacaaauauuau

SEQ ID NO: 3287312 - RNA, 18 nt, Variola virus
gaacaauaaacaaaauac

SEQ ID NO: 3287313 - RNA, 19 nt, Variola virus
auaugcuuuuauuuuugga

SEQ ID NO: 3287314 - RNA, 17 nt, Variola virus
aucaaaaaguaagauau

SEQ ID NO: 3287315 - RNA, 21 nt, Variola virus
guuuggagacuaauucuuuuu

SEQ ID NO: 3287316 - RNA, 13 nt, Variola virus
auaaaacauucuc

SEQ ID NO: 3287317 - RNA, 14 nt, Variola virus
acauccgaaaaagu

SEQ ID NO: 3287318 - RNA, 17 nt, Variola virus
uaauuuauacaaaguau

SEQ ID NO: 3287319 - RNA, 22 nt, Variola virus
uccacuucugcagaauaauuag

SEQ ID NO: 3287320 - RNA, 21 nt, Variola virus
acugaacgaugguuuucacau

SEQ ID NO: 3287321 - RNA, 18 nt, Variola virus
uuaauuccagauguugua

SEQ ID NO: 3287322 - RNA, 15 nt, Variola virus
gccaaaaugauagau

SEQ ID NO: 3287323 - RNA, 18 nt, Variola virus
auaguuauuacuuuucuc

SEQ ID NO: 3287324 - RNA, 13 nt, Variola virus
uauacuccauuaa

SEQ ID NO: 3287325 - RNA, 18 nt, Variola virus
ugguauuucuuacauaaa

SEQ ID NO: 3287326 - RNA, 14 nt, Variola virus
auccacaauuauug

SEQ ID NO: 3287327 - RNA, 17 nt, Variola virus
uacaaaauguugauaau

SEQ ID NO: 3287328 - RNA, 21 nt, Variola virus
cagaauauacuuuguguuuca

SEQ ID NO: 3287329 - RNA, 21 nt, Variola virus
uaaagauauucuaaaauggua

SEQ ID NO: 3287330 - RNA, 22 nt, Variola virus
gccccgcuucuauuuacucccg

SEQ ID NO: 3287331 - RNA, 19 nt, Variola virus
uuuaaaagacucagaagag

SEQ ID NO: 3287332 - RNA, 15 nt, Variola virus
uacuacuauuauuga

SEQ ID NO: 3287333 - RNA, 16 nt, Variola virus
aucucuuuuuaacuaa

SEQ ID NO: 3287334 - RNA, 21 nt, Variola virus
gcguugauuaaaaaagaucaa

SEQ ID NO: 3287335 - RNA, 19 nt, Variola virus
uauauaauccaucaacaau

SEQ ID NO: 3287336 - RNA, 12 nt, Variola virus
gaacaugaugau

SEQ ID NO: 3287337 - RNA, 23 nt, Variola virus
ccuuugauaaauaguaucaucua

SEQ ID NO: 3287338 - RNA, 19 nt, Variola virus
ccagaguguucgaaugcca

SEQ ID NO: 3287339 - RNA, 14 nt, Variola virus
agucauaaaucauu

SEQ ID NO: 3287340 - RNA, 21 nt, Variola virus
uauaucuagaguaauguuuaa

SEQ ID NO: 3287341 - RNA, 14 nt, Variola virus
uuucgucaacaagu

SEQ ID NO: 3287342 - RNA, 18 nt, Variola virus
auauauuugaaaaucguu

SEQ ID NO: 3287343 - RNA, 18 nt, Variola virus
uaguaaaaaauauacauc

SEQ ID NO: 3287344 - RNA, 16 nt, Variola virus
aaucuguacuucuaua

SEQ ID NO: 3287345 - RNA, 20 nt, Variola virus
cuuaucuucuauaucaucua

SEQ ID NO: 3287346 - RNA, 18 nt, Variola virus
agacauauuaauaagacu

SEQ ID NO: 3287347 - RNA, 14 nt, Variola virus
acauaccauggaaa

SEQ ID NO: 3287348 - RNA, 22 nt, Variola virus
acuuugcauucuaucucaaaau

SEQ ID NO: 3287349 - RNA, 14 nt, Variola virus
acaaccaucuuuga

SEQ ID NO: 3287350 - RNA, 19 nt, Variola virus
guaucuaauauagauuuua

SEQ ID NO: 3287351 - RNA, 18 nt, Variola virus
gcauaaacuauacuauga

SEQ ID NO: 3287352 - RNA, 20 nt, Variola virus
ucgaugaaauaucugauguu

SEQ ID NO: 3287353 - RNA, 13 nt, Variola virus
auuaucugaaaug

SEQ ID NO: 3287354 - RNA, 16 nt, Variola virus
auuagguuaaaugauu

SEQ ID NO: 3287355 - RNA, 12 nt, Variola virus
cuauagauggag

SEQ ID NO: 3287356 - RNA, 20 nt, Variola virus
uaauuuuagauaauauacca

SEQ ID NO: 3287357 - RNA, 13 nt, Variola virus
agauuaaaaaugg

SEQ ID NO: 3287358 - RNA, 20 nt, Variola virus
ugaauaucuaggaguaauua

SEQ ID NO: 3287359 - RNA, 20 nt, Variola virus
auaugacgcgcguucaacau

SEQ ID NO: 3287360 - RNA, 18 nt, Variola virus
ugaagauguagcauucca

SEQ ID NO: 3287361 - RNA, 16 nt, Variola virus
agaggaguuauuuacu

SEQ ID NO: 3287362 - RNA, 18 nt, Variola virus
acuuacuaaagucaauaa

SEQ ID NO: 3287363 - RNA, 18 nt, Variola virus
accgauaauagacuauca

SEQ ID NO: 3287364 - RNA, 17 nt, Variola virus
uaaaaugguauuucauu

SEQ ID NO: 3287365 - RNA, 17 nt, Variola virus
guauaauauuuaaacaa

SEQ ID NO: 3287366 - RNA, 14 nt, Variola virus
agauguauacuccu

SEQ ID NO: 3287367 - RNA, 21 nt, Variola virus
agaaccgucauucaucuagaa

SEQ ID NO: 3287368 - RNA, 19 nt, Variola virus
ugaacacacgaugaaaaug

SEQ ID NO: 3287369 - RNA, 14 nt, Variola virus
gaucucgaugaaaa

SEQ ID NO: 3287370 - RNA, 19 nt, Variola virus
agcugucguucaagaucag

SEQ ID NO: 3287371 - RNA, 13 nt, Variola virus
agaugaaaaaugg

SEQ ID NO: 3287372 - RNA, 14 nt, Variola virus
uuuugguucuucuc

SEQ ID NO: 3287373 - RNA, 18 nt, Variola virus
aacguacaaauggauaaa

SEQ ID NO: 3287374 - RNA, 17 nt, Variola virus
cauccuuuauuaaauca

SEQ ID NO: 3287375 - RNA, 18 nt, Variola virus
agcaucuccaauacguua

SEQ ID NO: 3287376 - RNA, 21 nt, Variola virus
aguauuuuucaaaaaauguau

SEQ ID NO: 3287377 - RNA, 23 nt, Variola virus
uaaucaguacguucuucauuuau

SEQ ID NO: 3287378 - RNA, 15 nt, Variola virus
aaugauauaucuugu

SEQ ID NO: 3287379 - RNA, 23 nt, Variola virus
auaaaucacuaaauaauauccca

SEQ ID NO: 3287380 - RNA, 17 nt, Variola virus
ucggauaauauguaaaa

SEQ ID NO: 3287381 - RNA, 17 nt, Variola virus
aauuuuuuaaauccugu

SEQ ID NO: 3287382 - RNA, 15 nt, Variola virus
uauagcaauaugugu

SEQ ID NO: 3287383 - RNA, 14 nt, Variola virus
agcaaaaaaugaua

SEQ ID NO: 3287384 - RNA, 21 nt, Variola virus
cugcggauauaaagucaucgu

SEQ ID NO: 3287385 - RNA, 16 nt, Variola virus
cgucauucuaaaagac

SEQ ID NO: 3287386 - RNA, 16 nt, Variola virus
uacuguucauacauga

SEQ ID NO: 3287387 - RNA, 23 nt, Variola virus
gauguaugcaaaucaguauauaa

SEQ ID NO: 3287388 - RNA, 16 nt, Variola virus
aggggaugaaucauug

SEQ ID NO: 3287389 - RNA, 19 nt, Variola virus
uucauguuuaaaaugaucu

SEQ ID NO: 3287390 - RNA, 22 nt, Variola virus
uaguuauggcacucuuauuaua

SEQ ID NO: 3287391 - RNA, 13 nt, Variola virus
auuuuagacacua

SEQ ID NO: 3287392 - RNA, 20 nt, Variola virus
auacauuuccgaaugaaugu

SEQ ID NO: 3287393 - RNA, 14 nt, Variola virus
guauuauauaugua

SEQ ID NO: 3287394 - RNA, 17 nt, Variola virus
aaagcgugugcguguau

SEQ ID NO: 3287395 - RNA, 16 nt, Variola virus
uggauacuaauuguag

SEQ ID NO: 3287396 - RNA, 22 nt, Variola virus
aaauuuguucgucugucaugau

SEQ ID NO: 3287397 - RNA, 16 nt, Variola virus
uuucgcuguauaauaa

SEQ ID NO: 3287398 - RNA, 17 nt, Variola virus
uagcccucuucaagaac

SEQ ID NO: 3287399 - RNA, 15 nt, Variola virus
gaucuaaaaaaaacu

SEQ ID NO: 3287400 - RNA, 16 nt, Variola virus
auuuuuaguuacagaa

SEQ ID NO: 3287401 - RNA, 17 nt, Variola virus
cuuuuaacaugauguaa

SEQ ID NO: 3287402 - RNA, 23 nt, Variola virus
gaauggaaaccuuuaaucuauau

SEQ ID NO: 3287403 - RNA, 20 nt, Variola virus
aaaauguucuuaauagucua

SEQ ID NO: 3287404 - RNA, 14 nt, Variola virus
uaaaauuagaucuu

SEQ ID NO: 3287405 - RNA, 15 nt, Variola virus
auauagcuuauucca

SEQ ID NO: 3287406 - RNA, 18 nt, Variola virus
auuuggagcuuuaauagu

SEQ ID NO: 3287407 - RNA, 20 nt, Variola virus
agugcagauaaucauuuaau

SEQ ID NO: 3287408 - RNA, 17 nt, Variola virus
ugacaaauguaguaaau

SEQ ID NO: 3287409 - RNA, 15 nt, Variola virus
uauacggauuucuau

SEQ ID NO: 3287410 - RNA, 20 nt, Variola virus
ucugguaccuauucuagaaa

SEQ ID NO: 3287411 - RNA, 16 nt, Variola virus
uugauaucuuuagaua

SEQ ID NO: 3287412 - RNA, 14 nt, Variola virus
ugacuuacauaaau

SEQ ID NO: 3287413 - RNA, 13 nt, Variola virus
auccuugacuauc

SEQ ID NO: 3287414 - RNA, 22 nt, Variola virus
auacuacauuaaaacuuaaaaa

SEQ ID NO: 3287415 - RNA, 21 nt, Variola virus
aucccaaaaccguuaaaaugu

SEQ ID NO: 3287416 - RNA, 19 nt, Variola virus
caaugacauggaaauaucu

SEQ ID NO: 3287417 - RNA, 22 nt, Variola virus
uaaaguccgcacuacuguuaag

SEQ ID NO: 3287418 - RNA, 15 nt, Variola virus
uuaugaaucauuaaa

SEQ ID NO: 3287419 - RNA, 19 nt, Variola virus
aauuaguagaaaauacaac

SEQ ID NO: 3287420 - RNA, 18 nt, Variola virus
gguuucggaacauauucu

SEQ ID NO: 3287421 - RNA, 18 nt, Variola virus
ugauauuuauuuugcuau

SEQ ID NO: 3287422 - RNA, 19 nt, Variola virus
cauauuuagaaaaaagauu

SEQ ID NO: 3287423 - RNA, 19 nt, Variola virus
uuagucgccgucucuauaa

SEQ ID NO: 3287424 - RNA, 13 nt, Variola virus
ugagaaugugauu

SEQ ID NO: 3287425 - RNA, 18 nt, Variola virus
ucugacaauauuuaguuu

SEQ ID NO: 3287426 - RNA, 20 nt, Variola virus
auuaaauaucauuuuuugaa

SEQ ID NO: 3287427 - RNA, 13 nt, Variola virus
aucacuaaaauaa

SEQ ID NO: 3287428 - RNA, 16 nt, Variola virus
aacauuccaaagauca

SEQ ID NO: 3287429 - RNA, 17 nt, Variola virus
uaauauagaaaauucau

SEQ ID NO: 3287430 - RNA, 23 nt, Variola virus
agcgcauguacauauuuguacau

SEQ ID NO: 3287431 - RNA, 14 nt, Variola virus
auaaacaugucuau

SEQ ID NO: 3287432 - RNA, 13 nt, Variola virus
uaauagacuauau

SEQ ID NO: 3287433 - RNA, 17 nt, Variola virus
auuuuaucuuuuagagg

SEQ ID NO: 3287434 - RNA, 13 nt, Variola virus
aaaaaggaaucua

SEQ ID NO: 3287435 - RNA, 19 nt, Variola virus
cugguauuuauaugugcau

SEQ ID NO: 3287436 - RNA, 24 nt, Variola virus
acuaauucuuuuucauuaacuaga

SEQ ID NO: 3287437 - RNA, 20 nt, Variola virus
uaauauaaaucaaauacuug

SEQ ID NO: 3287438 - RNA, 14 nt, Variola virus
uacauuuguaucua

SEQ ID NO: 3287439 - RNA, 17 nt, Variola virus
aauugaccguguaauau

SEQ ID NO: 3287440 - RNA, 18 nt, Variola virus
gauaacguauuaaauauu

SEQ ID NO: 3287441 - RNA, 14 nt, Variola virus
auacucuaaucuuu

SEQ ID NO: 3287442 - RNA, 21 nt, Variola virus
auauggucucaacgcaaacuu

SEQ ID NO: 3287443 - RNA, 21 nt, Variola virus
uuauuggcguuggaaaaauua

SEQ ID NO: 3287444 - RNA, 21 nt, Variola virus
auauauucgcauauauuccca

SEQ ID NO: 3287445 - RNA, 22 nt, Variola virus
cagauuaauaguuuuauuugaa

SEQ ID NO: 3287446 - RNA, 17 nt, Variola virus
aagacuaauuuguaaac

SEQ ID NO: 3287447 - RNA, 13 nt, Variola virus
uguucccaucauu

SEQ ID NO: 3287448 - RNA, 22 nt, Variola virus
guaugccauuuacuuaauauga

SEQ ID NO: 3287449 - RNA, 20 nt, Variola virus
uucagauauaaaaaucuguu

SEQ ID NO: 3287450 - RNA, 18 nt, Variola virus
uuagacaugaauguggua

SEQ ID NO: 3287451 - RNA, 20 nt, Variola virus
uuaaggaauacaauacauac

SEQ ID NO: 3287452 - RNA, 12 nt, Variola virus
aaacuauacgaa

SEQ ID NO: 3287453 - RNA, 23 nt, Variola virus
uucacagauagaucauuuugaac

SEQ ID NO: 3287454 - RNA, 14 nt, Variola virus
ucccaauuccaaag

SEQ ID NO: 3287455 - RNA, 19 nt, Variola virus
gcagacuagaaauaacagg

SEQ ID NO: 3287456 - RNA, 15 nt, Variola virus
gaauuaauguccuga

SEQ ID NO: 3287457 - RNA, 24 nt, Variola virus
auggauuuggucauaauagaaugu

SEQ ID NO: 3287458 - RNA, 21 nt, Variola virus
aaauuauuuaauuuaauacau

SEQ ID NO: 3287459 - RNA, 13 nt, Variola virus
auguuucaaucau

SEQ ID NO: 3287460 - RNA, 15 nt, Variola virus
agaaaguaugauaua

SEQ ID NO: 3287461 - RNA, 22 nt, Variola virus
uggcuaauugucuuucucuuuu

SEQ ID NO: 3287462 - RNA, 14 nt, Variola virus
aacgauauuaaccu

SEQ ID NO: 3287463 - RNA, 14 nt, Variola virus
aguaagcauuuccu

SEQ ID NO: 3287464 - RNA, 21 nt, Variola virus
ucaggaacauaaacaaauucu

SEQ ID NO: 3287465 - RNA, 21 nt, Variola virus
cagaaauugugucauugacau

SEQ ID NO: 3287466 - RNA, 18 nt, Variola virus
aucaugucuaaugaugaa

SEQ ID NO: 3287467 - RNA, 16 nt, Variola virus
uaagcugucuaucaag

SEQ ID NO: 3287468 - RNA, 13 nt, Variola virus
uagaucaaacuua

SEQ ID NO: 3287469 - RNA, 20 nt, Variola virus
aaaaagcuccauauuacaaa

SEQ ID NO: 3287470 - RNA, 15 nt, Variola virus
uguauuuugaggaaa

SEQ ID NO: 3287471 - RNA, 15 nt, Variola virus
aauccagauaauaac

SEQ ID NO: 3287472 - RNA, 14 nt, Variola virus
auuaaaucaugaag

SEQ ID NO: 3287473 - RNA, 15 nt, Variola virus
uuucaagauaaauaa

SEQ ID NO: 3287474 - RNA, 18 nt, Variola virus
auaaucucaauuagaaua

SEQ ID NO: 3287475 - RNA, 17 nt, Variola virus
gauuuaucuaguuuauc

SEQ ID NO: 3287476 - RNA, 23 nt, Variola virus
uuaugauauaaggaaacagcuuu

SEQ ID NO: 3287477 - RNA, 23 nt, Variola virus
uguaaacuugacaaaaauuguga

SEQ ID NO: 3287478 - RNA, 20 nt, Variola virus
agucuagcagccaauacuuu

SEQ ID NO: 3287479 - RNA, 12 nt, Variola virus
cuaaugaugcag

SEQ ID NO: 3287480 - RNA, 18 nt, Variola virus
aacucauuacuuacgaua

SEQ ID NO: 3287481 - RNA, 12 nt, Variola virus
uaagugaugcau

SEQ ID NO: 3287482 - RNA, 15 nt, Variola virus
cuaccgaucucuuua

SEQ ID NO: 3287483 - RNA, 17 nt, Variola virus
cuauaaugacaauaaaa

SEQ ID NO: 3287484 - RNA, 23 nt, Variola virus
ucagaaauuacaaacacuacaac

SEQ ID NO: 3287485 - RNA, 16 nt, Variola virus
cccacugaugagaugu

SEQ ID NO: 3287486 - RNA, 16 nt, Variola virus
guaaauccuaguucug

SEQ ID NO: 3287487 - RNA, 20 nt, Variola virus
ccuuuacaucucgcaauaau

SEQ ID NO: 3287488 - RNA, 14 nt, Variola virus
uagauuaaugcuua

SEQ ID NO: 3287489 - RNA, 20 nt, Variola virus
uaacacuuucuuugauuuaa

SEQ ID NO: 3287490 - RNA, 17 nt, Variola virus
aucucccauuaucuugg

SEQ ID NO: 3287491 - RNA, 18 nt, Variola virus
caaaacuauuccaauguu

SEQ ID NO: 3287492 - RNA, 19 nt, Variola virus
uucauaaaagaaaauacua

SEQ ID NO: 3287493 - RNA, 24 nt, Variola virus
aaacugguaauccacauaguugua

SEQ ID NO: 3287494 - RNA, 22 nt, Variola virus
acgacuuucucgcgucauauau

SEQ ID NO: 3287495 - RNA, 15 nt, Variola virus
augucuccaauuuuu

SEQ ID NO: 3287496 - RNA, 15 nt, Variola virus
agcuauauagaugac

SEQ ID NO: 3287497 - RNA, 18 nt, Variola virus
caagauuuguagaagcau

SEQ ID NO: 3287498 - RNA, 15 nt, Variola virus
agaaaauuuaauaaa

SEQ ID NO: 3287499 - RNA, 21 nt, Variola virus
acuaucauaauuaaauuauug

SEQ ID NO: 3287500 - RNA, 16 nt, Variola virus
uauucauauucuuaaa

SEQ ID NO: 3287501 - RNA, 17 nt, Variola virus
caaaauagguacucugu

SEQ ID NO: 3287502 - RNA, 21 nt, Variola virus
cuccuccguuguuuuuucccu

SEQ ID NO: 3287503 - RNA, 18 nt, Variola virus
cuaucuccucuauucaua

SEQ ID NO: 3287504 - RNA, 23 nt, Variola virus
aacaugguaucuauuuuaaauac

SEQ ID NO: 3287505 - RNA, 19 nt, Variola virus
gaacagcuuuuguauauac

SEQ ID NO: 3287506 - RNA, 22 nt, Variola virus
uguuucuacuaacuuuuuggua

SEQ ID NO: 3287507 - RNA, 15 nt, Variola virus
aauuacauuucuugu

SEQ ID NO: 3287508 - RNA, 15 nt, Variola virus
augauuguaaugaac

SEQ ID NO: 3287509 - RNA, 23 nt, Variola virus
acgaacgucuccaauauaugaua

SEQ ID NO: 3287510 - RNA, 21 nt, Variola virus
uugguaauauggauacuaauu

SEQ ID NO: 3287511 - RNA, 20 nt, Variola virus
uauaaacguauacuguagau

SEQ ID NO: 3287512 - RNA, 20 nt, Variola virus
gcuauagaggacaauaauau

SEQ ID NO: 3287513 - RNA, 21 nt, Variola virus
aauauuggcuuuucuuuauca

SEQ ID NO: 3287514 - RNA, 21 nt, Variola virus
uaugaccgguuuaauguuaua

SEQ ID NO: 3287515 - RNA, 20 nt, Variola virus
agauaaaccguuuauguauu

SEQ ID NO: 3287516 - RNA, 15 nt, Variola virus
uuucuggcuaagaag

SEQ ID NO: 3287517 - RNA, 23 nt, Variola virus
ggaaaagaauuuaccagauaucu

SEQ ID NO: 3287518 - RNA, 17 nt, Variola virus
cuaccguuguuaaauac

SEQ ID NO: 3287519 - RNA, 14 nt, Variola virus
aagauaaucuucuc

SEQ ID NO: 3287520 - RNA, 15 nt, Variola virus
auaaaacaaaaucua

SEQ ID NO: 3287521 - RNA, 18 nt, Variola virus
aguauacuaucgucauuu

SEQ ID NO: 3287522 - RNA, 15 nt, Variola virus
guauuggauaaagga

SEQ ID NO: 3287523 - RNA, 23 nt, Variola virus
auaagaugacuguagaacucaug

SEQ ID NO: 3287524 - RNA, 21 nt, Variola virus
aacaguucuaccaccaguaau

SEQ ID NO: 3287525 - RNA, 19 nt, Variola virus
aagauuaugauccaaugug

SEQ ID NO: 3287526 - RNA, 17 nt, Variola virus
auuauuaguugauguga

SEQ ID NO: 3287527 - RNA, 15 nt, Variola virus
uuuucuuuguuggaa

SEQ ID NO: 3287528 - RNA, 17 nt, Variola virus
caauagugguaacgcua

SEQ ID NO: 3287529 - RNA, 12 nt, Variola virus
caucuaauaauu

SEQ ID NO: 3287530 - RNA, 16 nt, Variola virus
aaaucuagagguagaa

SEQ ID NO: 3287531 - RNA, 14 nt, Variola virus
aucuacacaaauag

SEQ ID NO: 3287532 - RNA, 18 nt, Variola virus
aaaucaaaauccauauca

SEQ ID NO: 3287533 - RNA, 23 nt, Variola virus
gaacccauaaauacaccaaauau

SEQ ID NO: 3287534 - RNA, 13 nt, Variola virus
uugaugauagcaa

SEQ ID NO: 3287535 - RNA, 13 nt, Variola virus
cauggcaauaaua

SEQ ID NO: 3287536 - RNA, 23 nt, Variola virus
agugugaauaugaucuucaucua

SEQ ID NO: 3287537 - RNA, 14 nt, Variola virus
uacuaaaggaugag

SEQ ID NO: 3287538 - RNA, 19 nt, Variola virus
auaaccggcgcugucaugu

SEQ ID NO: 3287539 - RNA, 21 nt, Variola virus
acuuucaaugagauaaauaug

SEQ ID NO: 3287540 - RNA, 16 nt, Variola virus
agauauaugaacgaua

SEQ ID NO: 3287541 - RNA, 20 nt, Variola virus
uuacugaggggaaaaucaau

SEQ ID NO: 3287542 - RNA, 18 nt, Variola virus
uagcuccccuguuuucau

SEQ ID NO: 3287543 - RNA, 23 nt, Variola virus
uuuccuauaaucguuaaauuuua

SEQ ID NO: 3287544 - RNA, 13 nt, Variola virus
aggaugaauuuga

SEQ ID NO: 3287545 - RNA, 17 nt, Variola virus
agaggcagucggauugg

SEQ ID NO: 3287546 - RNA, 17 nt, Variola virus
aggauuguauaaauuac

SEQ ID NO: 3287547 - RNA, 13 nt, Variola virus
auaaauuauacuc

SEQ ID NO: 3287548 - RNA, 20 nt, Variola virus
uccuugugcuuaauguuucc

SEQ ID NO: 3287549 - RNA, 13 nt, Variola virus
acaaauacugaca

SEQ ID NO: 3287550 - RNA, 15 nt, Variola virus
auuaaaaauaaaguu

SEQ ID NO: 3287551 - RNA, 15 nt, Variola virus
caauagauuauacau

SEQ ID NO: 3287552 - RNA, 15 nt, Variola virus
cuacaauacacacaa

SEQ ID NO: 3287553 - RNA, 14 nt, Variola virus
ggaauuguauuuuc

SEQ ID NO: 3287554 - RNA, 16 nt, Variola virus
uguaauuuuuguuuca

SEQ ID NO: 3287555 - RNA, 13 nt, Variola virus
auaagaacuauau

SEQ ID NO: 3287556 - RNA, 17 nt, Variola virus
auuucuagaaaaaauua

SEQ ID NO: 3287557 - RNA, 22 nt, Variola virus
ucauuugcucggcaguaaucaa

SEQ ID NO: 3287558 - RNA, 17 nt, Variola virus
aguauaaacgacauaau

SEQ ID NO: 3287559 - RNA, 16 nt, Variola virus
aggauacuuuaugaau

SEQ ID NO: 3287560 - RNA, 24 nt, Variola virus
ugaacauauaguucgucauuuaau

SEQ ID NO: 3287561 - RNA, 11 nt, Variola virus
acuuuaaugau

SEQ ID NO: 3287562 - RNA, 21 nt, Variola virus
gauaccgaucacguucuaguu

SEQ ID NO: 3287563 - RNA, 13 nt, Variola virus
auaaaucauauaa

SEQ ID NO: 3287564 - RNA, 13 nt, Variola virus
aauauucauuaau

SEQ ID NO: 3287565 - RNA, 19 nt, Variola virus
uaauauuuuauuucaaaau

SEQ ID NO: 3287566 - RNA, 16 nt, Variola virus
cauuuuauuguggaau

SEQ ID NO: 3287567 - RNA, 14 nt, Variola virus
ugaaguagguuucu

SEQ ID NO: 3287568 - RNA, 18 nt, Variola virus
auaauguaaaaucaugau

SEQ ID NO: 3287569 - RNA, 13 nt, Variola virus
uaauagaacucuu

SEQ ID NO: 3287570 - RNA, 22 nt, Variola virus
cuauguauucagaauuaauaga

SEQ ID NO: 3287571 - RNA, 21 nt, Variola virus
aacucuuuuauagagaaaugu

SEQ ID NO: 3287572 - RNA, 20 nt, Variola virus
auucagacacuucuuaacga

SEQ ID NO: 3287573 - RNA, 16 nt, Variola virus
ugauuauaguuucuau

SEQ ID NO: 3287574 - RNA, 20 nt, Variola virus
aauauuguuaauuauuucua

SEQ ID NO: 3287575 - RNA, 13 nt, Variola virus
ucauuuccaaauc

SEQ ID NO: 3287576 - RNA, 14 nt, Variola virus
guaaaugauaacua

SEQ ID NO: 3287577 - RNA, 15 nt, Variola virus
aucccuuaaaaauua

SEQ ID NO: 3287578 - RNA, 15 nt, Variola virus
uaaauccgagaauau

SEQ ID NO: 3287579 - RNA, 14 nt, Variola virus
uacgauacuuauaa

SEQ ID NO: 3287580 - RNA, 16 nt, Variola virus
aacuagacaauaaugu

SEQ ID NO: 3287581 - RNA, 18 nt, Variola virus
caaauauauuacuagaca

SEQ ID NO: 3287582 - RNA, 22 nt, Variola virus
guuaauacuuauucauauuuua

SEQ ID NO: 3287583 - RNA, 16 nt, Variola virus
cguauuuuuuaugaau

SEQ ID NO: 3287584 - RNA, 14 nt, Variola virus
ucagaauaucucau

SEQ ID NO: 3287585 - RNA, 15 nt, Variola virus
uuacaagucaaagag

SEQ ID NO: 3287586 - RNA, 13 nt, Variola virus
aguuuuauuggga

SEQ ID NO: 3287587 - RNA, 17 nt, Variola virus
ucauuaaucauuucuaa

SEQ ID NO: 3287588 - RNA, 22 nt, Variola virus
uuguuggcgcgccucaaaugua

SEQ ID NO: 3287589 - RNA, 22 nt, Variola virus
ucggcaacauacuauuguacau

SEQ ID NO: 3287590 - RNA, 13 nt, Variola virus
acuuuuuacuaau

SEQ ID NO: 3287591 - RNA, 16 nt, Variola virus
ucauaauagaauguau

SEQ ID NO: 3287592 - RNA, 14 nt, Variola virus
aucucaucauucca

SEQ ID NO: 3287593 - RNA, 21 nt, Variola virus
cuaguuaagaacaugucuuca

SEQ ID NO: 3287594 - RNA, 15 nt, Variola virus
agaucgaaaaaagag

SEQ ID NO: 3287595 - RNA, 14 nt, Variola virus
aaggaugauacauu

SEQ ID NO: 3287596 - RNA, 19 nt, Variola virus
ucuauaucuagaaauaagu

SEQ ID NO: 3287597 - RNA, 15 nt, Variola virus
uuauaaaacauagau

SEQ ID NO: 3287598 - RNA, 21 nt, Variola virus
cugucaugauaaaaauuuaaa

SEQ ID NO: 3287599 - RNA, 19 nt, Variola virus
uguuucgaaacuuuaucaa

SEQ ID NO: 3287600 - RNA, 15 nt, Variola virus
ucuugguuaaacuca

SEQ ID NO: 3287601 - RNA, 19 nt, Variola virus
uuguaagguuguaaauuuu

SEQ ID NO: 3287602 - RNA, 22 nt, Variola virus
gccuaaacccgacuuaguuaua

SEQ ID NO: 3287603 - RNA, 21 nt, Variola virus
acgaugauauuaaaauuauuu

SEQ ID NO: 3287604 - RNA, 13 nt, Variola virus
agaauugucuauc

SEQ ID NO: 3287605 - RNA, 23 nt, Variola virus
uuuucagcuccccuacguaucua

SEQ ID NO: 3287606 - RNA, 16 nt, Variola virus
aaaacuuuaauaacaa

SEQ ID NO: 3287607 - RNA, 22 nt, Variola virus
caaguauuauuuuuggaagaca

SEQ ID NO: 3287608 - RNA, 18 nt, Variola virus
acuacugccauuaauauc

SEQ ID NO: 3287609 - RNA, 18 nt, Variola virus
uuaauccuuugauuauca

SEQ ID NO: 3287610 - RNA, 22 nt, Variola virus
auaucaucuuuucacuaaauaa

SEQ ID NO: 3287611 - RNA, 22 nt, Variola virus
caaucuuuuucuacgucaaauu

SEQ ID NO: 3287612 - RNA, 15 nt, Variola virus
cuaacacacaaugua

SEQ ID NO: 3287613 - RNA, 13 nt, Variola virus
auucagaaaugga

SEQ ID NO: 3287614 - RNA, 16 nt, Variola virus
cuaacgugauggauau

SEQ ID NO: 3287615 - RNA, 17 nt, Variola virus
aagaauugucuguaaac

SEQ ID NO: 3287616 - RNA, 21 nt, Variola virus
acaacuaauuaagcauauucu

SEQ ID NO: 3287617 - RNA, 21 nt, Variola virus
auagcauuguuauguauuuca

SEQ ID NO: 3287618 - RNA, 20 nt, Variola virus
uuuauaucacauuguauaua

SEQ ID NO: 3287619 - RNA, 20 nt, Variola virus
aaaguuuucuuucaaaauag

SEQ ID NO: 3287620 - RNA, 13 nt, Variola virus
gugcuaccaaagg

SEQ ID NO: 3287621 - RNA, 22 nt, Variola virus
auacaucggcuaccaaaguuau

SEQ ID NO: 3287622 - RNA, 19 nt, Variola virus
acuauuacagaaguuuuaa

SEQ ID NO: 3287623 - RNA, 13 nt, Variola virus
acaggcauauuag

SEQ ID NO: 3287624 - RNA, 17 nt, Variola virus
auaucccuuaaaaauua

SEQ ID NO: 3287625 - RNA, 17 nt, Variola virus
acucugggucauauuau

SEQ ID NO: 3287626 - RNA, 17 nt, Variola virus
auuuuuagacauuagau

SEQ ID NO: 3287627 - RNA, 20 nt, Variola virus
uuuuagccagagauaucaua

SEQ ID NO: 3287628 - RNA, 14 nt, Variola virus
gagaaauuauuccu

SEQ ID NO: 3287629 - RNA, 17 nt, Variola virus
ucgaauuucuacaaaag

SEQ ID NO: 3287630 - RNA, 13 nt, Variola virus
uauauuacgguau

SEQ ID NO: 3287631 - RNA, 15 nt, Variola virus
aucuguauaauaaga

SEQ ID NO: 3287632 - RNA, 16 nt, Variola virus
auaucuauucauaugc

SEQ ID NO: 3287633 - RNA, 18 nt, Variola virus
aucuaucuuaaagacuau

SEQ ID NO: 3287634 - RNA, 16 nt, Variola virus
auuacaauacauagau

SEQ ID NO: 3287635 - RNA, 13 nt, Variola virus
aucacaagaaguu

SEQ ID NO: 3287636 - RNA, 13 nt, Variola virus
aucauuaaaggau

SEQ ID NO: 3287637 - RNA, 20 nt, Variola virus
uccagcguuacuauacacaa

SEQ ID NO: 3287638 - RNA, 16 nt, Variola virus
guagaacguaaauuaa

SEQ ID NO: 3287639 - RNA, 14 nt, Variola virus
uaauccuuguaaug

SEQ ID NO: 3287640 - RNA, 20 nt, Variola virus
auaacaugaacgauaaacaa

SEQ ID NO: 3287641 - RNA, 22 nt, Variola virus
ucauuccaucauuuaagaaggc

SEQ ID NO: 3287642 - RNA, 19 nt, Variola virus
aguuucauaucguaacuga

SEQ ID NO: 3287643 - RNA, 14 nt, Variola virus
uauauucuaucaua

SEQ ID NO: 3287644 - RNA, 22 nt, Variola virus
auaaguauaguuuuaaacuaau

SEQ ID NO: 3287645 - RNA, 18 nt, Variola virus
uaugucuguacaaauguu

SEQ ID NO: 3287646 - RNA, 15 nt, Variola virus
auuuuuguugauaaa

SEQ ID NO: 3287647 - RNA, 22 nt, Variola virus
gauaguauaccaacuauauuac

SEQ ID NO: 3287648 - RNA, 15 nt, Variola virus
ucuauaauagauggu

SEQ ID NO: 3287649 - RNA, 19 nt, Variola virus
uguaacugucggaguagua

SEQ ID NO: 3287650 - RNA, 17 nt, Variola virus
uguagaugguucuuuaa

SEQ ID NO: 3287651 - RNA, 19 nt, Variola virus
ucaaauagauguucaucau

SEQ ID NO: 3287652 - RNA, 13 nt, Variola virus
gaaucaacauaua

SEQ ID NO: 3287653 - RNA, 17 nt, Variola virus
gaucacuguagugcuau

SEQ ID NO: 3287654 - RNA, 16 nt, Variola virus
gauuuccaaucuuuug

SEQ ID NO: 3287655 - RNA, 15 nt, Variola virus
guuuucauuauuauu

SEQ ID NO: 3287656 - RNA, 23 nt, Variola virus
agaauauauguauguaaaaauau

SEQ ID NO: 3287657 - RNA, 17 nt, Variola virus
uaaccaugaaagaaaga

SEQ ID NO: 3287658 - RNA, 17 nt, Variola virus
auccaaacccuugaucu

SEQ ID NO: 3287659 - RNA, 24 nt, Variola virus
uaucacuucaacgacaauagucaa

SEQ ID NO: 3287660 - RNA, 18 nt, Variola virus
caauaauaguaacauauu

SEQ ID NO: 3287661 - RNA, 15 nt, Variola virus
aagaacucuugaaga

SEQ ID NO: 3287662 - RNA, 23 nt, Variola virus
aucacuaccgaguuuaaaacuuc

SEQ ID NO: 3287663 - RNA, 16 nt, Variola virus
ucaucuuugauauuua

SEQ ID NO: 3287664 - RNA, 13 nt, Variola virus
aggaguauacaga

SEQ ID NO: 3287665 - RNA, 13 nt, Variola virus
ucggguuccaaac

SEQ ID NO: 3287666 - RNA, 19 nt, Variola virus
cuuuaucuaguuguuuaug

SEQ ID NO: 3287667 - RNA, 15 nt, Variola virus
ccuagaacaauguca

SEQ ID NO: 3287668 - RNA, 21 nt, Variola virus
auucuugcacacuauugacga

SEQ ID NO: 3287669 - RNA, 13 nt, Variola virus
uguagaacucaug

SEQ ID NO: 3287670 - RNA, 22 nt, Variola virus
gccccaggaucuccaacaaauu

SEQ ID NO: 3287671 - RNA, 16 nt, Variola virus
aaauaugauuuuguaa

SEQ ID NO: 3287672 - RNA, 20 nt, Variola virus
gacguuggcacaugaugaau

SEQ ID NO: 3287673 - RNA, 13 nt, Variola virus
ugaacaauacuac

SEQ ID NO: 3287674 - RNA, 14 nt, Variola virus
aaaucucguaguau

SEQ ID NO: 3287675 - RNA, 12 nt, Variola virus
cguuacuauuau

SEQ ID NO: 3287676 - RNA, 13 nt, Variola virus
auacuaaagaaac

SEQ ID NO: 3287677 - RNA, 15 nt, Variola virus
auaaucuguguuguu

SEQ ID NO: 3287678 - RNA, 19 nt, Variola virus
ucugcguguaaaaaguugu

SEQ ID NO: 3287679 - RNA, 17 nt, Variola virus
acuuguuuaacaaaguu

SEQ ID NO: 3287680 - RNA, 18 nt, Variola virus
uuccauaugaugaacuaa

SEQ ID NO: 3287681 - RNA, 18 nt, Variola virus
uagaacagauuuaacaau

SEQ ID NO: 3287682 - RNA, 19 nt, Variola virus
aauagcauagauauagaaa

SEQ ID NO: 3287683 - RNA, 17 nt, Variola virus
guucugggaauagaaac

SEQ ID NO: 3287684 - RNA, 14 nt, Variola virus
ugauaaauuguaca

SEQ ID NO: 3287685 - RNA, 16 nt, Variola virus
uacaacauuccaaaga

SEQ ID NO: 3287686 - RNA, 17 nt, Variola virus
gucuaauagaacaaaua

SEQ ID NO: 3287687 - RNA, 17 nt, Variola virus
ucaaggaugucauagau

SEQ ID NO: 3287688 - RNA, 16 nt, Variola virus
cuccgucauccuucac

SEQ ID NO: 3287689 - RNA, 21 nt, Variola virus
cauaaaauuaucgaggauauu

SEQ ID NO: 3287690 - RNA, 17 nt, Variola virus
aucuaugucuuuaucca

SEQ ID NO: 3287691 - RNA, 16 nt, Variola virus
uaauacccauguuuaa

SEQ ID NO: 3287692 - RNA, 22 nt, Variola virus
gauucugauaacauaaaaauau

SEQ ID NO: 3287693 - RNA, 17 nt, Variola virus
ucuauaauaucagaauu

SEQ ID NO: 3287694 - RNA, 13 nt, Variola virus
gucuaaugaugaa

SEQ ID NO: 3287695 - RNA, 17 nt, Variola virus
agauguugcuccuggau

SEQ ID NO: 3287696 - RNA, 12 nt, Variola virus
uauaugucuacc

SEQ ID NO: 3287697 - RNA, 14 nt, Variola virus
cacauuguaacuau

SEQ ID NO: 3287698 - RNA, 20 nt, Variola virus
agucuuaaccaagaaaucgu

SEQ ID NO: 3287699 - RNA, 16 nt, Variola virus
aaaguuaauauuuucu

SEQ ID NO: 3287700 - RNA, 16 nt, Variola virus
ucauuacuacuguaaa

SEQ ID NO: 3287701 - RNA, 14 nt, Variola virus
uuuguuagaguaua

SEQ ID NO: 3287702 - RNA, 21 nt, Variola virus
cuguaaauagaauaguauaau

SEQ ID NO: 3287703 - RNA, 21 nt, Variola virus
aacuguucaucguuuagaaua

SEQ ID NO: 3287704 - RNA, 17 nt, Variola virus
aauagaaaaaacaugug

SEQ ID NO: 3287705 - RNA, 19 nt, Variola virus
gaaucgguuuuauacuguu

SEQ ID NO: 3287706 - RNA, 17 nt, Variola virus
gaaauauaugagaugua

SEQ ID NO: 3287707 - RNA, 15 nt, Variola virus
cagucgaaacauauu

SEQ ID NO: 3287708 - RNA, 18 nt, Variola virus
gucauuccuuauacaauc

SEQ ID NO: 3287709 - RNA, 13 nt, Variola virus
gagagagaaauac

SEQ ID NO: 3287710 - RNA, 16 nt, Variola virus
uauccaucuaacaaaa

SEQ ID NO: 3287711 - RNA, 16 nt, Variola virus
gauacuaucaaaauau

SEQ ID NO: 3287712 - RNA, 18 nt, Variola virus
cuagagcaucaauguccu

SEQ ID NO: 3287713 - RNA, 15 nt, Variola virus
ggagaucuaaagaua

SEQ ID NO: 3287714 - RNA, 20 nt, Variola virus
ccugucuccuagcaauuagu

SEQ ID NO: 3287715 - RNA, 15 nt, Variola virus
caucuggauuucaga

SEQ ID NO: 3287716 - RNA, 22 nt, Variola virus
cagaaauuaguuuagagucaaa

SEQ ID NO: 3287717 - RNA, 22 nt, Variola virus
auuccuagagguacaacucauu

SEQ ID NO: 3287718 - RNA, 21 nt, Variola virus
gaauauuccucuaacagauau

SEQ ID NO: 3287719 - RNA, 16 nt, Variola virus
acuguggauacucugu

SEQ ID NO: 3287720 - RNA, 18 nt, Variola virus
aaucuuuguuaaauauug

SEQ ID NO: 3287721 - RNA, 21 nt, Variola virus
gucaucgaaaugguagauaua

SEQ ID NO: 3287722 - RNA, 15 nt, Variola virus
guauuauuaaaucau

SEQ ID NO: 3287723 - RNA, 22 nt, Variola virus
augauguguuauuuuuuaacug

SEQ ID NO: 3287724 - RNA, 22 nt, Variola virus
aauuauaccaauagauaauugu

SEQ ID NO: 3287725 - RNA, 16 nt, Variola virus
uuauguuggacauaag

SEQ ID NO: 3287726 - RNA, 15 nt, Variola virus
uguauucucuuacaa

SEQ ID NO: 3287727 - RNA, 15 nt, Variola virus
aucaaaagaaugauu

SEQ ID NO: 3287728 - RNA, 14 nt, Variola virus
uuauuguuugggua

SEQ ID NO: 3287729 - RNA, 22 nt, Variola virus
acaucguauaucgucuuuguua

SEQ ID NO: 3287730 - RNA, 13 nt, Variola virus
acaaacaucucac

SEQ ID NO: 3287731 - RNA, 12 nt, Variola virus
aauauuagaaaa

SEQ ID NO: 3287732 - RNA, 14 nt, Variola virus
ucuaccauuucauu

SEQ ID NO: 3287733 - RNA, 21 nt, Variola virus
uauccagugcguuucuacaaa

SEQ ID NO: 3287734 - RNA, 16 nt, Variola virus
caauggagaaauacuu

SEQ ID NO: 3287735 - RNA, 19 nt, Variola virus
caagugaaccuauaaugag

SEQ ID NO: 3287736 - RNA, 15 nt, Variola virus
uuaaacguauaaaaa

SEQ ID NO: 3287737 - RNA, 15 nt, Variola virus
auauauucgcauaua

SEQ ID NO: 3287738 - RNA, 15 nt, Variola virus
auaugacuaacuuau

SEQ ID NO: 3287739 - RNA, 17 nt, Variola virus
ugaacacacaacgcauc

SEQ ID NO: 3287740 - RNA, 20 nt, Variola virus
caucuucuuugauuaaugau

SEQ ID NO: 3287741 - RNA, 16 nt, Variola virus
acuauaaaauaaaaga

SEQ ID NO: 3287742 - RNA, 15 nt, Variola virus
acaaaaucaaauaau

SEQ ID NO: 3287743 - RNA, 20 nt, Variola virus
auacugcaauaauuuucaaa

SEQ ID NO: 3287744 - RNA, 20 nt, Variola virus
uucuuggauauagaauccaa

SEQ ID NO: 3287745 - RNA, 17 nt, Variola virus
gugaggaaauaaaucau

SEQ ID NO: 3287746 - RNA, 20 nt, Variola virus
ucaucaugauccuauucuaa

SEQ ID NO: 3287747 - RNA, 14 nt, Variola virus
agaauaucucuaac

SEQ ID NO: 3287748 - RNA, 16 nt, Variola virus
uuauugucuucuuaaa

SEQ ID NO: 3287749 - RNA, 16 nt, Variola virus
cuuaguaaacagucca

SEQ ID NO: 3287750 - RNA, 17 nt, Variola virus
cguauauagaugucaau

SEQ ID NO: 3287751 - RNA, 22 nt, Variola virus
gaacucuaaucaaaaucuuaau

SEQ ID NO: 3287752 - RNA, 15 nt, Variola virus
aggcgcccauuucaa

SEQ ID NO: 3287753 - RNA, 18 nt, Variola virus
ucuugauuacaaaaccaa

SEQ ID NO: 3287754 - RNA, 12 nt, Variola virus
cgagacuauuau

SEQ ID NO: 3287755 - RNA, 15 nt, Variola virus
auuccaucuacuaag

SEQ ID NO: 3287756 - RNA, 19 nt, Variola virus
aauuauuagcaaaaauaua

SEQ ID NO: 3287757 - RNA, 17 nt, Variola virus
augcauuauccaaaaua

SEQ ID NO: 3287758 - RNA, 21 nt, Variola virus
uuuacccuuugacauuaaaaa

SEQ ID NO: 3287759 - RNA, 16 nt, Variola virus
uacacaauauaaacac

SEQ ID NO: 3287760 - RNA, 19 nt, Variola virus
guuauacgucauuucaucu

SEQ ID NO: 3287761 - RNA, 23 nt, Variola virus
uaguguaccaauaugcgaaucau

SEQ ID NO: 3287762 - RNA, 14 nt, Variola virus
uagauaucaaaaua

SEQ ID NO: 3287763 - RNA, 13 nt, Variola virus
ucaaugaauuaug

SEQ ID NO: 3287764 - RNA, 21 nt, Variola virus
agcauuagcuaaaaaaauagu

SEQ ID NO: 3287765 - RNA, 13 nt, Variola virus
gccucuagauaua

SEQ ID NO: 3287766 - RNA, 14 nt, Variola virus
uacuguuaaaugua

SEQ ID NO: 3287767 - RNA, 22 nt, Variola virus
cguguauuaaauagaauauuua

SEQ ID NO: 3287768 - RNA, 19 nt, Variola virus
acuggaucguuuagaauac

SEQ ID NO: 3287769 - RNA, 19 nt, Variola virus
acuugaaagagauaauaga

SEQ ID NO: 3287770 - RNA, 18 nt, Variola virus
gcaaauugucuauaucua

SEQ ID NO: 3287771 - RNA, 11 nt, Variola virus
uacuuaaugaa

SEQ ID NO: 3287772 - RNA, 16 nt, Variola virus
gaucagguaaaacaau

SEQ ID NO: 3287773 - RNA, 13 nt, Variola virus
aagauuaggaaau

SEQ ID NO: 3287774 - RNA, 13 nt, Variola virus
guguuuagauauu

SEQ ID NO: 3287775 - RNA, 18 nt, Variola virus
acucgaacagauaguuua

SEQ ID NO: 3287776 - RNA, 23 nt, Variola virus
aauuucucucaucuguaggauau

SEQ ID NO: 3287777 - RNA, 12 nt, Variola virus
auaucugaugau

SEQ ID NO: 3287778 - RNA, 18 nt, Variola virus
ucaacguagaaaaaauag

SEQ ID NO: 3287779 - RNA, 17 nt, Variola virus
ccauuagguuaaaugau

SEQ ID NO: 3287780 - RNA, 13 nt, Variola virus
aacuguagaauuc

SEQ ID NO: 3287781 - RNA, 17 nt, Variola virus
aauccuuuuuuauaaaa

SEQ ID NO: 3287782 - RNA, 18 nt, Variola virus
auaaacggguguaaacaa

SEQ ID NO: 3287783 - RNA, 23 nt, Variola virus
acaucuaaaaaauccuuaaugau

SEQ ID NO: 3287784 - RNA, 12 nt, Variola virus
guuaauaaucuc

SEQ ID NO: 3287785 - RNA, 21 nt, Variola virus
uucuagugcuuguauguguua

SEQ ID NO: 3287786 - RNA, 11 nt, Variola virus
cuuuuuaggaa

SEQ ID NO: 3287787 - RNA, 18 nt, Variola virus
gacuguacgauacauaau

SEQ ID NO: 3287788 - RNA, 13 nt, Variola virus
uauauuaaaguca

SEQ ID NO: 3287789 - RNA, 14 nt, Variola virus
cagaggaacgccau

SEQ ID NO: 3287790 - RNA, 18 nt, Variola virus
auaacauuuuuuguaaau

SEQ ID NO: 3287791 - RNA, 14 nt, Variola virus
auaaagaaugaaug

SEQ ID NO: 3287792 - RNA, 21 nt, Variola virus
uacaauccuucguuaucucug

SEQ ID NO: 3287793 - RNA, 22 nt, Variola virus
caguugcgaacaacaacaaaau

SEQ ID NO: 3287794 - RNA, 21 nt, Variola virus
accaaguuaaauuuuacuuua

SEQ ID NO: 3287795 - RNA, 20 nt, Variola virus
gucgaauaacuguaauuuua

SEQ ID NO: 3287796 - RNA, 16 nt, Variola virus
gcauauuaguauauaa

SEQ ID NO: 3287797 - RNA, 13 nt, Variola virus
uguucgaggauau

SEQ ID NO: 3287798 - RNA, 11 nt, Variola virus
gaaaauacuua

SEQ ID NO: 3287799 - RNA, 21 nt, Variola virus
auaacagagccaucuguaaaa

SEQ ID NO: 3287800 - RNA, 12 nt, Variola virus
aauuuuucuuaa

SEQ ID NO: 3287801 - RNA, 21 nt, Variola virus
aacucauuuaaauaucauaau

SEQ ID NO: 3287802 - RNA, 15 nt, Variola virus
cauauuucauuucca

SEQ ID NO: 3287803 - RNA, 14 nt, Variola virus
ucaaagauuugaga

SEQ ID NO: 3287804 - RNA, 16 nt, Variola virus
agagaccgauaccuau

SEQ ID NO: 3287805 - RNA, 15 nt, Variola virus
ccgaaaauauugugu

SEQ ID NO: 3287806 - RNA, 17 nt, Variola virus
agaaccacgaaacuaau

SEQ ID NO: 3287807 - RNA, 22 nt, Variola virus
agaaucaagcuaggcuggaaac

SEQ ID NO: 3287808 - RNA, 21 nt, Variola virus
ugaaaacuaaaugguauacac

SEQ ID NO: 3287809 - RNA, 15 nt, Variola virus
cuuuugugaaaagau

SEQ ID NO: 3287810 - RNA, 16 nt, Variola virus
auaaaguuuauacaag

SEQ ID NO: 3287811 - RNA, 14 nt, Variola virus
aucauaaguuuaua

SEQ ID NO: 3287812 - RNA, 14 nt, Variola virus
auaugcucuagaua

SEQ ID NO: 3287813 - RNA, 18 nt, Variola virus
augcacagcgaagaauuc

SEQ ID NO: 3287814 - RNA, 16 nt, Variola virus
uauguuuuguauacau

SEQ ID NO: 3287815 - RNA, 22 nt, Variola virus
agucaccaaauuuuacaaaaaa

SEQ ID NO: 3287816 - RNA, 22 nt, Variola virus
agaugugauuuuaucaaacaug

SEQ ID NO: 3287817 - RNA, 19 nt, Variola virus
agauuaauuuugaauuugu

SEQ ID NO: 3287818 - RNA, 20 nt, Variola virus
gaaguuuucccaaaaaauau

SEQ ID NO: 3287819 - RNA, 12 nt, Variola virus
gucuacaucauc

SEQ ID NO: 3287820 - RNA, 18 nt, Variola virus
gcucgaaucauacaaaaa

SEQ ID NO: 3287821 - RNA, 15 nt, Variola virus
uaagauuaagugcua

SEQ ID NO: 3287822 - RNA, 16 nt, Variola virus
auuuucacaaauacua

SEQ ID NO: 3287823 - RNA, 21 nt, Variola virus
guagauuuuucaauuaugcau

SEQ ID NO: 3287824 - RNA, 19 nt, Variola virus
ugccgguauugguauacag

SEQ ID NO: 3287825 - RNA, 15 nt, Variola virus
auuuuauauacuuuu

SEQ ID NO: 3287826 - RNA, 21 nt, Variola virus
auguauuuuuuucuaaauaua

SEQ ID NO: 3287827 - RNA, 16 nt, Variola virus
uauugcauauaucucu

SEQ ID NO: 3287828 - RNA, 20 nt, Variola virus
ucauuuacuaaggaguaaaa

SEQ ID NO: 3287829 - RNA, 12 nt, Variola virus
uaaaaauauguu

SEQ ID NO: 3287830 - RNA, 20 nt, Variola virus
accgacaucacuucagaaau

SEQ ID NO: 3287831 - RNA, 15 nt, Variola virus
agucaaacauucaac

SEQ ID NO: 3287832 - RNA, 21 nt, Variola virus
uaacggaugaaaauaagaaaa

SEQ ID NO: 3287833 - RNA, 15 nt, Variola virus
ucaagucaaagaaau

SEQ ID NO: 3287834 - RNA, 19 nt, Variola virus
uguaucaaacaguuuggua

SEQ ID NO: 3287835 - RNA, 16 nt, Variola virus
gcacugguuuaguuca

SEQ ID NO: 3287836 - RNA, 23 nt, Variola virus
ugaugaaucuucauuaucugaua

SEQ ID NO: 3287837 - RNA, 13 nt, Variola virus
uaucuucuaaaaa

SEQ ID NO: 3287838 - RNA, 23 nt, Variola virus
cuacacuaaaaugauuaaacaau

SEQ ID NO: 3287839 - RNA, 19 nt, Variola virus
acacuuugauuucuuaucu

SEQ ID NO: 3287840 - RNA, 20 nt, Variola virus
uuauuaaauauuuuuggaca

SEQ ID NO: 3287841 - RNA, 16 nt, Variola virus
uuggaucagucucuaa

SEQ ID NO: 3287842 - RNA, 15 nt, Variola virus
guaaauaaauacuuu

SEQ ID NO: 3287843 - RNA, 17 nt, Variola virus
uguuuaucuauacuauu

SEQ ID NO: 3287844 - RNA, 15 nt, Variola virus
aaaaugauagaaaua

SEQ ID NO: 3287845 - RNA, 18 nt, Variola virus
acuacuuacauggacaca

SEQ ID NO: 3287846 - RNA, 19 nt, Variola virus
auaggauuaacaacaaugu

SEQ ID NO: 3287847 - RNA, 14 nt, Variola virus
cgcugauuuaacua

SEQ ID NO: 3287848 - RNA, 16 nt, Variola virus
guuaucugaugaaaga

SEQ ID NO: 3287849 - RNA, 14 nt, Variola virus
auucaguagcuaga

SEQ ID NO: 3287850 - RNA, 15 nt, Variola virus
aucuacaauauauau

SEQ ID NO: 3287851 - RNA, 16 nt, Variola virus
acuauguguuaaaaga

SEQ ID NO: 3287852 - RNA, 17 nt, Variola virus
guuagugaugaauaucu

SEQ ID NO: 3287853 - RNA, 17 nt, Variola virus
auacaaucguucaaacu

SEQ ID NO: 3287854 - RNA, 19 nt, Variola virus
agaucuauuccuauuuccu

SEQ ID NO: 3287855 - RNA, 15 nt, Variola virus
uaauugucuauaaau

SEQ ID NO: 3287856 - RNA, 13 nt, Variola virus
aaaauacauaaag

SEQ ID NO: 3287857 - RNA, 18 nt, Variola virus
auuaauauuuaguaauua

SEQ ID NO: 3287858 - RNA, 19 nt, Variola virus
uccaugauucuaucucuaa

SEQ ID NO: 3287859 - RNA, 20 nt, Variola virus
cugauuuauguuuuaaauau

SEQ ID NO: 3287860 - RNA, 15 nt, Variola virus
uccaacuccuuuucg

SEQ ID NO: 3287861 - RNA, 14 nt, Variola virus
caauaaauguccaa

SEQ ID NO: 3287862 - RNA, 17 nt, Variola virus
gaauagguuuuugaauu

SEQ ID NO: 3287863 - RNA, 15 nt, Variola virus
uaucauccaauauua

SEQ ID NO: 3287864 - RNA, 20 nt, Variola virus
ugauuaaugugugacacauu

SEQ ID NO: 3287865 - RNA, 23 nt, Variola virus
aucagugauagacuagaagaaag

SEQ ID NO: 3287866 - RNA, 13 nt, Variola virus
auuauugcauaua

SEQ ID NO: 3287867 - RNA, 16 nt, Variola virus
caauguaaaguaucua

SEQ ID NO: 3287868 - RNA, 17 nt, Variola virus
cccgcuucuauuuacuc

SEQ ID NO: 3287869 - RNA, 16 nt, Variola virus
uaaaucaacagaaguu

SEQ ID NO: 3287870 - RNA, 13 nt, Variola virus
cuagucagaacua

SEQ ID NO: 3287871 - RNA, 18 nt, Variola virus
agacgauuaguaauauau

SEQ ID NO: 3287872 - RNA, 22 nt, Variola virus
aaaguaucuuauauacacagua

SEQ ID NO: 3287873 - RNA, 20 nt, Variola virus
cuuuuaguaacguaugugaa

SEQ ID NO: 3287874 - RNA, 22 nt, Variola virus
uauaaaccgcuauugaaacuga

SEQ ID NO: 3287875 - RNA, 16 nt, Variola virus
uuugguagauucuauu

SEQ ID NO: 3287876 - RNA, 15 nt, Variola virus
ccaaacuguaaaugu

SEQ ID NO: 3287877 - RNA, 15 nt, Variola virus
uccaugaucaagaag

SEQ ID NO: 3287878 - RNA, 19 nt, Variola virus
gauuauaaauaucgauguu

SEQ ID NO: 3287879 - RNA, 13 nt, Variola virus
gaacuauauuaag

SEQ ID NO: 3287880 - RNA, 22 nt, Variola virus
auuaccaggguucuuguuauau

SEQ ID NO: 3287881 - RNA, 13 nt, Variola virus
uauauaacucauu

SEQ ID NO: 3287882 - RNA, 12 nt, Variola virus
gaaaaaguaaau

SEQ ID NO: 3287883 - RNA, 20 nt, Variola virus
aaauaucgauguuaauaaca

SEQ ID NO: 3287884 - RNA, 20 nt, Variola virus
uggaaagauaucagauaagu

SEQ ID NO: 3287885 - RNA, 21 nt, Variola virus
aucuuaauccuucuagaauua

SEQ ID NO: 3287886 - RNA, 18 nt, Variola virus
uauaaaaacauuauucua

SEQ ID NO: 3287887 - RNA, 14 nt, Variola virus
augagagucaauau

SEQ ID NO: 3287888 - RNA, 15 nt, Variola virus
ucucugacauucaga

SEQ ID NO: 3287889 - RNA, 13 nt, Variola virus
uguauaugugauc

SEQ ID NO: 3287890 - RNA, 15 nt, Variola virus
ucaucaauagacaua

SEQ ID NO: 3287891 - RNA, 17 nt, Variola virus
agauuuaucauauuucu

SEQ ID NO: 3287892 - RNA, 14 nt, Variola virus
uuaacuuacuuauu

SEQ ID NO: 3287893 - RNA, 20 nt, Variola virus
aucagcauccacucauauag

SEQ ID NO: 3287894 - RNA, 13 nt, Variola virus
uauuuccauaaua

SEQ ID NO: 3287895 - RNA, 18 nt, Variola virus
auuauuaucuuuagaaau

SEQ ID NO: 3287896 - RNA, 16 nt, Variola virus
uauauauccuuuugua

SEQ ID NO: 3287897 - RNA, 21 nt, Variola virus
aacuauauauuuguauagaua

SEQ ID NO: 3287898 - RNA, 14 nt, Variola virus
aacaucuuuaaucu

SEQ ID NO: 3287899 - RNA, 14 nt, Variola virus
uguaggaaaaagau

SEQ ID NO: 3287900 - RNA, 24 nt, Variola virus
uuucaagaucuaauauucuagauu

SEQ ID NO: 3287901 - RNA, 18 nt, Variola virus
caauagaugauagaauau

SEQ ID NO: 3287902 - RNA, 16 nt, Variola virus
cucccauaauacuuua

SEQ ID NO: 3287903 - RNA, 19 nt, Variola virus
gugcacuuuuuuauaaaga

SEQ ID NO: 3287904 - RNA, 13 nt, Variola virus
uucugaauuauug

SEQ ID NO: 3287905 - RNA, 19 nt, Variola virus
aagacaugauaauauuaaa

SEQ ID NO: 3287906 - RNA, 12 nt, Variola virus
guuaauuuuacu

SEQ ID NO: 3287907 - RNA, 17 nt, Variola virus
uaucuugguaauacuua

SEQ ID NO: 3287908 - RNA, 19 nt, Variola virus
uugcucaaauaauacuaua

SEQ ID NO: 3287909 - RNA, 12 nt, Variola virus
aagaaaugagug

SEQ ID NO: 3287910 - RNA, 17 nt, Variola virus
acaguaucauuuaaaca

SEQ ID NO: 3287911 - RNA, 12 nt, Variola virus
uaagauacugug

SEQ ID NO: 3287912 - RNA, 17 nt, Variola virus
agaaaacucguuauuaa

SEQ ID NO: 3287913 - RNA, 18 nt, Variola virus
auuuaaguagagaauguu

SEQ ID NO: 3287914 - RNA, 19 nt, Variola virus
ggcaauaacuaaaaaugua

SEQ ID NO: 3287915 - RNA, 19 nt, Variola virus
aguguaauaauuuauguau

SEQ ID NO: 3287916 - RNA, 13 nt, Variola virus
aacaacuguaaaa

SEQ ID NO: 3287917 - RNA, 14 nt, Variola virus
uucaucuuggauga

SEQ ID NO: 3287918 - RNA, 19 nt, Variola virus
uuuauaaacuuaacccauu

SEQ ID NO: 3287919 - RNA, 19 nt, Variola virus
aagccgucuuuucugaagu

SEQ ID NO: 3287920 - RNA, 21 nt, Variola virus
aaaacauuauucuauuucgaa

SEQ ID NO: 3287921 - RNA, 22 nt, Variola virus
ccacuagaagagaauacacaug

SEQ ID NO: 3287922 - RNA, 21 nt, Variola virus
uauaugguauagggagaguau

SEQ ID NO: 3287923 - RNA, 16 nt, Variola virus
ggacagcuauauucuc

SEQ ID NO: 3287924 - RNA, 23 nt, Variola virus
gagaacauacauuuguaaaagua

SEQ ID NO: 3287925 - RNA, 20 nt, Variola virus
cucaucuacaaaaacauacu

SEQ ID NO: 3287926 - RNA, 15 nt, Variola virus
guaaaaauaaaucac

SEQ ID NO: 3287927 - RNA, 14 nt, Variola virus
uaaaguguaugucu

SEQ ID NO: 3287928 - RNA, 20 nt, Variola virus
auaaauuaggagauaaucua

SEQ ID NO: 3287929 - RNA, 21 nt, Variola virus
auaucuaucgacuucagauga

SEQ ID NO: 3287930 - RNA, 16 nt, Variola virus
uaacauaaacauauca

SEQ ID NO: 3287931 - RNA, 15 nt, Variola virus
ccaacugauuaauaa

SEQ ID NO: 3287932 - RNA, 12 nt, Variola virus
auggaaaggaaa

SEQ ID NO: 3287933 - RNA, 13 nt, Variola virus
uaaaguuaucaug

SEQ ID NO: 3287934 - RNA, 22 nt, Variola virus
uaacguuccuaauucucucauu

SEQ ID NO: 3287935 - RNA, 17 nt, Variola virus
uaugacaaaguuuacau

SEQ ID NO: 3287936 - RNA, 23 nt, Variola virus
acaaaguacuguucauacaugau

SEQ ID NO: 3287937 - RNA, 12 nt, Variola virus
accaaugucucu

SEQ ID NO: 3287938 - RNA, 17 nt, Variola virus
agugggacaaagaaaau

SEQ ID NO: 3287939 - RNA, 22 nt, Variola virus
gcuuccagauacagugauuuug

SEQ ID NO: 3287940 - RNA, 22 nt, Variola virus
aacaucguaucuucaaaaaggu

SEQ ID NO: 3287941 - RNA, 17 nt, Variola virus
augaagaguacacagaa

SEQ ID NO: 3287942 - RNA, 21 nt, Variola virus
uaagaacuccuaauauguucg

SEQ ID NO: 3287943 - RNA, 19 nt, Variola virus
uauuuacaucuaauuuacu

SEQ ID NO: 3287944 - RNA, 15 nt, Variola virus
gauguuauuaugaau

SEQ ID NO: 3287945 - RNA, 22 nt, Variola virus
cucuauuuugucauuaacuuua

SEQ ID NO: 3287946 - RNA, 15 nt, Variola virus
acuaacacauuucaa

SEQ ID NO: 3287947 - RNA, 11 nt, Variola virus
guuaucuuuug

SEQ ID NO: 3287948 - RNA, 13 nt, Variola virus
acagacucauuau

SEQ ID NO: 3287949 - RNA, 15 nt, Variola virus
acgaugaaaaugaug

SEQ ID NO: 3287950 - RNA, 21 nt, Variola virus
acaaucaaaccuauaacauua

SEQ ID NO: 3287951 - RNA, 22 nt, Variola virus
ugaaccaguaccagaucuuaau

SEQ ID NO: 3287952 - RNA, 14 nt, Variola virus
acuacuucauuaau

SEQ ID NO: 3287953 - RNA, 23 nt, Variola virus
uguagauaauaacuaaaaaucaa

SEQ ID NO: 3287954 - RNA, 15 nt, Variola virus
agaaacuuuuucgaa

SEQ ID NO: 3287955 - RNA, 14 nt, Variola virus
acauuccuaugaug

SEQ ID NO: 3287956 - RNA, 17 nt, Variola virus
ccauauaucuguaucau

SEQ ID NO: 3287957 - RNA, 19 nt, Variola virus
auaacuuugacaaauauua

SEQ ID NO: 3287958 - RNA, 22 nt, Variola virus
caauagcaucgcaacuauucua

SEQ ID NO: 3287959 - RNA, 21 nt, Variola virus
ucaagcuaggcuggaaacuau

SEQ ID NO: 3287960 - RNA, 16 nt, Variola virus
gaaggagauacuauca

SEQ ID NO: 3287961 - RNA, 21 nt, Variola virus
ccaucguaauacccauguuua

SEQ ID NO: 3287962 - RNA, 20 nt, Variola virus
cauaauguaaagauauucua

SEQ ID NO: 3287963 - RNA, 13 nt, Variola virus
ugauguucauaua

SEQ ID NO: 3287964 - RNA, 17 nt, Variola virus
caaaaguagaugguauu

SEQ ID NO: 3287965 - RNA, 21 nt, Variola virus
caaaugauacugauaaaguag

SEQ ID NO: 3287966 - RNA, 15 nt, Variola virus
uacgcgcacacaaua

SEQ ID NO: 3287967 - RNA, 13 nt, Variola virus
cauuuauacauau

SEQ ID NO: 3287968 - RNA, 13 nt, Variola virus
uggaaauguuaua

SEQ ID NO: 3287969 - RNA, 23 nt, Variola virus
uaaaauuauuuaauuuaauacau

SEQ ID NO: 3287970 - RNA, 14 nt, Variola virus
uagacuuguuaaua

SEQ ID NO: 3287971 - RNA, 14 nt, Variola virus
auaagaaacuauaa

SEQ ID NO: 3287972 - RNA, 14 nt, Variola virus
uuaguaaggcuuua

SEQ ID NO: 3287973 - RNA, 21 nt, Variola virus
auuucauagacuuuaucuaga

SEQ ID NO: 3287974 - RNA, 22 nt, Variola virus
uggcggaguaaguguugagcuc

SEQ ID NO: 3287975 - RNA, 17 nt, Variola virus
auaacacuaauuuguaa

SEQ ID NO: 3287976 - RNA, 13 nt, Variola virus
aacuguucaaaau

SEQ ID NO: 3287977 - RNA, 18 nt, Variola virus
uuuucaucuuuacauacu

SEQ ID NO: 3287978 - RNA, 14 nt, Variola virus
uaaaauuaaacauu

SEQ ID NO: 3287979 - RNA, 18 nt, Variola virus
aaugguuucgaagaucuu

SEQ ID NO: 3287980 - RNA, 20 nt, Variola virus
ucuacuacacuucuagauau

SEQ ID NO: 3287981 - RNA, 17 nt, Variola virus
gucuuuucugaaguagg

SEQ ID NO: 3287982 - RNA, 14 nt, Variola virus
auaaugauauauau

SEQ ID NO: 3287983 - RNA, 18 nt, Variola virus
gauaaucagccauaauua

SEQ ID NO: 3287984 - RNA, 12 nt, Variola virus
ugauaauaacuu

SEQ ID NO: 3287985 - RNA, 14 nt, Variola virus
agagauaauauccu

SEQ ID NO: 3287986 - RNA, 21 nt, Variola virus
gcuccuacaggaauaucuuua

SEQ ID NO: 3287987 - RNA, 15 nt, Variola virus
caacugaaaaaguua

SEQ ID NO: 3287988 - RNA, 20 nt, Variola virus
uucuuaccagauauuauaca

SEQ ID NO: 3287989 - RNA, 11 nt, Variola virus
gauguauauau

SEQ ID NO: 3287990 - RNA, 14 nt, Variola virus
uuauauacaucuuc

SEQ ID NO: 3287991 - RNA, 17 nt, Variola virus
augaauaucaggaaaug

SEQ ID NO: 3287992 - RNA, 14 nt, Variola virus
uauauaagacguau

SEQ ID NO: 3287993 - RNA, 22 nt, Variola virus
uuucuagaauaaguuucaagau

SEQ ID NO: 3287994 - RNA, 13 nt, Variola virus
agcagaaaaagac

SEQ ID NO: 3287995 - RNA, 14 nt, Variola virus
uaaacgaacuauau

SEQ ID NO: 3287996 - RNA, 22 nt, Variola virus
ucgaauaaguuugcagacaaac

SEQ ID NO: 3287997 - RNA, 16 nt, Variola virus
cguccaucagcauugu

SEQ ID NO: 3287998 - RNA, 23 nt, Variola virus
ucaaacaaaaaagcucaauaaga

SEQ ID NO: 3287999 - RNA, 20 nt, Variola virus
acaugucgccgacaugaaug

SEQ ID NO: 3288000 - RNA, 22 nt, Variola virus
auaugcaucuauauaaucuuuu

SEQ ID NO: 3288001 - RNA, 13 nt, Variola virus
uuacuugugguaa

SEQ ID NO: 3288002 - RNA, 14 nt, Variola virus
ucauuauaaauucu

SEQ ID NO: 3288003 - RNA, 14 nt, Variola virus
acaugauuaauaca

SEQ ID NO: 3288004 - RNA, 12 nt, Variola virus
aggauaauacau

SEQ ID NO: 3288005 - RNA, 15 nt, Variola virus
aaugcauuaaauaau

SEQ ID NO: 3288006 - RNA, 15 nt, Variola virus
cucuauaaaauacua

SEQ ID NO: 3288007 - RNA, 20 nt, Variola virus
aucuauaucugacacaagau

SEQ ID NO: 3288008 - RNA, 20 nt, Variola virus
uuuuauauccaauguauuua

SEQ ID NO: 3288009 - RNA, 23 nt, Variola virus
acaaaaguaguauagcaauacaa

SEQ ID NO: 3288010 - RNA, 18 nt, Variola virus
gauccugcauagaaauau

SEQ ID NO: 3288011 - RNA, 18 nt, Variola virus
auaacagcauuuguguag

SEQ ID NO: 3288012 - RNA, 20 nt, Variola virus
uguacuacaaacaggcgaug

SEQ ID NO: 3288013 - RNA, 17 nt, Variola virus
guuauaauuaugaugau

SEQ ID NO: 3288014 - RNA, 16 nt, Variola virus
uagguuguaauacaua

SEQ ID NO: 3288015 - RNA, 14 nt, Variola virus
ucuuuauacaauga

SEQ ID NO: 3288016 - RNA, 19 nt, Variola virus
agagucauuaaaauaugcg

SEQ ID NO: 3288017 - RNA, 19 nt, Variola virus
accaucugugguacgaaug

SEQ ID NO: 3288018 - RNA, 12 nt, Variola virus
uagauaaaucaa

SEQ ID NO: 3288019 - RNA, 13 nt, Variola virus
uuuauucuagaau

SEQ ID NO: 3288020 - RNA, 14 nt, Variola virus
uucuaguuaucaug

SEQ ID NO: 3288021 - RNA, 21 nt, Variola virus
uaguaaguagaaauuaucaaa

SEQ ID NO: 3288022 - RNA, 20 nt, Variola virus
uuauccguauuuccauaaua

SEQ ID NO: 3288023 - RNA, 16 nt, Variola virus
gauaaugguacucuag

SEQ ID NO: 3288024 - RNA, 19 nt, Variola virus
ggaaugccacgaauaaaaa

SEQ ID NO: 3288025 - RNA, 12 nt, Variola virus
uccauaggaaag

SEQ ID NO: 3288026 - RNA, 19 nt, Variola virus
aaaauuguugaucauauag

SEQ ID NO: 3288027 - RNA, 14 nt, Variola virus
ucaauaauuucagg

SEQ ID NO: 3288028 - RNA, 24 nt, Variola virus
agucuagagucuuugcaaacauaa

SEQ ID NO: 3288029 - RNA, 13 nt, Variola virus
auuagaaauggau

SEQ ID NO: 3288030 - RNA, 20 nt, Variola virus
gaauucauccguccuucaga

SEQ ID NO: 3288031 - RNA, 15 nt, Variola virus
auaacuuacuuucca

SEQ ID NO: 3288032 - RNA, 12 nt, Variola virus
uaaaauaguucu

SEQ ID NO: 3288033 - RNA, 18 nt, Variola virus
uguauauaauaguuucua

SEQ ID NO: 3288034 - RNA, 13 nt, Variola virus
uauguaugugcau

SEQ ID NO: 3288035 - RNA, 15 nt, Variola virus
ucauauuauagauuu

SEQ ID NO: 3288036 - RNA, 15 nt, Variola virus
aguuaauauauuuaa

SEQ ID NO: 3288037 - RNA, 19 nt, Variola virus
guuugaugcgauucaaaaa

SEQ ID NO: 3288038 - RNA, 16 nt, Variola virus
gucaaucuaauauuaa

SEQ ID NO: 3288039 - RNA, 17 nt, Variola virus
accuaagcaagaaagau

SEQ ID NO: 3288040 - RNA, 17 nt, Variola virus
uaauauccaaucuuauu

SEQ ID NO: 3288041 - RNA, 18 nt, Variola virus
auuauuaaucauuaacuu

SEQ ID NO: 3288042 - RNA, 17 nt, Variola virus
gcuggaaaauaaaucac

SEQ ID NO: 3288043 - RNA, 16 nt, Variola virus
aacauucuuucaaaga

SEQ ID NO: 3288044 - RNA, 13 nt, Variola virus
aauuuuaacagau

SEQ ID NO: 3288045 - RNA, 15 nt, Variola virus
uuaaccgauaauaga

SEQ ID NO: 3288046 - RNA, 19 nt, Variola virus
gcaucugauacaacaauau

SEQ ID NO: 3288047 - RNA, 21 nt, Variola virus
auaucgguaccguuaaagaug

SEQ ID NO: 3288048 - RNA, 16 nt, Variola virus
uacuggauucauacau

SEQ ID NO: 3288049 - RNA, 16 nt, Variola virus
ucuucaaaugaaguag

SEQ ID NO: 3288050 - RNA, 19 nt, Variola virus
uuuuaucaaccauucaaaa

SEQ ID NO: 3288051 - RNA, 13 nt, Variola virus
aaaaguuaaaacu

SEQ ID NO: 3288052 - RNA, 15 nt, Variola virus
ucuucuacaugaaga

SEQ ID NO: 3288053 - RNA, 21 nt, Variola virus
ucaacauaaugucauaguuga

SEQ ID NO: 3288054 - RNA, 24 nt, Variola virus
aggaagaggaaauauucaguauau

SEQ ID NO: 3288055 - RNA, 14 nt, Variola virus
ucuacaugaaauag

SEQ ID NO: 3288056 - RNA, 15 nt, Variola virus
auuauacuuugguaa

SEQ ID NO: 3288057 - RNA, 14 nt, Variola virus
auuuagcaaaauuc

SEQ ID NO: 3288058 - RNA, 16 nt, Variola virus
agauacuaucaaaaua

SEQ ID NO: 3288059 - RNA, 22 nt, Variola virus
accggacgacauauuaaucuuu

SEQ ID NO: 3288060 - RNA, 16 nt, Variola virus
agagaagcaaaugaug

SEQ ID NO: 3288061 - RNA, 14 nt, Variola virus
gaauagauauuaau

SEQ ID NO: 3288062 - RNA, 17 nt, Variola virus
auuuugaagauauagau

SEQ ID NO: 3288063 - RNA, 19 nt, Variola virus
aguaguuuaacuagucuuc

SEQ ID NO: 3288064 - RNA, 19 nt, Variola virus
aucucuucaucuguaaguu

SEQ ID NO: 3288065 - RNA, 20 nt, Variola virus
uacagagacuuuaucuaaau

SEQ ID NO: 3288066 - RNA, 21 nt, Variola virus
auaaaccaaaagcuuucuagu

SEQ ID NO: 3288067 - RNA, 14 nt, Variola virus
aacaacuaaaaugu

SEQ ID NO: 3288068 - RNA, 13 nt, Variola virus
acuagaagaaagu

SEQ ID NO: 3288069 - RNA, 18 nt, Variola virus
uuuuuuagauguaguauc

SEQ ID NO: 3288070 - RNA, 16 nt, Variola virus
aauagcauaaaugcua

SEQ ID NO: 3288071 - RNA, 21 nt, Variola virus
uuauuuuuugguauaauucua

SEQ ID NO: 3288072 - RNA, 23 nt, Variola virus
caucguauacuuuuuaauucucu

SEQ ID NO: 3288073 - RNA, 19 nt, Variola virus
aggauuauaugauauaauu

SEQ ID NO: 3288074 - RNA, 16 nt, Variola virus
uuuguucuuguagaua

SEQ ID NO: 3288075 - RNA, 22 nt, Variola virus
auaacuuuaccccaaucagaua

SEQ ID NO: 3288076 - RNA, 22 nt, Variola virus
uuucuggaaguggauauacaua

SEQ ID NO: 3288077 - RNA, 20 nt, Variola virus
ugguauccuggcgaauauua

SEQ ID NO: 3288078 - RNA, 14 nt, Variola virus
guauuaugaugaau

SEQ ID NO: 3288079 - RNA, 14 nt, Variola virus
caacaaauuuggaa

SEQ ID NO: 3288080 - RNA, 17 nt, Variola virus
auaauaggaggaauuga

SEQ ID NO: 3288081 - RNA, 20 nt, Variola virus
uuagaaggauuggucuuaaa

SEQ ID NO: 3288082 - RNA, 17 nt, Variola virus
aagacuaugucaaagua

SEQ ID NO: 3288083 - RNA, 19 nt, Variola virus
caucaaccgaguuguuaau

SEQ ID NO: 3288084 - RNA, 14 nt, Variola virus
aagauuguguagaa

SEQ ID NO: 3288085 - RNA, 19 nt, Variola virus
auaucauauauauacugaa

SEQ ID NO: 3288086 - RNA, 15 nt, Variola virus
gcaucuucacaaauu

SEQ ID NO: 3288087 - RNA, 20 nt, Variola virus
aguuuuauauccuuuagagu

SEQ ID NO: 3288088 - RNA, 20 nt, Variola virus
guuaaauguugguauaucaa

SEQ ID NO: 3288089 - RNA, 15 nt, Variola virus
aauacacacaaagua

SEQ ID NO: 3288090 - RNA, 13 nt, Variola virus
cguuguuaagaua

SEQ ID NO: 3288091 - RNA, 15 nt, Variola virus
acagacaucacagac

SEQ ID NO: 3288092 - RNA, 14 nt, Variola virus
aaauauuuacuaau

SEQ ID NO: 3288093 - RNA, 17 nt, Variola virus
cauuccuaugaugaugu

SEQ ID NO: 3288094 - RNA, 14 nt, Variola virus
auaguaaaauaaag

SEQ ID NO: 3288095 - RNA, 18 nt, Variola virus
cagaaguuuuguauugua

SEQ ID NO: 3288096 - RNA, 17 nt, Variola virus
agaaauaauauaaauga

SEQ ID NO: 3288097 - RNA, 13 nt, Variola virus
aagauaaugugaa

SEQ ID NO: 3288098 - RNA, 14 nt, Variola virus
cguccgauuucaua

SEQ ID NO: 3288099 - RNA, 18 nt, Variola virus
cagauuuugauauucuau

SEQ ID NO: 3288100 - RNA, 13 nt, Variola virus
auagauguauaua

SEQ ID NO: 3288101 - RNA, 22 nt, Variola virus
guuacacgcauccuuauaaaga

SEQ ID NO: 3288102 - RNA, 20 nt, Variola virus
cagcaacuucuguacuagug

SEQ ID NO: 3288103 - RNA, 14 nt, Variola virus
ugcugcguguauaa

SEQ ID NO: 3288104 - RNA, 15 nt, Variola virus
ucaucaucuucuggu

SEQ ID NO: 3288105 - RNA, 19 nt, Variola virus
cauaguaaaaaauauacau

SEQ ID NO: 3288106 - RNA, 15 nt, Variola virus
auagaaauuuuggua

SEQ ID NO: 3288107 - RNA, 17 nt, Variola virus
caaauguugucaaauga

SEQ ID NO: 3288108 - RNA, 22 nt, Variola virus
uaaucauguacucauaaaacga

SEQ ID NO: 3288109 - RNA, 17 nt, Variola virus
uguuauuaugaaucauu

SEQ ID NO: 3288110 - RNA, 18 nt, Variola virus
uaaacaagcuaucucuug

SEQ ID NO: 3288111 - RNA, 23 nt, Variola virus
acgaaucauccauaaauuauacu

SEQ ID NO: 3288112 - RNA, 17 nt, Variola virus
uaaaacuuuauuaucca

SEQ ID NO: 3288113 - RNA, 20 nt, Variola virus
auuaucuuuguuuugauauc

SEQ ID NO: 3288114 - RNA, 20 nt, Variola virus
auguuuaauguuuuaaauuu

SEQ ID NO: 3288115 - RNA, 23 nt, Variola virus
aagaaacugacuugauaaaaaug

SEQ ID NO: 3288116 - RNA, 19 nt, Variola virus
auuuuuauucagcauuacu

SEQ ID NO: 3288117 - RNA, 16 nt, Variola virus
uuccuucuauugaucu

SEQ ID NO: 3288118 - RNA, 13 nt, Variola virus
cauaauaucuuua

SEQ ID NO: 3288119 - RNA, 12 nt, Variola virus
uuaaauauuucu

SEQ ID NO: 3288120 - RNA, 16 nt, Variola virus
ucuuauccauuucgaa

SEQ ID NO: 3288121 - RNA, 17 nt, Variola virus
auaaacaacuaaaaugu

SEQ ID NO: 3288122 - RNA, 14 nt, Variola virus
aucaaucaaaagac

SEQ ID NO: 3288123 - RNA, 17 nt, Variola virus
agcaucuucuucauuau

SEQ ID NO: 3288124 - RNA, 18 nt, Variola virus
caauuuuaacagauguau

SEQ ID NO: 3288125 - RNA, 17 nt, Variola virus
uaauagcauaaaugcua

SEQ ID NO: 3288126 - RNA, 14 nt, Variola virus
acuaaaauauuuua

SEQ ID NO: 3288127 - RNA, 23 nt, Variola virus
gaaagacgaauauuauaauacca

SEQ ID NO: 3288128 - RNA, 18 nt, Variola virus
ugauuguaaacacagaua

SEQ ID NO: 3288129 - RNA, 17 nt, Variola virus
augaaaaaaaacacuga

SEQ ID NO: 3288130 - RNA, 17 nt, Variola virus
uaauauugaaaauacua

SEQ ID NO: 3288131 - RNA, 13 nt, Variola virus
agacauaauacua

SEQ ID NO: 3288132 - RNA, 17 nt, Variola virus
uauuuauaccaugucaa

SEQ ID NO: 3288133 - RNA, 22 nt, Variola virus
ugacuuuccugccgaauuuaga

SEQ ID NO: 3288134 - RNA, 15 nt, Variola virus
auucgcauuucuaua

SEQ ID NO: 3288135 - RNA, 15 nt, Variola virus
uauuaagauuaucua

SEQ ID NO: 3288136 - RNA, 19 nt, Variola virus
uagauguauauauuucauu

SEQ ID NO: 3288137 - RNA, 15 nt, Variola virus
cauuaauccugucaa

SEQ ID NO: 3288138 - RNA, 16 nt, Variola virus
acuaaacuaacuccuu

SEQ ID NO: 3288139 - RNA, 14 nt, Variola virus
ggauagagaaauau

SEQ ID NO: 3288140 - RNA, 19 nt, Variola virus
gcuuuaauaucuaaauaug

SEQ ID NO: 3288141 - RNA, 16 nt, Variola virus
aauuacuaguaucaau

SEQ ID NO: 3288142 - RNA, 15 nt, Variola virus
auuggcuaguauuua

SEQ ID NO: 3288143 - RNA, 15 nt, Variola virus
acaaauucuuggaua

SEQ ID NO: 3288144 - RNA, 15 nt, Variola virus
cuaaacauauaacaa

SEQ ID NO: 3288145 - RNA, 19 nt, Variola virus
auuuugcauuagauuuacu

SEQ ID NO: 3288146 - RNA, 14 nt, Variola virus
aagauaaugugaau

SEQ ID NO: 3288147 - RNA, 11 nt, Variola virus
ucccagcauua

SEQ ID NO: 3288148 - RNA, 17 nt, Variola virus
aaaugaguucugugcag

SEQ ID NO: 3288149 - RNA, 14 nt, Variola virus
gaauaaauauccuu

SEQ ID NO: 3288150 - RNA, 16 nt, Variola virus
aguauugaaacuauau

SEQ ID NO: 3288151 - RNA, 22 nt, Variola virus
acauauuaguaacuguuuucca

SEQ ID NO: 3288152 - RNA, 23 nt, Variola virus
guaacuccagaacaucuuccaua

SEQ ID NO: 3288153 - RNA, 18 nt, Variola virus
cuuaauauugccauaauu

SEQ ID NO: 3288154 - RNA, 15 nt, Variola virus
aaaaagaauguauca

SEQ ID NO: 3288155 - RNA, 20 nt, Variola virus
cauauauguuuucaucauuu

SEQ ID NO: 3288156 - RNA, 20 nt, Variola virus
gacgcagauagcuauaugau

SEQ ID NO: 3288157 - RNA, 15 nt, Variola virus
gaaagauuaaaucau

SEQ ID NO: 3288158 - RNA, 14 nt, Variola virus
aauuuaaaauggua

SEQ ID NO: 3288159 - RNA, 14 nt, Variola virus
uuaacuaauaaaaa

SEQ ID NO: 3288160 - RNA, 17 nt, Variola virus
agacuacgaaacugaua

SEQ ID NO: 3288161 - RNA, 11 nt, Variola virus
uuuaacuuuuc

SEQ ID NO: 3288162 - RNA, 16 nt, Variola virus
auucaaaauauuaaac

SEQ ID NO: 3288163 - RNA, 12 nt, Variola virus
uuuccaaagaua

SEQ ID NO: 3288164 - RNA, 15 nt, Variola virus
uugaggauuuaaaac

SEQ ID NO: 3288165 - RNA, 22 nt, Variola virus
ucuccuuuucagaaauuaguuu

SEQ ID NO: 3288166 - RNA, 14 nt, Variola virus
cauucuaucucaaa

SEQ ID NO: 3288167 - RNA, 18 nt, Variola virus
guacaaacaggauaucua

SEQ ID NO: 3288168 - RNA, 18 nt, Variola virus
aaacugguuaaaacagua

SEQ ID NO: 3288169 - RNA, 18 nt, Variola virus
uagaaaaugauucacaau

SEQ ID NO: 3288170 - RNA, 14 nt, Variola virus
gcuccauauuacaa

SEQ ID NO: 3288171 - RNA, 14 nt, Variola virus
uauuuuuuauuaua

SEQ ID NO: 3288172 - RNA, 23 nt, Variola virus
acuaggaaauugguuuauaaugu

SEQ ID NO: 3288173 - RNA, 18 nt, Variola virus
uaucaucgacacaaauga

SEQ ID NO: 3288174 - RNA, 16 nt, Variola virus
uuaggauugacauagu

SEQ ID NO: 3288175 - RNA, 15 nt, Variola virus
uaacuuuucaaucau

SEQ ID NO: 3288176 - RNA, 20 nt, Variola virus
caucaacucucucauuuucu

SEQ ID NO: 3288177 - RNA, 19 nt, Variola virus
acgaaguauuuauacuuuu

SEQ ID NO: 3288178 - RNA, 16 nt, Variola virus
uacgcuuauuaucauc

SEQ ID NO: 3288179 - RNA, 19 nt, Variola virus
agacgcuauaucaaaauau

SEQ ID NO: 3288180 - RNA, 17 nt, Variola virus
ccuauaaacaugaauuu

SEQ ID NO: 3288181 - RNA, 19 nt, Variola virus
aaaucuucuuauaagauug

SEQ ID NO: 3288182 - RNA, 21 nt, Variola virus
ucaauggaccccaacaucuuu

SEQ ID NO: 3288183 - RNA, 18 nt, Variola virus
cauuuauaacguacaaau

SEQ ID NO: 3288184 - RNA, 13 nt, Variola virus
cuuugauuaauga

SEQ ID NO: 3288185 - RNA, 13 nt, Variola virus
aauugauucuuga

SEQ ID NO: 3288186 - RNA, 19 nt, Variola virus
aaccauucaaaaaaguaau

SEQ ID NO: 3288187 - RNA, 22 nt, Variola virus
uuuacgagcuauuaaacuguuu

SEQ ID NO: 3288188 - RNA, 22 nt, Variola virus
ugcuuuuaucaggauaaauaca

SEQ ID NO: 3288189 - RNA, 13 nt, Variola virus
aggagaaguaaua

SEQ ID NO: 3288190 - RNA, 17 nt, Variola virus
cugauuauucacuauaa

SEQ ID NO: 3288191 - RNA, 19 nt, Variola virus
caauguauauuuauacaga

SEQ ID NO: 3288192 - RNA, 20 nt, Variola virus
uguaaacaagaauauauguu

SEQ ID NO: 3288193 - RNA, 22 nt, Variola virus
ugcgaaccgauuaaacauaaau

SEQ ID NO: 3288194 - RNA, 17 nt, Variola virus
aaacuaguucugagaaa

SEQ ID NO: 3288195 - RNA, 18 nt, Variola virus
ucagaaauauauaacaau

SEQ ID NO: 3288196 - RNA, 14 nt, Variola virus
uaucgaauuucuac

SEQ ID NO: 3288197 - RNA, 19 nt, Variola virus
uaaccguuucaucaucauu

SEQ ID NO: 3288198 - RNA, 19 nt, Variola virus
aauacugaugcuuuuucca

SEQ ID NO: 3288199 - RNA, 16 nt, Variola virus
uuaacaaaguuauuca

SEQ ID NO: 3288200 - RNA, 22 nt, Variola virus
cuacaaaacagaaauaugugaa

SEQ ID NO: 3288201 - RNA, 14 nt, Variola virus
uauacaaaaaugca

SEQ ID NO: 3288202 - RNA, 14 nt, Variola virus
ccaacaauuguuua

SEQ ID NO: 3288203 - RNA, 20 nt, Variola virus
aguuucaucaauaaaggaua

SEQ ID NO: 3288204 - RNA, 11 nt, Variola virus
acuacauaucc

SEQ ID NO: 3288205 - RNA, 15 nt, Variola virus
uuguacauguaauga

SEQ ID NO: 3288206 - RNA, 21 nt, Variola virus
aacuuuuguuuuguuucugau

SEQ ID NO: 3288207 - RNA, 16 nt, Variola virus
aacuucuagucuagaa

SEQ ID NO: 3288208 - RNA, 20 nt, Variola virus
cauugauacacguucacuau

SEQ ID NO: 3288209 - RNA, 16 nt, Variola virus
aauaauucauggaaau

SEQ ID NO: 3288210 - RNA, 15 nt, Variola virus
agcaaccguaugaau

SEQ ID NO: 3288211 - RNA, 16 nt, Variola virus
augauugggaaccagu

SEQ ID NO: 3288212 - RNA, 21 nt, Variola virus
uaaacuugacaaaaauuguga

SEQ ID NO: 3288213 - RNA, 16 nt, Variola virus
cugaguuuuuaggaaa

SEQ ID NO: 3288214 - RNA, 22 nt, Variola virus
uuaacucggucgguuuaucuac

SEQ ID NO: 3288215 - RNA, 23 nt, Variola virus
uaacaucuggccuguucauaaau

SEQ ID NO: 3288216 - RNA, 19 nt, Variola virus
ucaucacuuagaacagauu

SEQ ID NO: 3288217 - RNA, 15 nt, Variola virus
gucaauugauucuua

SEQ ID NO: 3288218 - RNA, 12 nt, Variola virus
caaguuaaauag

SEQ ID NO: 3288219 - RNA, 19 nt, Variola virus
aaacuuagaaccaaaugau

SEQ ID NO: 3288220 - RNA, 18 nt, Variola virus
aucuauucauaugcaucu

SEQ ID NO: 3288221 - RNA, 14 nt, Variola virus
augauuauguuguu

SEQ ID NO: 3288222 - RNA, 16 nt, Variola virus
uuaacuagauuauaca

SEQ ID NO: 3288223 - RNA, 21 nt, Variola virus
aauuuauuucuaauucucaga

SEQ ID NO: 3288224 - RNA, 16 nt, Variola virus
gaguaggugcaacaau

SEQ ID NO: 3288225 - RNA, 18 nt, Variola virus
uaauggauauucugaaua

SEQ ID NO: 3288226 - RNA, 17 nt, Variola virus
acgcauaaaaaugccac

SEQ ID NO: 3288227 - RNA, 17 nt, Variola virus
gacgucucuucgugaau

SEQ ID NO: 3288228 - RNA, 16 nt, Variola virus
auaaauuaaauauuaa

SEQ ID NO: 3288229 - RNA, 18 nt, Variola virus
aacucaucuaccauuuca

SEQ ID NO: 3288230 - RNA, 22 nt, Variola virus
auuuccacauuagaugguaaau

SEQ ID NO: 3288231 - RNA, 18 nt, Variola virus
auaaccggcgcugucaug

SEQ ID NO: 3288232 - RNA, 14 nt, Variola virus
uagacauaauacua

SEQ ID NO: 3288233 - RNA, 16 nt, Variola virus
guuccggaucuauaga

SEQ ID NO: 3288234 - RNA, 13 nt, Variola virus
ucagaaauuauuc

SEQ ID NO: 3288235 - RNA, 22 nt, Variola virus
uauccaaggacaaggaugaaaa

SEQ ID NO: 3288236 - RNA, 21 nt, Variola virus
uauuuuaggaucauauuuaca

SEQ ID NO: 3288237 - RNA, 16 nt, Variola virus
ucauuuguguacccaa

SEQ ID NO: 3288238 - RNA, 21 nt, Variola virus
auuuaauuuuguaguuaauuu

SEQ ID NO: 3288239 - RNA, 19 nt, Variola virus
aggguauuggauauaucaa

SEQ ID NO: 3288240 - RNA, 16 nt, Variola virus
acuaguuguagaauuu

SEQ ID NO: 3288241 - RNA, 19 nt, Variola virus
auagauuucgaaaauacua

SEQ ID NO: 3288242 - RNA, 21 nt, Variola virus
guugaucagaaugaauguuua

SEQ ID NO: 3288243 - RNA, 20 nt, Variola virus
aggauacuuuaugaauggau

SEQ ID NO: 3288244 - RNA, 20 nt, Variola virus
acgauccaaacaauguuucu

SEQ ID NO: 3288245 - RNA, 13 nt, Variola virus
aauuauuuaccau

SEQ ID NO: 3288246 - RNA, 23 nt, Variola virus
gagcuaauuuuuguaaauaacua

SEQ ID NO: 3288247 - RNA, 20 nt, Variola virus
uguugugucaguuuauaaua

SEQ ID NO: 3288248 - RNA, 21 nt, Variola virus
acuaauucauuuucaauaaua

SEQ ID NO: 3288249 - RNA, 13 nt, Variola virus
uauaauaaaugua

SEQ ID NO: 3288250 - RNA, 18 nt, Variola virus
gugauguuacggauaucu

SEQ ID NO: 3288251 - RNA, 17 nt, Variola virus
uaucuuuauagaguaua

SEQ ID NO: 3288252 - RNA, 21 nt, Variola virus
gaaagauucuauaauaaugaa

SEQ ID NO: 3288253 - RNA, 14 nt, Variola virus
gacuauaacagaua

SEQ ID NO: 3288254 - RNA, 15 nt, Variola virus
ugcauuauccaaaau

SEQ ID NO: 3288255 - RNA, 14 nt, Variola virus
uauaaaaaacuuuu

SEQ ID NO: 3288256 - RNA, 23 nt, Variola virus
auuuucgaaacucguaaaaagau

SEQ ID NO: 3288257 - RNA, 16 nt, Variola virus
ucucaauauuuggauu

SEQ ID NO: 3288258 - RNA, 11 nt, Variola virus
auuaucaucug

SEQ ID NO: 3288259 - RNA, 13 nt, Variola virus
auauuuguaacuu

SEQ ID NO: 3288260 - RNA, 16 nt, Variola virus
acauccaaaauacaaa

SEQ ID NO: 3288261 - RNA, 16 nt, Variola virus
uuugauacccugauau

SEQ ID NO: 3288262 - RNA, 15 nt, Variola virus
aauucgagaaagaua

SEQ ID NO: 3288263 - RNA, 16 nt, Variola virus
uguuugauaauuacgc

SEQ ID NO: 3288264 - RNA, 20 nt, Variola virus
agaguaguaucauuaaaucu

SEQ ID NO: 3288265 - RNA, 21 nt, Variola virus
auacuuuguaaucuagacaua

SEQ ID NO: 3288266 - RNA, 22 nt, Variola virus
uguuuugaggcagcaaauacug

SEQ ID NO: 3288267 - RNA, 16 nt, Variola virus
aguuuuggaucaaaug

SEQ ID NO: 3288268 - RNA, 20 nt, Variola virus
uuggagacgucaucuguucu

SEQ ID NO: 3288269 - RNA, 21 nt, Variola virus
gucuauauaguauuuuucuga

SEQ ID NO: 3288270 - RNA, 22 nt, Variola virus
uauauaauuuuuggacaaaugu

SEQ ID NO: 3288271 - RNA, 22 nt, Variola virus
auauccgguguuaaaaaaauua

SEQ ID NO: 3288272 - RNA, 16 nt, Variola virus
cuacauuauuaaauca

SEQ ID NO: 3288273 - RNA, 22 nt, Variola virus
cuagauauagcuuuuauuucca

SEQ ID NO: 3288274 - RNA, 17 nt, Variola virus
aucuuuucacuaaauaa

SEQ ID NO: 3288275 - RNA, 16 nt, Variola virus
uagugaccaacucauc

SEQ ID NO: 3288276 - RNA, 14 nt, Variola virus
aacugcucuagauu

SEQ ID NO: 3288277 - RNA, 19 nt, Variola virus
auaugugguguuacaguua

SEQ ID NO: 3288278 - RNA, 23 nt, Variola virus
auucuucuuuaaacgauuuucca

SEQ ID NO: 3288279 - RNA, 15 nt, Variola virus
aucuauuuuaaauac

SEQ ID NO: 3288280 - RNA, 16 nt, Variola virus
auuugauuauuuugaa

SEQ ID NO: 3288281 - RNA, 13 nt, Variola virus
auucauaacgaga

SEQ ID NO: 3288282 - RNA, 15 nt, Variola virus
ucugacgacaaacag

SEQ ID NO: 3288283 - RNA, 18 nt, Variola virus
auauaucccuuaaaaauu

SEQ ID NO: 3288284 - RNA, 15 nt, Variola virus
aaagauauuccaaga

SEQ ID NO: 3288285 - RNA, 19 nt, Variola virus
auucugaauagauccacca

SEQ ID NO: 3288286 - RNA, 14 nt, Variola virus
uuuauuaauacagg

SEQ ID NO: 3288287 - RNA, 12 nt, Variola virus
aaauauauuguu

SEQ ID NO: 3288288 - RNA, 22 nt, Variola virus
uucaacauuuuauggaaacuau

SEQ ID NO: 3288289 - RNA, 18 nt, Variola virus
uauuauggaaaucaacau

SEQ ID NO: 3288290 - RNA, 19 nt, Variola virus
agauuuacuguuuaucuaa

SEQ ID NO: 3288291 - RNA, 13 nt, Variola virus
acugacuuuagac

SEQ ID NO: 3288292 - RNA, 21 nt, Variola virus
auuaaaggcuuuuuauaucau

SEQ ID NO: 3288293 - RNA, 21 nt, Variola virus
ucguguuuguguaguuuucac

SEQ ID NO: 3288294 - RNA, 18 nt, Variola virus
acuaauauuuuauuucaa

SEQ ID NO: 3288295 - RNA, 19 nt, Variola virus
aauauuauucuuugauucg

SEQ ID NO: 3288296 - RNA, 14 nt, Variola virus
auauuguuaaauaa

SEQ ID NO: 3288297 - RNA, 17 nt, Variola virus
cuuuagaugaauuauua

SEQ ID NO: 3288298 - RNA, 23 nt, Variola virus
uuagugaaacauuccacaucguu

SEQ ID NO: 3288299 - RNA, 13 nt, Variola virus
acaucaucugaaa

SEQ ID NO: 3288300 - RNA, 13 nt, Variola virus
aucauuaaaugau

SEQ ID NO: 3288301 - RNA, 23 nt, Variola virus
cuaagauauacuaccgauauaca

SEQ ID NO: 3288302 - RNA, 21 nt, Variola virus
cugauaagauaucuucucaaa

SEQ ID NO: 3288303 - RNA, 23 nt, Variola virus
aaacggcaaaccaaaaacauuug

SEQ ID NO: 3288304 - RNA, 14 nt, Variola virus
gaauauuucuaguu

SEQ ID NO: 3288305 - RNA, 19 nt, Variola virus
aauuugaccugauuacauu

SEQ ID NO: 3288306 - RNA, 18 nt, Variola virus
ugaaaaauggauuuugau

SEQ ID NO: 3288307 - RNA, 18 nt, Variola virus
aauaugauagaaaugaug

SEQ ID NO: 3288308 - RNA, 17 nt, Variola virus
cuguugugaauauuuua

SEQ ID NO: 3288309 - RNA, 22 nt, Variola virus
uuaauaaaaauaauuuaguguu

SEQ ID NO: 3288310 - RNA, 16 nt, Variola virus
uuccaaucuuuugcaa

SEQ ID NO: 3288311 - RNA, 23 nt, Variola virus
augauuaaugacgauagauuuac

SEQ ID NO: 3288312 - RNA, 21 nt, Variola virus
auauacaacucucuaauacga

SEQ ID NO: 3288313 - RNA, 12 nt, Variola virus
cacguuaaacaa

SEQ ID NO: 3288314 - RNA, 16 nt, Variola virus
auacuaugaugucuag

SEQ ID NO: 3288315 - RNA, 23 nt, Variola virus
aagaaucuucaagagugcauuga

SEQ ID NO: 3288316 - RNA, 13 nt, Variola virus
guauacuuuuuaa

SEQ ID NO: 3288317 - RNA, 12 nt, Variola virus
uagaauuuccaa

SEQ ID NO: 3288318 - RNA, 16 nt, Variola virus
aucggacgcagaaauu

SEQ ID NO: 3288319 - RNA, 21 nt, Variola virus
ucuauaaacgaugguuuaauu

SEQ ID NO: 3288320 - RNA, 16 nt, Variola virus
acuguauuaagaacag

SEQ ID NO: 3288321 - RNA, 17 nt, Variola virus
aucaauuaaauaauuaa

SEQ ID NO: 3288322 - RNA, 17 nt, Variola virus
gcaagagcugauuauuu

SEQ ID NO: 3288323 - RNA, 17 nt, Variola virus
auauuaaagucaaauaa

SEQ ID NO: 3288324 - RNA, 23 nt, Variola virus
gccacaauauauucuaugauggu

SEQ ID NO: 3288325 - RNA, 20 nt, Variola virus
uaauauucauucaauauuua

SEQ ID NO: 3288326 - RNA, 21 nt, Variola virus
aaucucgucaguauugacaau

SEQ ID NO: 3288327 - RNA, 20 nt, Variola virus
aggaauagaaaucuugaaua

SEQ ID NO: 3288328 - RNA, 22 nt, Variola virus
cgaacacuaacgcgcaugauuu

SEQ ID NO: 3288329 - RNA, 22 nt, Variola virus
gaugauaucaguauauuauuau

SEQ ID NO: 3288330 - RNA, 19 nt, Variola virus
ccuguauucuuuuuaagau

SEQ ID NO: 3288331 - RNA, 14 nt, Variola virus
uaugaaucauacag

SEQ ID NO: 3288332 - RNA, 13 nt, Variola virus
agaaauaauauaa

SEQ ID NO: 3288333 - RNA, 24 nt, Variola virus
cuagacauuguacaauauguguua

SEQ ID NO: 3288334 - RNA, 13 nt, Variola virus
uuuuauacauauu

SEQ ID NO: 3288335 - RNA, 20 nt, Variola virus
auccuucagauaaucugaaa

SEQ ID NO: 3288336 - RNA, 14 nt, Variola virus
caaacauccucuau

SEQ ID NO: 3288337 - RNA, 20 nt, Variola virus
auuuuaaaauuauuaaacaa

SEQ ID NO: 3288338 - RNA, 18 nt, Variola virus
uuacugaauuaauaauau

SEQ ID NO: 3288339 - RNA, 16 nt, Variola virus
aguaagaguuaugaau

SEQ ID NO: 3288340 - RNA, 14 nt, Variola virus
uuuucguuguuuaa

SEQ ID NO: 3288341 - RNA, 13 nt, Variola virus
agauaacaaccuu

SEQ ID NO: 3288342 - RNA, 14 nt, Variola virus
aauguuaaaacuac

SEQ ID NO: 3288343 - RNA, 14 nt, Variola virus
guauauaguuuaua

SEQ ID NO: 3288344 - RNA, 18 nt, Variola virus
aaacaguuauuuucugaa

SEQ ID NO: 3288345 - RNA, 16 nt, Variola virus
auuaaugacgauagau

SEQ ID NO: 3288346 - RNA, 21 nt, Variola virus
ugauaugauuaucguuuucau

SEQ ID NO: 3288347 - RNA, 15 nt, Variola virus
aagagcaaacaucug

SEQ ID NO: 3288348 - RNA, 15 nt, Variola virus
acauguuuaaauaau

SEQ ID NO: 3288349 - RNA, 23 nt, Variola virus
aaaaucaggguuaucaaaguguu

SEQ ID NO: 3288350 - RNA, 15 nt, Variola virus
aaauaauuagaacua

SEQ ID NO: 3288351 - RNA, 21 nt, Variola virus
gacaauaacagagugcagaua

SEQ ID NO: 3288352 - RNA, 12 nt, Variola virus
auuccaaaauug

SEQ ID NO: 3288353 - RNA, 14 nt, Variola virus
ugugauuguucaau

SEQ ID NO: 3288354 - RNA, 22 nt, Variola virus
uagaacacauaaccaauuuaua

SEQ ID NO: 3288355 - RNA, 15 nt, Variola virus
aucguuuaaaguaaa

SEQ ID NO: 3288356 - RNA, 23 nt, Variola virus
uuucagcaaucuaacauuuuuaa

SEQ ID NO: 3288357 - RNA, 15 nt, Variola virus
aaaagccccaauuua

SEQ ID NO: 3288358 - RNA, 20 nt, Variola virus
aauacuuuaacaucacuaau

SEQ ID NO: 3288359 - RNA, 17 nt, Variola virus
uuaucguuuucaucuuu

SEQ ID NO: 3288360 - RNA, 16 nt, Variola virus
aguauuccaauaucug

SEQ ID NO: 3288361 - RNA, 21 nt, Variola virus
gaucuaacgaggaagaaauuu

SEQ ID NO: 3288362 - RNA, 15 nt, Variola virus
ucaaggaacaaauau

SEQ ID NO: 3288363 - RNA, 17 nt, Variola virus
uaaucguuauuaucauc

SEQ ID NO: 3288364 - RNA, 13 nt, Variola virus
auuuguauauaca

SEQ ID NO: 3288365 - RNA, 17 nt, Variola virus
uuacauaucuacguucu

SEQ ID NO: 3288366 - RNA, 17 nt, Variola virus
agaacccuuaauaacaa

SEQ ID NO: 3288367 - RNA, 20 nt, Variola virus
aauacaaggcacuaugucca

SEQ ID NO: 3288368 - RNA, 17 nt, Variola virus
guguaaaucuagaaauu

SEQ ID NO: 3288369 - RNA, 17 nt, Variola virus
uaauccaucaacaaugu

SEQ ID NO: 3288370 - RNA, 14 nt, Variola virus
cauagugcgucuaa

SEQ ID NO: 3288371 - RNA, 16 nt, Variola virus
cugucuggcaauaaau

SEQ ID NO: 3288372 - RNA, 14 nt, Variola virus
aacacuaaaaauau

SEQ ID NO: 3288373 - RNA, 22 nt, Variola virus
agauuugguaaaaugaaauauc

SEQ ID NO: 3288374 - RNA, 13 nt, Variola virus
aaguuuuaccauu

SEQ ID NO: 3288375 - RNA, 12 nt, Variola virus
acgaauaaagcg

SEQ ID NO: 3288376 - RNA, 23 nt, Variola virus
aauaguuuguacugcaaaaauaa

SEQ ID NO: 3288377 - RNA, 17 nt, Variola virus
ucacauccuuuauuuua

SEQ ID NO: 3288378 - RNA, 18 nt, Variola virus
auuacgaguugacacauu

SEQ ID NO: 3288379 - RNA, 21 nt, Variola virus
uugaugacacuaguuaagaac

SEQ ID NO: 3288380 - RNA, 15 nt, Variola virus
cagaauguacacuau

SEQ ID NO: 3288381 - RNA, 19 nt, Variola virus
uaauaucccacauugucau

SEQ ID NO: 3288382 - RNA, 18 nt, Variola virus
uaaauauuaauaaaguau

SEQ ID NO: 3288383 - RNA, 13 nt, Variola virus
cuauauuguauuc

SEQ ID NO: 3288384 - RNA, 13 nt, Variola virus
ucuucaaauucca

SEQ ID NO: 3288385 - RNA, 22 nt, Variola virus
ugccauaauucucauauauuga

SEQ ID NO: 3288386 - RNA, 15 nt, Variola virus
uguagauaugugaua

SEQ ID NO: 3288387 - RNA, 20 nt, Variola virus
caucucguuuagauuuucca

SEQ ID NO: 3288388 - RNA, 15 nt, Variola virus
cgaaucuaugauauu

SEQ ID NO: 3288389 - RNA, 20 nt, Variola virus
ugcaucuuauuagaauauua

SEQ ID NO: 3288390 - RNA, 21 nt, Variola virus
aauaacuucacuauugaucaa

SEQ ID NO: 3288391 - RNA, 23 nt, Variola virus
gauaauggaagacgcuauaucaa

SEQ ID NO: 3288392 - RNA, 14 nt, Variola virus
aggaucuagcaaag

SEQ ID NO: 3288393 - RNA, 22 nt, Variola virus
uuuauucgguaagacgaucauu

SEQ ID NO: 3288394 - RNA, 16 nt, Variola virus
auuaaauuauugauau

SEQ ID NO: 3288395 - RNA, 23 nt, Variola virus
uauuccgcucaucacuaaucaua

SEQ ID NO: 3288396 - RNA, 17 nt, Variola virus
ugaacauaguaagaaau

SEQ ID NO: 3288397 - RNA, 22 nt, Variola virus
aaugucuauaguucucaucuuu

SEQ ID NO: 3288398 - RNA, 15 nt, Variola virus
ucuuauuauuaauaa

SEQ ID NO: 3288399 - RNA, 19 nt, Variola virus
ucgauuacuauggauaucu

SEQ ID NO: 3288400 - RNA, 21 nt, Variola virus
guaaauagaauaguauaaugu

SEQ ID NO: 3288401 - RNA, 14 nt, Variola virus
cguaauuuuuuaua

SEQ ID NO: 3288402 - RNA, 20 nt, Variola virus
uuaguaaaaaauuuauuucu

SEQ ID NO: 3288403 - RNA, 21 nt, Variola virus
aguguauuuaugaaaaauaua

SEQ ID NO: 3288404 - RNA, 18 nt, Variola virus
uccucuucaacacaaagu

SEQ ID NO: 3288405 - RNA, 20 nt, Variola virus
acuacaaagggaaaaugcua

SEQ ID NO: 3288406 - RNA, 19 nt, Variola virus
agggugaguuaauaugcau

SEQ ID NO: 3288407 - RNA, 14 nt, Variola virus
cauuccaucauuua

SEQ ID NO: 3288408 - RNA, 14 nt, Variola virus
uucaucauuucaca

SEQ ID NO: 3288409 - RNA, 20 nt, Variola virus
uaauuguuauuuuauucaua

SEQ ID NO: 3288410 - RNA, 17 nt, Variola virus
acguaucucgucuaaau

SEQ ID NO: 3288411 - RNA, 20 nt, Variola virus
ucaugaaccaauacaaugua

SEQ ID NO: 3288412 - RNA, 15 nt, Variola virus
caaauuaaauucugg

SEQ ID NO: 3288413 - RNA, 18 nt, Variola virus
uaaagacacuccacaugc

SEQ ID NO: 3288414 - RNA, 20 nt, Variola virus
uaauacagcauccaacuuga

SEQ ID NO: 3288415 - RNA, 15 nt, Variola virus
aacucgguuguguau

SEQ ID NO: 3288416 - RNA, 19 nt, Variola virus
caauguauuuauaucugau

SEQ ID NO: 3288417 - RNA, 19 nt, Variola virus
gguagaccguuaaugaaga

SEQ ID NO: 3288418 - RNA, 13 nt, Variola virus
uagauuuuggaua

SEQ ID NO: 3288419 - RNA, 12 nt, Variola virus
agaggaaauauc

SEQ ID NO: 3288420 - RNA, 17 nt, Variola virus
cauucaaccauucauaa

SEQ ID NO: 3288421 - RNA, 16 nt, Variola virus
caccaagaaagcugua

SEQ ID NO: 3288422 - RNA, 15 nt, Variola virus
auuuauaaaaugcuu

SEQ ID NO: 3288423 - RNA, 13 nt, Variola virus
guucgauagaaac

SEQ ID NO: 3288424 - RNA, 13 nt, Variola virus
acaauacagcagu

SEQ ID NO: 3288425 - RNA, 23 nt, Variola virus
gaauuacuuuacauauaauauca

SEQ ID NO: 3288426 - RNA, 19 nt, Variola virus
aacagucacgauaucucuu

SEQ ID NO: 3288427 - RNA, 19 nt, Variola virus
uguuugugaugcuuaaaau

SEQ ID NO: 3288428 - RNA, 18 nt, Variola virus
guaauauggaauaguguu

SEQ ID NO: 3288429 - RNA, 18 nt, Variola virus
uauauucuuacaguacau

SEQ ID NO: 3288430 - RNA, 23 nt, Variola virus
gaaauagcgcugaaaauaaagau

SEQ ID NO: 3288431 - RNA, 16 nt, Variola virus
auagaagauauuacau

SEQ ID NO: 3288432 - RNA, 19 nt, Variola virus
uauguugugauucuagaau

SEQ ID NO: 3288433 - RNA, 19 nt, Variola virus
guuaaugcaucuaaaacaa

SEQ ID NO: 3288434 - RNA, 19 nt, Variola virus
gugaguacggauuaaacau

SEQ ID NO: 3288435 - RNA, 18 nt, Variola virus
aauacccugaugaaaaug

SEQ ID NO: 3288436 - RNA, 18 nt, Variola virus
gaaguacuuauuaaaacc

SEQ ID NO: 3288437 - RNA, 18 nt, Variola virus
ucauaaaaucgucacaau

SEQ ID NO: 3288438 - RNA, 15 nt, Variola virus
uagugacaauacuau

SEQ ID NO: 3288439 - RNA, 22 nt, Variola virus
uuggaaaaaugaugaauuaaug

SEQ ID NO: 3288440 - RNA, 22 nt, Variola virus
gcuuauaucagguauaauagau

SEQ ID NO: 3288441 - RNA, 16 nt, Variola virus
gcaauaagucuuucuc

SEQ ID NO: 3288442 - RNA, 14 nt, Variola virus
uaaaugacaaguau

SEQ ID NO: 3288443 - RNA, 16 nt, Variola virus
uuaaaugccuuauucu

SEQ ID NO: 3288444 - RNA, 14 nt, Variola virus
auaagaugucuaug

SEQ ID NO: 3288445 - RNA, 22 nt, Variola virus
uuauccuuuagaugaauuauua

SEQ ID NO: 3288446 - RNA, 16 nt, Variola virus
acauaccugauuagaa

SEQ ID NO: 3288447 - RNA, 17 nt, Variola virus
aauacuuaaaaauggau

SEQ ID NO: 3288448 - RNA, 14 nt, Variola virus
uggucaaccuuugu

SEQ ID NO: 3288449 - RNA, 20 nt, Variola virus
ucaaauucucauucauguau

SEQ ID NO: 3288450 - RNA, 21 nt, Variola virus
uuagagauaauauccugaaca

SEQ ID NO: 3288451 - RNA, 20 nt, Variola virus
ugaacuccgccguaguuucc

SEQ ID NO: 3288452 - RNA, 19 nt, Variola virus
uuuuaugacaaacuuuacu

SEQ ID NO: 3288453 - RNA, 14 nt, Variola virus
uacggaaagaacca

SEQ ID NO: 3288454 - RNA, 14 nt, Variola virus
aauaaguaaaaagu

SEQ ID NO: 3288455 - RNA, 17 nt, Variola virus
uaaaucaucgauuuuca

SEQ ID NO: 3288456 - RNA, 16 nt, Variola virus
gauaacaaauuaaaga

SEQ ID NO: 3288457 - RNA, 14 nt, Variola virus
uucuucaaaugaag

SEQ ID NO: 3288458 - RNA, 20 nt, Variola virus
cuauaagauuaucaaaaucu

SEQ ID NO: 3288459 - RNA, 16 nt, Variola virus
acaaacuauagaaauu

SEQ ID NO: 3288460 - RNA, 13 nt, Variola virus
gaagauagauaua

SEQ ID NO: 3288461 - RNA, 16 nt, Variola virus
aauaucagaaaggaua

SEQ ID NO: 3288462 - RNA, 14 nt, Variola virus
ccaucaaaagcauu

SEQ ID NO: 3288463 - RNA, 14 nt, Variola virus
aguaugugaauaga

SEQ ID NO: 3288464 - RNA, 19 nt, Variola virus
aucauauaguuauguauau

SEQ ID NO: 3288465 - RNA, 20 nt, Variola virus
agacuuuaagcuaaaauauu

SEQ ID NO: 3288466 - RNA, 18 nt, Variola virus
acgauguaguuagauaga

SEQ ID NO: 3288467 - RNA, 16 nt, Variola virus
uacaaauauuauacau

SEQ ID NO: 3288468 - RNA, 13 nt, Variola virus
ggucaauagcgac

SEQ ID NO: 3288469 - RNA, 12 nt, Variola virus
aguuguaaaugu

SEQ ID NO: 3288470 - RNA, 18 nt, Variola virus
auacuuuguaauauaaug

SEQ ID NO: 3288471 - RNA, 14 nt, Variola virus
caauuuccaacaaa

SEQ ID NO: 3288472 - RNA, 14 nt, Variola virus
gaucuuuuguacau

SEQ ID NO: 3288473 - RNA, 14 nt, Variola virus
uacuagaguacuua

SEQ ID NO: 3288474 - RNA, 20 nt, Variola virus
auuaugucucugaacuauau

SEQ ID NO: 3288475 - RNA, 18 nt, Variola virus
cagaauuucuacauaauu

SEQ ID NO: 3288476 - RNA, 16 nt, Variola virus
caagaaguuuaucuac

SEQ ID NO: 3288477 - RNA, 21 nt, Variola virus
guauucuauaccaauauuauu

SEQ ID NO: 3288478 - RNA, 11 nt, Variola virus
cuguguucaag

SEQ ID NO: 3288479 - RNA, 18 nt, Variola virus
aauaaacuagaaaaacuu

SEQ ID NO: 3288480 - RNA, 13 nt, Variola virus
cuguuaaucuuua

SEQ ID NO: 3288481 - RNA, 17 nt, Variola virus
accaaaaacucauauaa

SEQ ID NO: 3288482 - RNA, 23 nt, Variola virus
agaagaauucaagucaggaacua

SEQ ID NO: 3288483 - RNA, 17 nt, Variola virus
gcacuagguacaucauu

SEQ ID NO: 3288484 - RNA, 21 nt, Variola virus
guaugugugugugguauagau

SEQ ID NO: 3288485 - RNA, 14 nt, Variola virus
cuauagaucaugua

SEQ ID NO: 3288486 - RNA, 13 nt, Variola virus
uugccaaguuauc

SEQ ID NO: 3288487 - RNA, 15 nt, Variola virus
cgucuuuauuuucua

SEQ ID NO: 3288488 - RNA, 24 nt, Variola virus
aaagagaacguauuuauuguuacu

SEQ ID NO: 3288489 - RNA, 18 nt, Variola virus
aaguuucguacaaauaca

SEQ ID NO: 3288490 - RNA, 15 nt, Variola virus
auagccaaaagacua

SEQ ID NO: 3288491 - RNA, 17 nt, Variola virus
augacgucaugucuauu

SEQ ID NO: 3288492 - RNA, 18 nt, Variola virus
uugagacgggucaaacaa

SEQ ID NO: 3288493 - RNA, 17 nt, Variola virus
uuuucaaagaaaaaggu

SEQ ID NO: 3288494 - RNA, 14 nt, Variola virus
cuauugccuuagau

SEQ ID NO: 3288495 - RNA, 17 nt, Variola virus
auuacuacguaaagaag

SEQ ID NO: 3288496 - RNA, 14 nt, Variola virus
gaaauccuauuuua

SEQ ID NO: 3288497 - RNA, 15 nt, Variola virus
augaacuaagagaaa

SEQ ID NO: 3288498 - RNA, 11 nt, Variola virus
gguaauacuua

SEQ ID NO: 3288499 - RNA, 12 nt, Variola virus
cuaauuaauuuu

SEQ ID NO: 3288500 - RNA, 15 nt, Variola virus
cauuuacaacucuau

SEQ ID NO: 3288501 - RNA, 15 nt, Variola virus
auauuuacaguuacu

SEQ ID NO: 3288502 - RNA, 21 nt, Variola virus
aacggagaauaucuauacaua

SEQ ID NO: 3288503 - RNA, 23 nt, Variola virus
auggauuaguuagacugaaugcu

SEQ ID NO: 3288504 - RNA, 18 nt, Variola virus
uuggcgcuagucaucuca

SEQ ID NO: 3288505 - RNA, 20 nt, Variola virus
auaauuucuacuuacuuaau

SEQ ID NO: 3288506 - RNA, 16 nt, Variola virus
auuaaaggauguacuc

SEQ ID NO: 3288507 - RNA, 20 nt, Variola virus
guaucauccacauauuuaua

SEQ ID NO: 3288508 - RNA, 21 nt, Variola virus
aucgauaauuguuucauaugu

SEQ ID NO: 3288509 - RNA, 12 nt, Variola virus
aaagugaaaauc

SEQ ID NO: 3288510 - RNA, 12 nt, Variola virus
aaacugaaaaug

SEQ ID NO: 3288511 - RNA, 21 nt, Variola virus
cugugcauaaauuaaaauaca

SEQ ID NO: 3288512 - RNA, 14 nt, Variola virus
agauacaucuauau

SEQ ID NO: 3288513 - RNA, 13 nt, Variola virus
auaaaucugaugu

SEQ ID NO: 3288514 - RNA, 13 nt, Variola virus
aaauagaacuuau

SEQ ID NO: 3288515 - RNA, 11 nt, Variola virus
ccuuguaacuu

SEQ ID NO: 3288516 - RNA, 15 nt, Variola virus
acaauaacuacauau

SEQ ID NO: 3288517 - RNA, 19 nt, Variola virus
uuuagaaaaaugcuaauau

SEQ ID NO: 3288518 - RNA, 22 nt, Variola virus
aguuacucuuggucuaauacug

SEQ ID NO: 3288519 - RNA, 18 nt, Variola virus
uucaaaaauauucauuaa

SEQ ID NO: 3288520 - RNA, 11 nt, Variola virus
aucuaauuaau

SEQ ID NO: 3288521 - RNA, 22 nt, Variola virus
gugauaaacuugugcuaaucuc

SEQ ID NO: 3288522 - RNA, 21 nt, Variola virus
uauaaaaauuuuuuauacauu

SEQ ID NO: 3288523 - RNA, 14 nt, Variola virus
acaucucuuuucca

SEQ ID NO: 3288524 - RNA, 20 nt, Variola virus
uuugucuccuccuccguaaa

SEQ ID NO: 3288525 - RNA, 21 nt, Variola virus
caaaaaacuuuacgauagacu

SEQ ID NO: 3288526 - RNA, 14 nt, Variola virus
agauuauaacuuau

SEQ ID NO: 3288527 - RNA, 23 nt, Variola virus
ucaaugugaauguauucacuuaa

SEQ ID NO: 3288528 - RNA, 18 nt, Variola virus
caccucuaccgaauagag

SEQ ID NO: 3288529 - RNA, 14 nt, Variola virus
cauuaauuauaacg

SEQ ID NO: 3288530 - RNA, 23 nt, Variola virus
cugauguaacccacguaacauua

SEQ ID NO: 3288531 - RNA, 16 nt, Variola virus
ucaaacacgauauuca

SEQ ID NO: 3288532 - RNA, 13 nt, Variola virus
uaucuucuaaaau

SEQ ID NO: 3288533 - RNA, 23 nt, Variola virus
aaguuuauuaguguuuagauaau

SEQ ID NO: 3288534 - RNA, 16 nt, Variola virus
uaucggaggaauuaag

SEQ ID NO: 3288535 - RNA, 16 nt, Variola virus
aaugacgaauugaaaa

SEQ ID NO: 3288536 - RNA, 12 nt, Variola virus
auuagaauguau

SEQ ID NO: 3288537 - RNA, 13 nt, Variola virus
agguauuuauuca

SEQ ID NO: 3288538 - RNA, 21 nt, Variola virus
cauuauggauaaucuauuuac

SEQ ID NO: 3288539 - RNA, 13 nt, Variola virus
aaauuuaccacua

SEQ ID NO: 3288540 - RNA, 16 nt, Variola virus
auauuauauaaacauu

SEQ ID NO: 3288541 - RNA, 13 nt, Variola virus
cggaaaugauaua

SEQ ID NO: 3288542 - RNA, 15 nt, Variola virus
aaagauguauuaccu

SEQ ID NO: 3288543 - RNA, 21 nt, Variola virus
uuaaacaaauaaguauuauca

SEQ ID NO: 3288544 - RNA, 22 nt, Variola virus
auguucucguuuccaaaaaaug

SEQ ID NO: 3288545 - RNA, 16 nt, Variola virus
ugaguuuuuaggaaau

SEQ ID NO: 3288546 - RNA, 16 nt, Variola virus
ugauacguauauacac

SEQ ID NO: 3288547 - RNA, 19 nt, Variola virus
auaaagucugucaaaucau

SEQ ID NO: 3288548 - RNA, 18 nt, Variola virus
acgaugucaauaaugccg

SEQ ID NO: 3288549 - RNA, 12 nt, Variola virus
aaaguuuaagaa

SEQ ID NO: 3288550 - RNA, 22 nt, Variola virus
ggaacaguucuaccaccaguaa

SEQ ID NO: 3288551 - RNA, 16 nt, Variola virus
auugccaacucucaaa

SEQ ID NO: 3288552 - RNA, 19 nt, Variola virus
agauaucuucuuuuuucca

SEQ ID NO: 3288553 - RNA, 16 nt, Variola virus
auuuaguauuaaauga

SEQ ID NO: 3288554 - RNA, 12 nt, Variola virus
aauauaacagua

SEQ ID NO: 3288555 - RNA, 16 nt, Variola virus
cuaaaagcuguuaaag

SEQ ID NO: 3288556 - RNA, 18 nt, Variola virus
ucuauuuuaucauuuucc

SEQ ID NO: 3288557 - RNA, 22 nt, Variola virus
acuuuuuaacgaaauuagaaaa

SEQ ID NO: 3288558 - RNA, 12 nt, Variola virus
aagauaauccaa

SEQ ID NO: 3288559 - RNA, 19 nt, Variola virus
guuauugaaauuaaucaua

SEQ ID NO: 3288560 - RNA, 15 nt, Variola virus
uuacauucucauuaa

SEQ ID NO: 3288561 - RNA, 18 nt, Variola virus
agugcuauuuugacauac

SEQ ID NO: 3288562 - RNA, 17 nt, Variola virus
accaggguuuauuucau

SEQ ID NO: 3288563 - RNA, 20 nt, Variola virus
acauuuuuuaaagcuaaaau

SEQ ID NO: 3288564 - RNA, 12 nt, Variola virus
aauuuauuucua

SEQ ID NO: 3288565 - RNA, 15 nt, Variola virus
auaucugauguuguu

SEQ ID NO: 3288566 - RNA, 19 nt, Variola virus
uaauauucccagaaaagau

SEQ ID NO: 3288567 - RNA, 18 nt, Variola virus
ucuucuuugauuaaugau

SEQ ID NO: 3288568 - RNA, 19 nt, Variola virus
uuaauuuguacauucuuaa

SEQ ID NO: 3288569 - RNA, 22 nt, Variola virus
augugacccaguaaugcauuua

SEQ ID NO: 3288570 - RNA, 19 nt, Variola virus
ccacuuuaauaauaucaua

SEQ ID NO: 3288571 - RNA, 15 nt, Variola virus
cuauguuuuuaauga

SEQ ID NO: 3288572 - RNA, 13 nt, Variola virus
acaaugaacuaau

SEQ ID NO: 3288573 - RNA, 19 nt, Variola virus
guuuaccacaauguauaau

SEQ ID NO: 3288574 - RNA, 11 nt, Variola virus
uaaauuagaag

SEQ ID NO: 3288575 - RNA, 21 nt, Variola virus
cuccgucaucaucuccuggag

SEQ ID NO: 3288576 - RNA, 21 nt, Variola virus
cuacauaguuaucuaucuuaa

SEQ ID NO: 3288577 - RNA, 17 nt, Variola virus
acauaucgguguuucca

SEQ ID NO: 3288578 - RNA, 16 nt, Variola virus
ucaaacgaauaaacaa

SEQ ID NO: 3288579 - RNA, 15 nt, Variola virus
ucuacauuuucaguc

SEQ ID NO: 3288580 - RNA, 18 nt, Variola virus
uuauuuaaguuuuugaua

SEQ ID NO: 3288581 - RNA, 23 nt, Variola virus
cauucacuauuccgucacuggcu

SEQ ID NO: 3288582 - RNA, 16 nt, Variola virus
aauuucuauuagauaa

SEQ ID NO: 3288583 - RNA, 21 nt, Variola virus
ugauaacguuggcaauacuaa

SEQ ID NO: 3288584 - RNA, 22 nt, Variola virus
uaaaaaccaauuuguauaugug

SEQ ID NO: 3288585 - RNA, 18 nt, Variola virus
uaagucaacguuuacauu

SEQ ID NO: 3288586 - RNA, 15 nt, Variola virus
auauauuagaaauac

SEQ ID NO: 3288587 - RNA, 23 nt, Variola virus
gucuaugucucuuauuagagauu

SEQ ID NO: 3288588 - RNA, 16 nt, Variola virus
caaaauuuauauauca

SEQ ID NO: 3288589 - RNA, 24 nt, Variola virus
aaaaugaaaacacuuuaguaauua

SEQ ID NO: 3288590 - RNA, 13 nt, Variola virus
auuacaacauaau

SEQ ID NO: 3288591 - RNA, 21 nt, Variola virus
acacucaacggaaaacauuuu

SEQ ID NO: 3288592 - RNA, 14 nt, Variola virus
gucauccuucacuc

SEQ ID NO: 3288593 - RNA, 20 nt, Variola virus
uauacagugaacacacaaua

SEQ ID NO: 3288594 - RNA, 20 nt, Variola virus
uuaugaaaaaguaaaugaug

SEQ ID NO: 3288595 - RNA, 21 nt, Variola virus
gaauauggggaaaauauucua

SEQ ID NO: 3288596 - RNA, 16 nt, Variola virus
guaauuaauuguuuua

SEQ ID NO: 3288597 - RNA, 22 nt, Variola virus
acauggauuuaucauaucaugg

SEQ ID NO: 3288598 - RNA, 18 nt, Variola virus
auuaccaucguuguugaa

SEQ ID NO: 3288599 - RNA, 20 nt, Variola virus
ugaugacacuagaugauuug

SEQ ID NO: 3288600 - RNA, 22 nt, Variola virus
uaugucuagcaaugaucuaaau

SEQ ID NO: 3288601 - RNA, 22 nt, Variola virus
aucuccacacagucaaauccgu

SEQ ID NO: 3288602 - RNA, 15 nt, Variola virus
caaaggaugaaagaa

SEQ ID NO: 3288603 - RNA, 19 nt, Variola virus
aucauauuauaaagaugau

SEQ ID NO: 3288604 - RNA, 13 nt, Variola virus
aauucuaauggau

SEQ ID NO: 3288605 - RNA, 22 nt, Variola virus
ucuucucgcuaguuuacuaugu

SEQ ID NO: 3288606 - RNA, 17 nt, Variola virus
aauucgacaaugaugcg

SEQ ID NO: 3288607 - RNA, 18 nt, Variola virus
cauuauucuauuucgaau

SEQ ID NO: 3288608 - RNA, 18 nt, Variola virus
auacacuguuuaaaauua

SEQ ID NO: 3288609 - RNA, 17 nt, Variola virus
aaguuaguuauuuuacg

SEQ ID NO: 3288610 - RNA, 12 nt, Variola virus
uucuuaagaaau

SEQ ID NO: 3288611 - RNA, 19 nt, Variola virus
uucaaugcugguugcaaga

SEQ ID NO: 3288612 - RNA, 23 nt, Variola virus
cuaguagaggcgguauuacugag

SEQ ID NO: 3288613 - RNA, 22 nt, Variola virus
aauguuugauaaaaauauguau

SEQ ID NO: 3288614 - RNA, 23 nt, Variola virus
cauauacuauuacuuaucacgau

SEQ ID NO: 3288615 - RNA, 12 nt, Variola virus
gauuaauguuuu

SEQ ID NO: 3288616 - RNA, 21 nt, Variola virus
uguucaaaaauuuagaaugau

SEQ ID NO: 3288617 - RNA, 16 nt, Variola virus
gcuaauugucuuucuc

SEQ ID NO: 3288618 - RNA, 13 nt, Variola virus
auauaaauuauuc

SEQ ID NO: 3288619 - RNA, 15 nt, Variola virus
cucaugucaaauugu

SEQ ID NO: 3288620 - RNA, 15 nt, Variola virus
acucgcguuuagagg

SEQ ID NO: 3288621 - RNA, 14 nt, Variola virus
aacucuuuuccauu

SEQ ID NO: 3288622 - RNA, 15 nt, Variola virus
aacauugauaacuac

SEQ ID NO: 3288623 - RNA, 18 nt, Variola virus
augugacucuaguaacuc

SEQ ID NO: 3288624 - RNA, 17 nt, Variola virus
aaauauauuuucauuua

SEQ ID NO: 3288625 - RNA, 21 nt, Variola virus
aauaugcggaaccucgagaau

SEQ ID NO: 3288626 - RNA, 21 nt, Variola virus
gugcauaauaaaguauaugua

SEQ ID NO: 3288627 - RNA, 20 nt, Variola virus
acucucuacccuaaacuuua

SEQ ID NO: 3288628 - RNA, 13 nt, Variola virus
cguuagacauaaa

SEQ ID NO: 3288629 - RNA, 15 nt, Variola virus
aauccauucuaauga

SEQ ID NO: 3288630 - RNA, 19 nt, Variola virus
cuagaaaacgaaaacaucc

SEQ ID NO: 3288631 - RNA, 15 nt, Variola virus
cagaggaguuauuua

SEQ ID NO: 3288632 - RNA, 19 nt, Variola virus
gauaguacagcguaguaca

SEQ ID NO: 3288633 - RNA, 22 nt, Variola virus
auuaguaaaacuaguauugugu

SEQ ID NO: 3288634 - RNA, 15 nt, Variola virus
uguuaauacaucaau

SEQ ID NO: 3288635 - RNA, 14 nt, Variola virus
auucugcaauauug

SEQ ID NO: 3288636 - RNA, 17 nt, Variola virus
ggaaacuuuuguuuugu

SEQ ID NO: 3288637 - RNA, 15 nt, Variola virus
aacuaucuuucaaga

SEQ ID NO: 3288638 - RNA, 20 nt, Variola virus
auuacauucucauuaauuaa

SEQ ID NO: 3288639 - RNA, 15 nt, Variola virus
auucuaauacauaau

SEQ ID NO: 3288640 - RNA, 14 nt, Variola virus
cuuuauaaugcauu

SEQ ID NO: 3288641 - RNA, 20 nt, Variola virus
auaaacauuuguguuuguau

SEQ ID NO: 3288642 - RNA, 15 nt, Variola virus
auguaauaacaaagg

SEQ ID NO: 3288643 - RNA, 15 nt, Variola virus
aauaauuauguagua

SEQ ID NO: 3288644 - RNA, 15 nt, Variola virus
ggucuaucaauaacu

SEQ ID NO: 3288645 - RNA, 13 nt, Variola virus
auucuaaauggau

SEQ ID NO: 3288646 - RNA, 20 nt, Variola virus
agaaaacucguuauuaacua

SEQ ID NO: 3288647 - RNA, 19 nt, Variola virus
auucuagacuccgcaucaa

SEQ ID NO: 3288648 - RNA, 19 nt, Variola virus
uaauauaaucuagacagau

SEQ ID NO: 3288649 - RNA, 16 nt, Variola virus
acauaacucuuuucca

SEQ ID NO: 3288650 - RNA, 13 nt, Variola virus
gacuauaaaauau

SEQ ID NO: 3288651 - RNA, 16 nt, Variola virus
cuuuuuuccaaacugc

SEQ ID NO: 3288652 - RNA, 19 nt, Variola virus
aggauaugauaaaaauaua

SEQ ID NO: 3288653 - RNA, 13 nt, Variola virus
guaccaaauuaau

SEQ ID NO: 3288654 - RNA, 23 nt, Variola virus
auggucuauauauacacuacaau

SEQ ID NO: 3288655 - RNA, 21 nt, Variola virus
ugucaucgaaaugguagauau

SEQ ID NO: 3288656 - RNA, 20 nt, Variola virus
augucugauggcgacauaau

SEQ ID NO: 3288657 - RNA, 13 nt, Variola virus
uauauauguagug

SEQ ID NO: 3288658 - RNA, 17 nt, Variola virus
uccauauuuuagaauau

SEQ ID NO: 3288659 - RNA, 15 nt, Variola virus
accagaugucauuau

SEQ ID NO: 3288660 - RNA, 22 nt, Variola virus
uaaauuauuccaucgauacauc

SEQ ID NO: 3288661 - RNA, 15 nt, Variola virus
auucgaauucaaaug

SEQ ID NO: 3288662 - RNA, 18 nt, Variola virus
ucucuuaguaaguuuauu

SEQ ID NO: 3288663 - RNA, 16 nt, Variola virus
aaaaucauugggauuu

SEQ ID NO: 3288664 - RNA, 22 nt, Variola virus
agaugaaucaaauguaacuauu

SEQ ID NO: 3288665 - RNA, 17 nt, Variola virus
uaaucucuccagaguau

SEQ ID NO: 3288666 - RNA, 12 nt, Variola virus
aacuuuuuggua

SEQ ID NO: 3288667 - RNA, 15 nt, Variola virus
auaccguuaaauaua

SEQ ID NO: 3288668 - RNA, 22 nt, Variola virus
ccaaguaggugcaucuggagca

SEQ ID NO: 3288669 - RNA, 22 nt, Variola virus
aaauuauucacuauaucaguau

SEQ ID NO: 3288670 - RNA, 14 nt, Variola virus
caucuauaucaucu

SEQ ID NO: 3288671 - RNA, 16 nt, Variola virus
uuaaaauaucuauuca

SEQ ID NO: 3288672 - RNA, 22 nt, Variola virus
uaaugccuguaaaaauaaacau

SEQ ID NO: 3288673 - RNA, 14 nt, Variola virus
aaauguguaauaau

SEQ ID NO: 3288674 - RNA, 14 nt, Variola virus
uaaaucuucacauu

SEQ ID NO: 3288675 - RNA, 11 nt, Variola virus
aaaauccacuu

SEQ ID NO: 3288676 - RNA, 12 nt, Variola virus
auauaaauacuu

SEQ ID NO: 3288677 - RNA, 15 nt, Variola virus
gaguuggauaucauc

SEQ ID NO: 3288678 - RNA, 16 nt, Variola virus
augucaucgaaauggu

SEQ ID NO: 3288679 - RNA, 22 nt, Variola virus
aucaccauggacauaaagauag

SEQ ID NO: 3288680 - RNA, 13 nt, Variola virus
uaauuucacgaau

SEQ ID NO: 3288681 - RNA, 17 nt, Variola virus
uaagauuuuaaauguau

SEQ ID NO: 3288682 - RNA, 15 nt, Variola virus
aucucguuuagaaaa

SEQ ID NO: 3288683 - RNA, 17 nt, Variola virus
gauacauggaaauguau

SEQ ID NO: 3288684 - RNA, 13 nt, Variola virus
uuuccuacauaac

SEQ ID NO: 3288685 - RNA, 16 nt, Variola virus
uuuacagauauauuca

SEQ ID NO: 3288686 - RNA, 16 nt, Variola virus
ucucggacauuucagc

SEQ ID NO: 3288687 - RNA, 23 nt, Variola virus
uguacuucuuucaguucuggaua

SEQ ID NO: 3288688 - RNA, 19 nt, Variola virus
auaucccacauugucaucu

SEQ ID NO: 3288689 - RNA, 15 nt, Variola virus
aauacaacaaccauu

SEQ ID NO: 3288690 - RNA, 17 nt, Variola virus
agguucauuguuaucca

SEQ ID NO: 3288691 - RNA, 16 nt, Variola virus
gaaaaucauacagaca

SEQ ID NO: 3288692 - RNA, 14 nt, Variola virus
uauacauuacugaa

SEQ ID NO: 3288693 - RNA, 14 nt, Variola virus
auauagacaaaaau

SEQ ID NO: 3288694 - RNA, 13 nt, Variola virus
uauuguuaucgua

SEQ ID NO: 3288695 - RNA, 16 nt, Variola virus
aacacuacaacagaua

SEQ ID NO: 3288696 - RNA, 19 nt, Variola virus
guaaagauaucuauacuua

SEQ ID NO: 3288697 - RNA, 11 nt, Variola virus
cuccuccacca

SEQ ID NO: 3288698 - RNA, 15 nt, Variola virus
ccaucaaauuguuua

SEQ ID NO: 3288699 - RNA, 15 nt, Variola virus
caacaaauauaaaau

SEQ ID NO: 3288700 - RNA, 16 nt, Variola virus
uuuagaguauuucuca

SEQ ID NO: 3288701 - RNA, 11 nt, Variola virus
aucauuaacga

SEQ ID NO: 3288702 - RNA, 22 nt, Variola virus
auuauacuguaacacaaugaag

SEQ ID NO: 3288703 - RNA, 15 nt, Variola virus
acauccauuucuaga

SEQ ID NO: 3288704 - RNA, 17 nt, Variola virus
aaaugauaucuuagaau

SEQ ID NO: 3288705 - RNA, 22 nt, Variola virus
cauguaaacuugacaaaaauug

SEQ ID NO: 3288706 - RNA, 19 nt, Variola virus
auuaaauagaauauuuaac

SEQ ID NO: 3288707 - RNA, 13 nt, Variola virus
gaacuaagagaaa

SEQ ID NO: 3288708 - RNA, 17 nt, Variola virus
gcaauucgcuaaacaau

SEQ ID NO: 3288709 - RNA, 16 nt, Variola virus
auugggagucaaugaa

SEQ ID NO: 3288710 - RNA, 17 nt, Variola virus
ucauuaauaauuucuag

SEQ ID NO: 3288711 - RNA, 14 nt, Variola virus
gcagaauagauauu

SEQ ID NO: 3288712 - RNA, 20 nt, Variola virus
uuuagaaggaguguuuucuu

SEQ ID NO: 3288713 - RNA, 23 nt, Variola virus
acauuggcgccguuuaauuuccu

SEQ ID NO: 3288714 - RNA, 21 nt, Variola virus
uguuuuugaacuguucaaaau

SEQ ID NO: 3288715 - RNA, 14 nt, Variola virus
uguaucuagugaua

SEQ ID NO: 3288716 - RNA, 14 nt, Variola virus
ucuucaacacaaag

SEQ ID NO: 3288717 - RNA, 22 nt, Variola virus
guaucucuaccuaugauuaaau

SEQ ID NO: 3288718 - RNA, 20 nt, Variola virus
cuuaguauuuuuagauauca

SEQ ID NO: 3288719 - RNA, 21 nt, Variola virus
agacucuaucgcgugucuaua

SEQ ID NO: 3288720 - RNA, 22 nt, Variola virus
aaauauuaauaacauuacauau

SEQ ID NO: 3288721 - RNA, 16 nt, Variola virus
auaauaggauaugauu

SEQ ID NO: 3288722 - RNA, 17 nt, Variola virus
uuucacuuuaucucauu

SEQ ID NO: 3288723 - RNA, 18 nt, Variola virus
aguuaaagaaaaauacuc

SEQ ID NO: 3288724 - RNA, 22 nt, Variola virus
aacaauacaguauauaacuauu

SEQ ID NO: 3288725 - RNA, 21 nt, Variola virus
acaaauauaugcaaaauaaua

SEQ ID NO: 3288726 - RNA, 13 nt, Variola virus
ccaauuuuucaga

SEQ ID NO: 3288727 - RNA, 15 nt, Variola virus
cuauacaagucgucu

SEQ ID NO: 3288728 - RNA, 16 nt, Variola virus
uaucuggcggugaaau

SEQ ID NO: 3288729 - RNA, 23 nt, Variola virus
uccauguucgagcauacuagcau

SEQ ID NO: 3288730 - RNA, 17 nt, Variola virus
caaccaaaaaggauaaa

SEQ ID NO: 3288731 - RNA, 17 nt, Variola virus
aucucuacauuguuuac

SEQ ID NO: 3288732 - RNA, 22 nt, Variola virus
cauuaccuccacgauacauuug

SEQ ID NO: 3288733 - RNA, 13 nt, Variola virus
uuaaauucuuuaa

SEQ ID NO: 3288734 - RNA, 22 nt, Variola virus
agucuuggacuaauuauacuuu

SEQ ID NO: 3288735 - RNA, 18 nt, Variola virus
accaauaauaguagaauu

SEQ ID NO: 3288736 - RNA, 21 nt, Variola virus
uaucgcauuuucuaacgugau

SEQ ID NO: 3288737 - RNA, 15 nt, Variola virus
uuaguacauucuuca

SEQ ID NO: 3288738 - RNA, 16 nt, Variola virus
uauagaccguuacauu

SEQ ID NO: 3288739 - RNA, 19 nt, Variola virus
auaucauacaugauauuca

SEQ ID NO: 3288740 - RNA, 18 nt, Variola virus
uacaacauuccaaagauc

SEQ ID NO: 3288741 - RNA, 15 nt, Variola virus
aauuuaauaagaaau

SEQ ID NO: 3288742 - RNA, 16 nt, Variola virus
auagauaauuguaaca

SEQ ID NO: 3288743 - RNA, 13 nt, Variola virus
uggagaugaaugc

SEQ ID NO: 3288744 - RNA, 21 nt, Variola virus
aaaugaacuuuuacagaucua

SEQ ID NO: 3288745 - RNA, 17 nt, Variola virus
auugauuagaaaauaua

SEQ ID NO: 3288746 - RNA, 17 nt, Variola virus
uaauuuaacuauuuuag

SEQ ID NO: 3288747 - RNA, 18 nt, Variola virus
auagaacaauauaaugua

SEQ ID NO: 3288748 - RNA, 12 nt, Variola virus
acuaagaaaguu

SEQ ID NO: 3288749 - RNA, 19 nt, Variola virus
uuauagaauugucuaucua

SEQ ID NO: 3288750 - RNA, 20 nt, Variola virus
caacuuaaacaaaauacaau

SEQ ID NO: 3288751 - RNA, 17 nt, Variola virus
gcgaaccgauuaaacau

SEQ ID NO: 3288752 - RNA, 18 nt, Variola virus
gaaucccuacauauuuua

SEQ ID NO: 3288753 - RNA, 17 nt, Variola virus
ucguauaccauuucuag

SEQ ID NO: 3288754 - RNA, 12 nt, Variola virus
cacuacaucuuu

SEQ ID NO: 3288755 - RNA, 17 nt, Variola virus
auauucuguaguuguau

SEQ ID NO: 3288756 - RNA, 19 nt, Variola virus
aaaacauauauaauaaaua

SEQ ID NO: 3288757 - RNA, 22 nt, Variola virus
uucuauaacuugagacuugaua

SEQ ID NO: 3288758 - RNA, 19 nt, Variola virus
auucagauaaucagccaua

SEQ ID NO: 3288759 - RNA, 14 nt, Variola virus
aauaauuuacaaaa

SEQ ID NO: 3288760 - RNA, 22 nt, Variola virus
gcguucauuggaaaauauacca

SEQ ID NO: 3288761 - RNA, 14 nt, Variola virus
auucuuaaaaucua

SEQ ID NO: 3288762 - RNA, 18 nt, Variola virus
guuauuuauguugcuaaa

SEQ ID NO: 3288763 - RNA, 14 nt, Variola virus
uggacauaaagaua

SEQ ID NO: 3288764 - RNA, 20 nt, Variola virus
guauagauccuccaguaaau

SEQ ID NO: 3288765 - RNA, 15 nt, Variola virus
uccaauuuuucuuaa

SEQ ID NO: 3288766 - RNA, 16 nt, Variola virus
auauauuuauuuccag

SEQ ID NO: 3288767 - RNA, 19 nt, Variola virus
gcgauaauagauagugcua

SEQ ID NO: 3288768 - RNA, 12 nt, Variola virus
uaugacaaaauu

SEQ ID NO: 3288769 - RNA, 14 nt, Variola virus
gugaucaucuucau

SEQ ID NO: 3288770 - RNA, 17 nt, Variola virus
auuuggcgcuuuucucu

SEQ ID NO: 3288771 - RNA, 14 nt, Variola virus
acaagucauuuaaa

SEQ ID NO: 3288772 - RNA, 17 nt, Variola virus
aggcucaguauguaaac

SEQ ID NO: 3288773 - RNA, 21 nt, Variola virus
uaauauaucuuauaucucguu

SEQ ID NO: 3288774 - RNA, 17 nt, Variola virus
gaaagauauauuaagaa

SEQ ID NO: 3288775 - RNA, 14 nt, Variola virus
guguagaagaucaa

SEQ ID NO: 3288776 - RNA, 19 nt, Variola virus
ucuaguugauauuccaacc

SEQ ID NO: 3288777 - RNA, 14 nt, Variola virus
uauuuaaaugacuu

SEQ ID NO: 3288778 - RNA, 20 nt, Variola virus
uuuuacagaucuaguauaau

SEQ ID NO: 3288779 - RNA, 20 nt, Variola virus
acucugggucauauuauaga

SEQ ID NO: 3288780 - RNA, 23 nt, Variola virus
uaaugagcaaguagaaaaccucu

SEQ ID NO: 3288781 - RNA, 14 nt, Variola virus
auucaucaaugaug

SEQ ID NO: 3288782 - RNA, 11 nt, Variola virus
caaaaagcaua

SEQ ID NO: 3288783 - RNA, 17 nt, Variola virus
aaacaccuauggagaag

SEQ ID NO: 3288784 - RNA, 16 nt, Variola virus
uccuuuaccaccaaau

SEQ ID NO: 3288785 - RNA, 16 nt, Variola virus
aaauagauagaaucua

SEQ ID NO: 3288786 - RNA, 15 nt, Variola virus
agacugcggacuuua

SEQ ID NO: 3288787 - RNA, 19 nt, Variola virus
uuagugauguaaguauaac

SEQ ID NO: 3288788 - RNA, 17 nt, Variola virus
gaaguaaaagauuuaua

SEQ ID NO: 3288789 - RNA, 21 nt, Variola virus
ucagugcaaagauuacuacac

SEQ ID NO: 3288790 - RNA, 15 nt, Variola virus
aaucuucuuauaaga

SEQ ID NO: 3288791 - RNA, 21 nt, Variola virus
acccaaguuugagauuucaua

SEQ ID NO: 3288792 - RNA, 14 nt, Variola virus
auuaucaaaagaca

SEQ ID NO: 3288793 - RNA, 11 nt, Variola virus
aacauccacug

SEQ ID NO: 3288794 - RNA, 18 nt, Variola virus
uaccaauaggaauacaag

SEQ ID NO: 3288795 - RNA, 15 nt, Variola virus
gaugagauguuuaua

SEQ ID NO: 3288796 - RNA, 21 nt, Variola virus
aaugagguagcaaaaaaacug

SEQ ID NO: 3288797 - RNA, 14 nt, Variola virus
auccuauacucuga

SEQ ID NO: 3288798 - RNA, 14 nt, Variola virus
uugaugacguguac

SEQ ID NO: 3288799 - RNA, 13 nt, Variola virus
auaagaaacaauu

SEQ ID NO: 3288800 - RNA, 15 nt, Variola virus
auauaucaugaugau

SEQ ID NO: 3288801 - RNA, 19 nt, Variola virus
aauaugcucaugaagauua

SEQ ID NO: 3288802 - RNA, 21 nt, Variola virus
agacauaucgguaaaaugcau

SEQ ID NO: 3288803 - RNA, 16 nt, Variola virus
aauuacauagaugaua

SEQ ID NO: 3288804 - RNA, 14 nt, Variola virus
uggucauagaaaau

SEQ ID NO: 3288805 - RNA, 18 nt, Variola virus
auauggauauucauagau

SEQ ID NO: 3288806 - RNA, 13 nt, Variola virus
guccguacuuauu

SEQ ID NO: 3288807 - RNA, 21 nt, Variola virus
uaauugaguaaauaaaugcuc

SEQ ID NO: 3288808 - RNA, 17 nt, Variola virus
cauagaugcccucuaua

SEQ ID NO: 3288809 - RNA, 14 nt, Variola virus
auauauucaaacaa

SEQ ID NO: 3288810 - RNA, 15 nt, Variola virus
auuauagauguguau

SEQ ID NO: 3288811 - RNA, 17 nt, Variola virus
uuggucaccaauucuag

SEQ ID NO: 3288812 - RNA, 21 nt, Variola virus
agaaaauaacagauauuacaa

SEQ ID NO: 3288813 - RNA, 21 nt, Variola virus
auagaagagcaaauaucucau

SEQ ID NO: 3288814 - RNA, 16 nt, Variola virus
uaauacauauuauuca

SEQ ID NO: 3288815 - RNA, 14 nt, Variola virus
aacuuuuaaauaca

SEQ ID NO: 3288816 - RNA, 13 nt, Variola virus
uauuccuuucauu

SEQ ID NO: 3288817 - RNA, 16 nt, Variola virus
cuuuugcuauuaccaa

SEQ ID NO: 3288818 - RNA, 20 nt, Variola virus
auuugauacggacaugguau

SEQ ID NO: 3288819 - RNA, 20 nt, Variola virus
auaucacaggggcaauguuu

SEQ ID NO: 3288820 - RNA, 18 nt, Variola virus
uacaaauauuauacauga

SEQ ID NO: 3288821 - RNA, 13 nt, Variola virus
gcucuaucuuuua

SEQ ID NO: 3288822 - RNA, 14 nt, Variola virus
uauuucguacauuu

SEQ ID NO: 3288823 - RNA, 16 nt, Variola virus
uaccucuucugauauc

SEQ ID NO: 3288824 - RNA, 14 nt, Variola virus
uuaaacuguaucga

SEQ ID NO: 3288825 - RNA, 21 nt, Variola virus
agaaguuguaaauaacaauga

SEQ ID NO: 3288826 - RNA, 23 nt, Variola virus
aggauauuagcgaauauaucaaa

SEQ ID NO: 3288827 - RNA, 21 nt, Variola virus
auuauucuuuggauccaaaug

SEQ ID NO: 3288828 - RNA, 13 nt, Variola virus
aguauuuaacaag

SEQ ID NO: 3288829 - RNA, 19 nt, Variola virus
cucauugauuauauucuca

SEQ ID NO: 3288830 - RNA, 22 nt, Variola virus
cacaaauggauguuaauguauu

SEQ ID NO: 3288831 - RNA, 20 nt, Variola virus
aguaaagauuucaaagaugu

SEQ ID NO: 3288832 - RNA, 15 nt, Variola virus
gucuaucaauaacug

SEQ ID NO: 3288833 - RNA, 17 nt, Variola virus
uaauacgaaaugucuga

SEQ ID NO: 3288834 - RNA, 13 nt, Variola virus
gcauuaauacagu

SEQ ID NO: 3288835 - RNA, 17 nt, Variola virus
gaauauaaauuauauau

SEQ ID NO: 3288836 - RNA, 16 nt, Variola virus
gaugcuauaguauauu

SEQ ID NO: 3288837 - RNA, 14 nt, Variola virus
aguaaaugcauaua

SEQ ID NO: 3288838 - RNA, 18 nt, Variola virus
uuguaaaguuaaaauugu

SEQ ID NO: 3288839 - RNA, 20 nt, Variola virus
uaauauuaucuauaugaugg

SEQ ID NO: 3288840 - RNA, 14 nt, Variola virus
ucuucuucuacauu

SEQ ID NO: 3288841 - RNA, 17 nt, Variola virus
guuuauggaucuauuca

SEQ ID NO: 3288842 - RNA, 16 nt, Variola virus
auaacguuagccacca

SEQ ID NO: 3288843 - RNA, 15 nt, Variola virus
ucaguaucuucuuua

SEQ ID NO: 3288844 - RNA, 23 nt, Variola virus
cuaucagagcuaccgaaggagau

SEQ ID NO: 3288845 - RNA, 18 nt, Variola virus
uguauggguaauaguguu

SEQ ID NO: 3288846 - RNA, 15 nt, Variola virus
uacaauauuuacauu

SEQ ID NO: 3288847 - RNA, 15 nt, Variola virus
aucaucuuuaucauu

SEQ ID NO: 3288848 - RNA, 21 nt, Variola virus
ucacaucaucgaacuucugau

SEQ ID NO: 3288849 - RNA, 16 nt, Variola virus
auguuugggagaauua

SEQ ID NO: 3288850 - RNA, 15 nt, Variola virus
ugucuauuauguaua

SEQ ID NO: 3288851 - RNA, 18 nt, Variola virus
auagucaaccaaauaaua

SEQ ID NO: 3288852 - RNA, 20 nt, Variola virus
ugacauggcuucuuccauag

SEQ ID NO: 3288853 - RNA, 21 nt, Variola virus
ugucaucaucaugauacacaa

SEQ ID NO: 3288854 - RNA, 16 nt, Variola virus
auaucuauauauguau

SEQ ID NO: 3288855 - RNA, 14 nt, Variola virus
auaucauuaaugau

SEQ ID NO: 3288856 - RNA, 19 nt, Variola virus
aggauuaacggguucucaa

SEQ ID NO: 3288857 - RNA, 22 nt, Variola virus
auuuucuuacaauuaacgagaa

SEQ ID NO: 3288858 - RNA, 13 nt, Variola virus
ugaauuaauguaa

SEQ ID NO: 3288859 - RNA, 16 nt, Variola virus
augaggugguugcaga

SEQ ID NO: 3288860 - RNA, 20 nt, Variola virus
uuauaaagaugguaaacugu

SEQ ID NO: 3288861 - RNA, 20 nt, Variola virus
agguaauguauauuuaucca

SEQ ID NO: 3288862 - RNA, 16 nt, Variola virus
agaaaucaaucuaucu

SEQ ID NO: 3288863 - RNA, 19 nt, Variola virus
guucagaggaugaaauaga

SEQ ID NO: 3288864 - RNA, 12 nt, Variola virus
aacaucagaaac

SEQ ID NO: 3288865 - RNA, 22 nt, Variola virus
auaauuuuuuaagcacaaaaua

SEQ ID NO: 3288866 - RNA, 15 nt, Variola virus
uauuccauuaaugac

SEQ ID NO: 3288867 - RNA, 16 nt, Variola virus
auauuuauaagaauga

SEQ ID NO: 3288868 - RNA, 18 nt, Variola virus
uuccacguagucaaugaa

SEQ ID NO: 3288869 - RNA, 23 nt, Variola virus
uaauagcagaaagcuauaacuug

SEQ ID NO: 3288870 - RNA, 17 nt, Variola virus
uaaaaaaucugaugagu

SEQ ID NO: 3288871 - RNA, 19 nt, Variola virus
ucuacagauauuuuaguuu

SEQ ID NO: 3288872 - RNA, 18 nt, Variola virus
uuaaacgauuuauaaaaa

SEQ ID NO: 3288873 - RNA, 17 nt, Variola virus
auacaaaauuuucaguu

SEQ ID NO: 3288874 - RNA, 20 nt, Variola virus
agagaggcugcugaaaauaa

SEQ ID NO: 3288875 - RNA, 16 nt, Variola virus
uuggcuucuuccaacu

SEQ ID NO: 3288876 - RNA, 18 nt, Variola virus
aguuccaaauuuaaauac

SEQ ID NO: 3288877 - RNA, 19 nt, Variola virus
uaucuggcucucucugcca

SEQ ID NO: 3288878 - RNA, 13 nt, Variola virus
ccaaauaucuuua

SEQ ID NO: 3288879 - RNA, 13 nt, Variola virus
auaauuauacuuu

SEQ ID NO: 3288880 - RNA, 18 nt, Variola virus
ugaugaauaauuuagaua

SEQ ID NO: 3288881 - RNA, 20 nt, Variola virus
uagacgagggguuagauggu

SEQ ID NO: 3288882 - RNA, 20 nt, Variola virus
uaacaugcgguucaaaauag

SEQ ID NO: 3288883 - RNA, 20 nt, Variola virus
caauuauaacaauuauaaca

SEQ ID NO: 3288884 - RNA, 15 nt, Variola virus
uaacuacuaauguau

SEQ ID NO: 3288885 - RNA, 21 nt, Variola virus
auacuuuuaauugaacaaaag

SEQ ID NO: 3288886 - RNA, 21 nt, Variola virus
accuagaaucgauaaaaccau

SEQ ID NO: 3288887 - RNA, 16 nt, Variola virus
aaauauaauguuguau

SEQ ID NO: 3288888 - RNA, 17 nt, Variola virus
uugauaucuuuagauau

SEQ ID NO: 3288889 - RNA, 14 nt, Variola virus
uuauauauguaaua

SEQ ID NO: 3288890 - RNA, 20 nt, Variola virus
gaaaccacugucuaaaugua

SEQ ID NO: 3288891 - RNA, 15 nt, Variola virus
gacaugcaaaaaugc

SEQ ID NO: 3288892 - RNA, 23 nt, Variola virus
auauuuaagugauauaaaacauu

SEQ ID NO: 3288893 - RNA, 18 nt, Variola virus
cgcuacacccacuagaaa

SEQ ID NO: 3288894 - RNA, 15 nt, Variola virus
ucuaacgguaguguu

SEQ ID NO: 3288895 - RNA, 15 nt, Variola virus
auauugaaaaugaca

SEQ ID NO: 3288896 - RNA, 16 nt, Variola virus
auaaacuauuguuaug

SEQ ID NO: 3288897 - RNA, 13 nt, Variola virus
uguuaauguauua

SEQ ID NO: 3288898 - RNA, 21 nt, Variola virus
cauaaauaaaugcuugauauu

SEQ ID NO: 3288899 - RNA, 22 nt, Variola virus
uguuauguauuucauuguucau

SEQ ID NO: 3288900 - RNA, 23 nt, Variola virus
aucaaucaaaagacuauacauuu

SEQ ID NO: 3288901 - RNA, 19 nt, Variola virus
cucuacaaaaugucaugau

SEQ ID NO: 3288902 - RNA, 12 nt, Variola virus
caacucucaaaa

SEQ ID NO: 3288903 - RNA, 11 nt, Variola virus
agaaaacauua

SEQ ID NO: 3288904 - RNA, 11 nt, Variola virus
caauuaaugau

SEQ ID NO: 3288905 - RNA, 15 nt, Variola virus
aauuaguuuuaccuu

SEQ ID NO: 3288906 - RNA, 16 nt, Variola virus
agaaccaguaacauau

SEQ ID NO: 3288907 - RNA, 14 nt, Variola virus
uauuacaauuaaau

SEQ ID NO: 3288908 - RNA, 16 nt, Variola virus
aguuaaggauaauaag

SEQ ID NO: 3288909 - RNA, 17 nt, Variola virus
uguucgucugucaugau

SEQ ID NO: 3288910 - RNA, 17 nt, Variola virus
uucaacaugauuauucu

SEQ ID NO: 3288911 - RNA, 14 nt, Variola virus
auuauuaugaugau

SEQ ID NO: 3288912 - RNA, 22 nt, Variola virus
uuaauagaugacguauuauaca

SEQ ID NO: 3288913 - RNA, 18 nt, Variola virus
uaauuccaaaaauagcau

SEQ ID NO: 3288914 - RNA, 14 nt, Variola virus
aacaaugucaaaau

SEQ ID NO: 3288915 - RNA, 19 nt, Variola virus
cugcuuuagaugauuuugg

SEQ ID NO: 3288916 - RNA, 18 nt, Variola virus
accaguaucaauuuauca

SEQ ID NO: 3288917 - RNA, 15 nt, Variola virus
agucuccacacuauu

SEQ ID NO: 3288918 - RNA, 16 nt, Variola virus
uucuaagguagaaucu

SEQ ID NO: 3288919 - RNA, 16 nt, Variola virus
uauuggaauuauaaua

SEQ ID NO: 3288920 - RNA, 22 nt, Variola virus
uucauaauuguuagcuguuuuc

SEQ ID NO: 3288921 - RNA, 18 nt, Variola virus
uaucuucauaaaauacua

SEQ ID NO: 3288922 - RNA, 18 nt, Variola virus
ucuaccagcuggaaaaag

SEQ ID NO: 3288923 - RNA, 18 nt, Variola virus
gaacuucugaucauuaau

SEQ ID NO: 3288924 - RNA, 18 nt, Variola virus
cauuuggucuauacaaau

SEQ ID NO: 3288925 - RNA, 18 nt, Variola virus
agaauugcugcaauauau

SEQ ID NO: 3288926 - RNA, 22 nt, Variola virus
uuccaaaguugggauaguauuu

SEQ ID NO: 3288927 - RNA, 17 nt, Variola virus
auugauuucgucaaugu

SEQ ID NO: 3288928 - RNA, 21 nt, Variola virus
agaauuucuacauaauuauau

SEQ ID NO: 3288929 - RNA, 14 nt, Variola virus
uuuuaauauaaacg

SEQ ID NO: 3288930 - RNA, 18 nt, Variola virus
uauaauaaauguauacau

SEQ ID NO: 3288931 - RNA, 14 nt, Variola virus
uaaugguguguuau

SEQ ID NO: 3288932 - RNA, 16 nt, Variola virus
aauaugcucaugaaga

SEQ ID NO: 3288933 - RNA, 14 nt, Variola virus
agcaauucauguac

SEQ ID NO: 3288934 - RNA, 14 nt, Variola virus
gcauccaaauggau

SEQ ID NO: 3288935 - RNA, 19 nt, Variola virus
aguagauaauauagaaaau

SEQ ID NO: 3288936 - RNA, 17 nt, Variola virus
uuacauaaaugaaaaga

SEQ ID NO: 3288937 - RNA, 17 nt, Variola virus
gcagauagcuauaugau

SEQ ID NO: 3288938 - RNA, 23 nt, Variola virus
aucaaacucuaaugaccacaucu

SEQ ID NO: 3288939 - RNA, 12 nt, Variola virus
uaaucauuauua

SEQ ID NO: 3288940 - RNA, 18 nt, Variola virus
cuguauuuggaucuuuug

SEQ ID NO: 3288941 - RNA, 21 nt, Variola virus
augauauccacuaguuuccuu

SEQ ID NO: 3288942 - RNA, 18 nt, Variola virus
uuagaugagaaauuauuc

SEQ ID NO: 3288943 - RNA, 12 nt, Variola virus
caaauauauuua

SEQ ID NO: 3288944 - RNA, 17 nt, Variola virus
cuaguuuuacuaucaua

SEQ ID NO: 3288945 - RNA, 13 nt, Variola virus
gaaucaguauaua

SEQ ID NO: 3288946 - RNA, 22 nt, Variola virus
aaacauuuuauauacuuuucua

SEQ ID NO: 3288947 - RNA, 13 nt, Variola virus
acauuauaugauu

SEQ ID NO: 3288948 - RNA, 22 nt, Variola virus
uuauccguauuuccauaauaag

SEQ ID NO: 3288949 - RNA, 14 nt, Variola virus
uuuaaaaugaucua

SEQ ID NO: 3288950 - RNA, 14 nt, Variola virus
ggaguuauaugaau

SEQ ID NO: 3288951 - RNA, 22 nt, Variola virus
gcaaguaggauuuuuccaaagu

SEQ ID NO: 3288952 - RNA, 17 nt, Variola virus
agaucaacagaaauauu

SEQ ID NO: 3288953 - RNA, 20 nt, Variola virus
cguccaacgaauaacauccg

SEQ ID NO: 3288954 - RNA, 19 nt, Variola virus
auauuuccccuauaaucuu

SEQ ID NO: 3288955 - RNA, 23 nt, Variola virus
cuaaaauaguucuguaauauguc

SEQ ID NO: 3288956 - RNA, 20 nt, Variola virus
ucgaaaaacuuuaauguaga

SEQ ID NO: 3288957 - RNA, 19 nt, Variola virus
acacuuuuguaaaauauua

SEQ ID NO: 3288958 - RNA, 19 nt, Variola virus
cucgagaauauuuaauuug

SEQ ID NO: 3288959 - RNA, 16 nt, Variola virus
uucuauuuuuaauuuu

SEQ ID NO: 3288960 - RNA, 16 nt, Variola virus
acucaauuauacucua

SEQ ID NO: 3288961 - RNA, 22 nt, Variola virus
uggccauuauuagaaauuuauc

SEQ ID NO: 3288962 - RNA, 14 nt, Variola virus
cgaaugaauguuuu

SEQ ID NO: 3288963 - RNA, 19 nt, Variola virus
aaugaacauaguaagaaau

SEQ ID NO: 3288964 - RNA, 19 nt, Variola virus
aauaauauaaaauucccaa

SEQ ID NO: 3288965 - RNA, 14 nt, Variola virus
uaucuaacaucuug

SEQ ID NO: 3288966 - RNA, 18 nt, Variola virus
gaggaaaaaggacacauu

SEQ ID NO: 3288967 - RNA, 23 nt, Variola virus
aauauccacuauugcaacuauaa

SEQ ID NO: 3288968 - RNA, 13 nt, Variola virus
uauaaccuuaaua

SEQ ID NO: 3288969 - RNA, 22 nt, Variola virus
uuaauucuagacuauuuggaca

SEQ ID NO: 3288970 - RNA, 19 nt, Variola virus
aucucguuuagaaaaaugc

SEQ ID NO: 3288971 - RNA, 22 nt, Variola virus
gaaauugucacuacuaaaucaa

SEQ ID NO: 3288972 - RNA, 16 nt, Variola virus
cugaaaaugaaauugu

SEQ ID NO: 3288973 - RNA, 23 nt, Variola virus
augaucaagaaggaaaucaaauc

SEQ ID NO: 3288974 - RNA, 15 nt, Variola virus
aaagaaguccauuua

SEQ ID NO: 3288975 - RNA, 14 nt, Variola virus
auuauucuauccaa

SEQ ID NO: 3288976 - RNA, 16 nt, Variola virus
ugguaaaguaaaucau

SEQ ID NO: 3288977 - RNA, 20 nt, Variola virus
auuacugcaacguucauaga

SEQ ID NO: 3288978 - RNA, 17 nt, Variola virus
gcauuuuuauauacauu

SEQ ID NO: 3288979 - RNA, 14 nt, Variola virus
acuccuugacuauc

SEQ ID NO: 3288980 - RNA, 18 nt, Variola virus
uuaauaucgcacaaagaa

SEQ ID NO: 3288981 - RNA, 21 nt, Variola virus
auccuuagucaucuugucuag

SEQ ID NO: 3288982 - RNA, 14 nt, Variola virus
uauaguuaacauuu

SEQ ID NO: 3288983 - RNA, 15 nt, Variola virus
uucauucguaaaucu

SEQ ID NO: 3288984 - RNA, 21 nt, Variola virus
gacgcuuguuaauaaguaaau

SEQ ID NO: 3288985 - RNA, 12 nt, Variola virus
cuugaucauuuc

SEQ ID NO: 3288986 - RNA, 15 nt, Variola virus
cuaggauuuaaacaa

SEQ ID NO: 3288987 - RNA, 20 nt, Variola virus
uacuuagucuguacaaaagu

SEQ ID NO: 3288988 - RNA, 21 nt, Variola virus
cauugucuaauagauauuuga

SEQ ID NO: 3288989 - RNA, 21 nt, Variola virus
cuagauuaucuagucagaacu

SEQ ID NO: 3288990 - RNA, 21 nt, Variola virus
uauaacagagccaucuguaaa

SEQ ID NO: 3288991 - RNA, 20 nt, Variola virus
ccacugagaugacuggaaau

SEQ ID NO: 3288992 - RNA, 15 nt, Variola virus
ccaaaggauguuuaa

SEQ ID NO: 3288993 - RNA, 14 nt, Variola virus
gacucauuaaaacu

SEQ ID NO: 3288994 - RNA, 18 nt, Variola virus
acuucuuggaaugauacu

SEQ ID NO: 3288995 - RNA, 16 nt, Variola virus
guuaacauuuuauuau

SEQ ID NO: 3288996 - RNA, 16 nt, Variola virus
ccauuaaaaauuguua

SEQ ID NO: 3288997 - RNA, 23 nt, Variola virus
uaaaauagcguucacauauccuc

SEQ ID NO: 3288998 - RNA, 20 nt, Variola virus
auaaaauagcguucacauau

SEQ ID NO: 3288999 - RNA, 21 nt, Variola virus
uacgaaaacgaaaucuguaau

SEQ ID NO: 3289000 - RNA, 23 nt, Variola virus
auuuaugucauaaacuguaaaug

SEQ ID NO: 3289001 - RNA, 19 nt, Variola virus
caauaaaugcauuaguuua

SEQ ID NO: 3289002 - RNA, 22 nt, Variola virus
agagcuaccgaaggagauacua

SEQ ID NO: 3289003 - RNA, 16 nt, Variola virus
uuuaaccuauacauga

SEQ ID NO: 3289004 - RNA, 15 nt, Variola virus
uuuaagauuguacac

SEQ ID NO: 3289005 - RNA, 19 nt, Variola virus
uccauggaagaacuaccaa

SEQ ID NO: 3289006 - RNA, 17 nt, Variola virus
uuucaauaauauacuaa

SEQ ID NO: 3289007 - RNA, 15 nt, Variola virus
auugagguuucugac

SEQ ID NO: 3289008 - RNA, 21 nt, Variola virus
uaacgaguucaaauaugaaau

SEQ ID NO: 3289009 - RNA, 17 nt, Variola virus
cuaugaauuuauaaaau

SEQ ID NO: 3289010 - RNA, 23 nt, Variola virus
aucuuuaacgauaccuauaccua

SEQ ID NO: 3289011 - RNA, 12 nt, Variola virus
uuaaaauaucua

SEQ ID NO: 3289012 - RNA, 17 nt, Variola virus
acccguaguuuuaacug

SEQ ID NO: 3289013 - RNA, 18 nt, Variola virus
ccacaugccgccacuacc

SEQ ID NO: 3289014 - RNA, 14 nt, Variola virus
uuacuauagcauua

SEQ ID NO: 3289015 - RNA, 15 nt, Variola virus
acaaaucuauaacau

SEQ ID NO: 3289016 - RNA, 22 nt, Variola virus
acuacauaguuaucuaucuuaa

SEQ ID NO: 3289017 - RNA, 19 nt, Variola virus
aaguauacauguuagagaa

SEQ ID NO: 3289018 - RNA, 21 nt, Variola virus
guugcaauaauaaaaguuauc

SEQ ID NO: 3289019 - RNA, 13 nt, Variola virus
auacuuuaacauc

SEQ ID NO: 3289020 - RNA, 17 nt, Variola virus
ccauuauuagaaauuua

SEQ ID NO: 3289021 - RNA, 18 nt, Variola virus
uaguaaaaaauaagucag

SEQ ID NO: 3289022 - RNA, 18 nt, Variola virus
uuaguuauugcaauauag

SEQ ID NO: 3289023 - RNA, 13 nt, Variola virus
ugagauucuccau

SEQ ID NO: 3289024 - RNA, 16 nt, Variola virus
ugaggauuuaaaacuc

SEQ ID NO: 3289025 - RNA, 14 nt, Variola virus
aaauacaaauauau

SEQ ID NO: 3289026 - RNA, 17 nt, Variola virus
aaacuuuucagaauauc

SEQ ID NO: 3289027 - RNA, 14 nt, Variola virus
ugaggauauacaaa

SEQ ID NO: 3289028 - RNA, 23 nt, Variola virus
gaucuuuauuuuuuguguauuuu

SEQ ID NO: 3289029 - RNA, 19 nt, Variola virus
cugauacccaaaaacaucc

SEQ ID NO: 3289030 - RNA, 20 nt, Variola virus
gauaaugauauauuaaacaa

SEQ ID NO: 3289031 - RNA, 18 nt, Variola virus
augauagaaaugaugaag

SEQ ID NO: 3289032 - RNA, 19 nt, Variola virus
aagucucguucguaaauaa

SEQ ID NO: 3289033 - RNA, 13 nt, Variola virus
cuaucuacaucuu

SEQ ID NO: 3289034 - RNA, 23 nt, Variola virus
uuacaacggcgccagauuuaaga

SEQ ID NO: 3289035 - RNA, 14 nt, Variola virus
auauucuaugacug

SEQ ID NO: 3289036 - RNA, 15 nt, Variola virus
auuuaagugaugcau

SEQ ID NO: 3289037 - RNA, 11 nt, Variola virus
uaaaauuauuc

SEQ ID NO: 3289038 - RNA, 12 nt, Variola virus
cauuccaaagau

SEQ ID NO: 3289039 - RNA, 15 nt, Variola virus
auuagcagaauagau

SEQ ID NO: 3289040 - RNA, 22 nt, Variola virus
auagcauagauauagaaacgga

SEQ ID NO: 3289041 - RNA, 20 nt, Variola virus
gucaauucccuccuguagua

SEQ ID NO: 3289042 - RNA, 21 nt, Variola virus
aaaaugaugcuauuagaauuu

SEQ ID NO: 3289043 - RNA, 16 nt, Variola virus
uagucauaauaucuuu

SEQ ID NO: 3289044 - RNA, 18 nt, Variola virus
aguauauggacaaacgug

SEQ ID NO: 3289045 - RNA, 22 nt, Variola virus
uuaagagauuuagaaaacauua

SEQ ID NO: 3289046 - RNA, 23 nt, Variola virus
agaacuuaggcauggacauacua

SEQ ID NO: 3289047 - RNA, 18 nt, Variola virus
uuaagacauauauuauua

SEQ ID NO: 3289048 - RNA, 23 nt, Variola virus
uaagacguuguaucucuuuuucc

SEQ ID NO: 3289049 - RNA, 16 nt, Variola virus
guacauuucacagaaa

SEQ ID NO: 3289050 - RNA, 17 nt, Variola virus
ucauuaaguucacuaga

SEQ ID NO: 3289051 - RNA, 16 nt, Variola virus
cugauuucucucauaa

SEQ ID NO: 3289052 - RNA, 21 nt, Variola virus
aucaacugcguugauuaaaaa

SEQ ID NO: 3289053 - RNA, 12 nt, Variola virus
auuaguuauuau

SEQ ID NO: 3289054 - RNA, 15 nt, Variola virus
uagugaaacaaaaua

SEQ ID NO: 3289055 - RNA, 23 nt, Variola virus
aaccuaacuaaaagacauaauau

SEQ ID NO: 3289056 - RNA, 18 nt, Variola virus
auggauugguaacauuau

SEQ ID NO: 3289057 - RNA, 14 nt, Variola virus
cuccgauauucaau

SEQ ID NO: 3289058 - RNA, 23 nt, Variola virus
auuaaggacuuuuauaucccaca

SEQ ID NO: 3289059 - RNA, 21 nt, Variola virus
uccuguaguauugauucuaga

SEQ ID NO: 3289060 - RNA, 17 nt, Variola virus
auagugguacaauacua

SEQ ID NO: 3289061 - RNA, 16 nt, Variola virus
uuauuagaauaagagu

SEQ ID NO: 3289062 - RNA, 11 nt, Variola virus
ucaaggauucu

SEQ ID NO: 3289063 - RNA, 14 nt, Variola virus
aaccauucauuaau

SEQ ID NO: 3289064 - RNA, 22 nt, Variola virus
gaucugcuauauggauauucau

SEQ ID NO: 3289065 - RNA, 14 nt, Variola virus
aguauaaacuauaa

SEQ ID NO: 3289066 - RNA, 18 nt, Variola virus
aaacuaauuuuagcagaa

SEQ ID NO: 3289067 - RNA, 13 nt, Variola virus
gucuuuacagauu

SEQ ID NO: 3289068 - RNA, 21 nt, Variola virus
gacauaugccuauuuauauau

SEQ ID NO: 3289069 - RNA, 23 nt, Variola virus
gcguauauuuuauacauuuuuua

SEQ ID NO: 3289070 - RNA, 18 nt, Variola virus
uuaucaugagauguguuu

SEQ ID NO: 3289071 - RNA, 20 nt, Variola virus
uacacguuagauuauucuca

SEQ ID NO: 3289072 - RNA, 22 nt, Variola virus
cuugauaaccuuggcugucuca

SEQ ID NO: 3289073 - RNA, 13 nt, Variola virus
aaacgaacuauau

SEQ ID NO: 3289074 - RNA, 22 nt, Variola virus
uuauaucauccaauauuauuga

SEQ ID NO: 3289075 - RNA, 15 nt, Variola virus
cagaauguuucaaag

SEQ ID NO: 3289076 - RNA, 22 nt, Variola virus
uaacuucgugaauaauguuucu

SEQ ID NO: 3289077 - RNA, 18 nt, Variola virus
uaguacaagaaauacuuc

SEQ ID NO: 3289078 - RNA, 17 nt, Variola virus
gacucauuuaguuuauu

SEQ ID NO: 3289079 - RNA, 21 nt, Variola virus
uauuaacgugaaacguaguau

SEQ ID NO: 3289080 - RNA, 13 nt, Variola virus
auguuacacuaua

SEQ ID NO: 3289081 - RNA, 20 nt, Variola virus
cagcuauaugcaacuauaaa

SEQ ID NO: 3289082 - RNA, 14 nt, Variola virus
acuacuuuagaaga

SEQ ID NO: 3289083 - RNA, 16 nt, Variola virus
gccacuauuauugaaa

SEQ ID NO: 3289084 - RNA, 21 nt, Variola virus
aagugacauuauaauuuuacc

SEQ ID NO: 3289085 - RNA, 12 nt, Variola virus
acuauuaaaacu

SEQ ID NO: 3289086 - RNA, 18 nt, Variola virus
aacgcuacuauauauuau

SEQ ID NO: 3289087 - RNA, 13 nt, Variola virus
auauuaaggagau

SEQ ID NO: 3289088 - RNA, 15 nt, Variola virus
aucuauauauguauu

SEQ ID NO: 3289089 - RNA, 23 nt, Variola virus
auaauggcuguuuguauaauaga

SEQ ID NO: 3289090 - RNA, 17 nt, Variola virus
caauaaacaaaauacuc

SEQ ID NO: 3289091 - RNA, 15 nt, Variola virus
uagguauguccucua

SEQ ID NO: 3289092 - RNA, 15 nt, Variola virus
aucuguaaacauuug

SEQ ID NO: 3289093 - RNA, 13 nt, Variola virus
cuagcaaaacuau

SEQ ID NO: 3289094 - RNA, 20 nt, Variola virus
guuuuugaacuguucaaaau

SEQ ID NO: 3289095 - RNA, 17 nt, Variola virus
uaauucuccuauuacau

SEQ ID NO: 3289096 - RNA, 18 nt, Variola virus
aauaaucguuauuaucau

SEQ ID NO: 3289097 - RNA, 18 nt, Variola virus
auuaaauagaauauuuaa

SEQ ID NO: 3289098 - RNA, 17 nt, Variola virus
uuucguaccaacucauu

SEQ ID NO: 3289099 - RNA, 23 nt, Variola virus
guuauauguaacauuaaguaaau

SEQ ID NO: 3289100 - RNA, 18 nt, Variola virus
aggccaagcgaauuauuu

SEQ ID NO: 3289101 - RNA, 18 nt, Variola virus
uccaugucaaauagaguu

SEQ ID NO: 3289102 - RNA, 20 nt, Variola virus
uggaauccaauuguuugaua

SEQ ID NO: 3289103 - RNA, 15 nt, Variola virus
aaugaagauccaaga

SEQ ID NO: 3289104 - RNA, 16 nt, Variola virus
auaucuucuccuguaa

SEQ ID NO: 3289105 - RNA, 20 nt, Variola virus
gaccguaccagugacagaua

SEQ ID NO: 3289106 - RNA, 16 nt, Variola virus
aggcaucaaaaaaugu

SEQ ID NO: 3289107 - RNA, 14 nt, Variola virus
gaauuauagacacu

SEQ ID NO: 3289108 - RNA, 21 nt, Variola virus
ugucuacaaccgcuacauaau

SEQ ID NO: 3289109 - RNA, 17 nt, Variola virus
agauugaucauguagaa

SEQ ID NO: 3289110 - RNA, 16 nt, Variola virus
ucuguaacuaugaauu

SEQ ID NO: 3289111 - RNA, 21 nt, Variola virus
uuaaugccgauuuaauacguu

SEQ ID NO: 3289112 - RNA, 22 nt, Variola virus
aauugauucuuauucacuauau

SEQ ID NO: 3289113 - RNA, 22 nt, Variola virus
uaguuucugguuuucuauaaau

SEQ ID NO: 3289114 - RNA, 18 nt, Variola virus
agcaaaaacaaaaaacuu

SEQ ID NO: 3289115 - RNA, 17 nt, Variola virus
auuauccuaucauguau

SEQ ID NO: 3289116 - RNA, 21 nt, Variola virus
acaguuacgguuguacauuau

SEQ ID NO: 3289117 - RNA, 23 nt, Variola virus
accaccuauagauuuugaauauu

SEQ ID NO: 3289118 - RNA, 15 nt, Variola virus
auaaugauuaauauu

SEQ ID NO: 3289119 - RNA, 22 nt, Variola virus
uacagauauauucauaguaguu

SEQ ID NO: 3289120 - RNA, 22 nt, Variola virus
guauuuuaacacuaauuaagau

SEQ ID NO: 3289121 - RNA, 22 nt, Variola virus
agcaauuagugccguauacuuu

SEQ ID NO: 3289122 - RNA, 16 nt, Variola virus
auaaucguauacuuca

SEQ ID NO: 3289123 - RNA, 16 nt, Variola virus
ucucuguaagauuucc

SEQ ID NO: 3289124 - RNA, 13 nt, Variola virus
guguuauaauauu

SEQ ID NO: 3289125 - RNA, 18 nt, Variola virus
agauuagcuuugauguuu

SEQ ID NO: 3289126 - RNA, 16 nt, Variola virus
gaacgauaaacaaauu

SEQ ID NO: 3289127 - RNA, 15 nt, Variola virus
aagaaaacaaacauu

SEQ ID NO: 3289128 - RNA, 11 nt, Variola virus
cagaugauauc

SEQ ID NO: 3289129 - RNA, 16 nt, Variola virus
guuuaaauuaagcauc

SEQ ID NO: 3289130 - RNA, 21 nt, Variola virus
agauaaauuuaccacuagaac

SEQ ID NO: 3289131 - RNA, 17 nt, Variola virus
uguuucuauguuuucua

SEQ ID NO: 3289132 - RNA, 18 nt, Variola virus
auacgugagaauauacua

SEQ ID NO: 3289133 - RNA, 19 nt, Variola virus
uagaugguauuucugaaag

SEQ ID NO: 3289134 - RNA, 13 nt, Variola virus
ucuggaauuaaaa

SEQ ID NO: 3289135 - RNA, 22 nt, Variola virus
gaaauauaaaaccaacuaauau

SEQ ID NO: 3289136 - RNA, 15 nt, Variola virus
ugguuuauaccuaac

SEQ ID NO: 3289137 - RNA, 19 nt, Variola virus
uuaauucguucgaugagua

SEQ ID NO: 3289138 - RNA, 22 nt, Variola virus
gaaaaaaaauugaauugaugau

SEQ ID NO: 3289139 - RNA, 19 nt, Variola virus
cauucuaauguucauaauu

SEQ ID NO: 3289140 - RNA, 20 nt, Variola virus
ccagugcuauaucucccugu

SEQ ID NO: 3289141 - RNA, 18 nt, Variola virus
ucagaacacacuuuucuc

SEQ ID NO: 3289142 - RNA, 16 nt, Variola virus
ucuguuuccuauaauc

SEQ ID NO: 3289143 - RNA, 16 nt, Variola virus
cauuaguaaggcuuua

SEQ ID NO: 3289144 - RNA, 15 nt, Variola virus
aaauaaaauaauaau

SEQ ID NO: 3289145 - RNA, 23 nt, Variola virus
aauagaaugcucuuaaauaaugu

SEQ ID NO: 3289146 - RNA, 14 nt, Variola virus
cuauaaaauggauu

SEQ ID NO: 3289147 - RNA, 22 nt, Variola virus
acuauaaaaaaaauaauaauua

SEQ ID NO: 3289148 - RNA, 21 nt, Variola virus
ucacuuaacaauuccacaaau

SEQ ID NO: 3289149 - RNA, 16 nt, Variola virus
aauuuuuuaaauccug

SEQ ID NO: 3289150 - RNA, 14 nt, Variola virus
ugaaucaaauguaa

SEQ ID NO: 3289151 - RNA, 16 nt, Variola virus
acuuaacuaucuuuca

SEQ ID NO: 3289152 - RNA, 17 nt, Variola virus
gaauuaauguaaucauu

SEQ ID NO: 3289153 - RNA, 12 nt, Variola virus
aucaauguacau

SEQ ID NO: 3289154 - RNA, 16 nt, Variola virus
uguuauauauugucua

SEQ ID NO: 3289155 - RNA, 18 nt, Variola virus
aauaagagacuuaaacaa

SEQ ID NO: 3289156 - RNA, 16 nt, Variola virus
aauauuaauaacauua

SEQ ID NO: 3289157 - RNA, 15 nt, Variola virus
guauuugauaaaaca

SEQ ID NO: 3289158 - RNA, 19 nt, Variola virus
agcaauuacuaaacauaaa

SEQ ID NO: 3289159 - RNA, 22 nt, Variola virus
uacuuggaaaguuuuauaugua

SEQ ID NO: 3289160 - RNA, 22 nt, Variola virus
aucuauauauguauuuuaauaa

SEQ ID NO: 3289161 - RNA, 15 nt, Variola virus
auauuccuagaauua

SEQ ID NO: 3289162 - RNA, 14 nt, Variola virus
aauagaaacauaua

SEQ ID NO: 3289163 - RNA, 16 nt, Variola virus
aaaagauacguacugu

SEQ ID NO: 3289164 - RNA, 23 nt, Variola virus
cuccaucaauuucaaaaagagcu

SEQ ID NO: 3289165 - RNA, 18 nt, Variola virus
aucaugcagagaaaaguu

SEQ ID NO: 3289166 - RNA, 15 nt, Variola virus
aaugucuaaauucca

SEQ ID NO: 3289167 - RNA, 17 nt, Variola virus
ccaaacauuaacagauu

SEQ ID NO: 3289168 - RNA, 17 nt, Variola virus
auguuacucacauuuau

SEQ ID NO: 3289169 - RNA, 15 nt, Variola virus
aaaaugauuaaauua

SEQ ID NO: 3289170 - RNA, 15 nt, Variola virus
uuaucguuauuauua

SEQ ID NO: 3289171 - RNA, 16 nt, Variola virus
gauaacacauuuucau

SEQ ID NO: 3289172 - RNA, 23 nt, Variola virus
aucaaguuuguaggaaaggacaa

SEQ ID NO: 3289173 - RNA, 22 nt, Variola virus
uacaaacgauuauuagaucuuu

SEQ ID NO: 3289174 - RNA, 16 nt, Variola virus
gguaugggauaaaaua

SEQ ID NO: 3289175 - RNA, 18 nt, Variola virus
gaugagcauaaacauaau

SEQ ID NO: 3289176 - RNA, 20 nt, Variola virus
gauuauaauccuuauacauc

SEQ ID NO: 3289177 - RNA, 13 nt, Variola virus
uaaaacaugguga

SEQ ID NO: 3289178 - RNA, 15 nt, Variola virus
aguuucuuaacuaca

SEQ ID NO: 3289179 - RNA, 14 nt, Variola virus
aacuacaauauuuc

SEQ ID NO: 3289180 - RNA, 15 nt, Variola virus
gaaucccuacauauu

SEQ ID NO: 3289181 - RNA, 17 nt, Variola virus
aucuguacuucuauaca

SEQ ID NO: 3289182 - RNA, 18 nt, Variola virus
ggaugaaucauuggcaac

SEQ ID NO: 3289183 - RNA, 21 nt, Variola virus
cagaagugugaauaugaucuu

SEQ ID NO: 3289184 - RNA, 22 nt, Variola virus
uugugaucggauaguauucaag

SEQ ID NO: 3289185 - RNA, 13 nt, Variola virus
uacaguucuucua

SEQ ID NO: 3289186 - RNA, 11 nt, Variola virus
gcuauaaugau

SEQ ID NO: 3289187 - RNA, 18 nt, Variola virus
uguuguacaaauuccucg

SEQ ID NO: 3289188 - RNA, 23 nt, Variola virus
cguaaaccauuuuucagaaagua

SEQ ID NO: 3289189 - RNA, 14 nt, Variola virus
uuagugaaacauuc

SEQ ID NO: 3289190 - RNA, 15 nt, Variola virus
auaacauuguuuaug

SEQ ID NO: 3289191 - RNA, 17 nt, Variola virus
ggaauaugacuauuuuc

SEQ ID NO: 3289192 - RNA, 13 nt, Variola virus
cuguuuauuuuag

SEQ ID NO: 3289193 - RNA, 16 nt, Variola virus
uaauugggugaagaau

SEQ ID NO: 3289194 - RNA, 17 nt, Variola virus
uagccuuaagaaaacua

SEQ ID NO: 3289195 - RNA, 13 nt, Variola virus
aaaaccaaaucuu

SEQ ID NO: 3289196 - RNA, 16 nt, Variola virus
aacaucacgaaaucua

SEQ ID NO: 3289197 - RNA, 13 nt, Variola virus
auuuaauaagacu

SEQ ID NO: 3289198 - RNA, 21 nt, Variola virus
uaggaaauugguuuauaaugu

SEQ ID NO: 3289199 - RNA, 11 nt, Variola virus
gauauaaugaa

SEQ ID NO: 3289200 - RNA, 21 nt, Variola virus
aauauagguauauuuauucca

SEQ ID NO: 3289201 - RNA, 16 nt, Variola virus
guagauauauaaauaa

SEQ ID NO: 3289202 - RNA, 16 nt, Variola virus
aaugaguucugugcag

SEQ ID NO: 3289203 - RNA, 21 nt, Variola virus
uaguaucaauaacacaaucau

SEQ ID NO: 3289204 - RNA, 22 nt, Variola virus
acucauuauuucccaaaauuug

SEQ ID NO: 3289205 - RNA, 13 nt, Variola virus
cuauccaauaaac

SEQ ID NO: 3289206 - RNA, 15 nt, Variola virus
aaauaucuauaugau

SEQ ID NO: 3289207 - RNA, 19 nt, Variola virus
uaucuuuccauuuaucaug

SEQ ID NO: 3289208 - RNA, 16 nt, Variola virus
augauugauuagaaaa

SEQ ID NO: 3289209 - RNA, 15 nt, Variola virus
aaguuucuuuacugu

SEQ ID NO: 3289210 - RNA, 23 nt, Variola virus
uagaacuguagagggucaacaau

SEQ ID NO: 3289211 - RNA, 16 nt, Variola virus
agaauaauuagaaauu

SEQ ID NO: 3289212 - RNA, 16 nt, Variola virus
uuagaagauaaugaau

SEQ ID NO: 3289213 - RNA, 22 nt, Variola virus
augccuauuaggacagauacua

SEQ ID NO: 3289214 - RNA, 21 nt, Variola virus
aguuucucaugucucuauaua

SEQ ID NO: 3289215 - RNA, 16 nt, Variola virus
aaugagagcaaaauau

SEQ ID NO: 3289216 - RNA, 16 nt, Variola virus
uuuuggugaaauccaa

SEQ ID NO: 3289217 - RNA, 17 nt, Variola virus
uaaucuauuuuaucauu

SEQ ID NO: 3289218 - RNA, 14 nt, Variola virus
uaaagcauuauucu

SEQ ID NO: 3289219 - RNA, 16 nt, Variola virus
ugaauggauacuaguu

SEQ ID NO: 3289220 - RNA, 23 nt, Variola virus
ggauaucuuagugcaaaaguaua

SEQ ID NO: 3289221 - RNA, 14 nt, Variola virus
uuacaucuugauau

SEQ ID NO: 3289222 - RNA, 16 nt, Variola virus
agauuguuuaauauau

SEQ ID NO: 3289223 - RNA, 18 nt, Variola virus
uauuuaucaauucuucua

SEQ ID NO: 3289224 - RNA, 15 nt, Variola virus
guaucauauauuaaa

SEQ ID NO: 3289225 - RNA, 23 nt, Variola virus
uauuuacacacauaauccauucu

SEQ ID NO: 3289226 - RNA, 15 nt, Variola virus
gaaacauaacaauga

SEQ ID NO: 3289227 - RNA, 18 nt, Variola virus
auaacuuccgacuacaua

SEQ ID NO: 3289228 - RNA, 15 nt, Variola virus
aaaaagugaaacaug

SEQ ID NO: 3289229 - RNA, 16 nt, Variola virus
acaguuacaaaugagu

SEQ ID NO: 3289230 - RNA, 17 nt, Variola virus
uugcuaucgucauuaau

SEQ ID NO: 3289231 - RNA, 17 nt, Variola virus
guaauuaaguuuggaug

SEQ ID NO: 3289232 - RNA, 15 nt, Variola virus
uagcuaaugaugcag

SEQ ID NO: 3289233 - RNA, 22 nt, Variola virus
ucauuaauugagaaaaaacuaa

SEQ ID NO: 3289234 - RNA, 12 nt, Variola virus
accaaaucagau

SEQ ID NO: 3289235 - RNA, 23 nt, Variola virus
caauuugcucccgccgauccugu

SEQ ID NO: 3289236 - RNA, 14 nt, Variola virus
aagaacuacuaucg

SEQ ID NO: 3289237 - RNA, 20 nt, Variola virus
acugcuaaauguaucuucca

SEQ ID NO: 3289238 - RNA, 14 nt, Variola virus
ucuuuguuauuaua

SEQ ID NO: 3289239 - RNA, 21 nt, Variola virus
uaauccaaauaugauauguga

SEQ ID NO: 3289240 - RNA, 18 nt, Variola virus
gacucauuauuucccaaa

SEQ ID NO: 3289241 - RNA, 19 nt, Variola virus
uaguaucuagcucuguaaa

SEQ ID NO: 3289242 - RNA, 18 nt, Variola virus
acuucuugcgugucuuuc

SEQ ID NO: 3289243 - RNA, 14 nt, Variola virus
aauaguucuguaau

SEQ ID NO: 3289244 - RNA, 19 nt, Variola virus
aaucaaaagaaugauucca

SEQ ID NO: 3289245 - RNA, 16 nt, Variola virus
uaauacaaaauuuuca

SEQ ID NO: 3289246 - RNA, 13 nt, Variola virus
auaaauguuguaa

SEQ ID NO: 3289247 - RNA, 15 nt, Variola virus
acuuauguaugugca

SEQ ID NO: 3289248 - RNA, 17 nt, Variola virus
caaacaauguauacaaa

SEQ ID NO: 3289249 - RNA, 12 nt, Variola virus
auaauauacaaa

SEQ ID NO: 3289250 - RNA, 13 nt, Variola virus
cgacaauauucua

SEQ ID NO: 3289251 - RNA, 22 nt, Variola virus
auuuuacccucaaucauguacu

SEQ ID NO: 3289252 - RNA, 18 nt, Variola virus
ucacuaauucuagucuuu

SEQ ID NO: 3289253 - RNA, 18 nt, Variola virus
gccgcaaccauuagauuu

SEQ ID NO: 3289254 - RNA, 20 nt, Variola virus
acaauuugggacaaugaauu

SEQ ID NO: 3289255 - RNA, 15 nt, Variola virus
cuuuaauccauguuu

SEQ ID NO: 3289256 - RNA, 21 nt, Variola virus
aauuuauagacgacucauuua

SEQ ID NO: 3289257 - RNA, 15 nt, Variola virus
aaaauacaacaaugu

SEQ ID NO: 3289258 - RNA, 21 nt, Variola virus
ugggacuauuggaauguguua

SEQ ID NO: 3289259 - RNA, 21 nt, Variola virus
uaacgagugaucaaauuauug

SEQ ID NO: 3289260 - RNA, 20 nt, Variola virus
cuguuuaucuauacuauuaa

SEQ ID NO: 3289261 - RNA, 18 nt, Variola virus
auagaaaauaucauaaau

SEQ ID NO: 3289262 - RNA, 21 nt, Variola virus
acugcuaccgaagagcagcua

SEQ ID NO: 3289263 - RNA, 22 nt, Variola virus
acaauauaauguacuagauaau

SEQ ID NO: 3289264 - RNA, 20 nt, Variola virus
auuguacuauacauuuugaa

SEQ ID NO: 3289265 - RNA, 19 nt, Variola virus
agcauaucacgaacuauau

SEQ ID NO: 3289266 - RNA, 12 nt, Variola virus
aguauuaaugau

SEQ ID NO: 3289267 - RNA, 14 nt, Variola virus
uccaauuacaaaaa

SEQ ID NO: 3289268 - RNA, 12 nt, Variola virus
ugauagcauugu

SEQ ID NO: 3289269 - RNA, 15 nt, Variola virus
auuggcuuuucuuua

SEQ ID NO: 3289270 - RNA, 13 nt, Variola virus
uauauaaauacuu

SEQ ID NO: 3289271 - RNA, 23 nt, Variola virus
augaagauccaagauuuguagaa

SEQ ID NO: 3289272 - RNA, 13 nt, Variola virus
cauuuguaauaau

SEQ ID NO: 3289273 - RNA, 17 nt, Variola virus
auguaauucuuucucca

SEQ ID NO: 3289274 - RNA, 14 nt, Variola virus
aaaucccaaauguu

SEQ ID NO: 3289275 - RNA, 18 nt, Variola virus
uauuccagaugucaugau

SEQ ID NO: 3289276 - RNA, 21 nt, Variola virus
gcacgccguauacucuauagu

SEQ ID NO: 3289277 - RNA, 18 nt, Variola virus
gauuccagccacuuggga

SEQ ID NO: 3289278 - RNA, 16 nt, Variola virus
gauaguuguugugaca

SEQ ID NO: 3289279 - RNA, 15 nt, Variola virus
gcguaucaaauguaa

SEQ ID NO: 3289280 - RNA, 20 nt, Variola virus
gcauauucuauagucagaau

SEQ ID NO: 3289281 - RNA, 13 nt, Variola virus
gauauauucaaac

SEQ ID NO: 3289282 - RNA, 22 nt, Variola virus
aguacuacugaagaacuaaaag

SEQ ID NO: 3289283 - RNA, 18 nt, Variola virus
caauacacacaauagaca

SEQ ID NO: 3289284 - RNA, 18 nt, Variola virus
acgauauuuguuggauuu

SEQ ID NO: 3289285 - RNA, 22 nt, Variola virus
uccaaguacgguaauagauuuu

SEQ ID NO: 3289286 - RNA, 17 nt, Variola virus
aguuuuccguuagaaaa

SEQ ID NO: 3289287 - RNA, 13 nt, Variola virus
aauaguaucaucu

SEQ ID NO: 3289288 - RNA, 18 nt, Variola virus
uuggcaguacucauuaau

SEQ ID NO: 3289289 - RNA, 20 nt, Variola virus
cguuuaaaguaaacuucgua

SEQ ID NO: 3289290 - RNA, 15 nt, Variola virus
aacaaaguuauucau

SEQ ID NO: 3289291 - RNA, 14 nt, Variola virus
aguagaauaauaga

SEQ ID NO: 3289292 - RNA, 22 nt, Variola virus
ucuaucccccguauuuacauua

SEQ ID NO: 3289293 - RNA, 14 nt, Variola virus
cguacccaacaaua

SEQ ID NO: 3289294 - RNA, 20 nt, Variola virus
ucguucaacugucuuucaag

SEQ ID NO: 3289295 - RNA, 22 nt, Variola virus
auaccauauccuccuguagaua

SEQ ID NO: 3289296 - RNA, 13 nt, Variola virus
cagauacauacua

SEQ ID NO: 3289297 - RNA, 20 nt, Variola virus
gauagaugaacugacauaua

SEQ ID NO: 3289298 - RNA, 19 nt, Variola virus
auugguuacucuugucauu

SEQ ID NO: 3289299 - RNA, 19 nt, Variola virus
gauaacaauagucuuguaa

SEQ ID NO: 3289300 - RNA, 18 nt, Variola virus
acaaugcucaguaaaugu

SEQ ID NO: 3289301 - RNA, 13 nt, Variola virus
uacccuuccaaau

SEQ ID NO: 3289302 - RNA, 16 nt, Variola virus
caguuagcuacucuag

SEQ ID NO: 3289303 - RNA, 16 nt, Variola virus
uuuauuccacaugagu

SEQ ID NO: 3289304 - RNA, 12 nt, Variola virus
uuagcauacaaa

SEQ ID NO: 3289305 - RNA, 20 nt, Variola virus
auaaugacauggacguagau

SEQ ID NO: 3289306 - RNA, 14 nt, Variola virus
aaagagaauuauau

SEQ ID NO: 3289307 - RNA, 21 nt, Variola virus
caucauacgaaaauagauucu

SEQ ID NO: 3289308 - RNA, 21 nt, Variola virus
ucacuaacugauaccaugaaa

SEQ ID NO: 3289309 - RNA, 15 nt, Variola virus
guuguuccaauaaau

SEQ ID NO: 3289310 - RNA, 13 nt, Variola virus
cacgauauggaug

SEQ ID NO: 3289311 - RNA, 11 nt, Variola virus
acauuaaacag

SEQ ID NO: 3289312 - RNA, 22 nt, Variola virus
acuauggacgcaugauaagaau

SEQ ID NO: 3289313 - RNA, 13 nt, Variola virus
ugguguaaaucua

SEQ ID NO: 3289314 - RNA, 18 nt, Variola virus
acugaguuuuuaggaaau

SEQ ID NO: 3289315 - RNA, 18 nt, Variola virus
aaauacaaaauaauagau

SEQ ID NO: 3289316 - RNA, 15 nt, Variola virus
uaauuuguucaaaau

SEQ ID NO: 3289317 - RNA, 13 nt, Variola virus
ucuaaauguauua

SEQ ID NO: 3289318 - RNA, 18 nt, Variola virus
acacuaccaguaucaauu

SEQ ID NO: 3289319 - RNA, 12 nt, Variola virus
uacacauaauga

SEQ ID NO: 3289320 - RNA, 23 nt, Variola virus
uuauuucagucgcugauuaauca

SEQ ID NO: 3289321 - RNA, 19 nt, Variola virus
gaugacuuuaguaaaucau

SEQ ID NO: 3289322 - RNA, 21 nt, Variola virus
aacuucaggauuuuuuacagg

SEQ ID NO: 3289323 - RNA, 14 nt, Variola virus
gauaucuccauuaa

SEQ ID NO: 3289324 - RNA, 17 nt, Variola virus
ccauucuaaucacauua

SEQ ID NO: 3289325 - RNA, 21 nt, Variola virus
guaaauccugcacuaugucca

SEQ ID NO: 3289326 - RNA, 21 nt, Variola virus
gcagguaugauagcuccacca

SEQ ID NO: 3289327 - RNA, 16 nt, Variola virus
aaucuacugauauugu

SEQ ID NO: 3289328 - RNA, 21 nt, Variola virus
aucauauaucugaagauauac

SEQ ID NO: 3289329 - RNA, 19 nt, Variola virus
caguaaccaaauacauauu

SEQ ID NO: 3289330 - RNA, 19 nt, Variola virus
cuuuaauaacaaagaaaga

SEQ ID NO: 3289331 - RNA, 15 nt, Variola virus
auuaaaaauuuccau

SEQ ID NO: 3289332 - RNA, 14 nt, Variola virus
auuuaaugauucau

SEQ ID NO: 3289333 - RNA, 21 nt, Variola virus
uaauauaaaagaauauguaua

SEQ ID NO: 3289334 - RNA, 16 nt, Variola virus
acucaugauuaaaccu

SEQ ID NO: 3289335 - RNA, 13 nt, Variola virus
guaaauaguuuua

SEQ ID NO: 3289336 - RNA, 21 nt, Variola virus
acuuacuuuccagauagaaaa

SEQ ID NO: 3289337 - RNA, 21 nt, Variola virus
auacuaauaugacacgauugu

SEQ ID NO: 3289338 - RNA, 14 nt, Variola virus
cauaaaacaucauu

SEQ ID NO: 3289339 - RNA, 16 nt, Variola virus
uucuggauauguuuuu

SEQ ID NO: 3289340 - RNA, 17 nt, Variola virus
acauugugauuaaacau

SEQ ID NO: 3289341 - RNA, 19 nt, Variola virus
agaacucuugaagaugauu

SEQ ID NO: 3289342 - RNA, 17 nt, Variola virus
uucccguaauaaauuuu

SEQ ID NO: 3289343 - RNA, 13 nt, Variola virus
uguguuacauaau

SEQ ID NO: 3289344 - RNA, 14 nt, Variola virus
guuuguuuuggaaa

SEQ ID NO: 3289345 - RNA, 23 nt, Variola virus
gaaaucuuuagacgguugagaaa

SEQ ID NO: 3289346 - RNA, 11 nt, Variola virus
cuucuauuuua

SEQ ID NO: 3289347 - RNA, 13 nt, Variola virus
uuugcaaacauaa

SEQ ID NO: 3289348 - RNA, 19 nt, Variola virus
auucuugguaauuaauaga

SEQ ID NO: 3289349 - RNA, 17 nt, Variola virus
uaugaauaaucuucauu

SEQ ID NO: 3289350 - RNA, 19 nt, Variola virus
ggaaaaucugaagaagaua

SEQ ID NO: 3289351 - RNA, 12 nt, Variola virus
auuaauacuuuu

SEQ ID NO: 3289352 - RNA, 22 nt, Variola virus
ccaaccaaacggaguaaaauaa

SEQ ID NO: 3289353 - RNA, 16 nt, Variola virus
uguuguguacauguag

SEQ ID NO: 3289354 - RNA, 17 nt, Variola virus
aauguugucaaaugauc

SEQ ID NO: 3289355 - RNA, 20 nt, Variola virus
acaauauauucucaugguau

SEQ ID NO: 3289356 - RNA, 20 nt, Variola virus
uuuuugagccauauuccaca

SEQ ID NO: 3289357 - RNA, 18 nt, Variola virus
aucuagaaauuacauaaa

SEQ ID NO: 3289358 - RNA, 18 nt, Variola virus
uaguuucagaauuuucua

SEQ ID NO: 3289359 - RNA, 23 nt, Variola virus
ccguuuuguucuuggauuucaua

SEQ ID NO: 3289360 - RNA, 14 nt, Variola virus
aauucguuuaaaaa

SEQ ID NO: 3289361 - RNA, 18 nt, Variola virus
caucugucauuacauaau

SEQ ID NO: 3289362 - RNA, 15 nt, Variola virus
uaaaaguuaggguuc

SEQ ID NO: 3289363 - RNA, 12 nt, Variola virus
aaauauaaugau

SEQ ID NO: 3289364 - RNA, 22 nt, Variola virus
auggucagugcauaauaaagua

SEQ ID NO: 3289365 - RNA, 14 nt, Variola virus
uauucauucaaugu

SEQ ID NO: 3289366 - RNA, 21 nt, Variola virus
uaauuuacaaaaauuuaaaau

SEQ ID NO: 3289367 - RNA, 19 nt, Variola virus
guauagaacacaugucuua

SEQ ID NO: 3289368 - RNA, 14 nt, Variola virus
gaaaucguauauaa

SEQ ID NO: 3289369 - RNA, 23 nt, Variola virus
ucuaaaauuuccaucucuaucua

SEQ ID NO: 3289370 - RNA, 17 nt, Variola virus
ugauauauaauuuaccg

SEQ ID NO: 3289371 - RNA, 20 nt, Variola virus
gcuaguuaauaguaaaugaa

SEQ ID NO: 3289372 - RNA, 21 nt, Variola virus
gauugggaaccagucaugaau

SEQ ID NO: 3289373 - RNA, 23 nt, Variola virus
gagaccauguauugcuguauuug

SEQ ID NO: 3289374 - RNA, 15 nt, Variola virus
ugucuuucucuuuua

SEQ ID NO: 3289375 - RNA, 15 nt, Variola virus
cuaugguacaaguug

SEQ ID NO: 3289376 - RNA, 18 nt, Variola virus
ugcuauguugauucuauu

SEQ ID NO: 3289377 - RNA, 17 nt, Variola virus
uugauaauuacgcguau

SEQ ID NO: 3289378 - RNA, 19 nt, Variola virus
agaaucauaaagaacagua

SEQ ID NO: 3289379 - RNA, 13 nt, Variola virus
cuggauauguuuu

SEQ ID NO: 3289380 - RNA, 16 nt, Variola virus
cugaaaagaaaguauc

SEQ ID NO: 3289381 - RNA, 14 nt, Variola virus
acgaaagcaaagaa

SEQ ID NO: 3289382 - RNA, 18 nt, Variola virus
caaaagacaugauaauau

SEQ ID NO: 3289383 - RNA, 21 nt, Variola virus
uaaaacagucacgauaucucu

SEQ ID NO: 3289384 - RNA, 17 nt, Variola virus
ucagaaaagucaaauau

SEQ ID NO: 3289385 - RNA, 13 nt, Variola virus
aaugaugcagaua

SEQ ID NO: 3289386 - RNA, 14 nt, Variola virus
ucacuagaaacuag

SEQ ID NO: 3289387 - RNA, 21 nt, Variola virus
ucuagccucgguaaucuguac

SEQ ID NO: 3289388 - RNA, 13 nt, Variola virus
auuaaaucaauau

SEQ ID NO: 3289389 - RNA, 13 nt, Variola virus
uauuaaucuuuuu

SEQ ID NO: 3289390 - RNA, 19 nt, Variola virus
cccggguacguggauauca

SEQ ID NO: 3289391 - RNA, 20 nt, Variola virus
augugauggaaaaaugacua

SEQ ID NO: 3289392 - RNA, 12 nt, Variola virus
cuugcuauuuuu

SEQ ID NO: 3289393 - RNA, 16 nt, Variola virus
cuaauaaauuaaauau

SEQ ID NO: 3289394 - RNA, 12 nt, Variola virus
uaugacaaacuu

SEQ ID NO: 3289395 - RNA, 16 nt, Variola virus
agccaauccuaacucu

SEQ ID NO: 3289396 - RNA, 17 nt, Variola virus
auaacuaaauuaacaau

SEQ ID NO: 3289397 - RNA, 14 nt, Variola virus
uaacauucauuagu

SEQ ID NO: 3289398 - RNA, 12 nt, Variola virus
auaauuuucuau

SEQ ID NO: 3289399 - RNA, 14 nt, Variola virus
ucauuggaaaauau

SEQ ID NO: 3289400 - RNA, 13 nt, Variola virus
cuauacuauguua

SEQ ID NO: 3289401 - RNA, 16 nt, Variola virus
uagcaauuucaaaaua

SEQ ID NO: 3289402 - RNA, 16 nt, Variola virus
aauacaaaaguuaaua

SEQ ID NO: 3289403 - RNA, 20 nt, Variola virus
caaucaacgaauuaaugaua

SEQ ID NO: 3289404 - RNA, 21 nt, Variola virus
ucuagacgauuaguaauauau

SEQ ID NO: 3289405 - RNA, 19 nt, Variola virus
aguauuuuucaaaaaaugu

SEQ ID NO: 3289406 - RNA, 16 nt, Variola virus
uaauuucaucuacaau

SEQ ID NO: 3289407 - RNA, 16 nt, Variola virus
aguauuuuuaccuaau

SEQ ID NO: 3289408 - RNA, 19 nt, Variola virus
aguauugguaauguacaaa

SEQ ID NO: 3289409 - RNA, 15 nt, Variola virus
gucaauauuguuuua

SEQ ID NO: 3289410 - RNA, 21 nt, Variola virus
auuauuuuugacgaugucaag

SEQ ID NO: 3289411 - RNA, 18 nt, Variola virus
ucuaucauggcaauaaua

SEQ ID NO: 3289412 - RNA, 14 nt, Variola virus
uagguuucuauaau

SEQ ID NO: 3289413 - RNA, 17 nt, Variola virus
aaguaucaaaucuucua

SEQ ID NO: 3289414 - RNA, 22 nt, Variola virus
gcaucuaaaacaauaaaugcau

SEQ ID NO: 3289415 - RNA, 14 nt, Variola virus
uaaacuuuaaugau

SEQ ID NO: 3289416 - RNA, 12 nt, Variola virus
aauuaguuuauu

SEQ ID NO: 3289417 - RNA, 15 nt, Variola virus
uuugagauuucauaa

SEQ ID NO: 3289418 - RNA, 22 nt, Variola virus
caaauaaaucacuaaauaauau

SEQ ID NO: 3289419 - RNA, 16 nt, Variola virus
uguuaauuauuucuaa

SEQ ID NO: 3289420 - RNA, 20 nt, Variola virus
cuaaagaacggagaauaucu

SEQ ID NO: 3289421 - RNA, 22 nt, Variola virus
uuaugaauaucacauaucaugu

SEQ ID NO: 3289422 - RNA, 22 nt, Variola virus
gcguaaaagucaaauuagauuu

SEQ ID NO: 3289423 - RNA, 15 nt, Variola virus
auauagguuacuaga

SEQ ID NO: 3289424 - RNA, 19 nt, Variola virus
agauuaucaaaaucuuguc

SEQ ID NO: 3289425 - RNA, 17 nt, Variola virus
ccaucuccuuauuuuua

SEQ ID NO: 3289426 - RNA, 15 nt, Variola virus
aacagugaguuuauc

SEQ ID NO: 3289427 - RNA, 13 nt, Variola virus
cagaaaaaacaau

SEQ ID NO: 3289428 - RNA, 22 nt, Variola virus
auuucugaacccguuaauguau

SEQ ID NO: 3289429 - RNA, 18 nt, Variola virus
auauugucccaauguuuc

SEQ ID NO: 3289430 - RNA, 19 nt, Variola virus
aacacaagucuaauaaugu

SEQ ID NO: 3289431 - RNA, 14 nt, Variola virus
ucuuuaaugugaaa

SEQ ID NO: 3289432 - RNA, 15 nt, Variola virus
acaccauuuacuuua

SEQ ID NO: 3289433 - RNA, 18 nt, Variola virus
aucagagucugaggauau

SEQ ID NO: 3289434 - RNA, 21 nt, Variola virus
cauggaaaagauaaaguuuua

SEQ ID NO: 3289435 - RNA, 12 nt, Variola virus
gaaaauacuaua

SEQ ID NO: 3289436 - RNA, 16 nt, Variola virus
aaaucuaguuguggaa

SEQ ID NO: 3289437 - RNA, 21 nt, Variola virus
auacgaaauaaauaaugaauu

SEQ ID NO: 3289438 - RNA, 19 nt, Variola virus
uagaaauuaucaaauguug

SEQ ID NO: 3289439 - RNA, 16 nt, Variola virus
uucgauagauauucuu

SEQ ID NO: 3289440 - RNA, 14 nt, Variola virus
aggagauuaaagga

SEQ ID NO: 3289441 - RNA, 20 nt, Variola virus
auagacagcuucuagaaguu

SEQ ID NO: 3289442 - RNA, 13 nt, Variola virus
ugccauuaugaua

SEQ ID NO: 3289443 - RNA, 13 nt, Variola virus
uucuauuauuaca

SEQ ID NO: 3289444 - RNA, 19 nt, Variola virus
cgauaaugugguuacucuu

SEQ ID NO: 3289445 - RNA, 18 nt, Variola virus
augucauuuuuuuauccg

SEQ ID NO: 3289446 - RNA, 15 nt, Variola virus
augauaaacuaacua

SEQ ID NO: 3289447 - RNA, 21 nt, Variola virus
uaugaauggauaccuguauua

SEQ ID NO: 3289448 - RNA, 18 nt, Variola virus
agaugacugauauucagg

SEQ ID NO: 3289449 - RNA, 18 nt, Variola virus
auauuaucaccuauugcc

SEQ ID NO: 3289450 - RNA, 17 nt, Variola virus
ucacaaguaugaagaaa

SEQ ID NO: 3289451 - RNA, 12 nt, Variola virus
uuauguacuaag

SEQ ID NO: 3289452 - RNA, 14 nt, Variola virus
uaggauuuaaacaa

SEQ ID NO: 3289453 - RNA, 21 nt, Variola virus
aauggauaagaauaaauuaua

SEQ ID NO: 3289454 - RNA, 21 nt, Variola virus
auacagauuguaguucuauaa

SEQ ID NO: 3289455 - RNA, 21 nt, Variola virus
auuucuauacuuguuggugaa

SEQ ID NO: 3289456 - RNA, 15 nt, Variola virus
acugaacaggcauuu

SEQ ID NO: 3289457 - RNA, 16 nt, Variola virus
caaacaauuuuaacag

SEQ ID NO: 3289458 - RNA, 11 nt, Variola virus
uuuucacuuua

SEQ ID NO: 3289459 - RNA, 18 nt, Variola virus
ggauuuggucauaauaga

SEQ ID NO: 3289460 - RNA, 17 nt, Variola virus
augaauuagagaauuac

SEQ ID NO: 3289461 - RNA, 20 nt, Variola virus
aaacacauauugaugugucu

SEQ ID NO: 3289462 - RNA, 19 nt, Variola virus
uuaucaauauacuauucuu

SEQ ID NO: 3289463 - RNA, 17 nt, Variola virus
guguauaaaauauacug

SEQ ID NO: 3289464 - RNA, 14 nt, Variola virus
aaugugagaaguuu

SEQ ID NO: 3289465 - RNA, 14 nt, Variola virus
cacuauuauaacaa

SEQ ID NO: 3289466 - RNA, 17 nt, Variola virus
aaaaauccuuaaugaua

SEQ ID NO: 3289467 - RNA, 18 nt, Variola virus
auuguauccauacauaca

SEQ ID NO: 3289468 - RNA, 22 nt, Variola virus
acguaaaugugugcgaaaauac

SEQ ID NO: 3289469 - RNA, 22 nt, Variola virus
cuauaucuucuaaaauuacaaa

SEQ ID NO: 3289470 - RNA, 16 nt, Variola virus
aaaauucauuagaaua

SEQ ID NO: 3289471 - RNA, 20 nt, Variola virus
auauugauaucuuuuugaau

SEQ ID NO: 3289472 - RNA, 15 nt, Variola virus
acugauuaacaaaug

SEQ ID NO: 3289473 - RNA, 15 nt, Variola virus
aaauacgaacuuuau

SEQ ID NO: 3289474 - RNA, 14 nt, Variola virus
acuaugcacauuau

SEQ ID NO: 3289475 - RNA, 17 nt, Variola virus
uauaucauuuguuuuaa

SEQ ID NO: 3289476 - RNA, 19 nt, Variola virus
agaaucaugguauauggau

SEQ ID NO: 3289477 - RNA, 23 nt, Variola virus
aauguuauaguuuucuaaaaugu

SEQ ID NO: 3289478 - RNA, 13 nt, Variola virus
agaauucuaaaug

SEQ ID NO: 3289479 - RNA, 17 nt, Variola virus
aucagaugauaucagua

SEQ ID NO: 3289480 - RNA, 14 nt, Variola virus
augugauuguucaa

SEQ ID NO: 3289481 - RNA, 21 nt, Variola virus
acuuucuugcaaguuacuaau

SEQ ID NO: 3289482 - RNA, 14 nt, Variola virus
ccaauaaaauuacu

SEQ ID NO: 3289483 - RNA, 17 nt, Variola virus
ucuaauucuacauaugg

SEQ ID NO: 3289484 - RNA, 14 nt, Variola virus
acaaacuaucugau

SEQ ID NO: 3289485 - RNA, 21 nt, Variola virus
aaaauuuguauuuuuaaucua

SEQ ID NO: 3289486 - RNA, 21 nt, Variola virus
gcaccauucauaauuacagaa

SEQ ID NO: 3289487 - RNA, 12 nt, Variola virus
gauuuucuggga

SEQ ID NO: 3289488 - RNA, 23 nt, Variola virus
cauauccagacaacaaucguuug

SEQ ID NO: 3289489 - RNA, 14 nt, Variola virus
uagaauauauguca

SEQ ID NO: 3289490 - RNA, 18 nt, Variola virus
uguuaauaaguaaaugaa

SEQ ID NO: 3289491 - RNA, 15 nt, Variola virus
cuugauuacauucuc

SEQ ID NO: 3289492 - RNA, 24 nt, Variola virus
cguuaacuaucaaacaaacugcug

SEQ ID NO: 3289493 - RNA, 15 nt, Variola virus
ggccguuuguuuccu

SEQ ID NO: 3289494 - RNA, 17 nt, Variola virus
aauauggucuuuaaaaa

SEQ ID NO: 3289495 - RNA, 19 nt, Variola virus
aauauuagaguuagguaau

SEQ ID NO: 3289496 - RNA, 21 nt, Variola virus
uguuaauacaucaauggaaga

SEQ ID NO: 3289497 - RNA, 23 nt, Variola virus
uuaaagagacuacaauauauucu

SEQ ID NO: 3289498 - RNA, 21 nt, Variola virus
ggguauuuaucaauaaacaau

SEQ ID NO: 3289499 - RNA, 12 nt, Variola virus
auuaucaucaaa

SEQ ID NO: 3289500 - RNA, 15 nt, Variola virus
auaauuauagaucag

SEQ ID NO: 3289501 - RNA, 15 nt, Variola virus
cagaucaauggauua

SEQ ID NO: 3289502 - RNA, 12 nt, Variola virus
acugaucuucuu

SEQ ID NO: 3289503 - RNA, 12 nt, Variola virus
uaauauuguuaa

SEQ ID NO: 3289504 - RNA, 23 nt, Variola virus
auuaucaggaacauuaucaauuu

SEQ ID NO: 3289505 - RNA, 18 nt, Variola virus
auaauuuuuggacaaaug

SEQ ID NO: 3289506 - RNA, 13 nt, Variola virus
aaauaauaugauu

SEQ ID NO: 3289507 - RNA, 19 nt, Variola virus
auacguaaacuuuaauagu

SEQ ID NO: 3289508 - RNA, 18 nt, Variola virus
uaacgaaacaauguuucu

SEQ ID NO: 3289509 - RNA, 18 nt, Variola virus
uuagacggcaacauagaa

SEQ ID NO: 3289510 - RNA, 21 nt, Variola virus
aauuauacuuugguaaauguu

SEQ ID NO: 3289511 - RNA, 22 nt, Variola virus
uaagaaaguaauucagacacuu

SEQ ID NO: 3289512 - RNA, 15 nt, Variola virus
gaauuugauacuguc

SEQ ID NO: 3289513 - RNA, 22 nt, Variola virus
uuagcgagguauuuauucauaa

SEQ ID NO: 3289514 - RNA, 23 nt, Variola virus
uaccaugacuccucuucauacag

SEQ ID NO: 3289515 - RNA, 13 nt, Variola virus
guuuggaauaacu

SEQ ID NO: 3289516 - RNA, 23 nt, Variola virus
aaguauaaaaauuaaacaaaacg

SEQ ID NO: 3289517 - RNA, 15 nt, Variola virus
uuaauauuagaguua

SEQ ID NO: 3289518 - RNA, 20 nt, Variola virus
auauuucuaaacccaaaaug

SEQ ID NO: 3289519 - RNA, 20 nt, Variola virus
caaugaacaagauuaaucuc

SEQ ID NO: 3289520 - RNA, 16 nt, Variola virus
cauaugccaacaugca

SEQ ID NO: 3289521 - RNA, 13 nt, Variola virus
auaucuuaaauaa

SEQ ID NO: 3289522 - RNA, 19 nt, Variola virus
caacauaaauaauucuaga

SEQ ID NO: 3289523 - RNA, 15 nt, Variola virus
ugcaaagaacaaaau

SEQ ID NO: 3289524 - RNA, 21 nt, Variola virus
gauaaaaaauuauauacugaa

SEQ ID NO: 3289525 - RNA, 22 nt, Variola virus
ccuacguaucuauaaucaucug

SEQ ID NO: 3289526 - RNA, 22 nt, Variola virus
aaccucacuguuaaaaauaugu

SEQ ID NO: 3289527 - RNA, 15 nt, Variola virus
aacucauucuauaua

SEQ ID NO: 3289528 - RNA, 20 nt, Variola virus
uucucucauuuaucaaaagu

SEQ ID NO: 3289529 - RNA, 18 nt, Variola virus
aaauauaugcucauauau

SEQ ID NO: 3289530 - RNA, 20 nt, Variola virus
gcuuagcuaauccugauauu

SEQ ID NO: 3289531 - RNA, 12 nt, Variola virus
acaaaagguauu

SEQ ID NO: 3289532 - RNA, 14 nt, Variola virus
auacgauaaacauu

SEQ ID NO: 3289533 - RNA, 18 nt, Variola virus
uaacaaaaauuaugaaau

SEQ ID NO: 3289534 - RNA, 17 nt, Variola virus
uucaaggacaaaaugac

SEQ ID NO: 3289535 - RNA, 12 nt, Variola virus
uaucguuuucau

SEQ ID NO: 3289536 - RNA, 20 nt, Variola virus
acggcaaaccaaaaacauuu

SEQ ID NO: 3289537 - RNA, 23 nt, Variola virus
uaaaaaaaugauugaagaaggag

SEQ ID NO: 3289538 - RNA, 17 nt, Variola virus
caguaccauuaucuuug

SEQ ID NO: 3289539 - RNA, 22 nt, Variola virus
aaccgucauucaucuagaaugg

SEQ ID NO: 3289540 - RNA, 11 nt, Variola virus
uuucaaagaug

SEQ ID NO: 3289541 - RNA, 14 nt, Variola virus
augacaauauaaca

SEQ ID NO: 3289542 - RNA, 21 nt, Variola virus
uuugagaaauauguauacaua

SEQ ID NO: 3289543 - RNA, 16 nt, Variola virus
ucuaagauuauuuuaa

SEQ ID NO: 3289544 - RNA, 14 nt, Variola virus
aaaacgaaauauau

SEQ ID NO: 3289545 - RNA, 17 nt, Variola virus
cugauaauauuaucuau

SEQ ID NO: 3289546 - RNA, 20 nt, Variola virus
caauaaaaauaaacuagaaa

SEQ ID NO: 3289547 - RNA, 23 nt, Variola virus
agaagacguggauaguuucuuaa

SEQ ID NO: 3289548 - RNA, 21 nt, Variola virus
aaaucauaauaugagauguuu

SEQ ID NO: 3289549 - RNA, 17 nt, Variola virus
uauaguagaauuucauu

SEQ ID NO: 3289550 - RNA, 15 nt, Variola virus
ccauaguuuuucuac

SEQ ID NO: 3289551 - RNA, 23 nt, Variola virus
ucauccguggauauuugauuuuu

SEQ ID NO: 3289552 - RNA, 15 nt, Variola virus
cuuuugucguaaaua

SEQ ID NO: 3289553 - RNA, 18 nt, Variola virus
uuuaaacacucuuucuga

SEQ ID NO: 3289554 - RNA, 15 nt, Variola virus
aaacaaaauuuuacu

SEQ ID NO: 3289555 - RNA, 16 nt, Variola virus
agaucuaauuuuucau

SEQ ID NO: 3289556 - RNA, 14 nt, Variola virus
auaguccagaaaug

SEQ ID NO: 3289557 - RNA, 13 nt, Variola virus
aucucuugcuucu

SEQ ID NO: 3289558 - RNA, 15 nt, Variola virus
aaauguugucauuau

SEQ ID NO: 3289559 - RNA, 22 nt, Variola virus
uaaauauuuuucuaccuuuuca

SEQ ID NO: 3289560 - RNA, 17 nt, Variola virus
aauuuggucauucuuaa

SEQ ID NO: 3289561 - RNA, 20 nt, Variola virus
cuauuaguuguuccaauaaa

SEQ ID NO: 3289562 - RNA, 21 nt, Variola virus
uucccugauuaguauuuucua

SEQ ID NO: 3289563 - RNA, 17 nt, Variola virus
ggaccuauaauugauua

SEQ ID NO: 3289564 - RNA, 22 nt, Variola virus
uauacaaugcucaguaaaugua

SEQ ID NO: 3289565 - RNA, 17 nt, Variola virus
ccaacucauuuaaauau

SEQ ID NO: 3289566 - RNA, 18 nt, Variola virus
acguucacuaauaaauug

SEQ ID NO: 3289567 - RNA, 16 nt, Variola virus
gucauguugauacauc

SEQ ID NO: 3289568 - RNA, 11 nt, Variola virus
aauauauguau

SEQ ID NO: 3289569 - RNA, 15 nt, Variola virus
ucugauaaucucuaa

SEQ ID NO: 3289570 - RNA, 21 nt, Variola virus
aauuaugagaaugugauucaa

SEQ ID NO: 3289571 - RNA, 14 nt, Variola virus
augaugaaauguau

SEQ ID NO: 3289572 - RNA, 17 nt, Variola virus
auacauggaagaauuag

SEQ ID NO: 3289573 - RNA, 17 nt, Variola virus
ucuuaaaauuggaucua

SEQ ID NO: 3289574 - RNA, 14 nt, Variola virus
uaugaaaaacaugu

SEQ ID NO: 3289575 - RNA, 17 nt, Variola virus
acgaugaaaaugugcuu

SEQ ID NO: 3289576 - RNA, 21 nt, Variola virus
ucgcuuucugguaacaugaua

SEQ ID NO: 3289577 - RNA, 14 nt, Variola virus
acaguuuaucacau

SEQ ID NO: 3289578 - RNA, 15 nt, Variola virus
auaaaugacaaguau

SEQ ID NO: 3289579 - RNA, 18 nt, Variola virus
caauuuguauuauccaau

SEQ ID NO: 3289580 - RNA, 17 nt, Variola virus
agaaagugcaaaugagg

SEQ ID NO: 3289581 - RNA, 22 nt, Variola virus
uacaacacaggauaaauuauuu

SEQ ID NO: 3289582 - RNA, 15 nt, Variola virus
auauauuauauagau

SEQ ID NO: 3289583 - RNA, 20 nt, Variola virus
agaaaaaucauuaaaaagau

SEQ ID NO: 3289584 - RNA, 15 nt, Variola virus
auuucuauucaugaa

SEQ ID NO: 3289585 - RNA, 13 nt, Variola virus
ugagauuuugcau

SEQ ID NO: 3289586 - RNA, 21 nt, Variola virus
auuauggggaaauaaagaaaa

SEQ ID NO: 3289587 - RNA, 16 nt, Variola virus
aaaaccguuaaaaugu

SEQ ID NO: 3289588 - RNA, 13 nt, Variola virus
uaucuuuccaacu

SEQ ID NO: 3289589 - RNA, 19 nt, Variola virus
uaacaaaauccaaacauua

SEQ ID NO: 3289590 - RNA, 15 nt, Variola virus
uacuauuguacauua

SEQ ID NO: 3289591 - RNA, 22 nt, Variola virus
aauagacggcauuaauuuccau

SEQ ID NO: 3289592 - RNA, 16 nt, Variola virus
auacauaaagaaaugu

SEQ ID NO: 3289593 - RNA, 18 nt, Variola virus
cgugauuauucuccacca

SEQ ID NO: 3289594 - RNA, 14 nt, Variola virus
auagaaacauauau

SEQ ID NO: 3289595 - RNA, 21 nt, Variola virus
auaauucuccagucgaaacau

SEQ ID NO: 3289596 - RNA, 17 nt, Variola virus
gauuauuagaucuuuuc

SEQ ID NO: 3289597 - RNA, 12 nt, Variola virus
uacaaauuauug

SEQ ID NO: 3289598 - RNA, 17 nt, Variola virus
uuaacauaugauauuca

SEQ ID NO: 3289599 - RNA, 16 nt, Variola virus
cgaauaccauggauug

SEQ ID NO: 3289600 - RNA, 18 nt, Variola virus
auacuacgacuuuguuaa

SEQ ID NO: 3289601 - RNA, 18 nt, Variola virus
gaauaaucguuauuauca

SEQ ID NO: 3289602 - RNA, 21 nt, Variola virus
uuaucuauuccuuucauuaac

SEQ ID NO: 3289603 - RNA, 22 nt, Variola virus
uccuaaaauacuauuauaucuu

SEQ ID NO: 3289604 - RNA, 16 nt, Variola virus
caaugagauguaucau

SEQ ID NO: 3289605 - RNA, 20 nt, Variola virus
caaauaaaauggauaauggu

SEQ ID NO: 3289606 - RNA, 19 nt, Variola virus
ucagacgauccacaaucaa

SEQ ID NO: 3289607 - RNA, 16 nt, Variola virus
acccaugauaaugaau

SEQ ID NO: 3289608 - RNA, 21 nt, Variola virus
cuaucgaaaauugcuauuuca

SEQ ID NO: 3289609 - RNA, 19 nt, Variola virus
caaaaccguuaaaauguau

SEQ ID NO: 3289610 - RNA, 15 nt, Variola virus
aaagguauacgaaug

SEQ ID NO: 3289611 - RNA, 20 nt, Variola virus
auaauuauuucaauauacua

SEQ ID NO: 3289612 - RNA, 18 nt, Variola virus
aaaaugcgauguuaauuu

SEQ ID NO: 3289613 - RNA, 15 nt, Variola virus
auccguucuuaacuu

SEQ ID NO: 3289614 - RNA, 14 nt, Variola virus
gaucuggaaaauaa

SEQ ID NO: 3289615 - RNA, 16 nt, Variola virus
uuucuacuaacuuuuu

SEQ ID NO: 3289616 - RNA, 16 nt, Variola virus
cguuagaucuauuuua

SEQ ID NO: 3289617 - RNA, 18 nt, Variola virus
gaaacaguuccauaugau

SEQ ID NO: 3289618 - RNA, 14 nt, Variola virus
augcagaaaugauu

SEQ ID NO: 3289619 - RNA, 15 nt, Variola virus
guauauucucuaguu

SEQ ID NO: 3289620 - RNA, 15 nt, Variola virus
gauauucuaugaauu

SEQ ID NO: 3289621 - RNA, 22 nt, Variola virus
gacaaaagacguaaauauucua

SEQ ID NO: 3289622 - RNA, 13 nt, Variola virus
acauguuaguaga

SEQ ID NO: 3289623 - RNA, 13 nt, Variola virus
aauuauuaccaua

SEQ ID NO: 3289624 - RNA, 18 nt, Variola virus
aucagaauaaaucaauau

SEQ ID NO: 3289625 - RNA, 15 nt, Variola virus
cgguacaacauucca

SEQ ID NO: 3289626 - RNA, 15 nt, Variola virus
uaaucgaguacgcca

SEQ ID NO: 3289627 - RNA, 14 nt, Variola virus
ucuucaucaaacag

SEQ ID NO: 3289628 - RNA, 14 nt, Variola virus
aaauagauuauuua

SEQ ID NO: 3289629 - RNA, 16 nt, Variola virus
gccauggacuaagaua

SEQ ID NO: 3289630 - RNA, 18 nt, Variola virus
ccucagaggauauguuug

SEQ ID NO: 3289631 - RNA, 12 nt, Variola virus
cuacauuguuua

SEQ ID NO: 3289632 - RNA, 14 nt, Variola virus
auggaugcagaaua

SEQ ID NO: 3289633 - RNA, 19 nt, Variola virus
auuuaucgauuagucuuaa

SEQ ID NO: 3289634 - RNA, 22 nt, Variola virus
uuuccauuagauuauaucauaa

SEQ ID NO: 3289635 - RNA, 20 nt, Variola virus
aucaauaaaugugagaaguu

SEQ ID NO: 3289636 - RNA, 18 nt, Variola virus
gugcauaaauuaaaauac

SEQ ID NO: 3289637 - RNA, 21 nt, Variola virus
uucacaaucggauuaauaucu

SEQ ID NO: 3289638 - RNA, 17 nt, Variola virus
auaaaguauauaugaga

SEQ ID NO: 3289639 - RNA, 19 nt, Variola virus
cauguauccacuuuugagc

SEQ ID NO: 3289640 - RNA, 19 nt, Variola virus
cauuauuacauagauguau

SEQ ID NO: 3289641 - RNA, 12 nt, Variola virus
cauuuaaacauu

SEQ ID NO: 3289642 - RNA, 18 nt, Variola virus
uaucaaaaucuugucugc

SEQ ID NO: 3289643 - RNA, 15 nt, Variola virus
ucaucuaagaaauag

SEQ ID NO: 3289644 - RNA, 14 nt, Variola virus
ugcuauuaagguua

SEQ ID NO: 3289645 - RNA, 15 nt, Variola virus
auguguuaaaaagaa

SEQ ID NO: 3289646 - RNA, 23 nt, Variola virus
uaacauuguuaauugaaaaggga

SEQ ID NO: 3289647 - RNA, 13 nt, Variola virus
gugauaguuuaua

SEQ ID NO: 3289648 - RNA, 17 nt, Variola virus
aacuauuccaauguuua

SEQ ID NO: 3289649 - RNA, 20 nt, Variola virus
aauauuuuucguuuacaaaa

SEQ ID NO: 3289650 - RNA, 16 nt, Variola virus
aacucaggaacuauaa

SEQ ID NO: 3289651 - RNA, 13 nt, Variola virus
gucaauugauucu

SEQ ID NO: 3289652 - RNA, 23 nt, Variola virus
auaucauuaggauuuaacuccuu

SEQ ID NO: 3289653 - RNA, 23 nt, Variola virus
aaauuuuguugauuacucuuuuu

SEQ ID NO: 3289654 - RNA, 17 nt, Variola virus
uacauuguauaaaaagc

SEQ ID NO: 3289655 - RNA, 14 nt, Variola virus
auuagacauuuaac

SEQ ID NO: 3289656 - RNA, 22 nt, Variola virus
accuacuuuagcauugaaaaua

SEQ ID NO: 3289657 - RNA, 15 nt, Variola virus
guucaucacauaugc

SEQ ID NO: 3289658 - RNA, 17 nt, Variola virus
gaagaauuaauaaacaa

SEQ ID NO: 3289659 - RNA, 14 nt, Variola virus
auugguacauagau

SEQ ID NO: 3289660 - RNA, 23 nt, Variola virus
uaagacuaaugcuugaaaaugga

SEQ ID NO: 3289661 - RNA, 23 nt, Variola virus
gcgauaucuccauuaauaaugau

SEQ ID NO: 3289662 - RNA, 16 nt, Variola virus
aagacgaucauuuacu

SEQ ID NO: 3289663 - RNA, 15 nt, Variola virus
uggguguaaggaaau

SEQ ID NO: 3289664 - RNA, 17 nt, Variola virus
aaagacuguagaagcua

SEQ ID NO: 3289665 - RNA, 22 nt, Variola virus
cuaauugaucaagaguaacuau

SEQ ID NO: 3289666 - RNA, 19 nt, Variola virus
auguuaaaacuacaaaaau

SEQ ID NO: 3289667 - RNA, 14 nt, Variola virus
aauauaucuuauau

SEQ ID NO: 3289668 - RNA, 17 nt, Variola virus
uuugucaacuuuguaaa

SEQ ID NO: 3289669 - RNA, 20 nt, Variola virus
cgcuacaauuauagaacgaa

SEQ ID NO: 3289670 - RNA, 17 nt, Variola virus
auauuuuucuuaacaag

SEQ ID NO: 3289671 - RNA, 13 nt, Variola virus
uaguuucuaagau

SEQ ID NO: 3289672 - RNA, 15 nt, Variola virus
gucaaaaacugaagu

SEQ ID NO: 3289673 - RNA, 16 nt, Variola virus
gaacccaauuacgaua

SEQ ID NO: 3289674 - RNA, 19 nt, Variola virus
gacuagauaaacuaucagu

SEQ ID NO: 3289675 - RNA, 11 nt, Variola virus
cuuucucucuu

SEQ ID NO: 3289676 - RNA, 11 nt, Variola virus
guuaauaaucu

SEQ ID NO: 3289677 - RNA, 19 nt, Variola virus
uaaaacauaaucaaggaua

SEQ ID NO: 3289678 - RNA, 17 nt, Variola virus
aauguuugaaaacauua

SEQ ID NO: 3289679 - RNA, 16 nt, Variola virus
aucaacuuauucuuaa

SEQ ID NO: 3289680 - RNA, 19 nt, Variola virus
ucuacuagacuauuaauaa

SEQ ID NO: 3289681 - RNA, 15 nt, Variola virus
uaaugauugcauauu

SEQ ID NO: 3289682 - RNA, 21 nt, Variola virus
uaaguuacagcgacacgguau

SEQ ID NO: 3289683 - RNA, 15 nt, Variola virus
uaauaguuuaucaua

SEQ ID NO: 3289684 - RNA, 13 nt, Variola virus
caaaaaauauauu

SEQ ID NO: 3289685 - RNA, 21 nt, Variola virus
ucuacauaugguggauuagua

SEQ ID NO: 3289686 - RNA, 20 nt, Variola virus
aucuucucuccuuucaaacu

SEQ ID NO: 3289687 - RNA, 15 nt, Variola virus
ccauaaacuauuuua

SEQ ID NO: 3289688 - RNA, 15 nt, Variola virus
agaauucaaaauauu

SEQ ID NO: 3289689 - RNA, 17 nt, Variola virus
auacuuugguaaauguu

SEQ ID NO: 3289690 - RNA, 13 nt, Variola virus
uauaauagaucuu

SEQ ID NO: 3289691 - RNA, 16 nt, Variola virus
uuugacauauuaacgu

SEQ ID NO: 3289692 - RNA, 15 nt, Variola virus
acauauuaaugaauu

SEQ ID NO: 3289693 - RNA, 23 nt, Variola virus
aacaacgaccgauaauaaaauua

SEQ ID NO: 3289694 - RNA, 17 nt, Variola virus
augaugaugaaaugaua

SEQ ID NO: 3289695 - RNA, 19 nt, Variola virus
uuaauuguuauuuuauuca

SEQ ID NO: 3289696 - RNA, 22 nt, Variola virus
ugucuaucaagauccaugauuc

SEQ ID NO: 3289697 - RNA, 17 nt, Variola virus
uauccaguuccuuuucu

SEQ ID NO: 3289698 - RNA, 14 nt, Variola virus
auaaauuauaucua

SEQ ID NO: 3289699 - RNA, 22 nt, Variola virus
ugccauugcuggauuacaucua

SEQ ID NO: 3289700 - RNA, 13 nt, Variola virus
aauuuuagauaau

SEQ ID NO: 3289701 - RNA, 19 nt, Variola virus
auaauauuuuaauagauua

SEQ ID NO: 3289702 - RNA, 17 nt, Variola virus
agaaaaacuuaguacua

SEQ ID NO: 3289703 - RNA, 19 nt, Variola virus
ucuaugaucugucuuuuaa

SEQ ID NO: 3289704 - RNA, 14 nt, Variola virus
gaaucaauauuaau

SEQ ID NO: 3289705 - RNA, 15 nt, Variola virus
cauuuuuuuaaaacu

SEQ ID NO: 3289706 - RNA, 22 nt, Variola virus
ugaaguauuuguuguauucauu

SEQ ID NO: 3289707 - RNA, 16 nt, Variola virus
gacauaccaucuauca

SEQ ID NO: 3289708 - RNA, 13 nt, Variola virus
aaauaauccugaa

SEQ ID NO: 3289709 - RNA, 12 nt, Variola virus
acugaauuauua

SEQ ID NO: 3289710 - RNA, 19 nt, Variola virus
ucuccggccacuauuauug

SEQ ID NO: 3289711 - RNA, 16 nt, Variola virus
aaaccaucgucugaau

SEQ ID NO: 3289712 - RNA, 12 nt, Variola virus
uuaacagcuuua

SEQ ID NO: 3289713 - RNA, 18 nt, Variola virus
gcauuaauacuguuuucu

SEQ ID NO: 3289714 - RNA, 13 nt, Variola virus
aaguauuuacauu

SEQ ID NO: 3289715 - RNA, 16 nt, Variola virus
guaauuauagaugaau

SEQ ID NO: 3289716 - RNA, 14 nt, Variola virus
uuuaaaaaguuauc

SEQ ID NO: 3289717 - RNA, 18 nt, Variola virus
gaucauuaauaaaaauac

SEQ ID NO: 3289718 - RNA, 16 nt, Variola virus
auguaacauuaaguaa

SEQ ID NO: 3289719 - RNA, 23 nt, Variola virus
ucaaaaaugucgaugaaauaucu

SEQ ID NO: 3289720 - RNA, 17 nt, Variola virus
cuccguauuccaaacua

SEQ ID NO: 3289721 - RNA, 14 nt, Variola virus
agauaugauaaaca

SEQ ID NO: 3289722 - RNA, 18 nt, Variola virus
agcgggguugaucuugug

SEQ ID NO: 3289723 - RNA, 19 nt, Variola virus
aaacauuguucaugauaua

SEQ ID NO: 3289724 - RNA, 15 nt, Variola virus
aauuauucuaucaau

SEQ ID NO: 3289725 - RNA, 21 nt, Variola virus
uuaguugaugugacaguuuuc

SEQ ID NO: 3289726 - RNA, 20 nt, Variola virus
gucaauuggaguaucaucua

SEQ ID NO: 3289727 - RNA, 22 nt, Variola virus
agucaaauaaagcgaaaaauaa

SEQ ID NO: 3289728 - RNA, 20 nt, Variola virus
caaugggaugcaaaacccca

SEQ ID NO: 3289729 - RNA, 14 nt, Variola virus
cuauuguuuggaau

SEQ ID NO: 3289730 - RNA, 22 nt, Variola virus
gacgucuagaguuuauaucaau

SEQ ID NO: 3289731 - RNA, 13 nt, Variola virus
auauaacauaggu

SEQ ID NO: 3289732 - RNA, 12 nt, Variola virus
augugaauguau

SEQ ID NO: 3289733 - RNA, 14 nt, Variola virus
acauuuuuuguaaa

SEQ ID NO: 3289734 - RNA, 17 nt, Variola virus
uauaugaaguaaaguau

SEQ ID NO: 3289735 - RNA, 14 nt, Variola virus
guauuaguaggaaa

SEQ ID NO: 3289736 - RNA, 18 nt, Variola virus
auucuucgcccucaauuu

SEQ ID NO: 3289737 - RNA, 16 nt, Variola virus
ugacugcuaaagaugc

SEQ ID NO: 3289738 - RNA, 22 nt, Variola virus
uauuuucgcuccaaauauacau

SEQ ID NO: 3289739 - RNA, 18 nt, Variola virus
ucaaacucgauauauuca

SEQ ID NO: 3289740 - RNA, 14 nt, Variola virus
acaccgaauacaaa

SEQ ID NO: 3289741 - RNA, 17 nt, Variola virus
agauguuagaaaaauga

SEQ ID NO: 3289742 - RNA, 19 nt, Variola virus
cauaauacuaucuauguua

SEQ ID NO: 3289743 - RNA, 22 nt, Variola virus
ccauuuaucauggaaaagaauu

SEQ ID NO: 3289744 - RNA, 22 nt, Variola virus
acaaaaacuugguuucaaugag

SEQ ID NO: 3289745 - RNA, 18 nt, Variola virus
agaauguuccuaauguau

SEQ ID NO: 3289746 - RNA, 17 nt, Variola virus
acuauuacaauuaauaa

SEQ ID NO: 3289747 - RNA, 15 nt, Variola virus
acuucucuaaaugag

SEQ ID NO: 3289748 - RNA, 21 nt, Variola virus
cauuuucaauaauauacuaau

SEQ ID NO: 3289749 - RNA, 14 nt, Variola virus
uaucauuuacuaga

SEQ ID NO: 3289750 - RNA, 19 nt, Variola virus
uaaacguuccguguguaau

SEQ ID NO: 3289751 - RNA, 17 nt, Variola virus
aucaggaauccaaagag

SEQ ID NO: 3289752 - RNA, 18 nt, Variola virus
uauugagaagcauuuagu

SEQ ID NO: 3289753 - RNA, 24 nt, Variola virus
cuugagauaccaaagucugauauu

SEQ ID NO: 3289754 - RNA, 23 nt, Variola virus
ugcuguacuaaauucaauaucuu

SEQ ID NO: 3289755 - RNA, 23 nt, Variola virus
gugucagagcacaggauuuccaa

SEQ ID NO: 3289756 - RNA, 15 nt, Variola virus
uucaaaaauuuagaa

SEQ ID NO: 3289757 - RNA, 22 nt, Variola virus
auguagaauaucuaccaaauua

SEQ ID NO: 3289758 - RNA, 15 nt, Variola virus
gcuaauugucuuucu

SEQ ID NO: 3289759 - RNA, 19 nt, Variola virus
cuagaauuagaauuacaaa

SEQ ID NO: 3289760 - RNA, 13 nt, Variola virus
auaaaaugucaca

SEQ ID NO: 3289761 - RNA, 16 nt, Variola virus
caaacguuuguuaaag

SEQ ID NO: 3289762 - RNA, 22 nt, Variola virus
ugaaccguauuacucuacagua

SEQ ID NO: 3289763 - RNA, 16 nt, Variola virus
uaaauagaacgucauc

SEQ ID NO: 3289764 - RNA, 13 nt, Variola virus
uuaauauuucuau

SEQ ID NO: 3289765 - RNA, 21 nt, Variola virus
caucgguacggguauucauuu

SEQ ID NO: 3289766 - RNA, 13 nt, Variola virus
cuauauagauauu

SEQ ID NO: 3289767 - RNA, 19 nt, Variola virus
caacgaaucccuacauauu

SEQ ID NO: 3289768 - RNA, 18 nt, Variola virus
aguagcuagacaaauggu

SEQ ID NO: 3289769 - RNA, 19 nt, Variola virus
auugacauggcuucuucca

SEQ ID NO: 3289770 - RNA, 13 nt, Variola virus
aucucuuaaugag

SEQ ID NO: 3289771 - RNA, 17 nt, Variola virus
agcuaucaagucuuuau

SEQ ID NO: 3289772 - RNA, 16 nt, Variola virus
auuaagcaacaugucu

SEQ ID NO: 3289773 - RNA, 11 nt, Variola virus
gcauaauacaa

SEQ ID NO: 3289774 - RNA, 19 nt, Variola virus
caggaucuccaacaaauuu

SEQ ID NO: 3289775 - RNA, 19 nt, Variola virus
aacgaugccuuuuguaaau

SEQ ID NO: 3289776 - RNA, 21 nt, Variola virus
ccaugucaaauagaguuuaua

SEQ ID NO: 3289777 - RNA, 16 nt, Variola virus
acaugucuaauguguu

SEQ ID NO: 3289778 - RNA, 18 nt, Variola virus
gaugaauugauuaauguu

SEQ ID NO: 3289779 - RNA, 12 nt, Variola virus
aucuaaaaaacu

SEQ ID NO: 3289780 - RNA, 16 nt, Variola virus
gaagugauauuugaaa

SEQ ID NO: 3289781 - RNA, 20 nt, Variola virus
cugauaucauuaaugauaua

SEQ ID NO: 3289782 - RNA, 12 nt, Variola virus
aauauuaggaau

SEQ ID NO: 3289783 - RNA, 18 nt, Variola virus
cgaaauauauuuguagua

SEQ ID NO: 3289784 - RNA, 22 nt, Variola virus
agaaacuauagauaaugauaua

SEQ ID NO: 3289785 - RNA, 13 nt, Variola virus
ucauacagacacu

SEQ ID NO: 3289786 - RNA, 23 nt, Variola virus
uguaaucgauaacacaauuuaug

SEQ ID NO: 3289787 - RNA, 17 nt, Variola virus
ugaguauaucagaucau

SEQ ID NO: 3289788 - RNA, 22 nt, Variola virus
auuaguuuccuuguuuagagau

SEQ ID NO: 3289789 - RNA, 13 nt, Variola virus
aguacauuucaca

SEQ ID NO: 3289790 - RNA, 21 nt, Variola virus
uugacauuaaucuauuagaau

SEQ ID NO: 3289791 - RNA, 13 nt, Variola virus
auacuaaacauug

SEQ ID NO: 3289792 - RNA, 15 nt, Variola virus
acuguucaaaauaua

SEQ ID NO: 3289793 - RNA, 14 nt, Variola virus
gaaaauaaauacaa

SEQ ID NO: 3289794 - RNA, 18 nt, Variola virus
uaauaccaguuauguuca

SEQ ID NO: 3289795 - RNA, 13 nt, Variola virus
aauuauuuaacuu

SEQ ID NO: 3289796 - RNA, 23 nt, Variola virus
ugugucaaagguuaaaccuuuau

SEQ ID NO: 3289797 - RNA, 12 nt, Variola virus
aaucugaaaaua

SEQ ID NO: 3289798 - RNA, 17 nt, Variola virus
auaucacauuguauaua

SEQ ID NO: 3289799 - RNA, 13 nt, Variola virus
uuaaauauguucu

SEQ ID NO: 3289800 - RNA, 22 nt, Variola virus
uauuagaauuggaauaccaaau

SEQ ID NO: 3289801 - RNA, 21 nt, Variola virus
aauguuaagcauauccugaau

SEQ ID NO: 3289802 - RNA, 19 nt, Variola virus
caaggacagaaaaauguua

SEQ ID NO: 3289803 - RNA, 23 nt, Variola virus
uaucucaauaaaaaauuaauauu

SEQ ID NO: 3289804 - RNA, 13 nt, Variola virus
ucuucaucaucca

SEQ ID NO: 3289805 - RNA, 21 nt, Variola virus
ugcgagagacaaaaugugaua

SEQ ID NO: 3289806 - RNA, 13 nt, Variola virus
uaauaagauaaau

SEQ ID NO: 3289807 - RNA, 20 nt, Variola virus
caugacuugguauuuggaaa

SEQ ID NO: 3289808 - RNA, 17 nt, Variola virus
auuaaaucuuucauuuc

SEQ ID NO: 3289809 - RNA, 11 nt, Variola virus
cauuauuggaa

SEQ ID NO: 3289810 - RNA, 18 nt, Variola virus
aaaucucaguuaacgauu

SEQ ID NO: 3289811 - RNA, 17 nt, Variola virus
aacuuuguuguuacauu

SEQ ID NO: 3289812 - RNA, 13 nt, Variola virus
gcggauacaaaac

SEQ ID NO: 3289813 - RNA, 20 nt, Variola virus
guaucaucgucuaguuuauc

SEQ ID NO: 3289814 - RNA, 15 nt, Variola virus
cugcuagaacaucca

SEQ ID NO: 3289815 - RNA, 21 nt, Variola virus
acaaacuguuguuaaggaaua

SEQ ID NO: 3289816 - RNA, 21 nt, Variola virus
guuguuacuccauuauauauu

SEQ ID NO: 3289817 - RNA, 18 nt, Variola virus
caucuaucaaacaaaauu

SEQ ID NO: 3289818 - RNA, 17 nt, Variola virus
uguauauuacacauuau

SEQ ID NO: 3289819 - RNA, 20 nt, Variola virus
auauagcggaugaaaaauuu

SEQ ID NO: 3289820 - RNA, 16 nt, Variola virus
aauagucaauagauua

SEQ ID NO: 3289821 - RNA, 12 nt, Variola virus
ucuuuuaaccag

SEQ ID NO: 3289822 - RNA, 20 nt, Variola virus
aauauucuaugacugaaugu

SEQ ID NO: 3289823 - RNA, 15 nt, Variola virus
gaccacauccuucag

SEQ ID NO: 3289824 - RNA, 15 nt, Variola virus
cuccauuacacaaau

SEQ ID NO: 3289825 - RNA, 16 nt, Variola virus
uacgccccuguaucuc

SEQ ID NO: 3289826 - RNA, 19 nt, Variola virus
acaaacaggauaucuauga

SEQ ID NO: 3289827 - RNA, 17 nt, Variola virus
aucaagucucucauauu

SEQ ID NO: 3289828 - RNA, 15 nt, Variola virus
aucaacauauuaaug

SEQ ID NO: 3289829 - RNA, 19 nt, Variola virus
aagaaugcuguuauauaca

SEQ ID NO: 3289830 - RNA, 14 nt, Variola virus
uauauuuuggaagc

SEQ ID NO: 3289831 - RNA, 17 nt, Variola virus
uccuuggaauugauaga

SEQ ID NO: 3289832 - RNA, 15 nt, Variola virus
guagcaaauuuccua

SEQ ID NO: 3289833 - RNA, 15 nt, Variola virus
caauauauauacagu

SEQ ID NO: 3289834 - RNA, 19 nt, Variola virus
acgaagauacuauccauca

SEQ ID NO: 3289835 - RNA, 15 nt, Variola virus
cuuuauuuuaucuau

SEQ ID NO: 3289836 - RNA, 17 nt, Variola virus
cuuaacaaguucucaau

SEQ ID NO: 3289837 - RNA, 18 nt, Variola virus
uaaaaugaucuauauguu

SEQ ID NO: 3289838 - RNA, 15 nt, Variola virus
gaaucauaaagaaca

SEQ ID NO: 3289839 - RNA, 22 nt, Variola virus
aagaagugucuauaaauguaga

SEQ ID NO: 3289840 - RNA, 16 nt, Variola virus
uuccguaucuguauuu

SEQ ID NO: 3289841 - RNA, 20 nt, Variola virus
guauauuuuagguacuuaug

SEQ ID NO: 3289842 - RNA, 16 nt, Variola virus
ucugucucagaaucaa

SEQ ID NO: 3289843 - RNA, 21 nt, Variola virus
caucuuaaugcggcuuaauaa

SEQ ID NO: 3289844 - RNA, 12 nt, Variola virus
uauuuuucuuua

SEQ ID NO: 3289845 - RNA, 16 nt, Variola virus
cuauugacugaacaau

SEQ ID NO: 3289846 - RNA, 14 nt, Variola virus
agacgcucaaaaua

SEQ ID NO: 3289847 - RNA, 14 nt, Variola virus
ucuguuauuucagu

SEQ ID NO: 3289848 - RNA, 13 nt, Variola virus
ucaucuucauagg

SEQ ID NO: 3289849 - RNA, 19 nt, Variola virus
uaaacucuccaccauuucc

SEQ ID NO: 3289850 - RNA, 17 nt, Variola virus
ugaacgcuauuaaacau

SEQ ID NO: 3289851 - RNA, 20 nt, Variola virus
augugucucucacucucucu

SEQ ID NO: 3289852 - RNA, 14 nt, Variola virus
uucaugacaaucaa

SEQ ID NO: 3289853 - RNA, 21 nt, Variola virus
gacucgcaaaaaauacaauau

SEQ ID NO: 3289854 - RNA, 23 nt, Variola virus
ucuucguaaaaagauucuugaaa

SEQ ID NO: 3289855 - RNA, 15 nt, Variola virus
auaggcguacaaaag

SEQ ID NO: 3289856 - RNA, 18 nt, Variola virus
auuaucaaaagacaugau

SEQ ID NO: 3289857 - RNA, 19 nt, Variola virus
uaacucuuucgaauacuua

SEQ ID NO: 3289858 - RNA, 17 nt, Variola virus
ugguuucauguuuucaa

SEQ ID NO: 3289859 - RNA, 22 nt, Variola virus
agauauuaucauuagucauguu

SEQ ID NO: 3289860 - RNA, 13 nt, Variola virus
auuucgacaaaaa

SEQ ID NO: 3289861 - RNA, 19 nt, Variola virus
ugcuugcuagacaccuuuu

SEQ ID NO: 3289862 - RNA, 17 nt, Variola virus
uuacaaauauucacaag

SEQ ID NO: 3289863 - RNA, 13 nt, Variola virus
gaaauuagaaaau

SEQ ID NO: 3289864 - RNA, 18 nt, Variola virus
gaaaaaguaaaugaugaa

SEQ ID NO: 3289865 - RNA, 18 nt, Variola virus
uauugauaaaauuaauga

SEQ ID NO: 3289866 - RNA, 16 nt, Variola virus
aggaaguauaucugag

SEQ ID NO: 3289867 - RNA, 17 nt, Variola virus
acauuaaugguacaaau

SEQ ID NO: 3289868 - RNA, 17 nt, Variola virus
aacaguuauuuucugaa

SEQ ID NO: 3289869 - RNA, 13 nt, Variola virus
aaaguaauucauu

SEQ ID NO: 3289870 - RNA, 13 nt, Variola virus
uaauaaauacaga

SEQ ID NO: 3289871 - RNA, 19 nt, Variola virus
acuuagucuguacaaaagu

SEQ ID NO: 3289872 - RNA, 14 nt, Variola virus
gauuucuauuuuua

SEQ ID NO: 3289873 - RNA, 16 nt, Variola virus
uuguauccuuaucuau

SEQ ID NO: 3289874 - RNA, 19 nt, Variola virus
uaugauccaauguguuuaa

SEQ ID NO: 3289875 - RNA, 18 nt, Variola virus
ugccauaaauaaaugcuu

SEQ ID NO: 3289876 - RNA, 17 nt, Variola virus
auauauuuucauuuaaa

SEQ ID NO: 3289877 - RNA, 15 nt, Variola virus
cauacacuacaguaa

SEQ ID NO: 3289878 - RNA, 11 nt, Variola virus
auuuacuaaca

SEQ ID NO: 3289879 - RNA, 15 nt, Variola virus
agcaucauaucuugu

SEQ ID NO: 3289880 - RNA, 17 nt, Variola virus
aaauuuuuugaaguaau

SEQ ID NO: 3289881 - RNA, 19 nt, Variola virus
uuucucguucccuaucaag

SEQ ID NO: 3289882 - RNA, 15 nt, Variola virus
agcaaaggaaauugu

SEQ ID NO: 3289883 - RNA, 17 nt, Variola virus
uaucuaaccauucaauu

SEQ ID NO: 3289884 - RNA, 19 nt, Variola virus
acuuaauauaauauugaag

SEQ ID NO: 3289885 - RNA, 23 nt, Variola virus
aggaaauuaauaucgaugauauu

SEQ ID NO: 3289886 - RNA, 18 nt, Variola virus
gacuuguauaugccaaag

SEQ ID NO: 3289887 - RNA, 18 nt, Variola virus
cuuuuguggaauuuccca

SEQ ID NO: 3289888 - RNA, 14 nt, Variola virus
aucgauaauuauuu

SEQ ID NO: 3289889 - RNA, 19 nt, Variola virus
uucaauaucuauacuaguu

SEQ ID NO: 3289890 - RNA, 20 nt, Variola virus
uucugcaauaucuucguaaa

SEQ ID NO: 3289891 - RNA, 13 nt, Variola virus
auaaugaacauau

SEQ ID NO: 3289892 - RNA, 15 nt, Variola virus
gagcaagugguggug

SEQ ID NO: 3289893 - RNA, 22 nt, Variola virus
acaagucuaauaauguuauuac

SEQ ID NO: 3289894 - RNA, 19 nt, Variola virus
agaauauaaaaaaaugauu

SEQ ID NO: 3289895 - RNA, 17 nt, Variola virus
auucuucauucugcaua

SEQ ID NO: 3289896 - RNA, 23 nt, Variola virus
uggcuaagaagucauauguggua

SEQ ID NO: 3289897 - RNA, 21 nt, Variola virus
cuuaagucuccaaucuuuugu

SEQ ID NO: 3289898 - RNA, 22 nt, Variola virus
cagaauagcggauauagauauu

SEQ ID NO: 3289899 - RNA, 19 nt, Variola virus
aauguuauauguaacauua

SEQ ID NO: 3289900 - RNA, 19 nt, Variola virus
guagugaugguuuucuaaa

SEQ ID NO: 3289901 - RNA, 15 nt, Variola virus
auuaaguaaauccuu

SEQ ID NO: 3289902 - RNA, 17 nt, Variola virus
uauaagacgauacuguu

SEQ ID NO: 3289903 - RNA, 17 nt, Variola virus
agcuuacaauaaacucc

SEQ ID NO: 3289904 - RNA, 16 nt, Variola virus
auagacauugaaaaug

SEQ ID NO: 3289905 - RNA, 14 nt, Variola virus
agaguauuguacag

SEQ ID NO: 3289906 - RNA, 15 nt, Variola virus
caacuacauaaucuu

SEQ ID NO: 3289907 - RNA, 16 nt, Variola virus
auacugucgaauuuga

SEQ ID NO: 3289908 - RNA, 13 nt, Variola virus
ugaacaggcauuu

SEQ ID NO: 3289909 - RNA, 19 nt, Variola virus
acuagaguuguuaaaguua

SEQ ID NO: 3289910 - RNA, 13 nt, Variola virus
ucugaaauaauca

SEQ ID NO: 3289911 - RNA, 12 nt, Variola virus
guucugauuuua

SEQ ID NO: 3289912 - RNA, 14 nt, Variola virus
uaaagauacaaaac

SEQ ID NO: 3289913 - RNA, 18 nt, Variola virus
caauuggaguaucaucua

SEQ ID NO: 3289914 - RNA, 14 nt, Variola virus
aacaaauauuggca

SEQ ID NO: 3289915 - RNA, 15 nt, Variola virus
uaucgauaauuauuu

SEQ ID NO: 3289916 - RNA, 12 nt, Variola virus
auucagacacuu

SEQ ID NO: 3289917 - RNA, 20 nt, Variola virus
augaauaucaggaaauguau

SEQ ID NO: 3289918 - RNA, 15 nt, Variola virus
gcauaccauacuuag

SEQ ID NO: 3289919 - RNA, 18 nt, Variola virus
uauuuuuaaaaauuacca

SEQ ID NO: 3289920 - RNA, 14 nt, Variola virus
uaaagaauaucuuu

SEQ ID NO: 3289921 - RNA, 22 nt, Variola virus
acuaucugauaagauaucuucu

SEQ ID NO: 3289922 - RNA, 16 nt, Variola virus
cucaaauaauacuaua

SEQ ID NO: 3289923 - RNA, 16 nt, Variola virus
auaaucggagaauguu

SEQ ID NO: 3289924 - RNA, 17 nt, Variola virus
gaucaggaauccaaaga

SEQ ID NO: 3289925 - RNA, 14 nt, Variola virus
aguaaaaucuauca

SEQ ID NO: 3289926 - RNA, 13 nt, Variola virus
augauaaaaugaa

SEQ ID NO: 3289927 - RNA, 16 nt, Variola virus
uacuacacauuauucc

SEQ ID NO: 3289928 - RNA, 15 nt, Variola virus
uaauuauagauguau

SEQ ID NO: 3289929 - RNA, 15 nt, Variola virus
ugcucaaacaaaaug

SEQ ID NO: 3289930 - RNA, 13 nt, Variola virus
ucuucuauuucua

SEQ ID NO: 3289931 - RNA, 15 nt, Variola virus
aacuagaauuguaua

SEQ ID NO: 3289932 - RNA, 15 nt, Variola virus
auaauacgaauauau

SEQ ID NO: 3289933 - RNA, 15 nt, Variola virus
uauaaucguuaaauu

SEQ ID NO: 3289934 - RNA, 16 nt, Variola virus
gucugcuuucuuuuaa

SEQ ID NO: 3289935 - RNA, 22 nt, Variola virus
uguuaccauaucguauaacuug

SEQ ID NO: 3289936 - RNA, 20 nt, Variola virus
gcuaguuaacuaauaaauaa

SEQ ID NO: 3289937 - RNA, 16 nt, Variola virus
caucggcaacauacua

SEQ ID NO: 3289938 - RNA, 21 nt, Variola virus
gaaccaguaccagaucuuaau

SEQ ID NO: 3289939 - RNA, 16 nt, Variola virus
ucuccaauauaugaua

SEQ ID NO: 3289940 - RNA, 18 nt, Variola virus
uaaaugcgugacuauaaa

SEQ ID NO: 3289941 - RNA, 18 nt, Variola virus
cauaaaacuaauauuuua

SEQ ID NO: 3289942 - RNA, 16 nt, Variola virus
uuauaagaaauauaga

SEQ ID NO: 3289943 - RNA, 15 nt, Variola virus
acaauacguguugau

SEQ ID NO: 3289944 - RNA, 22 nt, Variola virus
aaucaagauucauuuuuaaaau

SEQ ID NO: 3289945 - RNA, 15 nt, Variola virus
ccaguacaucuauca

SEQ ID NO: 3289946 - RNA, 14 nt, Variola virus
uuauaaacacagau

SEQ ID NO: 3289947 - RNA, 18 nt, Variola virus
aauccagauuuuaaaacu

SEQ ID NO: 3289948 - RNA, 19 nt, Variola virus
auugaauuggaaaaauaac

SEQ ID NO: 3289949 - RNA, 14 nt, Variola virus
aauaucuuaaauaa

SEQ ID NO: 3289950 - RNA, 17 nt, Variola virus
auuuacuaucuguaaug

SEQ ID NO: 3289951 - RNA, 21 nt, Variola virus
gacauagagagcuucaucaau

SEQ ID NO: 3289952 - RNA, 13 nt, Variola virus
aucgacuauuuua

SEQ ID NO: 3289953 - RNA, 15 nt, Variola virus
cgucuggagauaucc

SEQ ID NO: 3289954 - RNA, 13 nt, Variola virus
acaguuacaaaug

SEQ ID NO: 3289955 - RNA, 19 nt, Variola virus
aauauuauauaaacauuug

SEQ ID NO: 3289956 - RNA, 18 nt, Variola virus
uuucguacaaauacagaa

SEQ ID NO: 3289957 - RNA, 23 nt, Variola virus
guguacauccaaaauacaaaaug

SEQ ID NO: 3289958 - RNA, 16 nt, Variola virus
aguauuugauaaaaca

SEQ ID NO: 3289959 - RNA, 14 nt, Variola virus
aauacggauaugac

SEQ ID NO: 3289960 - RNA, 18 nt, Variola virus
cauguuccuauuaugaaa

SEQ ID NO: 3289961 - RNA, 21 nt, Variola virus
uuuuuauaaaaugacaucguu

SEQ ID NO: 3289962 - RNA, 22 nt, Variola virus
agaauauaaauuauauauggau

SEQ ID NO: 3289963 - RNA, 21 nt, Variola virus
acaaaagguauuacaagaaua

SEQ ID NO: 3289964 - RNA, 13 nt, Variola virus
uagacaaaacuau

SEQ ID NO: 3289965 - RNA, 17 nt, Variola virus
aaucucuguuauuuccu

SEQ ID NO: 3289966 - RNA, 18 nt, Variola virus
uauggaucuauucaagau

SEQ ID NO: 3289967 - RNA, 22 nt, Variola virus
guagauaagaaugugauaagau

SEQ ID NO: 3289968 - RNA, 16 nt, Variola virus
uuacuuagucuguaca

SEQ ID NO: 3289969 - RNA, 12 nt, Variola virus
uauuuauuucca

SEQ ID NO: 3289970 - RNA, 19 nt, Variola virus
uagggaugauaaauauuua

SEQ ID NO: 3289971 - RNA, 13 nt, Variola virus
ugacaaauuauuc

SEQ ID NO: 3289972 - RNA, 19 nt, Variola virus
cucucauaauccauuucca

SEQ ID NO: 3289973 - RNA, 16 nt, Variola virus
accauuaauaggaaaa

SEQ ID NO: 3289974 - RNA, 20 nt, Variola virus
aucuguauaauaagaugcaa

SEQ ID NO: 3289975 - RNA, 20 nt, Variola virus
auugaagaaggagaagauau

SEQ ID NO: 3289976 - RNA, 13 nt, Variola virus
ucuauuacuacaa

SEQ ID NO: 3289977 - RNA, 14 nt, Variola virus
auucauuaauucua

SEQ ID NO: 3289978 - RNA, 21 nt, Variola virus
ugauauauccagauuacuaac

SEQ ID NO: 3289979 - RNA, 22 nt, Variola virus
guugggacugacagauguguuc

SEQ ID NO: 3289980 - RNA, 19 nt, Variola virus
cuaauaugaggaaaaugau

SEQ ID NO: 3289981 - RNA, 12 nt, Variola virus
cauguauacaau

SEQ ID NO: 3289982 - RNA, 14 nt, Variola virus
guaucuuuacuaga

SEQ ID NO: 3289983 - RNA, 18 nt, Variola virus
ccaaucuuguuauaaaca

SEQ ID NO: 3289984 - RNA, 20 nt, Variola virus
aagaagugucuauaaaugua

SEQ ID NO: 3289985 - RNA, 20 nt, Variola virus
ggauauagauauuaaacaag

SEQ ID NO: 3289986 - RNA, 12 nt, Variola virus
uucuuucaaaau

SEQ ID NO: 3289987 - RNA, 23 nt, Variola virus
auaaauuuauuauuuaugauauu

SEQ ID NO: 3289988 - RNA, 22 nt, Variola virus
aacgauuuuccaaaucaguaac

SEQ ID NO: 3289989 - RNA, 17 nt, Variola virus
cagauacauuauaugau

SEQ ID NO: 3289990 - RNA, 18 nt, Variola virus
acucuggguaacaaacau

SEQ ID NO: 3289991 - RNA, 19 nt, Variola virus
gaggauguauauaucauga

SEQ ID NO: 3289992 - RNA, 20 nt, Variola virus
guacacaauaucauaaacaa

SEQ ID NO: 3289993 - RNA, 18 nt, Variola virus
uaacaugcgguucaaaau

SEQ ID NO: 3289994 - RNA, 20 nt, Variola virus
gauaauacauuuucuuacaa

SEQ ID NO: 3289995 - RNA, 14 nt, Variola virus
auuuagaaauguug

SEQ ID NO: 3289996 - RNA, 13 nt, Variola virus
aguucuucuagaa

SEQ ID NO: 3289997 - RNA, 16 nt, Variola virus
acugagaaacagcaua

SEQ ID NO: 3289998 - RNA, 20 nt, Variola virus
aacucucguauagucauaga

SEQ ID NO: 3289999 - RNA, 17 nt, Variola virus
ccauugcguugaaugau

SEQ ID NO: 3290000 - RNA, 18 nt, Variola virus
aaugauuucauuagaaua

SEQ ID NO: 3290001 - RNA, 12 nt, Variola virus
agaauacucuac

SEQ ID NO: 3290002 - RNA, 23 nt, Variola virus
uagcuaucucgucucucaacaaa

SEQ ID NO: 3290003 - RNA, 13 nt, Variola virus
auuauaauuauua

SEQ ID NO: 3290004 - RNA, 16 nt, Variola virus
aaacuguuuaagaaaa

SEQ ID NO: 3290005 - RNA, 13 nt, Variola virus
aucacuaacaaua

SEQ ID NO: 3290006 - RNA, 15 nt, Variola virus
acuugacaaaaauug

SEQ ID NO: 3290007 - RNA, 23 nt, Variola virus
aucaagucuuuauacaaugacau

SEQ ID NO: 3290008 - RNA, 11 nt, Variola virus
cgauagaaaaa

SEQ ID NO: 3290009 - RNA, 22 nt, Variola virus
aucuaccucuccaaaaagaaaa

SEQ ID NO: 3290010 - RNA, 21 nt, Variola virus
ucaauuggcacgaacaaaaau

SEQ ID NO: 3290011 - RNA, 23 nt, Variola virus
uacugagaauuaacgaaacaaug

SEQ ID NO: 3290012 - RNA, 17 nt, Variola virus
guuuaaugauaaacaaa

SEQ ID NO: 3290013 - RNA, 22 nt, Variola virus
uuaauuuccggaucuacauuuu

SEQ ID NO: 3290014 - RNA, 13 nt, Variola virus
acuaaaacugaag

SEQ ID NO: 3290015 - RNA, 13 nt, Variola virus
auuaucaaaauua

SEQ ID NO: 3290016 - RNA, 23 nt, Variola virus
agaaacugacuugauaaaaaugg

SEQ ID NO: 3290017 - RNA, 23 nt, Variola virus
uuuaaggaggcguccuuuucuaa

SEQ ID NO: 3290018 - RNA, 16 nt, Variola virus
auagucuccagaaauc

SEQ ID NO: 3290019 - RNA, 21 nt, Variola virus
acauuaauuccuuuuuaaauu

SEQ ID NO: 3290020 - RNA, 15 nt, Variola virus
acagacugaaaguau

SEQ ID NO: 3290021 - RNA, 22 nt, Variola virus
agacaugauaauauuaaagaua

SEQ ID NO: 3290022 - RNA, 20 nt, Variola virus
gaguauaaaacauuaaaugu

SEQ ID NO: 3290023 - RNA, 21 nt, Variola virus
cagauuagaugacaugacauu

SEQ ID NO: 3290024 - RNA, 19 nt, Variola virus
uccuuaaauguuuucucug

SEQ ID NO: 3290025 - RNA, 19 nt, Variola virus
aaagcaauugacuaauaaa

SEQ ID NO: 3290026 - RNA, 19 nt, Variola virus
gaugaaggugggacuauau

SEQ ID NO: 3290027 - RNA, 15 nt, Variola virus
auucuagaccaaaaa

SEQ ID NO: 3290028 - RNA, 14 nt, Variola virus
acgaugauauguau

SEQ ID NO: 3290029 - RNA, 19 nt, Variola virus
guuauagaggaauaucauc

SEQ ID NO: 3290030 - RNA, 20 nt, Variola virus
guaauauuguacgauguaau

SEQ ID NO: 3290031 - RNA, 17 nt, Variola virus
auaacaggcuaaaaugu

SEQ ID NO: 3290032 - RNA, 19 nt, Variola virus
aaaucagaugcuguaaauu

SEQ ID NO: 3290033 - RNA, 19 nt, Variola virus
aguuuaucguuuacauaag

SEQ ID NO: 3290034 - RNA, 16 nt, Variola virus
cuaaucucuucuuuaa

SEQ ID NO: 3290035 - RNA, 17 nt, Variola virus
auccuguuucuacuaac

SEQ ID NO: 3290036 - RNA, 15 nt, Variola virus
aucaaagaagaaguu

SEQ ID NO: 3290037 - RNA, 20 nt, Variola virus
uauauuaucaaaauuuggaa

SEQ ID NO: 3290038 - RNA, 22 nt, Variola virus
aauuaugaaaaaguaaaugaug

SEQ ID NO: 3290039 - RNA, 18 nt, Variola virus
cuguaacuaugaauucua

SEQ ID NO: 3290040 - RNA, 21 nt, Variola virus
cuuuucuauaaucauuuuuag

SEQ ID NO: 3290041 - RNA, 17 nt, Variola virus
ccacuuuaacaucucuu

SEQ ID NO: 3290042 - RNA, 17 nt, Variola virus
uaaaaagauaaacuuua

SEQ ID NO: 3290043 - RNA, 14 nt, Variola virus
ucuagacuccgcau

SEQ ID NO: 3290044 - RNA, 24 nt, Variola virus
aauguaaagagugaucaaaucauu

SEQ ID NO: 3290045 - RNA, 18 nt, Variola virus
auaacucguuuuucuuaa

SEQ ID NO: 3290046 - RNA, 16 nt, Variola virus
gaagacaauauuauca

SEQ ID NO: 3290047 - RNA, 18 nt, Variola virus
aaaugauaucuuagaaua

SEQ ID NO: 3290048 - RNA, 15 nt, Variola virus
uaaauuaauuuacca

SEQ ID NO: 3290049 - RNA, 21 nt, Variola virus
uaaguaucuauaaaacucaua

SEQ ID NO: 3290050 - RNA, 22 nt, Variola virus
agaguucgauccuaaagguaaa

SEQ ID NO: 3290051 - RNA, 17 nt, Variola virus
auuaaaaaauaacuuaa

SEQ ID NO: 3290052 - RNA, 13 nt, Variola virus
uauuucuuacaua

SEQ ID NO: 3290053 - RNA, 14 nt, Variola virus
uaaauacauuauca

SEQ ID NO: 3290054 - RNA, 14 nt, Variola virus
auaucacaaaaaua

SEQ ID NO: 3290055 - RNA, 15 nt, Variola virus
gaauauaaaccauau

SEQ ID NO: 3290056 - RNA, 17 nt, Variola virus
uucugaaauaacguauu

SEQ ID NO: 3290057 - RNA, 18 nt, Variola virus
auacucccacaaauacug

SEQ ID NO: 3290058 - RNA, 17 nt, Variola virus
ugaaauaauuagaacua

SEQ ID NO: 3290059 - RNA, 16 nt, Variola virus
auccuccaguaaauga

SEQ ID NO: 3290060 - RNA, 18 nt, Variola virus
accgucggcguuaauagu

SEQ ID NO: 3290061 - RNA, 15 nt, Variola virus
uucaaauaaaucacu

SEQ ID NO: 3290062 - RNA, 21 nt, Variola virus
agucguaugugguaugauaca

SEQ ID NO: 3290063 - RNA, 22 nt, Variola virus
aucauucuacguccuauggaug

SEQ ID NO: 3290064 - RNA, 16 nt, Variola virus
aguuucuauacugucu

SEQ ID NO: 3290065 - RNA, 21 nt, Variola virus
agcauauuccauauaaauaua

SEQ ID NO: 3290066 - RNA, 12 nt, Variola virus
uuauuguaacag

SEQ ID NO: 3290067 - RNA, 15 nt, Variola virus
uucuaaguucuaaug

SEQ ID NO: 3290068 - RNA, 12 nt, Variola virus
uucaucuguaag

SEQ ID NO: 3290069 - RNA, 17 nt, Variola virus
gauaccguuacauuuga

SEQ ID NO: 3290070 - RNA, 20 nt, Variola virus
uucuaucccccguauuuaca

SEQ ID NO: 3290071 - RNA, 17 nt, Variola virus
aguauuuuuuuucagua

SEQ ID NO: 3290072 - RNA, 14 nt, Variola virus
uaaaugaugauguu

SEQ ID NO: 3290073 - RNA, 15 nt, Variola virus
ucaucuacucuacaa

SEQ ID NO: 3290074 - RNA, 18 nt, Variola virus
cucguuuuucuuaagaaa

SEQ ID NO: 3290075 - RNA, 16 nt, Variola virus
ugguucgcucaagaau

SEQ ID NO: 3290076 - RNA, 17 nt, Variola virus
cauuuguauaaucuuua

SEQ ID NO: 3290077 - RNA, 19 nt, Variola virus
gaauaaagagaaugcagaa

SEQ ID NO: 3290078 - RNA, 22 nt, Variola virus
guaccuaucaaggaacaaauau

SEQ ID NO: 3290079 - RNA, 15 nt, Variola virus
caagucauuacuaau

SEQ ID NO: 3290080 - RNA, 23 nt, Variola virus
cccccguauuuacauuaaaugua

SEQ ID NO: 3290081 - RNA, 12 nt, Variola virus
agaaaugauauc

SEQ ID NO: 3290082 - RNA, 19 nt, Variola virus
uaauagaauuuauauaucu

SEQ ID NO: 3290083 - RNA, 19 nt, Variola virus
auacuauauaguaauacca

SEQ ID NO: 3290084 - RNA, 21 nt, Variola virus
auaacuuggaaaaaauaacua

SEQ ID NO: 3290085 - RNA, 17 nt, Variola virus
aaauguugauagcugaa

SEQ ID NO: 3290086 - RNA, 23 nt, Variola virus
aaacuaugucaaaaauuguagaa

SEQ ID NO: 3290087 - RNA, 22 nt, Variola virus
aacuauuuuaguuaacaacuau

SEQ ID NO: 3290088 - RNA, 18 nt, Variola virus
acuuuauaauuaaugaaa

SEQ ID NO: 3290089 - RNA, 13 nt, Variola virus
gcgcuauaguauu

SEQ ID NO: 3290090 - RNA, 18 nt, Variola virus
gaaauagaggaagacaca

SEQ ID NO: 3290091 - RNA, 16 nt, Variola virus
acguugaaaaaaauug

SEQ ID NO: 3290092 - RNA, 19 nt, Variola virus
uuuuagguacucaucuacu

SEQ ID NO: 3290093 - RNA, 23 nt, Variola virus
cuaaagggauuuuauaugauauc

SEQ ID NO: 3290094 - RNA, 11 nt, Variola virus
ucuauuucuau

SEQ ID NO: 3290095 - RNA, 13 nt, Variola virus
aguaauaucugau

SEQ ID NO: 3290096 - RNA, 19 nt, Variola virus
uacauauaugcaauucgcu

SEQ ID NO: 3290097 - RNA, 21 nt, Variola virus
guguacguauauuuagauguu

SEQ ID NO: 3290098 - RNA, 19 nt, Variola virus
ugaauaaucagauuuaccc

SEQ ID NO: 3290099 - RNA, 19 nt, Variola virus
aucggacuuugugcauaug

SEQ ID NO: 3290100 - RNA, 13 nt, Variola virus
agauugaaauuau

SEQ ID NO: 3290101 - RNA, 15 nt, Variola virus
auuggaaaauuagug

SEQ ID NO: 3290102 - RNA, 19 nt, Variola virus
uuuauccucucguuagccu

SEQ ID NO: 3290103 - RNA, 23 nt, Variola virus
cggauaguauucaagucaaagaa

SEQ ID NO: 3290104 - RNA, 14 nt, Variola virus
cuccaauacuaauu

SEQ ID NO: 3290105 - RNA, 14 nt, Variola virus
uaaacaccaagaaa

SEQ ID NO: 3290106 - RNA, 14 nt, Variola virus
aaauaguucauuuu

SEQ ID NO: 3290107 - RNA, 16 nt, Variola virus
gauaagagacguguua

SEQ ID NO: 3290108 - RNA, 14 nt, Variola virus
aaaagauauccaga

SEQ ID NO: 3290109 - RNA, 18 nt, Variola virus
aguuuuggaucaaaugga

SEQ ID NO: 3290110 - RNA, 15 nt, Variola virus
aucgauauugaaaau

SEQ ID NO: 3290111 - RNA, 12 nt, Variola virus
ugauuacuacau

SEQ ID NO: 3290112 - RNA, 16 nt, Variola virus
auaacuagauuuuagu

SEQ ID NO: 3290113 - RNA, 21 nt, Variola virus
gaaaauaauccugaauauauu

SEQ ID NO: 3290114 - RNA, 15 nt, Variola virus
aauccacauaugaua

SEQ ID NO: 3290115 - RNA, 20 nt, Variola virus
ucugauaauccagucuuuaa

SEQ ID NO: 3290116 - RNA, 19 nt, Variola virus
acauccucacuauucaugg

SEQ ID NO: 3290117 - RNA, 14 nt, Variola virus
uaauuaagaacuau

SEQ ID NO: 3290118 - RNA, 21 nt, Variola virus
agauacaguuaauaucuauau

SEQ ID NO: 3290119 - RNA, 18 nt, Variola virus
aguaauuaaauauaucau

SEQ ID NO: 3290120 - RNA, 14 nt, Variola virus
ccaaugaaauggua

SEQ ID NO: 3290121 - RNA, 23 nt, Variola virus
auaacaagagauuuauuguguau

SEQ ID NO: 3290122 - RNA, 14 nt, Variola virus
uaucgauguacaca

SEQ ID NO: 3290123 - RNA, 20 nt, Variola virus
uacaaucguucaaacucguc

SEQ ID NO: 3290124 - RNA, 12 nt, Variola virus
agaacaaauguu

SEQ ID NO: 3290125 - RNA, 16 nt, Variola virus
ucgauagaggaaguau

SEQ ID NO: 3290126 - RNA, 18 nt, Variola virus
auaauaagaugcaaacau

SEQ ID NO: 3290127 - RNA, 18 nt, Variola virus
agacuuacaggaauagau

SEQ ID NO: 3290128 - RNA, 20 nt, Variola virus
caaugggagauuaaacuacu

SEQ ID NO: 3290129 - RNA, 16 nt, Variola virus
uauuauccaauacaga

SEQ ID NO: 3290130 - RNA, 18 nt, Variola virus
uucuauauagcuauucuu

SEQ ID NO: 3290131 - RNA, 20 nt, Variola virus
uuccauacguuuauauucuu

SEQ ID NO: 3290132 - RNA, 15 nt, Variola virus
guuaagcauauccug

SEQ ID NO: 3290133 - RNA, 14 nt, Variola virus
ucaacuuucauagc

SEQ ID NO: 3290134 - RNA, 22 nt, Variola virus
cgcgaagcaauauauauacagu

SEQ ID NO: 3290135 - RNA, 17 nt, Variola virus
gauauuuugcaaaauag

SEQ ID NO: 3290136 - RNA, 16 nt, Variola virus
aucucuugacaaaaau

SEQ ID NO: 3290137 - RNA, 13 nt, Variola virus
uaaucauuaucca

SEQ ID NO: 3290138 - RNA, 16 nt, Variola virus
cuuuaacagaugaucu

SEQ ID NO: 3290139 - RNA, 14 nt, Variola virus
gaacaucuuccaua

SEQ ID NO: 3290140 - RNA, 12 nt, Variola virus
ucggauagaguu

SEQ ID NO: 3290141 - RNA, 18 nt, Variola virus
uaaagccgguguaacauu

SEQ ID NO: 3290142 - RNA, 11 nt, Variola virus
gcgcaugauuu

SEQ ID NO: 3290143 - RNA, 18 nt, Variola virus
uggguuaauaaauacaga

SEQ ID NO: 3290144 - RNA, 15 nt, Variola virus
auacuaguuuucuaa

SEQ ID NO: 3290145 - RNA, 12 nt, Variola virus
aaucauugacau

SEQ ID NO: 3290146 - RNA, 16 nt, Variola virus
agguauauuuauucca

SEQ ID NO: 3290147 - RNA, 10 nt, Variola virus
auaacaaagg

SEQ ID NO: 3290148 - RNA, 20 nt, Variola virus
ggauuagaauccauaaaaca

SEQ ID NO: 3290149 - RNA, 16 nt, Variola virus
auugucccaauguuuc

SEQ ID NO: 3290150 - RNA, 22 nt, Variola virus
acuuuaauccuguguuuauaga

SEQ ID NO: 3290151 - RNA, 23 nt, Variola virus
aacaaguuccucaacgugauuau

SEQ ID NO: 3290152 - RNA, 19 nt, Variola virus
aucugauguaggacaucaa

SEQ ID NO: 3290153 - RNA, 19 nt, Variola virus
uuauuaaguguauuaguca

SEQ ID NO: 3290154 - RNA, 17 nt, Variola virus
aaucucaucaucgaaga

SEQ ID NO: 3290155 - RNA, 20 nt, Variola virus
uuuagaaauguuauauauaa

SEQ ID NO: 3290156 - RNA, 21 nt, Variola virus
uuauauggcuacaauuucaua

SEQ ID NO: 3290157 - RNA, 23 nt, Variola virus
uauauagccgucgccaauugugu

SEQ ID NO: 3290158 - RNA, 21 nt, Variola virus
acgugauggauauauuaaagu

SEQ ID NO: 3290159 - RNA, 22 nt, Variola virus
ucagaauaggaugaauguagua

SEQ ID NO: 3290160 - RNA, 13 nt, Variola virus
agaaacauauucu

SEQ ID NO: 3290161 - RNA, 16 nt, Variola virus
guuucuuauguggauc

SEQ ID NO: 3290162 - RNA, 12 nt, Variola virus
uuacuaagaaag

SEQ ID NO: 3290163 - RNA, 21 nt, Variola virus
ugcuauuucggcugucagagu

SEQ ID NO: 3290164 - RNA, 18 nt, Variola virus
uagcaaaggaaauugugc

SEQ ID NO: 3290165 - RNA, 21 nt, Variola virus
auguauuucauuguucaucca

SEQ ID NO: 3290166 - RNA, 12 nt, Variola virus
ucucaauacuaa

SEQ ID NO: 3290167 - RNA, 17 nt, Variola virus
uuuaccucuucugauau

SEQ ID NO: 3290168 - RNA, 13 nt, Variola virus
aucaggaaaaaag

SEQ ID NO: 3290169 - RNA, 22 nt, Variola virus
guacacaacauguuauaacuaa

SEQ ID NO: 3290170 - RNA, 16 nt, Variola virus
auaaucuuuaguauua

SEQ ID NO: 3290171 - RNA, 14 nt, Variola virus
uauuuuucuaugau

SEQ ID NO: 3290172 - RNA, 17 nt, Variola virus
cagaaagcuguggaugu

SEQ ID NO: 3290173 - RNA, 23 nt, Variola virus
auacaucgaauauaaaauaacua

SEQ ID NO: 3290174 - RNA, 22 nt, Variola virus
ucaugaaucaauuaguagaguu

SEQ ID NO: 3290175 - RNA, 22 nt, Variola virus
aaacacuguuguuagagauuuu

SEQ ID NO: 3290176 - RNA, 15 nt, Variola virus
agaggauguuauuau

SEQ ID NO: 3290177 - RNA, 19 nt, Variola virus
aaaguaauauucauaugua

SEQ ID NO: 3290178 - RNA, 23 nt, Variola virus
agugguaggucauacuccaucaa

SEQ ID NO: 3290179 - RNA, 21 nt, Variola virus
agaaaugguguacaauuguuu

SEQ ID NO: 3290180 - RNA, 16 nt, Variola virus
acuuaaugaaaaaugu

SEQ ID NO: 3290181 - RNA, 16 nt, Variola virus
aaccgccaaugaugcg

SEQ ID NO: 3290182 - RNA, 17 nt, Variola virus
gaacaaugucaaaauau

SEQ ID NO: 3290183 - RNA, 10 nt, Variola virus
guuagaaaag

SEQ ID NO: 3290184 - RNA, 19 nt, Variola virus
uuaucagugucguaaauua

SEQ ID NO: 3290185 - RNA, 21 nt, Variola virus
cauuaacagcuuuaacagaug

SEQ ID NO: 3290186 - RNA, 22 nt, Variola virus
guugaaucaacauauagaaaag

SEQ ID NO: 3290187 - RNA, 23 nt, Variola virus
ucaauuaacauucuuauaacauc

SEQ ID NO: 3290188 - RNA, 21 nt, Variola virus
cacaggauuuccaaucuuuug

SEQ ID NO: 3290189 - RNA, 18 nt, Variola virus
caaugucugucauaugua

SEQ ID NO: 3290190 - RNA, 16 nt, Variola virus
guauaaucuuuaacaa

SEQ ID NO: 3290191 - RNA, 21 nt, Variola virus
uauuagauuugguaaaaugaa

SEQ ID NO: 3290192 - RNA, 13 nt, Variola virus
auuaauacauauu

SEQ ID NO: 3290193 - RNA, 18 nt, Variola virus
aucaggauauaaagaaaa

SEQ ID NO: 3290194 - RNA, 19 nt, Variola virus
uagagacagauuaaguucu

SEQ ID NO: 3290195 - RNA, 15 nt, Variola virus
uuauugauauguaua

SEQ ID NO: 3290196 - RNA, 16 nt, Variola virus
uuaacaucacuaauau

SEQ ID NO: 3290197 - RNA, 15 nt, Variola virus
aucucuuaaaugcua

SEQ ID NO: 3290198 - RNA, 16 nt, Variola virus
uauacaguauaaugau

SEQ ID NO: 3290199 - RNA, 20 nt, Variola virus
gauauaguauauuccaguuc

SEQ ID NO: 3290200 - RNA, 12 nt, Variola virus
acgucuguaguc

SEQ ID NO: 3290201 - RNA, 20 nt, Variola virus
acauccaucuucucuagaaa

SEQ ID NO: 3290202 - RNA, 17 nt, Variola virus
uaauccagucuuuaaug

SEQ ID NO: 3290203 - RNA, 21 nt, Variola virus
aaucuaguacucgaaauaaua

SEQ ID NO: 3290204 - RNA, 20 nt, Variola virus
agacuaugucaaaguauuug

SEQ ID NO: 3290205 - RNA, 23 nt, Variola virus
uacagaagcugccaauauagucu

SEQ ID NO: 3290206 - RNA, 18 nt, Variola virus
auacaauggaauacuuca

SEQ ID NO: 3290207 - RNA, 17 nt, Variola virus
guagcaaagaaauuaau

SEQ ID NO: 3290208 - RNA, 21 nt, Variola virus
cguuuccguuauauccaggga

SEQ ID NO: 3290209 - RNA, 19 nt, Variola virus
cauauaacguaaccagaau

SEQ ID NO: 3290210 - RNA, 23 nt, Variola virus
uaugauacugucuauaauagcaa

SEQ ID NO: 3290211 - RNA, 18 nt, Variola virus
acauuuuuauaaauagau

SEQ ID NO: 3290212 - RNA, 14 nt, Variola virus
uguauacacaugau

SEQ ID NO: 3290213 - RNA, 11 nt, Variola virus
guauaaacucc

SEQ ID NO: 3290214 - RNA, 20 nt, Variola virus
auacucaagauauuuguuaa

SEQ ID NO: 3290215 - RNA, 13 nt, Variola virus
uauaguuuaaauu

SEQ ID NO: 3290216 - RNA, 12 nt, Variola virus
uuggauguaugc

SEQ ID NO: 3290217 - RNA, 18 nt, Variola virus
cuuucaucaucugauacc

SEQ ID NO: 3290218 - RNA, 14 nt, Variola virus
gcauauauuagaaa

SEQ ID NO: 3290219 - RNA, 13 nt, Variola virus
agaauuguaacuu

SEQ ID NO: 3290220 - RNA, 20 nt, Variola virus
ucaauagaauaugucucuua

SEQ ID NO: 3290221 - RNA, 18 nt, Variola virus
acucucccuauaucuucu

SEQ ID NO: 3290222 - RNA, 17 nt, Variola virus
aacaaguuggaugauau

SEQ ID NO: 3290223 - RNA, 19 nt, Variola virus
cacuaaucauaauauucua

SEQ ID NO: 3290224 - RNA, 19 nt, Variola virus
uaucggcauuuauguuucu

SEQ ID NO: 3290225 - RNA, 15 nt, Variola virus
auacauuuucaaaua

SEQ ID NO: 3290226 - RNA, 23 nt, Variola virus
uaaaauaacucuguagacgauac

SEQ ID NO: 3290227 - RNA, 17 nt, Variola virus
guuacguuuauaaacga

SEQ ID NO: 3290228 - RNA, 21 nt, Variola virus
uuucaugaagucuaacguauu

SEQ ID NO: 3290229 - RNA, 17 nt, Variola virus
gcaacuauuuauuucua

SEQ ID NO: 3290230 - RNA, 12 nt, Variola virus
cguauacaguau

SEQ ID NO: 3290231 - RNA, 13 nt, Variola virus
uagacauuuacca

SEQ ID NO: 3290232 - RNA, 16 nt, Variola virus
uguuguuacauuucca

SEQ ID NO: 3290233 - RNA, 15 nt, Variola virus
uugaggauauacaaa

SEQ ID NO: 3290234 - RNA, 18 nt, Variola virus
uaguaccaaauucuucua

SEQ ID NO: 3290235 - RNA, 19 nt, Variola virus
guacagaaaauaucauguu

SEQ ID NO: 3290236 - RNA, 22 nt, Variola virus
agaaauuacauaaaaaaaaugu

SEQ ID NO: 3290237 - RNA, 13 nt, Variola virus
aucacaugaugau

SEQ ID NO: 3290238 - RNA, 15 nt, Variola virus
cauauauuuuuggau

SEQ ID NO: 3290239 - RNA, 22 nt, Variola virus
uuuuaaauuuccgucuaucauc

SEQ ID NO: 3290240 - RNA, 16 nt, Variola virus
uccgauauucaauuuu

SEQ ID NO: 3290241 - RNA, 18 nt, Variola virus
aguaaucauguaaauguu

SEQ ID NO: 3290242 - RNA, 13 nt, Variola virus
guaaguacaucau

SEQ ID NO: 3290243 - RNA, 16 nt, Variola virus
ucuauuauugaugcaa

SEQ ID NO: 3290244 - RNA, 14 nt, Variola virus
uaauagauuucuag

SEQ ID NO: 3290245 - RNA, 14 nt, Variola virus
uaaauuauuucauu

SEQ ID NO: 3290246 - RNA, 15 nt, Variola virus
aaacuacagguguga

SEQ ID NO: 3290247 - RNA, 23 nt, Variola virus
gaaauacuuuauuacuccauuaa

SEQ ID NO: 3290248 - RNA, 16 nt, Variola virus
agcucuuaguauggga

SEQ ID NO: 3290249 - RNA, 20 nt, Variola virus
gccauuaagaaacuaguuua

SEQ ID NO: 3290250 - RNA, 21 nt, Variola virus
auuuacgaaacuaucaaaaug

SEQ ID NO: 3290251 - RNA, 21 nt, Variola virus
ugauauacaaugcucaguaaa

SEQ ID NO: 3290252 - RNA, 22 nt, Variola virus
auacacaucucuucaucuguaa

SEQ ID NO: 3290253 - RNA, 16 nt, Variola virus
aguacuguuaagaaaa

SEQ ID NO: 3290254 - RNA, 19 nt, Variola virus
auuauauucucaucuauca

SEQ ID NO: 3290255 - RNA, 15 nt, Variola virus
uuucugguucuaauu

SEQ ID NO: 3290256 - RNA, 19 nt, Variola virus
aucuugacugucuaucucu

SEQ ID NO: 3290257 - RNA, 22 nt, Variola virus
augacacuaguuaagaacaugu

SEQ ID NO: 3290258 - RNA, 23 nt, Variola virus
acgauaaaccaaaagcuuucuag

SEQ ID NO: 3290259 - RNA, 20 nt, Variola virus
aaaugagguagcaaaaaaac

SEQ ID NO: 3290260 - RNA, 19 nt, Variola virus
acaauuauccuuuugauua

SEQ ID NO: 3290261 - RNA, 17 nt, Variola virus
uacuaggagaauuauuu

SEQ ID NO: 3290262 - RNA, 18 nt, Variola virus
aagauugauggauuagaa

SEQ ID NO: 3290263 - RNA, 20 nt, Variola virus
gucuaguaaguagaaauuau

SEQ ID NO: 3290264 - RNA, 18 nt, Variola virus
uauuuaucuuucuugcua

SEQ ID NO: 3290265 - RNA, 18 nt, Variola virus
aacucuuuagucgagaua

SEQ ID NO: 3290266 - RNA, 14 nt, Variola virus
caauaaacauagua

SEQ ID NO: 3290267 - RNA, 15 nt, Variola virus
uauaucguuaucauu

SEQ ID NO: 3290268 - RNA, 17 nt, Variola virus
uaacuccucuauuaaug

SEQ ID NO: 3290269 - RNA, 18 nt, Variola virus
acuguauccucaaacauc

SEQ ID NO: 3290270 - RNA, 17 nt, Variola virus
guacaaauguuaaacau

SEQ ID NO: 3290271 - RNA, 21 nt, Variola virus
uagaagaucaaccucuggagu

SEQ ID NO: 3290272 - RNA, 22 nt, Variola virus
ccggaagaucgcuauuguauuu

SEQ ID NO: 3290273 - RNA, 17 nt, Variola virus
ccauuucaacaguuucu

SEQ ID NO: 3290274 - RNA, 15 nt, Variola virus
uagcuguucaagaau

SEQ ID NO: 3290275 - RNA, 19 nt, Variola virus
aaaaguacucaaucuguac

SEQ ID NO: 3290276 - RNA, 15 nt, Variola virus
ugguauuugaaaucg

SEQ ID NO: 3290277 - RNA, 19 nt, Variola virus
acaaauagagauaaaacaa

SEQ ID NO: 3290278 - RNA, 17 nt, Variola virus
ugguaauaaaauuauuc

SEQ ID NO: 3290279 - RNA, 17 nt, Variola virus
uagagauacaauauuua

SEQ ID NO: 3290280 - RNA, 17 nt, Variola virus
acaugcaucuuauuaga

SEQ ID NO: 3290281 - RNA, 15 nt, Variola virus
aguaguucaacauaa

SEQ ID NO: 3290282 - RNA, 20 nt, Variola virus
ucucauaacugcucuagauu

SEQ ID NO: 3290283 - RNA, 16 nt, Variola virus
uuagcacuaucauaau

SEQ ID NO: 3290284 - RNA, 17 nt, Variola virus
ucaccauggacauaaag

SEQ ID NO: 3290285 - RNA, 23 nt, Variola virus
auuuauuuucggguuuaaauucu

SEQ ID NO: 3290286 - RNA, 17 nt, Variola virus
guuuagacgcuuauuau

SEQ ID NO: 3290287 - RNA, 12 nt, Variola virus
cguauauguuuc

SEQ ID NO: 3290288 - RNA, 20 nt, Variola virus
cuucauaaaagaaaauacua

SEQ ID NO: 3290289 - RNA, 17 nt, Variola virus
caaauaucuuuaugaau

SEQ ID NO: 3290290 - RNA, 19 nt, Variola virus
acaaucauccggauauucu

SEQ ID NO: 3290291 - RNA, 13 nt, Variola virus
uacgcguucucaa

SEQ ID NO: 3290292 - RNA, 22 nt, Variola virus
auuauaucauugucuaauagau

SEQ ID NO: 3290293 - RNA, 21 nt, Variola virus
acuaaacuaacuccuugguuu

SEQ ID NO: 3290294 - RNA, 19 nt, Variola virus
gaauugauaauauaaauau

SEQ ID NO: 3290295 - RNA, 14 nt, Variola virus
uguagauuuggaua

SEQ ID NO: 3290296 - RNA, 24 nt, Variola virus
uacauaccucuuaaauggacuagu

SEQ ID NO: 3290297 - RNA, 13 nt, Variola virus
auacauuuucaaa

SEQ ID NO: 3290298 - RNA, 15 nt, Variola virus
uaauuccuuugcuau

SEQ ID NO: 3290299 - RNA, 22 nt, Variola virus
aaaacggugcugaccuggaaaa

SEQ ID NO: 3290300 - RNA, 15 nt, Variola virus
guuucucaucuuuua

SEQ ID NO: 3290301 - RNA, 18 nt, Variola virus
acuuaaacaaaauacaau

SEQ ID NO: 3290302 - RNA, 14 nt, Variola virus
auaaaauuauucac

SEQ ID NO: 3290303 - RNA, 11 nt, Variola virus
auaaaacauua

SEQ ID NO: 3290304 - RNA, 19 nt, Variola virus
accaauuguuuuuguacau

SEQ ID NO: 3290305 - RNA, 15 nt, Variola virus
auguuauaaaaucua

SEQ ID NO: 3290306 - RNA, 23 nt, Variola virus
gcauccacucauauagaagaugc

SEQ ID NO: 3290307 - RNA, 14 nt, Variola virus
uguaucaaucaaaa

SEQ ID NO: 3290308 - RNA, 15 nt, Variola virus
gcgauaauagauagu

SEQ ID NO: 3290309 - RNA, 19 nt, Variola virus
gcuguuccucuguaaauaa

SEQ ID NO: 3290310 - RNA, 21 nt, Variola virus
uccccaaaaguaaaauaauca

SEQ ID NO: 3290311 - RNA, 12 nt, Variola virus
ucaccaauaaaa

SEQ ID NO: 3290312 - RNA, 16 nt, Variola virus
aacuaauacaucugaa

SEQ ID NO: 3290313 - RNA, 22 nt, Variola virus
cguuucauaaagagaucaggaa

SEQ ID NO: 3290314 - RNA, 17 nt, Variola virus
acuagauauauuaauaa

SEQ ID NO: 3290315 - RNA, 21 nt, Variola virus
aacuauugaagccauugaaaa

SEQ ID NO: 3290316 - RNA, 20 nt, Variola virus
cauaaaggcgcccauuucaa

SEQ ID NO: 3290317 - RNA, 13 nt, Variola virus
gguacuauuucua

SEQ ID NO: 3290318 - RNA, 16 nt, Variola virus
uaacgaggaagaaauu

SEQ ID NO: 3290319 - RNA, 17 nt, Variola virus
uuauacuaugucauuaa

SEQ ID NO: 3290320 - RNA, 12 nt, Variola virus
acaaaaugugau

SEQ ID NO: 3290321 - RNA, 13 nt, Variola virus
gaaauauucuguu

SEQ ID NO: 3290322 - RNA, 21 nt, Variola virus
aaguuaucucuaacaaaacua

SEQ ID NO: 3290323 - RNA, 22 nt, Variola virus
aaugugaauuuagcauauagua

SEQ ID NO: 3290324 - RNA, 16 nt, Variola virus
ucuagcuuucacuuaa

SEQ ID NO: 3290325 - RNA, 20 nt, Variola virus
auacauggggaucugauggu

SEQ ID NO: 3290326 - RNA, 15 nt, Variola virus
uaaagaccgaauaca

SEQ ID NO: 3290327 - RNA, 18 nt, Variola virus
aaaaguuccagaaaaugu

SEQ ID NO: 3290328 - RNA, 18 nt, Variola virus
uuuauacauauucuaaug

SEQ ID NO: 3290329 - RNA, 21 nt, Variola virus
cuccuagguuucucuauaaac

SEQ ID NO: 3290330 - RNA, 22 nt, Variola virus
gaagaugauuuugcuagagaua

SEQ ID NO: 3290331 - RNA, 17 nt, Variola virus
aggugucccgucaguau

SEQ ID NO: 3290332 - RNA, 15 nt, Variola virus
aucauuaaugauaua

SEQ ID NO: 3290333 - RNA, 17 nt, Variola virus
ucagcauuacuugauau

SEQ ID NO: 3290334 - RNA, 14 nt, Variola virus
cuugacaucuaaaa

SEQ ID NO: 3290335 - RNA, 20 nt, Variola virus
cauagaaagguugcgucuag

SEQ ID NO: 3290336 - RNA, 17 nt, Variola virus
uaauuuuaucaagacau

SEQ ID NO: 3290337 - RNA, 15 nt, Variola virus
uaacaauuucuauaa

SEQ ID NO: 3290338 - RNA, 15 nt, Variola virus
aaucuaauacaaaau

SEQ ID NO: 3290339 - RNA, 13 nt, Variola virus
aaauaucuuguau

SEQ ID NO: 3290340 - RNA, 14 nt, Variola virus
gucaagaugaugaa

SEQ ID NO: 3290341 - RNA, 15 nt, Variola virus
acaaaguacucaaua

SEQ ID NO: 3290342 - RNA, 16 nt, Variola virus
ucaauaugucaucuau

SEQ ID NO: 3290343 - RNA, 17 nt, Variola virus
ugcuauaccuaauacua

SEQ ID NO: 3290344 - RNA, 15 nt, Variola virus
uacgaggauucaaaa

SEQ ID NO: 3290345 - RNA, 19 nt, Variola virus
uagguauuuuaucucuauu

SEQ ID NO: 3290346 - RNA, 18 nt, Variola virus
cgaauauaucaaaacuac

SEQ ID NO: 3290347 - RNA, 17 nt, Variola virus
gaaucuguucaaaaauu

SEQ ID NO: 3290348 - RNA, 15 nt, Variola virus
ccagauauauaucuu

SEQ ID NO: 3290349 - RNA, 13 nt, Variola virus
cuacuuaaaugua

SEQ ID NO: 3290350 - RNA, 22 nt, Variola virus
caguuauguucaacuuugaaau

SEQ ID NO: 3290351 - RNA, 14 nt, Variola virus
uggauauguuuuua

SEQ ID NO: 3290352 - RNA, 12 nt, Variola virus
ucaggaaaugua

SEQ ID NO: 3290353 - RNA, 15 nt, Variola virus
aaacucagaacaaua

SEQ ID NO: 3290354 - RNA, 19 nt, Variola virus
ucauauaucugcucuuaaa

SEQ ID NO: 3290355 - RNA, 20 nt, Variola virus
guuauuuggcaguacucauu

SEQ ID NO: 3290356 - RNA, 16 nt, Variola virus
uaaaccguuuaauauu

SEQ ID NO: 3290357 - RNA, 16 nt, Variola virus
gucaaaaucuaaacaa

SEQ ID NO: 3290358 - RNA, 19 nt, Variola virus
caauuguggacucacuaua

SEQ ID NO: 3290359 - RNA, 21 nt, Variola virus
uauccucaauaacguuaucau

SEQ ID NO: 3290360 - RNA, 18 nt, Variola virus
cguuuaaaguaaacuucg

SEQ ID NO: 3290361 - RNA, 16 nt, Variola virus
gucguccaauauuuua

SEQ ID NO: 3290362 - RNA, 14 nt, Variola virus
caucuaacagaauu

SEQ ID NO: 3290363 - RNA, 21 nt, Variola virus
gaucauagaacaaaccaaaua

SEQ ID NO: 3290364 - RNA, 19 nt, Variola virus
uuucccguaauaaauuuua

SEQ ID NO: 3290365 - RNA, 15 nt, Variola virus
agcugcaucuaaauu

SEQ ID NO: 3290366 - RNA, 18 nt, Variola virus
uguaauuuagaauacguu

SEQ ID NO: 3290367 - RNA, 16 nt, Variola virus
uaucaucauuaucauu

SEQ ID NO: 3290368 - RNA, 17 nt, Variola virus
caggauacuaugcuauu

SEQ ID NO: 3290369 - RNA, 20 nt, Variola virus
aaaugucuagcgauauuucu

SEQ ID NO: 3290370 - RNA, 18 nt, Variola virus
aauacucaauacuuucca

SEQ ID NO: 3290371 - RNA, 17 nt, Variola virus
cggagaagaauugguaa

SEQ ID NO: 3290372 - RNA, 14 nt, Variola virus
acaucucgcaauaa

SEQ ID NO: 3290373 - RNA, 20 nt, Variola virus
cauggucuagauguaaaaaa

SEQ ID NO: 3290374 - RNA, 15 nt, Variola virus
uauaauaaauguaua

SEQ ID NO: 3290375 - RNA, 12 nt, Variola virus
auaaaauaugaa

SEQ ID NO: 3290376 - RNA, 13 nt, Variola virus
uuuagcauuucua

SEQ ID NO: 3290377 - RNA, 20 nt, Variola virus
aucauuugaugauauguuug

SEQ ID NO: 3290378 - RNA, 17 nt, Variola virus
ccuagucauauguuuaa

SEQ ID NO: 3290379 - RNA, 17 nt, Variola virus
ugaauguucucaagaac

SEQ ID NO: 3290380 - RNA, 16 nt, Variola virus
uacuuuuguuacuaau

SEQ ID NO: 3290381 - RNA, 13 nt, Variola virus
auuaauacauuua

SEQ ID NO: 3290382 - RNA, 20 nt, Variola virus
guauuuuugacguaaaugug

SEQ ID NO: 3290383 - RNA, 17 nt, Variola virus
aaaugguugauaccauu

SEQ ID NO: 3290384 - RNA, 19 nt, Variola virus
aaacggauuaauauauguc

SEQ ID NO: 3290385 - RNA, 13 nt, Variola virus
ucuaugucucuua

SEQ ID NO: 3290386 - RNA, 14 nt, Variola virus
agcauuacuugaua

SEQ ID NO: 3290387 - RNA, 17 nt, Variola virus
gucuuuaaguauauacg

SEQ ID NO: 3290388 - RNA, 17 nt, Variola virus
uucuauaucuauaucua

SEQ ID NO: 3290389 - RNA, 18 nt, Variola virus
ucacacuacugaaaaaag

SEQ ID NO: 3290390 - RNA, 16 nt, Variola virus
aaagaggaucguacau

SEQ ID NO: 3290391 - RNA, 17 nt, Variola virus
uaauaguuuaucauacu

SEQ ID NO: 3290392 - RNA, 23 nt, Variola virus
uuauuccgguacugguuuagaua

SEQ ID NO: 3290393 - RNA, 20 nt, Variola virus
auuguaccaucuuguuguaa

SEQ ID NO: 3290394 - RNA, 17 nt, Variola virus
aucuucauaaaauacua

SEQ ID NO: 3290395 - RNA, 14 nt, Variola virus
uacaucuguuuccu

SEQ ID NO: 3290396 - RNA, 16 nt, Variola virus
aaaacugaaaauauau

SEQ ID NO: 3290397 - RNA, 22 nt, Variola virus
aauaugaggaaaaugauuaaau

SEQ ID NO: 3290398 - RNA, 18 nt, Variola virus
guuauuacacauguguuu

SEQ ID NO: 3290399 - RNA, 15 nt, Variola virus
acuucacagaugaua

SEQ ID NO: 3290400 - RNA, 17 nt, Variola virus
guaaaagucaaauuaga

SEQ ID NO: 3290401 - RNA, 14 nt, Variola virus
aaugacuuauaaaa

SEQ ID NO: 3290402 - RNA, 20 nt, Variola virus
caaaaggcgguaauagaaua

SEQ ID NO: 3290403 - RNA, 15 nt, Variola virus
auuuagacgagagau

SEQ ID NO: 3290404 - RNA, 15 nt, Variola virus
cuacaucaucaucuu

SEQ ID NO: 3290405 - RNA, 20 nt, Variola virus
agaguuucaaaaauauucau

SEQ ID NO: 3290406 - RNA, 14 nt, Variola virus
aguaaaguaaacaa

SEQ ID NO: 3290407 - RNA, 23 nt, Variola virus
augugacuuuucucuaaaugaug

SEQ ID NO: 3290408 - RNA, 20 nt, Variola virus
auucucugacauucagaaag

SEQ ID NO: 3290409 - RNA, 20 nt, Variola virus
uuaagugauauaaaacauuc

SEQ ID NO: 3290410 - RNA, 23 nt, Variola virus
aguauauuuuaauucauuucauu

SEQ ID NO: 3290411 - RNA, 16 nt, Variola virus
uauauucgaauucaaa

SEQ ID NO: 3290412 - RNA, 13 nt, Variola virus
agaauauagacaa

SEQ ID NO: 3290413 - RNA, 20 nt, Variola virus
ucuauccauuguuucacauu

SEQ ID NO: 3290414 - RNA, 15 nt, Variola virus
uauauucuuacagua

SEQ ID NO: 3290415 - RNA, 15 nt, Variola virus
aucguauaaauacug

SEQ ID NO: 3290416 - RNA, 14 nt, Variola virus
gagugauucuaguu

SEQ ID NO: 3290417 - RNA, 18 nt, Variola virus
agauuuaguuguuuaauu

SEQ ID NO: 3290418 - RNA, 14 nt, Variola virus
auaauauuaaauau

SEQ ID NO: 3290419 - RNA, 21 nt, Variola virus
auaugcucauauauuuauaga

SEQ ID NO: 3290420 - RNA, 11 nt, Variola virus
uaaaauuauug

SEQ ID NO: 3290421 - RNA, 16 nt, Variola virus
uaaaaccaacuaauau

SEQ ID NO: 3290422 - RNA, 15 nt, Variola virus
aucaacauauagaac

SEQ ID NO: 3290423 - RNA, 15 nt, Variola virus
uagaaaaaauuuauu

SEQ ID NO: 3290424 - RNA, 16 nt, Variola virus
agauacuauccaucag

SEQ ID NO: 3290425 - RNA, 21 nt, Variola virus
guaaacuguugaugauaucua

SEQ ID NO: 3290426 - RNA, 22 nt, Variola virus
agacuuuuguccuaaaauacua

SEQ ID NO: 3290427 - RNA, 14 nt, Variola virus
uaguuuguuuucau

SEQ ID NO: 3290428 - RNA, 17 nt, Variola virus
guaauaacuauguuuua

SEQ ID NO: 3290429 - RNA, 17 nt, Variola virus
aagugucuauaaaugua

SEQ ID NO: 3290430 - RNA, 14 nt, Variola virus
acgauauuagaauu

SEQ ID NO: 3290431 - RNA, 17 nt, Variola virus
ugauuguuugacaaauc

SEQ ID NO: 3290432 - RNA, 20 nt, Variola virus
ucaaggacaguuaaaacuau

SEQ ID NO: 3290433 - RNA, 21 nt, Variola virus
aaucaugugauuaugaauauu

SEQ ID NO: 3290434 - RNA, 16 nt, Variola virus
agucauaacaaaugua

SEQ ID NO: 3290435 - RNA, 17 nt, Variola virus
acaaauaguaaaugaga

SEQ ID NO: 3290436 - RNA, 15 nt, Variola virus
ggugaauccaucucu

SEQ ID NO: 3290437 - RNA, 14 nt, Variola virus
ccacuauaaaauaa

SEQ ID NO: 3290438 - RNA, 17 nt, Variola virus
uuauuacuaaacauuuu

SEQ ID NO: 3290439 - RNA, 12 nt, Variola virus
acuauaaugaaa

SEQ ID NO: 3290440 - RNA, 16 nt, Variola virus
aaaagugugcugauuu

SEQ ID NO: 3290441 - RNA, 13 nt, Variola virus
aguuauaugaaua

SEQ ID NO: 3290442 - RNA, 14 nt, Variola virus
uuugcuaauaauaa

SEQ ID NO: 3290443 - RNA, 17 nt, Variola virus
ugagucuauaucccauu

SEQ ID NO: 3290444 - RNA, 15 nt, Variola virus
aacuuuguucauuua

SEQ ID NO: 3290445 - RNA, 13 nt, Variola virus
uaaaagaaaauac

SEQ ID NO: 3290446 - RNA, 16 nt, Variola virus
aagucauaugugguau

SEQ ID NO: 3290447 - RNA, 15 nt, Variola virus
agauauauauacucu

SEQ ID NO: 3290448 - RNA, 22 nt, Variola virus
auaucuaacguauucuagcaua

SEQ ID NO: 3290449 - RNA, 18 nt, Variola virus
caaacuuacagaaacaau

SEQ ID NO: 3290450 - RNA, 16 nt, Variola virus
auauucucauggaaau

SEQ ID NO: 3290451 - RNA, 16 nt, Variola virus
agauucuuauauaccg

SEQ ID NO: 3290452 - RNA, 12 nt, Variola virus
uuaauugccaua

SEQ ID NO: 3290453 - RNA, 24 nt, Variola virus
aagacgagaucugaauggugaguu

SEQ ID NO: 3290454 - RNA, 15 nt, Variola virus
aaagauuuuauuuca

SEQ ID NO: 3290455 - RNA, 12 nt, Variola virus
uaucuacaauua

SEQ ID NO: 3290456 - RNA, 16 nt, Variola virus
aucaauaauaguaaca

SEQ ID NO: 3290457 - RNA, 16 nt, Variola virus
uaucuauacuauuaaa

SEQ ID NO: 3290458 - RNA, 22 nt, Variola virus
cuuauacgauccgcgucuuuuu

SEQ ID NO: 3290459 - RNA, 23 nt, Variola virus
agaauacgaugauauuaaaauua

SEQ ID NO: 3290460 - RNA, 21 nt, Variola virus
uuuaggauucauuagacguag

SEQ ID NO: 3290461 - RNA, 23 nt, Variola virus
aagaucguuggacauuggauaau

SEQ ID NO: 3290462 - RNA, 22 nt, Variola virus
acauaaucguagauucauguua

SEQ ID NO: 3290463 - RNA, 14 nt, Variola virus
uauuguuacagaug

SEQ ID NO: 3290464 - RNA, 20 nt, Variola virus
uauauccaccaauagaaguu

SEQ ID NO: 3290465 - RNA, 19 nt, Variola virus
gucacuacguaauaaaagu

SEQ ID NO: 3290466 - RNA, 13 nt, Variola virus
aauggaauccaau

SEQ ID NO: 3290467 - RNA, 20 nt, Variola virus
aguuagcaauuucaaaauag

SEQ ID NO: 3290468 - RNA, 18 nt, Variola virus
agaaucuauuuuaaugag

SEQ ID NO: 3290469 - RNA, 17 nt, Variola virus
auaaucgcgaguauuaa

SEQ ID NO: 3290470 - RNA, 15 nt, Variola virus
aucucaacaaaauuc

SEQ ID NO: 3290471 - RNA, 22 nt, Variola virus
caaauaauaaacuaaacaaaac

SEQ ID NO: 3290472 - RNA, 15 nt, Variola virus
gaccgaauacauaac

SEQ ID NO: 3290473 - RNA, 13 nt, Variola virus
acauacuuuguaa

SEQ ID NO: 3290474 - RNA, 19 nt, Variola virus
uaauaucuuggaucuuauu

SEQ ID NO: 3290475 - RNA, 19 nt, Variola virus
ugaaacauacaacaaagaa

SEQ ID NO: 3290476 - RNA, 16 nt, Variola virus
ugguaucaagaaguau

SEQ ID NO: 3290477 - RNA, 19 nt, Variola virus
ugucccuauuauaaucauu

SEQ ID NO: 3290478 - RNA, 23 nt, Variola virus
cguaugugguaugauacaaucaa

SEQ ID NO: 3290479 - RNA, 17 nt, Variola virus
auaaggcuucucaauau

SEQ ID NO: 3290480 - RNA, 19 nt, Variola virus
auuuacauucuuuuugcug

SEQ ID NO: 3290481 - RNA, 14 nt, Variola virus
cuguuaauaucaau

SEQ ID NO: 3290482 - RNA, 18 nt, Variola virus
acucgucgacaaaguacu

SEQ ID NO: 3290483 - RNA, 22 nt, Variola virus
uuaucguuuaagaauaauacag

SEQ ID NO: 3290484 - RNA, 14 nt, Variola virus
gguucauuggaauc

SEQ ID NO: 3290485 - RNA, 13 nt, Variola virus
acauuaauacaaa

SEQ ID NO: 3290486 - RNA, 20 nt, Variola virus
cuggaauagaaucuauuuua

SEQ ID NO: 3290487 - RNA, 21 nt, Variola virus
uagagaggcugcugaaaauaa

SEQ ID NO: 3290488 - RNA, 12 nt, Variola virus
uuuaguuucuuc

SEQ ID NO: 3290489 - RNA, 12 nt, Variola virus
agauaaauaugg

SEQ ID NO: 3290490 - RNA, 18 nt, Variola virus
gaugccaucauagauaua

SEQ ID NO: 3290491 - RNA, 16 nt, Variola virus
ucuucuaaauucauaa

SEQ ID NO: 3290492 - RNA, 16 nt, Variola virus
caugaagaaaaacacc

SEQ ID NO: 3290493 - RNA, 21 nt, Variola virus
agauagguauuuuaucucuau

SEQ ID NO: 3290494 - RNA, 18 nt, Variola virus
acugauuaauaagaucuu

SEQ ID NO: 3290495 - RNA, 16 nt, Variola virus
gagauaaucuauauca

SEQ ID NO: 3290496 - RNA, 21 nt, Variola virus
ucuagcguugcuucuacauaa

SEQ ID NO: 3290497 - RNA, 23 nt, Variola virus
ucgagaugggcccguucucugaa

SEQ ID NO: 3290498 - RNA, 13 nt, Variola virus
uguagucuugguc

SEQ ID NO: 3290499 - RNA, 18 nt, Variola virus
aacaacaaauaaaaaggu

SEQ ID NO: 3290500 - RNA, 13 nt, Variola virus
cuauauaugaaua

SEQ ID NO: 3290501 - RNA, 13 nt, Variola virus
augucacuauuaa

SEQ ID NO: 3290502 - RNA, 14 nt, Variola virus
aguaucuaauggau

SEQ ID NO: 3290503 - RNA, 21 nt, Variola virus
aauagauuggaugguugacau

SEQ ID NO: 3290504 - RNA, 23 nt, Variola virus
caucgacuguacgauacauaaug

SEQ ID NO: 3290505 - RNA, 20 nt, Variola virus
aaacauuuuauauacuuuuc

SEQ ID NO: 3290506 - RNA, 14 nt, Variola virus
uauaacaaugacuu

SEQ ID NO: 3290507 - RNA, 19 nt, Variola virus
aaauauuaauaaaguauau

SEQ ID NO: 3290508 - RNA, 21 nt, Variola virus
aauuugguaauguuucuuaug

SEQ ID NO: 3290509 - RNA, 18 nt, Variola virus
uugaugaaguucgaugau

SEQ ID NO: 3290510 - RNA, 18 nt, Variola virus
acuaaaaaacgaaauaua

SEQ ID NO: 3290511 - RNA, 13 nt, Variola virus
cuacaacuaguga

SEQ ID NO: 3290512 - RNA, 17 nt, Variola virus
caguuucucaucuuuua

SEQ ID NO: 3290513 - RNA, 20 nt, Variola virus
auuaacucuuuuauuuucca

SEQ ID NO: 3290514 - RNA, 20 nt, Variola virus
auugaucuauuauuuaauga

SEQ ID NO: 3290515 - RNA, 16 nt, Variola virus
aaauguccaauauguc

SEQ ID NO: 3290516 - RNA, 21 nt, Variola virus
uguugcuucauccagaucauu

SEQ ID NO: 3290517 - RNA, 12 nt, Variola virus
gucauagauaua

SEQ ID NO: 3290518 - RNA, 16 nt, Variola virus
uuaauuacauauuguu

SEQ ID NO: 3290519 - RNA, 21 nt, Variola virus
uauuauuuaaugagaaacuua

SEQ ID NO: 3290520 - RNA, 18 nt, Variola virus
uguauuauccaauacaga

SEQ ID NO: 3290521 - RNA, 19 nt, Variola virus
auucuuuguauuuuggcau

SEQ ID NO: 3290522 - RNA, 15 nt, Variola virus
uucaagauuaucuuu

SEQ ID NO: 3290523 - RNA, 16 nt, Variola virus
aucauccguaucuucu

SEQ ID NO: 3290524 - RNA, 23 nt, Variola virus
gacucucaguaagaguuaugaau

SEQ ID NO: 3290525 - RNA, 17 nt, Variola virus
uaaauuccauagaauau

SEQ ID NO: 3290526 - RNA, 14 nt, Variola virus
ccaacaaaacaauu

SEQ ID NO: 3290527 - RNA, 21 nt, Variola virus
uucgaggaauaauaagaacaa

SEQ ID NO: 3290528 - RNA, 18 nt, Variola virus
cuuaugaaagaacgcauu

SEQ ID NO: 3290529 - RNA, 20 nt, Variola virus
auguuuaacuugacauuuau

SEQ ID NO: 3290530 - RNA, 20 nt, Variola virus
aucucuucuaguuucacuag

SEQ ID NO: 3290531 - RNA, 12 nt, Variola virus
gaucaaauggau

SEQ ID NO: 3290532 - RNA, 16 nt, Variola virus
uauaaaaguguauuua

SEQ ID NO: 3290533 - RNA, 12 nt, Variola virus
acucuaaaauau

SEQ ID NO: 3290534 - RNA, 20 nt, Variola virus
auuaugaaaaaaagauguau

SEQ ID NO: 3290535 - RNA, 17 nt, Variola virus
auuuauccaucgucaaa

SEQ ID NO: 3290536 - RNA, 18 nt, Variola virus
agaaagauacagguauag

SEQ ID NO: 3290537 - RNA, 20 nt, Variola virus
auuaggcaugucgauggcaa

SEQ ID NO: 3290538 - RNA, 20 nt, Variola virus
auaucuuguucugguuuaaa

SEQ ID NO: 3290539 - RNA, 13 nt, Variola virus
ucgucuacaucau

SEQ ID NO: 3290540 - RNA, 15 nt, Variola virus
guacccuuaaucaug

SEQ ID NO: 3290541 - RNA, 13 nt, Variola virus
acuucucuaaaug

SEQ ID NO: 3290542 - RNA, 20 nt, Variola virus
uuuucaauuaugcaucaaua

SEQ ID NO: 3290543 - RNA, 19 nt, Variola virus
acauaauuuucuauaacug

SEQ ID NO: 3290544 - RNA, 13 nt, Variola virus
gcauaucaugaaa

SEQ ID NO: 3290545 - RNA, 14 nt, Variola virus
uaucagcuauugca

SEQ ID NO: 3290546 - RNA, 17 nt, Variola virus
auuaugcaaauuugaau

SEQ ID NO: 3290547 - RNA, 19 nt, Variola virus
acguaaauacaaaacagaa

SEQ ID NO: 3290548 - RNA, 19 nt, Variola virus
uaaaauuggaucuacuaau

SEQ ID NO: 3290549 - RNA, 18 nt, Variola virus
uauuuucggguuuaaauu

SEQ ID NO: 3290550 - RNA, 21 nt, Variola virus
gacuccaucaucgaucuaaua

SEQ ID NO: 3290551 - RNA, 19 nt, Variola virus
uauaaccaccgauaaaucu

SEQ ID NO: 3290552 - RNA, 17 nt, Variola virus
acgaguugaucuucaaa

SEQ ID NO: 3290553 - RNA, 17 nt, Variola virus
uucaggaacauaaacaa

SEQ ID NO: 3290554 - RNA, 21 nt, Variola virus
aucauguagauaguuaccauc

SEQ ID NO: 3290555 - RNA, 12 nt, Variola virus
gaucuauaaaaa

SEQ ID NO: 3290556 - RNA, 11 nt, Variola virus
ugauugaagaa

SEQ ID NO: 3290557 - RNA, 19 nt, Variola virus
guuuaaaaugaucuauaug

SEQ ID NO: 3290558 - RNA, 19 nt, Variola virus
auaaaucuuuaucaagcac

SEQ ID NO: 3290559 - RNA, 12 nt, Variola virus
ucacuucagaaa

SEQ ID NO: 3290560 - RNA, 21 nt, Variola virus
uagaagagcaaauaucucauc

SEQ ID NO: 3290561 - RNA, 16 nt, Variola virus
uuacaaaauucaucaa

SEQ ID NO: 3290562 - RNA, 14 nt, Variola virus
gaauccuauacucu

SEQ ID NO: 3290563 - RNA, 21 nt, Variola virus
aauaaaauucugauuggucaa

SEQ ID NO: 3290564 - RNA, 13 nt, Variola virus
uaguuaaauauua

SEQ ID NO: 3290565 - RNA, 14 nt, Variola virus
uacacaccaaugga

SEQ ID NO: 3290566 - RNA, 22 nt, Variola virus
uccgcauacgcauuacaguuuu

SEQ ID NO: 3290567 - RNA, 14 nt, Variola virus
cgauauuauuguaa

SEQ ID NO: 3290568 - RNA, 14 nt, Variola virus
gucgauaacaaauu

SEQ ID NO: 3290569 - RNA, 14 nt, Variola virus
aaaaguaggaauua

SEQ ID NO: 3290570 - RNA, 20 nt, Variola virus
gaacauaucuauauaauuau

SEQ ID NO: 3290571 - RNA, 18 nt, Variola virus
ccaacguaguaucaucuu

SEQ ID NO: 3290572 - RNA, 15 nt, Variola virus
auuuaaacauuuaac

SEQ ID NO: 3290573 - RNA, 20 nt, Variola virus
ugggugugguuaaacgaaag

SEQ ID NO: 3290574 - RNA, 15 nt, Variola virus
auguuuuauuaauuu

SEQ ID NO: 3290575 - RNA, 18 nt, Variola virus
auagauuguuuucaguaa

SEQ ID NO: 3290576 - RNA, 14 nt, Variola virus
cuccccacauuuca

SEQ ID NO: 3290577 - RNA, 18 nt, Variola virus
ucaaaaguuaauuucuau

SEQ ID NO: 3290578 - RNA, 17 nt, Variola virus
gacuucguaagaaauaa

SEQ ID NO: 3290579 - RNA, 15 nt, Variola virus
agucucaaaauuaua

SEQ ID NO: 3290580 - RNA, 15 nt, Variola virus
gagauaauagaaaau

SEQ ID NO: 3290581 - RNA, 17 nt, Variola virus
uauauuaucauagaccu

SEQ ID NO: 3290582 - RNA, 13 nt, Variola virus
uacuccguuuuau

SEQ ID NO: 3290583 - RNA, 17 nt, Variola virus
agcacuauuucuaaauc

SEQ ID NO: 3290584 - RNA, 19 nt, Variola virus
gaaugccugccuguauuau

SEQ ID NO: 3290585 - RNA, 20 nt, Variola virus
uagaagaaauugaacuccuc

SEQ ID NO: 3290586 - RNA, 14 nt, Variola virus
acuaauaaacauuc

SEQ ID NO: 3290587 - RNA, 15 nt, Variola virus
cguagacuuucuugc

SEQ ID NO: 3290588 - RNA, 22 nt, Variola virus
aucggcauuuauguuucuuuaa

SEQ ID NO: 3290589 - RNA, 12 nt, Variola virus
aaaaguuauuau

SEQ ID NO: 3290590 - RNA, 22 nt, Variola virus
auuuagauuaaauccagaaguu

SEQ ID NO: 3290591 - RNA, 19 nt, Variola virus
uucagauauaaaaaucugu

SEQ ID NO: 3290592 - RNA, 15 nt, Variola virus
auacuguauauacua

SEQ ID NO: 3290593 - RNA, 12 nt, Variola virus
aaacuaauacau

SEQ ID NO: 3290594 - RNA, 17 nt, Variola virus
gaaauaauauaaaugau

SEQ ID NO: 3290595 - RNA, 14 nt, Variola virus
agaaaaaaauggaa

SEQ ID NO: 3290596 - RNA, 12 nt, Variola virus
uuauuuagugua

SEQ ID NO: 3290597 - RNA, 21 nt, Variola virus
guuccauaaauuuauaauguu

SEQ ID NO: 3290598 - RNA, 13 nt, Variola virus
acaucuaguucuu

SEQ ID NO: 3290599 - RNA, 17 nt, Variola virus
uaacagaaaaaacaaug

SEQ ID NO: 3290600 - RNA, 16 nt, Variola virus
ugaugaaucagacaau

SEQ ID NO: 3290601 - RNA, 20 nt, Variola virus
ggucauauuauagauuuaau

SEQ ID NO: 3290602 - RNA, 20 nt, Variola virus
ucuaaaauguauaacaaaug

SEQ ID NO: 3290603 - RNA, 21 nt, Variola virus
uguuuaacaaagauauuacca

SEQ ID NO: 3290604 - RNA, 20 nt, Variola virus
ucaaucggauacagacacuc

SEQ ID NO: 3290605 - RNA, 17 nt, Variola virus
uuuaaaaaaaaauacuu

SEQ ID NO: 3290606 - RNA, 19 nt, Variola virus
guuagauaacucugcucca

SEQ ID NO: 3290607 - RNA, 13 nt, Variola virus
cuuuauuaucuau

SEQ ID NO: 3290608 - RNA, 23 nt, Variola virus
guuaauaggacacauauaauaau

SEQ ID NO: 3290609 - RNA, 20 nt, Variola virus
uugaugauaucuacaucguu

SEQ ID NO: 3290610 - RNA, 22 nt, Variola virus
aacaauuuuguauuauucugaa

SEQ ID NO: 3290611 - RNA, 21 nt, Variola virus
aucuguauucucgauacagua

SEQ ID NO: 3290612 - RNA, 12 nt, Variola virus
ucuagaaugaag

SEQ ID NO: 3290613 - RNA, 17 nt, Variola virus
aacuacucgaacagaua

SEQ ID NO: 3290614 - RNA, 22 nt, Variola virus
uuggaauaaucucaauuagaau

SEQ ID NO: 3290615 - RNA, 16 nt, Variola virus
cuauaauaucuuugaa

SEQ ID NO: 3290616 - RNA, 15 nt, Variola virus
aaauguaucuuccac

SEQ ID NO: 3290617 - RNA, 13 nt, Variola virus
agaacaugaugau

SEQ ID NO: 3290618 - RNA, 13 nt, Variola virus
ugaaaauguaaua

SEQ ID NO: 3290619 - RNA, 21 nt, Variola virus
uaaaacuuccucauuaagauu

SEQ ID NO: 3290620 - RNA, 19 nt, Variola virus
aauacucccacaaauacug

SEQ ID NO: 3290621 - RNA, 14 nt, Variola virus
auucaguaaauaga

SEQ ID NO: 3290622 - RNA, 17 nt, Variola virus
augauuuacaaaugguu

SEQ ID NO: 3290623 - RNA, 20 nt, Variola virus
aguaaacauaucauaauauu

SEQ ID NO: 3290624 - RNA, 21 nt, Variola virus
uagaaaugugcuacuaagaua

SEQ ID NO: 3290625 - RNA, 17 nt, Variola virus
agcauuguuauguauuu

SEQ ID NO: 3290626 - RNA, 21 nt, Variola virus
gcacguaucuaaaguauuucu

SEQ ID NO: 3290627 - RNA, 15 nt, Variola virus
cuauuucuauuucua

SEQ ID NO: 3290628 - RNA, 17 nt, Variola virus
ccaaucauugauaucuu

SEQ ID NO: 3290629 - RNA, 21 nt, Variola virus
agucaugcuuauugauaaaga

SEQ ID NO: 3290630 - RNA, 15 nt, Variola virus
gccggcagucacauc

SEQ ID NO: 3290631 - RNA, 19 nt, Variola virus
auuccuaccaaacaaaauu

SEQ ID NO: 3290632 - RNA, 20 nt, Variola virus
gucuaaagaugacugauauu

SEQ ID NO: 3290633 - RNA, 20 nt, Variola virus
acaccaaccuguauacugua

SEQ ID NO: 3290634 - RNA, 20 nt, Variola virus
cuuaaucauauucuuaugaa

SEQ ID NO: 3290635 - RNA, 15 nt, Variola virus
augauaaaaacaaua

SEQ ID NO: 3290636 - RNA, 17 nt, Variola virus
augucugucauauguau

SEQ ID NO: 3290637 - RNA, 23 nt, Variola virus
acuuaggaguuagaauuuauaga

SEQ ID NO: 3290638 - RNA, 11 nt, Variola virus
cucuuaggaag

SEQ ID NO: 3290639 - RNA, 21 nt, Variola virus
ccauaaaacaaaaucuaacag

SEQ ID NO: 3290640 - RNA, 13 nt, Variola virus
uuaagagauaucu

SEQ ID NO: 3290641 - RNA, 22 nt, Variola virus
uuaaacgaauuaaaauuauuua

SEQ ID NO: 3290642 - RNA, 21 nt, Variola virus
auauguuuuaauauuuacaag

SEQ ID NO: 3290643 - RNA, 17 nt, Variola virus
uuuucaguuaucaucua

SEQ ID NO: 3290644 - RNA, 15 nt, Variola virus
accgaaauuaucacu

SEQ ID NO: 3290645 - RNA, 20 nt, Variola virus
uuaucagaagauggauggau

SEQ ID NO: 3290646 - RNA, 15 nt, Variola virus
aaucguauaaauacu

SEQ ID NO: 3290647 - RNA, 16 nt, Variola virus
aacuguugugaauauu

SEQ ID NO: 3290648 - RNA, 16 nt, Variola virus
aguuugagauuucaua

SEQ ID NO: 3290649 - RNA, 13 nt, Variola virus
augucauuuguau

SEQ ID NO: 3290650 - RNA, 18 nt, Variola virus
uaaauuuacgaauuaaga

SEQ ID NO: 3290651 - RNA, 16 nt, Variola virus
gaauacauuuauugca

SEQ ID NO: 3290652 - RNA, 16 nt, Variola virus
aaguacaucaucugaa

SEQ ID NO: 3290653 - RNA, 12 nt, Variola virus
gcuaacaucaua

SEQ ID NO: 3290654 - RNA, 12 nt, Variola virus
aguuucuagaua

SEQ ID NO: 3290655 - RNA, 15 nt, Variola virus
aucucgccaaaauau

SEQ ID NO: 3290656 - RNA, 15 nt, Variola virus
uacuaguuccaacau

SEQ ID NO: 3290657 - RNA, 17 nt, Variola virus
ugcacguuuacauaucu

SEQ ID NO: 3290658 - RNA, 17 nt, Variola virus
guaguugcguauuucuc

SEQ ID NO: 3290659 - RNA, 17 nt, Variola virus
ucgauaacacauuuuca

SEQ ID NO: 3290660 - RNA, 13 nt, Variola virus
uuucaaauaccag

SEQ ID NO: 3290661 - RNA, 23 nt, Variola virus
uaagaucuggguauuucuuuucu

SEQ ID NO: 3290662 - RNA, 15 nt, Variola virus
ugaauuuaccagaua

SEQ ID NO: 3290663 - RNA, 16 nt, Variola virus
uagauauaacuucugg

SEQ ID NO: 3290664 - RNA, 15 nt, Variola virus
auaaacgacauaaua

SEQ ID NO: 3290665 - RNA, 21 nt, Variola virus
auaacucauuuuuugaauaua

SEQ ID NO: 3290666 - RNA, 15 nt, Variola virus
aggaauuaauuauuc

SEQ ID NO: 3290667 - RNA, 21 nt, Variola virus
uggauaaugguacucuagaau

SEQ ID NO: 3290668 - RNA, 13 nt, Variola virus
aucuaauacaaaa

SEQ ID NO: 3290669 - RNA, 11 nt, Variola virus
aaaacauaaua

SEQ ID NO: 3290670 - RNA, 14 nt, Variola virus
ucuuuaucucuuag

SEQ ID NO: 3290671 - RNA, 16 nt, Variola virus
gauuguugccguaaau

SEQ ID NO: 3290672 - RNA, 22 nt, Variola virus
auauaaaauagaaaauaacaga

SEQ ID NO: 3290673 - RNA, 18 nt, Variola virus
aguuaaguuuuuuaagaa

SEQ ID NO: 3290674 - RNA, 16 nt, Variola virus
uaagauuuuaaaugua

SEQ ID NO: 3290675 - RNA, 18 nt, Variola virus
uauucuggacuagcgaua

SEQ ID NO: 3290676 - RNA, 17 nt, Variola virus
auauuucuaguuuguaa

SEQ ID NO: 3290677 - RNA, 19 nt, Variola virus
acgagaauacguaauaauu

SEQ ID NO: 3290678 - RNA, 14 nt, Variola virus
ucccaaauaucuuu

SEQ ID NO: 3290679 - RNA, 17 nt, Variola virus
uuagaauacuaaauuga

SEQ ID NO: 3290680 - RNA, 19 nt, Variola virus
acuaucuuuuuaggaaugu

SEQ ID NO: 3290681 - RNA, 20 nt, Variola virus
uucuauaccaauauuauucu

SEQ ID NO: 3290682 - RNA, 16 nt, Variola virus
aucagcugaaaaacua

SEQ ID NO: 3290683 - RNA, 19 nt, Variola virus
guaaacuucgcguauacag

SEQ ID NO: 3290684 - RNA, 13 nt, Variola virus
guguuuaaucuuc

SEQ ID NO: 3290685 - RNA, 16 nt, Variola virus
cgaauauauaaaagac

SEQ ID NO: 3290686 - RNA, 13 nt, Variola virus
uuaacuauuuuag

SEQ ID NO: 3290687 - RNA, 21 nt, Variola virus
aucuaacaucuugauuaauaa

SEQ ID NO: 3290688 - RNA, 21 nt, Variola virus
accaucguacucuacagcaua

SEQ ID NO: 3290689 - RNA, 18 nt, Variola virus
caauguacaccguguggu

SEQ ID NO: 3290690 - RNA, 17 nt, Variola virus
gauggauaaagauauau

SEQ ID NO: 3290691 - RNA, 18 nt, Variola virus
gaacuaauccacauauga

SEQ ID NO: 3290692 - RNA, 14 nt, Variola virus
guuugauaaaugua

SEQ ID NO: 3290693 - RNA, 14 nt, Variola virus
uuaucacauacuag

SEQ ID NO: 3290694 - RNA, 15 nt, Variola virus
uuugagaacaucgau

SEQ ID NO: 3290695 - RNA, 22 nt, Variola virus
acagugcaaccucuauuggaua

SEQ ID NO: 3290696 - RNA, 19 nt, Variola virus
aggauaaaauauuauccaa

SEQ ID NO: 3290697 - RNA, 22 nt, Variola virus
uuaaaagaauuacuuagucugu

SEQ ID NO: 3290698 - RNA, 18 nt, Variola virus
agaauauacuuuguguuu

SEQ ID NO: 3290699 - RNA, 21 nt, Variola virus
gacguauaagucuauuugaaa

SEQ ID NO: 3290700 - RNA, 12 nt, Variola virus
cucguccuuggu

SEQ ID NO: 3290701 - RNA, 15 nt, Variola virus
cagagcuugcucuau

SEQ ID NO: 3290702 - RNA, 13 nt, Variola virus
gcgccaaauugug

SEQ ID NO: 3290703 - RNA, 20 nt, Variola virus
cuucuaucuuguuuagauuu

SEQ ID NO: 3290704 - RNA, 20 nt, Variola virus
acuaucguuggaaaaugaug

SEQ ID NO: 3290705 - RNA, 14 nt, Variola virus
acaaaugauaauca

SEQ ID NO: 3290706 - RNA, 19 nt, Variola virus
ugacggauaaaacaaaaau

SEQ ID NO: 3290707 - RNA, 17 nt, Variola virus
gaccaauuuauuacuug

SEQ ID NO: 3290708 - RNA, 14 nt, Variola virus
gaccuuuuccuuau

SEQ ID NO: 3290709 - RNA, 18 nt, Variola virus
gcaaaucuaguaaaucaa

SEQ ID NO: 3290710 - RNA, 18 nt, Variola virus
uaauuguccuauaugucg

SEQ ID NO: 3290711 - RNA, 23 nt, Variola virus
gauagcugauacguuauaaaggu

SEQ ID NO: 3290712 - RNA, 20 nt, Variola virus
acuggagccauugucuuaac

SEQ ID NO: 3290713 - RNA, 21 nt, Variola virus
auaggauuaaaaauaaaguua

SEQ ID NO: 3290714 - RNA, 17 nt, Variola virus
uuucuguaucuaucaac

SEQ ID NO: 3290715 - RNA, 14 nt, Variola virus
uguguaaaaaguuu

SEQ ID NO: 3290716 - RNA, 15 nt, Variola virus
auuuuaauauugaaa

SEQ ID NO: 3290717 - RNA, 17 nt, Variola virus
uaguaacugacuuaaua

SEQ ID NO: 3290718 - RNA, 21 nt, Variola virus
uaacuuuuucuuucucagcau

SEQ ID NO: 3290719 - RNA, 22 nt, Variola virus
agcauacgccaaauaucucaaa

SEQ ID NO: 3290720 - RNA, 21 nt, Variola virus
caaauaaagcgaaaaauaauu

SEQ ID NO: 3290721 - RNA, 16 nt, Variola virus
aaucauauuuagaaaa

SEQ ID NO: 3290722 - RNA, 15 nt, Variola virus
cuugaauucuuuuau

SEQ ID NO: 3290723 - RNA, 18 nt, Variola virus
auucagaacacacuuuuc

SEQ ID NO: 3290724 - RNA, 23 nt, Variola virus
guauaacaugacauuuauucauc

SEQ ID NO: 3290725 - RNA, 20 nt, Variola virus
cauuuucccaaauaucuuua

SEQ ID NO: 3290726 - RNA, 15 nt, Variola virus
uauauccuuuuguau

SEQ ID NO: 3290727 - RNA, 18 nt, Variola virus
auaacguauuaaauauua

SEQ ID NO: 3290728 - RNA, 21 nt, Variola virus
accuguagaucuuaucuaucc

SEQ ID NO: 3290729 - RNA, 18 nt, Variola virus
auaacuucuagauguaga

SEQ ID NO: 3290730 - RNA, 19 nt, Variola virus
aauguuagagacggaaaua

SEQ ID NO: 3290731 - RNA, 16 nt, Variola virus
aaacucgcuuaauauc

SEQ ID NO: 3290732 - RNA, 15 nt, Variola virus
aaacuuuauuaucca

SEQ ID NO: 3290733 - RNA, 21 nt, Variola virus
gugaauguauucacuuaacaa

SEQ ID NO: 3290734 - RNA, 18 nt, Variola virus
aauguuacaacugacaau

SEQ ID NO: 3290735 - RNA, 20 nt, Variola virus
gaccaauuacugauaaugua

SEQ ID NO: 3290736 - RNA, 21 nt, Variola virus
caucuuggggaaauauggaag

SEQ ID NO: 3290737 - RNA, 16 nt, Variola virus
aucccauauaauacag

SEQ ID NO: 3290738 - RNA, 18 nt, Variola virus
ucaaaagacguuguacaa

SEQ ID NO: 3290739 - RNA, 16 nt, Variola virus
caagucccaaauggag

SEQ ID NO: 3290740 - RNA, 20 nt, Variola virus
auugguucuuuaccagaaaa

SEQ ID NO: 3290741 - RNA, 21 nt, Variola virus
cugaaauggugguaaaacuaa

SEQ ID NO: 3290742 - RNA, 23 nt, Variola virus
gauaccaauaaguuuuagauauu

SEQ ID NO: 3290743 - RNA, 22 nt, Variola virus
uucuacuaugcaauuaccaaaa

SEQ ID NO: 3290744 - RNA, 19 nt, Variola virus
ucuacgauuuuuacaaaag

SEQ ID NO: 3290745 - RNA, 13 nt, Variola virus
cauaauuacagaa

SEQ ID NO: 3290746 - RNA, 22 nt, Variola virus
uaccgcuaguacccuuaaucau

SEQ ID NO: 3290747 - RNA, 20 nt, Variola virus
aaacgacauacuauauguaa

SEQ ID NO: 3290748 - RNA, 14 nt, Variola virus
augcgauucaaaaa

SEQ ID NO: 3290749 - RNA, 14 nt, Variola virus
gucauuauauacuc

SEQ ID NO: 3290750 - RNA, 14 nt, Variola virus
uagaaaucaacaau

SEQ ID NO: 3290751 - RNA, 21 nt, Variola virus
ucaaaaaacaauuuauucaga

SEQ ID NO: 3290752 - RNA, 13 nt, Variola virus
guuuuuuauucau

SEQ ID NO: 3290753 - RNA, 21 nt, Variola virus
uggcguguggauuugguaaga

SEQ ID NO: 3290754 - RNA, 21 nt, Variola virus
uagauuaugaagaauacucua

SEQ ID NO: 3290755 - RNA, 23 nt, Variola virus
cauacaaaaauauauuauuuuua

SEQ ID NO: 3290756 - RNA, 17 nt, Variola virus
cauuauuuuuuuggaau

SEQ ID NO: 3290757 - RNA, 20 nt, Variola virus
auauagauuuuuuaaaggau

SEQ ID NO: 3290758 - RNA, 12 nt, Variola virus
uuaccuauucac

SEQ ID NO: 3290759 - RNA, 14 nt, Variola virus
uauacgaauacuau

SEQ ID NO: 3290760 - RNA, 12 nt, Variola virus
caauuaaaucaa

SEQ ID NO: 3290761 - RNA, 19 nt, Variola virus
uagauugguacgaaauaua

SEQ ID NO: 3290762 - RNA, 19 nt, Variola virus
cugauuaacccaucaucua

SEQ ID NO: 3290763 - RNA, 14 nt, Variola virus
cauacuacuauuau

SEQ ID NO: 3290764 - RNA, 16 nt, Variola virus
ggaguaucuauuuuaa

SEQ ID NO: 3290765 - RNA, 14 nt, Variola virus
cacugagaaacagc

SEQ ID NO: 3290766 - RNA, 22 nt, Variola virus
cuauucuaacucacguuaauaa

SEQ ID NO: 3290767 - RNA, 20 nt, Variola virus
uaagacguaucuccauaaag

SEQ ID NO: 3290768 - RNA, 19 nt, Variola virus
agauugaaugccauuuacg

SEQ ID NO: 3290769 - RNA, 12 nt, Variola virus
gcaauaauacaa

SEQ ID NO: 3290770 - RNA, 16 nt, Variola virus
guuuaauuuucacaag

SEQ ID NO: 3290771 - RNA, 18 nt, Variola virus
auuuuauaugucaaccau

SEQ ID NO: 3290772 - RNA, 15 nt, Variola virus
auuucacaaauggau

SEQ ID NO: 3290773 - RNA, 17 nt, Variola virus
uacgaagacagacauac

SEQ ID NO: 3290774 - RNA, 19 nt, Variola virus
uauuguggcgccuuauaua

SEQ ID NO: 3290775 - RNA, 13 nt, Variola virus
aaucugaaaaugu

SEQ ID NO: 3290776 - RNA, 14 nt, Variola virus
uaacaaaauuaaag

SEQ ID NO: 3290777 - RNA, 22 nt, Variola virus
uaaauguuucgauuucaauuua

SEQ ID NO: 3290778 - RNA, 21 nt, Variola virus
uagacaaugcuaauauauucu

SEQ ID NO: 3290779 - RNA, 17 nt, Variola virus
uaauuuguauauacaua

SEQ ID NO: 3290780 - RNA, 17 nt, Variola virus
auucagcugaaaugaga

SEQ ID NO: 3290781 - RNA, 16 nt, Variola virus
auacacaugauugaca

SEQ ID NO: 3290782 - RNA, 12 nt, Variola virus
uuagaguauaaa

SEQ ID NO: 3290783 - RNA, 20 nt, Variola virus
auaagaacauaauaauauau

SEQ ID NO: 3290784 - RNA, 16 nt, Variola virus
gguucgauauaaagga

SEQ ID NO: 3290785 - RNA, 14 nt, Variola virus
ccaaauuuaaauac

SEQ ID NO: 3290786 - RNA, 14 nt, Variola virus
cauccauauguuug

SEQ ID NO: 3290787 - RNA, 22 nt, Variola virus
ucaugucugguaauucauauag

SEQ ID NO: 3290788 - RNA, 17 nt, Variola virus
auaaugucugacaagau

SEQ ID NO: 3290789 - RNA, 13 nt, Variola virus
uuaaaucauuaaa

SEQ ID NO: 3290790 - RNA, 13 nt, Variola virus
uuauuagaucuuu

SEQ ID NO: 3290791 - RNA, 20 nt, Variola virus
auuaauaagauuuuuauuau

SEQ ID NO: 3290792 - RNA, 15 nt, Variola virus
auaauacuauauaca

SEQ ID NO: 3290793 - RNA, 15 nt, Variola virus
uuuagcuaauacuaa

SEQ ID NO: 3290794 - RNA, 19 nt, Variola virus
auggagaauguuccuaaug

SEQ ID NO: 3290795 - RNA, 21 nt, Variola virus
uaccuaauacuaaauacauua

SEQ ID NO: 3290796 - RNA, 20 nt, Variola virus
uguagcauuacgcucucugg

SEQ ID NO: 3290797 - RNA, 19 nt, Variola virus
gaaucaguuaauaaauuca

SEQ ID NO: 3290798 - RNA, 14 nt, Variola virus
cucuuucuuuugau

SEQ ID NO: 3290799 - RNA, 16 nt, Variola virus
ccuauacuauguuaua

SEQ ID NO: 3290800 - RNA, 15 nt, Variola virus
cauuuucuaucuuua

SEQ ID NO: 3290801 - RNA, 20 nt, Variola virus
uuauuaacaaauuuuuugaa

SEQ ID NO: 3290802 - RNA, 16 nt, Variola virus
uuuccuuuuauugcuu

SEQ ID NO: 3290803 - RNA, 13 nt, Variola virus
aucuaaaaaacua

SEQ ID NO: 3290804 - RNA, 15 nt, Variola virus
caaaacuauuucaga

SEQ ID NO: 3290805 - RNA, 14 nt, Variola virus
auauucuguugugu

SEQ ID NO: 3290806 - RNA, 17 nt, Variola virus
ugcagauaucguucuua

SEQ ID NO: 3290807 - RNA, 19 nt, Variola virus
uuaaccuuuuuaguaaaug

SEQ ID NO: 3290808 - RNA, 19 nt, Variola virus
gcguucaagauuaucuuua

SEQ ID NO: 3290809 - RNA, 17 nt, Variola virus
ucuuuuucauuaacuag

SEQ ID NO: 3290810 - RNA, 14 nt, Variola virus
agagauuauaugau

SEQ ID NO: 3290811 - RNA, 16 nt, Variola virus
uagaagccaauaucug

SEQ ID NO: 3290812 - RNA, 18 nt, Variola virus
uuuuaaaaaucauaacag

SEQ ID NO: 3290813 - RNA, 16 nt, Variola virus
aucaucuauaugacug

SEQ ID NO: 3290814 - RNA, 14 nt, Variola virus
caaccggauuuaaa

SEQ ID NO: 3290815 - RNA, 17 nt, Variola virus
aauguaaucauauaaau

SEQ ID NO: 3290816 - RNA, 15 nt, Variola virus
cacuuggauauugua

SEQ ID NO: 3290817 - RNA, 22 nt, Variola virus
ucaaucguuuaaaguaaacuuc

SEQ ID NO: 3290818 - RNA, 15 nt, Variola virus
uauacuuuaaagcaa

SEQ ID NO: 3290819 - RNA, 14 nt, Variola virus
ucaagucaauuauc

SEQ ID NO: 3290820 - RNA, 14 nt, Variola virus
uaaaauuuagcauu

SEQ ID NO: 3290821 - RNA, 19 nt, Variola virus
uacuaauuacuaaaucugu

SEQ ID NO: 3290822 - RNA, 14 nt, Variola virus
cauaaaauuuaaga

SEQ ID NO: 3290823 - RNA, 22 nt, Variola virus
acauaaauaauucuagaggaga

SEQ ID NO: 3290824 - RNA, 20 nt, Variola virus
acaauaguucagauaaugua

SEQ ID NO: 3290825 - RNA, 17 nt, Variola virus
agcacaugaagaaaaac

SEQ ID NO: 3290826 - RNA, 22 nt, Variola virus
uccauggaaaagauaaaguuuu

SEQ ID NO: 3290827 - RNA, 15 nt, Variola virus
cuacacuaaaaugau

SEQ ID NO: 3290828 - RNA, 16 nt, Variola virus
auacaccgaacaucca

SEQ ID NO: 3290829 - RNA, 16 nt, Variola virus
ccauugaugaauuccu

SEQ ID NO: 3290830 - RNA, 21 nt, Variola virus
uaauaaggaaggcgucaaaau

SEQ ID NO: 3290831 - RNA, 21 nt, Variola virus
gauacacuagacauuuuuuaa

SEQ ID NO: 3290832 - RNA, 21 nt, Variola virus
agaagagucauuaaaauaugc

SEQ ID NO: 3290833 - RNA, 14 nt, Variola virus
auuaaaaaaucacu

SEQ ID NO: 3290834 - RNA, 17 nt, Variola virus
uauccagauccuuuucu

SEQ ID NO: 3290835 - RNA, 11 nt, Variola virus
uuaaauuauug

SEQ ID NO: 3290836 - RNA, 12 nt, Variola virus
guacaaucagau

SEQ ID NO: 3290837 - RNA, 17 nt, Variola virus
ccugccauuuuagagau

SEQ ID NO: 3290838 - RNA, 16 nt, Variola virus
uguacauauuuguaca

SEQ ID NO: 3290839 - RNA, 19 nt, Variola virus
acaguacauaguauugaca

SEQ ID NO: 3290840 - RNA, 22 nt, Variola virus
gauucuguguauaaaaacagaa

SEQ ID NO: 3290841 - RNA, 19 nt, Variola virus
augauaaaaacacguuuau

SEQ ID NO: 3290842 - RNA, 16 nt, Variola virus
gaaguuaaacugugaa

SEQ ID NO: 3290843 - RNA, 14 nt, Variola virus
uauucuauuucgaa

SEQ ID NO: 3290844 - RNA, 19 nt, Variola virus
uuaguaaggcuuuagaaac

SEQ ID NO: 3290845 - RNA, 23 nt, Variola virus
acacaaguugauaaaauguugau

SEQ ID NO: 3290846 - RNA, 11 nt, Variola virus
aacaguuuauu

SEQ ID NO: 3290847 - RNA, 17 nt, Variola virus
aauauaaaaaaaugauu

SEQ ID NO: 3290848 - RNA, 12 nt, Variola virus
cuuugcuauuuc

SEQ ID NO: 3290849 - RNA, 22 nt, Variola virus
gcuuccaggcuaucaaauggau

SEQ ID NO: 3290850 - RNA, 18 nt, Variola virus
aaaauuauugauauguau

SEQ ID NO: 3290851 - RNA, 16 nt, Variola virus
acauaucuaaaugaau

SEQ ID NO: 3290852 - RNA, 16 nt, Variola virus
guagucaauaaaagag

SEQ ID NO: 3290853 - RNA, 18 nt, Variola virus
uacuugauaagauaaaau

SEQ ID NO: 3290854 - RNA, 22 nt, Variola virus
auuuggucauaauagaauguau

SEQ ID NO: 3290855 - RNA, 17 nt, Variola virus
auagauuuuccauccac

SEQ ID NO: 3290856 - RNA, 19 nt, Variola virus
aacauuaauacaaacgaua

SEQ ID NO: 3290857 - RNA, 17 nt, Variola virus
aacagcauuucugucaa

SEQ ID NO: 3290858 - RNA, 15 nt, Variola virus
aucagauuauuuaac

SEQ ID NO: 3290859 - RNA, 14 nt, Variola virus
auaccgauuuuaca

SEQ ID NO: 3290860 - RNA, 15 nt, Variola virus
uauucacuuaacaau

SEQ ID NO: 3290861 - RNA, 22 nt, Variola virus
auauuuuuuaucuaaaaaacua

SEQ ID NO: 3290862 - RNA, 17 nt, Variola virus
cuacuggugaaauguga

SEQ ID NO: 3290863 - RNA, 17 nt, Variola virus
acaauuuauucagagag

SEQ ID NO: 3290864 - RNA, 24 nt, Variola virus
uuuuguggauuaguguacucucuu

SEQ ID NO: 3290865 - RNA, 13 nt, Variola virus
cuguuauuuugaa

SEQ ID NO: 3290866 - RNA, 20 nt, Variola virus
acuaugccaagcguaugcug

SEQ ID NO: 3290867 - RNA, 19 nt, Variola virus
agacaaauggucaaugaua

SEQ ID NO: 3290868 - RNA, 17 nt, Variola virus
agaacacacuuuucuca

SEQ ID NO: 3290869 - RNA, 23 nt, Variola virus
auauuauugggugguaaacuaga

SEQ ID NO: 3290870 - RNA, 22 nt, Variola virus
aaacucuuuuauagagaaaugu

SEQ ID NO: 3290871 - RNA, 20 nt, Variola virus
uuuguccacguucuuuaauu

SEQ ID NO: 3290872 - RNA, 17 nt, Variola virus
gaguuauuaagaaauac

SEQ ID NO: 3290873 - RNA, 12 nt, Variola virus
auaaaacuauau

SEQ ID NO: 3290874 - RNA, 18 nt, Variola virus
caucuuggaaacauaaaa

SEQ ID NO: 3290875 - RNA, 22 nt, Variola virus
aucggaacacuugguaguugaa

SEQ ID NO: 3290876 - RNA, 14 nt, Variola virus
ugauauuguuacag

SEQ ID NO: 3290877 - RNA, 20 nt, Variola virus
uaucuuauauacacauaauu

SEQ ID NO: 3290878 - RNA, 18 nt, Variola virus
aauaguuauuacuuuucu

SEQ ID NO: 3290879 - RNA, 17 nt, Variola virus
acacucgacacaauauu

SEQ ID NO: 3290880 - RNA, 14 nt, Variola virus
auacuauguuauau

SEQ ID NO: 3290881 - RNA, 21 nt, Variola virus
uuuuaauauaauacuuaaaaa

SEQ ID NO: 3290882 - RNA, 16 nt, Variola virus
ggaaccucgagaaugu

SEQ ID NO: 3290883 - RNA, 14 nt, Variola virus
ucuagauguagaag

SEQ ID NO: 3290884 - RNA, 12 nt, Variola virus
gcacuauuucua

SEQ ID NO: 3290885 - RNA, 20 nt, Variola virus
caacaagucaaaacauaaua

SEQ ID NO: 3290886 - RNA, 23 nt, Variola virus
agguguuccggagaaucaguaaa

SEQ ID NO: 3290887 - RNA, 16 nt, Variola virus
ccauggaaaaauauua

SEQ ID NO: 3290888 - RNA, 22 nt, Variola virus
uggauauucgauaacagcauuu

SEQ ID NO: 3290889 - RNA, 21 nt, Variola virus
cuccgcaauacauuucucaaa

SEQ ID NO: 3290890 - RNA, 20 nt, Variola virus
augaauuacuaaaauauaca

SEQ ID NO: 3290891 - RNA, 20 nt, Variola virus
gagauccugcauagaaauau

SEQ ID NO: 3290892 - RNA, 16 nt, Variola virus
uaugauggguggauau

SEQ ID NO: 3290893 - RNA, 19 nt, Variola virus
auucagaguccucuaauug

SEQ ID NO: 3290894 - RNA, 19 nt, Variola virus
guaaaauuccuaaauuagu

SEQ ID NO: 3290895 - RNA, 19 nt, Variola virus
aucaauuuuaaagguauaa

SEQ ID NO: 3290896 - RNA, 12 nt, Variola virus
agaacaaaauaa

SEQ ID NO: 3290897 - RNA, 23 nt, Variola virus
acucuacaaggaauugaugaagu

SEQ ID NO: 3290898 - RNA, 13 nt, Variola virus
acaacaaucuaua

SEQ ID NO: 3290899 - RNA, 15 nt, Variola virus
uuauauaaaacauuu

SEQ ID NO: 3290900 - RNA, 13 nt, Variola virus
uacaauaaauguu

SEQ ID NO: 3290901 - RNA, 13 nt, Variola virus
cucuuaaaaauug

SEQ ID NO: 3290902 - RNA, 20 nt, Variola virus
cucuggguaacaaacauacu

SEQ ID NO: 3290903 - RNA, 20 nt, Variola virus
cuugagacuugauagauauu

SEQ ID NO: 3290904 - RNA, 21 nt, Variola virus
acuaucacuguagaaaaauuu

SEQ ID NO: 3290905 - RNA, 11 nt, Variola virus
auggucucaca

SEQ ID NO: 3290906 - RNA, 16 nt, Variola virus
acuuuuguccuaaaau

SEQ ID NO: 3290907 - RNA, 14 nt, Variola virus
agaugaccauagau

SEQ ID NO: 3290908 - RNA, 16 nt, Variola virus
uaaauggaacagacau

SEQ ID NO: 3290909 - RNA, 18 nt, Variola virus
ccuacaggaauaucuuua

SEQ ID NO: 3290910 - RNA, 18 nt, Variola virus
auuugaaauucuaucucu

SEQ ID NO: 3290911 - RNA, 16 nt, Variola virus
auucuucccaugaaug

SEQ ID NO: 3290912 - RNA, 20 nt, Variola virus
aaguaaaagauuuauaaugu

SEQ ID NO: 3290913 - RNA, 16 nt, Variola virus
auucuuagucaaugga

SEQ ID NO: 3290914 - RNA, 17 nt, Variola virus
uuuacuuuaucuauuca

SEQ ID NO: 3290915 - RNA, 16 nt, Variola virus
aaagauuguguagaaa

SEQ ID NO: 3290916 - RNA, 13 nt, Variola virus
gcaaagagaugau

SEQ ID NO: 3290917 - RNA, 19 nt, Variola virus
uaaagaaaaaugauugucu

SEQ ID NO: 3290918 - RNA, 22 nt, Variola virus
gauaacagcauuuguguaguuu

SEQ ID NO: 3290919 - RNA, 21 nt, Variola virus
uuccaucaacgauucuagaac

SEQ ID NO: 3290920 - RNA, 16 nt, Variola virus
agucugucuguagaua

SEQ ID NO: 3290921 - RNA, 17 nt, Variola virus
aaacuauaaaacagaua

SEQ ID NO: 3290922 - RNA, 12 nt, Variola virus
uugucagauuca

SEQ ID NO: 3290923 - RNA, 18 nt, Variola virus
uccuguauaugugaauau

SEQ ID NO: 3290924 - RNA, 18 nt, Variola virus
acuauuuagaaauugaaa

SEQ ID NO: 3290925 - RNA, 18 nt, Variola virus
uauauccguucuuaacuu

SEQ ID NO: 3290926 - RNA, 20 nt, Variola virus
auuuuaccuuauuuuuuaua

SEQ ID NO: 3290927 - RNA, 21 nt, Variola virus
uauagacgguaaugucaucau

SEQ ID NO: 3290928 - RNA, 20 nt, Variola virus
agaauauauagguaauacau

SEQ ID NO: 3290929 - RNA, 14 nt, Variola virus
auguuuaucuucuu

SEQ ID NO: 3290930 - RNA, 12 nt, Variola virus
auguucaagcag

SEQ ID NO: 3290931 - RNA, 14 nt, Variola virus
agcauugaaaauac

SEQ ID NO: 3290932 - RNA, 15 nt, Variola virus
uaaauccuuguuuga

SEQ ID NO: 3290933 - RNA, 13 nt, Variola virus
caucgaacuucug

SEQ ID NO: 3290934 - RNA, 20 nt, Variola virus
uauugcuuuccuuuaucauu

SEQ ID NO: 3290935 - RNA, 17 nt, Variola virus
uaccguugugucuacaa

SEQ ID NO: 3290936 - RNA, 22 nt, Variola virus
uuucuugagaucccacaucauu

SEQ ID NO: 3290937 - RNA, 14 nt, Variola virus
cacuucucuaucaa

SEQ ID NO: 3290938 - RNA, 12 nt, Variola virus
gugggaugaugu

SEQ ID NO: 3290939 - RNA, 18 nt, Variola virus
ggaauaaauuauuaucca

SEQ ID NO: 3290940 - RNA, 18 nt, Variola virus
uacuaauacuaauacuaa

SEQ ID NO: 3290941 - RNA, 21 nt, Variola virus
aauagcaaaauuuuuacuauu

SEQ ID NO: 3290942 - RNA, 22 nt, Variola virus
acuuuuucuagaaaaaaaauug

SEQ ID NO: 3290943 - RNA, 20 nt, Variola virus
gcacuacuguuaagaaugau

SEQ ID NO: 3290944 - RNA, 17 nt, Variola virus
cuuauacaggucauuac

SEQ ID NO: 3290945 - RNA, 20 nt, Variola virus
caaaauaguaaaguaacgau

SEQ ID NO: 3290946 - RNA, 16 nt, Variola virus
acaucauaaaaugagu

SEQ ID NO: 3290947 - RNA, 14 nt, Variola virus
auguuaaaaaugac

SEQ ID NO: 3290948 - RNA, 20 nt, Variola virus
guaauuucacgaauuugaua

SEQ ID NO: 3290949 - RNA, 17 nt, Variola virus
aaauuguccuauauaau

SEQ ID NO: 3290950 - RNA, 19 nt, Variola virus
agauagauuuccaaagaua

SEQ ID NO: 3290951 - RNA, 13 nt, Variola virus
uugaugcaucuua

SEQ ID NO: 3290952 - RNA, 16 nt, Variola virus
uaaauacauuaucaug

SEQ ID NO: 3290953 - RNA, 15 nt, Variola virus
acaccaauagaugau

SEQ ID NO: 3290954 - RNA, 14 nt, Variola virus
agugguuaaucuua

SEQ ID NO: 3290955 - RNA, 18 nt, Variola virus
ggcuagucaagaugauga

SEQ ID NO: 3290956 - RNA, 20 nt, Variola virus
cuuuaguaaaguugucuaua

SEQ ID NO: 3290957 - RNA, 20 nt, Variola virus
auagaacgaaguaaaaaguu

SEQ ID NO: 3290958 - RNA, 15 nt, Variola virus
ucauuuggagaguau

SEQ ID NO: 3290959 - RNA, 19 nt, Variola virus
acggagauacaucuucaau

SEQ ID NO: 3290960 - RNA, 15 nt, Variola virus
gcaacaaguauacaa

SEQ ID NO: 3290961 - RNA, 18 nt, Variola virus
auugcacaauccaaacuu

SEQ ID NO: 3290962 - RNA, 15 nt, Variola virus
gaauuuucuaacgaa

SEQ ID NO: 3290963 - RNA, 19 nt, Variola virus
uuaaaaaaauaaaaaugaa

SEQ ID NO: 3290964 - RNA, 21 nt, Variola virus
uuuaccgacaccuguuucaug

SEQ ID NO: 3290965 - RNA, 17 nt, Variola virus
uauucgagaugaacauu

SEQ ID NO: 3290966 - RNA, 18 nt, Variola virus
gaugaggugguugcagaa

SEQ ID NO: 3290967 - RNA, 20 nt, Variola virus
aaauaacauauagauuuuau

SEQ ID NO: 3290968 - RNA, 18 nt, Variola virus
aaugcauuuuauaccgaa

SEQ ID NO: 3290969 - RNA, 15 nt, Variola virus
acuaaaagacauaau

SEQ ID NO: 3290970 - RNA, 17 nt, Variola virus
uuauccaaaauauuaau

SEQ ID NO: 3290971 - RNA, 22 nt, Variola virus
gucuacaaauagagauaaaaca

SEQ ID NO: 3290972 - RNA, 16 nt, Variola virus
guguuaucuuagauau

SEQ ID NO: 3290973 - RNA, 17 nt, Variola virus
agcuauguuuacggcug

SEQ ID NO: 3290974 - RNA, 11 nt, Variola virus
agauuuaagaa

SEQ ID NO: 3290975 - RNA, 17 nt, Variola virus
aacgaaguauuuauacu

SEQ ID NO: 3290976 - RNA, 22 nt, Variola virus
auaugacuauuuucacauguac

SEQ ID NO: 3290977 - RNA, 22 nt, Variola virus
caaauuccuacuuacagaagau

SEQ ID NO: 3290978 - RNA, 18 nt, Variola virus
uuaaagucuucuauuucu

SEQ ID NO: 3290979 - RNA, 19 nt, Variola virus
ucuacuuacuggaaaauag

SEQ ID NO: 3290980 - RNA, 17 nt, Variola virus
uuuuacaauuucaucca

SEQ ID NO: 3290981 - RNA, 19 nt, Variola virus
auaguuaucuaucuuaaag

SEQ ID NO: 3290982 - RNA, 19 nt, Variola virus
uuaaugcccaauuuggaua

SEQ ID NO: 3290983 - RNA, 21 nt, Variola virus
ugaguaucggagcuacauuac

SEQ ID NO: 3290984 - RNA, 23 nt, Variola virus
gaucuccucuaucuguacuaucu

SEQ ID NO: 3290985 - RNA, 12 nt, Variola virus
uaaauucaagau

SEQ ID NO: 3290986 - RNA, 23 nt, Variola virus
gauuaaugcuacagauauuauca

SEQ ID NO: 3290987 - RNA, 23 nt, Variola virus
ccaugagauuguagaagcuuugg

SEQ ID NO: 3290988 - RNA, 20 nt, Variola virus
guguaguucuguucuaucau

SEQ ID NO: 3290989 - RNA, 14 nt, Variola virus
acacugauucagaa

SEQ ID NO: 3290990 - RNA, 13 nt, Variola virus
aagauuuguagaa

SEQ ID NO: 3290991 - RNA, 16 nt, Variola virus
gaaucggauaguuuaa

SEQ ID NO: 3290992 - RNA, 22 nt, Variola virus
agaagguuucgauuaucuguau

SEQ ID NO: 3290993 - RNA, 15 nt, Variola virus
uauaguggauccauu

SEQ ID NO: 3290994 - RNA, 17 nt, Variola virus
agaaauaagagacuuaa

SEQ ID NO: 3290995 - RNA, 17 nt, Variola virus
auuguauauacuuagau

SEQ ID NO: 3290996 - RNA, 18 nt, Variola virus
aucauuaauuaauacaau

SEQ ID NO: 3290997 - RNA, 16 nt, Variola virus
guauuauccaauacag

SEQ ID NO: 3290998 - RNA, 13 nt, Variola virus
aagucaaaugauu

SEQ ID NO: 3290999 - RNA, 15 nt, Variola virus
aaacaauguauacaa

SEQ ID NO: 3291000 - RNA, 14 nt, Variola virus
guguucuauacguc

SEQ ID NO: 3291001 - RNA, 16 nt, Variola virus
aaguuuggaugucuua

SEQ ID NO: 3291002 - RNA, 23 nt, Variola virus
aaaacagaauaugagaaugaaua

SEQ ID NO: 3291003 - RNA, 19 nt, Variola virus
auauuugagaguauuggua

SEQ ID NO: 3291004 - RNA, 20 nt, Variola virus
uauagauggcuuguauguca

SEQ ID NO: 3291005 - RNA, 14 nt, Variola virus
auauuuuacagcca

SEQ ID NO: 3291006 - RNA, 15 nt, Variola virus
acguuggcacaugau

SEQ ID NO: 3291007 - RNA, 20 nt, Variola virus
cauguguauuacaugcaucu

SEQ ID NO: 3291008 - RNA, 22 nt, Variola virus
gucucaugaccguguaugaaau

SEQ ID NO: 3291009 - RNA, 19 nt, Variola virus
uaguauuauucauuuucua

SEQ ID NO: 3291010 - RNA, 15 nt, Variola virus
guuccauuacaaaua

SEQ ID NO: 3291011 - RNA, 14 nt, Variola virus
augaguuaauguau

SEQ ID NO: 3291012 - RNA, 18 nt, Variola virus
uauaacaugcuaaaccuu

SEQ ID NO: 3291013 - RNA, 21 nt, Variola virus
aguacugcuuuuuucgaaaug

SEQ ID NO: 3291014 - RNA, 18 nt, Variola virus
caaauuaaauucuggaau

SEQ ID NO: 3291015 - RNA, 14 nt, Variola virus
auuguuuucaguaa

SEQ ID NO: 3291016 - RNA, 16 nt, Variola virus
guuauaaacgggugua

SEQ ID NO: 3291017 - RNA, 16 nt, Variola virus
acaauccaaaaaauga

SEQ ID NO: 3291018 - RNA, 13 nt, Variola virus
auuagauaaaguu

SEQ ID NO: 3291019 - RNA, 18 nt, Variola virus
cuaucaugucuauucucc

SEQ ID NO: 3291020 - RNA, 14 nt, Variola virus
ggagaauguuuccc

SEQ ID NO: 3291021 - RNA, 17 nt, Variola virus
aaaaguagaaaauauau

SEQ ID NO: 3291022 - RNA, 14 nt, Variola virus
augcaacauuuccu

SEQ ID NO: 3291023 - RNA, 17 nt, Variola virus
gaacuagauauauuaau

SEQ ID NO: 3291024 - RNA, 19 nt, Variola virus
caaagaauuuuagacacua

SEQ ID NO: 3291025 - RNA, 24 nt, Variola virus
gcuacacaaauaccaaucaaaaga

SEQ ID NO: 3291026 - RNA, 20 nt, Variola virus
ugugaauuuagcauauagua

SEQ ID NO: 3291027 - RNA, 19 nt, Variola virus
caacaaguuggaugauauu

SEQ ID NO: 3291028 - RNA, 15 nt, Variola virus
agauaucucuggaua

SEQ ID NO: 3291029 - RNA, 21 nt, Variola virus
gcaucaacaguuacaaaugag

SEQ ID NO: 3291030 - RNA, 16 nt, Variola virus
guuuggauuaauaauu

SEQ ID NO: 3291031 - RNA, 20 nt, Variola virus
ggaugucauagauucuuuaa

SEQ ID NO: 3291032 - RNA, 18 nt, Variola virus
uaacgaauuauauagucu

SEQ ID NO: 3291033 - RNA, 14 nt, Variola virus
uagauauagauguu

SEQ ID NO: 3291034 - RNA, 17 nt, Variola virus
ccacugucacuggaaag

SEQ ID NO: 3291035 - RNA, 21 nt, Variola virus
auuuucuaacgaaacgaugaa

SEQ ID NO: 3291036 - RNA, 15 nt, Variola virus
auauauuaacucaga

SEQ ID NO: 3291037 - RNA, 16 nt, Variola virus
agauaguaaauagaua

SEQ ID NO: 3291038 - RNA, 17 nt, Variola virus
agaguauucuuauguau

SEQ ID NO: 3291039 - RNA, 13 nt, Variola virus
uguugugggaaac

SEQ ID NO: 3291040 - RNA, 15 nt, Variola virus
agauacgucuauaca

SEQ ID NO: 3291041 - RNA, 17 nt, Variola virus
uauucaagucaaagaaa

SEQ ID NO: 3291042 - RNA, 23 nt, Variola virus
gauaguuuuuuucauuacuaucu

SEQ ID NO: 3291043 - RNA, 20 nt, Variola virus
guugagcuaauuuuuguaaa

SEQ ID NO: 3291044 - RNA, 15 nt, Variola virus
uguaaggaaauguuu

SEQ ID NO: 3291045 - RNA, 19 nt, Variola virus
aucuaaacgcguuagauaa

SEQ ID NO: 3291046 - RNA, 12 nt, Variola virus
caaaaaauaaua

SEQ ID NO: 3291047 - RNA, 13 nt, Variola virus
accguacaaguau

SEQ ID NO: 3291048 - RNA, 15 nt, Variola virus
uaauacuaucuggau

SEQ ID NO: 3291049 - RNA, 12 nt, Variola virus
gcgaauauuaaa

SEQ ID NO: 3291050 - RNA, 18 nt, Variola virus
aucauguccauggauaaa

SEQ ID NO: 3291051 - RNA, 14 nt, Variola virus
cagaauaucccaaa

SEQ ID NO: 3291052 - RNA, 17 nt, Variola virus
caugaaacgaacacuau

SEQ ID NO: 3291053 - RNA, 20 nt, Variola virus
uaaguucauuaucugaaaua

SEQ ID NO: 3291054 - RNA, 15 nt, Variola virus
gaaauauauacuuca

SEQ ID NO: 3291055 - RNA, 20 nt, Variola virus
auggauuuaucauaucaugg

SEQ ID NO: 3291056 - RNA, 15 nt, Variola virus
aauauaauaaauaua

SEQ ID NO: 3291057 - RNA, 23 nt, Variola virus
cuaauauucccaaacauacaucu

SEQ ID NO: 3291058 - RNA, 13 nt, Variola virus
agaaggagaagau

SEQ ID NO: 3291059 - RNA, 15 nt, Variola virus
aauaaauguauacau

SEQ ID NO: 3291060 - RNA, 20 nt, Variola virus
aauuacuuaaagauagaaau

SEQ ID NO: 3291061 - RNA, 15 nt, Variola virus
ucacaccuccauuaa

SEQ ID NO: 3291062 - RNA, 17 nt, Variola virus
ucucucauuuaucaaaa

SEQ ID NO: 3291063 - RNA, 16 nt, Variola virus
aauauuuuuuagagaa

SEQ ID NO: 3291064 - RNA, 14 nt, Variola virus
gucuuggaagcaau

SEQ ID NO: 3291065 - RNA, 12 nt, Variola virus
aaacaacucuuc

SEQ ID NO: 3291066 - RNA, 16 nt, Variola virus
agacguuucauaauaa

SEQ ID NO: 3291067 - RNA, 21 nt, Variola virus
cguuaaugaagaacacauauu

SEQ ID NO: 3291068 - RNA, 23 nt, Variola virus
ugccgaacuaaaaaaaauaacuu

SEQ ID NO: 3291069 - RNA, 17 nt, Variola virus
cgaauauaaaucauauu

SEQ ID NO: 3291070 - RNA, 22 nt, Variola virus
ucucuuuuguagaacuuaacuu

SEQ ID NO: 3291071 - RNA, 16 nt, Variola virus
acaccgccucuagaua

SEQ ID NO: 3291072 - RNA, 17 nt, Variola virus
agauuucaaagauguuu

SEQ ID NO: 3291073 - RNA, 22 nt, Variola virus
ugaaucuauuucugucauuaaa

SEQ ID NO: 3291074 - RNA, 22 nt, Variola virus
guauccaguuccuuuucuaguu

SEQ ID NO: 3291075 - RNA, 21 nt, Variola virus
auguaucuuccacaucaaacg

SEQ ID NO: 3291076 - RNA, 13 nt, Variola virus
auguaacgcguau

SEQ ID NO: 3291077 - RNA, 15 nt, Variola virus
uagucuauaugauca

SEQ ID NO: 3291078 - RNA, 11 nt, Variola virus
ugauacugaua

SEQ ID NO: 3291079 - RNA, 16 nt, Variola virus
aagcucuaaauccaaa

SEQ ID NO: 3291080 - RNA, 18 nt, Variola virus
aucaucgaucuaauagau

SEQ ID NO: 3291081 - RNA, 22 nt, Variola virus
aaaaauuauccuaucauguauu

SEQ ID NO: 3291082 - RNA, 17 nt, Variola virus
uuacaaugcucauuaaa

SEQ ID NO: 3291083 - RNA, 18 nt, Variola virus
gaacuggacuguauaucu

SEQ ID NO: 3291084 - RNA, 15 nt, Variola virus
uggaggcucaacaag

SEQ ID NO: 3291085 - RNA, 15 nt, Variola virus
uauuagaaucguguu

SEQ ID NO: 3291086 - RNA, 23 nt, Variola virus
aauguaacguuuauauauucaau

SEQ ID NO: 3291087 - RNA, 19 nt, Variola virus
auaaagaccgaauacauaa

SEQ ID NO: 3291088 - RNA, 23 nt, Variola virus
gucuuauucuuaaaaucuauucc

SEQ ID NO: 3291089 - RNA, 19 nt, Variola virus
uacaucgguaucuagaucu

SEQ ID NO: 3291090 - RNA, 15 nt, Variola virus
ggauuucauauaaga

SEQ ID NO: 3291091 - RNA, 16 nt, Variola virus
uagacuugauuauucu

SEQ ID NO: 3291092 - RNA, 19 nt, Variola virus
aucaggaauguuugcugaa

SEQ ID NO: 3291093 - RNA, 19 nt, Variola virus
auuucaaaauguuaaauca

SEQ ID NO: 3291094 - RNA, 22 nt, Variola virus
uauuacauugugauuaaacauu

SEQ ID NO: 3291095 - RNA, 13 nt, Variola virus
cugaaguuucaua

SEQ ID NO: 3291096 - RNA, 15 nt, Variola virus
uucuuaagacacauu

SEQ ID NO: 3291097 - RNA, 14 nt, Variola virus
ucuaucaaagcuuu

SEQ ID NO: 3291098 - RNA, 17 nt, Variola virus
gaaauagauagaaucua

SEQ ID NO: 3291099 - RNA, 21 nt, Variola virus
cuaaacccgacuuaguuauau

SEQ ID NO: 3291100 - RNA, 23 nt, Variola virus
aauauggagagguguauuuccau

SEQ ID NO: 3291101 - RNA, 18 nt, Variola virus
auucauaguaguugugac

SEQ ID NO: 3291102 - RNA, 17 nt, Variola virus
aucggauacagacacuc

SEQ ID NO: 3291103 - RNA, 18 nt, Variola virus
ucaauauauuaagaaguu

SEQ ID NO: 3291104 - RNA, 18 nt, Variola virus
gauaauuucguuaaaaca

SEQ ID NO: 3291105 - RNA, 14 nt, Variola virus
accauuaaaaauug

SEQ ID NO: 3291106 - RNA, 23 nt, Variola virus
ucagauaacauguuaauuuccga

SEQ ID NO: 3291107 - RNA, 19 nt, Variola virus
cuauaacauuaauaucaaa

SEQ ID NO: 3291108 - RNA, 14 nt, Variola virus
ucaaagaagaaguu

SEQ ID NO: 3291109 - RNA, 19 nt, Variola virus
aaauggaugcgguuauuag

SEQ ID NO: 3291110 - RNA, 16 nt, Variola virus
gucuggcaauaaauga

SEQ ID NO: 3291111 - RNA, 23 nt, Variola virus
auacuucauaaaagaaaauacua

SEQ ID NO: 3291112 - RNA, 23 nt, Variola virus
gaauagcagauagauaaagucuu

SEQ ID NO: 3291113 - RNA, 17 nt, Variola virus
gugauaaguaauaacua

SEQ ID NO: 3291114 - RNA, 13 nt, Variola virus
caacuuaaugaag

SEQ ID NO: 3291115 - RNA, 14 nt, Variola virus
cacacuaaacaguu

SEQ ID NO: 3291116 - RNA, 15 nt, Variola virus
cuuucaguucuggau

SEQ ID NO: 3291117 - RNA, 14 nt, Variola virus
acuuguuggugaaa

SEQ ID NO: 3291118 - RNA, 20 nt, Variola virus
cuaaaauauuuuuauucuca

SEQ ID NO: 3291119 - RNA, 14 nt, Variola virus
gacuaaauacuaca

SEQ ID NO: 3291120 - RNA, 13 nt, Variola virus
aagaagagaauua

SEQ ID NO: 3291121 - RNA, 16 nt, Variola virus
ucaucaaacaacugaa

SEQ ID NO: 3291122 - RNA, 19 nt, Variola virus
uaguuauagguaauacgcu

SEQ ID NO: 3291123 - RNA, 17 nt, Variola virus
aaugugauaauuuccag

SEQ ID NO: 3291124 - RNA, 22 nt, Variola virus
acauugaucuauuauuuaauga

SEQ ID NO: 3291125 - RNA, 20 nt, Variola virus
gaaacccccucauuuuuuaa

SEQ ID NO: 3291126 - RNA, 17 nt, Variola virus
accaaagacuuugaaau

SEQ ID NO: 3291127 - RNA, 17 nt, Variola virus
uacuuuuuaauucucua

SEQ ID NO: 3291128 - RNA, 14 nt, Variola virus
gaaucauuuuugca

SEQ ID NO: 3291129 - RNA, 22 nt, Variola virus
caugauccuauucuaaauggau

SEQ ID NO: 3291130 - RNA, 20 nt, Variola virus
auauuaacgaguuccauuua

SEQ ID NO: 3291131 - RNA, 22 nt, Variola virus
gcaacgaauaacaaaauacaag

SEQ ID NO: 3291132 - RNA, 14 nt, Variola virus
aucaagaaacauuu

SEQ ID NO: 3291133 - RNA, 18 nt, Variola virus
aacaagguaccgaaucua

SEQ ID NO: 3291134 - RNA, 13 nt, Variola virus
uaaauguauacau

SEQ ID NO: 3291135 - RNA, 22 nt, Variola virus
gauuggauaagaaaacauaucu

SEQ ID NO: 3291136 - RNA, 22 nt, Variola virus
gaaaaugugcuucuaugagauu

SEQ ID NO: 3291137 - RNA, 18 nt, Variola virus
agucugucaaaucaucuu

SEQ ID NO: 3291138 - RNA, 15 nt, Variola virus
aucuaaauuaaauau

SEQ ID NO: 3291139 - RNA, 21 nt, Variola virus
acaaaacaauuagagcagcag

SEQ ID NO: 3291140 - RNA, 19 nt, Variola virus
uguuuaaauaauucucuga

SEQ ID NO: 3291141 - RNA, 21 nt, Variola virus
guacuaacuuuugauuuuaac

SEQ ID NO: 3291142 - RNA, 22 nt, Variola virus
auaguuagcgucaacuuucaua

SEQ ID NO: 3291143 - RNA, 21 nt, Variola virus
uccaucgguauaaaaaucauu

SEQ ID NO: 3291144 - RNA, 18 nt, Variola virus
ucuuuaaaaauuuaaaau

SEQ ID NO: 3291145 - RNA, 14 nt, Variola virus
uuugagagggaaaa

SEQ ID NO: 3291146 - RNA, 19 nt, Variola virus
auuuaagagaucaaagcau

SEQ ID NO: 3291147 - RNA, 15 nt, Variola virus
aguaucauuaaaucu

SEQ ID NO: 3291148 - RNA, 16 nt, Variola virus
ucucuauaacaaaugu

SEQ ID NO: 3291149 - RNA, 19 nt, Variola virus
gguuaacucuuucuuuuga

SEQ ID NO: 3291150 - RNA, 20 nt, Variola virus
uagcaauuucugauucuaga

SEQ ID NO: 3291151 - RNA, 19 nt, Variola virus
aucaacucauguguaaauu

SEQ ID NO: 3291152 - RNA, 16 nt, Variola virus
gaaaaaacauguggua

SEQ ID NO: 3291153 - RNA, 14 nt, Variola virus
ugauuagaaaauau

SEQ ID NO: 3291154 - RNA, 15 nt, Variola virus
augccugagaguaaa

SEQ ID NO: 3291155 - RNA, 22 nt, Variola virus
aaaaauggauuuugaugauauu

SEQ ID NO: 3291156 - RNA, 12 nt, Variola virus
aagaaauuauuu

SEQ ID NO: 3291157 - RNA, 18 nt, Variola virus
auaaacuaucaguaaguu

SEQ ID NO: 3291158 - RNA, 13 nt, Variola virus
uacagaauuauug

SEQ ID NO: 3291159 - RNA, 18 nt, Variola virus
caacucaucguuccauag

SEQ ID NO: 3291160 - RNA, 16 nt, Variola virus
aaguaucaaaucgaua

SEQ ID NO: 3291161 - RNA, 23 nt, Variola virus
cccuaucaagcgauucuuucaau

SEQ ID NO: 3291162 - RNA, 18 nt, Variola virus
gauacaguaucguuuuaa

SEQ ID NO: 3291163 - RNA, 23 nt, Variola virus
aaguauccucuacucauuucauu

SEQ ID NO: 3291164 - RNA, 15 nt, Variola virus
auagaugaaauacuc

SEQ ID NO: 3291165 - RNA, 19 nt, Variola virus
aauuagaauuacaaaagaa

SEQ ID NO: 3291166 - RNA, 21 nt, Variola virus
gaauauaacgugguaucuucu

SEQ ID NO: 3291167 - RNA, 14 nt, Variola virus
acguucauuaaaaa

SEQ ID NO: 3291168 - RNA, 15 nt, Variola virus
caucgaugaugcauu

SEQ ID NO: 3291169 - RNA, 18 nt, Variola virus
acacaggauaaauuauuu

SEQ ID NO: 3291170 - RNA, 23 nt, Variola virus
uucauccccauacauuuuacauu

SEQ ID NO: 3291171 - RNA, 13 nt, Variola virus
gucuauuguuaau

SEQ ID NO: 3291172 - RNA, 18 nt, Variola virus
aaaaaauuacuccaugga

SEQ ID NO: 3291173 - RNA, 15 nt, Variola virus
guuaacccgaugguu

SEQ ID NO: 3291174 - RNA, 20 nt, Variola virus
ccguuaguuuaauauccuua

SEQ ID NO: 3291175 - RNA, 13 nt, Variola virus
gcucuuaaacgac

SEQ ID NO: 3291176 - RNA, 12 nt, Variola virus
ucaaagaaaaag

SEQ ID NO: 3291177 - RNA, 19 nt, Variola virus
uauuuggcuaaauuauaua

SEQ ID NO: 3291178 - RNA, 13 nt, Variola virus
uauauguaacauu

SEQ ID NO: 3291179 - RNA, 23 nt, Variola virus
aaguuuuucacccauaaauagua

SEQ ID NO: 3291180 - RNA, 18 nt, Variola virus
acagcuuuaacagaugau

SEQ ID NO: 3291181 - RNA, 19 nt, Variola virus
aguuuaauacuaauacuaa

SEQ ID NO: 3291182 - RNA, 11 nt, Variola virus
guuaauacagg

SEQ ID NO: 3291183 - RNA, 22 nt, Variola virus
acuauagucagcacucuuccau

SEQ ID NO: 3291184 - RNA, 14 nt, Variola virus
acauucuaggaaug

SEQ ID NO: 3291185 - RNA, 16 nt, Variola virus
aguauuucuuacucaa

SEQ ID NO: 3291186 - RNA, 16 nt, Variola virus
ccggaguuagaaagca

SEQ ID NO: 3291187 - RNA, 22 nt, Variola virus
uauaauguucaccauuuauaua

SEQ ID NO: 3291188 - RNA, 19 nt, Variola virus
uacaaacuuuuccuuuucc

SEQ ID NO: 3291189 - RNA, 19 nt, Variola virus
aucgucguacguuuacaca

SEQ ID NO: 3291190 - RNA, 18 nt, Variola virus
aagcagacuagaaauaac

SEQ ID NO: 3291191 - RNA, 17 nt, Variola virus
uacagcguuuacuauuc

SEQ ID NO: 3291192 - RNA, 17 nt, Variola virus
guauucaguuucaucaa

SEQ ID NO: 3291193 - RNA, 16 nt, Variola virus
guucagaggaugaaau

SEQ ID NO: 3291194 - RNA, 20 nt, Variola virus
auaacaguaguuuaacuagu

SEQ ID NO: 3291195 - RNA, 22 nt, Variola virus
auaauacucggccgacauaaug

SEQ ID NO: 3291196 - RNA, 17 nt, Variola virus
aacccguuuauacagug

SEQ ID NO: 3291197 - RNA, 15 nt, Variola virus
uacuaaaacugaaga

SEQ ID NO: 3291198 - RNA, 16 nt, Variola virus
uuaauccuucuagaau

SEQ ID NO: 3291199 - RNA, 20 nt, Variola virus
gaacacauaaccaauuuaua

SEQ ID NO: 3291200 - RNA, 21 nt, Variola virus
uacaugguuaaaguacaugua

SEQ ID NO: 3291201 - RNA, 14 nt, Variola virus
augacuaaacauuu

SEQ ID NO: 3291202 - RNA, 12 nt, Variola virus
uaucuauacaua

SEQ ID NO: 3291203 - RNA, 15 nt, Variola virus
acaaacguaaugaca

SEQ ID NO: 3291204 - RNA, 20 nt, Variola virus
uccuuaagauguuugagaau

SEQ ID NO: 3291205 - RNA, 22 nt, Variola virus
aaguacuguucauacaugauga

SEQ ID NO: 3291206 - RNA, 20 nt, Variola virus
aggcaauaagucuuucucca

SEQ ID NO: 3291207 - RNA, 14 nt, Variola virus
caaaucuauuugga

SEQ ID NO: 3291208 - RNA, 15 nt, Variola virus
uaagauuaucaaaau

SEQ ID NO: 3291209 - RNA, 15 nt, Variola virus
auaaauacauuuaca

SEQ ID NO: 3291210 - RNA, 24 nt, Variola virus
gaacuauauuaagauuaucuauca

SEQ ID NO: 3291211 - RNA, 13 nt, Variola virus
auuacugucucca

SEQ ID NO: 3291212 - RNA, 21 nt, Variola virus
auauauaagacacagaaauac

SEQ ID NO: 3291213 - RNA, 21 nt, Variola virus
ucaacaauuuuguauuauucu

SEQ ID NO: 3291214 - RNA, 16 nt, Variola virus
uuucagaauuuucuaa

SEQ ID NO: 3291215 - RNA, 22 nt, Variola virus
aauaguaguagaauaagaacua

SEQ ID NO: 3291216 - RNA, 19 nt, Variola virus
cucaguuugauauuacuaa

SEQ ID NO: 3291217 - RNA, 17 nt, Variola virus
aaacuucucuaaaugag

SEQ ID NO: 3291218 - RNA, 12 nt, Variola virus
aaacaauguuuc

SEQ ID NO: 3291219 - RNA, 23 nt, Variola virus
ugaaaacagaaacaucuuauuca

SEQ ID NO: 3291220 - RNA, 20 nt, Variola virus
aaaccuauaacauuaauauc

SEQ ID NO: 3291221 - RNA, 21 nt, Variola virus
caagagaaugaaauauauaca

SEQ ID NO: 3291222 - RNA, 19 nt, Variola virus
aguauagcuaaugaugcag

SEQ ID NO: 3291223 - RNA, 19 nt, Variola virus
auaaccucuccuauaugaa

SEQ ID NO: 3291224 - RNA, 22 nt, Variola virus
uuaguauuaaacagauccuuaa

SEQ ID NO: 3291225 - RNA, 14 nt, Variola virus
aaauagaaacauau

SEQ ID NO: 3291226 - RNA, 22 nt, Variola virus
aaacuucaaucuguuaagauua

SEQ ID NO: 3291227 - RNA, 20 nt, Variola virus
acuauuuuaaauagcauaga

SEQ ID NO: 3291228 - RNA, 18 nt, Variola virus
ugaaacuaugucaaaaau

SEQ ID NO: 3291229 - RNA, 20 nt, Variola virus
auuaucgaggauauuucaaa

SEQ ID NO: 3291230 - RNA, 23 nt, Variola virus
uauugagguuucugacaauuacu

SEQ ID NO: 3291231 - RNA, 17 nt, Variola virus
uuaaccuaacuaaaaga

SEQ ID NO: 3291232 - RNA, 22 nt, Variola virus
aguuaaggauaagaacuggacu

SEQ ID NO: 3291233 - RNA, 20 nt, Variola virus
uuaacccacgauuuaauauu

SEQ ID NO: 3291234 - RNA, 20 nt, Variola virus
aucauggauuuuacauagau

SEQ ID NO: 3291235 - RNA, 16 nt, Variola virus
ccuuuacagugaauaa

SEQ ID NO: 3291236 - RNA, 17 nt, Variola virus
aguguaccaauaugcga

SEQ ID NO: 3291237 - RNA, 21 nt, Variola virus
aauuaagcauauucuuaauau

SEQ ID NO: 3291238 - RNA, 19 nt, Variola virus
uuucuacccauaaguuauc

SEQ ID NO: 3291239 - RNA, 13 nt, Variola virus
uaaaagucaacau

SEQ ID NO: 3291240 - RNA, 13 nt, Variola virus
acaugucuucaau

SEQ ID NO: 3291241 - RNA, 17 nt, Variola virus
auuauuacacauagcau

SEQ ID NO: 3291242 - RNA, 17 nt, Variola virus
ucuagauccucucuuca

SEQ ID NO: 3291243 - RNA, 16 nt, Variola virus
caaagguuauagugua

SEQ ID NO: 3291244 - RNA, 16 nt, Variola virus
uuuuguauuguauaua

SEQ ID NO: 3291245 - RNA, 21 nt, Variola virus
cauugacggauaaaacaaaaa

SEQ ID NO: 3291246 - RNA, 13 nt, Variola virus
aguuaauaggaca

SEQ ID NO: 3291247 - RNA, 17 nt, Variola virus
cgacucuacuaguucca

SEQ ID NO: 3291248 - RNA, 16 nt, Variola virus
acguaaccaagaaguu

SEQ ID NO: 3291249 - RNA, 18 nt, Variola virus
uaucguaccuaucuuaaa

SEQ ID NO: 3291250 - RNA, 18 nt, Variola virus
uaaugugaauuuagcaua

SEQ ID NO: 3291251 - RNA, 17 nt, Variola virus
aauuauucguuuacuga

SEQ ID NO: 3291252 - RNA, 15 nt, Variola virus
aauagccguuucaug

SEQ ID NO: 3291253 - RNA, 17 nt, Variola virus
aaagggaccuaaaucua

SEQ ID NO: 3291254 - RNA, 12 nt, Variola virus
aguuuuuaagag

SEQ ID NO: 3291255 - RNA, 17 nt, Variola virus
ccaugcaacauuuccua

SEQ ID NO: 3291256 - RNA, 15 nt, Variola virus
caaaucuaacuucua

SEQ ID NO: 3291257 - RNA, 13 nt, Variola virus
ucaaaaacugaag

SEQ ID NO: 3291258 - RNA, 19 nt, Variola virus
auguauuuuaauaaaucau

SEQ ID NO: 3291259 - RNA, 22 nt, Variola virus
auuaacuccgaggcacauacau

SEQ ID NO: 3291260 - RNA, 22 nt, Variola virus
aacacgauuauuauaaaauaac

SEQ ID NO: 3291261 - RNA, 18 nt, Variola virus
ucauuuucuucaacaaau

SEQ ID NO: 3291262 - RNA, 16 nt, Variola virus
uuuuucaguuaucauc

SEQ ID NO: 3291263 - RNA, 17 nt, Variola virus
guuauacagauguauua

SEQ ID NO: 3291264 - RNA, 18 nt, Variola virus
gcucuguaaagcauauuc

SEQ ID NO: 3291265 - RNA, 14 nt, Variola virus
auggaagaaacaga

SEQ ID NO: 3291266 - RNA, 17 nt, Variola virus
guuauaagauuacuuau

SEQ ID NO: 3291267 - RNA, 15 nt, Variola virus
ucacucaauaucuag

SEQ ID NO: 3291268 - RNA, 24 nt, Variola virus
gaaaaugaacaucggaaauauaga

SEQ ID NO: 3291269 - RNA, 15 nt, Variola virus
auauacaauaucacu

SEQ ID NO: 3291270 - RNA, 23 nt, Variola virus
augacuuuaucagaucaaaauua

SEQ ID NO: 3291271 - RNA, 18 nt, Variola virus
gcuaaagauuugucacaa

SEQ ID NO: 3291272 - RNA, 14 nt, Variola virus
gaagguauuuccau

SEQ ID NO: 3291273 - RNA, 14 nt, Variola virus
aucaaguggauaaa

SEQ ID NO: 3291274 - RNA, 11 nt, Variola virus
auaauacuuug

SEQ ID NO: 3291275 - RNA, 11 nt, Variola virus
uccagauuuca

SEQ ID NO: 3291276 - RNA, 13 nt, Variola virus
guaauuacuuauc

SEQ ID NO: 3291277 - RNA, 12 nt, Variola virus
ucagaucaaagu

SEQ ID NO: 3291278 - RNA, 13 nt, Variola virus
aaauugcaaaaua

SEQ ID NO: 3291279 - RNA, 14 nt, Variola virus
augaauuaauuaaa

SEQ ID NO: 3291280 - RNA, 19 nt, Variola virus
uuaacaucucuucauuaau

SEQ ID NO: 3291281 - RNA, 22 nt, Variola virus
cucaaagagaauuauauauuua

SEQ ID NO: 3291282 - RNA, 16 nt, Variola virus
ugauguaaucucuaaa

SEQ ID NO: 3291283 - RNA, 14 nt, Variola virus
uuuacuggaauuag

SEQ ID NO: 3291284 - RNA, 18 nt, Variola virus
gaauguggaauuugcuau

SEQ ID NO: 3291285 - RNA, 16 nt, Variola virus
auuuuuaauagcugcu

SEQ ID NO: 3291286 - RNA, 21 nt, Variola virus
caucagaauaaaucaauaucu

SEQ ID NO: 3291287 - RNA, 22 nt, Variola virus
gucauacuccaucaauuucaaa

SEQ ID NO: 3291288 - RNA, 23 nt, Variola virus
caaauaaagcgaaaaauaauuau

SEQ ID NO: 3291289 - RNA, 20 nt, Variola virus
auaugcgccuagagaauugc

SEQ ID NO: 3291290 - RNA, 18 nt, Variola virus
aaucagugauagacuaga

SEQ ID NO: 3291291 - RNA, 22 nt, Variola virus
ccuaccaaaaucaauauaucau

SEQ ID NO: 3291292 - RNA, 18 nt, Variola virus
cguuacuaacgugauuau

SEQ ID NO: 3291293 - RNA, 13 nt, Variola virus
cuuaccccuugau

SEQ ID NO: 3291294 - RNA, 15 nt, Variola virus
ucaaauuagauuucg

SEQ ID NO: 3291295 - RNA, 17 nt, Variola virus
auuguuuuuguacauaa

SEQ ID NO: 3291296 - RNA, 21 nt, Variola virus
aauauucauucaauauuuaca

SEQ ID NO: 3291297 - RNA, 13 nt, Variola virus
uguucacauccuu

SEQ ID NO: 3291298 - RNA, 19 nt, Variola virus
acaaauuaaauucuggaau

SEQ ID NO: 3291299 - RNA, 23 nt, Variola virus
aacaaacagacuauucuuuauua

SEQ ID NO: 3291300 - RNA, 14 nt, Variola virus
accaaguagaaauu

SEQ ID NO: 3291301 - RNA, 21 nt, Variola virus
ucacuucucuucauuacuacu

SEQ ID NO: 3291302 - RNA, 20 nt, Variola virus
acauaaaccgaucacuaauu

SEQ ID NO: 3291303 - RNA, 16 nt, Variola virus
cacucuucgaaaagaa

SEQ ID NO: 3291304 - RNA, 19 nt, Variola virus
caaaauugucuaugauauc

SEQ ID NO: 3291305 - RNA, 20 nt, Variola virus
uaaauauauuuauaaaguau

SEQ ID NO: 3291306 - RNA, 20 nt, Variola virus
auaauccugugcauaaauua

SEQ ID NO: 3291307 - RNA, 17 nt, Variola virus
ccaauucguauaaauau

SEQ ID NO: 3291308 - RNA, 17 nt, Variola virus
ugacauaauuacauaua

SEQ ID NO: 3291309 - RNA, 20 nt, Variola virus
ugagaauaucuuuauucauu

SEQ ID NO: 3291310 - RNA, 22 nt, Variola virus
acugauaaaguagauuaugaag

SEQ ID NO: 3291311 - RNA, 19 nt, Variola virus
guucauccuuguucaucau

SEQ ID NO: 3291312 - RNA, 15 nt, Variola virus
uguaacaauauuaca

SEQ ID NO: 3291313 - RNA, 20 nt, Variola virus
cuugauuacauucucauuaa

SEQ ID NO: 3291314 - RNA, 19 nt, Variola virus
uagucgguuaauguuguau

SEQ ID NO: 3291315 - RNA, 17 nt, Variola virus
caguuuauuauccacua

SEQ ID NO: 3291316 - RNA, 15 nt, Variola virus
gauagaaacauaugc

SEQ ID NO: 3291317 - RNA, 12 nt, Variola virus
uucauucguaaa

SEQ ID NO: 3291318 - RNA, 17 nt, Variola virus
cuuauuacuuuuggaau

SEQ ID NO: 3291319 - RNA, 16 nt, Variola virus
acauucaaagauuuga

SEQ ID NO: 3291320 - RNA, 17 nt, Variola virus
cuuacguguuuaauuuu

SEQ ID NO: 3291321 - RNA, 17 nt, Variola virus
uacauguauuaaagaau

SEQ ID NO: 3291322 - RNA, 21 nt, Variola virus
uagcauuguuauguauuucau

SEQ ID NO: 3291323 - RNA, 17 nt, Variola virus
caugagauugaaugcca

SEQ ID NO: 3291324 - RNA, 22 nt, Variola virus
acuuaugcgaagccauguuaaa

SEQ ID NO: 3291325 - RNA, 17 nt, Variola virus
uuuuucaucuuuacaua

SEQ ID NO: 3291326 - RNA, 23 nt, Variola virus
cauauaacuaucaacugugaugu

SEQ ID NO: 3291327 - RNA, 18 nt, Variola virus
uaauaaauuuauuauuua

SEQ ID NO: 3291328 - RNA, 16 nt, Variola virus
acagaacuaauguaua

SEQ ID NO: 3291329 - RNA, 23 nt, Variola virus
cuauaaagucugucaaaucaucu

SEQ ID NO: 3291330 - RNA, 22 nt, Variola virus
uucuacuaugcacauuauucua

SEQ ID NO: 3291331 - RNA, 14 nt, Variola virus
aacaaacaucucac

SEQ ID NO: 3291332 - RNA, 15 nt, Variola virus
gaaagcgugauuuua

SEQ ID NO: 3291333 - RNA, 23 nt, Variola virus
uuuaauagcuaacucgguaucua

SEQ ID NO: 3291334 - RNA, 17 nt, Variola virus
uauaaaaacauuauucu

SEQ ID NO: 3291335 - RNA, 21 nt, Variola virus
uaugcaccuagagguucuauu

SEQ ID NO: 3291336 - RNA, 22 nt, Variola virus
uauccucaauaacguuaucauu

SEQ ID NO: 3291337 - RNA, 17 nt, Variola virus
gagcacuauuucuaaau

SEQ ID NO: 3291338 - RNA, 20 nt, Variola virus
acagguagaauuuauaaaca

SEQ ID NO: 3291339 - RNA, 14 nt, Variola virus
auagcacaaaugug

SEQ ID NO: 3291340 - RNA, 17 nt, Variola virus
ccaugaaacgaacacua

SEQ ID NO: 3291341 - RNA, 14 nt, Variola virus
agaauuucuguuca

SEQ ID NO: 3291342 - RNA, 23 nt, Variola virus
aucgucaccgaugucaaaaaaag

SEQ ID NO: 3291343 - RNA, 19 nt, Variola virus
cuauuauuugcgaggauga

SEQ ID NO: 3291344 - RNA, 18 nt, Variola virus
aaggcaucaaaaaaugua

SEQ ID NO: 3291345 - RNA, 17 nt, Variola virus
ucuuuagcuucugaaau

SEQ ID NO: 3291346 - RNA, 16 nt, Variola virus
cacuucuauaguaucu

SEQ ID NO: 3291347 - RNA, 23 nt, Variola virus
gaaguauaucugaguaugaugau

SEQ ID NO: 3291348 - RNA, 17 nt, Variola virus
uauugcauguuuucaua

SEQ ID NO: 3291349 - RNA, 14 nt, Variola virus
agacaaaaauaugg

SEQ ID NO: 3291350 - RNA, 18 nt, Variola virus
cuaauuaaucuaaaaucu

SEQ ID NO: 3291351 - RNA, 17 nt, Variola virus
acuaagcccaaaaccaa

SEQ ID NO: 3291352 - RNA, 20 nt, Variola virus
aaaauuuaaagaauguauaa

SEQ ID NO: 3291353 - RNA, 12 nt, Variola virus
gaauuaauacau

SEQ ID NO: 3291354 - RNA, 19 nt, Variola virus
uaacuaaaaauguaaaaua

SEQ ID NO: 3291355 - RNA, 22 nt, Variola virus
uauuggcuuuucuuuaucacua

SEQ ID NO: 3291356 - RNA, 21 nt, Variola virus
acgauaaugugguuacucuuc

SEQ ID NO: 3291357 - RNA, 22 nt, Variola virus
agagguucccaauuccaaagau

SEQ ID NO: 3291358 - RNA, 14 nt, Variola virus
uuucuuuuaacaug

SEQ ID NO: 3291359 - RNA, 18 nt, Variola virus
acacauccugaacaauaa

SEQ ID NO: 3291360 - RNA, 12 nt, Variola virus
gaaucaaaaagu

SEQ ID NO: 3291361 - RNA, 20 nt, Variola virus
aggauucguuuacucucaga

SEQ ID NO: 3291362 - RNA, 12 nt, Variola virus
uguauuaaauag

SEQ ID NO: 3291363 - RNA, 18 nt, Variola virus
uagaauuuauaaacauca

SEQ ID NO: 3291364 - RNA, 18 nt, Variola virus
uucagaauuucuacauaa

SEQ ID NO: 3291365 - RNA, 21 nt, Variola virus
acaucuauauugcuacauaau

SEQ ID NO: 3291366 - RNA, 16 nt, Variola virus
acaauuauuauauaau

SEQ ID NO: 3291367 - RNA, 15 nt, Variola virus
ucauuaauugagaaa

SEQ ID NO: 3291368 - RNA, 16 nt, Variola virus
agaaaacuagauacaa

SEQ ID NO: 3291369 - RNA, 14 nt, Variola virus
auguauauaucacu

SEQ ID NO: 3291370 - RNA, 18 nt, Variola virus
cguauaauagacauaaug

SEQ ID NO: 3291371 - RNA, 21 nt, Variola virus
uucuacuaugcacauuauucu

SEQ ID NO: 3291372 - RNA, 14 nt, Variola virus
acuaucuuuaacau

SEQ ID NO: 3291373 - RNA, 20 nt, Variola virus
guacuucucccauaauacuu

SEQ ID NO: 3291374 - RNA, 22 nt, Variola virus
uuuuaccgcaauauguaugcua

SEQ ID NO: 3291375 - RNA, 24 nt, Variola virus
uaguuuuguaauaucuauagcauc

SEQ ID NO: 3291376 - RNA, 14 nt, Variola virus
uuggcaaauuauuu

SEQ ID NO: 3291377 - RNA, 17 nt, Variola virus
aucaaugaguaagacuu

SEQ ID NO: 3291378 - RNA, 12 nt, Variola virus
uuacaaaucuag

SEQ ID NO: 3291379 - RNA, 15 nt, Variola virus
aagaagccauuuuau

SEQ ID NO: 3291380 - RNA, 23 nt, Variola virus
uaauauaaaauucccaaucuugu

SEQ ID NO: 3291381 - RNA, 22 nt, Variola virus
uacuguuaaauguacuguauau

SEQ ID NO: 3291382 - RNA, 18 nt, Variola virus
gucuuuuauaguauauac

SEQ ID NO: 3291383 - RNA, 15 nt, Variola virus
aaacauauauggucu

SEQ ID NO: 3291384 - RNA, 18 nt, Variola virus
ucagaauaucucauucaa

SEQ ID NO: 3291385 - RNA, 17 nt, Variola virus
ccauaguuuguaucaau

SEQ ID NO: 3291386 - RNA, 14 nt, Variola virus
uagaaauacaaaag

SEQ ID NO: 3291387 - RNA, 21 nt, Variola virus
uaaugaauuuagaaaugauug

SEQ ID NO: 3291388 - RNA, 16 nt, Variola virus
aucauuauuuacugaa

SEQ ID NO: 3291389 - RNA, 14 nt, Variola virus
aaaaguaaauacug

SEQ ID NO: 3291390 - RNA, 22 nt, Variola virus
acauguaaacuugacaaaaauu

SEQ ID NO: 3291391 - RNA, 22 nt, Variola virus
cauguauugcuguauuuguaau

SEQ ID NO: 3291392 - RNA, 13 nt, Variola virus
gauaacauaaaaa

SEQ ID NO: 3291393 - RNA, 15 nt, Variola virus
auuugucacaauaug

SEQ ID NO: 3291394 - RNA, 19 nt, Variola virus
uaauaaaaaaaauuauuua

SEQ ID NO: 3291395 - RNA, 18 nt, Variola virus
gguauuggcgauugauuu

SEQ ID NO: 3291396 - RNA, 18 nt, Variola virus
aucgagucuagauucgag

SEQ ID NO: 3291397 - RNA, 14 nt, Variola virus
ucgauuucuggaua

SEQ ID NO: 3291398 - RNA, 17 nt, Variola virus
gugcugaggucuuucaa

SEQ ID NO: 3291399 - RNA, 21 nt, Variola virus
aaaacucugauuauugucuaa

SEQ ID NO: 3291400 - RNA, 17 nt, Variola virus
cgagaauaugauagaaa

SEQ ID NO: 3291401 - RNA, 13 nt, Variola virus
gguaggagaaaga

SEQ ID NO: 3291402 - RNA, 14 nt, Variola virus
uagccaccauaaug

SEQ ID NO: 3291403 - RNA, 13 nt, Variola virus
ucaacuuauucuu

SEQ ID NO: 3291404 - RNA, 12 nt, Variola virus
aaccuaauucca

SEQ ID NO: 3291405 - RNA, 18 nt, Variola virus
uaaaucuguuucuaaaga

SEQ ID NO: 3291406 - RNA, 14 nt, Variola virus
uguaacaaaguuuc

SEQ ID NO: 3291407 - RNA, 22 nt, Variola virus
cgauugagauuuugcauacaau

SEQ ID NO: 3291408 - RNA, 20 nt, Variola virus
agauaccacgaguaucaauu

SEQ ID NO: 3291409 - RNA, 21 nt, Variola virus
gauuaaaaauaaaguuaucau

SEQ ID NO: 3291410 - RNA, 19 nt, Variola virus
guuuaaaaauauagauauu

SEQ ID NO: 3291411 - RNA, 17 nt, Variola virus
uagcaugugguucuuca

SEQ ID NO: 3291412 - RNA, 14 nt, Variola virus
aguauacaauauau

SEQ ID NO: 3291413 - RNA, 19 nt, Variola virus
auuuaccguuacuaauaag

SEQ ID NO: 3291414 - RNA, 12 nt, Variola virus
ucaucuguuuua

SEQ ID NO: 3291415 - RNA, 19 nt, Variola virus
ugaaauaaccgcaugauua

SEQ ID NO: 3291416 - RNA, 21 nt, Variola virus
auucuaggcucaguauguaaa

SEQ ID NO: 3291417 - RNA, 16 nt, Variola virus
aaguaaucaauuuuuc

SEQ ID NO: 3291418 - RNA, 22 nt, Variola virus
ucucacugaauacgaggaugau

SEQ ID NO: 3291419 - RNA, 13 nt, Variola virus
auauuuuaauagu

SEQ ID NO: 3291420 - RNA, 17 nt, Variola virus
ugcuaugaaguugucua

SEQ ID NO: 3291421 - RNA, 20 nt, Variola virus
uaucaccaguaagaacauaa

SEQ ID NO: 3291422 - RNA, 14 nt, Variola virus
cuuuuuccaauucu

SEQ ID NO: 3291423 - RNA, 15 nt, Variola virus
aauacaccaaauaua

SEQ ID NO: 3291424 - RNA, 17 nt, Variola virus
auaaauacaccaaauau

SEQ ID NO: 3291425 - RNA, 14 nt, Variola virus
aacauuaacagauu

SEQ ID NO: 3291426 - RNA, 13 nt, Variola virus
uguacauguaguu

SEQ ID NO: 3291427 - RNA, 12 nt, Variola virus
cagaacuauuag

SEQ ID NO: 3291428 - RNA, 17 nt, Variola virus
agcuccguauuccaaac

SEQ ID NO: 3291429 - RNA, 18 nt, Variola virus
acgagugaacguaauaga

SEQ ID NO: 3291430 - RNA, 16 nt, Variola virus
acuauacgaaauagau

SEQ ID NO: 3291431 - RNA, 15 nt, Variola virus
uagaaaaucauacag

SEQ ID NO: 3291432 - RNA, 22 nt, Variola virus
gcaacggggaugaugauaauga

SEQ ID NO: 3291433 - RNA, 12 nt, Variola virus
gaacuaauaaag

SEQ ID NO: 3291434 - RNA, 21 nt, Variola virus
gaaaaguucaacaugauuauu

SEQ ID NO: 3291435 - RNA, 12 nt, Variola virus
aauguauaacag

SEQ ID NO: 3291436 - RNA, 21 nt, Variola virus
aagauguuuucugucagaaaa

SEQ ID NO: 3291437 - RNA, 23 nt, Variola virus
agacgcuauggcacgaaauaucu

SEQ ID NO: 3291438 - RNA, 19 nt, Variola virus
acaaaauaaaaaacauaau

SEQ ID NO: 3291439 - RNA, 16 nt, Variola virus
cugaauuuauuucaga

SEQ ID NO: 3291440 - RNA, 16 nt, Variola virus
ucacuaacaauaacua

SEQ ID NO: 3291441 - RNA, 16 nt, Variola virus
gcaagaacauaaugau

SEQ ID NO: 3291442 - RNA, 23 nt, Variola virus
agaacuaagauuccauuaucuaa

SEQ ID NO: 3291443 - RNA, 15 nt, Variola virus
agaaccaaaugauua

SEQ ID NO: 3291444 - RNA, 14 nt, Variola virus
aaauauaauuuuau

SEQ ID NO: 3291445 - RNA, 18 nt, Variola virus
ccauguagaauaaauuau

SEQ ID NO: 3291446 - RNA, 20 nt, Variola virus
uacgguuccacagacucauu

SEQ ID NO: 3291447 - RNA, 15 nt, Variola virus
gaauuuauuaauaca

SEQ ID NO: 3291448 - RNA, 17 nt, Variola virus
acauacuaguauuuaca

SEQ ID NO: 3291449 - RNA, 18 nt, Variola virus
cauggaacaauaaaagag

SEQ ID NO: 3291450 - RNA, 19 nt, Variola virus
cauuccuaccaaacaaaau

SEQ ID NO: 3291451 - RNA, 20 nt, Variola virus
gaaauauguauacauaauau

SEQ ID NO: 3291452 - RNA, 21 nt, Variola virus
uauuacagauuuuauuaaacu

SEQ ID NO: 3291453 - RNA, 16 nt, Variola virus
uccacaaauaguaaau

SEQ ID NO: 3291454 - RNA, 20 nt, Variola virus
gaauuggaacuaguauuuau

SEQ ID NO: 3291455 - RNA, 21 nt, Variola virus
aacgagugcaaguagaacuua

SEQ ID NO: 3291456 - RNA, 22 nt, Variola virus
uauuaauacaggaucuagcaaa

SEQ ID NO: 3291457 - RNA, 15 nt, Variola virus
auaaguauuaucaaa

SEQ ID NO: 3291458 - RNA, 20 nt, Variola virus
cuuggaugaccauauauuua

SEQ ID NO: 3291459 - RNA, 21 nt, Variola virus
aaauguauuuuuuaugauaua

SEQ ID NO: 3291460 - RNA, 14 nt, Variola virus
ucuaucauguagua

SEQ ID NO: 3291461 - RNA, 14 nt, Variola virus
uaguaguguuuccc

SEQ ID NO: 3291462 - RNA, 13 nt, Variola virus
ccauuaaagaauu

SEQ ID NO: 3291463 - RNA, 13 nt, Variola virus
agauauuaucuau

SEQ ID NO: 3291464 - RNA, 22 nt, Variola virus
gacuauuggaauguguuaaaaa

SEQ ID NO: 3291465 - RNA, 14 nt, Variola virus
acaacuaaacagua

SEQ ID NO: 3291466 - RNA, 15 nt, Variola virus
auuuacgcgcacaca

SEQ ID NO: 3291467 - RNA, 22 nt, Variola virus
caggaagauuagucagaccauu

SEQ ID NO: 3291468 - RNA, 13 nt, Variola virus
cugcauuaucuac

SEQ ID NO: 3291469 - RNA, 15 nt, Variola virus
auauuugcuaauaau

SEQ ID NO: 3291470 - RNA, 24 nt, Variola virus
uacuauacacaauguuacucacau

SEQ ID NO: 3291471 - RNA, 21 nt, Variola virus
auaucauaaauaaaaauagua

SEQ ID NO: 3291472 - RNA, 14 nt, Variola virus
ucaucaauguagug

SEQ ID NO: 3291473 - RNA, 21 nt, Variola virus
uucuauaccaauauuauucuu

SEQ ID NO: 3291474 - RNA, 20 nt, Variola virus
ucaauguguguaacuccaga

SEQ ID NO: 3291475 - RNA, 16 nt, Variola virus
caugauaagaauaauu

SEQ ID NO: 3291476 - RNA, 17 nt, Variola virus
gacaucaauaugccaau

SEQ ID NO: 3291477 - RNA, 11 nt, Variola virus
aaauaaauguc

SEQ ID NO: 3291478 - RNA, 16 nt, Variola virus
cacuaacuguaucaau

SEQ ID NO: 3291479 - RNA, 15 nt, Variola virus
ucauaaauucuuuaa

SEQ ID NO: 3291480 - RNA, 18 nt, Variola virus
auuauguuguuaugagug

SEQ ID NO: 3291481 - RNA, 18 nt, Variola virus
agaaacagauagauaugu

SEQ ID NO: 3291482 - RNA, 13 nt, Variola virus
auuguuacaaaag

SEQ ID NO: 3291483 - RNA, 21 nt, Variola virus
uagaaagaaacgauuauuucu

SEQ ID NO: 3291484 - RNA, 18 nt, Variola virus
acaauuuauauguucauu

SEQ ID NO: 3291485 - RNA, 21 nt, Variola virus
acuagugauaucauuaauaca

SEQ ID NO: 3291486 - RNA, 15 nt, Variola virus
agucaauauauuaag

SEQ ID NO: 3291487 - RNA, 13 nt, Variola virus
augcaucaaacag

SEQ ID NO: 3291488 - RNA, 14 nt, Variola virus
cauaaacugauacg

SEQ ID NO: 3291489 - RNA, 12 nt, Variola virus
ucucaauacaga

SEQ ID NO: 3291490 - RNA, 19 nt, Variola virus
augauauacagucuuaaau

SEQ ID NO: 3291491 - RNA, 16 nt, Variola virus
caucagacaaugcuuu

SEQ ID NO: 3291492 - RNA, 12 nt, Variola virus
auauguuaauaa

SEQ ID NO: 3291493 - RNA, 12 nt, Variola virus
uauuguuauaua

SEQ ID NO: 3291494 - RNA, 17 nt, Variola virus
auaaacgcgucugcuaa

SEQ ID NO: 3291495 - RNA, 12 nt, Variola virus
gaucaaguaaag

SEQ ID NO: 3291496 - RNA, 17 nt, Variola virus
acugcaauaaaacauuu

SEQ ID NO: 3291497 - RNA, 19 nt, Variola virus
uucagugguaaagauaucu

SEQ ID NO: 3291498 - RNA, 15 nt, Variola virus
aucaugucacauagu

SEQ ID NO: 3291499 - RNA, 20 nt, Variola virus
uucagaauuaauagauauau

SEQ ID NO: 3291500 - RNA, 18 nt, Variola virus
acuuaacaugagacauaa

SEQ ID NO: 3291501 - RNA, 20 nt, Variola virus
acuuagucuguacaaaaguu

SEQ ID NO: 3291502 - RNA, 22 nt, Variola virus
caaguuuccuguaaauuuucua

SEQ ID NO: 3291503 - RNA, 13 nt, Variola virus
caucaauuuugaa

SEQ ID NO: 3291504 - RNA, 20 nt, Variola virus
uaaaugaaucccaaacauug

SEQ ID NO: 3291505 - RNA, 18 nt, Variola virus
guuuacauuuuuggauuu

SEQ ID NO: 3291506 - RNA, 20 nt, Variola virus
agagauacuaaauauagaca

SEQ ID NO: 3291507 - RNA, 23 nt, Variola virus
uucaacuuugaaauuguuuuuua

SEQ ID NO: 3291508 - RNA, 19 nt, Variola virus
ugaagaagaaaacaaacau

SEQ ID NO: 3291509 - RNA, 21 nt, Variola virus
acaagauuuuuagcguauuau

SEQ ID NO: 3291510 - RNA, 20 nt, Variola virus
ucaacauaaauaauucuaga

SEQ ID NO: 3291511 - RNA, 23 nt, Variola virus
uaucuaguguuccuaauaucaua

SEQ ID NO: 3291512 - RNA, 19 nt, Variola virus
uagcaucuuuuuauaucug

SEQ ID NO: 3291513 - RNA, 14 nt, Variola virus
aaauaaaacuauaa

SEQ ID NO: 3291514 - RNA, 17 nt, Variola virus
ugccauuuuuaacguag

SEQ ID NO: 3291515 - RNA, 13 nt, Variola virus
cuaguuguuuaug

SEQ ID NO: 3291516 - RNA, 14 nt, Variola virus
uucaucaucugaua

SEQ ID NO: 3291517 - RNA, 18 nt, Variola virus
uuauacaggucauuacau

SEQ ID NO: 3291518 - RNA, 15 nt, Variola virus
cuaauauuuuuagau

SEQ ID NO: 3291519 - RNA, 14 nt, Variola virus
uauugcuacauaau

SEQ ID NO: 3291520 - RNA, 20 nt, Variola virus
gugauucucugaaaauguaa

SEQ ID NO: 3291521 - RNA, 15 nt, Variola virus
caauaauauacuaau

SEQ ID NO: 3291522 - RNA, 16 nt, Variola virus
cugucauuaaaucuuu

SEQ ID NO: 3291523 - RNA, 16 nt, Variola virus
auuuucuauaacugaa

SEQ ID NO: 3291524 - RNA, 14 nt, Variola virus
aacuccuggauaac

SEQ ID NO: 3291525 - RNA, 12 nt, Variola virus
gaauauaaugaa

SEQ ID NO: 3291526 - RNA, 22 nt, Variola virus
agaucaauggugugauguugau

SEQ ID NO: 3291527 - RNA, 18 nt, Variola virus
uaacccauuauaaaacuu

SEQ ID NO: 3291528 - RNA, 23 nt, Variola virus
acaacuggauauucgauaacagc

SEQ ID NO: 3291529 - RNA, 21 nt, Variola virus
ccaucuccuuauuuuuaaaaa

SEQ ID NO: 3291530 - RNA, 14 nt, Variola virus
gaaaucuauaauau

SEQ ID NO: 3291531 - RNA, 18 nt, Variola virus
uucaaugugcucuuuaca

SEQ ID NO: 3291532 - RNA, 16 nt, Variola virus
ucaucugaaauuguca

SEQ ID NO: 3291533 - RNA, 16 nt, Variola virus
cauacaaugauuucaa

SEQ ID NO: 3291534 - RNA, 23 nt, Variola virus
acaaguugaccaauuuauuucua

SEQ ID NO: 3291535 - RNA, 21 nt, Variola virus
acauuaacaucauacaucaau

SEQ ID NO: 3291536 - RNA, 19 nt, Variola virus
cguuaucauuuucuacaau

SEQ ID NO: 3291537 - RNA, 13 nt, Variola virus
acaguuaaaacua

SEQ ID NO: 3291538 - RNA, 13 nt, Variola virus
uauuuuauacauu

SEQ ID NO: 3291539 - RNA, 21 nt, Variola virus
guucaaaugccacaucaaaga

SEQ ID NO: 3291540 - RNA, 14 nt, Variola virus
agacguguuauuac

SEQ ID NO: 3291541 - RNA, 14 nt, Variola virus
uaaacaaaauacuc

SEQ ID NO: 3291542 - RNA, 17 nt, Variola virus
ggauuacaagaaauaug

SEQ ID NO: 3291543 - RNA, 13 nt, Variola virus
uaguacaugaaug

SEQ ID NO: 3291544 - RNA, 14 nt, Variola virus
agauuuuacuaacu

SEQ ID NO: 3291545 - RNA, 17 nt, Variola virus
augaaauuuaaguaaca

SEQ ID NO: 3291546 - RNA, 13 nt, Variola virus
caaauaugauaug

SEQ ID NO: 3291547 - RNA, 20 nt, Variola virus
aauuacauaaaaaaaaugua

SEQ ID NO: 3291548 - RNA, 19 nt, Variola virus
auccaaacccuugaucucc

SEQ ID NO: 3291549 - RNA, 19 nt, Variola virus
aaauuaaaggagcauguau

SEQ ID NO: 3291550 - RNA, 21 nt, Variola virus
cauaaacgauugcugcuguuc

SEQ ID NO: 3291551 - RNA, 21 nt, Variola virus
caucauaugacauuucaugaa

SEQ ID NO: 3291552 - RNA, 22 nt, Variola virus
uuaguuucugguuuucuauaaa

SEQ ID NO: 3291553 - RNA, 13 nt, Variola virus
acaguuucuagug

SEQ ID NO: 3291554 - RNA, 21 nt, Variola virus
auuagcgagguauuuauucau

SEQ ID NO: 3291555 - RNA, 14 nt, Variola virus
aaaugauuuuggaa

SEQ ID NO: 3291556 - RNA, 15 nt, Variola virus
auauucccaaacaua

SEQ ID NO: 3291557 - RNA, 14 nt, Variola virus
ucucuaucaaugau

SEQ ID NO: 3291558 - RNA, 17 nt, Variola virus
augacauucucugacau

SEQ ID NO: 3291559 - RNA, 16 nt, Variola virus
uccaacuccuuuucga

SEQ ID NO: 3291560 - RNA, 23 nt, Variola virus
uucuucauuuauggguaucaaaa

SEQ ID NO: 3291561 - RNA, 21 nt, Variola virus
aauaauuuugaagcauuggaa

SEQ ID NO: 3291562 - RNA, 16 nt, Variola virus
cuuuuauuuuaucuaa

SEQ ID NO: 3291563 - RNA, 15 nt, Variola virus
auuuacucucuauaa

SEQ ID NO: 3291564 - RNA, 14 nt, Variola virus
uuuguggacauuuu

SEQ ID NO: 3291565 - RNA, 21 nt, Variola virus
ucaacggaugaguuaauguau

SEQ ID NO: 3291566 - RNA, 22 nt, Variola virus
uguuaucaugaaauguuugaua

SEQ ID NO: 3291567 - RNA, 21 nt, Variola virus
uuucuacaauaacuacauauu

SEQ ID NO: 3291568 - RNA, 21 nt, Variola virus
aggaugaauuaucguuauuau

SEQ ID NO: 3291569 - RNA, 12 nt, Variola virus
cuagauuuugac

SEQ ID NO: 3291570 - RNA, 12 nt, Variola virus
acuguauuugga

SEQ ID NO: 3291571 - RNA, 15 nt, Variola virus
cauaguugcucaaaa

SEQ ID NO: 3291572 - RNA, 15 nt, Variola virus
acuuggaaacaucuc

SEQ ID NO: 3291573 - RNA, 14 nt, Variola virus
cuaguagaaaagau

SEQ ID NO: 3291574 - RNA, 14 nt, Variola virus
gauaauauuauuau

SEQ ID NO: 3291575 - RNA, 16 nt, Variola virus
aauaugugcucugcag

SEQ ID NO: 3291576 - RNA, 18 nt, Variola virus
uauaggaccacuagcaaa

SEQ ID NO: 3291577 - RNA, 12 nt, Variola virus
cauaauccucua

SEQ ID NO: 3291578 - RNA, 16 nt, Variola virus
aacuucuaaucuugua

SEQ ID NO: 3291579 - RNA, 16 nt, Variola virus
aguacaaugaacgaua

SEQ ID NO: 3291580 - RNA, 23 nt, Variola virus
guuucccaaugaaaugguacaau

SEQ ID NO: 3291581 - RNA, 15 nt, Variola virus
acagcagaaaaagac

SEQ ID NO: 3291582 - RNA, 20 nt, Variola virus
ucuacaguaauguccaaauc

SEQ ID NO: 3291583 - RNA, 23 nt, Variola virus
uuaacuaucgugucucuguuuuu

SEQ ID NO: 3291584 - RNA, 18 nt, Variola virus
uaagguagaaucucuauu

SEQ ID NO: 3291585 - RNA, 20 nt, Variola virus
agguacuauaauauuaaaaa

SEQ ID NO: 3291586 - RNA, 14 nt, Variola virus
ucguuauuaucauc

SEQ ID NO: 3291587 - RNA, 20 nt, Variola virus
gauaccauuauuaacaaauu

SEQ ID NO: 3291588 - RNA, 20 nt, Variola virus
guagcugaauguuauaaaaa

SEQ ID NO: 3291589 - RNA, 21 nt, Variola virus
guauugacaauacuguauuau

SEQ ID NO: 3291590 - RNA, 19 nt, Variola virus
auuuuaacgucuaaaugua

SEQ ID NO: 3291591 - RNA, 14 nt, Variola virus
uuaucuaacucuuu

SEQ ID NO: 3291592 - RNA, 19 nt, Variola virus
gcguuuccuacauaacauc

SEQ ID NO: 3291593 - RNA, 13 nt, Variola virus
uuccuccauaauu

SEQ ID NO: 3291594 - RNA, 20 nt, Variola virus
guuauaaaggacagaaauau

SEQ ID NO: 3291595 - RNA, 15 nt, Variola virus
uuaaauaauguauca

SEQ ID NO: 3291596 - RNA, 23 nt, Variola virus
uuugacaggaucagguucuucua

SEQ ID NO: 3291597 - RNA, 20 nt, Variola virus
uauuaauacaugucuuagau

SEQ ID NO: 3291598 - RNA, 19 nt, Variola virus
aauaaaaugucacaaccuu

SEQ ID NO: 3291599 - RNA, 20 nt, Variola virus
gaaacuaugucaaaaauugu

SEQ ID NO: 3291600 - RNA, 17 nt, Variola virus
uaagaccgaaauuauca

SEQ ID NO: 3291601 - RNA, 19 nt, Variola virus
guuagcugucguucaagau

SEQ ID NO: 3291602 - RNA, 12 nt, Variola virus
aucauguagaaa

SEQ ID NO: 3291603 - RNA, 17 nt, Variola virus
aauauuuuaauagauua

SEQ ID NO: 3291604 - RNA, 17 nt, Variola virus
auuuuacccucaaucau

SEQ ID NO: 3291605 - RNA, 18 nt, Variola virus
aaaugucaugauuaguau

SEQ ID NO: 3291606 - RNA, 14 nt, Variola virus
ugugacaguuuucu

SEQ ID NO: 3291607 - RNA, 12 nt, Variola virus
auuuaaauccua

SEQ ID NO: 3291608 - RNA, 14 nt, Variola virus
cggaagacaaucaa

SEQ ID NO: 3291609 - RNA, 13 nt, Variola virus
aguuaaauauuaa

SEQ ID NO: 3291610 - RNA, 15 nt, Variola virus
agucaagauacagaa

SEQ ID NO: 3291611 - RNA, 18 nt, Variola virus
gcaaaacuauuauuuuaa

SEQ ID NO: 3291612 - RNA, 16 nt, Variola virus
uauuacacauaaacau

SEQ ID NO: 3291613 - RNA, 21 nt, Variola virus
agaaaucaacaaucuaauaca

SEQ ID NO: 3291614 - RNA, 14 nt, Variola virus
uaaaaauguuaauu

SEQ ID NO: 3291615 - RNA, 22 nt, Variola virus
ucuaaaugaugauauaccuguu

SEQ ID NO: 3291616 - RNA, 17 nt, Variola virus
cugaaauuagagcucau

SEQ ID NO: 3291617 - RNA, 20 nt, Variola virus
aauauuaauaaaguauauau

SEQ ID NO: 3291618 - RNA, 21 nt, Variola virus
agcuaugcgauuggauaagaa

SEQ ID NO: 3291619 - RNA, 15 nt, Variola virus
auacaucuuuaaucu

SEQ ID NO: 3291620 - RNA, 15 nt, Variola virus
ucuauaucuucuuuu

SEQ ID NO: 3291621 - RNA, 15 nt, Variola virus
aauaacauaggauua

SEQ ID NO: 3291622 - RNA, 15 nt, Variola virus
aauaucuaaauaugc

SEQ ID NO: 3291623 - RNA, 21 nt, Variola virus
cuaaaucuguauaucuuucca

SEQ ID NO: 3291624 - RNA, 22 nt, Variola virus
cuauaaacgaugguuuaauuug

SEQ ID NO: 3291625 - RNA, 19 nt, Variola virus
uaaucuauaggcaacgaug

SEQ ID NO: 3291626 - RNA, 16 nt, Variola virus
auagauaaugauauau

SEQ ID NO: 3291627 - RNA, 19 nt, Variola virus
uauacgaaauagauauuca

SEQ ID NO: 3291628 - RNA, 22 nt, Variola virus
augaaauagcguucgucaacau

SEQ ID NO: 3291629 - RNA, 23 nt, Variola virus
uucggacuuauauagcuuauucc

SEQ ID NO: 3291630 - RNA, 14 nt, Variola virus
aucuguuuguugag

SEQ ID NO: 3291631 - RNA, 16 nt, Variola virus
auaaaccauuguauaa

SEQ ID NO: 3291632 - RNA, 12 nt, Variola virus
uucuuuguguag

SEQ ID NO: 3291633 - RNA, 20 nt, Variola virus
ucauagccgcucuuagaguu

SEQ ID NO: 3291634 - RNA, 14 nt, Variola virus
agcaucuaguugau

SEQ ID NO: 3291635 - RNA, 14 nt, Variola virus
ccaaacaauaccau

SEQ ID NO: 3291636 - RNA, 13 nt, Variola virus
cgaggauuuugau

SEQ ID NO: 3291637 - RNA, 21 nt, Variola virus
uaucuuaaagccauacauuua

SEQ ID NO: 3291638 - RNA, 15 nt, Variola virus
uggacauacuaauau

SEQ ID NO: 3291639 - RNA, 15 nt, Variola virus
auaacauguuaauuu

SEQ ID NO: 3291640 - RNA, 15 nt, Variola virus
uuuacaagauuauua

SEQ ID NO: 3291641 - RNA, 19 nt, Variola virus
uaaacagauccuuaaccuu

SEQ ID NO: 3291642 - RNA, 19 nt, Variola virus
guuaaaggauauuaugcau

SEQ ID NO: 3291643 - RNA, 20 nt, Variola virus
agauguuagaaaaaugaugc

SEQ ID NO: 3291644 - RNA, 14 nt, Variola virus
cguuuauagauguu

SEQ ID NO: 3291645 - RNA, 17 nt, Variola virus
gaucuggaaaauaaucu

SEQ ID NO: 3291646 - RNA, 19 nt, Variola virus
guuagaacgguuauagcau

SEQ ID NO: 3291647 - RNA, 18 nt, Variola virus
aauggaagguauuuccau

SEQ ID NO: 3291648 - RNA, 15 nt, Variola virus
auuguaaacacagau

SEQ ID NO: 3291649 - RNA, 17 nt, Variola virus
auaauauaaaaacuuau

SEQ ID NO: 3291650 - RNA, 13 nt, Variola virus
uaugauaugugau

SEQ ID NO: 3291651 - RNA, 17 nt, Variola virus
aguucugcauucaauuc

SEQ ID NO: 3291652 - RNA, 15 nt, Variola virus
aaaaauuauaauauu

SEQ ID NO: 3291653 - RNA, 14 nt, Variola virus
aaaaacaugucucu

SEQ ID NO: 3291654 - RNA, 21 nt, Variola virus
auaaaaacgagaaugacauaa

SEQ ID NO: 3291655 - RNA, 17 nt, Variola virus
augaacuagacaauaau

SEQ ID NO: 3291656 - RNA, 19 nt, Variola virus
uaguucucuuuuguagaac

SEQ ID NO: 3291657 - RNA, 17 nt, Variola virus
caagagagcagaaauaa

SEQ ID NO: 3291658 - RNA, 18 nt, Variola virus
uuuaacaaaguuauucau

SEQ ID NO: 3291659 - RNA, 15 nt, Variola virus
gucuagucuuaaaug

SEQ ID NO: 3291660 - RNA, 16 nt, Variola virus
gucacguuuauacauc

SEQ ID NO: 3291661 - RNA, 18 nt, Variola virus
gauccuaggauccuucag

SEQ ID NO: 3291662 - RNA, 16 nt, Variola virus
guuaaaacuacaaaaa

SEQ ID NO: 3291663 - RNA, 19 nt, Variola virus
caaauuuuuuuuacaaaca

SEQ ID NO: 3291664 - RNA, 15 nt, Variola virus
cuguucuaucaucua

SEQ ID NO: 3291665 - RNA, 20 nt, Variola virus
acacaucgacggacaaucua

SEQ ID NO: 3291666 - RNA, 17 nt, Variola virus
agaucaucaaaauaugu

SEQ ID NO: 3291667 - RNA, 16 nt, Variola virus
uauuacaaugcucauu

SEQ ID NO: 3291668 - RNA, 23 nt, Variola virus
acaaaggaacuaaucaaugaaug

SEQ ID NO: 3291669 - RNA, 16 nt, Variola virus
cgaguuuaaaacuucu

SEQ ID NO: 3291670 - RNA, 23 nt, Variola virus
aaagaauuuguuguuucuauuua

SEQ ID NO: 3291671 - RNA, 14 nt, Variola virus
auguuaguaggaau

SEQ ID NO: 3291672 - RNA, 18 nt, Variola virus
gaauacgaggaugaugau

SEQ ID NO: 3291673 - RNA, 14 nt, Variola virus
augccaaaaucaua

SEQ ID NO: 3291674 - RNA, 16 nt, Variola virus
cauaauauaaaaacuu

SEQ ID NO: 3291675 - RNA, 21 nt, Variola virus
cuauuuauugacauuaaucua

SEQ ID NO: 3291676 - RNA, 13 nt, Variola virus
aucaaaugucuaa

SEQ ID NO: 3291677 - RNA, 20 nt, Variola virus
uagugguauaucuuguucua

SEQ ID NO: 3291678 - RNA, 18 nt, Variola virus
agaauauguauaucaauu

SEQ ID NO: 3291679 - RNA, 19 nt, Variola virus
cauuuuauaaauauauaau

SEQ ID NO: 3291680 - RNA, 18 nt, Variola virus
uaaacacccuuauauuca

SEQ ID NO: 3291681 - RNA, 13 nt, Variola virus
ccaaauuaaugag

SEQ ID NO: 3291682 - RNA, 21 nt, Variola virus
ugcuaauauacaauuauccuu

SEQ ID NO: 3291683 - RNA, 15 nt, Variola virus
auuaucauuuuguaa

SEQ ID NO: 3291684 - RNA, 23 nt, Variola virus
aauauuguuuuucacuuuuuaua

SEQ ID NO: 3291685 - RNA, 17 nt, Variola virus
acucauaaauaaaaaug

SEQ ID NO: 3291686 - RNA, 14 nt, Variola virus
uuauuuuuuuggaa

SEQ ID NO: 3291687 - RNA, 16 nt, Variola virus
uaaaaaaaaauacuua

SEQ ID NO: 3291688 - RNA, 19 nt, Variola virus
acauaagaugucuaugaau

SEQ ID NO: 3291689 - RNA, 16 nt, Variola virus
uuucuacuacuucauu

SEQ ID NO: 3291690 - RNA, 14 nt, Variola virus
auuuuacauuccuc

SEQ ID NO: 3291691 - RNA, 22 nt, Variola virus
cauuuaucgacuaaucaaaaaa

SEQ ID NO: 3291692 - RNA, 13 nt, Variola virus
agauaaucuauau

SEQ ID NO: 3291693 - RNA, 18 nt, Variola virus
cguaauacccauguuuaa

SEQ ID NO: 3291694 - RNA, 21 nt, Variola virus
uuaacauguguauuacaugca

SEQ ID NO: 3291695 - RNA, 19 nt, Variola virus
acuaaaggcaacaaagaaa

SEQ ID NO: 3291696 - RNA, 16 nt, Variola virus
acauuuuuuguuuugg

SEQ ID NO: 3291697 - RNA, 12 nt, Variola virus
ucaucaauaaag

SEQ ID NO: 3291698 - RNA, 12 nt, Variola virus
uccucaauaacg

SEQ ID NO: 3291699 - RNA, 18 nt, Variola virus
uugugucauugacaucuu

SEQ ID NO: 3291700 - RNA, 20 nt, Variola virus
uuaccaacgacgauaguucu

SEQ ID NO: 3291701 - RNA, 15 nt, Variola virus
aucuaauaacaaugu

SEQ ID NO: 3291702 - RNA, 13 nt, Variola virus
agaaaaaacuaau

SEQ ID NO: 3291703 - RNA, 12 nt, Variola virus
caaaauaaugac

SEQ ID NO: 3291704 - RNA, 16 nt, Variola virus
caagacuaacacacaa

SEQ ID NO: 3291705 - RNA, 21 nt, Variola virus
auagaugauggaagacaaguu

SEQ ID NO: 3291706 - RNA, 21 nt, Variola virus
aaacuuuaauaacaaagaaag

SEQ ID NO: 3291707 - RNA, 12 nt, Variola virus
agauauuucauc

SEQ ID NO: 3291708 - RNA, 17 nt, Variola virus
auauuuuuuuuuaaaga

SEQ ID NO: 3291709 - RNA, 14 nt, Variola virus
agaaauuauaacau

SEQ ID NO: 3291710 - RNA, 17 nt, Variola virus
aaugaaacagaauuaac

SEQ ID NO: 3291711 - RNA, 17 nt, Variola virus
auccucgcuuuguguau

SEQ ID NO: 3291712 - RNA, 16 nt, Variola virus
uguguaacaaaguauu

SEQ ID NO: 3291713 - RNA, 22 nt, Variola virus
aaacauucuuuauuaaguguuu

SEQ ID NO: 3291714 - RNA, 22 nt, Variola virus
aaauaucuuuaauacagaguuu

SEQ ID NO: 3291715 - RNA, 15 nt, Variola virus
augccuauaaaguaa

SEQ ID NO: 3291716 - RNA, 14 nt, Variola virus
cuacaaaaaugcgu

SEQ ID NO: 3291717 - RNA, 13 nt, Variola virus
ucccaauguuucg

SEQ ID NO: 3291718 - RNA, 13 nt, Variola virus
acgaauaaaagaa

SEQ ID NO: 3291719 - RNA, 14 nt, Variola virus
uaaaaauauguaua

SEQ ID NO: 3291720 - RNA, 16 nt, Variola virus
aauuagaauuacaaaa

SEQ ID NO: 3291721 - RNA, 18 nt, Variola virus
acauacuuuccuguagua

SEQ ID NO: 3291722 - RNA, 17 nt, Variola virus
caaaguguccuccuauu

SEQ ID NO: 3291723 - RNA, 23 nt, Variola virus
cuuuuaaauacaaauauaucaau

SEQ ID NO: 3291724 - RNA, 15 nt, Variola virus
agcaauacaacagaa

SEQ ID NO: 3291725 - RNA, 22 nt, Variola virus
agauuggccagaaucaugguau

SEQ ID NO: 3291726 - RNA, 11 nt, Variola virus
cuauaguucuc

SEQ ID NO: 3291727 - RNA, 18 nt, Variola virus
auuuauaucuaaaaauua

SEQ ID NO: 3291728 - RNA, 19 nt, Variola virus
aaaccaggcgaguguagaa

SEQ ID NO: 3291729 - RNA, 14 nt, Variola virus
aauuacaaacacua

SEQ ID NO: 3291730 - RNA, 20 nt, Variola virus
aguaaguaucuauaaaacuc

SEQ ID NO: 3291731 - RNA, 11 nt, Variola virus
cacaucaucug

SEQ ID NO: 3291732 - RNA, 23 nt, Variola virus
aaauuguuuaguuuucucuuuuu

SEQ ID NO: 3291733 - RNA, 11 nt, Variola virus
aucccuuauca

SEQ ID NO: 3291734 - RNA, 16 nt, Variola virus
cauuauuuuauuguga

SEQ ID NO: 3291735 - RNA, 17 nt, Variola virus
uaggagaugauagcuau

SEQ ID NO: 3291736 - RNA, 13 nt, Variola virus
uaugauucuaaua

SEQ ID NO: 3291737 - RNA, 19 nt, Variola virus
aucacaagaaguuagaaag

SEQ ID NO: 3291738 - RNA, 20 nt, Variola virus
auacagaagauuuaacuaga

SEQ ID NO: 3291739 - RNA, 14 nt, Variola virus
cauuucaacguaaa

SEQ ID NO: 3291740 - RNA, 14 nt, Variola virus
aaauauauaacaau

SEQ ID NO: 3291741 - RNA, 23 nt, Variola virus
ucaucgaacuucugaucauuaau

SEQ ID NO: 3291742 - RNA, 21 nt, Variola virus
aagauagaugaacugacauau

SEQ ID NO: 3291743 - RNA, 13 nt, Variola virus
accaugaaauaua

SEQ ID NO: 3291744 - RNA, 21 nt, Variola virus
acauuuuuugacgaugaugau

SEQ ID NO: 3291745 - RNA, 15 nt, Variola virus
acaagaucuuuguuu

SEQ ID NO: 3291746 - RNA, 22 nt, Variola virus
acucuaccaguuaagucaauaa

SEQ ID NO: 3291747 - RNA, 13 nt, Variola virus
acguuaauacaaa

SEQ ID NO: 3291748 - RNA, 19 nt, Variola virus
caaagauuuaaauccuaau

SEQ ID NO: 3291749 - RNA, 19 nt, Variola virus
cacuauguuagcauuucua

SEQ ID NO: 3291750 - RNA, 17 nt, Variola virus
gugaauaugaucuucau

SEQ ID NO: 3291751 - RNA, 17 nt, Variola virus
uaagaauaauccagaau

SEQ ID NO: 3291752 - RNA, 12 nt, Variola virus
uauuucuaaaau

SEQ ID NO: 3291753 - RNA, 23 nt, Variola virus
agaugaaaauaauccugaauaua

SEQ ID NO: 3291754 - RNA, 19 nt, Variola virus
uuaauuuggucauucuuaa

SEQ ID NO: 3291755 - RNA, 13 nt, Variola virus
auucauugacaua

SEQ ID NO: 3291756 - RNA, 18 nt, Variola virus
aucuaguccuuuaauucc

SEQ ID NO: 3291757 - RNA, 16 nt, Variola virus
ucauuauuuaaguuuu

SEQ ID NO: 3291758 - RNA, 17 nt, Variola virus
ucaugaaucaauuagua

SEQ ID NO: 3291759 - RNA, 16 nt, Variola virus
acagcuucuagaaguu

SEQ ID NO: 3291760 - RNA, 15 nt, Variola virus
acuguggaauuauuu

SEQ ID NO: 3291761 - RNA, 20 nt, Variola virus
aaguagaaauuaucaaaugu

SEQ ID NO: 3291762 - RNA, 22 nt, Variola virus
auauugauaauauuuuaauaga

SEQ ID NO: 3291763 - RNA, 18 nt, Variola virus
uacgacuaaguucaaguc

SEQ ID NO: 3291764 - RNA, 14 nt, Variola virus
ucgaauaauguaua

SEQ ID NO: 3291765 - RNA, 17 nt, Variola virus
cuucgccgcgacuuucu

SEQ ID NO: 3291766 - RNA, 23 nt, Variola virus
ucaaacgaauaaacaauuucaca

SEQ ID NO: 3291767 - RNA, 16 nt, Variola virus
uaagauaguuguucau

SEQ ID NO: 3291768 - RNA, 12 nt, Variola virus
uguucagaaaua

SEQ ID NO: 3291769 - RNA, 20 nt, Variola virus
gauugauccuagaacuagau

SEQ ID NO: 3291770 - RNA, 15 nt, Variola virus
gucuaugauauccuc

SEQ ID NO: 3291771 - RNA, 19 nt, Variola virus
aaaaucaauauaucaucua

SEQ ID NO: 3291772 - RNA, 18 nt, Variola virus
aaauaucauuaacgauau

SEQ ID NO: 3291773 - RNA, 22 nt, Variola virus
auguuauagaauauaaauuaua

SEQ ID NO: 3291774 - RNA, 22 nt, Variola virus
uuucaaagaaugagauacauaa

SEQ ID NO: 3291775 - RNA, 11 nt, Variola virus
uacuaggaaaa

SEQ ID NO: 3291776 - RNA, 15 nt, Variola virus
acucucaaauuauua

SEQ ID NO: 3291777 - RNA, 17 nt, Variola virus
caucuuacauauacaga

SEQ ID NO: 3291778 - RNA, 18 nt, Variola virus
aacacucgacugaauauu

SEQ ID NO: 3291779 - RNA, 18 nt, Variola virus
caaaauugucuaugauau

SEQ ID NO: 3291780 - RNA, 23 nt, Variola virus
gacaaaaucaacuacauaaucuu

SEQ ID NO: 3291781 - RNA, 22 nt, Variola virus
ucaacauccgucaaaaccaauu

SEQ ID NO: 3291782 - RNA, 23 nt, Variola virus
auuucuggauauguuuuuaauaa

SEQ ID NO: 3291783 - RNA, 15 nt, Variola virus
aucuuuaguaaacau

SEQ ID NO: 3291784 - RNA, 17 nt, Variola virus
aagaauucggaaaugua

SEQ ID NO: 3291785 - RNA, 16 nt, Variola virus
cauacgcguucucaag

SEQ ID NO: 3291786 - RNA, 22 nt, Variola virus
ggacuacuuauucuauuuuaca

SEQ ID NO: 3291787 - RNA, 10 nt, Variola virus
ggauuacuua

SEQ ID NO: 3291788 - RNA, 12 nt, Variola virus
auaugacauaau

SEQ ID NO: 3291789 - RNA, 17 nt, Variola virus
auaaugaugaccuauau

SEQ ID NO: 3291790 - RNA, 17 nt, Variola virus
ugacauauguaaauauu

SEQ ID NO: 3291791 - RNA, 21 nt, Variola virus
uaucuuauguauauguuugua

SEQ ID NO: 3291792 - RNA, 18 nt, Variola virus
cuuuuuauuuauccucuc

SEQ ID NO: 3291793 - RNA, 16 nt, Variola virus
uaacaacgacuuauaa

SEQ ID NO: 3291794 - RNA, 14 nt, Variola virus
cauacaugauauuc

SEQ ID NO: 3291795 - RNA, 13 nt, Variola virus
aauauucagaaaa

SEQ ID NO: 3291796 - RNA, 17 nt, Variola virus
ugagaucuguaaugcua

SEQ ID NO: 3291797 - RNA, 21 nt, Variola virus
auugucucgucaaugucuaua

SEQ ID NO: 3291798 - RNA, 20 nt, Variola virus
aaauuauuaaacaauacucu

SEQ ID NO: 3291799 - RNA, 14 nt, Variola virus
aagaauauagaaau

SEQ ID NO: 3291800 - RNA, 17 nt, Variola virus
uacuauaauaguacuag

SEQ ID NO: 3291801 - RNA, 18 nt, Variola virus
uaguuaaucuuauucaag

SEQ ID NO: 3291802 - RNA, 21 nt, Variola virus
uuaugagucacguuacacuuu

SEQ ID NO: 3291803 - RNA, 16 nt, Variola virus
uaaagaauaucuuugg

SEQ ID NO: 3291804 - RNA, 23 nt, Variola virus
aaaauaaauuagucauacguaau

SEQ ID NO: 3291805 - RNA, 22 nt, Variola virus
acaagccgaagaguauaaauuc

SEQ ID NO: 3291806 - RNA, 13 nt, Variola virus
gucuuggaagcaa

SEQ ID NO: 3291807 - RNA, 15 nt, Variola virus
uacuuugacaaaugu

SEQ ID NO: 3291808 - RNA, 20 nt, Variola virus
aauacauauuguuuagcaaa

SEQ ID NO: 3291809 - RNA, 19 nt, Variola virus
acuauguuagcauuucuau

SEQ ID NO: 3291810 - RNA, 16 nt, Variola virus
auuauuaauaugagug

SEQ ID NO: 3291811 - RNA, 18 nt, Variola virus
cucauauaacuucuagau

SEQ ID NO: 3291812 - RNA, 17 nt, Variola virus
uuaauaaacuuagugua

SEQ ID NO: 3291813 - RNA, 12 nt, Variola virus
gucaauaaaaga

SEQ ID NO: 3291814 - RNA, 13 nt, Variola virus
augaauuagagaa

SEQ ID NO: 3291815 - RNA, 13 nt, Variola virus
aucccaaacauug

SEQ ID NO: 3291816 - RNA, 13 nt, Variola virus
auguuuguaucau

SEQ ID NO: 3291817 - RNA, 15 nt, Variola virus
aauauaguuaauagu

SEQ ID NO: 3291818 - RNA, 15 nt, Variola virus
uaagaagucauaugu

SEQ ID NO: 3291819 - RNA, 15 nt, Variola virus
aacaggcuaaaaugu

SEQ ID NO: 3291820 - RNA, 13 nt, Variola virus
uaaagccauacau

SEQ ID NO: 3291821 - RNA, 21 nt, Variola virus
aacaaguaugacauuguaaaa

SEQ ID NO: 3291822 - RNA, 22 nt, Variola virus
uaguggaguaauuuacaaauug

SEQ ID NO: 3291823 - RNA, 13 nt, Variola virus
gauaauagucacg

SEQ ID NO: 3291824 - RNA, 18 nt, Variola virus
augauucgucgacauguu

SEQ ID NO: 3291825 - RNA, 21 nt, Variola virus
caagauccucucuuaaaugaa

SEQ ID NO: 3291826 - RNA, 21 nt, Variola virus
ugaacuccgccguaguuucca

SEQ ID NO: 3291827 - RNA, 18 nt, Variola virus
caaugcucaguaaaugua

SEQ ID NO: 3291828 - RNA, 20 nt, Variola virus
uuuuaggauaugcuuucaua

SEQ ID NO: 3291829 - RNA, 13 nt, Variola virus
gaauaaguuuauu

SEQ ID NO: 3291830 - RNA, 21 nt, Variola virus
aauguaugaacaucauggaau

SEQ ID NO: 3291831 - RNA, 12 nt, Variola virus
ucuguucaaaaa

SEQ ID NO: 3291832 - RNA, 14 nt, Variola virus
guucaaauauauga

SEQ ID NO: 3291833 - RNA, 15 nt, Variola virus
gacuggaguauauau

SEQ ID NO: 3291834 - RNA, 17 nt, Variola virus
aaucucuucuauuuuca

SEQ ID NO: 3291835 - RNA, 14 nt, Variola virus
cuggaaaaaguugu

SEQ ID NO: 3291836 - RNA, 16 nt, Variola virus
uuacuuguauaauaag

SEQ ID NO: 3291837 - RNA, 14 nt, Variola virus
aaggcaauaagucu

SEQ ID NO: 3291838 - RNA, 14 nt, Variola virus
auagaaauauauau

SEQ ID NO: 3291839 - RNA, 23 nt, Variola virus
uaauccuuuuuauuuauccucuc

SEQ ID NO: 3291840 - RNA, 23 nt, Variola virus
uguauucagaauuaauagauaua

SEQ ID NO: 3291841 - RNA, 20 nt, Variola virus
uauaaacauuuguguuugua

SEQ ID NO: 3291842 - RNA, 18 nt, Variola virus
cggauuaauaucucuauc

SEQ ID NO: 3291843 - RNA, 18 nt, Variola virus
agucauuaacgaacaaua

SEQ ID NO: 3291844 - RNA, 17 nt, Variola virus
cauguaacaauauuaca

SEQ ID NO: 3291845 - RNA, 21 nt, Variola virus
uggucucaacgcaaacuuuuu

SEQ ID NO: 3291846 - RNA, 23 nt, Variola virus
gucuguauaguaacuauguaaau

SEQ ID NO: 3291847 - RNA, 12 nt, Variola virus
ucuauaggaaag

SEQ ID NO: 3291848 - RNA, 20 nt, Variola virus
ucuuaaggagaaugaaacag

SEQ ID NO: 3291849 - RNA, 16 nt, Variola virus
agauaguuuucucuau

SEQ ID NO: 3291850 - RNA, 16 nt, Variola virus
gugaucaauuuccaac

SEQ ID NO: 3291851 - RNA, 20 nt, Variola virus
ucaacuaucguuggaaaaug

SEQ ID NO: 3291852 - RNA, 14 nt, Variola virus
auaaacauaauaaa

SEQ ID NO: 3291853 - RNA, 17 nt, Variola virus
ugcaaagucuaaauauu

SEQ ID NO: 3291854 - RNA, 17 nt, Variola virus
agaauauucuuuucuaa

SEQ ID NO: 3291855 - RNA, 18 nt, Variola virus
aauucuuuuaugaauauc

SEQ ID NO: 3291856 - RNA, 15 nt, Variola virus
gcuaccaaaguuauu

SEQ ID NO: 3291857 - RNA, 15 nt, Variola virus
ucacacaauguagug

SEQ ID NO: 3291858 - RNA, 14 nt, Variola virus
ucgauccaauaaau

SEQ ID NO: 3291859 - RNA, 19 nt, Variola virus
agcauugaaaauacguucu

SEQ ID NO: 3291860 - RNA, 20 nt, Variola virus
acaagcaagcaucaugaaua

SEQ ID NO: 3291861 - RNA, 15 nt, Variola virus
acaauuucacaaaug

SEQ ID NO: 3291862 - RNA, 16 nt, Variola virus
uuaguuuuuuuagaaa

SEQ ID NO: 3291863 - RNA, 13 nt, Variola virus
aauauuaaaacua

SEQ ID NO: 3291864 - RNA, 22 nt, Variola virus
uaaugacguuaauaacaaaaau

SEQ ID NO: 3291865 - RNA, 21 nt, Variola virus
acgauauuaucgacuaugaau

SEQ ID NO: 3291866 - RNA, 16 nt, Variola virus
cuauguuucaguuuaa

SEQ ID NO: 3291867 - RNA, 19 nt, Variola virus
auaugcaaagaacaaaaua

SEQ ID NO: 3291868 - RNA, 16 nt, Variola virus
caaucuagcauuucua

SEQ ID NO: 3291869 - RNA, 19 nt, Variola virus
uauagcacuuuuaacuauu

SEQ ID NO: 3291870 - RNA, 17 nt, Variola virus
uucucuuuuaauucagu

SEQ ID NO: 3291871 - RNA, 16 nt, Variola virus
gaggaugagagucaau

SEQ ID NO: 3291872 - RNA, 23 nt, Variola virus
cuuuuuuuagagaugaaaaauuu

SEQ ID NO: 3291873 - RNA, 13 nt, Variola virus
uagaaaaacuuua

SEQ ID NO: 3291874 - RNA, 22 nt, Variola virus
aauuauuauauaauucuucgcc

SEQ ID NO: 3291875 - RNA, 18 nt, Variola virus
cguguuaauaaaaacaug

SEQ ID NO: 3291876 - RNA, 22 nt, Variola virus
uuccaggaucuagauaauuaau

SEQ ID NO: 3291877 - RNA, 23 nt, Variola virus
uuaugaacgaugauauguaucca

SEQ ID NO: 3291878 - RNA, 15 nt, Variola virus
acaucauaaaaugag

SEQ ID NO: 3291879 - RNA, 18 nt, Variola virus
caaaggaugaaagaaagc

SEQ ID NO: 3291880 - RNA, 13 nt, Variola virus
agucucaaaauua

SEQ ID NO: 3291881 - RNA, 21 nt, Variola virus
cauuuccaaaucuaacuucua

SEQ ID NO: 3291882 - RNA, 23 nt, Variola virus
uuacuauuggcaauuguagauau

SEQ ID NO: 3291883 - RNA, 23 nt, Variola virus
ugauaucuauaauaggguaucua

SEQ ID NO: 3291884 - RNA, 22 nt, Variola virus
caggcaaauguuuauaguauua

SEQ ID NO: 3291885 - RNA, 14 nt, Variola virus
gauggaauuaucau

SEQ ID NO: 3291886 - RNA, 17 nt, Variola virus
acauucauugucuauua

SEQ ID NO: 3291887 - RNA, 15 nt, Variola virus
uagccuauguuagga

SEQ ID NO: 3291888 - RNA, 22 nt, Variola virus
agccaauagaaauaucauuaag

SEQ ID NO: 3291889 - RNA, 22 nt, Variola virus
uguguuaucagccgcuacagaa

SEQ ID NO: 3291890 - RNA, 21 nt, Variola virus
auuuacucugaaaagaaagua

SEQ ID NO: 3291891 - RNA, 16 nt, Variola virus
gcuguccguauuguau

SEQ ID NO: 3291892 - RNA, 22 nt, Variola virus
uugggcggaucuguaaacauuu

SEQ ID NO: 3291893 - RNA, 13 nt, Variola virus
aauauuauuuccc

SEQ ID NO: 3291894 - RNA, 13 nt, Variola virus
uuaauaaauacag

SEQ ID NO: 3291895 - RNA, 12 nt, Variola virus
aaguaaacuucg

SEQ ID NO: 3291896 - RNA, 15 nt, Variola virus
ccauuaagugacauu

SEQ ID NO: 3291897 - RNA, 21 nt, Variola virus
auuauuuugugcaaauagaug

SEQ ID NO: 3291898 - RNA, 22 nt, Variola virus
cuaauauucccaaacauacauc

SEQ ID NO: 3291899 - RNA, 21 nt, Variola virus
agucaauggagaaauacuuaa

SEQ ID NO: 3291900 - RNA, 22 nt, Variola virus
caaauccgugauuuugguaaug

SEQ ID NO: 3291901 - RNA, 21 nt, Variola virus
auuucauuauaauaguuuauc

SEQ ID NO: 3291902 - RNA, 12 nt, Variola virus
aaugaaaugaua

SEQ ID NO: 3291903 - RNA, 16 nt, Variola virus
cucauuaaaacuucua

SEQ ID NO: 3291904 - RNA, 20 nt, Variola virus
auaauaggcaggagauagau

SEQ ID NO: 3291905 - RNA, 22 nt, Variola virus
uucacuuuuuauaauuuuacca

SEQ ID NO: 3291906 - RNA, 16 nt, Variola virus
ucguuuaauauuacau

SEQ ID NO: 3291907 - RNA, 16 nt, Variola virus
acuacugaagaacuaa

SEQ ID NO: 3291908 - RNA, 17 nt, Variola virus
uacauauuuguacauua

SEQ ID NO: 3291909 - RNA, 16 nt, Variola virus
gaacacguuaaacaaa

SEQ ID NO: 3291910 - RNA, 22 nt, Variola virus
aaagaguaugguaaaugacucu

SEQ ID NO: 3291911 - RNA, 18 nt, Variola virus
uuccacgaacuucuaauu

SEQ ID NO: 3291912 - RNA, 23 nt, Variola virus
uguggaauaaaauaaaacaagga

SEQ ID NO: 3291913 - RNA, 16 nt, Variola virus
auuaaaaaacauauau

SEQ ID NO: 3291914 - RNA, 16 nt, Variola virus
auucgauaagauagau

SEQ ID NO: 3291915 - RNA, 20 nt, Variola virus
ucgucaacaaguuggaugau

SEQ ID NO: 3291916 - RNA, 22 nt, Variola virus
augacauuguaaaagaaauaua

SEQ ID NO: 3291917 - RNA, 22 nt, Variola virus
uggauucaguacaauguuauau

SEQ ID NO: 3291918 - RNA, 17 nt, Variola virus
aggauccagaaggaaga

SEQ ID NO: 3291919 - RNA, 12 nt, Variola virus
auuuguuaauga

SEQ ID NO: 3291920 - RNA, 11 nt, Variola virus
ucguuaaccaa

SEQ ID NO: 3291921 - RNA, 13 nt, Variola virus
ucaucuaugaaug

SEQ ID NO: 3291922 - RNA, 15 nt, Variola virus
gccagauuuaagaaa

SEQ ID NO: 3291923 - RNA, 21 nt, Variola virus
agaaauuacauaaaaaaaaug

SEQ ID NO: 3291924 - RNA, 14 nt, Variola virus
aguacuuucacaag

SEQ ID NO: 3291925 - RNA, 16 nt, Variola virus
auucauaaaacauaau

SEQ ID NO: 3291926 - RNA, 16 nt, Variola virus
ucucuaagagcuacgu

SEQ ID NO: 3291927 - RNA, 12 nt, Variola virus
agaaauacuucc

SEQ ID NO: 3291928 - RNA, 16 nt, Variola virus
uaaucaagucaauuau

SEQ ID NO: 3291929 - RNA, 22 nt, Variola virus
guaaacauuauaucguuaucau

SEQ ID NO: 3291930 - RNA, 15 nt, Variola virus
auauguauacauaau

SEQ ID NO: 3291931 - RNA, 13 nt, Variola virus
aaaaaauuauacu

SEQ ID NO: 3291932 - RNA, 17 nt, Variola virus
acauaagcaucuccaau

SEQ ID NO: 3291933 - RNA, 22 nt, Variola virus
cucuaagaacuuauuaaugaau

SEQ ID NO: 3291934 - RNA, 18 nt, Variola virus
gaaacaauucauaauuau

SEQ ID NO: 3291935 - RNA, 22 nt, Variola virus
auugucagaaauuacaaacacu

SEQ ID NO: 3291936 - RNA, 21 nt, Variola virus
ucuaacuggugaguuaauauu

SEQ ID NO: 3291937 - RNA, 23 nt, Variola virus
uccagauauauaucuuuucagcu

SEQ ID NO: 3291938 - RNA, 16 nt, Variola virus
gaauauuuuauguaca

SEQ ID NO: 3291939 - RNA, 15 nt, Variola virus
uuauguuucuuuaaa

SEQ ID NO: 3291940 - RNA, 19 nt, Variola virus
agaauuaauaggaacuauu

SEQ ID NO: 3291941 - RNA, 13 nt, Variola virus
gaacgaugauaug

SEQ ID NO: 3291942 - RNA, 24 nt, Variola virus
ugaacauuuaagagaucaaagcau

SEQ ID NO: 3291943 - RNA, 22 nt, Variola virus
acuauccaauaaacagucuuua

SEQ ID NO: 3291944 - RNA, 15 nt, Variola virus
guuauuaucaucauu

SEQ ID NO: 3291945 - RNA, 18 nt, Variola virus
aucgauuuucaaauccau

SEQ ID NO: 3291946 - RNA, 19 nt, Variola virus
aauuccagauguuguaaaa

SEQ ID NO: 3291947 - RNA, 15 nt, Variola virus
aaccgaaucuuccca

SEQ ID NO: 3291948 - RNA, 21 nt, Variola virus
aauccauugauaauuucuugu

SEQ ID NO: 3291949 - RNA, 19 nt, Variola virus
cuucuaggacggcgauucu

SEQ ID NO: 3291950 - RNA, 16 nt, Variola virus
uaguuaauaaaaucua

SEQ ID NO: 3291951 - RNA, 16 nt, Variola virus
augacuggaaaucacu

SEQ ID NO: 3291952 - RNA, 13 nt, Variola virus
ucaucauuucuaa

SEQ ID NO: 3291953 - RNA, 21 nt, Variola virus
uagacugaaugcuuucuugga

SEQ ID NO: 3291954 - RNA, 17 nt, Variola virus
uacauucuuuuugcugu

SEQ ID NO: 3291955 - RNA, 21 nt, Variola virus
ugaguuccuuguuuuugcuaa

SEQ ID NO: 3291956 - RNA, 14 nt, Variola virus
ucagaaucguauau

SEQ ID NO: 3291957 - RNA, 17 nt, Variola virus
gaauaguaguagcucua

SEQ ID NO: 3291958 - RNA, 22 nt, Variola virus
uauuaaacaacgacauuguaaa

SEQ ID NO: 3291959 - RNA, 17 nt, Variola virus
ucuuucuugggaaacuc

SEQ ID NO: 3291960 - RNA, 15 nt, Variola virus
acauauccuccauaa

SEQ ID NO: 3291961 - RNA, 20 nt, Variola virus
caauaacacaaucaugauuu

SEQ ID NO: 3291962 - RNA, 19 nt, Variola virus
cuuaauacccugguagaag

SEQ ID NO: 3291963 - RNA, 23 nt, Variola virus
uauucucuggagaaaagauauca

SEQ ID NO: 3291964 - RNA, 13 nt, Variola virus
aauugucuaauga

SEQ ID NO: 3291965 - RNA, 16 nt, Variola virus
cgauacuaauuacaaa

SEQ ID NO: 3291966 - RNA, 20 nt, Variola virus
cuuaaauguaucuuuacuag

SEQ ID NO: 3291967 - RNA, 21 nt, Variola virus
aguaucaugaacucuaaucaa

SEQ ID NO: 3291968 - RNA, 22 nt, Variola virus
uauaacacguauguauuaacuu

SEQ ID NO: 3291969 - RNA, 23 nt, Variola virus
aacaaaaucuaacagauacaaau

SEQ ID NO: 3291970 - RNA, 16 nt, Variola virus
uaguugcauagaugua

SEQ ID NO: 3291971 - RNA, 17 nt, Variola virus
ucugaugaaucugaacc

SEQ ID NO: 3291972 - RNA, 17 nt, Variola virus
ccauuuuguggugcaac

SEQ ID NO: 3291973 - RNA, 16 nt, Variola virus
acucauaaaauacaag

SEQ ID NO: 3291974 - RNA, 13 nt, Variola virus
caaggaucuucua

SEQ ID NO: 3291975 - RNA, 20 nt, Variola virus
acuacuuuaucauagucuaa

SEQ ID NO: 3291976 - RNA, 16 nt, Variola virus
aguauggcgacauuga

SEQ ID NO: 3291977 - RNA, 13 nt, Variola virus
agaaguucaugau

SEQ ID NO: 3291978 - RNA, 17 nt, Variola virus
cauaagucuaauagacu

SEQ ID NO: 3291979 - RNA, 13 nt, Variola virus
aaaagaucaacau

SEQ ID NO: 3291980 - RNA, 16 nt, Variola virus
auacauuugaguuacu

SEQ ID NO: 3291981 - RNA, 19 nt, Variola virus
gauauuaucgacuaugaau

SEQ ID NO: 3291982 - RNA, 14 nt, Variola virus
uuuaguguagauau

SEQ ID NO: 3291983 - RNA, 22 nt, Variola virus
guuauguauuucauuguucauc

SEQ ID NO: 3291984 - RNA, 12 nt, Variola virus
gaaucuauuuua

SEQ ID NO: 3291985 - RNA, 22 nt, Variola virus
aauaggaggaauugauauguau

SEQ ID NO: 3291986 - RNA, 16 nt, Variola virus
auaauauuaugucuag

SEQ ID NO: 3291987 - RNA, 16 nt, Variola virus
aaaaaguuaagaauua

SEQ ID NO: 3291988 - RNA, 16 nt, Variola virus
uagucagaauuuucau

SEQ ID NO: 3291989 - RNA, 21 nt, Variola virus
agguuacguauagucuauaug

SEQ ID NO: 3291990 - RNA, 14 nt, Variola virus
acagaaauauauau

SEQ ID NO: 3291991 - RNA, 20 nt, Variola virus
ccagauaguuuauauccgua

SEQ ID NO: 3291992 - RNA, 17 nt, Variola virus
uuugagaauauauacag

SEQ ID NO: 3291993 - RNA, 15 nt, Variola virus
aauguauuaagauua

SEQ ID NO: 3291994 - RNA, 18 nt, Variola virus
uuaaauuuuuuuauuaau

SEQ ID NO: 3291995 - RNA, 18 nt, Variola virus
acaaauuuauuuauuaac

SEQ ID NO: 3291996 - RNA, 18 nt, Variola virus
gauuuacgcaaacuauau

SEQ ID NO: 3291997 - RNA, 15 nt, Variola virus
aaaauguuagaauua

SEQ ID NO: 3291998 - RNA, 14 nt, Variola virus
auauuuuuaauagc

SEQ ID NO: 3291999 - RNA, 22 nt, Variola virus
accagaguuaucaagagaaaau

SEQ ID NO: 3292000 - RNA, 17 nt, Variola virus
cugauacaauuagauau

SEQ ID NO: 3292001 - RNA, 15 nt, Variola virus
gaguugauuguaaac

SEQ ID NO: 3292002 - RNA, 13 nt, Variola virus
uuucaaauaauaa

SEQ ID NO: 3292003 - RNA, 13 nt, Variola virus
aggauaaagaaaa

SEQ ID NO: 3292004 - RNA, 21 nt, Variola virus
acuuuacgcuauuaaucuuua

SEQ ID NO: 3292005 - RNA, 16 nt, Variola virus
uguaguaaagaugcua

SEQ ID NO: 3292006 - RNA, 16 nt, Variola virus
cagauucuuauauacc

SEQ ID NO: 3292007 - RNA, 22 nt, Variola virus
uauagaugaggugguugcagaa

SEQ ID NO: 3292008 - RNA, 17 nt, Variola virus
gcgaauaaauagauaua

SEQ ID NO: 3292009 - RNA, 17 nt, Variola virus
auuuuauuucaaaauua

SEQ ID NO: 3292010 - RNA, 23 nt, Variola virus
aguauacuaccuauuauauuucu

SEQ ID NO: 3292011 - RNA, 13 nt, Variola virus
cauauuuugcaau

SEQ ID NO: 3292012 - RNA, 16 nt, Variola virus
uauaugagauguaguu

SEQ ID NO: 3292013 - RNA, 16 nt, Variola virus
caaaaguuaauuucua

SEQ ID NO: 3292014 - RNA, 21 nt, Variola virus
uucuaccuuacccauaaacaa

SEQ ID NO: 3292015 - RNA, 15 nt, Variola virus
ucauggggcaaacau

SEQ ID NO: 3292016 - RNA, 20 nt, Variola virus
ucuaaugaugaacacaaaug

SEQ ID NO: 3292017 - RNA, 15 nt, Variola virus
ugaugcgauucaaaa

SEQ ID NO: 3292018 - RNA, 17 nt, Variola virus
ccuuuauuaauucucuc

SEQ ID NO: 3292019 - RNA, 13 nt, Variola virus
uguuuucaucauu

SEQ ID NO: 3292020 - RNA, 22 nt, Variola virus
agaaugcuucggaauuagaaca

SEQ ID NO: 3292021 - RNA, 14 nt, Variola virus
agcuauuuaaaugg

SEQ ID NO: 3292022 - RNA, 16 nt, Variola virus
aauacguguugauaau

SEQ ID NO: 3292023 - RNA, 17 nt, Variola virus
uguucuaaccuaucaac

SEQ ID NO: 3292024 - RNA, 13 nt, Variola virus
uaacaaagaaaga

SEQ ID NO: 3292025 - RNA, 14 nt, Variola virus
aauguuaaacauua

SEQ ID NO: 3292026 - RNA, 17 nt, Variola virus
aacaaccaaaaaaauau

SEQ ID NO: 3292027 - RNA, 17 nt, Variola virus
aucauccauuaauauaa

SEQ ID NO: 3292028 - RNA, 15 nt, Variola virus
agacaccgaauacaa

SEQ ID NO: 3292029 - RNA, 21 nt, Variola virus
uuagaucauuaacucuagaaa

SEQ ID NO: 3292030 - RNA, 17 nt, Variola virus
cugcauuaucaauaaau

SEQ ID NO: 3292031 - RNA, 19 nt, Variola virus
gaauguucucaagaacuac

SEQ ID NO: 3292032 - RNA, 18 nt, Variola virus
caucuauaggugaugcug

SEQ ID NO: 3292033 - RNA, 14 nt, Variola virus
ccaaauuaaugaau

SEQ ID NO: 3292034 - RNA, 13 nt, Variola virus
aauaccaauuuuu

SEQ ID NO: 3292035 - RNA, 13 nt, Variola virus
gcacaaugauaau

SEQ ID NO: 3292036 - RNA, 18 nt, Variola virus
caaauaucuuuaugaauu

SEQ ID NO: 3292037 - RNA, 19 nt, Variola virus
auuaucaaaagacaugaua

SEQ ID NO: 3292038 - RNA, 17 nt, Variola virus
auauggauauucauaga

SEQ ID NO: 3292039 - RNA, 13 nt, Variola virus
cuuaaugcauuuu

SEQ ID NO: 3292040 - RNA, 19 nt, Variola virus
auuuccaaacuguugacuu

SEQ ID NO: 3292041 - RNA, 21 nt, Variola virus
acauagaugaaccaaaugaua

SEQ ID NO: 3292042 - RNA, 17 nt, Variola virus
uguaugcguuaauauua

SEQ ID NO: 3292043 - RNA, 22 nt, Variola virus
auaauguuucuauguuuucuac

SEQ ID NO: 3292044 - RNA, 21 nt, Variola virus
uccauauaccaaacuuucaga

SEQ ID NO: 3292045 - RNA, 13 nt, Variola virus
ugauuuacucauu

SEQ ID NO: 3292046 - RNA, 23 nt, Variola virus
auaugguuuuuggccaaaaugau

SEQ ID NO: 3292047 - RNA, 22 nt, Variola virus
aauaaacuccguagagaaauau

SEQ ID NO: 3292048 - RNA, 20 nt, Variola virus
cacauuucagcaaucuaaca

SEQ ID NO: 3292049 - RNA, 22 nt, Variola virus
aaaacccuuacaacuacaguag

SEQ ID NO: 3292050 - RNA, 17 nt, Variola virus
acaaauauaaaaugaua

SEQ ID NO: 3292051 - RNA, 15 nt, Variola virus
gaaguuguauacuau

SEQ ID NO: 3292052 - RNA, 14 nt, Variola virus
cuaaguuucuuucc

SEQ ID NO: 3292053 - RNA, 22 nt, Variola virus
acauaguuugggaaaagaaauc

SEQ ID NO: 3292054 - RNA, 15 nt, Variola virus
cuuuucuuauccauu

SEQ ID NO: 3292055 - RNA, 13 nt, Variola virus
guaguaacucuaa

SEQ ID NO: 3292056 - RNA, 11 nt, Variola virus
aaggauaaaga

SEQ ID NO: 3292057 - RNA, 22 nt, Variola virus
uuuauauccagauccuuuucuu

SEQ ID NO: 3292058 - RNA, 14 nt, Variola virus
uuucgaauaaguuu

SEQ ID NO: 3292059 - RNA, 23 nt, Variola virus
gaguuaucacaugcaaggcauuu

SEQ ID NO: 3292060 - RNA, 22 nt, Variola virus
uuaaaaguaaucaugaaauuaa

SEQ ID NO: 3292061 - RNA, 16 nt, Variola virus
uaaaaauaauauuguu

SEQ ID NO: 3292062 - RNA, 10 nt, Variola virus
cuaaauuaau

SEQ ID NO: 3292063 - RNA, 19 nt, Variola virus
cgaagauauacacacuaau

SEQ ID NO: 3292064 - RNA, 16 nt, Variola virus
uucaaucauagaacug

SEQ ID NO: 3292065 - RNA, 15 nt, Variola virus
guaugucuuauguau

SEQ ID NO: 3292066 - RNA, 23 nt, Variola virus
aguaauaucgaauauuuuaucca

SEQ ID NO: 3292067 - RNA, 22 nt, Variola virus
acauugauuaaauuuuaauaua

SEQ ID NO: 3292068 - RNA, 16 nt, Variola virus
auacugauaaaguaga

SEQ ID NO: 3292069 - RNA, 14 nt, Variola virus
uauauagaugucaa

SEQ ID NO: 3292070 - RNA, 17 nt, Variola virus
caaauauuauacaugau

SEQ ID NO: 3292071 - RNA, 17 nt, Variola virus
auaaaccgcuauugaaa

SEQ ID NO: 3292072 - RNA, 13 nt, Variola virus
gcgauugauuuug

SEQ ID NO: 3292073 - RNA, 20 nt, Variola virus
caauacauguuuuauaaaau

SEQ ID NO: 3292074 - RNA, 17 nt, Variola virus
uauguuuuauguuuauu

SEQ ID NO: 3292075 - RNA, 22 nt, Variola virus
uaaugccuuacucgguguauau

SEQ ID NO: 3292076 - RNA, 14 nt, Variola virus
guuauuuuguuaaa

SEQ ID NO: 3292077 - RNA, 18 nt, Variola virus
acuaaagacuaugucaaa

SEQ ID NO: 3292078 - RNA, 19 nt, Variola virus
uugaaacuaggauacauaa

SEQ ID NO: 3292079 - RNA, 22 nt, Variola virus
augugucuacauaaauaugcaa

SEQ ID NO: 3292080 - RNA, 18 nt, Variola virus
aauauuaauaacauuaca

SEQ ID NO: 3292081 - RNA, 15 nt, Variola virus
uaauaauucauggaa

SEQ ID NO: 3292082 - RNA, 19 nt, Variola virus
aucuauauugcuacauaau

SEQ ID NO: 3292083 - RNA, 23 nt, Variola virus
guggaggauggucccgaugauga

SEQ ID NO: 3292084 - RNA, 21 nt, Variola virus
cucugaauauagaacaucauu

SEQ ID NO: 3292085 - RNA, 17 nt, Variola virus
aguacccuacuaccaac

SEQ ID NO: 3292086 - RNA, 16 nt, Variola virus
auauuuuuuaacuagu

SEQ ID NO: 3292087 - RNA, 17 nt, Variola virus
aacagacuguuuaugaa

SEQ ID NO: 3292088 - RNA, 20 nt, Variola virus
ccaaucaacgaauuaaugau

SEQ ID NO: 3292089 - RNA, 18 nt, Variola virus
ucauaugacauuucauga

SEQ ID NO: 3292090 - RNA, 14 nt, Variola virus
gcaccaaaguuaua

SEQ ID NO: 3292091 - RNA, 13 nt, Variola virus
auauucuaugaug

SEQ ID NO: 3292092 - RNA, 19 nt, Variola virus
aauaauuuauguauuucga

SEQ ID NO: 3292093 - RNA, 16 nt, Variola virus
aguuugaauaguuugu

SEQ ID NO: 3292094 - RNA, 15 nt, Variola virus
auuucgaaaauacua

SEQ ID NO: 3292095 - RNA, 20 nt, Variola virus
cucguuaaacgccuuuagaa

SEQ ID NO: 3292096 - RNA, 17 nt, Variola virus
aaagaaugagauacaua

SEQ ID NO: 3292097 - RNA, 15 nt, Variola virus
agaucaagaaacauu

SEQ ID NO: 3292098 - RNA, 23 nt, Variola virus
gccauuuaguuauugaaauuaau

SEQ ID NO: 3292099 - RNA, 17 nt, Variola virus
gcuauauggauauucau

SEQ ID NO: 3292100 - RNA, 13 nt, Variola virus
auccuauaacuuc

SEQ ID NO: 3292101 - RNA, 19 nt, Variola virus
aauucggaucguaaaucug

SEQ ID NO: 3292102 - RNA, 13 nt, Variola virus
cacaugaaugaaa

SEQ ID NO: 3292103 - RNA, 16 nt, Variola virus
aauaguacauuuucca

SEQ ID NO: 3292104 - RNA, 16 nt, Variola virus
uuuaguccuauuucaa

SEQ ID NO: 3292105 - RNA, 19 nt, Variola virus
auaucuuuagauauaucca

SEQ ID NO: 3292106 - RNA, 13 nt, Variola virus
guacuauaauauu

SEQ ID NO: 3292107 - RNA, 12 nt, Variola virus
cgucuauccauu

SEQ ID NO: 3292108 - RNA, 15 nt, Variola virus
uuuaguaugacauaa

SEQ ID NO: 3292109 - RNA, 13 nt, Variola virus
uuuacauuauuua

SEQ ID NO: 3292110 - RNA, 15 nt, Variola virus
aaguacucaauaaau

SEQ ID NO: 3292111 - RNA, 20 nt, Variola virus
agauucuggaggagauggau

SEQ ID NO: 3292112 - RNA, 15 nt, Variola virus
uaaaagaugauuuuc

SEQ ID NO: 3292113 - RNA, 14 nt, Variola virus
accucuacaaauau

SEQ ID NO: 3292114 - RNA, 13 nt, Variola virus
aauacaggaucua

SEQ ID NO: 3292115 - RNA, 13 nt, Variola virus
acugcauauuaag

SEQ ID NO: 3292116 - RNA, 21 nt, Variola virus
uauuaaugagugcacaacugu

SEQ ID NO: 3292117 - RNA, 17 nt, Variola virus
agaugugucauacuugu

SEQ ID NO: 3292118 - RNA, 16 nt, Variola virus
uagucuguguuacaua

SEQ ID NO: 3292119 - RNA, 16 nt, Variola virus
caaacauuauguagua

SEQ ID NO: 3292120 - RNA, 14 nt, Variola virus
augaguauauguau

SEQ ID NO: 3292121 - RNA, 14 nt, Variola virus
aagauuguuuaaga

SEQ ID NO: 3292122 - RNA, 18 nt, Variola virus
acuucuaacaaacaucuc

SEQ ID NO: 3292123 - RNA, 20 nt, Variola virus
uacuaguggauguacaugua

SEQ ID NO: 3292124 - RNA, 20 nt, Variola virus
ucacuauaagaaaucagaau

SEQ ID NO: 3292125 - RNA, 14 nt, Variola virus
aacuuugaaauugu

SEQ ID NO: 3292126 - RNA, 13 nt, Variola virus
aaaucauccacag

SEQ ID NO: 3292127 - RNA, 16 nt, Variola virus
gauaguugaucagaau

SEQ ID NO: 3292128 - RNA, 13 nt, Variola virus
agugaaacaaaau

SEQ ID NO: 3292129 - RNA, 16 nt, Variola virus
aaaguaucacagaauc

SEQ ID NO: 3292130 - RNA, 15 nt, Variola virus
uagaaaauauauucu

SEQ ID NO: 3292131 - RNA, 20 nt, Variola virus
aacauaccauggaaaaauau

SEQ ID NO: 3292132 - RNA, 15 nt, Variola virus
gauccaaaacauaga

SEQ ID NO: 3292133 - RNA, 18 nt, Variola virus
uaaaauaaauauucuuca

SEQ ID NO: 3292134 - RNA, 16 nt, Variola virus
gaaguuguauacuauc

SEQ ID NO: 3292135 - RNA, 12 nt, Variola virus
aauauuuucuau

SEQ ID NO: 3292136 - RNA, 16 nt, Variola virus
aaucaagauucauuuu

SEQ ID NO: 3292137 - RNA, 19 nt, Variola virus
ucuucucuaagagcuacgu

SEQ ID NO: 3292138 - RNA, 21 nt, Variola virus
uuugauuaccuuacucaugau

SEQ ID NO: 3292139 - RNA, 16 nt, Variola virus
agugacagauauacaa

SEQ ID NO: 3292140 - RNA, 16 nt, Variola virus
uauaauguauguuuaa

SEQ ID NO: 3292141 - RNA, 18 nt, Variola virus
auacuugucaucauuucu

SEQ ID NO: 3292142 - RNA, 18 nt, Variola virus
caaucaacggauaaucug

SEQ ID NO: 3292143 - RNA, 22 nt, Variola virus
auugucugacauaagaugucua

SEQ ID NO: 3292144 - RNA, 23 nt, Variola virus
aguaugucgaaucuaaacuagug

SEQ ID NO: 3292145 - RNA, 15 nt, Variola virus
uuaauagauuaacau

SEQ ID NO: 3292146 - RNA, 19 nt, Variola virus
auaacguaaccagaauugu

SEQ ID NO: 3292147 - RNA, 16 nt, Variola virus
agucuagguucacaau

SEQ ID NO: 3292148 - RNA, 19 nt, Variola virus
gucuauucaacacuacuau

SEQ ID NO: 3292149 - RNA, 14 nt, Variola virus
acuuacuuaauaga

SEQ ID NO: 3292150 - RNA, 24 nt, Variola virus
uagaggaagggacggauacugucu

SEQ ID NO: 3292151 - RNA, 15 nt, Variola virus
auucugaaacaguau

SEQ ID NO: 3292152 - RNA, 23 nt, Variola virus
acuccuuauuuuuagacauuaga

SEQ ID NO: 3292153 - RNA, 23 nt, Variola virus
agcauuaauaauuguuuugaauu

SEQ ID NO: 3292154 - RNA, 15 nt, Variola virus
guaauuaauagauug

SEQ ID NO: 3292155 - RNA, 19 nt, Variola virus
uauagcuauucuucuuuaa

SEQ ID NO: 3292156 - RNA, 15 nt, Variola virus
agaauuuucuagauc

SEQ ID NO: 3292157 - RNA, 18 nt, Variola virus
uaacuacggauaacaaaa

SEQ ID NO: 3292158 - RNA, 20 nt, Variola virus
ccuacacuauuauaugauua

SEQ ID NO: 3292159 - RNA, 23 nt, Variola virus
acuucuaaugagcaaguagaaaa

SEQ ID NO: 3292160 - RNA, 22 nt, Variola virus
cugaggauuuacuaaguaauua

SEQ ID NO: 3292161 - RNA, 15 nt, Variola virus
uuguaagguuguaaa

SEQ ID NO: 3292162 - RNA, 14 nt, Variola virus
caaaauccaaauuu

SEQ ID NO: 3292163 - RNA, 13 nt, Variola virus
aaauaagagacuu

SEQ ID NO: 3292164 - RNA, 22 nt, Variola virus
acuugguauuuggaaauuagug

SEQ ID NO: 3292165 - RNA, 14 nt, Variola virus
gucaacaaaaaugu

SEQ ID NO: 3292166 - RNA, 14 nt, Variola virus
caugcucuauuuug

SEQ ID NO: 3292167 - RNA, 18 nt, Variola virus
aauaauugcgaauguuuu

SEQ ID NO: 3292168 - RNA, 15 nt, Variola virus
auaauaucuuguucu

SEQ ID NO: 3292169 - RNA, 18 nt, Variola virus
uguauaaaaacagaaaua

SEQ ID NO: 3292170 - RNA, 17 nt, Variola virus
agcauagaggaugaauu

SEQ ID NO: 3292171 - RNA, 14 nt, Variola virus
auacuuuguaacua

SEQ ID NO: 3292172 - RNA, 13 nt, Variola virus
agaguucauuuau

SEQ ID NO: 3292173 - RNA, 14 nt, Variola virus
caaaaaauccugua

SEQ ID NO: 3292174 - RNA, 20 nt, Variola virus
caucuacgccuuuaaauccu

SEQ ID NO: 3292175 - RNA, 14 nt, Variola virus
ucucaagauuuuaa

SEQ ID NO: 3292176 - RNA, 21 nt, Variola virus
caauaucuucguaaaaagauu

SEQ ID NO: 3292177 - RNA, 23 nt, Variola virus
caaauuuuuucuuuaauauuuua

SEQ ID NO: 3292178 - RNA, 17 nt, Variola virus
uaagauuguagaaucag

SEQ ID NO: 3292179 - RNA, 21 nt, Variola virus
uuacaagauaucucuggauau

SEQ ID NO: 3292180 - RNA, 16 nt, Variola virus
uaauaauagaaaccau

SEQ ID NO: 3292181 - RNA, 15 nt, Variola virus
acauaugguauuauu

SEQ ID NO: 3292182 - RNA, 21 nt, Variola virus
uauagagcacuauuucuaaau

SEQ ID NO: 3292183 - RNA, 23 nt, Variola virus
cuuaaaaucgguagaaucauauu

SEQ ID NO: 3292184 - RNA, 21 nt, Variola virus
gauugcauauuauauuuuaua

SEQ ID NO: 3292185 - RNA, 15 nt, Variola virus
auccaucaaaaaaca

SEQ ID NO: 3292186 - RNA, 15 nt, Variola virus
uaauagcgucuacau

SEQ ID NO: 3292187 - RNA, 22 nt, Variola virus
uugauuucgaauacgauacuua

SEQ ID NO: 3292188 - RNA, 13 nt, Variola virus
gcgcuaucuuuua

SEQ ID NO: 3292189 - RNA, 20 nt, Variola virus
cuaauaaacauuccacauuc

SEQ ID NO: 3292190 - RNA, 14 nt, Variola virus
gaucugaguaauau

SEQ ID NO: 3292191 - RNA, 16 nt, Variola virus
gaagcauuggaagcaa

SEQ ID NO: 3292192 - RNA, 16 nt, Variola virus
acugacagauguguuc

SEQ ID NO: 3292193 - RNA, 12 nt, Variola virus
agagauuuuacu

SEQ ID NO: 3292194 - RNA, 22 nt, Variola virus
aggauaugauaaaaauauaauu

SEQ ID NO: 3292195 - RNA, 22 nt, Variola virus
auaacaauuaacaauuaucaaa

SEQ ID NO: 3292196 - RNA, 23 nt, Variola virus
acaaaucuauuuggauuuuuugc

SEQ ID NO: 3292197 - RNA, 11 nt, Variola virus
cucuaaaugag

SEQ ID NO: 3292198 - RNA, 16 nt, Variola virus
aacuauuuucaguaau

SEQ ID NO: 3292199 - RNA, 13 nt, Variola virus
aacaaucaagaag

SEQ ID NO: 3292200 - RNA, 12 nt, Variola virus
auuuuuaucaug

SEQ ID NO: 3292201 - RNA, 18 nt, Variola virus
uucugcauuacaaagaag

SEQ ID NO: 3292202 - RNA, 19 nt, Variola virus
uacuaugcacauuauucua

SEQ ID NO: 3292203 - RNA, 13 nt, Variola virus
cuaauaaacauuc

SEQ ID NO: 3292204 - RNA, 19 nt, Variola virus
gccuauaaaguaauaaucu

SEQ ID NO: 3292205 - RNA, 21 nt, Variola virus
auccaacuuaacaaaucuuaa

SEQ ID NO: 3292206 - RNA, 15 nt, Variola virus
accuauuuacuggug

SEQ ID NO: 3292207 - RNA, 14 nt, Variola virus
uucucuaaaugaug

SEQ ID NO: 3292208 - RNA, 22 nt, Variola virus
gugguaaguuauacacuaaaag

SEQ ID NO: 3292209 - RNA, 14 nt, Variola virus
cuguauuguuaaua

SEQ ID NO: 3292210 - RNA, 15 nt, Variola virus
uauaucguuaucauc

SEQ ID NO: 3292211 - RNA, 16 nt, Variola virus
aaggaauugaugaagu

SEQ ID NO: 3292212 - RNA, 14 nt, Variola virus
gaauuuaguaauau

SEQ ID NO: 3292213 - RNA, 15 nt, Variola virus
uuaacuuuauacuuu

SEQ ID NO: 3292214 - RNA, 14 nt, Variola virus
cagaaauaugugaa

SEQ ID NO: 3292215 - RNA, 22 nt, Variola virus
agguuuugcaacauguuaaaau

SEQ ID NO: 3292216 - RNA, 21 nt, Variola virus
aguaucuagccauaucuaaag

SEQ ID NO: 3292217 - RNA, 14 nt, Variola virus
aguagguuuaagaa

SEQ ID NO: 3292218 - RNA, 13 nt, Variola virus
gccucaaauguag

SEQ ID NO: 3292219 - RNA, 18 nt, Variola virus
augaaaucuaucuuauau

SEQ ID NO: 3292220 - RNA, 18 nt, Variola virus
uauuacguacauaacauu

SEQ ID NO: 3292221 - RNA, 19 nt, Variola virus
aguagaaaauaauauagau

SEQ ID NO: 3292222 - RNA, 21 nt, Variola virus
guuaauuauuucuaacauuga

SEQ ID NO: 3292223 - RNA, 15 nt, Variola virus
ucgcuuucauaguua

SEQ ID NO: 3292224 - RNA, 12 nt, Variola virus
aagaauaaauua

SEQ ID NO: 3292225 - RNA, 14 nt, Variola virus
uccuguaauacuuu

SEQ ID NO: 3292226 - RNA, 13 nt, Variola virus
caagaaugauauc

SEQ ID NO: 3292227 - RNA, 18 nt, Variola virus
auuacucuccuagguuuc

SEQ ID NO: 3292228 - RNA, 22 nt, Variola virus
acucagauaauagcaauauuag

SEQ ID NO: 3292229 - RNA, 21 nt, Variola virus
cauauauuucgugauauacau

SEQ ID NO: 3292230 - RNA, 21 nt, Variola virus
acugucacuggaaagaugaua

SEQ ID NO: 3292231 - RNA, 22 nt, Variola virus
uauaaucaguagcguguuuuaa

SEQ ID NO: 3292232 - RNA, 15 nt, Variola virus
gaaauugauaaugag

SEQ ID NO: 3292233 - RNA, 18 nt, Variola virus
acggaugcagaugucuuu

SEQ ID NO: 3292234 - RNA, 18 nt, Variola virus
aaaguacuguucauacau

SEQ ID NO: 3292235 - RNA, 21 nt, Variola virus
uccaugcaacauuuccuacau

SEQ ID NO: 3292236 - RNA, 17 nt, Variola virus
gauauauccacuucuuc

SEQ ID NO: 3292237 - RNA, 14 nt, Variola virus
gaauguguauucuc

SEQ ID NO: 3292238 - RNA, 19 nt, Variola virus
ucacaacaucuauaaaagu

SEQ ID NO: 3292239 - RNA, 21 nt, Variola virus
acacgaaagaaucaaaagaau

SEQ ID NO: 3292240 - RNA, 18 nt, Variola virus
cugauagcaauucaugua

SEQ ID NO: 3292241 - RNA, 18 nt, Variola virus
auaaaggauacguuguau

SEQ ID NO: 3292242 - RNA, 18 nt, Variola virus
ugagaugacuggaaauca

SEQ ID NO: 3292243 - RNA, 17 nt, Variola virus
gagacgaucuacuauca

SEQ ID NO: 3292244 - RNA, 14 nt, Variola virus
acuaaaucuucaca

SEQ ID NO: 3292245 - RNA, 18 nt, Variola virus
agacaaugcuaauauauu

SEQ ID NO: 3292246 - RNA, 10 nt, Variola virus
cgauauuaau

SEQ ID NO: 3292247 - RNA, 22 nt, Variola virus
gaauaacuuugauaauaaggau

SEQ ID NO: 3292248 - RNA, 21 nt, Variola virus
uucuuuaauuauauggcacug

SEQ ID NO: 3292249 - RNA, 15 nt, Variola virus
guuuguuuuggaaau

SEQ ID NO: 3292250 - RNA, 19 nt, Variola virus
aacaagaucgauagacacu

SEQ ID NO: 3292251 - RNA, 16 nt, Variola virus
uagaucugaauuaaau

SEQ ID NO: 3292252 - RNA, 18 nt, Variola virus
acucauauaguauugaac

SEQ ID NO: 3292253 - RNA, 17 nt, Variola virus
uaacguugguauuauau

SEQ ID NO: 3292254 - RNA, 19 nt, Variola virus
uaaguauucacaaacggga

SEQ ID NO: 3292255 - RNA, 15 nt, Variola virus
agaacacaugucuua

SEQ ID NO: 3292256 - RNA, 21 nt, Variola virus
gaaauaaccgcaugauuauuu

SEQ ID NO: 3292257 - RNA, 14 nt, Variola virus
aacccauaaauaca

SEQ ID NO: 3292258 - RNA, 22 nt, Variola virus
uaauauucauucaauauuuaca

SEQ ID NO: 3292259 - RNA, 22 nt, Variola virus
gugaguuugaauuuucuacauc

SEQ ID NO: 3292260 - RNA, 15 nt, Variola virus
auuuugacuuacaua

SEQ ID NO: 3292261 - RNA, 18 nt, Variola virus
uagcucuguauucuguau

SEQ ID NO: 3292262 - RNA, 20 nt, Variola virus
caaauuugacuacauucagg

SEQ ID NO: 3292263 - RNA, 13 nt, Variola virus
cagaaaagauauu

SEQ ID NO: 3292264 - RNA, 19 nt, Variola virus
aaacuugauaauuaauaau

SEQ ID NO: 3292265 - RNA, 21 nt, Variola virus
aucugugacagauaucaucuu

SEQ ID NO: 3292266 - RNA, 23 nt, Variola virus
aauucucggauagucuucuuauc

SEQ ID NO: 3292267 - RNA, 17 nt, Variola virus
ucaaagcaucaaaauag

SEQ ID NO: 3292268 - RNA, 20 nt, Variola virus
augcauuggcaucaaaagaa

SEQ ID NO: 3292269 - RNA, 18 nt, Variola virus
aacaucaacugaaaaagu

SEQ ID NO: 3292270 - RNA, 14 nt, Variola virus
uaguuuuaagaaag

SEQ ID NO: 3292271 - RNA, 22 nt, Variola virus
uuuguguuugacuguuuguacu

SEQ ID NO: 3292272 - RNA, 22 nt, Variola virus
uaacuuuuauuuuuagaaagua

SEQ ID NO: 3292273 - RNA, 18 nt, Variola virus
auucauuaauuuucaguc

SEQ ID NO: 3292274 - RNA, 19 nt, Variola virus
aaguauuugaacauguaga

SEQ ID NO: 3292275 - RNA, 15 nt, Variola virus
aaucuacucacauau

SEQ ID NO: 3292276 - RNA, 13 nt, Variola virus
acguauuaaauau

SEQ ID NO: 3292277 - RNA, 15 nt, Variola virus
aaugauaauaggaau

SEQ ID NO: 3292278 - RNA, 16 nt, Variola virus
acaaaucacugaaaau

SEQ ID NO: 3292279 - RNA, 16 nt, Variola virus
guugcaauauacauaa

SEQ ID NO: 3292280 - RNA, 16 nt, Variola virus
caguucguuuaacgau

SEQ ID NO: 3292281 - RNA, 15 nt, Variola virus
acauaacuuguacag

SEQ ID NO: 3292282 - RNA, 17 nt, Variola virus
uuauccauuuauacauu

SEQ ID NO: 3292283 - RNA, 17 nt, Variola virus
aauuauauaauucuauu

SEQ ID NO: 3292284 - RNA, 14 nt, Variola virus
uauccucaaacauc

SEQ ID NO: 3292285 - RNA, 13 nt, Variola virus
uguaaaaugacuc

SEQ ID NO: 3292286 - RNA, 19 nt, Variola virus
ucagacgaguguaaacacu

SEQ ID NO: 3292287 - RNA, 19 nt, Variola virus
aucaaaaucguauaaaguu

SEQ ID NO: 3292288 - RNA, 18 nt, Variola virus
aauuccggcggcgguacc

SEQ ID NO: 3292289 - RNA, 13 nt, Variola virus
uuuuguacauaau

SEQ ID NO: 3292290 - RNA, 14 nt, Variola virus
aauuccauuauucu

SEQ ID NO: 3292291 - RNA, 15 nt, Variola virus
acuauagaucuuuca

SEQ ID NO: 3292292 - RNA, 21 nt, Variola virus
agaacuuaugaccguaauaaa

SEQ ID NO: 3292293 - RNA, 17 nt, Variola virus
aaugaguaaguucuaua

SEQ ID NO: 3292294 - RNA, 18 nt, Variola virus
uaauucauuuucaauaau

SEQ ID NO: 3292295 - RNA, 13 nt, Variola virus
aaaauaaaguuau

SEQ ID NO: 3292296 - RNA, 21 nt, Variola virus
ugauauuggagcaaaauccua

SEQ ID NO: 3292297 - RNA, 16 nt, Variola virus
uaauaaauugguaaau

SEQ ID NO: 3292298 - RNA, 16 nt, Variola virus
caaugacgaugauaug

SEQ ID NO: 3292299 - RNA, 14 nt, Variola virus
uuggcaaaaacgga

SEQ ID NO: 3292300 - RNA, 20 nt, Variola virus
uauuggaaaggcguuaucua

SEQ ID NO: 3292301 - RNA, 13 nt, Variola virus
aaucauaaccauu

SEQ ID NO: 3292302 - RNA, 23 nt, Variola virus
aaugagguguacagcacaugaua

SEQ ID NO: 3292303 - RNA, 13 nt, Variola virus
uuuccuuaucauu

SEQ ID NO: 3292304 - RNA, 20 nt, Variola virus
guucucaagaacuacaaaag

SEQ ID NO: 3292305 - RNA, 14 nt, Variola virus
guacucuuaagaga

SEQ ID NO: 3292306 - RNA, 14 nt, Variola virus
aucuacaauuauug

SEQ ID NO: 3292307 - RNA, 18 nt, Variola virus
ucgacguugcucaaaguc

SEQ ID NO: 3292308 - RNA, 17 nt, Variola virus
auuuguucaagauagau

SEQ ID NO: 3292309 - RNA, 16 nt, Variola virus
cuaauggaugucaaug

SEQ ID NO: 3292310 - RNA, 19 nt, Variola virus
aaucaagggaaaaucugaa

SEQ ID NO: 3292311 - RNA, 17 nt, Variola virus
auuucguucucugaaaa

SEQ ID NO: 3292312 - RNA, 22 nt, Variola virus
agcauagauccgugagaaauac

SEQ ID NO: 3292313 - RNA, 23 nt, Variola virus
aaaugauucuaucuacaucuuca

SEQ ID NO: 3292314 - RNA, 13 nt, Variola virus
aauauuacuacau

SEQ ID NO: 3292315 - RNA, 14 nt, Variola virus
auugcgacacuauu

SEQ ID NO: 3292316 - RNA, 21 nt, Variola virus
gucuaaacguuguuuacucau

SEQ ID NO: 3292317 - RNA, 17 nt, Variola virus
augaaacgaacacuauu

SEQ ID NO: 3292318 - RNA, 18 nt, Variola virus
auuuuugcaucauuuacg

SEQ ID NO: 3292319 - RNA, 22 nt, Variola virus
cagugguuuuauuuuauccuug

SEQ ID NO: 3292320 - RNA, 20 nt, Variola virus
ucguucugcuaaauuuucau

SEQ ID NO: 3292321 - RNA, 16 nt, Variola virus
agaugaaucaaaugua

SEQ ID NO: 3292322 - RNA, 22 nt, Variola virus
auucuagugccgaacauuaaca

SEQ ID NO: 3292323 - RNA, 19 nt, Variola virus
uguaaauauuacugguaua

SEQ ID NO: 3292324 - RNA, 22 nt, Variola virus
acaauagugucuacuuaaaugu

SEQ ID NO: 3292325 - RNA, 21 nt, Variola virus
aagacagagauacuaaauaua

SEQ ID NO: 3292326 - RNA, 19 nt, Variola virus
uccgacaugcaaaaaugcu

SEQ ID NO: 3292327 - RNA, 17 nt, Variola virus
auuuaauacguucauua

SEQ ID NO: 3292328 - RNA, 17 nt, Variola virus
auaaccuccugaaaaug

SEQ ID NO: 3292329 - RNA, 19 nt, Variola virus
uaguaacggacuuaacaug

SEQ ID NO: 3292330 - RNA, 17 nt, Variola virus
aauaucuuuaauccaau

SEQ ID NO: 3292331 - RNA, 17 nt, Variola virus
uggucauaauagaaugu

SEQ ID NO: 3292332 - RNA, 15 nt, Variola virus
aauacuuuacgcuau

SEQ ID NO: 3292333 - RNA, 19 nt, Variola virus
uuuaaaauuagaucuuuua

SEQ ID NO: 3292334 - RNA, 22 nt, Variola virus
uguauucaacaugcuuuucuau

SEQ ID NO: 3292335 - RNA, 14 nt, Variola virus
auccaagucaauau

SEQ ID NO: 3292336 - RNA, 13 nt, Variola virus
uacauacuaauau

SEQ ID NO: 3292337 - RNA, 15 nt, Variola virus
uuaauuuauuauuga

SEQ ID NO: 3292338 - RNA, 22 nt, Variola virus
agaacuuaacuuuuucuuucuc

SEQ ID NO: 3292339 - RNA, 16 nt, Variola virus
cuggaggagauggauu

SEQ ID NO: 3292340 - RNA, 15 nt, Variola virus
agauauccagaguuu

SEQ ID NO: 3292341 - RNA, 22 nt, Variola virus
accuaaauaauuauacuuugua

SEQ ID NO: 3292342 - RNA, 12 nt, Variola virus
uaaagauauucu

SEQ ID NO: 3292343 - RNA, 21 nt, Variola virus
cuugagagacaugauucagaa

SEQ ID NO: 3292344 - RNA, 22 nt, Variola virus
guuucaaagcaauuguauuauu

SEQ ID NO: 3292345 - RNA, 18 nt, Variola virus
uuuagaugaauuauuauu

SEQ ID NO: 3292346 - RNA, 18 nt, Variola virus
auuucaaggacaaaauga

SEQ ID NO: 3292347 - RNA, 17 nt, Variola virus
uuuauccuauuauguaa

SEQ ID NO: 3292348 - RNA, 17 nt, Variola virus
uaaacauugauuaaauu

SEQ ID NO: 3292349 - RNA, 13 nt, Variola virus
ucggguacaaaag

SEQ ID NO: 3292350 - RNA, 19 nt, Variola virus
aaaacugguuaaaacagua

SEQ ID NO: 3292351 - RNA, 13 nt, Variola virus
cucagaaagauau

SEQ ID NO: 3292352 - RNA, 20 nt, Variola virus
ggauauaaacuaauauggau

SEQ ID NO: 3292353 - RNA, 13 nt, Variola virus
agaauauauguau

SEQ ID NO: 3292354 - RNA, 15 nt, Variola virus
aacuaguguagaaaa

SEQ ID NO: 3292355 - RNA, 23 nt, Variola virus
aauuucuaaaggagcaaauguua

SEQ ID NO: 3292356 - RNA, 17 nt, Variola virus
ugauuucugaauuauug

SEQ ID NO: 3292357 - RNA, 23 nt, Variola virus
augacuuauaaaaauacuaaaac

SEQ ID NO: 3292358 - RNA, 14 nt, Variola virus
auuaccacuuucca

SEQ ID NO: 3292359 - RNA, 17 nt, Variola virus
auuucguuaaaacauuc

SEQ ID NO: 3292360 - RNA, 16 nt, Variola virus
uugcauauuuaucuuu

SEQ ID NO: 3292361 - RNA, 18 nt, Variola virus
aggcacuaaugcaaauua

SEQ ID NO: 3292362 - RNA, 22 nt, Variola virus
guguauuacaugcaucuuauua

SEQ ID NO: 3292363 - RNA, 14 nt, Variola virus
uuuaacuuuucauu

SEQ ID NO: 3292364 - RNA, 12 nt, Variola virus
uuacagagacuu

SEQ ID NO: 3292365 - RNA, 23 nt, Variola virus
ucacuuauagauagauaguacau

SEQ ID NO: 3292366 - RNA, 12 nt, Variola virus
caauuaaaucau

SEQ ID NO: 3292367 - RNA, 22 nt, Variola virus
gacuuguuaaaucuauauacca

SEQ ID NO: 3292368 - RNA, 19 nt, Variola virus
aaauacuacagaaacuaau

SEQ ID NO: 3292369 - RNA, 15 nt, Variola virus
uaaucguuauuauca

SEQ ID NO: 3292370 - RNA, 13 nt, Variola virus
gauaauaauacac

SEQ ID NO: 3292371 - RNA, 13 nt, Variola virus
cgcuguaucacaa

SEQ ID NO: 3292372 - RNA, 16 nt, Variola virus
agucuuggucuauuau

SEQ ID NO: 3292373 - RNA, 22 nt, Variola virus
uaucuuuaacuaagucaauuau

SEQ ID NO: 3292374 - RNA, 17 nt, Variola virus
auuggaacuaguauuua

SEQ ID NO: 3292375 - RNA, 16 nt, Variola virus
ggugagaacaugagac

SEQ ID NO: 3292376 - RNA, 21 nt, Variola virus
cuaucaaccacauaauacaau

SEQ ID NO: 3292377 - RNA, 20 nt, Variola virus
cuguacuaucuagagauugu

SEQ ID NO: 3292378 - RNA, 19 nt, Variola virus
uauagagcacuauuucuaa

SEQ ID NO: 3292379 - RNA, 18 nt, Variola virus
auauuacuaauugauaga

SEQ ID NO: 3292380 - RNA, 20 nt, Variola virus
auugauuauuucaaagacua

SEQ ID NO: 3292381 - RNA, 22 nt, Variola virus
uaauaucaaacgguaacacauc

SEQ ID NO: 3292382 - RNA, 20 nt, Variola virus
uuagcauauaccucauuaac

SEQ ID NO: 3292383 - RNA, 15 nt, Variola virus
auuguauuaugauga

SEQ ID NO: 3292384 - RNA, 14 nt, Variola virus
cgauaauauauuua

SEQ ID NO: 3292385 - RNA, 18 nt, Variola virus
acuacauacgcgacugua

SEQ ID NO: 3292386 - RNA, 12 nt, Variola virus
uuuuauaaacau

SEQ ID NO: 3292387 - RNA, 20 nt, Variola virus
ucguggauaaucauucuuaa

SEQ ID NO: 3292388 - RNA, 17 nt, Variola virus
ucgauacaucaacucuc

SEQ ID NO: 3292389 - RNA, 15 nt, Variola virus
aauaaguauauaaau

SEQ ID NO: 3292390 - RNA, 12 nt, Variola virus
caaucuaucuau

SEQ ID NO: 3292391 - RNA, 16 nt, Variola virus
agauuucaaagauguu

SEQ ID NO: 3292392 - RNA, 19 nt, Variola virus
gacuguagaacucaugaau

SEQ ID NO: 3292393 - RNA, 22 nt, Variola virus
cgauaauuguuucauauguuuu

SEQ ID NO: 3292394 - RNA, 21 nt, Variola virus
gcguauggcaaacgaaggaaa

SEQ ID NO: 3292395 - RNA, 13 nt, Variola virus
auaauuuugugaa

SEQ ID NO: 3292396 - RNA, 16 nt, Variola virus
cuagaugguuauuuac

SEQ ID NO: 3292397 - RNA, 17 nt, Variola virus
uuaauauaugauuauca

SEQ ID NO: 3292398 - RNA, 17 nt, Variola virus
aagucuuaaaaauacuu

SEQ ID NO: 3292399 - RNA, 21 nt, Variola virus
auaaaugcucugcaauaacua

SEQ ID NO: 3292400 - RNA, 22 nt, Variola virus
guaauauccucuauuauacauu

SEQ ID NO: 3292401 - RNA, 13 nt, Variola virus
uuccaucauuaac

SEQ ID NO: 3292402 - RNA, 13 nt, Variola virus
aaguugaucucaa

SEQ ID NO: 3292403 - RNA, 22 nt, Variola virus
aauaucuccacgauucaggaau

SEQ ID NO: 3292404 - RNA, 16 nt, Variola virus
acauauuuauaauuua

SEQ ID NO: 3292405 - RNA, 14 nt, Variola virus
aauauaugauuauc

SEQ ID NO: 3292406 - RNA, 18 nt, Variola virus
uaaaugagaugagaagau

SEQ ID NO: 3292407 - RNA, 13 nt, Variola virus
auuaaugagauug

SEQ ID NO: 3292408 - RNA, 15 nt, Variola virus
gggaggcuugaagug

SEQ ID NO: 3292409 - RNA, 18 nt, Variola virus
aauagauagucuaccauu

SEQ ID NO: 3292410 - RNA, 17 nt, Variola virus
aaauauuguuaaauaau

SEQ ID NO: 3292411 - RNA, 13 nt, Variola virus
auaggaucuauau

SEQ ID NO: 3292412 - RNA, 18 nt, Variola virus
gauaaacacucauauuau

SEQ ID NO: 3292413 - RNA, 13 nt, Variola virus
uauucuuaaaugu

SEQ ID NO: 3292414 - RNA, 15 nt, Variola virus
aacuuaaacaaaaua

SEQ ID NO: 3292415 - RNA, 14 nt, Variola virus
aauacguaaaacuc

SEQ ID NO: 3292416 - RNA, 13 nt, Variola virus
caugcuaccuaau

SEQ ID NO: 3292417 - RNA, 23 nt, Variola virus
auuaucguuccugguauauagau

SEQ ID NO: 3292418 - RNA, 13 nt, Variola virus
ggcaaaagaauac

SEQ ID NO: 3292419 - RNA, 18 nt, Variola virus
uauaaucuagccaacaau

SEQ ID NO: 3292420 - RNA, 18 nt, Variola virus
auaaauuaucaaauacuu

SEQ ID NO: 3292421 - RNA, 15 nt, Variola virus
cuauuuuaucauuuu

SEQ ID NO: 3292422 - RNA, 20 nt, Variola virus
uaaacgcgucaaauuuuuca

SEQ ID NO: 3292423 - RNA, 22 nt, Variola virus
uuagagaacauacauuuguaaa

SEQ ID NO: 3292424 - RNA, 12 nt, Variola virus
uaucuucucaaa

SEQ ID NO: 3292425 - RNA, 21 nt, Variola virus
cgaaauaguuaauaauucugu

SEQ ID NO: 3292426 - RNA, 23 nt, Variola virus
ugucuagaacggcaauugucuua

SEQ ID NO: 3292427 - RNA, 12 nt, Variola virus
ucauuugaaaau

SEQ ID NO: 3292428 - RNA, 13 nt, Variola virus
uguaagauacuug

SEQ ID NO: 3292429 - RNA, 18 nt, Variola virus
acuuacauggacacauuc

SEQ ID NO: 3292430 - RNA, 14 nt, Variola virus
acacauaacugaag

SEQ ID NO: 3292431 - RNA, 20 nt, Variola virus
uauuuguacacaucuaucaa

SEQ ID NO: 3292432 - RNA, 18 nt, Variola virus
cgaauaaguuugcagaca

SEQ ID NO: 3292433 - RNA, 14 nt, Variola virus
guauuaauaauauc

SEQ ID NO: 3292434 - RNA, 17 nt, Variola virus
gcgaucugaauaaacaa

SEQ ID NO: 3292435 - RNA, 17 nt, Variola virus
guuucaucaauagaaga

SEQ ID NO: 3292436 - RNA, 19 nt, Variola virus
uaguugauagaacaaaaua

SEQ ID NO: 3292437 - RNA, 14 nt, Variola virus
cagaccucucuuaa

SEQ ID NO: 3292438 - RNA, 22 nt, Variola virus
auucuugaaacuuuucagaaua

SEQ ID NO: 3292439 - RNA, 17 nt, Variola virus
aucggagcuacauuacc

SEQ ID NO: 3292440 - RNA, 13 nt, Variola virus
aucagaucauauu

SEQ ID NO: 3292441 - RNA, 20 nt, Variola virus
guagcaaagaaauuaauaga

SEQ ID NO: 3292442 - RNA, 21 nt, Variola virus
auguuuauuagcguacacauu

SEQ ID NO: 3292443 - RNA, 13 nt, Variola virus
agaacccuuaaua

SEQ ID NO: 3292444 - RNA, 13 nt, Variola virus
acagauuaauagu

SEQ ID NO: 3292445 - RNA, 13 nt, Variola virus
acaguuuaauaga

SEQ ID NO: 3292446 - RNA, 14 nt, Variola virus
ugaauuguuucuuu

SEQ ID NO: 3292447 - RNA, 19 nt, Variola virus
caaugccaucuuacaugau

SEQ ID NO: 3292448 - RNA, 14 nt, Variola virus
ugaggauaaugcua

SEQ ID NO: 3292449 - RNA, 14 nt, Variola virus
auauuguagcauua

SEQ ID NO: 3292450 - RNA, 20 nt, Variola virus
uugcuuugguuuaauuauuu

SEQ ID NO: 3292451 - RNA, 14 nt, Variola virus
agacuaugggaaua

SEQ ID NO: 3292452 - RNA, 17 nt, Variola virus
uguuuucaccaugacuu

SEQ ID NO: 3292453 - RNA, 13 nt, Variola virus
uagugauuuugaa

SEQ ID NO: 3292454 - RNA, 21 nt, Variola virus
cuauauagcuauucuucuuua

SEQ ID NO: 3292455 - RNA, 18 nt, Variola virus
aauuuauuaauacaggau

SEQ ID NO: 3292456 - RNA, 16 nt, Variola virus
uugcauacaauacuag

SEQ ID NO: 3292457 - RNA, 16 nt, Variola virus
aauacacccaauaaua

SEQ ID NO: 3292458 - RNA, 17 nt, Variola virus
uaggcacagucaaacau

SEQ ID NO: 3292459 - RNA, 17 nt, Variola virus
gcuaugaaggaaagaca

SEQ ID NO: 3292460 - RNA, 15 nt, Variola virus
aaggcacuaugucca

SEQ ID NO: 3292461 - RNA, 23 nt, Variola virus
acaaauaauagguuguaauacau

SEQ ID NO: 3292462 - RNA, 15 nt, Variola virus
uuaauguuuuaaauu

SEQ ID NO: 3292463 - RNA, 16 nt, Variola virus
agauaugccaaaauca

SEQ ID NO: 3292464 - RNA, 16 nt, Variola virus
auacgaggaugaugau

SEQ ID NO: 3292465 - RNA, 22 nt, Variola virus
aacgccuauucgaaauuagaaa

SEQ ID NO: 3292466 - RNA, 18 nt, Variola virus
uacacaucagcaucuuga

SEQ ID NO: 3292467 - RNA, 14 nt, Variola virus
uuuagaauuuccaa

SEQ ID NO: 3292468 - RNA, 17 nt, Variola virus
gaauaucuacaauauau

SEQ ID NO: 3292469 - RNA, 16 nt, Variola virus
acuuacugacaaaguu

SEQ ID NO: 3292470 - RNA, 16 nt, Variola virus
auaauggugcuuguau

SEQ ID NO: 3292471 - RNA, 15 nt, Variola virus
agauccaucuacuuu

SEQ ID NO: 3292472 - RNA, 20 nt, Variola virus
uuuucuugagagacaugauu

SEQ ID NO: 3292473 - RNA, 14 nt, Variola virus
aaucuuaauaucuu

SEQ ID NO: 3292474 - RNA, 18 nt, Variola virus
aaauaggcguacaaaagg

SEQ ID NO: 3292475 - RNA, 14 nt, Variola virus
cgcuguauauggaa

SEQ ID NO: 3292476 - RNA, 18 nt, Variola virus
gagauguuauuaaauguu

SEQ ID NO: 3292477 - RNA, 19 nt, Variola virus
gaaaugggucauauuauca

SEQ ID NO: 3292478 - RNA, 17 nt, Variola virus
auaucuuagaauauugu

SEQ ID NO: 3292479 - RNA, 12 nt, Variola virus
cauucuauuuuu

SEQ ID NO: 3292480 - RNA, 14 nt, Variola virus
aaacuaauucuguc

SEQ ID NO: 3292481 - RNA, 16 nt, Variola virus
uacagaaacaaugauu

SEQ ID NO: 3292482 - RNA, 19 nt, Variola virus
caaaacaacauauacacau

SEQ ID NO: 3292483 - RNA, 19 nt, Variola virus
uguaaauagaacauacuuu

SEQ ID NO: 3292484 - RNA, 20 nt, Variola virus
caaaagacguaaauauucua

SEQ ID NO: 3292485 - RNA, 23 nt, Variola virus
agaauauaaauuauauauggauu

SEQ ID NO: 3292486 - RNA, 14 nt, Variola virus
uuuauauuuuucuu

SEQ ID NO: 3292487 - RNA, 13 nt, Variola virus
caaaaagacuaua

SEQ ID NO: 3292488 - RNA, 19 nt, Variola virus
aucuuguuauaaacacaca

SEQ ID NO: 3292489 - RNA, 20 nt, Variola virus
uuguacauuaauaaaugaaa

SEQ ID NO: 3292490 - RNA, 20 nt, Variola virus
gauacaauuagauauaucua

SEQ ID NO: 3292491 - RNA, 23 nt, Variola virus
uuuuucguuuacaaaaucaaaua

SEQ ID NO: 3292492 - RNA, 18 nt, Variola virus
aucauaucuucgaaaguu

SEQ ID NO: 3292493 - RNA, 17 nt, Variola virus
accauauagaucaauca

SEQ ID NO: 3292494 - RNA, 18 nt, Variola virus
ccaacauguauauuugga

SEQ ID NO: 3292495 - RNA, 12 nt, Variola virus
caucugucauau

SEQ ID NO: 3292496 - RNA, 14 nt, Variola virus
cauuauaaaaagug

SEQ ID NO: 3292497 - RNA, 16 nt, Variola virus
uaaaaauacaucuguu

SEQ ID NO: 3292498 - RNA, 17 nt, Variola virus
ucccccuuaucaguaga

SEQ ID NO: 3292499 - RNA, 14 nt, Variola virus
aaagauagaaauga

SEQ ID NO: 3292500 - RNA, 22 nt, Variola virus
cccauuuuuugcuuucuguauc

SEQ ID NO: 3292501 - RNA, 13 nt, Variola virus
auauaacauagaa

SEQ ID NO: 3292502 - RNA, 12 nt, Variola virus
auuaauauuaac

SEQ ID NO: 3292503 - RNA, 13 nt, Variola virus
ccauagaggaugu

SEQ ID NO: 3292504 - RNA, 15 nt, Variola virus
auucacgcuuccaaa

SEQ ID NO: 3292505 - RNA, 23 nt, Variola virus
acuuuaaaguuguuaaaaaauua

SEQ ID NO: 3292506 - RNA, 22 nt, Variola virus
aaguuuucuuucaaaauagcua

SEQ ID NO: 3292507 - RNA, 19 nt, Variola virus
auuacagcguaaaacacau

SEQ ID NO: 3292508 - RNA, 13 nt, Variola virus
uuaauauauguca

SEQ ID NO: 3292509 - RNA, 15 nt, Variola virus
aaugauuuuggaaaa

SEQ ID NO: 3292510 - RNA, 23 nt, Variola virus
uaccuaauauaaaucaaauacuu

SEQ ID NO: 3292511 - RNA, 16 nt, Variola virus
uuucagaaucuagauu

SEQ ID NO: 3292512 - RNA, 18 nt, Variola virus
aguugaacagaugauaua

SEQ ID NO: 3292513 - RNA, 13 nt, Variola virus
auauagcauagau

SEQ ID NO: 3292514 - RNA, 17 nt, Variola virus
augaucaagaaggaaau

SEQ ID NO: 3292515 - RNA, 12 nt, Variola virus
gucuagaaauaa

SEQ ID NO: 3292516 - RNA, 17 nt, Variola virus
uuacuacauucauuaau

SEQ ID NO: 3292517 - RNA, 19 nt, Variola virus
agauuccugacuacuaacg

SEQ ID NO: 3292518 - RNA, 23 nt, Variola virus
gaaagcuaucgaacguaaacgua

SEQ ID NO: 3292519 - RNA, 17 nt, Variola virus
auagauaauacaaaauu

SEQ ID NO: 3292520 - RNA, 16 nt, Variola virus
cuaugccaacacaaac

SEQ ID NO: 3292521 - RNA, 15 nt, Variola virus
uguuauaaguuuuua

SEQ ID NO: 3292522 - RNA, 18 nt, Variola virus
auucauaacgucauugau

SEQ ID NO: 3292523 - RNA, 22 nt, Variola virus
auaaauacccuuccaaauaaua

SEQ ID NO: 3292524 - RNA, 17 nt, Variola virus
uuauauaaaaacauuuu

SEQ ID NO: 3292525 - RNA, 18 nt, Variola virus
aucuucguaccucaaacu

SEQ ID NO: 3292526 - RNA, 13 nt, Variola virus
ugagauaagaaca

SEQ ID NO: 3292527 - RNA, 23 nt, Variola virus
acucucaagauuuuaaaaaacug

SEQ ID NO: 3292528 - RNA, 21 nt, Variola virus
cgagaauguugggauccagag

SEQ ID NO: 3292529 - RNA, 16 nt, Variola virus
augauccuauucuaaa

SEQ ID NO: 3292530 - RNA, 16 nt, Variola virus
auauuacuguuaauaa

SEQ ID NO: 3292531 - RNA, 17 nt, Variola virus
agucagguccaauauua

SEQ ID NO: 3292532 - RNA, 17 nt, Variola virus
auuuaaggcuuuaaaau

SEQ ID NO: 3292533 - RNA, 21 nt, Variola virus
augguacguaaccgaaucuuc

SEQ ID NO: 3292534 - RNA, 20 nt, Variola virus
gaugcuguaaauuaugaaaa

SEQ ID NO: 3292535 - RNA, 22 nt, Variola virus
aaucccuacauauuuuagaaca

SEQ ID NO: 3292536 - RNA, 19 nt, Variola virus
uauuuuuaacuuucaucua

SEQ ID NO: 3292537 - RNA, 14 nt, Variola virus
aaacggauaugucu

SEQ ID NO: 3292538 - RNA, 17 nt, Variola virus
uauaugauauuccugga

SEQ ID NO: 3292539 - RNA, 17 nt, Variola virus
gggcaugcggaagacaa

SEQ ID NO: 3292540 - RNA, 21 nt, Variola virus
uuauaacgauaacgucauuaa

SEQ ID NO: 3292541 - RNA, 17 nt, Variola virus
uacucguguccauaauc

SEQ ID NO: 3292542 - RNA, 15 nt, Variola virus
auaucuuuaugaauu

SEQ ID NO: 3292543 - RNA, 22 nt, Variola virus
acuucugcagaauaauuagaaa

SEQ ID NO: 3292544 - RNA, 14 nt, Variola virus
uaucauuaauacag

SEQ ID NO: 3292545 - RNA, 21 nt, Variola virus
ugauaucaaauggauauugcc

SEQ ID NO: 3292546 - RNA, 16 nt, Variola virus
uuuaauuuccuaguau

SEQ ID NO: 3292547 - RNA, 17 nt, Variola virus
uaucuaccucuccaaaa

SEQ ID NO: 3292548 - RNA, 23 nt, Variola virus
aaauuagagcucaucuaagaaau

SEQ ID NO: 3292549 - RNA, 16 nt, Variola virus
uucucgcaacugucuu

SEQ ID NO: 3292550 - RNA, 16 nt, Variola virus
agaaauuaucaaaugu

SEQ ID NO: 3292551 - RNA, 17 nt, Variola virus
auucuguuacuacuuua

SEQ ID NO: 3292552 - RNA, 12 nt, Variola virus
agaagaacauau

SEQ ID NO: 3292553 - RNA, 22 nt, Variola virus
uugaaucaucaucgguguagua

SEQ ID NO: 3292554 - RNA, 20 nt, Variola virus
ccacaaauugcauauuugga

SEQ ID NO: 3292555 - RNA, 18 nt, Variola virus
uaaauucaaccaugaauu

SEQ ID NO: 3292556 - RNA, 12 nt, Variola virus
cuucuauacaaa

SEQ ID NO: 3292557 - RNA, 20 nt, Variola virus
ugaauaauacauuuaaauuu

SEQ ID NO: 3292558 - RNA, 13 nt, Variola virus
ccaacuguagacg

SEQ ID NO: 3292559 - RNA, 16 nt, Variola virus
aguuaucaucuauaug

SEQ ID NO: 3292560 - RNA, 22 nt, Variola virus
gauuggauaaacuaaaauuaaa

SEQ ID NO: 3292561 - RNA, 15 nt, Variola virus
aacuaucacuuauac

SEQ ID NO: 3292562 - RNA, 23 nt, Variola virus
ggaguacccacugaugagauguu

SEQ ID NO: 3292563 - RNA, 12 nt, Variola virus
gugcuacaaaac

SEQ ID NO: 3292564 - RNA, 21 nt, Variola virus
uuaggacgcgaauaaauagau

SEQ ID NO: 3292565 - RNA, 14 nt, Variola virus
aaaguaauaaucuu

SEQ ID NO: 3292566 - RNA, 24 nt, Variola virus
cugcuagaaaucauauaugauauu

SEQ ID NO: 3292567 - RNA, 18 nt, Variola virus
guagacauagauauucua

SEQ ID NO: 3292568 - RNA, 22 nt, Variola virus
uaagaaauccaaauaaaaugga

SEQ ID NO: 3292569 - RNA, 21 nt, Variola virus
aaacgaacgucuccaauauau

SEQ ID NO: 3292570 - RNA, 18 nt, Variola virus
guuaaacaauagauggau

SEQ ID NO: 3292571 - RNA, 22 nt, Variola virus
ucacaaagauggcugaaauuag

SEQ ID NO: 3292572 - RNA, 14 nt, Variola virus
cagcguaaaacaca

SEQ ID NO: 3292573 - RNA, 23 nt, Variola virus
ucuauuuguucugacaauauuua

SEQ ID NO: 3292574 - RNA, 23 nt, Variola virus
aauaauaccuucuacuaugcaau

SEQ ID NO: 3292575 - RNA, 14 nt, Variola virus
uauaugugucucca

SEQ ID NO: 3292576 - RNA, 16 nt, Variola virus
auguugauagaaguua

SEQ ID NO: 3292577 - RNA, 14 nt, Variola virus
uuccuaaaucgagu

SEQ ID NO: 3292578 - RNA, 15 nt, Variola virus
caaagucguuuaaug

SEQ ID NO: 3292579 - RNA, 19 nt, Variola virus
agcaucuucuauaucuaga

SEQ ID NO: 3292580 - RNA, 23 nt, Variola virus
acuucuucaacuaccaaaaauug

SEQ ID NO: 3292581 - RNA, 18 nt, Variola virus
gaacauaguaagaaauuc

SEQ ID NO: 3292582 - RNA, 20 nt, Variola virus
auagaauaaauauccuugga

SEQ ID NO: 3292583 - RNA, 13 nt, Variola virus
acaguuugaaaaa

SEQ ID NO: 3292584 - RNA, 13 nt, Variola virus
cgaauaacaaaaa

SEQ ID NO: 3292585 - RNA, 17 nt, Variola virus
uaguguaucgacaucuu

SEQ ID NO: 3292586 - RNA, 14 nt, Variola virus
auuucauuaauagu

SEQ ID NO: 3292587 - RNA, 21 nt, Variola virus
auaugauuucagauacuauau

SEQ ID NO: 3292588 - RNA, 16 nt, Variola virus
uaaaauaucauacgau

SEQ ID NO: 3292589 - RNA, 19 nt, Variola virus
uaugauaaaaugaaguuuu

SEQ ID NO: 3292590 - RNA, 16 nt, Variola virus
cuucaucacuucacua

SEQ ID NO: 3292591 - RNA, 22 nt, Variola virus
aaguaucuaguuagcaauuuuc

SEQ ID NO: 3292592 - RNA, 15 nt, Variola virus
guaggauuuuuccaa

SEQ ID NO: 3292593 - RNA, 23 nt, Variola virus
auagagccaagacgaacaaaauc

SEQ ID NO: 3292594 - RNA, 13 nt, Variola virus
uucaucauauuca

SEQ ID NO: 3292595 - RNA, 17 nt, Variola virus
aaaucacgagaacuauu

SEQ ID NO: 3292596 - RNA, 17 nt, Variola virus
uauuagauaauaaacag

SEQ ID NO: 3292597 - RNA, 14 nt, Variola virus
uuagauacauagau

SEQ ID NO: 3292598 - RNA, 23 nt, Variola virus
gcgguugccauagaauauacguc

SEQ ID NO: 3292599 - RNA, 20 nt, Variola virus
auaauauccauuuuguuuau

SEQ ID NO: 3292600 - RNA, 14 nt, Variola virus
aaacugguaaucca

SEQ ID NO: 3292601 - RNA, 19 nt, Variola virus
uauucgagaugaacauuca

SEQ ID NO: 3292602 - RNA, 18 nt, Variola virus
uacaaacaacuaggaaau

SEQ ID NO: 3292603 - RNA, 18 nt, Variola virus
acgggcgcuguaauuaau

SEQ ID NO: 3292604 - RNA, 18 nt, Variola virus
caucugaucccaaauacg

SEQ ID NO: 3292605 - RNA, 23 nt, Variola virus
gaaacguaauauccucaauaacg

SEQ ID NO: 3292606 - RNA, 19 nt, Variola virus
auuccaaugaacaagauua

SEQ ID NO: 3292607 - RNA, 19 nt, Variola virus
ucaucuaccaacgguauau

SEQ ID NO: 3292608 - RNA, 15 nt, Variola virus
aauaaucguuauuau

SEQ ID NO: 3292609 - RNA, 23 nt, Variola virus
uauuucauugacggaugaucaua

SEQ ID NO: 3292610 - RNA, 17 nt, Variola virus
acgucaaagguuaacau

SEQ ID NO: 3292611 - RNA, 13 nt, Variola virus
cuguguuacauaa

SEQ ID NO: 3292612 - RNA, 14 nt, Variola virus
aaucauuaaaugau

SEQ ID NO: 3292613 - RNA, 14 nt, Variola virus
uaucuauauaugua

SEQ ID NO: 3292614 - RNA, 13 nt, Variola virus
auccuaacaauga

SEQ ID NO: 3292615 - RNA, 19 nt, Variola virus
uagaacuaccaauaugucu

SEQ ID NO: 3292616 - RNA, 20 nt, Variola virus
gugcuuguaucgaaaaacuu

SEQ ID NO: 3292617 - RNA, 23 nt, Variola virus
uaccaauaugucuguacaaaugu

SEQ ID NO: 3292618 - RNA, 18 nt, Variola virus
auuuuauucuagaauuga

SEQ ID NO: 3292619 - RNA, 17 nt, Variola virus
cggcauaguuucuguaa

SEQ ID NO: 3292620 - RNA, 23 nt, Variola virus
auucgugacagauccaugucuga

SEQ ID NO: 3292621 - RNA, 23 nt, Variola virus
aggauugauuacuauaaauggag

SEQ ID NO: 3292622 - RNA, 15 nt, Variola virus
uauaagauuaucaaa

SEQ ID NO: 3292623 - RNA, 20 nt, Variola virus
caccaucauaugacauuuca

SEQ ID NO: 3292624 - RNA, 12 nt, Variola virus
auaccaaacaua

SEQ ID NO: 3292625 - RNA, 12 nt, Variola virus
agcaaaaaauga

SEQ ID NO: 3292626 - RNA, 12 nt, Variola virus
agacaucugaca

SEQ ID NO: 3292627 - RNA, 20 nt, Variola virus
uuacucuuggucuaauacug

SEQ ID NO: 3292628 - RNA, 16 nt, Variola virus
ucgcuauauccaccaa

SEQ ID NO: 3292629 - RNA, 16 nt, Variola virus
uagauuauucuuaaau

SEQ ID NO: 3292630 - RNA, 15 nt, Variola virus
auagacgguuccaaa

SEQ ID NO: 3292631 - RNA, 14 nt, Variola virus
gacaauauuuaguu

SEQ ID NO: 3292632 - RNA, 16 nt, Variola virus
uugucaacuuuguaaa

SEQ ID NO: 3292633 - RNA, 19 nt, Variola virus
uuuguaauaaaauuuagca

SEQ ID NO: 3292634 - RNA, 17 nt, Variola virus
uacaauuucauaaugag

SEQ ID NO: 3292635 - RNA, 20 nt, Variola virus
uccauaugacuaaaaugcug

SEQ ID NO: 3292636 - RNA, 23 nt, Variola virus
aacuuuaaauaauuuacaaaaau

SEQ ID NO: 3292637 - RNA, 19 nt, Variola virus
guucacguaaauacaaaac

SEQ ID NO: 3292638 - RNA, 12 nt, Variola virus
ucgucuuuagag

SEQ ID NO: 3292639 - RNA, 18 nt, Variola virus
ucauguagauaguuacca

SEQ ID NO: 3292640 - RNA, 16 nt, Variola virus
uuaauaauucauggaa

SEQ ID NO: 3292641 - RNA, 14 nt, Variola virus
gaauuuagaaauau

SEQ ID NO: 3292642 - RNA, 19 nt, Variola virus
auuauugcaugauagaaug

SEQ ID NO: 3292643 - RNA, 18 nt, Variola virus
acaauacgauaaacauug

SEQ ID NO: 3292644 - RNA, 15 nt, Variola virus
ucgaaauauguaaua

SEQ ID NO: 3292645 - RNA, 19 nt, Variola virus
uaaaaaaguuuuugauuac

SEQ ID NO: 3292646 - RNA, 23 nt, Variola virus
auuaugacaaaauuaaaaaagau

SEQ ID NO: 3292647 - RNA, 23 nt, Variola virus
gguaacauuauagauucuuuuaa

SEQ ID NO: 3292648 - RNA, 14 nt, Variola virus
gcuaaaauauccuc

SEQ ID NO: 3292649 - RNA, 12 nt, Variola virus
uauuagaauuaa

SEQ ID NO: 3292650 - RNA, 13 nt, Variola virus
uagcuguuuucau

SEQ ID NO: 3292651 - RNA, 18 nt, Variola virus
aaugauacugauaaagua

SEQ ID NO: 3292652 - RNA, 21 nt, Variola virus
agaaaauaucauaaauauauu

SEQ ID NO: 3292653 - RNA, 18 nt, Variola virus
uacuauuauauuugguau

SEQ ID NO: 3292654 - RNA, 19 nt, Variola virus
aaugacaaguauaaugaua

SEQ ID NO: 3292655 - RNA, 17 nt, Variola virus
uauaguucuuaaucauu

SEQ ID NO: 3292656 - RNA, 18 nt, Variola virus
ccguguucguucaaaugc

SEQ ID NO: 3292657 - RNA, 17 nt, Variola virus
uggaucuaugguuucca

SEQ ID NO: 3292658 - RNA, 19 nt, Variola virus
aagaugaugaaucuucauu

SEQ ID NO: 3292659 - RNA, 20 nt, Variola virus
uuauacgcauaaauuguaaa

SEQ ID NO: 3292660 - RNA, 21 nt, Variola virus
uauauagagccaagacgaaca

SEQ ID NO: 3292661 - RNA, 14 nt, Variola virus
auugguaaauccua

SEQ ID NO: 3292662 - RNA, 17 nt, Variola virus
uagauauuaguaaauua

SEQ ID NO: 3292663 - RNA, 18 nt, Variola virus
aaaacuaucaaugauaug

SEQ ID NO: 3292664 - RNA, 15 nt, Variola virus
acaaugauaaugaac

SEQ ID NO: 3292665 - RNA, 22 nt, Variola virus
agaaaugguaaauaaauacuuu

SEQ ID NO: 3292666 - RNA, 17 nt, Variola virus
uagauuuauaauacuuu

SEQ ID NO: 3292667 - RNA, 17 nt, Variola virus
caaaauacaaaauguua

SEQ ID NO: 3292668 - RNA, 20 nt, Variola virus
uuauaucaauaccaaagaag

SEQ ID NO: 3292669 - RNA, 13 nt, Variola virus
aaaugauacugau

SEQ ID NO: 3292670 - RNA, 20 nt, Variola virus
auagaguuaaauucauauaa

SEQ ID NO: 3292671 - RNA, 21 nt, Variola virus
augggaacggaacagaaacua

SEQ ID NO: 3292672 - RNA, 15 nt, Variola virus
acacuauuagaauua

SEQ ID NO: 3292673 - RNA, 12 nt, Variola virus
gcauccauccaa

SEQ ID NO: 3292674 - RNA, 23 nt, Variola virus
auuacuaucuuuaacauauguau

SEQ ID NO: 3292675 - RNA, 19 nt, Variola virus
acuuuaaccuauacaugau

SEQ ID NO: 3292676 - RNA, 14 nt, Variola virus
auguauuagacaaa

SEQ ID NO: 3292677 - RNA, 12 nt, Variola virus
uuugacacuauc

SEQ ID NO: 3292678 - RNA, 23 nt, Variola virus
auucaugguaaggucuuagaaau

SEQ ID NO: 3292679 - RNA, 23 nt, Variola virus
auaaacaugaauuuauuucuaau

SEQ ID NO: 3292680 - RNA, 11 nt, Variola virus
uacaacagaua

SEQ ID NO: 3292681 - RNA, 20 nt, Variola virus
ggucaucugguuuaggaaag

SEQ ID NO: 3292682 - RNA, 14 nt, Variola virus
uccauaaauuuaua

SEQ ID NO: 3292683 - RNA, 17 nt, Variola virus
uaaucagauucuuauau

SEQ ID NO: 3292684 - RNA, 16 nt, Variola virus
uaacaucuuucaucau

SEQ ID NO: 3292685 - RNA, 12 nt, Variola virus
uugaaacuuuuc

SEQ ID NO: 3292686 - RNA, 23 nt, Variola virus
auaaagucccaaaccagaauugc

SEQ ID NO: 3292687 - RNA, 18 nt, Variola virus
aguaucgcccuaauauua

SEQ ID NO: 3292688 - RNA, 17 nt, Variola virus
uucuuaccaacaucuua

SEQ ID NO: 3292689 - RNA, 20 nt, Variola virus
cugauaaguucuuuauacag

SEQ ID NO: 3292690 - RNA, 14 nt, Variola virus
ggguuguaaacaac

SEQ ID NO: 3292691 - RNA, 24 nt, Variola virus
cuaucaauagcaguuuauuaucca

SEQ ID NO: 3292692 - RNA, 22 nt, Variola virus
acaaaauccaaacauuacaaau

SEQ ID NO: 3292693 - RNA, 17 nt, Variola virus
uuacgaauuacauuucu

SEQ ID NO: 3292694 - RNA, 21 nt, Variola virus
cuaauuccuuugcuauuucua

SEQ ID NO: 3292695 - RNA, 13 nt, Variola virus
ugacguaaaugug

SEQ ID NO: 3292696 - RNA, 14 nt, Variola virus
cugauauucagaaa

SEQ ID NO: 3292697 - RNA, 14 nt, Variola virus
uuaaaguguaaaua

SEQ ID NO: 3292698 - RNA, 15 nt, Variola virus
uuuccccacauagaa

SEQ ID NO: 3292699 - RNA, 22 nt, Variola virus
guaauaucugauuuauuuccua

SEQ ID NO: 3292700 - RNA, 21 nt, Variola virus
aaacuuagauuaaaugcugaa

SEQ ID NO: 3292701 - RNA, 13 nt, Variola virus
agccauuuucuau

SEQ ID NO: 3292702 - RNA, 20 nt, Variola virus
aaugcuaauauauucuuaca

SEQ ID NO: 3292703 - RNA, 16 nt, Variola virus
uacaaccaaauucuug

SEQ ID NO: 3292704 - RNA, 14 nt, Variola virus
acucccacaaauac

SEQ ID NO: 3292705 - RNA, 14 nt, Variola virus
aauaucauaaucua

SEQ ID NO: 3292706 - RNA, 16 nt, Variola virus
auaggauacuuuguaa

SEQ ID NO: 3292707 - RNA, 17 nt, Variola virus
uuuauuucuaaaauuuu

SEQ ID NO: 3292708 - RNA, 12 nt, Variola virus
uuauuucuaaau

SEQ ID NO: 3292709 - RNA, 18 nt, Variola virus
aagacugcuaaauguauc

SEQ ID NO: 3292710 - RNA, 21 nt, Variola virus
gaugacaauauuauuaugaag

SEQ ID NO: 3292711 - RNA, 13 nt, Variola virus
gaucaucuagaua

SEQ ID NO: 3292712 - RNA, 13 nt, Variola virus
gaucgucuagaug

SEQ ID NO: 3292713 - RNA, 16 nt, Variola virus
uuuaauggauauacac

SEQ ID NO: 3292714 - RNA, 23 nt, Variola virus
augugaucuaugacaucaugcau

SEQ ID NO: 3292715 - RNA, 23 nt, Variola virus
accuuugguucuuuaaaagaaac

SEQ ID NO: 3292716 - RNA, 14 nt, Variola virus
aauagcaucaucuu

SEQ ID NO: 3292717 - RNA, 21 nt, Variola virus
cccagaauaauauacuucugu

SEQ ID NO: 3292718 - RNA, 12 nt, Variola virus
auuguuguguac

SEQ ID NO: 3292719 - RNA, 18 nt, Variola virus
agcaaucaugaaacaaua

SEQ ID NO: 3292720 - RNA, 12 nt, Variola virus
ucguuacaaaag

SEQ ID NO: 3292721 - RNA, 19 nt, Variola virus
uaaucuauaaaacaaucau

SEQ ID NO: 3292722 - RNA, 17 nt, Variola virus
uacuucagguuucuuag

SEQ ID NO: 3292723 - RNA, 11 nt, Variola virus
uauauguuucu

SEQ ID NO: 3292724 - RNA, 15 nt, Variola virus
uaauauaaaaacuua

SEQ ID NO: 3292725 - RNA, 15 nt, Variola virus
uuauaaaaauacuaa

SEQ ID NO: 3292726 - RNA, 17 nt, Variola virus
uauuauacuuguauaua

SEQ ID NO: 3292727 - RNA, 17 nt, Variola virus
aauaacuuguuagauaa

SEQ ID NO: 3292728 - RNA, 14 nt, Variola virus
ucuuuuuuacacau

SEQ ID NO: 3292729 - RNA, 22 nt, Variola virus
uaacaugacauuuauucaucau

SEQ ID NO: 3292730 - RNA, 16 nt, Variola virus
ggcaauuguagauaua

SEQ ID NO: 3292731 - RNA, 14 nt, Variola virus
guuuggauuaaucu

SEQ ID NO: 3292732 - RNA, 13 nt, Variola virus
cccaccaaucaac

SEQ ID NO: 3292733 - RNA, 19 nt, Variola virus
uugaauggauacuaguuuu

SEQ ID NO: 3292734 - RNA, 17 nt, Variola virus
gauccuaauuuacaaua

SEQ ID NO: 3292735 - RNA, 12 nt, Variola virus
acauaauacaau

SEQ ID NO: 3292736 - RNA, 14 nt, Variola virus
uucguuuucuaauu

SEQ ID NO: 3292737 - RNA, 22 nt, Variola virus
cuuaugauauaaggaaacagcu

SEQ ID NO: 3292738 - RNA, 20 nt, Variola virus
cguuaucauuugaugauaug

SEQ ID NO: 3292739 - RNA, 13 nt, Variola virus
agauuaugauacu

SEQ ID NO: 3292740 - RNA, 17 nt, Variola virus
uagaaacuauacgaaau

SEQ ID NO: 3292741 - RNA, 15 nt, Variola virus
auaaugugauuguau

SEQ ID NO: 3292742 - RNA, 16 nt, Variola virus
gaagaacgauaaugaa

SEQ ID NO: 3292743 - RNA, 23 nt, Variola virus
aauaagagcagcacaaacucauu

SEQ ID NO: 3292744 - RNA, 11 nt, Variola virus
uuaaucucaca

SEQ ID NO: 3292745 - RNA, 19 nt, Variola virus
cuaauacuacuacuuguaa

SEQ ID NO: 3292746 - RNA, 21 nt, Variola virus
uguauaacaaucuuauaucuu

SEQ ID NO: 3292747 - RNA, 20 nt, Variola virus
aaguuccuccuuguauuugu

SEQ ID NO: 3292748 - RNA, 14 nt, Variola virus
aaggcgaacgcuau

SEQ ID NO: 3292749 - RNA, 20 nt, Variola virus
auacguuuauauucuuuuaa

SEQ ID NO: 3292750 - RNA, 18 nt, Variola virus
ucauauacaacucucuaa

SEQ ID NO: 3292751 - RNA, 12 nt, Variola virus
aaaaaauuucca

SEQ ID NO: 3292752 - RNA, 14 nt, Variola virus
aacuccucuagaug

SEQ ID NO: 3292753 - RNA, 12 nt, Variola virus
cuucauuucuaa

SEQ ID NO: 3292754 - RNA, 21 nt, Variola virus
uaucucguuuagaaaaaugcu

SEQ ID NO: 3292755 - RNA, 13 nt, Variola virus
caauugucauuag

SEQ ID NO: 3292756 - RNA, 19 nt, Variola virus
auaaucaaaauugucuaug

SEQ ID NO: 3292757 - RNA, 18 nt, Variola virus
aauaauacaacaaccauu

SEQ ID NO: 3292758 - RNA, 15 nt, Variola virus
aagguuaacaucuua

SEQ ID NO: 3292759 - RNA, 17 nt, Variola virus
auaucuucuuuuuucca

SEQ ID NO: 3292760 - RNA, 20 nt, Variola virus
auuaaaucauuaaaugauug

SEQ ID NO: 3292761 - RNA, 20 nt, Variola virus
agaucuaaagauaaucuucu

SEQ ID NO: 3292762 - RNA, 16 nt, Variola virus
cgucuuuugaucuuua

SEQ ID NO: 3292763 - RNA, 14 nt, Variola virus
uuuaaaguuucuga

SEQ ID NO: 3292764 - RNA, 17 nt, Variola virus
aguucauuauaaauucu

SEQ ID NO: 3292765 - RNA, 19 nt, Variola virus
auuugauuauuuugaagac

SEQ ID NO: 3292766 - RNA, 21 nt, Variola virus
aaaaugaagauccaagauuug

SEQ ID NO: 3292767 - RNA, 15 nt, Variola virus
aaaucuugauuacaa

SEQ ID NO: 3292768 - RNA, 11 nt, Variola virus
uaucuguaaaa

SEQ ID NO: 3292769 - RNA, 18 nt, Variola virus
gaugccuuaacaucauca

SEQ ID NO: 3292770 - RNA, 12 nt, Variola virus
uguuaauaacug

SEQ ID NO: 3292771 - RNA, 12 nt, Variola virus
aauaaaaacaag

SEQ ID NO: 3292772 - RNA, 20 nt, Variola virus
aaauauauaguauuaaugau

SEQ ID NO: 3292773 - RNA, 19 nt, Variola virus
agaauuauaccaauagaua

SEQ ID NO: 3292774 - RNA, 13 nt, Variola virus
acacaaucaugau

SEQ ID NO: 3292775 - RNA, 20 nt, Variola virus
auuccuuugcuauuucuaug

SEQ ID NO: 3292776 - RNA, 15 nt, Variola virus
aucucuagacaauuu

SEQ ID NO: 3292777 - RNA, 23 nt, Variola virus
aauaccgaugugucuacauaaau

SEQ ID NO: 3292778 - RNA, 21 nt, Variola virus
ccuguuucuacuaacuuuuug

SEQ ID NO: 3292779 - RNA, 14 nt, Variola virus
auuuuuuacaauuu

SEQ ID NO: 3292780 - RNA, 12 nt, Variola virus
gacuguacgaua

SEQ ID NO: 3292781 - RNA, 15 nt, Variola virus
aacaauaugcaaaua

SEQ ID NO: 3292782 - RNA, 21 nt, Variola virus
aaaaauacucaguuugauauu

SEQ ID NO: 3292783 - RNA, 11 nt, Variola virus
gcguuaaacau

SEQ ID NO: 3292784 - RNA, 19 nt, Variola virus
aauaaucggagaauguuuc

SEQ ID NO: 3292785 - RNA, 21 nt, Variola virus
auauagacaacguagaauugu

SEQ ID NO: 3292786 - RNA, 15 nt, Variola virus
auaaauuuauucucu

SEQ ID NO: 3292787 - RNA, 12 nt, Variola virus
uucuaauacuau

SEQ ID NO: 3292788 - RNA, 15 nt, Variola virus
agcgauuguuuaaga

SEQ ID NO: 3292789 - RNA, 16 nt, Variola virus
uuucagaggaauacag

SEQ ID NO: 3292790 - RNA, 14 nt, Variola virus
auguugauaaaaug

SEQ ID NO: 3292791 - RNA, 21 nt, Variola virus
aguaaacucgucgacaaagua

SEQ ID NO: 3292792 - RNA, 23 nt, Variola virus
augccuauaaaguaauaaucuuc

SEQ ID NO: 3292793 - RNA, 21 nt, Variola virus
caguguccgaugauuaaugac

SEQ ID NO: 3292794 - RNA, 21 nt, Variola virus
uacaaacuauagaaauuauuu

SEQ ID NO: 3292795 - RNA, 19 nt, Variola virus
auaucuacugauaaaacug

SEQ ID NO: 3292796 - RNA, 17 nt, Variola virus
acacauuaggauacaga

SEQ ID NO: 3292797 - RNA, 16 nt, Variola virus
gauuauucacuauaau

SEQ ID NO: 3292798 - RNA, 19 nt, Variola virus
uaguacgggcgcuguaauu

SEQ ID NO: 3292799 - RNA, 18 nt, Variola virus
cguauauuuuauacauuu

SEQ ID NO: 3292800 - RNA, 21 nt, Variola virus
gaaaaugugcuucuaugagau

SEQ ID NO: 3292801 - RNA, 19 nt, Variola virus
ugugauaccaauaaguuuu

SEQ ID NO: 3292802 - RNA, 12 nt, Variola virus
agcaaaaaaacu

SEQ ID NO: 3292803 - RNA, 21 nt, Variola virus
uacuuuaauaaccguuagaca

SEQ ID NO: 3292804 - RNA, 19 nt, Variola virus
caaccgcauacuacuauua

SEQ ID NO: 3292805 - RNA, 14 nt, Variola virus
uuaagaucuaauau

SEQ ID NO: 3292806 - RNA, 17 nt, Variola virus
uuaacaauuccuuuuuu

SEQ ID NO: 3292807 - RNA, 13 nt, Variola virus
aaaucuaacuucu

SEQ ID NO: 3292808 - RNA, 20 nt, Variola virus
ggauaauuuuaccagaauac

SEQ ID NO: 3292809 - RNA, 17 nt, Variola virus
caacaucuauaaaagua

SEQ ID NO: 3292810 - RNA, 17 nt, Variola virus
aauaaacguucacguaa

SEQ ID NO: 3292811 - RNA, 20 nt, Variola virus
auauuuguuaucaugaugac

SEQ ID NO: 3292812 - RNA, 16 nt, Variola virus
auaauaaauuuuucca

SEQ ID NO: 3292813 - RNA, 20 nt, Variola virus
ucaagaaggaaaucaaaucu

SEQ ID NO: 3292814 - RNA, 14 nt, Variola virus
uaaugugaauuuag

SEQ ID NO: 3292815 - RNA, 18 nt, Variola virus
uauaaaacuacuacaaug

SEQ ID NO: 3292816 - RNA, 19 nt, Variola virus
acuauaucgacauauuuca

SEQ ID NO: 3292817 - RNA, 19 nt, Variola virus
cuagagauacaggaauaca

SEQ ID NO: 3292818 - RNA, 17 nt, Variola virus
aguuaacacaugucaca

SEQ ID NO: 3292819 - RNA, 14 nt, Variola virus
auaaauaaggaagu

SEQ ID NO: 3292820 - RNA, 16 nt, Variola virus
caacuaguaucaucuc

SEQ ID NO: 3292821 - RNA, 18 nt, Variola virus
gagaaguaauaaaacgaa

SEQ ID NO: 3292822 - RNA, 23 nt, Variola virus
gaaugagauacauaaaacuuuau

SEQ ID NO: 3292823 - RNA, 22 nt, Variola virus
auucuaccuuuuuauuuucuaa

SEQ ID NO: 3292824 - RNA, 14 nt, Variola virus
uguauaaauaauua

SEQ ID NO: 3292825 - RNA, 22 nt, Variola virus
gacacucuauaucuagaaauaa

SEQ ID NO: 3292826 - RNA, 18 nt, Variola virus
aaaaagacuaaaucuuca

SEQ ID NO: 3292827 - RNA, 21 nt, Variola virus
aauaaauuuucucuuaaaaau

SEQ ID NO: 3292828 - RNA, 13 nt, Variola virus
ucauaaagaacag

SEQ ID NO: 3292829 - RNA, 19 nt, Variola virus
uuauguauauguuuguaaa

SEQ ID NO: 3292830 - RNA, 18 nt, Variola virus
acauauagacaauaacua

SEQ ID NO: 3292831 - RNA, 19 nt, Variola virus
auacgaaauaaauaaugaa

SEQ ID NO: 3292832 - RNA, 17 nt, Variola virus
aauagauccugaauauu

SEQ ID NO: 3292833 - RNA, 13 nt, Variola virus
guauauguuucua

SEQ ID NO: 3292834 - RNA, 14 nt, Variola virus
cacguuuaaacauu

SEQ ID NO: 3292835 - RNA, 16 nt, Variola virus
cuaaauaauuauacuu

SEQ ID NO: 3292836 - RNA, 17 nt, Variola virus
cuaauuuacuaucugua

SEQ ID NO: 3292837 - RNA, 22 nt, Variola virus
auaauaucggucuuauucuuaa

SEQ ID NO: 3292838 - RNA, 16 nt, Variola virus
gaaaagauauccagag

SEQ ID NO: 3292839 - RNA, 20 nt, Variola virus
uuagagaugaugcggaauca

SEQ ID NO: 3292840 - RNA, 21 nt, Variola virus
ugcuaauauucccaaacauac

SEQ ID NO: 3292841 - RNA, 10 nt, Variola virus
uacuuuucua

SEQ ID NO: 3292842 - RNA, 21 nt, Variola virus
cgaaugccauagaauaaauau

SEQ ID NO: 3292843 - RNA, 12 nt, Variola virus
cuucauuauuuu

SEQ ID NO: 3292844 - RNA, 22 nt, Variola virus
uacucuccgaguguaaauauua

SEQ ID NO: 3292845 - RNA, 14 nt, Variola virus
ucuccccaaacauu

SEQ ID NO: 3292846 - RNA, 20 nt, Variola virus
gaacuuguuuaaugaugaau

SEQ ID NO: 3292847 - RNA, 15 nt, Variola virus
aguaacgcaauacaa

SEQ ID NO: 3292848 - RNA, 19 nt, Variola virus
auaguaacuauguaaauga

SEQ ID NO: 3292849 - RNA, 18 nt, Variola virus
uucucuaguuacacuaug

SEQ ID NO: 3292850 - RNA, 16 nt, Variola virus
aauaaaacaucaaugu

SEQ ID NO: 3292851 - RNA, 22 nt, Variola virus
cuacaauauauauucauagagg

SEQ ID NO: 3292852 - RNA, 14 nt, Variola virus
guaaacauaucaua

SEQ ID NO: 3292853 - RNA, 23 nt, Variola virus
ccauccauuuuaugcgauguuua

SEQ ID NO: 3292854 - RNA, 14 nt, Variola virus
ucaugacaaucaau

SEQ ID NO: 3292855 - RNA, 17 nt, Variola virus
auaaucgcuuuguuguu

SEQ ID NO: 3292856 - RNA, 17 nt, Variola virus
aguucuuuuaugucaag

SEQ ID NO: 3292857 - RNA, 20 nt, Variola virus
caauagauaauuguaacaau

SEQ ID NO: 3292858 - RNA, 19 nt, Variola virus
agaaaauuuauaaacuauu

SEQ ID NO: 3292859 - RNA, 18 nt, Variola virus
cuuauuccauuaucugaa

SEQ ID NO: 3292860 - RNA, 22 nt, Variola virus
uaucguauauuaaguugggaga

SEQ ID NO: 3292861 - RNA, 22 nt, Variola virus
uagaucuuuuacacuguuaaag

SEQ ID NO: 3292862 - RNA, 17 nt, Variola virus
aucaaaugguucauaau

SEQ ID NO: 3292863 - RNA, 20 nt, Variola virus
cuugauacagccaaguaucu

SEQ ID NO: 3292864 - RNA, 15 nt, Variola virus
auuuauaaugucuac

SEQ ID NO: 3292865 - RNA, 20 nt, Variola virus
uccuuaauucuagcaucuuc

SEQ ID NO: 3292866 - RNA, 17 nt, Variola virus
auagagaguucauuuau

SEQ ID NO: 3292867 - RNA, 19 nt, Variola virus
auaagacacagaaauacug

SEQ ID NO: 3292868 - RNA, 14 nt, Variola virus
ucaaaagaaaucuu

SEQ ID NO: 3292869 - RNA, 22 nt, Variola virus
ucuuacauauuuuuuucuuauu

SEQ ID NO: 3292870 - RNA, 12 nt, Variola virus
aagacaauaaug

SEQ ID NO: 3292871 - RNA, 17 nt, Variola virus
uagcugagaauaucuuu

SEQ ID NO: 3292872 - RNA, 16 nt, Variola virus
gaaaagaugaaaugau

SEQ ID NO: 3292873 - RNA, 21 nt, Variola virus
accuaaucccgcauuuauaca

SEQ ID NO: 3292874 - RNA, 17 nt, Variola virus
auauagggaaucauaua

SEQ ID NO: 3292875 - RNA, 19 nt, Variola virus
uggaaauguuauagaaaau

SEQ ID NO: 3292876 - RNA, 19 nt, Variola virus
auuaguaacgacuauuaaa

SEQ ID NO: 3292877 - RNA, 14 nt, Variola virus
gacuagcauauuau

SEQ ID NO: 3292878 - RNA, 13 nt, Variola virus
auuuuccauuuau

SEQ ID NO: 3292879 - RNA, 13 nt, Variola virus
auaaauuuauuau

SEQ ID NO: 3292880 - RNA, 19 nt, Variola virus
acaagaaaauuagaaggau

SEQ ID NO: 3292881 - RNA, 16 nt, Variola virus
uggaucuaguuuucag

SEQ ID NO: 3292882 - RNA, 18 nt, Variola virus
aaauccauuaauacggaa

SEQ ID NO: 3292883 - RNA, 16 nt, Variola virus
uauaaucgcuuuccag

SEQ ID NO: 3292884 - RNA, 11 nt, Variola virus
auaaaaacaag

SEQ ID NO: 3292885 - RNA, 16 nt, Variola virus
aaacgaauagaauaua

SEQ ID NO: 3292886 - RNA, 16 nt, Variola virus
aaguauccaucacuuc

SEQ ID NO: 3292887 - RNA, 17 nt, Variola virus
uauucgauaacagcauu

SEQ ID NO: 3292888 - RNA, 20 nt, Variola virus
cuguauuguuaauagauaua

SEQ ID NO: 3292889 - RNA, 17 nt, Variola virus
guauauaucaugaugau

SEQ ID NO: 3292890 - RNA, 23 nt, Variola virus
aauacuccucauuacguuucauu

SEQ ID NO: 3292891 - RNA, 18 nt, Variola virus
uacucggccgacauaaug

SEQ ID NO: 3292892 - RNA, 20 nt, Variola virus
uauuuugggcaaaucuaaau

SEQ ID NO: 3292893 - RNA, 19 nt, Variola virus
gugauaucaaauggauauu

SEQ ID NO: 3292894 - RNA, 17 nt, Variola virus
ugauaucgagaacagau

SEQ ID NO: 3292895 - RNA, 21 nt, Variola virus
caauaacuaauggcaaaugua

SEQ ID NO: 3292896 - RNA, 19 nt, Variola virus
auucaauuaguuuauuaau

SEQ ID NO: 3292897 - RNA, 16 nt, Variola virus
aacacaacaaaugaua

SEQ ID NO: 3292898 - RNA, 16 nt, Variola virus
auaauuacagaauuau

SEQ ID NO: 3292899 - RNA, 20 nt, Variola virus
aauacgacgguuuaauacac

SEQ ID NO: 3292900 - RNA, 17 nt, Variola virus
ccaguaugaauaaucuu

SEQ ID NO: 3292901 - RNA, 23 nt, Variola virus
aaucauuaucgauacuaauuaca

SEQ ID NO: 3292902 - RNA, 12 nt, Variola virus
acacauguguuu

SEQ ID NO: 3292903 - RNA, 20 nt, Variola virus
ugauauuuucuauaauauca

SEQ ID NO: 3292904 - RNA, 19 nt, Variola virus
uauuuggcauuucuaaaau

SEQ ID NO: 3292905 - RNA, 12 nt, Variola virus
uuauacaucuua

SEQ ID NO: 3292906 - RNA, 12 nt, Variola virus
cguuagucauau

SEQ ID NO: 3292907 - RNA, 17 nt, Variola virus
gcauuugucgauaaaga

SEQ ID NO: 3292908 - RNA, 16 nt, Variola virus
cuagguuucucuauaa

SEQ ID NO: 3292909 - RNA, 14 nt, Variola virus
uauaaguagauguu

SEQ ID NO: 3292910 - RNA, 14 nt, Variola virus
caucuacaaaaaca

SEQ ID NO: 3292911 - RNA, 15 nt, Variola virus
acauugugccaauaa

SEQ ID NO: 3292912 - RNA, 17 nt, Variola virus
uaucaugaauuagauau

SEQ ID NO: 3292913 - RNA, 13 nt, Variola virus
uuccauaaacagu

SEQ ID NO: 3292914 - RNA, 22 nt, Variola virus
uacuauauuaacaucuaaacau

SEQ ID NO: 3292915 - RNA, 18 nt, Variola virus
gaucaucaauccuucaga

SEQ ID NO: 3292916 - RNA, 13 nt, Variola virus
uucaacugucuuu

SEQ ID NO: 3292917 - RNA, 14 nt, Variola virus
ugaaacgaacacua

SEQ ID NO: 3292918 - RNA, 19 nt, Variola virus
agaucuacuggugaaaugu

SEQ ID NO: 3292919 - RNA, 14 nt, Variola virus
auauuagaaauaca

SEQ ID NO: 3292920 - RNA, 21 nt, Variola virus
aguuguuccaauaaauuauuu

SEQ ID NO: 3292921 - RNA, 21 nt, Variola virus
auuggaauguguuaaaaagaa

SEQ ID NO: 3292922 - RNA, 16 nt, Variola virus
auaacuguuuagaaau

SEQ ID NO: 3292923 - RNA, 19 nt, Variola virus
ucauuucuccaaagaauau

SEQ ID NO: 3292924 - RNA, 13 nt, Variola virus
uuuagaauacuaa

SEQ ID NO: 3292925 - RNA, 17 nt, Variola virus
acuggauauauuuuaca

SEQ ID NO: 3292926 - RNA, 17 nt, Variola virus
uuagucgucucaaagag

SEQ ID NO: 3292927 - RNA, 18 nt, Variola virus
ucauacuuguuaguaguu

SEQ ID NO: 3292928 - RNA, 21 nt, Variola virus
uucacucgguggauacaauaa

SEQ ID NO: 3292929 - RNA, 17 nt, Variola virus
caaaauaacaaauacua

SEQ ID NO: 3292930 - RNA, 22 nt, Variola virus
gaccacucuccgucauccuuca

SEQ ID NO: 3292931 - RNA, 18 nt, Variola virus
ucuuauuggucagaaguu

SEQ ID NO: 3292932 - RNA, 16 nt, Variola virus
augcaaagucuaaaua

SEQ ID NO: 3292933 - RNA, 21 nt, Variola virus
uaauagcuccccuguuuucau

SEQ ID NO: 3292934 - RNA, 21 nt, Variola virus
uaaacaugucuauuguuaauc

SEQ ID NO: 3292935 - RNA, 17 nt, Variola virus
acaaagauggcugaaau

SEQ ID NO: 3292936 - RNA, 15 nt, Variola virus
acuauuuuauaccuu

SEQ ID NO: 3292937 - RNA, 16 nt, Variola virus
aguguaccaauaugcg

SEQ ID NO: 3292938 - RNA, 13 nt, Variola virus
auacugucuguaa

SEQ ID NO: 3292939 - RNA, 20 nt, Variola virus
caugcaaagcucuaaaucca

SEQ ID NO: 3292940 - RNA, 16 nt, Variola virus
gcugaaugaucuuuuu

SEQ ID NO: 3292941 - RNA, 21 nt, Variola virus
aggguauauccaucacuaaaa

SEQ ID NO: 3292942 - RNA, 15 nt, Variola virus
uuaauguauaucuuu

SEQ ID NO: 3292943 - RNA, 12 nt, Variola virus
gcgaacaucuuu

SEQ ID NO: 3292944 - RNA, 13 nt, Variola virus
ucaacauauuaau

SEQ ID NO: 3292945 - RNA, 22 nt, Variola virus
gaauuauuacuuaaguuguaaa

SEQ ID NO: 3292946 - RNA, 15 nt, Variola virus
uuuucggguuccaaa

SEQ ID NO: 3292947 - RNA, 13 nt, Variola virus
agaugcaccauau

SEQ ID NO: 3292948 - RNA, 17 nt, Variola virus
cuuuuauuuccacauua

SEQ ID NO: 3292949 - RNA, 15 nt, Variola virus
cuacucguuuggaau

SEQ ID NO: 3292950 - RNA, 22 nt, Variola virus
cgucugucaugauaaaaauuua

SEQ ID NO: 3292951 - RNA, 18 nt, Variola virus
cauugugauuaaacauua

SEQ ID NO: 3292952 - RNA, 15 nt, Variola virus
cauuacgcucucugg

SEQ ID NO: 3292953 - RNA, 18 nt, Variola virus
gaauauuauuaugaugau

SEQ ID NO: 3292954 - RNA, 18 nt, Variola virus
auauuguuacagccaaga

SEQ ID NO: 3292955 - RNA, 16 nt, Variola virus
guggaugguuaaaaag

SEQ ID NO: 3292956 - RNA, 17 nt, Variola virus
auuaacggguucucaau

SEQ ID NO: 3292957 - RNA, 16 nt, Variola virus
uuaggaucuucuaaug

SEQ ID NO: 3292958 - RNA, 14 nt, Variola virus
gcguauauagucua

SEQ ID NO: 3292959 - RNA, 15 nt, Variola virus
auauuauacaaaaua

SEQ ID NO: 3292960 - RNA, 18 nt, Variola virus
auacuacuucuccaacau

SEQ ID NO: 3292961 - RNA, 15 nt, Variola virus
acuacguugaagauc

SEQ ID NO: 3292962 - RNA, 13 nt, Variola virus
auauccaucacua

SEQ ID NO: 3292963 - RNA, 16 nt, Variola virus
aacauaaacacagaua

SEQ ID NO: 3292964 - RNA, 15 nt, Variola virus
guguauaacaucuuu

SEQ ID NO: 3292965 - RNA, 12 nt, Variola virus
uauuuuaucauc

SEQ ID NO: 3292966 - RNA, 17 nt, Variola virus
uucuuguugcacuguaa

SEQ ID NO: 3292967 - RNA, 22 nt, Variola virus
uaugaauaucaggaaauguaua

SEQ ID NO: 3292968 - RNA, 13 nt, Variola virus
ucaaaacaaacag

SEQ ID NO: 3292969 - RNA, 21 nt, Variola virus
agcaaucuuuuagaugaugau

SEQ ID NO: 3292970 - RNA, 20 nt, Variola virus
aagauaccgcaccauaugcu

SEQ ID NO: 3292971 - RNA, 20 nt, Variola virus
ucugacuggguuguaauguu

SEQ ID NO: 3292972 - RNA, 18 nt, Variola virus
aauugucuguaaaccaca

SEQ ID NO: 3292973 - RNA, 16 nt, Variola virus
acaauuucuauuuccu

SEQ ID NO: 3292974 - RNA, 22 nt, Variola virus
aaguauuucuuacucaaaugaa

SEQ ID NO: 3292975 - RNA, 22 nt, Variola virus
uuuccaaguggcgaauuccaaa

SEQ ID NO: 3292976 - RNA, 14 nt, Variola virus
auguauacauaaua

SEQ ID NO: 3292977 - RNA, 18 nt, Variola virus
cuaaacgaucaaccaaaa

SEQ ID NO: 3292978 - RNA, 15 nt, Variola virus
uaucaucuguaagau

SEQ ID NO: 3292979 - RNA, 18 nt, Variola virus
acgauaaugucucuauaa

SEQ ID NO: 3292980 - RNA, 21 nt, Variola virus
uguaauaccagcgugaacaac

SEQ ID NO: 3292981 - RNA, 17 nt, Variola virus
auaugauaaacaaagau

SEQ ID NO: 3292982 - RNA, 22 nt, Variola virus
cuguucaaaaauuuagaaugau

SEQ ID NO: 3292983 - RNA, 17 nt, Variola virus
aaaguuaauaaucucau

SEQ ID NO: 3292984 - RNA, 13 nt, Variola virus
auucuaugaugaa

SEQ ID NO: 3292985 - RNA, 16 nt, Variola virus
cuguucuccguguggu

SEQ ID NO: 3292986 - RNA, 23 nt, Variola virus
cgacuaguucccgcauuaaauaa

SEQ ID NO: 3292987 - RNA, 23 nt, Variola virus
uuauugggugguaaacuagauaa

SEQ ID NO: 3292988 - RNA, 19 nt, Variola virus
uauuacgcuuaccaucaaa

SEQ ID NO: 3292989 - RNA, 16 nt, Variola virus
aauaguuuuuaucaua

SEQ ID NO: 3292990 - RNA, 18 nt, Variola virus
gauggguucgauauuaau

SEQ ID NO: 3292991 - RNA, 14 nt, Variola virus
uaucaucuauauca

SEQ ID NO: 3292992 - RNA, 15 nt, Variola virus
gguacaacauuccaa

SEQ ID NO: 3292993 - RNA, 17 nt, Variola virus
ucucauuaauuaaccau

SEQ ID NO: 3292994 - RNA, 18 nt, Variola virus
uugauaaagauagaugau

SEQ ID NO: 3292995 - RNA, 16 nt, Variola virus
aauauacauucgaaaa

SEQ ID NO: 3292996 - RNA, 21 nt, Variola virus
uaucauacaucggcuaccaaa

SEQ ID NO: 3292997 - RNA, 17 nt, Variola virus
ccaauuacaaaaacuac

SEQ ID NO: 3292998 - RNA, 13 nt, Variola virus
agagucaauguuu

SEQ ID NO: 3292999 - RNA, 21 nt, Variola virus
caauuaacauucuuauaacau

SEQ ID NO: 3293000 - RNA, 14 nt, Variola virus
auuauccaauagau

SEQ ID NO: 3293001 - RNA, 23 nt, Variola virus
guaaaaguacagaauuaauuaga

SEQ ID NO: 3293002 - RNA, 13 nt, Variola virus
ucuuauucuuaaa

SEQ ID NO: 3293003 - RNA, 17 nt, Variola virus
gacacuaguuaagaaca

SEQ ID NO: 3293004 - RNA, 21 nt, Variola virus
uauuuguacagguaccuacau

SEQ ID NO: 3293005 - RNA, 22 nt, Variola virus
cagaagauagcaaagagaugau

SEQ ID NO: 3293006 - RNA, 22 nt, Variola virus
acaauuuugcaccauucauaau

SEQ ID NO: 3293007 - RNA, 22 nt, Variola virus
uguugaugauaucuacaucguu

SEQ ID NO: 3293008 - RNA, 22 nt, Variola virus
ugugauuaaugugugacacauu

SEQ ID NO: 3293009 - RNA, 15 nt, Variola virus
aauaucuaggacaau

SEQ ID NO: 3293010 - RNA, 17 nt, Variola virus
guagaauuuuuuaaaaa

SEQ ID NO: 3293011 - RNA, 19 nt, Variola virus
uuagauaguugaucagaau

SEQ ID NO: 3293012 - RNA, 13 nt, Variola virus
uucuuguguaauu

SEQ ID NO: 3293013 - RNA, 12 nt, Variola virus
gaagcaaaauau

SEQ ID NO: 3293014 - RNA, 18 nt, Variola virus
ucgagaacagauuugaua

SEQ ID NO: 3293015 - RNA, 20 nt, Variola virus
aucagcauugcuuucauuau

SEQ ID NO: 3293016 - RNA, 19 nt, Variola virus
auuaauacggaauauagau

SEQ ID NO: 3293017 - RNA, 19 nt, Variola virus
aucgaauauaaaauaacua

SEQ ID NO: 3293018 - RNA, 21 nt, Variola virus
agaucccuuaucacacuuaaa

SEQ ID NO: 3293019 - RNA, 17 nt, Variola virus
acgauuuauauucacca

SEQ ID NO: 3293020 - RNA, 17 nt, Variola virus
uaccaaccuacacuauu

SEQ ID NO: 3293021 - RNA, 17 nt, Variola virus
uaucaugcuuuaacauu

SEQ ID NO: 3293022 - RNA, 20 nt, Variola virus
guuuaaaguaaacuucguaa

SEQ ID NO: 3293023 - RNA, 19 nt, Variola virus
ugucucuuaacuauuuccg

SEQ ID NO: 3293024 - RNA, 19 nt, Variola virus
ucaacacuacuauuauuga

SEQ ID NO: 3293025 - RNA, 22 nt, Variola virus
agauacuacaggaccguauuag

SEQ ID NO: 3293026 - RNA, 13 nt, Variola virus
uauggaauuccau

SEQ ID NO: 3293027 - RNA, 14 nt, Variola virus
uauccauuggaaaa

SEQ ID NO: 3293028 - RNA, 21 nt, Variola virus
uaauauucacagguauuauua

SEQ ID NO: 3293029 - RNA, 19 nt, Variola virus
gaguuagauauuaauaaca

SEQ ID NO: 3293030 - RNA, 22 nt, Variola virus
uugaccguguguaaaaugacuc

SEQ ID NO: 3293031 - RNA, 21 nt, Variola virus
ugauguaaucucuaaauucau

SEQ ID NO: 3293032 - RNA, 23 nt, Variola virus
ucaacaaauucugcaauaucuuc

SEQ ID NO: 3293033 - RNA, 17 nt, Variola virus
gaugucaagaucuuuug

SEQ ID NO: 3293034 - RNA, 14 nt, Variola virus
gauuccauauacca

SEQ ID NO: 3293035 - RNA, 13 nt, Variola virus
uaucaauagcagu

SEQ ID NO: 3293036 - RNA, 14 nt, Variola virus
aauuacagaaguac

SEQ ID NO: 3293037 - RNA, 15 nt, Variola virus
augagaacauaguau

SEQ ID NO: 3293038 - RNA, 15 nt, Variola virus
gaaauagauaaugaa

SEQ ID NO: 3293039 - RNA, 22 nt, Variola virus
agccaacaaauauaaaaugaua

SEQ ID NO: 3293040 - RNA, 14 nt, Variola virus
aggaaaaaaacaac

SEQ ID NO: 3293041 - RNA, 22 nt, Variola virus
cucuuugauuuugugucacaug

SEQ ID NO: 3293042 - RNA, 20 nt, Variola virus
uguaacauuaaguaaauccu

SEQ ID NO: 3293043 - RNA, 13 nt, Variola virus
aaacgaaaaauac

SEQ ID NO: 3293044 - RNA, 21 nt, Variola virus
uccuauauauuugaaaaucgu

SEQ ID NO: 3293045 - RNA, 15 nt, Variola virus
auccaagaaaaaguc

SEQ ID NO: 3293046 - RNA, 18 nt, Variola virus
ugccacugaucaugauug

SEQ ID NO: 3293047 - RNA, 13 nt, Variola virus
uaccuaauacuaa

SEQ ID NO: 3293048 - RNA, 16 nt, Variola virus
gaacauaagauaucua

SEQ ID NO: 3293049 - RNA, 23 nt, Variola virus
ugaacgguaucuucuugauuucu

SEQ ID NO: 3293050 - RNA, 19 nt, Variola virus
auacguaaaacucauuacu

SEQ ID NO: 3293051 - RNA, 21 nt, Variola virus
uauauucgauaguuauggaca

SEQ ID NO: 3293052 - RNA, 15 nt, Variola virus
cgcacaccaacaauu

SEQ ID NO: 3293053 - RNA, 13 nt, Variola virus
aaauaucuauuca

SEQ ID NO: 3293054 - RNA, 17 nt, Variola virus
aaggacaguuaaaacua

SEQ ID NO: 3293055 - RNA, 18 nt, Variola virus
ucuugauaaauuguacaa

SEQ ID NO: 3293056 - RNA, 13 nt, Variola virus
uguaaauguagua

SEQ ID NO: 3293057 - RNA, 13 nt, Variola virus
gucgucaaaauau

SEQ ID NO: 3293058 - RNA, 15 nt, Variola virus
gaucaaauuauugau

SEQ ID NO: 3293059 - RNA, 22 nt, Variola virus
auccacuauuaucaauucugga

SEQ ID NO: 3293060 - RNA, 12 nt, Variola virus
uaugaaugacuc

SEQ ID NO: 3293061 - RNA, 21 nt, Variola virus
aucucuuaaugagcguuuaaa

SEQ ID NO: 3293062 - RNA, 19 nt, Variola virus
auugucuuuacaaaucaua

SEQ ID NO: 3293063 - RNA, 14 nt, Variola virus
aaagacucagaaga

SEQ ID NO: 3293064 - RNA, 17 nt, Variola virus
ucauauuccaauucacg

SEQ ID NO: 3293065 - RNA, 20 nt, Variola virus
auacaaaauuugcaucuaca

SEQ ID NO: 3293066 - RNA, 22 nt, Variola virus
aauuaucguuccugguauauag

SEQ ID NO: 3293067 - RNA, 21 nt, Variola virus
auuuaucuaaccauucaauua

SEQ ID NO: 3293068 - RNA, 21 nt, Variola virus
auucuaccuuuuuauuuucua

SEQ ID NO: 3293069 - RNA, 21 nt, Variola virus
guucauuaaaaacaaacuuuu

SEQ ID NO: 3293070 - RNA, 19 nt, Variola virus
uguuuacggagacaaaauu

SEQ ID NO: 3293071 - RNA, 18 nt, Variola virus
augguaaaauacaaaaua

SEQ ID NO: 3293072 - RNA, 18 nt, Variola virus
uaaaauuucauagacuuu

SEQ ID NO: 3293073 - RNA, 14 nt, Variola virus
caaaccuagaugca

SEQ ID NO: 3293074 - RNA, 19 nt, Variola virus
ucccgccgauccuguauua

SEQ ID NO: 3293075 - RNA, 18 nt, Variola virus
agugacuuuguagcucuc

SEQ ID NO: 3293076 - RNA, 22 nt, Variola virus
cacguguagugggaacuauugc

SEQ ID NO: 3293077 - RNA, 14 nt, Variola virus
ugcgaucaauaaau

SEQ ID NO: 3293078 - RNA, 12 nt, Variola virus
aauauuaaauau

SEQ ID NO: 3293079 - RNA, 17 nt, Variola virus
gaaauuguuauaaugcu

SEQ ID NO: 3293080 - RNA, 15 nt, Variola virus
agccggacaaauaua

SEQ ID NO: 3293081 - RNA, 19 nt, Variola virus
gacuuguuaaaucuauaua

SEQ ID NO: 3293082 - RNA, 19 nt, Variola virus
ucuuuaaaguuucugaaau

SEQ ID NO: 3293083 - RNA, 19 nt, Variola virus
ucucuaaguuaacacaugu

SEQ ID NO: 3293084 - RNA, 23 nt, Variola virus
cacugggguaaaguaaguaucua

SEQ ID NO: 3293085 - RNA, 13 nt, Variola virus
auuuauaaaaaug

SEQ ID NO: 3293086 - RNA, 14 nt, Variola virus
aagaugaaaugauu

SEQ ID NO: 3293087 - RNA, 13 nt, Variola virus
acgaucaaccaaa

SEQ ID NO: 3293088 - RNA, 14 nt, Variola virus
auucacauaaaaga

SEQ ID NO: 3293089 - RNA, 18 nt, Variola virus
auaauauauuagauauuu

SEQ ID NO: 3293090 - RNA, 23 nt, Variola virus
auaccaaaucugguaaaaguuaa

SEQ ID NO: 3293091 - RNA, 15 nt, Variola virus
agaauucaacuauau

SEQ ID NO: 3293092 - RNA, 20 nt, Variola virus
cuaucuuuagcuucugaaau

SEQ ID NO: 3293093 - RNA, 23 nt, Variola virus
acuugaaauaaucggagaauguu

SEQ ID NO: 3293094 - RNA, 21 nt, Variola virus
uacauuuuuaaacuguuugua

SEQ ID NO: 3293095 - RNA, 14 nt, Variola virus
aaaaagaaugagua

SEQ ID NO: 3293096 - RNA, 18 nt, Variola virus
gucaaacuuaauaaagga

SEQ ID NO: 3293097 - RNA, 15 nt, Variola virus
uacuuuguguuucau

SEQ ID NO: 3293098 - RNA, 15 nt, Variola virus
uacuucuauacaaaa

SEQ ID NO: 3293099 - RNA, 12 nt, Variola virus
aucaaauuauug

SEQ ID NO: 3293100 - RNA, 16 nt, Variola virus
aagaugagcauaaaca

SEQ ID NO: 3293101 - RNA, 16 nt, Variola virus
uaguauagcagaaguu

SEQ ID NO: 3293102 - RNA, 16 nt, Variola virus
acguuuauucucaaau

SEQ ID NO: 3293103 - RNA, 13 nt, Variola virus
agcauaaaugcua

SEQ ID NO: 3293104 - RNA, 14 nt, Variola virus
aaucugaaaaugua

SEQ ID NO: 3293105 - RNA, 19 nt, Variola virus
agaugugauggaaaaauga

SEQ ID NO: 3293106 - RNA, 14 nt, Variola virus
acaaaaauacauaa

SEQ ID NO: 3293107 - RNA, 13 nt, Variola virus
ugaacauucaucu

SEQ ID NO: 3293108 - RNA, 14 nt, Variola virus
ucuauaaaauacua

SEQ ID NO: 3293109 - RNA, 18 nt, Variola virus
caaacuuuuucacagagc

SEQ ID NO: 3293110 - RNA, 16 nt, Variola virus
uagcagccaauacuuu

SEQ ID NO: 3293111 - RNA, 18 nt, Variola virus
uuaacggcguuuuggaaa

SEQ ID NO: 3293112 - RNA, 20 nt, Variola virus
auuaauaucuauuaaacgaa

SEQ ID NO: 3293113 - RNA, 21 nt, Variola virus
ugaggauuuacuaaguaauua

SEQ ID NO: 3293114 - RNA, 17 nt, Variola virus
auuaugaugauacauuu

SEQ ID NO: 3293115 - RNA, 16 nt, Variola virus
ccacguuuaaacauuc

SEQ ID NO: 3293116 - RNA, 12 nt, Variola virus
aaucacaaacau

SEQ ID NO: 3293117 - RNA, 14 nt, Variola virus
acaauucauuucca

SEQ ID NO: 3293118 - RNA, 19 nt, Variola virus
guaucucgucuaaauuaga

SEQ ID NO: 3293119 - RNA, 22 nt, Variola virus
aaaccaaucaauuauguaaaua

SEQ ID NO: 3293120 - RNA, 23 nt, Variola virus
uucuagaaaacgaaaacauccua

SEQ ID NO: 3293121 - RNA, 19 nt, Variola virus
gucaauuacgaauaaagcg

SEQ ID NO: 3293122 - RNA, 19 nt, Variola virus
aucggccuucuuuuuuaca

SEQ ID NO: 3293123 - RNA, 21 nt, Variola virus
aaaccaaaucuugauuacaaa

SEQ ID NO: 3293124 - RNA, 22 nt, Variola virus
ucuuaauagacauaucugccau

SEQ ID NO: 3293125 - RNA, 14 nt, Variola virus
aauauauucuauga

SEQ ID NO: 3293126 - RNA, 17 nt, Variola virus
agauauuaguaaaagau

SEQ ID NO: 3293127 - RNA, 19 nt, Variola virus
aguucuggcaauguuucau

SEQ ID NO: 3293128 - RNA, 17 nt, Variola virus
acuaguaacagucugaa

SEQ ID NO: 3293129 - RNA, 21 nt, Variola virus
cgauaaaauccuccuaucaau

SEQ ID NO: 3293130 - RNA, 15 nt, Variola virus
augacauuuauucau

SEQ ID NO: 3293131 - RNA, 22 nt, Variola virus
accauccguuaucgaagaaugg

SEQ ID NO: 3293132 - RNA, 12 nt, Variola virus
cugcugaaaaua

SEQ ID NO: 3293133 - RNA, 15 nt, Variola virus
ugugaguauuuuacu

SEQ ID NO: 3293134 - RNA, 12 nt, Variola virus
ucacauacuuug

SEQ ID NO: 3293135 - RNA, 22 nt, Variola virus
aaaauguauaacaaaugcagaa

SEQ ID NO: 3293136 - RNA, 15 nt, Variola virus
uccgccguucuaaug

SEQ ID NO: 3293137 - RNA, 20 nt, Variola virus
ucaguguccaucauuucauu

SEQ ID NO: 3293138 - RNA, 21 nt, Variola virus
cgcauuaguaagugcuacaaa

SEQ ID NO: 3293139 - RNA, 14 nt, Variola virus
aggaucuccaucaa

SEQ ID NO: 3293140 - RNA, 14 nt, Variola virus
uucacaauucauuc

SEQ ID NO: 3293141 - RNA, 14 nt, Variola virus
acaucaucugaaau

SEQ ID NO: 3293142 - RNA, 20 nt, Variola virus
ugauuagaaaauauaaauua

SEQ ID NO: 3293143 - RNA, 14 nt, Variola virus
gcgaauuacucugu

SEQ ID NO: 3293144 - RNA, 19 nt, Variola virus
gaauccgcugcauauuauu

SEQ ID NO: 3293145 - RNA, 13 nt, Variola virus
augaucuguuuau

SEQ ID NO: 3293146 - RNA, 13 nt, Variola virus
uacuuuacauaua

SEQ ID NO: 3293147 - RNA, 22 nt, Variola virus
uagagacaaacuauuaacuauc

SEQ ID NO: 3293148 - RNA, 22 nt, Variola virus
uuccgggugccgccaacaaggg

SEQ ID NO: 3293149 - RNA, 21 nt, Variola virus
cagauauagggauagaaguag

SEQ ID NO: 3293150 - RNA, 19 nt, Variola virus
ggaaaaaguguugaagaua

SEQ ID NO: 3293151 - RNA, 21 nt, Variola virus
uaguugauagaacaaaauaca

SEQ ID NO: 3293152 - RNA, 16 nt, Variola virus
uaggugcaucuggagc

SEQ ID NO: 3293153 - RNA, 15 nt, Variola virus
auccaaauucuggaa

SEQ ID NO: 3293154 - RNA, 23 nt, Variola virus
acgugucaauggcaguauuggga

SEQ ID NO: 3293155 - RNA, 18 nt, Variola virus
aaauuaugaaaaaaagau

SEQ ID NO: 3293156 - RNA, 22 nt, Variola virus
auaauauacuaauuaguaacga

SEQ ID NO: 3293157 - RNA, 22 nt, Variola virus
uuuucaguaccauuaucuuugu

SEQ ID NO: 3293158 - RNA, 14 nt, Variola virus
auauguuccaguaa

SEQ ID NO: 3293159 - RNA, 20 nt, Variola virus
cauauaguauucuuguauuc

SEQ ID NO: 3293160 - RNA, 17 nt, Variola virus
aauuuuaauauugaaaa

SEQ ID NO: 3293161 - RNA, 22 nt, Variola virus
ugaugagauguuauuaaauguu

SEQ ID NO: 3293162 - RNA, 15 nt, Variola virus
cggucgauucuuucg

SEQ ID NO: 3293163 - RNA, 23 nt, Variola virus
caugaauuuauuucuaauucuca

SEQ ID NO: 3293164 - RNA, 17 nt, Variola virus
aaauaucuuuaauacag

SEQ ID NO: 3293165 - RNA, 15 nt, Variola virus
auaaagaaaaaucua

SEQ ID NO: 3293166 - RNA, 16 nt, Variola virus
acauacguauaaucug

SEQ ID NO: 3293167 - RNA, 22 nt, Variola virus
uauuaucuucaucgauuucuau

SEQ ID NO: 3293168 - RNA, 21 nt, Variola virus
guucuaauuccgcauuaaaug

SEQ ID NO: 3293169 - RNA, 20 nt, Variola virus
uguauuaaauagaauauuua

SEQ ID NO: 3293170 - RNA, 16 nt, Variola virus
ggauuuuguauuaccu

SEQ ID NO: 3293171 - RNA, 20 nt, Variola virus
acuagauacaaaauuugcau

SEQ ID NO: 3293172 - RNA, 22 nt, Variola virus
ucagguucaucgaucucuauaa

SEQ ID NO: 3293173 - RNA, 15 nt, Variola virus
ucauuacucuaaaau

SEQ ID NO: 3293174 - RNA, 16 nt, Variola virus
auuuaacgaugucuau

SEQ ID NO: 3293175 - RNA, 18 nt, Variola virus
gaaauauguaauaaucau

SEQ ID NO: 3293176 - RNA, 17 nt, Variola virus
uauaaaaucuguaucga

SEQ ID NO: 3293177 - RNA, 15 nt, Variola virus
uaacaucacuaauau

SEQ ID NO: 3293178 - RNA, 23 nt, Variola virus
agaaaagguucuaucaacaauau

SEQ ID NO: 3293179 - RNA, 16 nt, Variola virus
uucacuaaauaguuuu

SEQ ID NO: 3293180 - RNA, 23 nt, Variola virus
gucacuaacugauaccaugaaau

SEQ ID NO: 3293181 - RNA, 17 nt, Variola virus
ccagaauacuauuuggu

SEQ ID NO: 3293182 - RNA, 16 nt, Variola virus
aauauuguuuuacugu

SEQ ID NO: 3293183 - RNA, 17 nt, Variola virus
cuaaagaaaaaugauug

SEQ ID NO: 3293184 - RNA, 17 nt, Variola virus
acuaauuguuuaaauaa

SEQ ID NO: 3293185 - RNA, 17 nt, Variola virus
acuuauuguuuuaauaa

SEQ ID NO: 3293186 - RNA, 16 nt, Variola virus
agauacguauuagaua

SEQ ID NO: 3293187 - RNA, 21 nt, Variola virus
gaaugucauuuguauuuuaua

SEQ ID NO: 3293188 - RNA, 15 nt, Variola virus
cugugacagauauca

SEQ ID NO: 3293189 - RNA, 19 nt, Variola virus
uaaaaugguaaacuuuugc

SEQ ID NO: 3293190 - RNA, 13 nt, Variola virus
agauguuaaauga

SEQ ID NO: 3293191 - RNA, 22 nt, Variola virus
gcaguggaguuauaugaauagu

SEQ ID NO: 3293192 - RNA, 18 nt, Variola virus
auaacagccaauaugaga

SEQ ID NO: 3293193 - RNA, 17 nt, Variola virus
uaucgcgauugcauaga

SEQ ID NO: 3293194 - RNA, 13 nt, Variola virus
augaaaaaaagau

SEQ ID NO: 3293195 - RNA, 17 nt, Variola virus
aauauucauauccuugu

SEQ ID NO: 3293196 - RNA, 17 nt, Variola virus
ccacugaugagauguua

SEQ ID NO: 3293197 - RNA, 17 nt, Variola virus
uauggcauucauugucu

SEQ ID NO: 3293198 - RNA, 18 nt, Variola virus
uuguccuaaaauacuauu

SEQ ID NO: 3293199 - RNA, 21 nt, Variola virus
gauuagaaaauauaaauuaau

SEQ ID NO: 3293200 - RNA, 15 nt, Variola virus
aucaaugauaugauu

SEQ ID NO: 3293201 - RNA, 22 nt, Variola virus
aaguugcgaugaaauaggagau

SEQ ID NO: 3293202 - RNA, 15 nt, Variola virus
auuaucaagaugugu

SEQ ID NO: 3293203 - RNA, 23 nt, Variola virus
agaaauuacauaaaaaaaaugua

SEQ ID NO: 3293204 - RNA, 17 nt, Variola virus
uauuaccauauuucuaa

SEQ ID NO: 3293205 - RNA, 17 nt, Variola virus
guuaaauaaauccuuca

SEQ ID NO: 3293206 - RNA, 14 nt, Variola virus
aaauaauacuauau

SEQ ID NO: 3293207 - RNA, 16 nt, Variola virus
ccguuaacaucucuuc

SEQ ID NO: 3293208 - RNA, 12 nt, Variola virus
uacagaaaauau

SEQ ID NO: 3293209 - RNA, 19 nt, Variola virus
auguauuuuuuaugauaua

SEQ ID NO: 3293210 - RNA, 13 nt, Variola virus
cagccaacaaaua

SEQ ID NO: 3293211 - RNA, 21 nt, Variola virus
ucaaugaguuuaauaacuuga

SEQ ID NO: 3293212 - RNA, 13 nt, Variola virus
aaguaucaaaucu

SEQ ID NO: 3293213 - RNA, 20 nt, Variola virus
uagauguuaaaaaaacaucg

SEQ ID NO: 3293214 - RNA, 14 nt, Variola virus
cauuuccaugucaa

SEQ ID NO: 3293215 - RNA, 16 nt, Variola virus
acgaguauagcaucau

SEQ ID NO: 3293216 - RNA, 16 nt, Variola virus
gaaaauacuaaaucag

SEQ ID NO: 3293217 - RNA, 16 nt, Variola virus
uggucaaaaacugaag

SEQ ID NO: 3293218 - RNA, 15 nt, Variola virus
uucagaauauucuuu

SEQ ID NO: 3293219 - RNA, 20 nt, Variola virus
guuccaauagguaucaaaga

SEQ ID NO: 3293220 - RNA, 21 nt, Variola virus
uuuuucgcgggauacaucauc

SEQ ID NO: 3293221 - RNA, 18 nt, Variola virus
agucuacauugucauuau

SEQ ID NO: 3293222 - RNA, 16 nt, Variola virus
gaacgccgguauauag

SEQ ID NO: 3293223 - RNA, 13 nt, Variola virus
aaaauauuaucua

SEQ ID NO: 3293224 - RNA, 20 nt, Variola virus
auacgaagggauugaaaaua

SEQ ID NO: 3293225 - RNA, 15 nt, Variola virus
auucugaugcaucaa

SEQ ID NO: 3293226 - RNA, 21 nt, Variola virus
uauaauuuuuuuucuagauaa

SEQ ID NO: 3293227 - RNA, 17 nt, Variola virus
aauaucaaacaauccaa

SEQ ID NO: 3293228 - RNA, 17 nt, Variola virus
acauugacauauuucga

SEQ ID NO: 3293229 - RNA, 19 nt, Variola virus
accgaaggagauacuauca

SEQ ID NO: 3293230 - RNA, 18 nt, Variola virus
augacuuuaguaaaucau

SEQ ID NO: 3293231 - RNA, 18 nt, Variola virus
auucauggaguuagaaaa

SEQ ID NO: 3293232 - RNA, 18 nt, Variola virus
ucaccugccauaaauaaa

SEQ ID NO: 3293233 - RNA, 15 nt, Variola virus
uuccuggagauaucc

SEQ ID NO: 3293234 - RNA, 17 nt, Variola virus
aagugcuuaaauauuuc

SEQ ID NO: 3293235 - RNA, 16 nt, Variola virus
aacucgguaaaaaauu

SEQ ID NO: 3293236 - RNA, 15 nt, Variola virus
aacaaacaucucacc

SEQ ID NO: 3293237 - RNA, 14 nt, Variola virus
uaaacuaauucauu

SEQ ID NO: 3293238 - RNA, 14 nt, Variola virus
acuaacacacaaug

SEQ ID NO: 3293239 - RNA, 21 nt, Variola virus
aacucugauuauugucuaaua

SEQ ID NO: 3293240 - RNA, 19 nt, Variola virus
guucguacccaucuuaaug

SEQ ID NO: 3293241 - RNA, 21 nt, Variola virus
uacuguauugauuacagugua

SEQ ID NO: 3293242 - RNA, 19 nt, Variola virus
aaguuugagauuucauaau

SEQ ID NO: 3293243 - RNA, 13 nt, Variola virus
ucaugaacauaau

SEQ ID NO: 3293244 - RNA, 15 nt, Variola virus
uugaaugauguaguu

SEQ ID NO: 3293245 - RNA, 14 nt, Variola virus
ccaucgauuguuua

SEQ ID NO: 3293246 - RNA, 21 nt, Variola virus
caauugcauucccaucauuuc

SEQ ID NO: 3293247 - RNA, 15 nt, Variola virus
uauaugacuguauuu

SEQ ID NO: 3293248 - RNA, 23 nt, Variola virus
uuuaucagaagauggauggauga

SEQ ID NO: 3293249 - RNA, 15 nt, Variola virus
guucauaaauaaaaa

SEQ ID NO: 3293250 - RNA, 14 nt, Variola virus
ucaucuaucauaga

SEQ ID NO: 3293251 - RNA, 13 nt, Variola virus
auagucauagcau

SEQ ID NO: 3293252 - RNA, 19 nt, Variola virus
ccacagauaauauuagaca

SEQ ID NO: 3293253 - RNA, 21 nt, Variola virus
cauacaugaaaugaucucuau

SEQ ID NO: 3293254 - RNA, 14 nt, Variola virus
ucauccgucucauu

SEQ ID NO: 3293255 - RNA, 13 nt, Variola virus
gauaauaaaucau

SEQ ID NO: 3293256 - RNA, 13 nt, Variola virus
agucgucaagcau

SEQ ID NO: 3293257 - RNA, 21 nt, Variola virus
acaucaacuaccuaaggaaua

SEQ ID NO: 3293258 - RNA, 13 nt, Variola virus
agaucccacauca

SEQ ID NO: 3293259 - RNA, 23 nt, Variola virus
aaaucaguaacuauguucauuuu

SEQ ID NO: 3293260 - RNA, 15 nt, Variola virus
uuagugggcaucuuu

SEQ ID NO: 3293261 - RNA, 12 nt, Variola virus
ucccuuuccaaa

SEQ ID NO: 3293262 - RNA, 18 nt, Variola virus
aguauuagucauaaacuu

SEQ ID NO: 3293263 - RNA, 15 nt, Variola virus
uaacauuacauauua

SEQ ID NO: 3293264 - RNA, 12 nt, Variola virus
guuuaucuuuuu

SEQ ID NO: 3293265 - RNA, 22 nt, Variola virus
auuccaguuuuaaacaaaauac

SEQ ID NO: 3293266 - RNA, 17 nt, Variola virus
gauacaauggaugauau

SEQ ID NO: 3293267 - RNA, 22 nt, Variola virus
cuguagagggucaacaaucguu

SEQ ID NO: 3293268 - RNA, 20 nt, Variola virus
ucuuauuggucagaaguuuu

SEQ ID NO: 3293269 - RNA, 17 nt, Variola virus
acauaacagguagaauu

SEQ ID NO: 3293270 - RNA, 12 nt, Variola virus
ccaaaagacuau

SEQ ID NO: 3293271 - RNA, 16 nt, Variola virus
uauuauugauagcauu

SEQ ID NO: 3293272 - RNA, 19 nt, Variola virus
aucuugcaaguuaaauaga

SEQ ID NO: 3293273 - RNA, 18 nt, Variola virus
auaucaacucauguguaa

SEQ ID NO: 3293274 - RNA, 15 nt, Variola virus
uaauaaaguguauau

SEQ ID NO: 3293275 - RNA, 13 nt, Variola virus
uggaaagauauca

SEQ ID NO: 3293276 - RNA, 12 nt, Variola virus
acuaaagacuau

SEQ ID NO: 3293277 - RNA, 15 nt, Variola virus
caauuagaacacgua

SEQ ID NO: 3293278 - RNA, 20 nt, Variola virus
uaauacaggaauauaaucuu

SEQ ID NO: 3293279 - RNA, 23 nt, Variola virus
aaguaucuacgauuuuuacaaaa

SEQ ID NO: 3293280 - RNA, 14 nt, Variola virus
accuaagggauuuu

SEQ ID NO: 3293281 - RNA, 15 nt, Variola virus
aucaugaauggauuu

SEQ ID NO: 3293282 - RNA, 19 nt, Variola virus
agcgaaaaauaauuauucu

SEQ ID NO: 3293283 - RNA, 22 nt, Variola virus
gccaauucuuccauugauguua

SEQ ID NO: 3293284 - RNA, 19 nt, Variola virus
uuacaaaaaaaucaauuaa

SEQ ID NO: 3293285 - RNA, 22 nt, Variola virus
ucuugacugucuaucucuguaa

SEQ ID NO: 3293286 - RNA, 16 nt, Variola virus
agguaguaaaaaauaa

SEQ ID NO: 3293287 - RNA, 13 nt, Variola virus
caaaauuaucaau

SEQ ID NO: 3293288 - RNA, 20 nt, Variola virus
ugauacggugaugguuuuua

SEQ ID NO: 3293289 - RNA, 18 nt, Variola virus
uagaauuauaccaauaga

SEQ ID NO: 3293290 - RNA, 21 nt, Variola virus
uucaacuuugaaauuguuuuu

SEQ ID NO: 3293291 - RNA, 20 nt, Variola virus
ucuaaauuauauuuauuauu

SEQ ID NO: 3293292 - RNA, 20 nt, Variola virus
aaaguagaaaauauauucua

SEQ ID NO: 3293293 - RNA, 13 nt, Variola virus
ugaauuagauaua

SEQ ID NO: 3293294 - RNA, 15 nt, Variola virus
caaacaugacauuuu

SEQ ID NO: 3293295 - RNA, 14 nt, Variola virus
aguauaaugauauc

SEQ ID NO: 3293296 - RNA, 21 nt, Variola virus
uaccauggacggagacaaauu

SEQ ID NO: 3293297 - RNA, 23 nt, Variola virus
gacugauuauugaguuaaaauca

SEQ ID NO: 3293298 - RNA, 19 nt, Variola virus
caugaaauauauuaagaaa

SEQ ID NO: 3293299 - RNA, 23 nt, Variola virus
uaccaaacuuucagaagaaaugg

SEQ ID NO: 3293300 - RNA, 12 nt, Variola virus
uuacgaaacuau

SEQ ID NO: 3293301 - RNA, 14 nt, Variola virus
uaauguaaaaucau

SEQ ID NO: 3293302 - RNA, 14 nt, Variola virus
uuaaccgauaaaaa

SEQ ID NO: 3293303 - RNA, 19 nt, Variola virus
auucucuaguuacacuaug

SEQ ID NO: 3293304 - RNA, 20 nt, Variola virus
auguccucaaauaaauacuc

SEQ ID NO: 3293305 - RNA, 20 nt, Variola virus
auuacguauuauauauguaa

SEQ ID NO: 3293306 - RNA, 15 nt, Variola virus
gacauaucugccaua

SEQ ID NO: 3293307 - RNA, 18 nt, Variola virus
caauaugccaauaaugau

SEQ ID NO: 3293308 - RNA, 14 nt, Variola virus
ccaucguuaauuau

SEQ ID NO: 3293309 - RNA, 15 nt, Variola virus
uaaaauuagagguau

SEQ ID NO: 3293310 - RNA, 20 nt, Variola virus
cauuguaugguuuuaaauau

SEQ ID NO: 3293311 - RNA, 15 nt, Variola virus
aucccggauacuuuu

SEQ ID NO: 3293312 - RNA, 23 nt, Variola virus
ccagaucuauugacuauaacucc

SEQ ID NO: 3293313 - RNA, 23 nt, Variola virus
auauaguuuuggaucaaauggau

SEQ ID NO: 3293314 - RNA, 16 nt, Variola virus
ccaucugguuuaauau

SEQ ID NO: 3293315 - RNA, 18 nt, Variola virus
uuagacguagaaaacgga

SEQ ID NO: 3293316 - RNA, 14 nt, Variola virus
aacaauaaugagaa

SEQ ID NO: 3293317 - RNA, 19 nt, Variola virus
ucuuugaucacuaccgagu

SEQ ID NO: 3293318 - RNA, 19 nt, Variola virus
agagacaaacuauuaacua

SEQ ID NO: 3293319 - RNA, 21 nt, Variola virus
acugcauauugucccaauguu

SEQ ID NO: 3293320 - RNA, 19 nt, Variola virus
uacaacuaguuuucaucaa

SEQ ID NO: 3293321 - RNA, 23 nt, Variola virus
uuaaauuaauaauggauauagua

SEQ ID NO: 3293322 - RNA, 16 nt, Variola virus
uuaauuaguaacuguu

SEQ ID NO: 3293323 - RNA, 13 nt, Variola virus
uucauuaacuaga

SEQ ID NO: 3293324 - RNA, 14 nt, Variola virus
auaauacuuaaaaa

SEQ ID NO: 3293325 - RNA, 13 nt, Variola virus
uaaauauuucauu

SEQ ID NO: 3293326 - RNA, 15 nt, Variola virus
aucauccguaucuuc

SEQ ID NO: 3293327 - RNA, 15 nt, Variola virus
cuuaaauauuucuac

SEQ ID NO: 3293328 - RNA, 19 nt, Variola virus
uugucucaugaccguguau

SEQ ID NO: 3293329 - RNA, 16 nt, Variola virus
aaauauaaucguguau

SEQ ID NO: 3293330 - RNA, 16 nt, Variola virus
auaauccagaauguac

SEQ ID NO: 3293331 - RNA, 22 nt, Variola virus
guguauuaccccucauaguauu

SEQ ID NO: 3293332 - RNA, 17 nt, Variola virus
aaaaauuuaaagaaugu

SEQ ID NO: 3293333 - RNA, 17 nt, Variola virus
ugccauaucauacauga

SEQ ID NO: 3293334 - RNA, 20 nt, Variola virus
uaaaaugucuccaauuuuug

SEQ ID NO: 3293335 - RNA, 23 nt, Variola virus
uuaccucuucugauaucauuaau

SEQ ID NO: 3293336 - RNA, 23 nt, Variola virus
caauaaauaugauuuuguaaagu

SEQ ID NO: 3293337 - RNA, 13 nt, Variola virus
aguauguaacaga

SEQ ID NO: 3293338 - RNA, 17 nt, Variola virus
uaugucucuuaacuauu

SEQ ID NO: 3293339 - RNA, 12 nt, Variola virus
ucguagaaagua

SEQ ID NO: 3293340 - RNA, 14 nt, Variola virus
uauaugacuguauu

SEQ ID NO: 3293341 - RNA, 21 nt, Variola virus
agaugagcauaaacauaauaa

SEQ ID NO: 3293342 - RNA, 23 nt, Variola virus
cuuuuuugacaggaucagguucu

SEQ ID NO: 3293343 - RNA, 21 nt, Variola virus
uauucacagucgccauuuagu

SEQ ID NO: 3293344 - RNA, 14 nt, Variola virus
acaaacauacucua

SEQ ID NO: 3293345 - RNA, 18 nt, Variola virus
aauauuacgaauuacauu

SEQ ID NO: 3293346 - RNA, 18 nt, Variola virus
gacaaaauauuagaaaaa

SEQ ID NO: 3293347 - RNA, 22 nt, Variola virus
aauuuuguuuuuguacuuucua

SEQ ID NO: 3293348 - RNA, 14 nt, Variola virus
agaauuagaauuac

SEQ ID NO: 3293349 - RNA, 18 nt, Variola virus
aacguauuaaauauuaau

SEQ ID NO: 3293350 - RNA, 22 nt, Variola virus
ucuacaaauagagauaaaacaa

SEQ ID NO: 3293351 - RNA, 12 nt, Variola virus
cugucaacaaug

SEQ ID NO: 3293352 - RNA, 22 nt, Variola virus
uuucauuccaggaucuagauaa

SEQ ID NO: 3293353 - RNA, 18 nt, Variola virus
uaguuguaaaguuaaaau

SEQ ID NO: 3293354 - RNA, 16 nt, Variola virus
uuuaacauauguauca

SEQ ID NO: 3293355 - RNA, 19 nt, Variola virus
ugcccccauucuuaauaau

SEQ ID NO: 3293356 - RNA, 18 nt, Variola virus
auaauagauuuaucuagu

SEQ ID NO: 3293357 - RNA, 17 nt, Variola virus
gaaaaauaacaaaucua

SEQ ID NO: 3293358 - RNA, 21 nt, Variola virus
aaacgaacacuauuagaauua

SEQ ID NO: 3293359 - RNA, 22 nt, Variola virus
aauacuucucuguccuuaauaa

SEQ ID NO: 3293360 - RNA, 14 nt, Variola virus
uaauauaauacuaa

SEQ ID NO: 3293361 - RNA, 15 nt, Variola virus
aucauuaauacagua

SEQ ID NO: 3293362 - RNA, 12 nt, Variola virus
guuccauauuau

SEQ ID NO: 3293363 - RNA, 20 nt, Variola virus
gcuaaguauacgaucuuuua

SEQ ID NO: 3293364 - RNA, 19 nt, Variola virus
gugagaacuuguuaaagaa

SEQ ID NO: 3293365 - RNA, 17 nt, Variola virus
gcauuggcaucaaaaga

SEQ ID NO: 3293366 - RNA, 14 nt, Variola virus
cccaaauaucuuua

SEQ ID NO: 3293367 - RNA, 21 nt, Variola virus
acgacgacauauuaguaacug

SEQ ID NO: 3293368 - RNA, 18 nt, Variola virus
cacuaaguauauacacag

SEQ ID NO: 3293369 - RNA, 14 nt, Variola virus
augaagaaagaaaa

SEQ ID NO: 3293370 - RNA, 15 nt, Variola virus
cuaauaucauuagua

SEQ ID NO: 3293371 - RNA, 21 nt, Variola virus
acuaucaguaaguuuuauaga

SEQ ID NO: 3293372 - RNA, 12 nt, Variola virus
agaauaauacag

SEQ ID NO: 3293373 - RNA, 23 nt, Variola virus
gaagcagcugcagcaacuucugu

SEQ ID NO: 3293374 - RNA, 21 nt, Variola virus
auguguuuacacuaacuguau

SEQ ID NO: 3293375 - RNA, 19 nt, Variola virus
uauauaaguaauaccaaaa

SEQ ID NO: 3293376 - RNA, 14 nt, Variola virus
uaaaaguuaaacuu

SEQ ID NO: 3293377 - RNA, 22 nt, Variola virus
uuuuugugggaagugauucaaa

SEQ ID NO: 3293378 - RNA, 17 nt, Variola virus
auuuggaaaagaaaauu

SEQ ID NO: 3293379 - RNA, 13 nt, Variola virus
uccacuuaaauau

SEQ ID NO: 3293380 - RNA, 18 nt, Variola virus
auaagaaaucaagacuac

SEQ ID NO: 3293381 - RNA, 16 nt, Variola virus
uacaaaugauacugau

SEQ ID NO: 3293382 - RNA, 22 nt, Variola virus
uaauaaacauuccacauucaga

SEQ ID NO: 3293383 - RNA, 19 nt, Variola virus
caucuaacuauaugauauc

SEQ ID NO: 3293384 - RNA, 15 nt, Variola virus
aucguuaagaauugu

SEQ ID NO: 3293385 - RNA, 17 nt, Variola virus
auauaccgccucaaacu

SEQ ID NO: 3293386 - RNA, 11 nt, Variola virus
aaauggauaau

SEQ ID NO: 3293387 - RNA, 13 nt, Variola virus
ugcugucaaacaa

SEQ ID NO: 3293388 - RNA, 18 nt, Variola virus
gaaauauauuaagaaauc

SEQ ID NO: 3293389 - RNA, 13 nt, Variola virus
aaccaaauacaua

SEQ ID NO: 3293390 - RNA, 17 nt, Variola virus
agaugauaauuuauaca

SEQ ID NO: 3293391 - RNA, 21 nt, Variola virus
caauaugucuguacaaauguu

SEQ ID NO: 3293392 - RNA, 24 nt, Variola virus
uuaaaggauggcgaaauuauugca

SEQ ID NO: 3293393 - RNA, 18 nt, Variola virus
acaguaucagauaaucua

SEQ ID NO: 3293394 - RNA, 13 nt, Variola virus
agcacagaacaca

SEQ ID NO: 3293395 - RNA, 14 nt, Variola virus
aaaauuauaugacc

SEQ ID NO: 3293396 - RNA, 12 nt, Variola virus
ucauugauuuuu

SEQ ID NO: 3293397 - RNA, 22 nt, Variola virus
uuauugcauguuuucauauuca

SEQ ID NO: 3293398 - RNA, 13 nt, Variola virus
ugagaaauuauuc

SEQ ID NO: 3293399 - RNA, 19 nt, Variola virus
ucaaucucuucuauuuuca

SEQ ID NO: 3293400 - RNA, 17 nt, Variola virus
cagucuaauauccauuu

SEQ ID NO: 3293401 - RNA, 19 nt, Variola virus
agguacuauaauauuaaaa

SEQ ID NO: 3293402 - RNA, 11 nt, Variola virus
caaaucuucuu

SEQ ID NO: 3293403 - RNA, 12 nt, Variola virus
accaaauuauca

SEQ ID NO: 3293404 - RNA, 22 nt, Variola virus
uuuuauaaucuuuauggaucua

SEQ ID NO: 3293405 - RNA, 12 nt, Variola virus
acuauccaauaa

SEQ ID NO: 3293406 - RNA, 20 nt, Variola virus
uuagauaaauggaauacuaa

SEQ ID NO: 3293407 - RNA, 22 nt, Variola virus
aggucgccauacgucaaauuua

SEQ ID NO: 3293408 - RNA, 13 nt, Variola virus
cgcauuaaaugau

SEQ ID NO: 3293409 - RNA, 19 nt, Variola virus
guguccguauaccaacaug

SEQ ID NO: 3293410 - RNA, 23 nt, Variola virus
uaacccauuauaaaacuuaugau

SEQ ID NO: 3293411 - RNA, 17 nt, Variola virus
aacguuaucauuuucua

SEQ ID NO: 3293412 - RNA, 13 nt, Variola virus
aucaauaaauagu

SEQ ID NO: 3293413 - RNA, 20 nt, Variola virus
gcacaaaugugcuuaaacga

SEQ ID NO: 3293414 - RNA, 23 nt, Variola virus
uuacgacgagcauauucauaaau

SEQ ID NO: 3293415 - RNA, 23 nt, Variola virus
uggaaugcuguuuaauguuucca

SEQ ID NO: 3293416 - RNA, 20 nt, Variola virus
cauucuacguccuauggaug

SEQ ID NO: 3293417 - RNA, 22 nt, Variola virus
uguaaacuguugaugauaucua

SEQ ID NO: 3293418 - RNA, 19 nt, Variola virus
aauccuauacucugaaaga

SEQ ID NO: 3293419 - RNA, 14 nt, Variola virus
cuagaauaucccaa

SEQ ID NO: 3293420 - RNA, 16 nt, Variola virus
auggaguauaaucuuu

SEQ ID NO: 3293421 - RNA, 15 nt, Variola virus
gauacguauauuaau

SEQ ID NO: 3293422 - RNA, 23 nt, Variola virus
cauuaucuggauuaaacauacua

SEQ ID NO: 3293423 - RNA, 18 nt, Variola virus
aaaauggcauaugcuuua

SEQ ID NO: 3293424 - RNA, 22 nt, Variola virus
uuaacgauuggaaaucauuaac

SEQ ID NO: 3293425 - RNA, 23 nt, Variola virus
uaagauuuuugagauaucucauu

SEQ ID NO: 3293426 - RNA, 14 nt, Variola virus
ugccauuaagaaac

SEQ ID NO: 3293427 - RNA, 13 nt, Variola virus
aacaaguuuuuau

SEQ ID NO: 3293428 - RNA, 15 nt, Variola virus
uuagaaaaaacauca

SEQ ID NO: 3293429 - RNA, 21 nt, Variola virus
uauucaaacuaauacaucuga

SEQ ID NO: 3293430 - RNA, 13 nt, Variola virus
agauaaugugaau

SEQ ID NO: 3293431 - RNA, 15 nt, Variola virus
uagaagcuaacauac

SEQ ID NO: 3293432 - RNA, 15 nt, Variola virus
caaauguuaaacauu

SEQ ID NO: 3293433 - RNA, 17 nt, Variola virus
ugucaagaucuuuugua

SEQ ID NO: 3293434 - RNA, 13 nt, Variola virus
caacauuguagaa

SEQ ID NO: 3293435 - RNA, 18 nt, Variola virus
ucauccuuaaauguuuuc

SEQ ID NO: 3293436 - RNA, 17 nt, Variola virus
gauguaucacacgcucu

SEQ ID NO: 3293437 - RNA, 13 nt, Variola virus
cugcauucaauuc

SEQ ID NO: 3293438 - RNA, 15 nt, Variola virus
aucuauuacaaacau

SEQ ID NO: 3293439 - RNA, 19 nt, Variola virus
uccauaaauuuauaauguu

SEQ ID NO: 3293440 - RNA, 22 nt, Variola virus
aaaguaguucaacauaauauua

SEQ ID NO: 3293441 - RNA, 18 nt, Variola virus
aaugccacaucaaagaua

SEQ ID NO: 3293442 - RNA, 13 nt, Variola virus
uagaaaauggauu

SEQ ID NO: 3293443 - RNA, 19 nt, Variola virus
aaucucuaucgucacauau

SEQ ID NO: 3293444 - RNA, 20 nt, Variola virus
uuacaauuaauaaguauaaa

SEQ ID NO: 3293445 - RNA, 18 nt, Variola virus
uuacagaucuaguauaau

SEQ ID NO: 3293446 - RNA, 14 nt, Variola virus
uggaaguuccaaac

SEQ ID NO: 3293447 - RNA, 14 nt, Variola virus
uucgucaaacauua

SEQ ID NO: 3293448 - RNA, 18 nt, Variola virus
acauggaauaaauuauua

SEQ ID NO: 3293449 - RNA, 14 nt, Variola virus
aucguuacaaaaga

SEQ ID NO: 3293450 - RNA, 15 nt, Variola virus
gcgauucagaacaca

SEQ ID NO: 3293451 - RNA, 13 nt, Variola virus
ugcuuccauaaua

SEQ ID NO: 3293452 - RNA, 17 nt, Variola virus
uaguuauaucacaugau

SEQ ID NO: 3293453 - RNA, 15 nt, Variola virus
ucuuaaaacaguuuu

SEQ ID NO: 3293454 - RNA, 14 nt, Variola virus
auuacaaaagaaac

SEQ ID NO: 3293455 - RNA, 16 nt, Variola virus
aauuguauuauuuccc

SEQ ID NO: 3293456 - RNA, 13 nt, Variola virus
guccaaaaugaug

SEQ ID NO: 3293457 - RNA, 18 nt, Variola virus
aauccaaaaaaugaaauc

SEQ ID NO: 3293458 - RNA, 22 nt, Variola virus
uauuaaacucuacauaaucaua

SEQ ID NO: 3293459 - RNA, 24 nt, Variola virus
aaaggggugagaacguuccagagu

SEQ ID NO: 3293460 - RNA, 17 nt, Variola virus
auuuguaggaaaaagau

SEQ ID NO: 3293461 - RNA, 18 nt, Variola virus
agugcgaugauuguacac

SEQ ID NO: 3293462 - RNA, 18 nt, Variola virus
uuuuaaauuuuguauuua

SEQ ID NO: 3293463 - RNA, 17 nt, Variola virus
ugaauucucauuuugca

SEQ ID NO: 3293464 - RNA, 23 nt, Variola virus
guuaaucgucgaacguucuagua

SEQ ID NO: 3293465 - RNA, 15 nt, Variola virus
cucuuaauuauaacg

SEQ ID NO: 3293466 - RNA, 14 nt, Variola virus
auaugcuacaagau

SEQ ID NO: 3293467 - RNA, 19 nt, Variola virus
uagaauguauuuuaacacu

SEQ ID NO: 3293468 - RNA, 23 nt, Variola virus
cagggacacucaaacuaaauguc

SEQ ID NO: 3293469 - RNA, 20 nt, Variola virus
aguauuuacaauguagaaau

SEQ ID NO: 3293470 - RNA, 17 nt, Variola virus
gaaaucguauauaacua

SEQ ID NO: 3293471 - RNA, 20 nt, Variola virus
caauuaacauucuuauaaca

SEQ ID NO: 3293472 - RNA, 11 nt, Variola virus
agaaaauggau

SEQ ID NO: 3293473 - RNA, 19 nt, Variola virus
auuuaucuguuuuggugaa

SEQ ID NO: 3293474 - RNA, 15 nt, Variola virus
uuguaauuaaauuuu

SEQ ID NO: 3293475 - RNA, 16 nt, Variola virus
uauuacguauuauaua

SEQ ID NO: 3293476 - RNA, 19 nt, Variola virus
agcuagaggaaaugaaaga

SEQ ID NO: 3293477 - RNA, 12 nt, Variola virus
acauuaaaugua

SEQ ID NO: 3293478 - RNA, 19 nt, Variola virus
ccugccauaaauaaaugcu

SEQ ID NO: 3293479 - RNA, 15 nt, Variola virus
gacauaguaauacau

SEQ ID NO: 3293480 - RNA, 23 nt, Variola virus
caauagagaccgcgucuguuaua

SEQ ID NO: 3293481 - RNA, 12 nt, Variola virus
aacuuaaugaaa

SEQ ID NO: 3293482 - RNA, 23 nt, Variola virus
uaaacucuccaccauuuccgcau

SEQ ID NO: 3293483 - RNA, 17 nt, Variola virus
acccaacaauacauuua

SEQ ID NO: 3293484 - RNA, 22 nt, Variola virus
aucuaaaacuacguucgaugaa

SEQ ID NO: 3293485 - RNA, 19 nt, Variola virus
uaauauuaaaaauaagaau

SEQ ID NO: 3293486 - RNA, 23 nt, Variola virus
uuaguauauaacauuaauacuau

SEQ ID NO: 3293487 - RNA, 15 nt, Variola virus
auguauaacuuuacu

SEQ ID NO: 3293488 - RNA, 12 nt, Variola virus
uucuuguuaaug

SEQ ID NO: 3293489 - RNA, 20 nt, Variola virus
ugucuggagaucuaaagaua

SEQ ID NO: 3293490 - RNA, 14 nt, Variola virus
cagaggaaacuaau

SEQ ID NO: 3293491 - RNA, 22 nt, Variola virus
cuuaugaaacuuggaaacaucu

SEQ ID NO: 3293492 - RNA, 14 nt, Variola virus
uugguucucuagau

SEQ ID NO: 3293493 - RNA, 13 nt, Variola virus
uagacgaugauuu

SEQ ID NO: 3293494 - RNA, 21 nt, Variola virus
auggauaauccgucuauuuua

SEQ ID NO: 3293495 - RNA, 14 nt, Variola virus
uucauuaaggagau

SEQ ID NO: 3293496 - RNA, 15 nt, Variola virus
uugguacauuuuuca

SEQ ID NO: 3293497 - RNA, 17 nt, Variola virus
uuccaugauauccaaaa

SEQ ID NO: 3293498 - RNA, 12 nt, Variola virus
ucaaaagaagau

SEQ ID NO: 3293499 - RNA, 22 nt, Variola virus
aauaucaucaauauagagauua

SEQ ID NO: 3293500 - RNA, 16 nt, Variola virus
uaauuuuagaagcuau

SEQ ID NO: 3293501 - RNA, 20 nt, Variola virus
accacuucucuaucaaugau

SEQ ID NO: 3293502 - RNA, 21 nt, Variola virus
gaaagucuuagggaugaggaa

SEQ ID NO: 3293503 - RNA, 14 nt, Variola virus
caaugaauuaacuu

SEQ ID NO: 3293504 - RNA, 22 nt, Variola virus
gauuguacacccaucauggaau

SEQ ID NO: 3293505 - RNA, 15 nt, Variola virus
agaccaucuaacaga

SEQ ID NO: 3293506 - RNA, 15 nt, Variola virus
uaaguuacaggaacu

SEQ ID NO: 3293507 - RNA, 14 nt, Variola virus
uucccaaauaauca

SEQ ID NO: 3293508 - RNA, 22 nt, Variola virus
uuagacuaucucugacacuaca

SEQ ID NO: 3293509 - RNA, 15 nt, Variola virus
agauacagauguaaa

SEQ ID NO: 3293510 - RNA, 20 nt, Variola virus
aguacuaauaaggaacuaga

SEQ ID NO: 3293511 - RNA, 21 nt, Variola virus
aagaagcuggaugugggagau

SEQ ID NO: 3293512 - RNA, 15 nt, Variola virus
uaauaaaacaaugga

SEQ ID NO: 3293513 - RNA, 20 nt, Variola virus
auuguacacuucuauaguau

SEQ ID NO: 3293514 - RNA, 13 nt, Variola virus
gccagaaucaugg

SEQ ID NO: 3293515 - RNA, 22 nt, Variola virus
guucucgccuaagagauaaaaa

SEQ ID NO: 3293516 - RNA, 22 nt, Variola virus
agaaauggaaaucguaauacca

SEQ ID NO: 3293517 - RNA, 17 nt, Variola virus
cagaacaucuuccauag

SEQ ID NO: 3293518 - RNA, 16 nt, Variola virus
uuccacauuaauacag

SEQ ID NO: 3293519 - RNA, 16 nt, Variola virus
gaaauuuaaaauuaga

SEQ ID NO: 3293520 - RNA, 20 nt, Variola virus
aacuuaacaaaucuuaauau

SEQ ID NO: 3293521 - RNA, 19 nt, Variola virus
aucucauuaagcuaauaga

SEQ ID NO: 3293522 - RNA, 15 nt, Variola virus
ucauguuaacacucu

SEQ ID NO: 3293523 - RNA, 16 nt, Variola virus
aaacaguauguuguac

SEQ ID NO: 3293524 - RNA, 21 nt, Variola virus
acaauacagaagauagcaaag

SEQ ID NO: 3293525 - RNA, 19 nt, Variola virus
uuugaauauacuuuuaauu

SEQ ID NO: 3293526 - RNA, 19 nt, Variola virus
auagaaauaaaaauuauua

SEQ ID NO: 3293527 - RNA, 15 nt, Variola virus
aauuuauuuaucaau

SEQ ID NO: 3293528 - RNA, 21 nt, Variola virus
auaauacauuuaaauuuauca

SEQ ID NO: 3293529 - RNA, 14 nt, Variola virus
uauauaaauacuuu

SEQ ID NO: 3293530 - RNA, 22 nt, Variola virus
uagaaaacagagauaguaaaua

SEQ ID NO: 3293531 - RNA, 16 nt, Variola virus
gucgagguuuaaagaa

SEQ ID NO: 3293532 - RNA, 18 nt, Variola virus
aacuaugucaaaaauugu

SEQ ID NO: 3293533 - RNA, 13 nt, Variola virus
agauaaacuagau

SEQ ID NO: 3293534 - RNA, 12 nt, Variola virus
auuauaauguau

SEQ ID NO: 3293535 - RNA, 22 nt, Variola virus
gauauauauugcacgauaaugu

SEQ ID NO: 3293536 - RNA, 13 nt, Variola virus
gcaaaaauaauau

SEQ ID NO: 3293537 - RNA, 15 nt, Variola virus
gaucauguagaaaac

SEQ ID NO: 3293538 - RNA, 16 nt, Variola virus
gauaauuaauaauaua

SEQ ID NO: 3293539 - RNA, 12 nt, Variola virus
agaaauaaagua

SEQ ID NO: 3293540 - RNA, 20 nt, Variola virus
gaauauacaaaguuaguaca

SEQ ID NO: 3293541 - RNA, 13 nt, Variola virus
caaauuuaucuac

SEQ ID NO: 3293542 - RNA, 22 nt, Variola virus
caaaucuaaauucacaucuuca

SEQ ID NO: 3293543 - RNA, 19 nt, Variola virus
guaaaaugaaauaucuuaa

SEQ ID NO: 3293544 - RNA, 14 nt, Variola virus
acauauuuauaauu

SEQ ID NO: 3293545 - RNA, 13 nt, Variola virus
cgaauaaauagau

SEQ ID NO: 3293546 - RNA, 13 nt, Variola virus
uaauaguaaauga

SEQ ID NO: 3293547 - RNA, 21 nt, Variola virus
uguaucauauucaacauguuu

SEQ ID NO: 3293548 - RNA, 20 nt, Variola virus
cuaacaauaacuagaucauc

SEQ ID NO: 3293549 - RNA, 16 nt, Variola virus
agauuuauaauacuuu

SEQ ID NO: 3293550 - RNA, 13 nt, Variola virus
augguaaauacug

SEQ ID NO: 3293551 - RNA, 22 nt, Variola virus
auccaaaaguuccgagauaauu

SEQ ID NO: 3293552 - RNA, 19 nt, Variola virus
agauacuaucaaaauaucu

SEQ ID NO: 3293553 - RNA, 17 nt, Variola virus
caaagaguuacacuaag

SEQ ID NO: 3293554 - RNA, 20 nt, Variola virus
uccauaauacucccacaaau

SEQ ID NO: 3293555 - RNA, 22 nt, Variola virus
uagaauuuauagacgacucauu

SEQ ID NO: 3293556 - RNA, 15 nt, Variola virus
aaugugcuacuaaga

SEQ ID NO: 3293557 - RNA, 18 nt, Variola virus
auuaauacacauaaugaa

SEQ ID NO: 3293558 - RNA, 19 nt, Variola virus
uauaaaauucccaaucuug

SEQ ID NO: 3293559 - RNA, 22 nt, Variola virus
gauuaauaauucauggaaauuu

SEQ ID NO: 3293560 - RNA, 13 nt, Variola virus
uauucacauaucg

SEQ ID NO: 3293561 - RNA, 18 nt, Variola virus
auaugaaccugacaugau

SEQ ID NO: 3293562 - RNA, 22 nt, Variola virus
uuacuacguucauauuccaauu

SEQ ID NO: 3293563 - RNA, 20 nt, Variola virus
cuaauuuuguagcauuagua

SEQ ID NO: 3293564 - RNA, 16 nt, Variola virus
cuaacucuuauauacc

SEQ ID NO: 3293565 - RNA, 19 nt, Variola virus
uccauauuucuuaauguaa

SEQ ID NO: 3293566 - RNA, 21 nt, Variola virus
auauuaggcacagucaaacau

SEQ ID NO: 3293567 - RNA, 13 nt, Variola virus
uauccauuauucu

SEQ ID NO: 3293568 - RNA, 15 nt, Variola virus
acaauaauuauaauu

SEQ ID NO: 3293569 - RNA, 13 nt, Variola virus
uaacggaugaaaa

SEQ ID NO: 3293570 - RNA, 19 nt, Variola virus
uuacaauguagaaauuaga

SEQ ID NO: 3293571 - RNA, 11 nt, Variola virus
auauaggaaaa

SEQ ID NO: 3293572 - RNA, 16 nt, Variola virus
aucauuaaaaaaauua

SEQ ID NO: 3293573 - RNA, 23 nt, Variola virus
ugagauguuauuaaauguugaua

SEQ ID NO: 3293574 - RNA, 17 nt, Variola virus
ugauagccguagaucuu

SEQ ID NO: 3293575 - RNA, 17 nt, Variola virus
cacucucccuauaucuu

SEQ ID NO: 3293576 - RNA, 12 nt, Variola virus
agauaaaacaag

SEQ ID NO: 3293577 - RNA, 19 nt, Variola virus
uucuacugaugcauguauu

SEQ ID NO: 3293578 - RNA, 13 nt, Variola virus
guucauaaucauc

SEQ ID NO: 3293579 - RNA, 23 nt, Variola virus
auuucuccaaagaauauaucuaa

SEQ ID NO: 3293580 - RNA, 18 nt, Variola virus
agugugaauaugaucuuc

SEQ ID NO: 3293581 - RNA, 21 nt, Variola virus
agacaauuauauaaaacauuu

SEQ ID NO: 3293582 - RNA, 21 nt, Variola virus
ucaccaauaaaaauaaacuag

SEQ ID NO: 3293583 - RNA, 12 nt, Variola virus
gaugaaauaugu

SEQ ID NO: 3293584 - RNA, 9 nt, Variola virus
uuagaaaaa

SEQ ID NO: 3293585 - RNA, 14 nt, Variola virus
auguuuuuaauagc

SEQ ID NO: 3293586 - RNA, 13 nt, Variola virus
caauauuuacaau

SEQ ID NO: 3293587 - RNA, 18 nt, Variola virus
cguuggaccauuaauagg

SEQ ID NO: 3293588 - RNA, 17 nt, Variola virus
uauauuaaaaaauguca

SEQ ID NO: 3293589 - RNA, 22 nt, Variola virus
uuauuacuaaacuacgugaaca

SEQ ID NO: 3293590 - RNA, 14 nt, Variola virus
cagauaauaacaga

SEQ ID NO: 3293591 - RNA, 12 nt, Variola virus
cacauaaaagaa

SEQ ID NO: 3293592 - RNA, 21 nt, Variola virus
gaacucuguuucuguaucuau

SEQ ID NO: 3293593 - RNA, 18 nt, Variola virus
auuccauuaucugaaaug

SEQ ID NO: 3293594 - RNA, 20 nt, Variola virus
aaacucgcuuaauaucuucu

SEQ ID NO: 3293595 - RNA, 14 nt, Variola virus
uccuuacacaaaua

SEQ ID NO: 3293596 - RNA, 19 nt, Variola virus
auauuacuaaacacacauu

SEQ ID NO: 3293597 - RNA, 22 nt, Variola virus
guuguagauaaucguuaauauu

SEQ ID NO: 3293598 - RNA, 15 nt, Variola virus
auacaaaauaauaga

SEQ ID NO: 3293599 - RNA, 12 nt, Variola virus
gcaaaauuuaua

SEQ ID NO: 3293600 - RNA, 17 nt, Variola virus
agaaucaucuguuguau

SEQ ID NO: 3293601 - RNA, 17 nt, Variola virus
agaacauaauaauauau

SEQ ID NO: 3293602 - RNA, 21 nt, Variola virus
caguaauagcuccauaaacug

SEQ ID NO: 3293603 - RNA, 20 nt, Variola virus
ucaguuccggaucuauagaa

SEQ ID NO: 3293604 - RNA, 19 nt, Variola virus
agaaaucauccguuguuau

SEQ ID NO: 3293605 - RNA, 13 nt, Variola virus
uuauuaaaaugag

SEQ ID NO: 3293606 - RNA, 23 nt, Variola virus
uuaaaaacaaacuuuuuauccuu

SEQ ID NO: 3293607 - RNA, 22 nt, Variola virus
aguauuuauacuuuuaggaaau

SEQ ID NO: 3293608 - RNA, 19 nt, Variola virus
aaaaagauuucagaaucua

SEQ ID NO: 3293609 - RNA, 14 nt, Variola virus
acaauuuauuucua

SEQ ID NO: 3293610 - RNA, 12 nt, Variola virus
uuauuuauguca

SEQ ID NO: 3293611 - RNA, 19 nt, Variola virus
cuacauacauaagcaucuc

SEQ ID NO: 3293612 - RNA, 20 nt, Variola virus
uacaaauuacaauaaugcag

SEQ ID NO: 3293613 - RNA, 19 nt, Variola virus
aaacgaguacuuuaaagaa

SEQ ID NO: 3293614 - RNA, 15 nt, Variola virus
auuuugcuaucuuga

SEQ ID NO: 3293615 - RNA, 21 nt, Variola virus
uuuacaagauuauuaaauccu

SEQ ID NO: 3293616 - RNA, 22 nt, Variola virus
agaauuuuuauaaauuuuucca

SEQ ID NO: 3293617 - RNA, 22 nt, Variola virus
acaaacauuuuuguugguguaa

SEQ ID NO: 3293618 - RNA, 13 nt, Variola virus
auauuagaauuua

SEQ ID NO: 3293619 - RNA, 19 nt, Variola virus
agaacuuaugaccguaaua

SEQ ID NO: 3293620 - RNA, 12 nt, Variola virus
cuauccaauaaa

SEQ ID NO: 3293621 - RNA, 13 nt, Variola virus
uguuuucauacau

SEQ ID NO: 3293622 - RNA, 14 nt, Variola virus
agaauauacuacaa

SEQ ID NO: 3293623 - RNA, 23 nt, Variola virus
acuaauucauuuucaauaauaua

SEQ ID NO: 3293624 - RNA, 12 nt, Variola virus
cucuaaaugagu

SEQ ID NO: 3293625 - RNA, 21 nt, Variola virus
gaucuuacuguuucuucacuc

SEQ ID NO: 3293626 - RNA, 18 nt, Variola virus
agugcagauaaucauuua

SEQ ID NO: 3293627 - RNA, 23 nt, Variola virus
aauaagaacuauaaaaaaaauaa

SEQ ID NO: 3293628 - RNA, 19 nt, Variola virus
ucuaauuuccugauucaga

SEQ ID NO: 3293629 - RNA, 15 nt, Variola virus
uaauauugaaaauac

SEQ ID NO: 3293630 - RNA, 15 nt, Variola virus
uuuuucaaauucuca

SEQ ID NO: 3293631 - RNA, 13 nt, Variola virus
caugauaguuuua

SEQ ID NO: 3293632 - RNA, 12 nt, Variola virus
ucaucuagaaug

SEQ ID NO: 3293633 - RNA, 17 nt, Variola virus
ccaacguaauaaugaag

SEQ ID NO: 3293634 - RNA, 16 nt, Variola virus
uaugcgggaauuaaug

SEQ ID NO: 3293635 - RNA, 12 nt, Variola virus
cagacugugcau

SEQ ID NO: 3293636 - RNA, 22 nt, Variola virus
gcccaauuuugguguaaaucua

SEQ ID NO: 3293637 - RNA, 15 nt, Variola virus
guauccguauaaaaa

SEQ ID NO: 3293638 - RNA, 15 nt, Variola virus
auaauaguaacauau

SEQ ID NO: 3293639 - RNA, 15 nt, Variola virus
uuuuacgaauaaaag

SEQ ID NO: 3293640 - RNA, 15 nt, Variola virus
caauuucauaaugag

SEQ ID NO: 3293641 - RNA, 16 nt, Variola virus
cguuuggauuaaucug

SEQ ID NO: 3293642 - RNA, 22 nt, Variola virus
guaauagaauacgaugauauua

SEQ ID NO: 3293643 - RNA, 18 nt, Variola virus
aaacauuuugacugaaua

SEQ ID NO: 3293644 - RNA, 22 nt, Variola virus
aucgcaucaaauaaaauuauug

SEQ ID NO: 3293645 - RNA, 14 nt, Variola virus
uuacaaucaauaau

SEQ ID NO: 3293646 - RNA, 15 nt, Variola virus
aauucuaucucuaag

SEQ ID NO: 3293647 - RNA, 16 nt, Variola virus
uaaagauagaugauga

SEQ ID NO: 3293648 - RNA, 21 nt, Variola virus
guauaccuuuccaguauauga

SEQ ID NO: 3293649 - RNA, 21 nt, Variola virus
agagggagccgauaacuuuau

SEQ ID NO: 3293650 - RNA, 16 nt, Variola virus
uaacugcaguguguau

SEQ ID NO: 3293651 - RNA, 16 nt, Variola virus
aacgggauauaugaau

SEQ ID NO: 3293652 - RNA, 14 nt, Variola virus
gaacaauaaaagag

SEQ ID NO: 3293653 - RNA, 15 nt, Variola virus
acgcgucuuuaacuc

SEQ ID NO: 3293654 - RNA, 15 nt, Variola virus
caauauuguagaauu

SEQ ID NO: 3293655 - RNA, 21 nt, Variola virus
cauuuagauagucacauuuca

SEQ ID NO: 3293656 - RNA, 20 nt, Variola virus
cuuuauaucguguucauuaa

SEQ ID NO: 3293657 - RNA, 15 nt, Variola virus
cuuuauaacugaacu

SEQ ID NO: 3293658 - RNA, 21 nt, Variola virus
gcugagaauaucuuuauucau

SEQ ID NO: 3293659 - RNA, 17 nt, Variola virus
ucaucuugucuagaaug

SEQ ID NO: 3293660 - RNA, 22 nt, Variola virus
acuauauaguuuaaauuaagca

SEQ ID NO: 3293661 - RNA, 21 nt, Variola virus
aaugaugacuugauagaauau

SEQ ID NO: 3293662 - RNA, 21 nt, Variola virus
auaaaggagaaggaaaaugaa

SEQ ID NO: 3293663 - RNA, 22 nt, Variola virus
aaagucuuuacagauuucaucc

SEQ ID NO: 3293664 - RNA, 21 nt, Variola virus
cauaucugcgacggagcauuu

SEQ ID NO: 3293665 - RNA, 19 nt, Variola virus
aauguuugacugaauauau

SEQ ID NO: 3293666 - RNA, 17 nt, Variola virus
uuacaagaauauaaaaa

SEQ ID NO: 3293667 - RNA, 18 nt, Variola virus
aacaucggaaaaaaaucu

SEQ ID NO: 3293668 - RNA, 14 nt, Variola virus
uauaaaguguaugu

SEQ ID NO: 3293669 - RNA, 22 nt, Variola virus
gagagaucauuucuauaauuua

SEQ ID NO: 3293670 - RNA, 14 nt, Variola virus
aauacauguacaaa

SEQ ID NO: 3293671 - RNA, 22 nt, Variola virus
cauauaguuuggauuaauaauu

SEQ ID NO: 3293672 - RNA, 21 nt, Variola virus
auagcugaaacaaagaauugc

SEQ ID NO: 3293673 - RNA, 17 nt, Variola virus
uguuuaccucuacaaau

SEQ ID NO: 3293674 - RNA, 15 nt, Variola virus
ccaucucuauguuuc

SEQ ID NO: 3293675 - RNA, 22 nt, Variola virus
caauugguuaugauaucaugua

SEQ ID NO: 3293676 - RNA, 22 nt, Variola virus
cagauugaauaggaguuugaau

SEQ ID NO: 3293677 - RNA, 15 nt, Variola virus
uaaaaacauuauucu

SEQ ID NO: 3293678 - RNA, 20 nt, Variola virus
acacaguaaccaaaaugaaa

SEQ ID NO: 3293679 - RNA, 22 nt, Variola virus
ucauagaugaaauacucuuuaa

SEQ ID NO: 3293680 - RNA, 22 nt, Variola virus
acaaguuauacgucauuucauc

SEQ ID NO: 3293681 - RNA, 23 nt, Variola virus
agucuaaaaguucuuuauugcac

SEQ ID NO: 3293682 - RNA, 22 nt, Variola virus
cagacaauaagagcagcacaaa

SEQ ID NO: 3293683 - RNA, 20 nt, Variola virus
augcauuauccaaaauauua

SEQ ID NO: 3293684 - RNA, 18 nt, Variola virus
caguggaguaguaaaugc

SEQ ID NO: 3293685 - RNA, 15 nt, Variola virus
aauuacuaaaauaua

SEQ ID NO: 3293686 - RNA, 21 nt, Variola virus
ucaugcauuuguuaguuauuc

SEQ ID NO: 3293687 - RNA, 16 nt, Variola virus
agauuaauuuugaauu

SEQ ID NO: 3293688 - RNA, 19 nt, Variola virus
auuaacaaaaucuuuaauu

SEQ ID NO: 3293689 - RNA, 13 nt, Variola virus
gaugaacagguua

SEQ ID NO: 3293690 - RNA, 18 nt, Variola virus
ugauuucuggugauacgu

SEQ ID NO: 3293691 - RNA, 12 nt, Variola virus
uuucauacauau

SEQ ID NO: 3293692 - RNA, 22 nt, Variola virus
uauuaccaaaaaaaauaacauu

SEQ ID NO: 3293693 - RNA, 19 nt, Variola virus
agauuuuuagcguauuauc

SEQ ID NO: 3293694 - RNA, 20 nt, Variola virus
uguaaaggauauuauauguu

SEQ ID NO: 3293695 - RNA, 22 nt, Variola virus
auaauauccugaacagcauuga

SEQ ID NO: 3293696 - RNA, 13 nt, Variola virus
aauacaagcaucu

SEQ ID NO: 3293697 - RNA, 18 nt, Variola virus
aguaggauauauuaaagu

SEQ ID NO: 3293698 - RNA, 16 nt, Variola virus
aauuacagacaguaau

SEQ ID NO: 3293699 - RNA, 23 nt, Variola virus
cuucagaauauucuuuucuaaga

SEQ ID NO: 3293700 - RNA, 13 nt, Variola virus
acugaaacuauac

SEQ ID NO: 3293701 - RNA, 16 nt, Variola virus
aucuucgucuauuaca

SEQ ID NO: 3293702 - RNA, 22 nt, Variola virus
auccgugguuagcauauaccuc

SEQ ID NO: 3293703 - RNA, 23 nt, Variola virus
acgauauuuguuggauuucugau

SEQ ID NO: 3293704 - RNA, 19 nt, Variola virus
uuaauacaccguuaacaau

SEQ ID NO: 3293705 - RNA, 21 nt, Variola virus
uccauagugguacaauacuac

SEQ ID NO: 3293706 - RNA, 18 nt, Variola virus
gauacaugauuaauacau

SEQ ID NO: 3293707 - RNA, 22 nt, Variola virus
gaaaccagaaugaaaaacucug

SEQ ID NO: 3293708 - RNA, 23 nt, Variola virus
gcuuuuauuuuuggaauaaucuc

SEQ ID NO: 3293709 - RNA, 20 nt, Variola virus
aacauuauaucguuaucauu

SEQ ID NO: 3293710 - RNA, 14 nt, Variola virus
auuaaauuauugau

SEQ ID NO: 3293711 - RNA, 17 nt, Variola virus
agauuuuaguccugugu

SEQ ID NO: 3293712 - RNA, 14 nt, Variola virus
auguaacaauauua

SEQ ID NO: 3293713 - RNA, 19 nt, Variola virus
uaucuacauauuuaccaaa

SEQ ID NO: 3293714 - RNA, 17 nt, Variola virus
aauuaugauagaaauua

SEQ ID NO: 3293715 - RNA, 17 nt, Variola virus
guuaguacuacugaaga

SEQ ID NO: 3293716 - RNA, 23 nt, Variola virus
uggaaauguuauagaaaauuaaa

SEQ ID NO: 3293717 - RNA, 14 nt, Variola virus
caaauguugucaaa

SEQ ID NO: 3293718 - RNA, 14 nt, Variola virus
ucaccaacuacaua

SEQ ID NO: 3293719 - RNA, 14 nt, Variola virus
uguaucaaaugcua

SEQ ID NO: 3293720 - RNA, 23 nt, Variola virus
aauaaccguuagacauaaaauug

SEQ ID NO: 3293721 - RNA, 22 nt, Variola virus
agugcuacaaaacagaaauaug

SEQ ID NO: 3293722 - RNA, 12 nt, Variola virus
uuaucauuauua

SEQ ID NO: 3293723 - RNA, 19 nt, Variola virus
auagcuuucacucauauaa

SEQ ID NO: 3293724 - RNA, 14 nt, Variola virus
aaucaucauaucca

SEQ ID NO: 3293725 - RNA, 16 nt, Variola virus
aauggauaauuuccau

SEQ ID NO: 3293726 - RNA, 13 nt, Variola virus
uaugauauucauu

SEQ ID NO: 3293727 - RNA, 21 nt, Variola virus
uauggucagugcauaauaaag

SEQ ID NO: 3293728 - RNA, 11 nt, Variola virus
aauacagaaug

SEQ ID NO: 3293729 - RNA, 22 nt, Variola virus
uccugacgucuagaguuuauau

SEQ ID NO: 3293730 - RNA, 12 nt, Variola virus
uuucuaaauuca

SEQ ID NO: 3293731 - RNA, 17 nt, Variola virus
auagagcccguaaaugc

SEQ ID NO: 3293732 - RNA, 14 nt, Variola virus
cguaucuucugaaa

SEQ ID NO: 3293733 - RNA, 16 nt, Variola virus
acuauagaugcuauca

SEQ ID NO: 3293734 - RNA, 15 nt, Variola virus
ucauucaagauaagc

SEQ ID NO: 3293735 - RNA, 22 nt, Variola virus
cuaagguagaaucucuauuugu

SEQ ID NO: 3293736 - RNA, 18 nt, Variola virus
acuccggucgaugaugau

SEQ ID NO: 3293737 - RNA, 13 nt, Variola virus
aaucuuuaccaua

SEQ ID NO: 3293738 - RNA, 14 nt, Variola virus
ugaauguuuucaau

SEQ ID NO: 3293739 - RNA, 14 nt, Variola virus
cagcauuaacugau

SEQ ID NO: 3293740 - RNA, 22 nt, Variola virus
guaccagcauuuguaauaaucc

SEQ ID NO: 3293741 - RNA, 15 nt, Variola virus
acuguggauguaaua

SEQ ID NO: 3293742 - RNA, 21 nt, Variola virus
auuaguuuuuuguuacugacu

SEQ ID NO: 3293743 - RNA, 15 nt, Variola virus
auaauauucaugucu

SEQ ID NO: 3293744 - RNA, 23 nt, Variola virus
cuaauguuuccggagauagauuu

SEQ ID NO: 3293745 - RNA, 14 nt, Variola virus
augaacuuguuuaa

SEQ ID NO: 3293746 - RNA, 17 nt, Variola virus
agaauuuagaaauauau

SEQ ID NO: 3293747 - RNA, 19 nt, Variola virus
aaucaguggaguaguaaau

SEQ ID NO: 3293748 - RNA, 18 nt, Variola virus
acaaccgcuuagaaauaa

SEQ ID NO: 3293749 - RNA, 14 nt, Variola virus
ggauauguuuuuaa

SEQ ID NO: 3293750 - RNA, 22 nt, Variola virus
caaaaacacaacaaaugauaau

SEQ ID NO: 3293751 - RNA, 23 nt, Variola virus
agaaaauaucuucuccuguaaua

SEQ ID NO: 3293752 - RNA, 17 nt, Variola virus
gucaucuuauguuuuua

SEQ ID NO: 3293753 - RNA, 22 nt, Variola virus
guggaggaguugcugaugauga

SEQ ID NO: 3293754 - RNA, 20 nt, Variola virus
cauauuaucaccuauugcca

SEQ ID NO: 3293755 - RNA, 15 nt, Variola virus
auauuaaugucguau

SEQ ID NO: 3293756 - RNA, 15 nt, Variola virus
cucauuaaaacuucu

SEQ ID NO: 3293757 - RNA, 19 nt, Variola virus
agauagcggacagcuauau

SEQ ID NO: 3293758 - RNA, 20 nt, Variola virus
aggcacagucaaacauucaa

SEQ ID NO: 3293759 - RNA, 15 nt, Variola virus
aaccuaagacaaauu

SEQ ID NO: 3293760 - RNA, 13 nt, Variola virus
uuaucaaaucuag

SEQ ID NO: 3293761 - RNA, 15 nt, Variola virus
agucaacaucuaaag

SEQ ID NO: 3293762 - RNA, 17 nt, Variola virus
ucauauaguuauguaua

SEQ ID NO: 3293763 - RNA, 12 nt, Variola virus
uucuucuguauc

SEQ ID NO: 3293764 - RNA, 17 nt, Variola virus
cuuauuuuuaaaaauua

SEQ ID NO: 3293765 - RNA, 13 nt, Variola virus
uaugaaaauagca

SEQ ID NO: 3293766 - RNA, 14 nt, Variola virus
aguuaguuuuagau

SEQ ID NO: 3293767 - RNA, 20 nt, Variola virus
uaacuuaaaagaauuacuua

SEQ ID NO: 3293768 - RNA, 16 nt, Variola virus
auagaugccagauuac

SEQ ID NO: 3293769 - RNA, 21 nt, Variola virus
acauaauuuucuauaacugaa

SEQ ID NO: 3293770 - RNA, 15 nt, Variola virus
agguuuaguaucuca

SEQ ID NO: 3293771 - RNA, 23 nt, Variola virus
aucagucuuguauuccaaauuaa

SEQ ID NO: 3293772 - RNA, 12 nt, Variola virus
uacguaaagaag

SEQ ID NO: 3293773 - RNA, 23 nt, Variola virus
aaugccuuacucgguguauauaa

SEQ ID NO: 3293774 - RNA, 17 nt, Variola virus
uagaggacuuggauguu

SEQ ID NO: 3293775 - RNA, 17 nt, Variola virus
cuuugguuuaauuauuu

SEQ ID NO: 3293776 - RNA, 18 nt, Variola virus
agauuauaucauaaauaa

SEQ ID NO: 3293777 - RNA, 21 nt, Variola virus
cgaauuaugucuuuauucucu

SEQ ID NO: 3293778 - RNA, 23 nt, Variola virus
guuuccacauuaaccaaguaaug

SEQ ID NO: 3293779 - RNA, 14 nt, Variola virus
auaucucaaagaug

SEQ ID NO: 3293780 - RNA, 18 nt, Variola virus
ugcguuaagaucuaauau

SEQ ID NO: 3293781 - RNA, 19 nt, Variola virus
auuaaugucguauuugaac

SEQ ID NO: 3293782 - RNA, 16 nt, Variola virus
aacugucaaugaauua

SEQ ID NO: 3293783 - RNA, 19 nt, Variola virus
caggauuuccaaucuuuug

SEQ ID NO: 3293784 - RNA, 22 nt, Variola virus
gaucuaauagaugaauauauca

SEQ ID NO: 3293785 - RNA, 16 nt, Variola virus
aauuucguuagucaua

SEQ ID NO: 3293786 - RNA, 15 nt, Variola virus
cucaugacuucauug

SEQ ID NO: 3293787 - RNA, 20 nt, Variola virus
gaaguuuaauaauacaauau

SEQ ID NO: 3293788 - RNA, 18 nt, Variola virus
agaugccaagauaucuau

SEQ ID NO: 3293789 - RNA, 15 nt, Variola virus
aacgaaguaaaaagu

SEQ ID NO: 3293790 - RNA, 13 nt, Variola virus
acuagaagagaau

SEQ ID NO: 3293791 - RNA, 17 nt, Variola virus
cugccauuuuagagauu

SEQ ID NO: 3293792 - RNA, 15 nt, Variola virus
gaucauacauuauga

SEQ ID NO: 3293793 - RNA, 22 nt, Variola virus
guacacauauggaauauaucua

SEQ ID NO: 3293794 - RNA, 18 nt, Variola virus
caaagauucuguguauaa

SEQ ID NO: 3293795 - RNA, 22 nt, Variola virus
gaagaacguguauuaaauagaa

SEQ ID NO: 3293796 - RNA, 20 nt, Variola virus
cuucagaauauucuuuucua

SEQ ID NO: 3293797 - RNA, 19 nt, Variola virus
ucaaugcggguguuauuca

SEQ ID NO: 3293798 - RNA, 17 nt, Variola virus
ugacauuuauucaucau

SEQ ID NO: 3293799 - RNA, 19 nt, Variola virus
gagcucaucuaagaaauag

SEQ ID NO: 3293800 - RNA, 24 nt, Variola virus
aaugaggaaaucguauaaauacug

SEQ ID NO: 3293801 - RNA, 12 nt, Variola virus
aaaguggauaaa

SEQ ID NO: 3293802 - RNA, 15 nt, Variola virus
agaauacgaugauau

SEQ ID NO: 3293803 - RNA, 18 nt, Variola virus
uguaaaaaauuauacugu

SEQ ID NO: 3293804 - RNA, 13 nt, Variola virus
ccaaauucuggaa

SEQ ID NO: 3293805 - RNA, 24 nt, Variola virus
auauccuuugcauucuauuuacca

SEQ ID NO: 3293806 - RNA, 17 nt, Variola virus
uuagcagaauauauaag

SEQ ID NO: 3293807 - RNA, 18 nt, Variola virus
aauauagaaauaaugaua

SEQ ID NO: 3293808 - RNA, 22 nt, Variola virus
auuuucugacaaaguuagaaaa

SEQ ID NO: 3293809 - RNA, 22 nt, Variola virus
aaugagauuauuaaguauuuau

SEQ ID NO: 3293810 - RNA, 16 nt, Variola virus
acuuugguaaauguua

SEQ ID NO: 3293811 - RNA, 17 nt, Variola virus
uagcucuguuaguuucc

SEQ ID NO: 3293812 - RNA, 21 nt, Variola virus
gaauuaacgaaacaauguuuc

SEQ ID NO: 3293813 - RNA, 21 nt, Variola virus
cuacaauugucuaaugauauc

SEQ ID NO: 3293814 - RNA, 14 nt, Variola virus
cauguuuauuucua

SEQ ID NO: 3293815 - RNA, 16 nt, Variola virus
cuuuauaauuaaugaa

SEQ ID NO: 3293816 - RNA, 22 nt, Variola virus
gaauaucuguaggcuucuuguu

SEQ ID NO: 3293817 - RNA, 14 nt, Variola virus
auucuagucuuaac

SEQ ID NO: 3293818 - RNA, 18 nt, Variola virus
uaaagaacgauuguguaa

SEQ ID NO: 3293819 - RNA, 13 nt, Variola virus
gaugaguauauau

SEQ ID NO: 3293820 - RNA, 18 nt, Variola virus
agggagccacagaaggau

SEQ ID NO: 3293821 - RNA, 21 nt, Variola virus
gcugaaguaaucaauuuuucu

SEQ ID NO: 3293822 - RNA, 18 nt, Variola virus
acuuuccaacuuaucauu

SEQ ID NO: 3293823 - RNA, 23 nt, Variola virus
uuauuagucgccgucucuauaaa

SEQ ID NO: 3293824 - RNA, 12 nt, Variola virus
auuucuauuuuu

SEQ ID NO: 3293825 - RNA, 13 nt, Variola virus
caaaacuauuuca

SEQ ID NO: 3293826 - RNA, 14 nt, Variola virus
aucauaccuccauc

SEQ ID NO: 3293827 - RNA, 13 nt, Variola virus
uccauagauuucc

SEQ ID NO: 3293828 - RNA, 16 nt, Variola virus
gauaagauaaaaucua

SEQ ID NO: 3293829 - RNA, 20 nt, Variola virus
uaguacucgaaauaauauua

SEQ ID NO: 3293830 - RNA, 21 nt, Variola virus
auauuuuucguuuacaaaauc

SEQ ID NO: 3293831 - RNA, 14 nt, Variola virus
aauacaauuaaaaa

SEQ ID NO: 3293832 - RNA, 14 nt, Variola virus
ccaugguaaacucu

SEQ ID NO: 3293833 - RNA, 14 nt, Variola virus
aaaauauaaugaua

SEQ ID NO: 3293834 - RNA, 14 nt, Variola virus
cugcacuaugucca

SEQ ID NO: 3293835 - RNA, 18 nt, Variola virus
acauauggaucuuuaugu

SEQ ID NO: 3293836 - RNA, 15 nt, Variola virus
cuauaaacaugaauu

SEQ ID NO: 3293837 - RNA, 14 nt, Variola virus
uauauuuuuggauu

SEQ ID NO: 3293838 - RNA, 20 nt, Variola virus
auauuauuacacauaaacau

SEQ ID NO: 3293839 - RNA, 18 nt, Variola virus
auaaaaaauuuuauucaa

SEQ ID NO: 3293840 - RNA, 17 nt, Variola virus
cuggagaagacacacuu

SEQ ID NO: 3293841 - RNA, 18 nt, Variola virus
cgaagagacgauagauuu

SEQ ID NO: 3293842 - RNA, 13 nt, Variola virus
aacuacuuuauca

SEQ ID NO: 3293843 - RNA, 15 nt, Variola virus
acuugaagacauucc

SEQ ID NO: 3293844 - RNA, 14 nt, Variola virus
auaacuaaaaaugu

SEQ ID NO: 3293845 - RNA, 18 nt, Variola virus
uaccauuagauaaucuag

SEQ ID NO: 3293846 - RNA, 19 nt, Variola virus
cuacuauggaauuaauuuu

SEQ ID NO: 3293847 - RNA, 17 nt, Variola virus
aggcacauaauaucuuu

SEQ ID NO: 3293848 - RNA, 21 nt, Variola virus
aaaucaaucaaggaacuaaau

SEQ ID NO: 3293849 - RNA, 14 nt, Variola virus
aguaagaacauaau

SEQ ID NO: 3293850 - RNA, 16 nt, Variola virus
cuuaguguaaaacuau

SEQ ID NO: 3293851 - RNA, 14 nt, Variola virus
uccguauuccaaac

SEQ ID NO: 3293852 - RNA, 22 nt, Variola virus
agggacacucaaacuaaauguc

SEQ ID NO: 3293853 - RNA, 12 nt, Variola virus
aagcaaaugaug

SEQ ID NO: 3293854 - RNA, 23 nt, Variola virus
aaaucuuucauuucuuccuggua

SEQ ID NO: 3293855 - RNA, 14 nt, Variola virus
cauuaguaaacaau

SEQ ID NO: 3293856 - RNA, 16 nt, Variola virus
auauccagaauguuuc

SEQ ID NO: 3293857 - RNA, 17 nt, Variola virus
aauucuuuauaacugaa

SEQ ID NO: 3293858 - RNA, 18 nt, Variola virus
uuugagagaucauuucua

SEQ ID NO: 3293859 - RNA, 17 nt, Variola virus
uauaaucgcuucaucau

SEQ ID NO: 3293860 - RNA, 14 nt, Variola virus
aguauuuaacaaga

SEQ ID NO: 3293861 - RNA, 13 nt, Variola virus
uaguggacaacau

SEQ ID NO: 3293862 - RNA, 21 nt, Variola virus
aaaaauugaauugaugauaua

SEQ ID NO: 3293863 - RNA, 21 nt, Variola virus
uaacgauauuuugcaaaauag

SEQ ID NO: 3293864 - RNA, 23 nt, Variola virus
ugguacguaaccgaaucuuccca

SEQ ID NO: 3293865 - RNA, 21 nt, Variola virus
uaaaggauauuauauguugug

SEQ ID NO: 3293866 - RNA, 22 nt, Variola virus
ucuugaggguuguguuaaauug

SEQ ID NO: 3293867 - RNA, 16 nt, Variola virus
uauagguauauuugcg

SEQ ID NO: 3293868 - RNA, 17 nt, Variola virus
ucagacaacaucucaga

SEQ ID NO: 3293869 - RNA, 21 nt, Variola virus
auaauuuugauuguacaccca

SEQ ID NO: 3293870 - RNA, 19 nt, Variola virus
aacaggguuuguugauucg

SEQ ID NO: 3293871 - RNA, 13 nt, Variola virus
uguugaucauaua

SEQ ID NO: 3293872 - RNA, 14 nt, Variola virus
aauugauucuuauu

SEQ ID NO: 3293873 - RNA, 15 nt, Variola virus
auccugaauaguaaa

SEQ ID NO: 3293874 - RNA, 13 nt, Variola virus
aauagguauauaa

SEQ ID NO: 3293875 - RNA, 18 nt, Variola virus
guauaauauuuaaacaau

SEQ ID NO: 3293876 - RNA, 21 nt, Variola virus
aguaacuauguaaaugauaac

SEQ ID NO: 3293877 - RNA, 14 nt, Variola virus
uuuggcauuucuaa

SEQ ID NO: 3293878 - RNA, 20 nt, Variola virus
aagugaguauacuugucauc

SEQ ID NO: 3293879 - RNA, 22 nt, Variola virus
aaugcgacgaguuagaaagaua

SEQ ID NO: 3293880 - RNA, 21 nt, Variola virus
auguagaaugugauaauuucc

SEQ ID NO: 3293881 - RNA, 17 nt, Variola virus
aaagaacggagaauugu

SEQ ID NO: 3293882 - RNA, 14 nt, Variola virus
agaauuaaauggau

SEQ ID NO: 3293883 - RNA, 19 nt, Variola virus
gaacuuuaaacagaaauau

SEQ ID NO: 3293884 - RNA, 14 nt, Variola virus
acacaaaaagaaag

SEQ ID NO: 3293885 - RNA, 17 nt, Variola virus
cuauuuuaccagcauua

SEQ ID NO: 3293886 - RNA, 12 nt, Variola virus
acgaugaaaaug

SEQ ID NO: 3293887 - RNA, 19 nt, Variola virus
aguuaaaacuuguaagaag

SEQ ID NO: 3293888 - RNA, 17 nt, Variola virus
uuaucgauucaucuaau

SEQ ID NO: 3293889 - RNA, 13 nt, Variola virus
ucaguuacaaaac

SEQ ID NO: 3293890 - RNA, 13 nt, Variola virus
auauauaaugaau

SEQ ID NO: 3293891 - RNA, 23 nt, Variola virus
uauaaaaaugcuaaaugugaugu

SEQ ID NO: 3293892 - RNA, 19 nt, Variola virus
acaaaaucaacuacauaau

SEQ ID NO: 3293893 - RNA, 23 nt, Variola virus
aaaucggauggauugguaacauu

SEQ ID NO: 3293894 - RNA, 20 nt, Variola virus
guggcuuuccauuuuccaaa

SEQ ID NO: 3293895 - RNA, 19 nt, Variola virus
ucaauuuugaaaauacuua

SEQ ID NO: 3293896 - RNA, 17 nt, Variola virus
caacuuaacaaaucuua

SEQ ID NO: 3293897 - RNA, 22 nt, Variola virus
aguagagauucggguacuguau

SEQ ID NO: 3293898 - RNA, 18 nt, Variola virus
cauaagcgcuauauaaau

SEQ ID NO: 3293899 - RNA, 19 nt, Variola virus
aucacucucauaauguaaa

SEQ ID NO: 3293900 - RNA, 20 nt, Variola virus
aucuucucuccgguuaauaa

SEQ ID NO: 3293901 - RNA, 20 nt, Variola virus
auaacaauaguuagauacaa

SEQ ID NO: 3293902 - RNA, 15 nt, Variola virus
aaaaccuaugauauc

SEQ ID NO: 3293903 - RNA, 15 nt, Variola virus
aaugcuaauauuaaa

SEQ ID NO: 3293904 - RNA, 13 nt, Variola virus
auuacguauuaua

SEQ ID NO: 3293905 - RNA, 14 nt, Variola virus
auacaaaaguuaau

SEQ ID NO: 3293906 - RNA, 19 nt, Variola virus
aggauguauauaucaugau

SEQ ID NO: 3293907 - RNA, 23 nt, Variola virus
caaugaauuauggaauuguauau

SEQ ID NO: 3293908 - RNA, 23 nt, Variola virus
aacaucauacaucaauuaacauu

SEQ ID NO: 3293909 - RNA, 19 nt, Variola virus
ucguuuaacgaucauauua

SEQ ID NO: 3293910 - RNA, 19 nt, Variola virus
uaauaauuuguauauacau

SEQ ID NO: 3293911 - RNA, 14 nt, Variola virus
auguuuuacucugg

SEQ ID NO: 3293912 - RNA, 23 nt, Variola virus
auucucuuacaaauauucacaag

SEQ ID NO: 3293913 - RNA, 22 nt, Variola virus
caauuauacguuuuuauauaau

SEQ ID NO: 3293914 - RNA, 23 nt, Variola virus
gcaaacaauguauacaaauguac

SEQ ID NO: 3293915 - RNA, 18 nt, Variola virus
cacauuuuaaauaaaugu

SEQ ID NO: 3293916 - RNA, 12 nt, Variola virus
auuauuagaaau

SEQ ID NO: 3293917 - RNA, 22 nt, Variola virus
uauuaucaaagucacaaagcaa

SEQ ID NO: 3293918 - RNA, 15 nt, Variola virus
uuuagcaauuucuga

SEQ ID NO: 3293919 - RNA, 14 nt, Variola virus
auagaggaugaauu

SEQ ID NO: 3293920 - RNA, 23 nt, Variola virus
aauuguguccgaaacuuagaaga

SEQ ID NO: 3293921 - RNA, 15 nt, Variola virus
uaucaagacauaugc

SEQ ID NO: 3293922 - RNA, 23 nt, Variola virus
uuauccacggauaccucauuuau

SEQ ID NO: 3293923 - RNA, 14 nt, Variola virus
auaagaacaaagua

SEQ ID NO: 3293924 - RNA, 23 nt, Variola virus
cugaauacuaucgauugaugagu

SEQ ID NO: 3293925 - RNA, 13 nt, Variola virus
uaccaaauauuag

SEQ ID NO: 3293926 - RNA, 14 nt, Variola virus
aauaaucuucauua

SEQ ID NO: 3293927 - RNA, 14 nt, Variola virus
acaacauuaauaca

SEQ ID NO: 3293928 - RNA, 12 nt, Variola virus
ccaauaguucuc

SEQ ID NO: 3293929 - RNA, 14 nt, Variola virus
uucagaauauucuu

SEQ ID NO: 3293930 - RNA, 21 nt, Variola virus
guuaaauaaauccuucaucac

SEQ ID NO: 3293931 - RNA, 15 nt, Variola virus
uauauaucuauuaca

SEQ ID NO: 3293932 - RNA, 15 nt, Variola virus
uuacacuaacuguau

SEQ ID NO: 3293933 - RNA, 21 nt, Variola virus
caauuuuacccucaaucaugu

SEQ ID NO: 3293934 - RNA, 15 nt, Variola virus
uaucaucuacgauau

SEQ ID NO: 3293935 - RNA, 13 nt, Variola virus
ucuagcauuucua

SEQ ID NO: 3293936 - RNA, 14 nt, Variola virus
accuguauacugua

SEQ ID NO: 3293937 - RNA, 18 nt, Variola virus
uuuaaaucccaauucaga

SEQ ID NO: 3293938 - RNA, 13 nt, Variola virus
uuaagugaugcau

SEQ ID NO: 3293939 - RNA, 16 nt, Variola virus
aaugaucuaaauuaua

SEQ ID NO: 3293940 - RNA, 13 nt, Variola virus
aguaaucaacaau

SEQ ID NO: 3293941 - RNA, 21 nt, Variola virus
ucagaaacgacaucaugaaca

SEQ ID NO: 3293942 - RNA, 21 nt, Variola virus
aaaaauuauacuguaacacaa

SEQ ID NO: 3293943 - RNA, 17 nt, Variola virus
aaaauucuaagguagaa

SEQ ID NO: 3293944 - RNA, 12 nt, Variola virus
gucaauacugua

SEQ ID NO: 3293945 - RNA, 16 nt, Variola virus
aguaacuauguaaaug

SEQ ID NO: 3293946 - RNA, 18 nt, Variola virus
uaacaauuuauuuuguau

SEQ ID NO: 3293947 - RNA, 16 nt, Variola virus
ccuuugcaaauacagc

SEQ ID NO: 3293948 - RNA, 16 nt, Variola virus
auauuccucuacacca

SEQ ID NO: 3293949 - RNA, 20 nt, Variola virus
auuaucaaaauuuggaaacu

SEQ ID NO: 3293950 - RNA, 17 nt, Variola virus
acgcccuuguauguuuu

SEQ ID NO: 3293951 - RNA, 21 nt, Variola virus
uguaaauguaacguauuuaga

SEQ ID NO: 3293952 - RNA, 19 nt, Variola virus
aggucauauggaagauguu

SEQ ID NO: 3293953 - RNA, 23 nt, Variola virus
gcaacggggaugaugauaaugau

SEQ ID NO: 3293954 - RNA, 13 nt, Variola virus
acuaaauacauua

SEQ ID NO: 3293955 - RNA, 21 nt, Variola virus
ucaaauccaugaauaaaguau

SEQ ID NO: 3293956 - RNA, 13 nt, Variola virus
uauggaaaacuaa

SEQ ID NO: 3293957 - RNA, 17 nt, Variola virus
auaucaucaaaauacug

SEQ ID NO: 3293958 - RNA, 20 nt, Variola virus
gcauuagaugaaaaauggaa

SEQ ID NO: 3293959 - RNA, 19 nt, Variola virus
gacuacaaagaauguucua

SEQ ID NO: 3293960 - RNA, 23 nt, Variola virus
aauaauucauggaaauuuaacag

SEQ ID NO: 3293961 - RNA, 15 nt, Variola virus
gaaagucagaaucua

SEQ ID NO: 3293962 - RNA, 19 nt, Variola virus
ucuuggauaaaagcaucca

SEQ ID NO: 3293963 - RNA, 16 nt, Variola virus
uguucuuaaucaaugu

SEQ ID NO: 3293964 - RNA, 14 nt, Variola virus
auugaaaauuauuu

SEQ ID NO: 3293965 - RNA, 12 nt, Variola virus
ccggaacaaaaa

SEQ ID NO: 3293966 - RNA, 23 nt, Variola virus
uaacuuuaguaaaguugucuaua

SEQ ID NO: 3293967 - RNA, 18 nt, Variola virus
uagcaaaacuauuucaga

SEQ ID NO: 3293968 - RNA, 19 nt, Variola virus
caguuuggggcuauucauc

SEQ ID NO: 3293969 - RNA, 17 nt, Variola virus
gauucauugacauaugu

SEQ ID NO: 3293970 - RNA, 14 nt, Variola virus
aaucagaguuuuua

SEQ ID NO: 3293971 - RNA, 22 nt, Variola virus
acaccuguuucauggaacaaua

SEQ ID NO: 3293972 - RNA, 20 nt, Variola virus
auaaaaauguuuuuguuuaa

SEQ ID NO: 3293973 - RNA, 17 nt, Variola virus
ucaaagucacaaagcaa

SEQ ID NO: 3293974 - RNA, 19 nt, Variola virus
uaauggucgaaacacguca

SEQ ID NO: 3293975 - RNA, 23 nt, Variola virus
aacuucuaaaacagcugugaaua

SEQ ID NO: 3293976 - RNA, 23 nt, Variola virus
uuaacuacgguauucauaaaaua

SEQ ID NO: 3293977 - RNA, 22 nt, Variola virus
uuagcuccguauuccaaacuag

SEQ ID NO: 3293978 - RNA, 18 nt, Variola virus
uucagcauuacuugauau

SEQ ID NO: 3293979 - RNA, 13 nt, Variola virus
aggaaucuaucca

SEQ ID NO: 3293980 - RNA, 15 nt, Variola virus
auaaauaucauauau

SEQ ID NO: 3293981 - RNA, 12 nt, Variola virus
auauauguuuau

SEQ ID NO: 3293982 - RNA, 21 nt, Variola virus
uugcaauauagaccauacuuc

SEQ ID NO: 3293983 - RNA, 18 nt, Variola virus
gucucuggauuauuuuua

SEQ ID NO: 3293984 - RNA, 13 nt, Variola virus
uacacuauuauau

SEQ ID NO: 3293985 - RNA, 20 nt, Variola virus
agucaauggagaaauacuua

SEQ ID NO: 3293986 - RNA, 22 nt, Variola virus
agacguaucuccauaaagaaau

SEQ ID NO: 3293987 - RNA, 18 nt, Variola virus
gucuaguaaguagaaauu

SEQ ID NO: 3293988 - RNA, 19 nt, Variola virus
acguuuuucgaaaaaauua

SEQ ID NO: 3293989 - RNA, 14 nt, Variola virus
uauauauuaucaua

SEQ ID NO: 3293990 - RNA, 13 nt, Variola virus
aucauaucuguaa

SEQ ID NO: 3293991 - RNA, 13 nt, Variola virus
uauguugauuuau

SEQ ID NO: 3293992 - RNA, 18 nt, Variola virus
auuaguuuauauuacuga

SEQ ID NO: 3293993 - RNA, 17 nt, Variola virus
uauuacuuuucaaugcu

SEQ ID NO: 3293994 - RNA, 13 nt, Variola virus
guaugauauguau

SEQ ID NO: 3293995 - RNA, 22 nt, Variola virus
gaauauauguauguaaaaauau

SEQ ID NO: 3293996 - RNA, 17 nt, Variola virus
acuaaugacaauaauua

SEQ ID NO: 3293997 - RNA, 15 nt, Variola virus
caagauauauauacu

SEQ ID NO: 3293998 - RNA, 18 nt, Variola virus
uacugggauaagauuucu

SEQ ID NO: 3293999 - RNA, 22 nt, Variola virus
ugcauucuccguuaguguuuga

SEQ ID NO: 3294000 - RNA, 14 nt, Variola virus
uugacguaaaugug

SEQ ID NO: 3294001 - RNA, 22 nt, Variola virus
auaauaccuaucuauaagauua

SEQ ID NO: 3294002 - RNA, 22 nt, Variola virus
caagaacucuugaagaugauuu

SEQ ID NO: 3294003 - RNA, 19 nt, Variola virus
auaacauguuaauuuccga

SEQ ID NO: 3294004 - RNA, 20 nt, Variola virus
ucaaauaauaaacuaaacaa

SEQ ID NO: 3294005 - RNA, 16 nt, Variola virus
aucguuaaauuuuaca

SEQ ID NO: 3294006 - RNA, 17 nt, Variola virus
agaauuuuuuaaaaagu

SEQ ID NO: 3294007 - RNA, 17 nt, Variola virus
aguacaucaucuagaga

SEQ ID NO: 3294008 - RNA, 19 nt, Variola virus
cauguacauauuuguacau

SEQ ID NO: 3294009 - RNA, 17 nt, Variola virus
aacacugauucagaaau

SEQ ID NO: 3294010 - RNA, 21 nt, Variola virus
aucaacguagaaaaaauagaa

SEQ ID NO: 3294011 - RNA, 17 nt, Variola virus
uggauacaauaaauguu

SEQ ID NO: 3294012 - RNA, 19 nt, Variola virus
cauucuaauauauguauuu

SEQ ID NO: 3294013 - RNA, 16 nt, Variola virus
ugacuccauagagaua

SEQ ID NO: 3294014 - RNA, 18 nt, Variola virus
uaauggagauuuucuauu

SEQ ID NO: 3294015 - RNA, 15 nt, Variola virus
uuuuagaauuuccaa

SEQ ID NO: 3294016 - RNA, 22 nt, Variola virus
gcgucuaguagauaugcuuuua

SEQ ID NO: 3294017 - RNA, 15 nt, Variola virus
auucuaucucuaaga

SEQ ID NO: 3294018 - RNA, 16 nt, Variola virus
ccaagauagaaacuau

SEQ ID NO: 3294019 - RNA, 17 nt, Variola virus
gcugguucaaaauuaau

SEQ ID NO: 3294020 - RNA, 14 nt, Variola virus
ccauacuaacugau

SEQ ID NO: 3294021 - RNA, 18 nt, Variola virus
cacuaacgcgcaugauuu

SEQ ID NO: 3294022 - RNA, 16 nt, Variola virus
aaauaaaauacauuua

SEQ ID NO: 3294023 - RNA, 20 nt, Variola virus
cauuauuuauuuaugauaua

SEQ ID NO: 3294024 - RNA, 19 nt, Variola virus
agucauaucuagaaugaag

SEQ ID NO: 3294025 - RNA, 18 nt, Variola virus
uuauaucacaacaucuau

SEQ ID NO: 3294026 - RNA, 13 nt, Variola virus
uacucuucuaaau

SEQ ID NO: 3294027 - RNA, 21 nt, Variola virus
ucaugaugauuugguuguauu

SEQ ID NO: 3294028 - RNA, 15 nt, Variola virus
cucuuccaguuccaa

SEQ ID NO: 3294029 - RNA, 19 nt, Variola virus
aauacuuauuaauggcucu

SEQ ID NO: 3294030 - RNA, 12 nt, Variola virus
auacauauuuua

SEQ ID NO: 3294031 - RNA, 14 nt, Variola virus
cucuaaaugaugau

SEQ ID NO: 3294032 - RNA, 13 nt, Variola virus
ugcauguuuucau

SEQ ID NO: 3294033 - RNA, 16 nt, Variola virus
uccgugagaaauacgu

SEQ ID NO: 3294034 - RNA, 21 nt, Variola virus
auauuuguuccuguagauaau

SEQ ID NO: 3294035 - RNA, 16 nt, Variola virus
guucaaaaauaaacga

SEQ ID NO: 3294036 - RNA, 19 nt, Variola virus
acccgcauacuuuaacaaa

SEQ ID NO: 3294037 - RNA, 16 nt, Variola virus
uacuucucccauaaua

SEQ ID NO: 3294038 - RNA, 15 nt, Variola virus
gcaucgauugcaugg

SEQ ID NO: 3294039 - RNA, 18 nt, Variola virus
agauaucagagaacuucu

SEQ ID NO: 3294040 - RNA, 17 nt, Variola virus
cgacucauaagaaagag

SEQ ID NO: 3294041 - RNA, 13 nt, Variola virus
cgauuuaugugac

SEQ ID NO: 3294042 - RNA, 21 nt, Variola virus
gcuuuucuauaaucauuuuua

SEQ ID NO: 3294043 - RNA, 12 nt, Variola virus
agaccaaaaauu

SEQ ID NO: 3294044 - RNA, 13 nt, Variola virus
caaagauauggaa

SEQ ID NO: 3294045 - RNA, 16 nt, Variola virus
aauucauucucuagaa

SEQ ID NO: 3294046 - RNA, 18 nt, Variola virus
uguauagaaauuuuggua

SEQ ID NO: 3294047 - RNA, 14 nt, Variola virus
uaauauucauuaag

SEQ ID NO: 3294048 - RNA, 22 nt, Variola virus
aucuuaccauguccucaaauaa

SEQ ID NO: 3294049 - RNA, 14 nt, Variola virus
cuuaacuauuuccg

SEQ ID NO: 3294050 - RNA, 16 nt, Variola virus
uuauacuaauaugaca

SEQ ID NO: 3294051 - RNA, 13 nt, Variola virus
cacacucuacaau

SEQ ID NO: 3294052 - RNA, 16 nt, Variola virus
gaaaucaacauaaugu

SEQ ID NO: 3294053 - RNA, 16 nt, Variola virus
uaagaaaaauagagag

SEQ ID NO: 3294054 - RNA, 18 nt, Variola virus
aacuaaaaauuaaacaau

SEQ ID NO: 3294055 - RNA, 14 nt, Variola virus
acaauuuuguauua

SEQ ID NO: 3294056 - RNA, 15 nt, Variola virus
uauuuuauuucaaaa

SEQ ID NO: 3294057 - RNA, 11 nt, Variola virus
caaacauaaua

SEQ ID NO: 3294058 - RNA, 14 nt, Variola virus
auaaucauaaauua

SEQ ID NO: 3294059 - RNA, 12 nt, Variola virus
uuuuucagauuu

SEQ ID NO: 3294060 - RNA, 23 nt, Variola virus
acacuguucacauccuuccaaga

SEQ ID NO: 3294061 - RNA, 13 nt, Variola virus
ugacgcuguaaaa

SEQ ID NO: 3294062 - RNA, 13 nt, Variola virus
acuguuuaauagc

SEQ ID NO: 3294063 - RNA, 17 nt, Variola virus
agcauuaauaauuguuu

SEQ ID NO: 3294064 - RNA, 15 nt, Variola virus
gaugaguuagauauu

SEQ ID NO: 3294065 - RNA, 19 nt, Variola virus
ucuauguuaauauguauau

SEQ ID NO: 3294066 - RNA, 15 nt, Variola virus
ccaaguuaaauuuua

SEQ ID NO: 3294067 - RNA, 16 nt, Variola virus
cauaacagauaguuua

SEQ ID NO: 3294068 - RNA, 17 nt, Variola virus
aauauauugaucauaau

SEQ ID NO: 3294069 - RNA, 16 nt, Variola virus
aaugagcguuuaaagu

SEQ ID NO: 3294070 - RNA, 14 nt, Variola virus
ugguauaucaacau

SEQ ID NO: 3294071 - RNA, 17 nt, Variola virus
auucucuauuaaauacc

SEQ ID NO: 3294072 - RNA, 14 nt, Variola virus
caucaaauggaugc

SEQ ID NO: 3294073 - RNA, 19 nt, Variola virus
agcauguauuuuuuucuaa

SEQ ID NO: 3294074 - RNA, 21 nt, Variola virus
uggauuauaaauaucgauguu

SEQ ID NO: 3294075 - RNA, 20 nt, Variola virus
ugaugaaagauaaacuagau

SEQ ID NO: 3294076 - RNA, 23 nt, Variola virus
uuccuagauauuuaaaauaaucc

SEQ ID NO: 3294077 - RNA, 16 nt, Variola virus
uauguguugaacauca

SEQ ID NO: 3294078 - RNA, 16 nt, Variola virus
aaaauaauaucguucu

SEQ ID NO: 3294079 - RNA, 16 nt, Variola virus
aaaguuaaucauauag

SEQ ID NO: 3294080 - RNA, 15 nt, Variola virus
uuauaauauucaugu

SEQ ID NO: 3294081 - RNA, 16 nt, Variola virus
augauuucagauacua

SEQ ID NO: 3294082 - RNA, 20 nt, Variola virus
aagauaucuacuagaaagau

SEQ ID NO: 3294083 - RNA, 16 nt, Variola virus
aaacuccaacgagaua

SEQ ID NO: 3294084 - RNA, 14 nt, Variola virus
ucguauaaaguuau

SEQ ID NO: 3294085 - RNA, 19 nt, Variola virus
caugauggucauguuuauu

SEQ ID NO: 3294086 - RNA, 20 nt, Variola virus
uagaaauuuaucaauaucca

SEQ ID NO: 3294087 - RNA, 21 nt, Variola virus
ucacgauaccggaaaaugcga

SEQ ID NO: 3294088 - RNA, 19 nt, Variola virus
uuagauuaguuaauacagg

SEQ ID NO: 3294089 - RNA, 20 nt, Variola virus
guuuauuguauuuaugaccu

SEQ ID NO: 3294090 - RNA, 23 nt, Variola virus
aacucuaaucaaaaucuuaauau

SEQ ID NO: 3294091 - RNA, 23 nt, Variola virus
ucauguuaaaaaaucuugauaga

SEQ ID NO: 3294092 - RNA, 19 nt, Variola virus
agguacucaucuacucuac

SEQ ID NO: 3294093 - RNA, 21 nt, Variola virus
cagaaucgcaacgcuaaaaga

SEQ ID NO: 3294094 - RNA, 16 nt, Variola virus
aguuaucaaaauaugu

SEQ ID NO: 3294095 - RNA, 22 nt, Variola virus
auaagaguguaguaucauagau

SEQ ID NO: 3294096 - RNA, 23 nt, Variola virus
uuauacgaauaucguucucuaaa

SEQ ID NO: 3294097 - RNA, 15 nt, Variola virus
aaauaauuuaacaau

SEQ ID NO: 3294098 - RNA, 15 nt, Variola virus
agauaucaaaauauu

SEQ ID NO: 3294099 - RNA, 23 nt, Variola virus
uaauguagaaaaucauacagaca

SEQ ID NO: 3294100 - RNA, 15 nt, Variola virus
auuaccaucauauau

SEQ ID NO: 3294101 - RNA, 14 nt, Variola virus
aauuuaaagaaugu

SEQ ID NO: 3294102 - RNA, 17 nt, Variola virus
uagaucauuugaaauua

SEQ ID NO: 3294103 - RNA, 19 nt, Variola virus
uauuaaaaaaaaauacuuu

SEQ ID NO: 3294104 - RNA, 11 nt, Variola virus
auauagacaaa

SEQ ID NO: 3294105 - RNA, 21 nt, Variola virus
uauuaacgguaauacauuuau

SEQ ID NO: 3294106 - RNA, 11 nt, Variola virus
cauuuaauagg

SEQ ID NO: 3294107 - RNA, 14 nt, Variola virus
aauaaucucaauua

SEQ ID NO: 3294108 - RNA, 15 nt, Variola virus
ucguucaacugucuu

SEQ ID NO: 3294109 - RNA, 23 nt, Variola virus
gacguugccaaaaaauccuguaa

SEQ ID NO: 3294110 - RNA, 15 nt, Variola virus
auaaaucaaauacuu

SEQ ID NO: 3294111 - RNA, 22 nt, Variola virus
ucagcugcuuuagaugauuuug

SEQ ID NO: 3294112 - RNA, 16 nt, Variola virus
auuuaaaaaguauuua

SEQ ID NO: 3294113 - RNA, 20 nt, Variola virus
gaaauaauauaaaugauuau

SEQ ID NO: 3294114 - RNA, 16 nt, Variola virus
uaaauaaauccaaauu

SEQ ID NO: 3294115 - RNA, 15 nt, Variola virus
aauacuuaaaaugua

SEQ ID NO: 3294116 - RNA, 14 nt, Variola virus
cgaacuuuaaacag

SEQ ID NO: 3294117 - RNA, 19 nt, Variola virus
caaaggauguuuaacauuc

SEQ ID NO: 3294118 - RNA, 18 nt, Variola virus
uccaucagaauguuuccc

SEQ ID NO: 3294119 - RNA, 23 nt, Variola virus
auaucugcgacggagcauuuucu

SEQ ID NO: 3294120 - RNA, 14 nt, Variola virus
ugucaaaaauugua

SEQ ID NO: 3294121 - RNA, 18 nt, Variola virus
aagucugcuaucagugau

SEQ ID NO: 3294122 - RNA, 17 nt, Variola virus
aguuaauauuauugggu

SEQ ID NO: 3294123 - RNA, 15 nt, Variola virus
uauauuaauacacau

SEQ ID NO: 3294124 - RNA, 19 nt, Variola virus
aauaucccacauugucauc

SEQ ID NO: 3294125 - RNA, 21 nt, Variola virus
ugaauccaucucuauguuuca

SEQ ID NO: 3294126 - RNA, 19 nt, Variola virus
aucacuaucuucaucauau

SEQ ID NO: 3294127 - RNA, 15 nt, Variola virus
acaaugcuuuaauaa

SEQ ID NO: 3294128 - RNA, 19 nt, Variola virus
gggaaaaagcucaauauug

SEQ ID NO: 3294129 - RNA, 19 nt, Variola virus
auuaacaucuugaaccauu

SEQ ID NO: 3294130 - RNA, 18 nt, Variola virus
uucucaucuaucaucucc

SEQ ID NO: 3294131 - RNA, 18 nt, Variola virus
uaaaaacauuuuauuucu

SEQ ID NO: 3294132 - RNA, 19 nt, Variola virus
aucagagagauagaagaac

SEQ ID NO: 3294133 - RNA, 21 nt, Variola virus
ccaagagaugcaauacaaaag

SEQ ID NO: 3294134 - RNA, 21 nt, Variola virus
aacuagaucauccaacaaucu

SEQ ID NO: 3294135 - RNA, 23 nt, Variola virus
uaaauccucuauuuauugacauu

SEQ ID NO: 3294136 - RNA, 13 nt, Variola virus
auaauuuaacaau

SEQ ID NO: 3294137 - RNA, 20 nt, Variola virus
aucugaaauaacauauagau

SEQ ID NO: 3294138 - RNA, 12 nt, Variola virus
aggauucuuaau

SEQ ID NO: 3294139 - RNA, 21 nt, Variola virus
ucuaugaauauaauagaugua

SEQ ID NO: 3294140 - RNA, 16 nt, Variola virus
agauaaaaaauuauau

SEQ ID NO: 3294141 - RNA, 18 nt, Variola virus
caugauacuaaguauaau

SEQ ID NO: 3294142 - RNA, 20 nt, Variola virus
auuccacgaacuucuaauug

SEQ ID NO: 3294143 - RNA, 21 nt, Variola virus
uaauaacaugcgguucaaaau

SEQ ID NO: 3294144 - RNA, 19 nt, Variola virus
gugccaaaaugauauacag

SEQ ID NO: 3294145 - RNA, 21 nt, Variola virus
agcaagacuaacacacaaugu

SEQ ID NO: 3294146 - RNA, 22 nt, Variola virus
aauuauacuuugguaaauguua

SEQ ID NO: 3294147 - RNA, 13 nt, Variola virus
cuauuuucaguaa

SEQ ID NO: 3294148 - RNA, 17 nt, Variola virus
caacaaauucugcaaua

SEQ ID NO: 3294149 - RNA, 20 nt, Variola virus
uaccacguaaaacuuaaaau

SEQ ID NO: 3294150 - RNA, 17 nt, Variola virus
uuaaccaacugauuaau

SEQ ID NO: 3294151 - RNA, 13 nt, Variola virus
ucugacauucaga

SEQ ID NO: 3294152 - RNA, 22 nt, Variola virus
ugaucagggcuaacaauaauag

SEQ ID NO: 3294153 - RNA, 17 nt, Variola virus
ugauaguaauucucgga

SEQ ID NO: 3294154 - RNA, 19 nt, Variola virus
aauucccaaucuuguuaua

SEQ ID NO: 3294155 - RNA, 16 nt, Variola virus
uaaaaauguuaauuua

SEQ ID NO: 3294156 - RNA, 22 nt, Variola virus
auuaggcacagucaaacauuca

SEQ ID NO: 3294157 - RNA, 16 nt, Variola virus
agaucugagaauggau

SEQ ID NO: 3294158 - RNA, 14 nt, Variola virus
ugaugaauuuacca

SEQ ID NO: 3294159 - RNA, 23 nt, Variola virus
auguacgauccaaacaauguuuc

SEQ ID NO: 3294160 - RNA, 16 nt, Variola virus
auuuguaucuuaguau

SEQ ID NO: 3294161 - RNA, 19 nt, Variola virus
auauccucguucuaauugu

SEQ ID NO: 3294162 - RNA, 17 nt, Variola virus
ugauugcagauuugcca

SEQ ID NO: 3294163 - RNA, 17 nt, Variola virus
cacaaugauaacaucca

SEQ ID NO: 3294164 - RNA, 22 nt, Variola virus
gaauguuuauuggcguuggaaa

SEQ ID NO: 3294165 - RNA, 18 nt, Variola virus
uccacugucacuggaaag

SEQ ID NO: 3294166 - RNA, 12 nt, Variola virus
ugacuguauuug

SEQ ID NO: 3294167 - RNA, 13 nt, Variola virus
aauaucucaauga

SEQ ID NO: 3294168 - RNA, 15 nt, Variola virus
uguccuucacaucau

SEQ ID NO: 3294169 - RNA, 19 nt, Variola virus
uaaauccuuaauauauuca

SEQ ID NO: 3294170 - RNA, 14 nt, Variola virus
ugccagauacauac

SEQ ID NO: 3294171 - RNA, 15 nt, Variola virus
caguacuuauacaau

SEQ ID NO: 3294172 - RNA, 22 nt, Variola virus
aucugauguaggacaucaauau

SEQ ID NO: 3294173 - RNA, 13 nt, Variola virus
guauacauaauau

SEQ ID NO: 3294174 - RNA, 12 nt, Variola virus
uaauauugugaa

SEQ ID NO: 3294175 - RNA, 13 nt, Variola virus
augcauaaacgaa

SEQ ID NO: 3294176 - RNA, 15 nt, Variola virus
acguagaaaauggau

SEQ ID NO: 3294177 - RNA, 14 nt, Variola virus
guaaaugaugaaau

SEQ ID NO: 3294178 - RNA, 14 nt, Variola virus
aucccauuguaaag

SEQ ID NO: 3294179 - RNA, 15 nt, Variola virus
uauaaauauccuuaa

SEQ ID NO: 3294180 - RNA, 20 nt, Variola virus
agcaaugaucuaaauuauau

SEQ ID NO: 3294181 - RNA, 16 nt, Variola virus
aucaaauuauugauac

SEQ ID NO: 3294182 - RNA, 16 nt, Variola virus
gaaaauuuaggacuua

SEQ ID NO: 3294183 - RNA, 22 nt, Variola virus
uccguguaauccauaauccagu

SEQ ID NO: 3294184 - RNA, 14 nt, Variola virus
acuuauaaaaauac

SEQ ID NO: 3294185 - RNA, 19 nt, Variola virus
uaaucucuucuuuaacagu

SEQ ID NO: 3294186 - RNA, 14 nt, Variola virus
cgcgaacaucuuuc

SEQ ID NO: 3294187 - RNA, 22 nt, Variola virus
uuaaacuguuuguauaauaucu

SEQ ID NO: 3294188 - RNA, 18 nt, Variola virus
uauaauuucaucuacaau

SEQ ID NO: 3294189 - RNA, 15 nt, Variola virus
uaauagaaaaugaau

SEQ ID NO: 3294190 - RNA, 20 nt, Variola virus
caaauagcuacaguaaaaau

SEQ ID NO: 3294191 - RNA, 18 nt, Variola virus
ccaucuugaauauuuuua

SEQ ID NO: 3294192 - RNA, 17 nt, Variola virus
uaguacuacugaagaac

SEQ ID NO: 3294193 - RNA, 12 nt, Variola virus
gcauaaaaaugc

SEQ ID NO: 3294194 - RNA, 19 nt, Variola virus
agacggauaagaaauauau

SEQ ID NO: 3294195 - RNA, 13 nt, Variola virus
auaguagaaucua

SEQ ID NO: 3294196 - RNA, 18 nt, Variola virus
uaaaggauauuauauguu

SEQ ID NO: 3294197 - RNA, 14 nt, Variola virus
auuuugacaaagau

SEQ ID NO: 3294198 - RNA, 22 nt, Variola virus
gaacuauaaaaaaaauaauaau

SEQ ID NO: 3294199 - RNA, 22 nt, Variola virus
auaaacguucacguaaauacaa

SEQ ID NO: 3294200 - RNA, 22 nt, Variola virus
gauggauauauuaaagucaaau

SEQ ID NO: 3294201 - RNA, 12 nt, Variola virus
guacuuggaaag

SEQ ID NO: 3294202 - RNA, 19 nt, Variola virus
ucugguugaagaaauccaa

SEQ ID NO: 3294203 - RNA, 16 nt, Variola virus
ucagauauaaaaaucu

SEQ ID NO: 3294204 - RNA, 15 nt, Variola virus
auaaugauagaauua

SEQ ID NO: 3294205 - RNA, 16 nt, Variola virus
uacagaacgaauuaug

SEQ ID NO: 3294206 - RNA, 20 nt, Variola virus
acaauuuauuucuaaaucua

SEQ ID NO: 3294207 - RNA, 22 nt, Variola virus
aaaauucauuagaauauauguc

SEQ ID NO: 3294208 - RNA, 14 nt, Variola virus
auacgcguucucaa

SEQ ID NO: 3294209 - RNA, 13 nt, Variola virus
uacuuauguaugu

SEQ ID NO: 3294210 - RNA, 22 nt, Variola virus
agauacaauggaugauaugaag

SEQ ID NO: 3294211 - RNA, 22 nt, Variola virus
uuaaagauggaguauaaucuuu

SEQ ID NO: 3294212 - RNA, 15 nt, Variola virus
ucuaucgacuucaga

SEQ ID NO: 3294213 - RNA, 13 nt, Variola virus
auuuggaaaagaa

SEQ ID NO: 3294214 - RNA, 18 nt, Variola virus
agauuuguaucucuuuuc

SEQ ID NO: 3294215 - RNA, 14 nt, Variola virus
gcaaauuaaaucaa

SEQ ID NO: 3294216 - RNA, 16 nt, Variola virus
uuuuugaagauuccca

SEQ ID NO: 3294217 - RNA, 22 nt, Variola virus
auuauacacauuauaauaggug

SEQ ID NO: 3294218 - RNA, 15 nt, Variola virus
ggaugaaaauaagaa

SEQ ID NO: 3294219 - RNA, 20 nt, Variola virus
cgacgauaacgaaguauuua

SEQ ID NO: 3294220 - RNA, 13 nt, Variola virus
auucuugguuaaa

SEQ ID NO: 3294221 - RNA, 18 nt, Variola virus
aguauuguuuaguauuuu

SEQ ID NO: 3294222 - RNA, 17 nt, Variola virus
acaaugcuauaccuaau

SEQ ID NO: 3294223 - RNA, 15 nt, Variola virus
aauaugauuagaagu

SEQ ID NO: 3294224 - RNA, 15 nt, Variola virus
uaucuagcaaagauu

SEQ ID NO: 3294225 - RNA, 17 nt, Variola virus
caaauaaaacuauaaau

SEQ ID NO: 3294226 - RNA, 22 nt, Variola virus
cuaauaacguuuuuauuuguaa

SEQ ID NO: 3294227 - RNA, 19 nt, Variola virus
ugguaaguucauuaucuga

SEQ ID NO: 3294228 - RNA, 21 nt, Variola virus
auuuauuauuuucacggagau

SEQ ID NO: 3294229 - RNA, 16 nt, Variola virus
cuggaaaaauacuuuu

SEQ ID NO: 3294230 - RNA, 16 nt, Variola virus
caucaucgagauaauu

SEQ ID NO: 3294231 - RNA, 22 nt, Variola virus
uaucgcuaaaaucuucaucaaa

SEQ ID NO: 3294232 - RNA, 21 nt, Variola virus
uauaaaauacuaaugcaucua

SEQ ID NO: 3294233 - RNA, 22 nt, Variola virus
uaacauaaaaauaucauugaau

SEQ ID NO: 3294234 - RNA, 13 nt, Variola virus
auuuuuuaucaua

SEQ ID NO: 3294235 - RNA, 19 nt, Variola virus
ugauuuggccaaauguacc

SEQ ID NO: 3294236 - RNA, 19 nt, Variola virus
aaauuuacggugacuacua

SEQ ID NO: 3294237 - RNA, 21 nt, Variola virus
aagauuguuuaagaagagaau

SEQ ID NO: 3294238 - RNA, 19 nt, Variola virus
auaaaacucauauaguuaa

SEQ ID NO: 3294239 - RNA, 17 nt, Variola virus
cuauauaauuauacuau

SEQ ID NO: 3294240 - RNA, 18 nt, Variola virus
agagcuuuauuaacuucu

SEQ ID NO: 3294241 - RNA, 19 nt, Variola virus
augaacauaguaagaaauu

SEQ ID NO: 3294242 - RNA, 19 nt, Variola virus
auccuccggaguauuaaug

SEQ ID NO: 3294243 - RNA, 18 nt, Variola virus
cugccauuuauccagucu

SEQ ID NO: 3294244 - RNA, 13 nt, Variola virus
uugguauuagaau

SEQ ID NO: 3294245 - RNA, 21 nt, Variola virus
auaauuuaacauuuuggcaaa

SEQ ID NO: 3294246 - RNA, 14 nt, Variola virus
uuauuuuugaagau

SEQ ID NO: 3294247 - RNA, 16 nt, Variola virus
aaaaagaaagaauaua

SEQ ID NO: 3294248 - RNA, 15 nt, Variola virus
auuaucgacauaggu

SEQ ID NO: 3294249 - RNA, 18 nt, Variola virus
agaaucagaaucauacaa

SEQ ID NO: 3294250 - RNA, 22 nt, Variola virus
uacaaaauguugauaauccuug

SEQ ID NO: 3294251 - RNA, 13 nt, Variola virus
acuguucaagaau

SEQ ID NO: 3294252 - RNA, 15 nt, Variola virus
acacugagaaacagc

SEQ ID NO: 3294253 - RNA, 21 nt, Variola virus
gaaaauauuguguuuaaucuu

SEQ ID NO: 3294254 - RNA, 14 nt, Variola virus
aauacucuacagag

SEQ ID NO: 3294255 - RNA, 21 nt, Variola virus
uuaaagaugacaauauuauua

SEQ ID NO: 3294256 - RNA, 16 nt, Variola virus
uuccaaauucuggauu

SEQ ID NO: 3294257 - RNA, 19 nt, Variola virus
aaauucaguugcuggaauu

SEQ ID NO: 3294258 - RNA, 14 nt, Variola virus
cuaaaggaugagua

SEQ ID NO: 3294259 - RNA, 17 nt, Variola virus
uauaaauagacaaacaa

SEQ ID NO: 3294260 - RNA, 18 nt, Variola virus
cauaaaauacaagagaau

SEQ ID NO: 3294261 - RNA, 19 nt, Variola virus
auaagaaggaugacaauaa

SEQ ID NO: 3294262 - RNA, 18 nt, Variola virus
aauuuuauucuagaauug

SEQ ID NO: 3294263 - RNA, 12 nt, Variola virus
ucuuaaaugaau

SEQ ID NO: 3294264 - RNA, 20 nt, Variola virus
ugcucaaacaaaaugugaua

SEQ ID NO: 3294265 - RNA, 21 nt, Variola virus
ucaaaagaaggaauuaaacga

SEQ ID NO: 3294266 - RNA, 21 nt, Variola virus
aagacguuguacaauaugaac

SEQ ID NO: 3294267 - RNA, 18 nt, Variola virus
uaaauguauaaaaacuaa

SEQ ID NO: 3294268 - RNA, 12 nt, Variola virus
uagauacaaaau

SEQ ID NO: 3294269 - RNA, 13 nt, Variola virus
acuaacuauugaa

SEQ ID NO: 3294270 - RNA, 18 nt, Variola virus
aaaauauuuauuagaaca

SEQ ID NO: 3294271 - RNA, 22 nt, Variola virus
aauggauuuugaugauauuaaa

SEQ ID NO: 3294272 - RNA, 20 nt, Variola virus
aaauugguauaaauguugua

SEQ ID NO: 3294273 - RNA, 15 nt, Variola virus
ugacccuauaaacau

SEQ ID NO: 3294274 - RNA, 15 nt, Variola virus
guuuuauaacgaagu

SEQ ID NO: 3294275 - RNA, 15 nt, Variola virus
uuuagaaacuucaaa

SEQ ID NO: 3294276 - RNA, 23 nt, Variola virus
gacauaaugacuccauagagaua

SEQ ID NO: 3294277 - RNA, 14 nt, Variola virus
aucuaacauaaaca

SEQ ID NO: 3294278 - RNA, 22 nt, Variola virus
agaauucaagucaggaacuauu

SEQ ID NO: 3294279 - RNA, 15 nt, Variola virus
guaaaacauaaagga

SEQ ID NO: 3294280 - RNA, 15 nt, Variola virus
agagcuauucuugga

SEQ ID NO: 3294281 - RNA, 17 nt, Variola virus
aaaucaggaaaaaagau

SEQ ID NO: 3294282 - RNA, 15 nt, Variola virus
uucuauaaacugaau

SEQ ID NO: 3294283 - RNA, 15 nt, Variola virus
acgauacaucuguuu

SEQ ID NO: 3294284 - RNA, 23 nt, Variola virus
uagcuaugaacuuguuuaaugau

SEQ ID NO: 3294285 - RNA, 23 nt, Variola virus
uguuuccuauaaucguuaaauuu

SEQ ID NO: 3294286 - RNA, 22 nt, Variola virus
agaauuaguuaaucuuauucaa

SEQ ID NO: 3294287 - RNA, 21 nt, Variola virus
uaaucagucauaacaaaugua

SEQ ID NO: 3294288 - RNA, 16 nt, Variola virus
uagaaaaauucuugga

SEQ ID NO: 3294289 - RNA, 13 nt, Variola virus
aguuaauagcuuc

SEQ ID NO: 3294290 - RNA, 16 nt, Variola virus
ucauucucuagaagau

SEQ ID NO: 3294291 - RNA, 19 nt, Variola virus
uagauuauaucauaaauaa

SEQ ID NO: 3294292 - RNA, 19 nt, Variola virus
auauaacaauaacauaacu

SEQ ID NO: 3294293 - RNA, 13 nt, Variola virus
caacucucuuuuu

SEQ ID NO: 3294294 - RNA, 17 nt, Variola virus
agucuuaaaaauacuua

SEQ ID NO: 3294295 - RNA, 14 nt, Variola virus
aaauuccaccauuu

SEQ ID NO: 3294296 - RNA, 12 nt, Variola virus
agaacucuuuuc

SEQ ID NO: 3294297 - RNA, 17 nt, Variola virus
uacggauaucuaauaau

SEQ ID NO: 3294298 - RNA, 23 nt, Variola virus
aguaaguaucuauaaaacucaua

SEQ ID NO: 3294299 - RNA, 22 nt, Variola virus
ucaaugucuuaauaagaagugu

SEQ ID NO: 3294300 - RNA, 14 nt, Variola virus
aaccaacuacagaa

SEQ ID NO: 3294301 - RNA, 18 nt, Variola virus
uaucuauaucuacaucua

SEQ ID NO: 3294302 - RNA, 20 nt, Variola virus
aucaaugauuaguuucuuaa

SEQ ID NO: 3294303 - RNA, 21 nt, Variola virus
aggaccuuccaacuguggaua

SEQ ID NO: 3294304 - RNA, 12 nt, Variola virus
uguuauauguaa

SEQ ID NO: 3294305 - RNA, 18 nt, Variola virus
agaguuaauaaauaucau

SEQ ID NO: 3294306 - RNA, 14 nt, Variola virus
acacucaccaauaa

SEQ ID NO: 3294307 - RNA, 18 nt, Variola virus
agccgggaaaaagaagau

SEQ ID NO: 3294308 - RNA, 13 nt, Variola virus
acuauaucaguau

SEQ ID NO: 3294309 - RNA, 15 nt, Variola virus
acucauuaaaacuuc

SEQ ID NO: 3294310 - RNA, 21 nt, Variola virus
aaaacauaaaggaauauacaa

SEQ ID NO: 3294311 - RNA, 17 nt, Variola virus
guuuacaacacuuuucu

SEQ ID NO: 3294312 - RNA, 18 nt, Variola virus
augauuauaguuucuauu

SEQ ID NO: 3294313 - RNA, 15 nt, Variola virus
acaaucaauaauaua

SEQ ID NO: 3294314 - RNA, 22 nt, Variola virus
acaagugaaauguugucauuau

SEQ ID NO: 3294315 - RNA, 13 nt, Variola virus
ccuagcuuuguua

SEQ ID NO: 3294316 - RNA, 16 nt, Variola virus
ucaacggaaaacauuu

SEQ ID NO: 3294317 - RNA, 16 nt, Variola virus
uaucacgcuuuccauu

SEQ ID NO: 3294318 - RNA, 21 nt, Variola virus
uaaacaauacuucugaagaaa

SEQ ID NO: 3294319 - RNA, 11 nt, Variola virus
ucguuuggauu

SEQ ID NO: 3294320 - RNA, 15 nt, Variola virus
ucuguacaaaaguuu

SEQ ID NO: 3294321 - RNA, 23 nt, Variola virus
auucuacaaguaacaacaaaaaa

SEQ ID NO: 3294322 - RNA, 18 nt, Variola virus
accaacuuaaacaaaaua

SEQ ID NO: 3294323 - RNA, 15 nt, Variola virus
ucauagauucuuuaa

SEQ ID NO: 3294324 - RNA, 22 nt, Variola virus
aauguauuaguuaaauauuaaa

SEQ ID NO: 3294325 - RNA, 23 nt, Variola virus
agacuacguagacuagacuguuu

SEQ ID NO: 3294326 - RNA, 13 nt, Variola virus
gacauaagaacag

SEQ ID NO: 3294327 - RNA, 17 nt, Variola virus
auaaagguagaccuaau

SEQ ID NO: 3294328 - RNA, 16 nt, Variola virus
uacuuuaaagaaguag

SEQ ID NO: 3294329 - RNA, 23 nt, Variola virus
auuauugaacaggcauugcuaaa

SEQ ID NO: 3294330 - RNA, 15 nt, Variola virus
aaagcauuaauacag

SEQ ID NO: 3294331 - RNA, 20 nt, Variola virus
aacuaucuaugcuguagaua

SEQ ID NO: 3294332 - RNA, 14 nt, Variola virus
auaucuucucaaaa

SEQ ID NO: 3294333 - RNA, 18 nt, Variola virus
gacuuuaaccuauacaug

SEQ ID NO: 3294334 - RNA, 20 nt, Variola virus
aacacacuaaacaguuuauu

SEQ ID NO: 3294335 - RNA, 19 nt, Variola virus
gcugcuggaucuaaauauu

SEQ ID NO: 3294336 - RNA, 21 nt, Variola virus
agguaaguauaguacuaaaga

SEQ ID NO: 3294337 - RNA, 19 nt, Variola virus
aagauugucauguggauua

SEQ ID NO: 3294338 - RNA, 19 nt, Variola virus
agaugagcauaaacauaau

SEQ ID NO: 3294339 - RNA, 19 nt, Variola virus
auuuacaggcuguuagcug

SEQ ID NO: 3294340 - RNA, 20 nt, Variola virus
uaugacgcgcguucaacauu

SEQ ID NO: 3294341 - RNA, 17 nt, Variola virus
cuuaacuuuuucuuucu

SEQ ID NO: 3294342 - RNA, 16 nt, Variola virus
agagccaucuguaaaa

SEQ ID NO: 3294343 - RNA, 13 nt, Variola virus
gaagaaguuaaua

SEQ ID NO: 3294344 - RNA, 13 nt, Variola virus
uuaucuacaucuu

SEQ ID NO: 3294345 - RNA, 17 nt, Variola virus
acuaaaaauaaacauug

SEQ ID NO: 3294346 - RNA, 21 nt, Variola virus
ucaaucaaaagacuauacauu

SEQ ID NO: 3294347 - RNA, 22 nt, Variola virus
cagauuuuugaaugaaugaaua

SEQ ID NO: 3294348 - RNA, 22 nt, Variola virus
cauauauuuugcauaacaugua

SEQ ID NO: 3294349 - RNA, 14 nt, Variola virus
acauuuuccauuua

SEQ ID NO: 3294350 - RNA, 16 nt, Variola virus
aauauucaguauauag

SEQ ID NO: 3294351 - RNA, 18 nt, Variola virus
aauuaauucguuggaaaa

SEQ ID NO: 3294352 - RNA, 17 nt, Variola virus
aaauccuguaauacuuu

SEQ ID NO: 3294353 - RNA, 23 nt, Variola virus
uaaucuauuuuaccucuucugau

SEQ ID NO: 3294354 - RNA, 23 nt, Variola virus
agcuccuaauggagauuuucuau

SEQ ID NO: 3294355 - RNA, 13 nt, Variola virus
aaaauaauaucua

SEQ ID NO: 3294356 - RNA, 22 nt, Variola virus
agcaucuugaauagaaacgaua

SEQ ID NO: 3294357 - RNA, 20 nt, Variola virus
aggaauuaaucuaguagaaa

SEQ ID NO: 3294358 - RNA, 22 nt, Variola virus
agacgacggugaauacacucag

SEQ ID NO: 3294359 - RNA, 14 nt, Variola virus
acuuauuuaacucu

SEQ ID NO: 3294360 - RNA, 19 nt, Variola virus
auagauccgugagaaauac

SEQ ID NO: 3294361 - RNA, 14 nt, Variola virus
aaaugauugaagaa

SEQ ID NO: 3294362 - RNA, 14 nt, Variola virus
ugucucuguuuuua

SEQ ID NO: 3294363 - RNA, 15 nt, Variola virus
uucaauaaaugauuc

SEQ ID NO: 3294364 - RNA, 20 nt, Variola virus
acauuagcgcauguacauau

SEQ ID NO: 3294365 - RNA, 17 nt, Variola virus
uauuucuauuucuacua

SEQ ID NO: 3294366 - RNA, 19 nt, Variola virus
aaguuucaagauaaauaau

SEQ ID NO: 3294367 - RNA, 14 nt, Variola virus
uagaacagaaauac

SEQ ID NO: 3294368 - RNA, 16 nt, Variola virus
uuaauaaacuaacauu

SEQ ID NO: 3294369 - RNA, 16 nt, Variola virus
auuaaauauuaaugag

SEQ ID NO: 3294370 - RNA, 22 nt, Variola virus
auguauuuugaggaaauugaua

SEQ ID NO: 3294371 - RNA, 16 nt, Variola virus
ucaauagaauaaacca

SEQ ID NO: 3294372 - RNA, 23 nt, Variola virus
uaaucauauaggcauugauuuuu

SEQ ID NO: 3294373 - RNA, 20 nt, Variola virus
auugaaauuaaucauauaca

SEQ ID NO: 3294374 - RNA, 16 nt, Variola virus
agaauaagaacuauaa

SEQ ID NO: 3294375 - RNA, 19 nt, Variola virus
cucacuucucuucauuacu

SEQ ID NO: 3294376 - RNA, 22 nt, Variola virus
ucacgauaucucuuaaaugcua

SEQ ID NO: 3294377 - RNA, 12 nt, Variola virus
uauuuuacuaau

SEQ ID NO: 3294378 - RNA, 22 nt, Variola virus
acuuuuuguuuauauuaaauau

SEQ ID NO: 3294379 - RNA, 18 nt, Variola virus
caaucauugauaucuuua

SEQ ID NO: 3294380 - RNA, 15 nt, Variola virus
guuugaaucaucauc

SEQ ID NO: 3294381 - RNA, 14 nt, Variola virus
cagcaucagcauuu

SEQ ID NO: 3294382 - RNA, 14 nt, Variola virus
uacauuucucaaau

SEQ ID NO: 3294383 - RNA, 17 nt, Variola virus
ccuuaaauguaucuuua

SEQ ID NO: 3294384 - RNA, 18 nt, Variola virus
auagauuuacucugaaaa

SEQ ID NO: 3294385 - RNA, 15 nt, Variola virus
cauaguuuuaagaaa

SEQ ID NO: 3294386 - RNA, 17 nt, Variola virus
guaauaauuuauguauu

SEQ ID NO: 3294387 - RNA, 22 nt, Variola virus
cucucauuuucuucaacaaauu

SEQ ID NO: 3294388 - RNA, 14 nt, Variola virus
agaaggaaacuucu

SEQ ID NO: 3294389 - RNA, 20 nt, Variola virus
acuucuuucaguucuggaua

SEQ ID NO: 3294390 - RNA, 13 nt, Variola virus
agaguuauccauu

SEQ ID NO: 3294391 - RNA, 15 nt, Variola virus
cuauguuaauaugua

SEQ ID NO: 3294392 - RNA, 16 nt, Variola virus
uauacccauuauguaa

SEQ ID NO: 3294393 - RNA, 16 nt, Variola virus
ccacugucuaaaugua

SEQ ID NO: 3294394 - RNA, 14 nt, Variola virus
augaacuuuaucca

SEQ ID NO: 3294395 - RNA, 18 nt, Variola virus
acauuuuuggauuucaua

SEQ ID NO: 3294396 - RNA, 14 nt, Variola virus
aaccauucuaaaca

SEQ ID NO: 3294397 - RNA, 20 nt, Variola virus
ucuucccaaaauguuagaga

SEQ ID NO: 3294398 - RNA, 18 nt, Variola virus
acaaauuuggauauucua

SEQ ID NO: 3294399 - RNA, 21 nt, Variola virus
aucuacugauaaaacuggaag

SEQ ID NO: 3294400 - RNA, 15 nt, Variola virus
uuaaaauuauuaaac

SEQ ID NO: 3294401 - RNA, 23 nt, Variola virus
cuacaugacaaagauuuaucaga

SEQ ID NO: 3294402 - RNA, 23 nt, Variola virus
cucgguuguguauuaucaucugc

SEQ ID NO: 3294403 - RNA, 18 nt, Variola virus
auagcuuccuucaaucua

SEQ ID NO: 3294404 - RNA, 16 nt, Variola virus
aauggugguaaaacua

SEQ ID NO: 3294405 - RNA, 13 nt, Variola virus
uaauauaauauua

SEQ ID NO: 3294406 - RNA, 22 nt, Variola virus
aucacaaaaaaaacuucucuaa

SEQ ID NO: 3294407 - RNA, 14 nt, Variola virus
aaaacuuaaauguu

SEQ ID NO: 3294408 - RNA, 19 nt, Variola virus
uaaucauguaaauguuuaa

SEQ ID NO: 3294409 - RNA, 20 nt, Variola virus
aaucaaccgccaaugaugcg

SEQ ID NO: 3294410 - RNA, 23 nt, Variola virus
caugaacaaucacaagaauagag

SEQ ID NO: 3294411 - RNA, 18 nt, Variola virus
cguuaguaacgccauuau

SEQ ID NO: 3294412 - RNA, 13 nt, Variola virus
acaucuaaaaaug

SEQ ID NO: 3294413 - RNA, 14 nt, Variola virus
auugacgacuuugg

SEQ ID NO: 3294414 - RNA, 13 nt, Variola virus
uuacaauacauag

SEQ ID NO: 3294415 - RNA, 16 nt, Variola virus
cucuguaauaguuucc

SEQ ID NO: 3294416 - RNA, 11 nt, Variola virus
aaauggauaag

SEQ ID NO: 3294417 - RNA, 16 nt, Variola virus
auugaugacacuagau

SEQ ID NO: 3294418 - RNA, 17 nt, Variola virus
agagacaaaaugugaua

SEQ ID NO: 3294419 - RNA, 13 nt, Variola virus
augaauaucacau

SEQ ID NO: 3294420 - RNA, 14 nt, Variola virus
guauuaauacauca

SEQ ID NO: 3294421 - RNA, 20 nt, Variola virus
aagaauaauccagaauguac

SEQ ID NO: 3294422 - RNA, 22 nt, Variola virus
gacgauauuagaugauaauuua

SEQ ID NO: 3294423 - RNA, 22 nt, Variola virus
guaacguuuauauauucaauau

SEQ ID NO: 3294424 - RNA, 19 nt, Variola virus
caucuauagacgaugauuu

SEQ ID NO: 3294425 - RNA, 17 nt, Variola virus
auuaaguguuauaagau

SEQ ID NO: 3294426 - RNA, 14 nt, Variola virus
auuugauuaguaga

SEQ ID NO: 3294427 - RNA, 17 nt, Variola virus
uuauaaaggagacuugu

SEQ ID NO: 3294428 - RNA, 16 nt, Variola virus
cugcauagaaauaucu

SEQ ID NO: 3294429 - RNA, 15 nt, Variola virus
aaacuaauucauuuu

SEQ ID NO: 3294430 - RNA, 14 nt, Variola virus
auuuagcaaaauua

SEQ ID NO: 3294431 - RNA, 17 nt, Variola virus
auuucaucguuuuguau

SEQ ID NO: 3294432 - RNA, 18 nt, Variola virus
agaguauuccaagaguuu

SEQ ID NO: 3294433 - RNA, 12 nt, Variola virus
aguuaaaacuug

SEQ ID NO: 3294434 - RNA, 18 nt, Variola virus
agccaugaaacgaacacu

SEQ ID NO: 3294435 - RNA, 23 nt, Variola virus
cuguugccaaugauguuaggaaa

SEQ ID NO: 3294436 - RNA, 17 nt, Variola virus
uaaacacauagaaauaa

SEQ ID NO: 3294437 - RNA, 18 nt, Variola virus
guacuacugaagaacuaa

SEQ ID NO: 3294438 - RNA, 19 nt, Variola virus
ucaaaggaugaaagaaagc

SEQ ID NO: 3294439 - RNA, 14 nt, Variola virus
uaagcaagaaagau

SEQ ID NO: 3294440 - RNA, 16 nt, Variola virus
uaaacgaaaacuauau

SEQ ID NO: 3294441 - RNA, 17 nt, Variola virus
uuuucaaucauagaacu

SEQ ID NO: 3294442 - RNA, 18 nt, Variola virus
augcuagugcucaaacaa

SEQ ID NO: 3294443 - RNA, 14 nt, Variola virus
acaaaucaauaauu

SEQ ID NO: 3294444 - RNA, 13 nt, Variola virus
cugaaaauauauu

SEQ ID NO: 3294445 - RNA, 13 nt, Variola virus
ugguuuaggaaag

SEQ ID NO: 3294446 - RNA, 13 nt, Variola virus
agcacaaaucaaa

SEQ ID NO: 3294447 - RNA, 13 nt, Variola virus
uagcggaugaaaa

SEQ ID NO: 3294448 - RNA, 15 nt, Variola virus
ucaaucccuaagucu

SEQ ID NO: 3294449 - RNA, 13 nt, Variola virus
uaaagacuuuuau

SEQ ID NO: 3294450 - RNA, 17 nt, Variola virus
uaacguauuaaauauua

SEQ ID NO: 3294451 - RNA, 14 nt, Variola virus
augaucaaaaagag

SEQ ID NO: 3294452 - RNA, 23 nt, Variola virus
aauagguguaaaucuagaaauua

SEQ ID NO: 3294453 - RNA, 15 nt, Variola virus
cucaauuaguuuauu

SEQ ID NO: 3294454 - RNA, 14 nt, Variola virus
agaaaaaacaaugu

SEQ ID NO: 3294455 - RNA, 22 nt, Variola virus
uuaguaagugcuacaaaacaga

SEQ ID NO: 3294456 - RNA, 16 nt, Variola virus
auuuauauauuaaaaa

SEQ ID NO: 3294457 - RNA, 17 nt, Variola virus
guuaauuuuaaaugaug

SEQ ID NO: 3294458 - RNA, 20 nt, Variola virus
aaucaggacgaauaauucua

SEQ ID NO: 3294459 - RNA, 18 nt, Variola virus
acugaaugcuuucuugga

SEQ ID NO: 3294460 - RNA, 16 nt, Variola virus
auucacaaauaugacg

SEQ ID NO: 3294461 - RNA, 13 nt, Variola virus
cacaugaugauuu

SEQ ID NO: 3294462 - RNA, 18 nt, Variola virus
uagaucacccuaaucuua

SEQ ID NO: 3294463 - RNA, 20 nt, Variola virus
auaaacaugucuauuguuaa

SEQ ID NO: 3294464 - RNA, 13 nt, Variola virus
auauaaaaaauuu

SEQ ID NO: 3294465 - RNA, 13 nt, Variola virus
aauuuaaaauaua

SEQ ID NO: 3294466 - RNA, 15 nt, Variola virus
cucaaacuaaauguc

SEQ ID NO: 3294467 - RNA, 13 nt, Variola virus
cagauuuuaauau

SEQ ID NO: 3294468 - RNA, 14 nt, Variola virus
aucuauauauguau

SEQ ID NO: 3294469 - RNA, 22 nt, Variola virus
aaauauagaucuuauuuaguau

SEQ ID NO: 3294470 - RNA, 23 nt, Variola virus
uaaaaguagaggaugugauacau

SEQ ID NO: 3294471 - RNA, 21 nt, Variola virus
cgucuuuauuuucuauuuuua

SEQ ID NO: 3294472 - RNA, 21 nt, Variola virus
guagaaacuauacgaaauaga

SEQ ID NO: 3294473 - RNA, 15 nt, Variola virus
auaaaaaauauaaca

SEQ ID NO: 3294474 - RNA, 21 nt, Variola virus
gaaugcucucccggauauuau

SEQ ID NO: 3294475 - RNA, 21 nt, Variola virus
cuccaucggcuuuaacaauug

SEQ ID NO: 3294476 - RNA, 21 nt, Variola virus
gauaacuagaaucagaaucua

SEQ ID NO: 3294477 - RNA, 20 nt, Variola virus
auguuccauuuauaagaaau

SEQ ID NO: 3294478 - RNA, 17 nt, Variola virus
auugaugcgaauagcag

SEQ ID NO: 3294479 - RNA, 20 nt, Variola virus
uuaacaccuccacaguuuuu

SEQ ID NO: 3294480 - RNA, 12 nt, Variola virus
aguauuuucuau

SEQ ID NO: 3294481 - RNA, 18 nt, Variola virus
ucuuccaucaacuuauua

SEQ ID NO: 3294482 - RNA, 19 nt, Variola virus
gauuugauacggcuauucu

SEQ ID NO: 3294483 - RNA, 13 nt, Variola virus
aacagaaaaaaca

SEQ ID NO: 3294484 - RNA, 22 nt, Variola virus
aaacaguuugguauuagaauca

SEQ ID NO: 3294485 - RNA, 15 nt, Variola virus
aaguaaaaaagaaaa

SEQ ID NO: 3294486 - RNA, 18 nt, Variola virus
uaucacuaucuucaucau

SEQ ID NO: 3294487 - RNA, 16 nt, Variola virus
acuaauauaacuuauu

SEQ ID NO: 3294488 - RNA, 22 nt, Variola virus
aaaaugacaucguugcccggau

SEQ ID NO: 3294489 - RNA, 15 nt, Variola virus
uuguaauaucuuaaa

SEQ ID NO: 3294490 - RNA, 21 nt, Variola virus
gagauaucccguuagaaauau

SEQ ID NO: 3294491 - RNA, 23 nt, Variola virus
auguauaacaaaugcagaaauua

SEQ ID NO: 3294492 - RNA, 13 nt, Variola virus
acaacaaaugaua

SEQ ID NO: 3294493 - RNA, 16 nt, Variola virus
ccaauuauuugaacaa

SEQ ID NO: 3294494 - RNA, 15 nt, Variola virus
uaauuaaucuaaaau

SEQ ID NO: 3294495 - RNA, 17 nt, Variola virus
cgcuacaauaacucuau

SEQ ID NO: 3294496 - RNA, 17 nt, Variola virus
auucuggagcuauuuuc

SEQ ID NO: 3294497 - RNA, 22 nt, Variola virus
agaaaaaauuuauuuaucaauu

SEQ ID NO: 3294498 - RNA, 19 nt, Variola virus
auaacuggauauagaacug

SEQ ID NO: 3294499 - RNA, 15 nt, Variola virus
aauaucauaaauaua

SEQ ID NO: 3294500 - RNA, 14 nt, Variola virus
uguauuuuggcaua

SEQ ID NO: 3294501 - RNA, 13 nt, Variola virus
acaucuguuugag

SEQ ID NO: 3294502 - RNA, 20 nt, Variola virus
aucaguauauaaaaagaaug

SEQ ID NO: 3294503 - RNA, 15 nt, Variola virus
ucaauagauuauaca

SEQ ID NO: 3294504 - RNA, 19 nt, Variola virus
caaaaguaagcauuuccuu

SEQ ID NO: 3294505 - RNA, 17 nt, Variola virus
uuauuaauaauuguaaa

SEQ ID NO: 3294506 - RNA, 16 nt, Variola virus
uacuauuuuauaccuu

SEQ ID NO: 3294507 - RNA, 17 nt, Variola virus
auugcauugugaauaua

SEQ ID NO: 3294508 - RNA, 17 nt, Variola virus
ucuacuaaucucuguaa

SEQ ID NO: 3294509 - RNA, 18 nt, Variola virus
ucaaucaaggaacuaaau

SEQ ID NO: 3294510 - RNA, 14 nt, Variola virus
aggaguuuuauuca

SEQ ID NO: 3294511 - RNA, 13 nt, Variola virus
cgcauaucaugaa

SEQ ID NO: 3294512 - RNA, 17 nt, Variola virus
auaaaaagguaucugau

SEQ ID NO: 3294513 - RNA, 13 nt, Variola virus
aaauccuguaaua

SEQ ID NO: 3294514 - RNA, 23 nt, Variola virus
gcuuaaaggaagaauaucauauu

SEQ ID NO: 3294515 - RNA, 15 nt, Variola virus
auacaguaaguacau

SEQ ID NO: 3294516 - RNA, 17 nt, Variola virus
aacauaguaaaaaauau

SEQ ID NO: 3294517 - RNA, 20 nt, Variola virus
uauuuacaucgcauacaaaa

SEQ ID NO: 3294518 - RNA, 16 nt, Variola virus
aucuguuuccuauaau

SEQ ID NO: 3294519 - RNA, 18 nt, Variola virus
auaacaggggaaugaaca

SEQ ID NO: 3294520 - RNA, 21 nt, Variola virus
auggacauuauuuuuuuaaac

SEQ ID NO: 3294521 - RNA, 21 nt, Variola virus
auauucuuaaaagguuucaua

SEQ ID NO: 3294522 - RNA, 13 nt, Variola virus
uuccauuauuaau

SEQ ID NO: 3294523 - RNA, 16 nt, Variola virus
aucauugacugcuaaa

SEQ ID NO: 3294524 - RNA, 21 nt, Variola virus
aaggacagaaaaauguuagaa

SEQ ID NO: 3294525 - RNA, 16 nt, Variola virus
uuagucauaaccguaa

SEQ ID NO: 3294526 - RNA, 19 nt, Variola virus
auuugggccauuauaccuc

SEQ ID NO: 3294527 - RNA, 22 nt, Variola virus
auaagacuuuacucuucuaaau

SEQ ID NO: 3294528 - RNA, 14 nt, Variola virus
aaauauauacauau

SEQ ID NO: 3294529 - RNA, 16 nt, Variola virus
uugcaaguuacuaauu

SEQ ID NO: 3294530 - RNA, 15 nt, Variola virus
aauauuauaaagccu

SEQ ID NO: 3294531 - RNA, 15 nt, Variola virus
ccauaagcaaacuga

SEQ ID NO: 3294532 - RNA, 20 nt, Variola virus
aauucguuuuuauaugugac

SEQ ID NO: 3294533 - RNA, 23 nt, Variola virus
uaggaaaacccucacacauaaac

SEQ ID NO: 3294534 - RNA, 16 nt, Variola virus
uaacucauuuuuugaa

SEQ ID NO: 3294535 - RNA, 14 nt, Variola virus
aaucugaacuuuaa

SEQ ID NO: 3294536 - RNA, 14 nt, Variola virus
auuuguacauuauu

SEQ ID NO: 3294537 - RNA, 20 nt, Variola virus
gauguugauuaggucuuuua

SEQ ID NO: 3294538 - RNA, 20 nt, Variola virus
uguaacuucacuagguagua

SEQ ID NO: 3294539 - RNA, 19 nt, Variola virus
ucuuaccaucuucuuugau

SEQ ID NO: 3294540 - RNA, 15 nt, Variola virus
uuucuucaacaaauu

SEQ ID NO: 3294541 - RNA, 18 nt, Variola virus
aucuauuucugucauuaa

SEQ ID NO: 3294542 - RNA, 22 nt, Variola virus
augauaauuuauacaaaguaua

SEQ ID NO: 3294543 - RNA, 21 nt, Variola virus
gcaugugauuuacucauuuau

SEQ ID NO: 3294544 - RNA, 15 nt, Variola virus
aggaaauuaugagaa

SEQ ID NO: 3294545 - RNA, 20 nt, Variola virus
uaaauauuuuaaaauuuaua

SEQ ID NO: 3294546 - RNA, 17 nt, Variola virus
aaggauacuaaacauug

SEQ ID NO: 3294547 - RNA, 14 nt, Variola virus
ugguguuacaaaac

SEQ ID NO: 3294548 - RNA, 18 nt, Variola virus
uaugcaaccguaucaaaa

SEQ ID NO: 3294549 - RNA, 20 nt, Variola virus
uuccauaggauacuuuguaa

SEQ ID NO: 3294550 - RNA, 17 nt, Variola virus
uacaaucaauaauauag

SEQ ID NO: 3294551 - RNA, 12 nt, Variola virus
acauagaaauaa

SEQ ID NO: 3294552 - RNA, 18 nt, Variola virus
aaggacagaaaaauguua

SEQ ID NO: 3294553 - RNA, 21 nt, Variola virus
uagcuaucgguuuugucagau

SEQ ID NO: 3294554 - RNA, 12 nt, Variola virus
aaguacaaaaua

SEQ ID NO: 3294555 - RNA, 17 nt, Variola virus
agaaccaguaacauaua

SEQ ID NO: 3294556 - RNA, 17 nt, Variola virus
cucgcuuuguguaucau

SEQ ID NO: 3294557 - RNA, 18 nt, Variola virus
guauaucgcagaugaaac

SEQ ID NO: 3294558 - RNA, 21 nt, Variola virus
gauauucagaaagcuguggau

SEQ ID NO: 3294559 - RNA, 21 nt, Variola virus
uuucuugagaucccacaucau

SEQ ID NO: 3294560 - RNA, 18 nt, Variola virus
uuaucgauuagucuuaau

SEQ ID NO: 3294561 - RNA, 19 nt, Variola virus
cgauucuauauauacucuu

SEQ ID NO: 3294562 - RNA, 17 nt, Variola virus
cuagucucgauauccaa

SEQ ID NO: 3294563 - RNA, 19 nt, Variola virus
gucuauauaugaauaagca

SEQ ID NO: 3294564 - RNA, 12 nt, Variola virus
uuuguaauuuua

SEQ ID NO: 3294565 - RNA, 20 nt, Variola virus
auuaacgcaccuauaaagac

SEQ ID NO: 3294566 - RNA, 12 nt, Variola virus
caugucuucaau

SEQ ID NO: 3294567 - RNA, 15 nt, Variola virus
gucuguuaauagaca

SEQ ID NO: 3294568 - RNA, 20 nt, Variola virus
uguucccgucaauagagcaa

SEQ ID NO: 3294569 - RNA, 17 nt, Variola virus
ucagaaauacgguuuuu

SEQ ID NO: 3294570 - RNA, 13 nt, Variola virus
uuaaauguuuucu

SEQ ID NO: 3294571 - RNA, 22 nt, Variola virus
caaauguuaaacauuaauugau

SEQ ID NO: 3294572 - RNA, 16 nt, Variola virus
uaauuccguuaauauu

SEQ ID NO: 3294573 - RNA, 16 nt, Variola virus
caucuaucacaguuaa

SEQ ID NO: 3294574 - RNA, 15 nt, Variola virus
uaaaauaaauauucu

SEQ ID NO: 3294575 - RNA, 14 nt, Variola virus
aaagucuuuaguau

SEQ ID NO: 3294576 - RNA, 18 nt, Variola virus
agaaaucauauaugauau

SEQ ID NO: 3294577 - RNA, 12 nt, Variola virus
acagaauuauug

SEQ ID NO: 3294578 - RNA, 12 nt, Variola virus
cauaaaacauca

SEQ ID NO: 3294579 - RNA, 22 nt, Variola virus
augaaacaguaggguuauuaac

SEQ ID NO: 3294580 - RNA, 16 nt, Variola virus
ggaacaguaaugauug

SEQ ID NO: 3294581 - RNA, 15 nt, Variola virus
uauguaucaaucaaa

SEQ ID NO: 3294582 - RNA, 23 nt, Variola virus
guuucccuauuaaaauucuuaaa

SEQ ID NO: 3294583 - RNA, 18 nt, Variola virus
uacuaagccaacaaauau

SEQ ID NO: 3294584 - RNA, 23 nt, Variola virus
auuuccaucaggaauguuugcug

SEQ ID NO: 3294585 - RNA, 19 nt, Variola virus
aaagggcaauaguuugcgu

SEQ ID NO: 3294586 - RNA, 20 nt, Variola virus
agauauaaaauagaaaauaa

SEQ ID NO: 3294587 - RNA, 13 nt, Variola virus
ugaauguuuucaa

SEQ ID NO: 3294588 - RNA, 14 nt, Variola virus
gugcuuaauguuuc

SEQ ID NO: 3294589 - RNA, 19 nt, Variola virus
auuauagcuucuggauaua

SEQ ID NO: 3294590 - RNA, 20 nt, Variola virus
ucaaucaaaagacuauacau

SEQ ID NO: 3294591 - RNA, 19 nt, Variola virus
uguaugagugauauugaua

SEQ ID NO: 3294592 - RNA, 13 nt, Variola virus
uauauucuaugau

SEQ ID NO: 3294593 - RNA, 17 nt, Variola virus
uuaaaaauguuacugaa

SEQ ID NO: 3294594 - RNA, 19 nt, Variola virus
acaugaugauugccuuaag

SEQ ID NO: 3294595 - RNA, 21 nt, Variola virus
cuaacaaaaauuaugaaauaa

SEQ ID NO: 3294596 - RNA, 16 nt, Variola virus
agaacuuauuaaugaa

SEQ ID NO: 3294597 - RNA, 13 nt, Variola virus
ugccaaaaugaua

SEQ ID NO: 3294598 - RNA, 12 nt, Variola virus
auuaauuacaau

SEQ ID NO: 3294599 - RNA, 14 nt, Variola virus
gucuaugucucuua

SEQ ID NO: 3294600 - RNA, 19 nt, Variola virus
acagauagaucauuuugaa

SEQ ID NO: 3294601 - RNA, 16 nt, Variola virus
uccgaugauuaaugac

SEQ ID NO: 3294602 - RNA, 16 nt, Variola virus
uuaacuuauuagcguu

SEQ ID NO: 3294603 - RNA, 17 nt, Variola virus
auccaaucuaagaaauu

SEQ ID NO: 3294604 - RNA, 21 nt, Variola virus
auuaacaccggaacaaaaagc

SEQ ID NO: 3294605 - RNA, 15 nt, Variola virus
acauuaauugccaua

SEQ ID NO: 3294606 - RNA, 18 nt, Variola virus
guuaauaguuuuuaucau

SEQ ID NO: 3294607 - RNA, 12 nt, Variola virus
uugguuguauug

SEQ ID NO: 3294608 - RNA, 12 nt, Variola virus
acuaaauacuac

SEQ ID NO: 3294609 - RNA, 23 nt, Variola virus
uuaaugauacacacuauacuguc

SEQ ID NO: 3294610 - RNA, 15 nt, Variola virus
gccaccacuucucua

SEQ ID NO: 3294611 - RNA, 18 nt, Variola virus
caaaacauaauacucugu

SEQ ID NO: 3294612 - RNA, 22 nt, Variola virus
guaauauuguuaauuauuucua

SEQ ID NO: 3294613 - RNA, 14 nt, Variola virus
aacggaugaaaaua

SEQ ID NO: 3294614 - RNA, 20 nt, Variola virus
uuauaagaaugauuguuuga

SEQ ID NO: 3294615 - RNA, 16 nt, Variola virus
ugaaacgaacacuauu

SEQ ID NO: 3294616 - RNA, 16 nt, Variola virus
cgugcguaauauuguu

SEQ ID NO: 3294617 - RNA, 19 nt, Variola virus
uguauaugugaauaugaca

SEQ ID NO: 3294618 - RNA, 20 nt, Variola virus
uccggugcgcagucuaaaag

SEQ ID NO: 3294619 - RNA, 21 nt, Variola virus
aaugguacuucuuaccaacau

SEQ ID NO: 3294620 - RNA, 19 nt, Variola virus
uuuagaauauauguaugua

SEQ ID NO: 3294621 - RNA, 20 nt, Variola virus
auauuauuuuuauguuuuau

SEQ ID NO: 3294622 - RNA, 14 nt, Variola virus
ucauuuucuacaau

SEQ ID NO: 3294623 - RNA, 14 nt, Variola virus
uuauuaucuguaga

SEQ ID NO: 3294624 - RNA, 14 nt, Variola virus
aagauauuccaaga

SEQ ID NO: 3294625 - RNA, 19 nt, Variola virus
auacuauccaucagaaugu

SEQ ID NO: 3294626 - RNA, 19 nt, Variola virus
aauaacauaggauuaaaaa

SEQ ID NO: 3294627 - RNA, 15 nt, Variola virus
guuuucgauacuuuu

SEQ ID NO: 3294628 - RNA, 22 nt, Variola virus
auaaucagucauaacaaaugua

SEQ ID NO: 3294629 - RNA, 19 nt, Variola virus
ccccaggaucuccaacaaa

SEQ ID NO: 3294630 - RNA, 14 nt, Variola virus
uuagacuuguauuc

SEQ ID NO: 3294631 - RNA, 19 nt, Variola virus
uuagaauaagaguguagua

SEQ ID NO: 3294632 - RNA, 20 nt, Variola virus
cauacuccaucaauuucaaa

SEQ ID NO: 3294633 - RNA, 22 nt, Variola virus
aagcggaacaauaaacaaaaua

SEQ ID NO: 3294634 - RNA, 16 nt, Variola virus
uuuaaaaaguuaucuu

SEQ ID NO: 3294635 - RNA, 15 nt, Variola virus
gucagcaucagcauu

SEQ ID NO: 3294636 - RNA, 16 nt, Variola virus
gcguuuuaguuauuac

SEQ ID NO: 3294637 - RNA, 19 nt, Variola virus
auaaucugguggauacucu

SEQ ID NO: 3294638 - RNA, 19 nt, Variola virus
cuuaacaugagacauaaau

SEQ ID NO: 3294639 - RNA, 19 nt, Variola virus
aaauuugcaucuacaucau

SEQ ID NO: 3294640 - RNA, 15 nt, Variola virus
aggugacacauguac

SEQ ID NO: 3294641 - RNA, 21 nt, Variola virus
guuguaugaguuuaucguuua

SEQ ID NO: 3294642 - RNA, 15 nt, Variola virus
cuauuggaauguguu

SEQ ID NO: 3294643 - RNA, 19 nt, Variola virus
agaauagcgguaaguauau

SEQ ID NO: 3294644 - RNA, 18 nt, Variola virus
agaucuaauuuuucauua

SEQ ID NO: 3294645 - RNA, 21 nt, Variola virus
aucaaaaauaaaauacauuua

SEQ ID NO: 3294646 - RNA, 15 nt, Variola virus
acuaucauaauuaaa

SEQ ID NO: 3294647 - RNA, 17 nt, Variola virus
gcacuacuguuaagaau

SEQ ID NO: 3294648 - RNA, 16 nt, Variola virus
ucuaaacaacaaacaa

SEQ ID NO: 3294649 - RNA, 19 nt, Variola virus
uccaugaucuguuuaucau

SEQ ID NO: 3294650 - RNA, 15 nt, Variola virus
aauccaaauaugaua

SEQ ID NO: 3294651 - RNA, 15 nt, Variola virus
auaggagauauauau

SEQ ID NO: 3294652 - RNA, 16 nt, Variola virus
ucucccaauaccuguc

SEQ ID NO: 3294653 - RNA, 22 nt, Variola virus
auaaaucuacuuagauuauucu

SEQ ID NO: 3294654 - RNA, 19 nt, Variola virus
acaaaguuuccuuuaacuc

SEQ ID NO: 3294655 - RNA, 14 nt, Variola virus
gagacuuaaacaac

SEQ ID NO: 3294656 - RNA, 13 nt, Variola virus
auauuauuaauaa

SEQ ID NO: 3294657 - RNA, 19 nt, Variola virus
agaaacgauaccaucuucu

SEQ ID NO: 3294658 - RNA, 22 nt, Variola virus
uauaauuauuauugauagcauu

SEQ ID NO: 3294659 - RNA, 22 nt, Variola virus
gucuuaauuaauugucuuucuc

SEQ ID NO: 3294660 - RNA, 14 nt, Variola virus
auuaaacaauagau

SEQ ID NO: 3294661 - RNA, 20 nt, Variola virus
ccuuaugcauccaaaguauu

SEQ ID NO: 3294662 - RNA, 13 nt, Variola virus
agaccaucuaaca

SEQ ID NO: 3294663 - RNA, 22 nt, Variola virus
aauaguucaacaucuacuuuug

SEQ ID NO: 3294664 - RNA, 13 nt, Variola virus
guaacacuuuuaa

SEQ ID NO: 3294665 - RNA, 14 nt, Variola virus
ugauagcuccacca

SEQ ID NO: 3294666 - RNA, 19 nt, Variola virus
guauacucccuugcaucau

SEQ ID NO: 3294667 - RNA, 15 nt, Variola virus
agauauguuuauuca

SEQ ID NO: 3294668 - RNA, 18 nt, Variola virus
uauggccauagaggaugu

SEQ ID NO: 3294669 - RNA, 21 nt, Variola virus
caauuacguggauuauaacau

SEQ ID NO: 3294670 - RNA, 21 nt, Variola virus
auaguuccccauuucaaaaug

SEQ ID NO: 3294671 - RNA, 19 nt, Variola virus
uuuuuauaaaaaaaucauu

SEQ ID NO: 3294672 - RNA, 17 nt, Variola virus
agugaaucgacuauaga

SEQ ID NO: 3294673 - RNA, 13 nt, Variola virus
uagauacaaaauc

SEQ ID NO: 3294674 - RNA, 14 nt, Variola virus
auaugcucauauau

SEQ ID NO: 3294675 - RNA, 19 nt, Variola virus
uguaacccacguaacauua

SEQ ID NO: 3294676 - RNA, 22 nt, Variola virus
gacuaaaucagauuaugaggau

SEQ ID NO: 3294677 - RNA, 18 nt, Variola virus
ggaucuucuaauggauug

SEQ ID NO: 3294678 - RNA, 19 nt, Variola virus
caugccucagguucaucga

SEQ ID NO: 3294679 - RNA, 16 nt, Variola virus
agcauuguuauguauu

SEQ ID NO: 3294680 - RNA, 20 nt, Variola virus
uaucugaguauaguguucau

SEQ ID NO: 3294681 - RNA, 18 nt, Variola virus
acuaaacacauuauuaau

SEQ ID NO: 3294682 - RNA, 21 nt, Variola virus
aauuuacuacugaguauaaau

SEQ ID NO: 3294683 - RNA, 20 nt, Variola virus
auauacgaaauaaaauagac

SEQ ID NO: 3294684 - RNA, 19 nt, Variola virus
aacgaagaucuuuucucaa

SEQ ID NO: 3294685 - RNA, 20 nt, Variola virus
gcuucagaauauucuuuucu

SEQ ID NO: 3294686 - RNA, 16 nt, Variola virus
uccaguuccuuuucua

SEQ ID NO: 3294687 - RNA, 17 nt, Variola virus
cauagauaauauauacg

SEQ ID NO: 3294688 - RNA, 20 nt, Variola virus
guaacgcguggaaaaagcuc

SEQ ID NO: 3294689 - RNA, 12 nt, Variola virus
caaguacauaaa

SEQ ID NO: 3294690 - RNA, 13 nt, Variola virus
auaauguuucuau

SEQ ID NO: 3294691 - RNA, 18 nt, Variola virus
gagauauuggaugaugau

SEQ ID NO: 3294692 - RNA, 13 nt, Variola virus
accuaagaagaau

SEQ ID NO: 3294693 - RNA, 17 nt, Variola virus
uauauuccugagcauau

SEQ ID NO: 3294694 - RNA, 13 nt, Variola virus
aauaucuuguaua

SEQ ID NO: 3294695 - RNA, 21 nt, Variola virus
aucuucaagagugcauugacu

SEQ ID NO: 3294696 - RNA, 14 nt, Variola virus
auucaucuagaaug

SEQ ID NO: 3294697 - RNA, 16 nt, Variola virus
aaauugguacauagau

SEQ ID NO: 3294698 - RNA, 13 nt, Variola virus
uuauuuaacaauu

SEQ ID NO: 3294699 - RNA, 15 nt, Variola virus
ucuuuaccuuaagaa

SEQ ID NO: 3294700 - RNA, 21 nt, Variola virus
gauuacggauugguuucuaaa

SEQ ID NO: 3294701 - RNA, 21 nt, Variola virus
cagaaauugguauaaauguug

SEQ ID NO: 3294702 - RNA, 14 nt, Variola virus
acaauuaucaaauu

SEQ ID NO: 3294703 - RNA, 22 nt, Variola virus
cuucuaaaauuacaaacaacug

SEQ ID NO: 3294704 - RNA, 15 nt, Variola virus
aauuuagaaaugauu

SEQ ID NO: 3294705 - RNA, 22 nt, Variola virus
uaauaaauugaugacgucaugu

SEQ ID NO: 3294706 - RNA, 13 nt, Variola virus
ugguuuucuaaau

SEQ ID NO: 3294707 - RNA, 20 nt, Variola virus
uaucuagauaacaacgacuu

SEQ ID NO: 3294708 - RNA, 12 nt, Variola virus
cagaaaugauuu

SEQ ID NO: 3294709 - RNA, 17 nt, Variola virus
aagaugcaaacauuaug

SEQ ID NO: 3294710 - RNA, 19 nt, Variola virus
uguuucacauugacauauu

SEQ ID NO: 3294711 - RNA, 21 nt, Variola virus
ccaaaucaguaacuauguuca

SEQ ID NO: 3294712 - RNA, 22 nt, Variola virus
guauaauagaccacgauaauau

SEQ ID NO: 3294713 - RNA, 24 nt, Variola virus
aguguuuagcguggcuagaauagu

SEQ ID NO: 3294714 - RNA, 18 nt, Variola virus
uaaaugaaaaaaaacuag

SEQ ID NO: 3294715 - RNA, 15 nt, Variola virus
agagaucuacuggug

SEQ ID NO: 3294716 - RNA, 19 nt, Variola virus
agauggaagggucaaacuu

SEQ ID NO: 3294717 - RNA, 23 nt, Variola virus
caagucuucaguucuaucuucua

SEQ ID NO: 3294718 - RNA, 21 nt, Variola virus
aucugauagaaagaauaagaa

SEQ ID NO: 3294719 - RNA, 13 nt, Variola virus
aauuagaaauugg

SEQ ID NO: 3294720 - RNA, 16 nt, Variola virus
uaguaauaaaauuucu

SEQ ID NO: 3294721 - RNA, 18 nt, Variola virus
uuauaaaguuuagucucu

SEQ ID NO: 3294722 - RNA, 15 nt, Variola virus
cauauugaucauuug

SEQ ID NO: 3294723 - RNA, 21 nt, Variola virus
gcaaccaccgcaugauaauau

SEQ ID NO: 3294724 - RNA, 16 nt, Variola virus
auugguauaaauguug

SEQ ID NO: 3294725 - RNA, 14 nt, Variola virus
caaauguuaaacau

SEQ ID NO: 3294726 - RNA, 18 nt, Variola virus
gauaaaacaaguuuucau

SEQ ID NO: 3294727 - RNA, 13 nt, Variola virus
caucuaucaucuc

SEQ ID NO: 3294728 - RNA, 20 nt, Variola virus
uauauugccuccauagcauu

SEQ ID NO: 3294729 - RNA, 21 nt, Variola virus
cucuuuuauagagaaauguaa

SEQ ID NO: 3294730 - RNA, 18 nt, Variola virus
uauugguccgaauuacag

SEQ ID NO: 3294731 - RNA, 21 nt, Variola virus
gcuaauuccuaguuucaucau

SEQ ID NO: 3294732 - RNA, 14 nt, Variola virus
aacacaaaauauga

SEQ ID NO: 3294733 - RNA, 18 nt, Variola virus
aaucgcauccgauaaagc

SEQ ID NO: 3294734 - RNA, 16 nt, Variola virus
auuaucaaauguuguu

SEQ ID NO: 3294735 - RNA, 19 nt, Variola virus
uaauugccauaauaauuac

SEQ ID NO: 3294736 - RNA, 20 nt, Variola virus
gugcugucaaacaaaaacuu

SEQ ID NO: 3294737 - RNA, 17 nt, Variola virus
uaaauuuaucaauaaau

SEQ ID NO: 3294738 - RNA, 15 nt, Variola virus
uauauaaaaauauca

SEQ ID NO: 3294739 - RNA, 20 nt, Variola virus
ugaauaccauacaauuuaug

SEQ ID NO: 3294740 - RNA, 19 nt, Variola virus
uguaucgagacguggagau

SEQ ID NO: 3294741 - RNA, 20 nt, Variola virus
auucuuuggauccaaaugcu

SEQ ID NO: 3294742 - RNA, 14 nt, Variola virus
uauguauucagaau

SEQ ID NO: 3294743 - RNA, 12 nt, Variola virus
aacucuguuuua

SEQ ID NO: 3294744 - RNA, 15 nt, Variola virus
caaauaggagauauu

SEQ ID NO: 3294745 - RNA, 21 nt, Variola virus
ugaacaagagauauauuggag

SEQ ID NO: 3294746 - RNA, 16 nt, Variola virus
auaccaucuucuggaa

SEQ ID NO: 3294747 - RNA, 22 nt, Variola virus
uauuuaccuuucuacaugaaau

SEQ ID NO: 3294748 - RNA, 16 nt, Variola virus
gauaacgcgucuuuaa

SEQ ID NO: 3294749 - RNA, 22 nt, Variola virus
cuaaauuuuguugauuacucuu

SEQ ID NO: 3294750 - RNA, 16 nt, Variola virus
gaacauauaaauguag

SEQ ID NO: 3294751 - RNA, 18 nt, Variola virus
agaugucagcaucugaua

SEQ ID NO: 3294752 - RNA, 21 nt, Variola virus
augcaacucuaucauguagua

SEQ ID NO: 3294753 - RNA, 15 nt, Variola virus
uguucccuugucauu

SEQ ID NO: 3294754 - RNA, 16 nt, Variola virus
uacugcuggaaaauaa

SEQ ID NO: 3294755 - RNA, 15 nt, Variola virus
uaauacacacaaagu

SEQ ID NO: 3294756 - RNA, 23 nt, Variola virus
caguaccuugacuaaagucuuua

SEQ ID NO: 3294757 - RNA, 20 nt, Variola virus
ugagagucuuauauguagca

SEQ ID NO: 3294758 - RNA, 20 nt, Variola virus
aucuauauuuaucacagucu

SEQ ID NO: 3294759 - RNA, 16 nt, Variola virus
caaaaugauagauauu

SEQ ID NO: 3294760 - RNA, 15 nt, Variola virus
uauuuaacaauuugg

SEQ ID NO: 3294761 - RNA, 16 nt, Variola virus
uucucacuagugucua

SEQ ID NO: 3294762 - RNA, 15 nt, Variola virus
caaauuuaucuacua

SEQ ID NO: 3294763 - RNA, 20 nt, Variola virus
auaucauuaaguucacuaga

SEQ ID NO: 3294764 - RNA, 20 nt, Variola virus
cagaaauugguauaaauguu

SEQ ID NO: 3294765 - RNA, 19 nt, Variola virus
aacaaggugacuauaaagu

SEQ ID NO: 3294766 - RNA, 22 nt, Variola virus
uuacaucaccucuaacaucauc

SEQ ID NO: 3294767 - RNA, 17 nt, Variola virus
uaaauuaauucauacac

SEQ ID NO: 3294768 - RNA, 19 nt, Variola virus
auaacucggaucugcuaua

SEQ ID NO: 3294769 - RNA, 13 nt, Variola virus
uguauauacuguc

SEQ ID NO: 3294770 - RNA, 22 nt, Variola virus
agcuaugaacuuguuuaaugau

SEQ ID NO: 3294771 - RNA, 19 nt, Variola virus
aaccuuuguuguacaaauu

SEQ ID NO: 3294772 - RNA, 18 nt, Variola virus
aauagaugauagaauauc

SEQ ID NO: 3294773 - RNA, 21 nt, Variola virus
uucuccaccaaacauauucuu

SEQ ID NO: 3294774 - RNA, 14 nt, Variola virus
ccaaguagauaucu

SEQ ID NO: 3294775 - RNA, 16 nt, Variola virus
uaucuauguuaucauc

SEQ ID NO: 3294776 - RNA, 20 nt, Variola virus
aauaaucauaaauuauuuca

SEQ ID NO: 3294777 - RNA, 20 nt, Variola virus
aauugguaacucauucuaua

SEQ ID NO: 3294778 - RNA, 16 nt, Variola virus
acuucgauaaaauuac

SEQ ID NO: 3294779 - RNA, 20 nt, Variola virus
auucagaauuucuacauaau

SEQ ID NO: 3294780 - RNA, 15 nt, Variola virus
aaauagcgcugaaaa

SEQ ID NO: 3294781 - RNA, 17 nt, Variola virus
aguaacuuuuuuucuau

SEQ ID NO: 3294782 - RNA, 14 nt, Variola virus
auauuguacaguac

SEQ ID NO: 3294783 - RNA, 15 nt, Variola virus
acacaucaaaauaac

SEQ ID NO: 3294784 - RNA, 20 nt, Variola virus
aucucaccugccauaaauaa

SEQ ID NO: 3294785 - RNA, 12 nt, Variola virus
agaggagaagua

SEQ ID NO: 3294786 - RNA, 18 nt, Variola virus
auaucaaauacgcauaua

SEQ ID NO: 3294787 - RNA, 18 nt, Variola virus
ucuaaaccuucuuauuuu

SEQ ID NO: 3294788 - RNA, 13 nt, Variola virus
augcaaggcauuu

SEQ ID NO: 3294789 - RNA, 17 nt, Variola virus
auacgcuccuuaucaaa

SEQ ID NO: 3294790 - RNA, 17 nt, Variola virus
gcaauagguaauaacua

SEQ ID NO: 3294791 - RNA, 22 nt, Variola virus
aauugguauauguauuagaaua

SEQ ID NO: 3294792 - RNA, 17 nt, Variola virus
ucauuaaaaaaauuaac

SEQ ID NO: 3294793 - RNA, 14 nt, Variola virus
agaaaauacuauau

SEQ ID NO: 3294794 - RNA, 24 nt, Variola virus
uauuccaugaauaagugcgaugau

SEQ ID NO: 3294795 - RNA, 14 nt, Variola virus
auaugacuaaacau

SEQ ID NO: 3294796 - RNA, 12 nt, Variola virus
cucccuuuagau

SEQ ID NO: 3294797 - RNA, 14 nt, Variola virus
aauauaauauugaa

SEQ ID NO: 3294798 - RNA, 20 nt, Variola virus
agucuguugagcuugaucau

SEQ ID NO: 3294799 - RNA, 15 nt, Variola virus
uaaaaauuaauacau

SEQ ID NO: 3294800 - RNA, 14 nt, Variola virus
aggcguuaacuaga

SEQ ID NO: 3294801 - RNA, 14 nt, Variola virus
uccuuuuacuacaa

SEQ ID NO: 3294802 - RNA, 21 nt, Variola virus
auaucuuagugcaaaaguaua

SEQ ID NO: 3294803 - RNA, 14 nt, Variola virus
uaauuacauacuuu

SEQ ID NO: 3294804 - RNA, 20 nt, Variola virus
cauuaauaauuguuuugaau

SEQ ID NO: 3294805 - RNA, 13 nt, Variola virus
aauaacaggcuaa

SEQ ID NO: 3294806 - RNA, 18 nt, Variola virus
caaaucuauaacaugcua

SEQ ID NO: 3294807 - RNA, 23 nt, Variola virus
aaugcuucucuguuuaaugaauu

SEQ ID NO: 3294808 - RNA, 16 nt, Variola virus
cauuaauuucugauau

SEQ ID NO: 3294809 - RNA, 15 nt, Variola virus
ccagcauuaacugau

SEQ ID NO: 3294810 - RNA, 12 nt, Variola virus
aauuaucaaaug

SEQ ID NO: 3294811 - RNA, 22 nt, Variola virus
gauaaaagaugcauauauuaga

SEQ ID NO: 3294812 - RNA, 18 nt, Variola virus
uucgcaauauucauuaau

SEQ ID NO: 3294813 - RNA, 20 nt, Variola virus
augcggaaccucgagaaugu

SEQ ID NO: 3294814 - RNA, 17 nt, Variola virus
acgauugucaauacuuu

SEQ ID NO: 3294815 - RNA, 14 nt, Variola virus
gcccaucuacaccu

SEQ ID NO: 3294816 - RNA, 18 nt, Variola virus
auauauuccaacgcauuu

SEQ ID NO: 3294817 - RNA, 13 nt, Variola virus
ugguguagcauau

SEQ ID NO: 3294818 - RNA, 20 nt, Variola virus
caugugaauauaauaauaca

SEQ ID NO: 3294819 - RNA, 14 nt, Variola virus
uuugugaacucuuu

SEQ ID NO: 3294820 - RNA, 18 nt, Variola virus
aucagauuauuuaacaau

SEQ ID NO: 3294821 - RNA, 17 nt, Variola virus
uucacuuuaauagauau

SEQ ID NO: 3294822 - RNA, 22 nt, Variola virus
aaauucuggauuggaugucacu

SEQ ID NO: 3294823 - RNA, 14 nt, Variola virus
aauccauccauuau

SEQ ID NO: 3294824 - RNA, 23 nt, Variola virus
aguuaucgcugaucgucuagaug

SEQ ID NO: 3294825 - RNA, 20 nt, Variola virus
uaguuagggaucacaugaau

SEQ ID NO: 3294826 - RNA, 18 nt, Variola virus
cuauaguuuccacauuaa

SEQ ID NO: 3294827 - RNA, 15 nt, Variola virus
guaaagauauuucuc

SEQ ID NO: 3294828 - RNA, 17 nt, Variola virus
aacuuuuuugacaaauu

SEQ ID NO: 3294829 - RNA, 20 nt, Variola virus
auaaugauacgauacuauau

SEQ ID NO: 3294830 - RNA, 18 nt, Variola virus
gaugucguuauucugaaa

SEQ ID NO: 3294831 - RNA, 20 nt, Variola virus
uguaucauuuagcgauucaa

SEQ ID NO: 3294832 - RNA, 16 nt, Variola virus
uguacuaucuagagau

SEQ ID NO: 3294833 - RNA, 18 nt, Variola virus
auuauuuaauuuaauaca

SEQ ID NO: 3294834 - RNA, 20 nt, Variola virus
aucaucaaccgucacauaau

SEQ ID NO: 3294835 - RNA, 23 nt, Variola virus
caauuucauacgcuccucuuuug

SEQ ID NO: 3294836 - RNA, 18 nt, Variola virus
uacagucuaauauccauu

SEQ ID NO: 3294837 - RNA, 13 nt, Variola virus
uuaaauauugauc

SEQ ID NO: 3294838 - RNA, 18 nt, Variola virus
acucaacggaaaacauuu

SEQ ID NO: 3294839 - RNA, 23 nt, Variola virus
uuuuacacaaggcauugucucua

SEQ ID NO: 3294840 - RNA, 15 nt, Variola virus
cuacuuuagcauuga

SEQ ID NO: 3294841 - RNA, 17 nt, Variola virus
auaaagauaaaaacgau

SEQ ID NO: 3294842 - RNA, 22 nt, Variola virus
auuuuuagugaaacauuccaca

SEQ ID NO: 3294843 - RNA, 16 nt, Variola virus
auuaucuugucuuggu

SEQ ID NO: 3294844 - RNA, 15 nt, Variola virus
acauagauaauaaua

SEQ ID NO: 3294845 - RNA, 13 nt, Variola virus
gauaaucauuuaa

SEQ ID NO: 3294846 - RNA, 14 nt, Variola virus
cgcuauagcauugu

SEQ ID NO: 3294847 - RNA, 16 nt, Variola virus
aacgauuauuucuaaa

SEQ ID NO: 3294848 - RNA, 15 nt, Variola virus
gcauugugaauauau

SEQ ID NO: 3294849 - RNA, 16 nt, Variola virus
agucauuacuaauaga

SEQ ID NO: 3294850 - RNA, 15 nt, Variola virus
auuucaucuacaaug

SEQ ID NO: 3294851 - RNA, 21 nt, Variola virus
auccgaaacaaucucaaauau

SEQ ID NO: 3294852 - RNA, 21 nt, Variola virus
auacauaccugauuagaauuc

SEQ ID NO: 3294853 - RNA, 18 nt, Variola virus
auaucugagcuaucuaga

SEQ ID NO: 3294854 - RNA, 19 nt, Variola virus
uauugacuuaauaggcauc

SEQ ID NO: 3294855 - RNA, 17 nt, Variola virus
aacuaaacagucuauca

SEQ ID NO: 3294856 - RNA, 16 nt, Variola virus
guaucuacgauuuuua

SEQ ID NO: 3294857 - RNA, 21 nt, Variola virus
gaacgauauuugugaaaauau

SEQ ID NO: 3294858 - RNA, 18 nt, Variola virus
aggaucuagcaaaggaaa

SEQ ID NO: 3294859 - RNA, 17 nt, Variola virus
cuaacaugcauuugaaa

SEQ ID NO: 3294860 - RNA, 15 nt, Variola virus
uauaauguggauaau

SEQ ID NO: 3294861 - RNA, 12 nt, Variola virus
ucaaaauuauuu

SEQ ID NO: 3294862 - RNA, 21 nt, Variola virus
ucugaaauaacauauagauuu

SEQ ID NO: 3294863 - RNA, 19 nt, Variola virus
uagaaauaucuaggacaau

SEQ ID NO: 3294864 - RNA, 13 nt, Variola virus
gauugauuagaaa

SEQ ID NO: 3294865 - RNA, 17 nt, Variola virus
guaauuaguuucugguu

SEQ ID NO: 3294866 - RNA, 21 nt, Variola virus
aacucuaucauguaguagaaa

SEQ ID NO: 3294867 - RNA, 23 nt, Variola virus
gucauaacaaauguauacuaucu

SEQ ID NO: 3294868 - RNA, 15 nt, Variola virus
ugauauguaugucca

SEQ ID NO: 3294869 - RNA, 21 nt, Variola virus
aagccaucuguauuaaagaua

SEQ ID NO: 3294870 - RNA, 19 nt, Variola virus
aauaacuacaguuugaaaa

SEQ ID NO: 3294871 - RNA, 17 nt, Variola virus
aucaucaccuaucuugu

SEQ ID NO: 3294872 - RNA, 19 nt, Variola virus
auuaaucauucuaaaacua

SEQ ID NO: 3294873 - RNA, 23 nt, Variola virus
auuuuuuuaaaaaggaaauacuu

SEQ ID NO: 3294874 - RNA, 20 nt, Variola virus
cuuccaaauaauauucucuu

SEQ ID NO: 3294875 - RNA, 12 nt, Variola virus
auagaugaaugu

SEQ ID NO: 3294876 - RNA, 14 nt, Variola virus
acgcgaaaaaagau

SEQ ID NO: 3294877 - RNA, 15 nt, Variola virus
uuagcaucuauuuuu

SEQ ID NO: 3294878 - RNA, 18 nt, Variola virus
augucguuauucugaaac

SEQ ID NO: 3294879 - RNA, 19 nt, Variola virus
uuucagcauggauuucuca

SEQ ID NO: 3294880 - RNA, 18 nt, Variola virus
gcaguuacaagauuuuua

SEQ ID NO: 3294881 - RNA, 22 nt, Variola virus
ccuuuaucauuaauaauuucua

SEQ ID NO: 3294882 - RNA, 23 nt, Variola virus
aauaacucauuuauauauuaaaa

SEQ ID NO: 3294883 - RNA, 18 nt, Variola virus
acuuugcccuuuaauaca

SEQ ID NO: 3294884 - RNA, 13 nt, Variola virus
agaugauauguau

SEQ ID NO: 3294885 - RNA, 19 nt, Variola virus
uaacaacgacgaaccaaaa

SEQ ID NO: 3294886 - RNA, 17 nt, Variola virus
ccaaaucaaaacaaaau

SEQ ID NO: 3294887 - RNA, 21 nt, Variola virus
aucuacgauccaucaaaaaac

SEQ ID NO: 3294888 - RNA, 12 nt, Variola virus
agaauuagaauu

SEQ ID NO: 3294889 - RNA, 21 nt, Variola virus
uauguauuguaccaaagauuu

SEQ ID NO: 3294890 - RNA, 15 nt, Variola virus
acaaugacuuuauca

SEQ ID NO: 3294891 - RNA, 16 nt, Variola virus
uagauuucgaaaauac

SEQ ID NO: 3294892 - RNA, 16 nt, Variola virus
auauacaaaugcaaua

SEQ ID NO: 3294893 - RNA, 17 nt, Variola virus
caagcuaggcuggaaac

SEQ ID NO: 3294894 - RNA, 18 nt, Variola virus
uaagauguuugagaauau

SEQ ID NO: 3294895 - RNA, 15 nt, Variola virus
acuccuauauuuccc

SEQ ID NO: 3294896 - RNA, 14 nt, Variola virus
auauagaugucaau

SEQ ID NO: 3294897 - RNA, 15 nt, Variola virus
cauaauauuaucaaa

SEQ ID NO: 3294898 - RNA, 20 nt, Variola virus
guauucaguagccaauccua

SEQ ID NO: 3294899 - RNA, 12 nt, Variola virus
cgcauuaacaaa

SEQ ID NO: 3294900 - RNA, 12 nt, Variola virus
cguauacucuau

SEQ ID NO: 3294901 - RNA, 18 nt, Variola virus
uaacguucuaacaucauu

SEQ ID NO: 3294902 - RNA, 20 nt, Variola virus
acaucuagguuucaaaagac

SEQ ID NO: 3294903 - RNA, 14 nt, Variola virus
cauuaaggagauuc

SEQ ID NO: 3294904 - RNA, 16 nt, Variola virus
uuauauacaucuuuaa

SEQ ID NO: 3294905 - RNA, 19 nt, Variola virus
agucuccgccguucuaaug

SEQ ID NO: 3294906 - RNA, 19 nt, Variola virus
auaauugagauugauguaa

SEQ ID NO: 3294907 - RNA, 18 nt, Variola virus
aaacgauuauuucuaaau

SEQ ID NO: 3294908 - RNA, 23 nt, Variola virus
accauagauucauucuuuauaga

SEQ ID NO: 3294909 - RNA, 17 nt, Variola virus
gaaguaaacgaacgucu

SEQ ID NO: 3294910 - RNA, 16 nt, Variola virus
uauauuuucauuuaaa

SEQ ID NO: 3294911 - RNA, 19 nt, Variola virus
acagaaaagauauuuguua

SEQ ID NO: 3294912 - RNA, 19 nt, Variola virus
aagcgugucccuaucuugu

SEQ ID NO: 3294913 - RNA, 17 nt, Variola virus
cuacuacacuucuagau

SEQ ID NO: 3294914 - RNA, 13 nt, Variola virus
gcaauuuucagua

SEQ ID NO: 3294915 - RNA, 17 nt, Variola virus
ucaagaauauagucuug

SEQ ID NO: 3294916 - RNA, 20 nt, Variola virus
aaaaugugauauugguguag

SEQ ID NO: 3294917 - RNA, 15 nt, Variola virus
cuaugauauuguuga

SEQ ID NO: 3294918 - RNA, 20 nt, Variola virus
uucaucauccaccuguuuua

SEQ ID NO: 3294919 - RNA, 18 nt, Variola virus
ugauggauuuaaacaucg

SEQ ID NO: 3294920 - RNA, 18 nt, Variola virus
cuauuuugguaucuucca

SEQ ID NO: 3294921 - RNA, 20 nt, Variola virus
aguguauaacaaucuuauau

SEQ ID NO: 3294922 - RNA, 17 nt, Variola virus
uggaggauuauaugaua

SEQ ID NO: 3294923 - RNA, 15 nt, Variola virus
aauccuuugauuauc

SEQ ID NO: 3294924 - RNA, 17 nt, Variola virus
acauuuucaucuagaua

SEQ ID NO: 3294925 - RNA, 16 nt, Variola virus
ucuaucguuauaacuc

SEQ ID NO: 3294926 - RNA, 21 nt, Variola virus
uaauauguuggucuaucuauu

SEQ ID NO: 3294927 - RNA, 13 nt, Variola virus
guauuagauaaau

SEQ ID NO: 3294928 - RNA, 16 nt, Variola virus
aaagauggucugaaau

SEQ ID NO: 3294929 - RNA, 12 nt, Variola virus
aggaacuagaau

SEQ ID NO: 3294930 - RNA, 14 nt, Variola virus
gccaaaucuucuuc

SEQ ID NO: 3294931 - RNA, 21 nt, Variola virus
uacuauauaguaauaccaaug

SEQ ID NO: 3294932 - RNA, 20 nt, Variola virus
agaugaggauaguaaaauaa

SEQ ID NO: 3294933 - RNA, 18 nt, Variola virus
gauuugagaacauccucc

SEQ ID NO: 3294934 - RNA, 13 nt, Variola virus
auguauaaaccuu

SEQ ID NO: 3294935 - RNA, 14 nt, Variola virus
ugauaugcauacua

SEQ ID NO: 3294936 - RNA, 18 nt, Variola virus
agaucggcaaucuuucuc

SEQ ID NO: 3294937 - RNA, 16 nt, Variola virus
ggauaaccuagaaaau

SEQ ID NO: 3294938 - RNA, 18 nt, Variola virus
auaauaucucuaauagau

SEQ ID NO: 3294939 - RNA, 18 nt, Variola virus
uacaaaauaauagauaua

SEQ ID NO: 3294940 - RNA, 19 nt, Variola virus
uaaagcauauuccauuaau

SEQ ID NO: 3294941 - RNA, 23 nt, Variola virus
auguucuuaauagucuaggaaug

SEQ ID NO: 3294942 - RNA, 21 nt, Variola virus
uguuaaaacuacgauuaucua

SEQ ID NO: 3294943 - RNA, 15 nt, Variola virus
gauuaauuagauaua

SEQ ID NO: 3294944 - RNA, 20 nt, Variola virus
aagcaagaaagauacaggua

SEQ ID NO: 3294945 - RNA, 22 nt, Variola virus
uauaacauuaauaucaaacaau

SEQ ID NO: 3294946 - RNA, 15 nt, Variola virus
auuaucuauaugaug

SEQ ID NO: 3294947 - RNA, 21 nt, Variola virus
aaaaguuccagaaaauguaga

SEQ ID NO: 3294948 - RNA, 23 nt, Variola virus
auuagauauuuuaugggaaaacg

SEQ ID NO: 3294949 - RNA, 16 nt, Variola virus
aauaggaauggauaau

SEQ ID NO: 3294950 - RNA, 20 nt, Variola virus
augaugcuauuagaauuuac

SEQ ID NO: 3294951 - RNA, 13 nt, Variola virus
aagacauaugcac

SEQ ID NO: 3294952 - RNA, 21 nt, Variola virus
gucucauauaacaacaaauaa

SEQ ID NO: 3294953 - RNA, 20 nt, Variola virus
auaggucuucgucuacagua

SEQ ID NO: 3294954 - RNA, 22 nt, Variola virus
agauuggguguagaucuagaug

SEQ ID NO: 3294955 - RNA, 14 nt, Variola virus
auacauauuguuua

SEQ ID NO: 3294956 - RNA, 21 nt, Variola virus
aucuauaauguuauuaaccuc

SEQ ID NO: 3294957 - RNA, 15 nt, Variola virus
auuaauuuuauuaac

SEQ ID NO: 3294958 - RNA, 17 nt, Variola virus
cuggucuaaaauuucca

SEQ ID NO: 3294959 - RNA, 16 nt, Variola virus
uugccauucuuuguaa

SEQ ID NO: 3294960 - RNA, 19 nt, Variola virus
uggaaacaauucauaauua

SEQ ID NO: 3294961 - RNA, 19 nt, Variola virus
uugucuccuccuccguaaa

SEQ ID NO: 3294962 - RNA, 24 nt, Variola virus
uaaauagaauucucuucauaucau

SEQ ID NO: 3294963 - RNA, 22 nt, Variola virus
cuauaguacacggaauaaugau

SEQ ID NO: 3294964 - RNA, 14 nt, Variola virus
auccuaacaaugag

SEQ ID NO: 3294965 - RNA, 23 nt, Variola virus
aauuuauagaugauggaagacaa

SEQ ID NO: 3294966 - RNA, 18 nt, Variola virus
auguuuuuagaaaaucua

SEQ ID NO: 3294967 - RNA, 18 nt, Variola virus
auucuuuuucauuaacua

SEQ ID NO: 3294968 - RNA, 14 nt, Variola virus
aauaugauagaaau

SEQ ID NO: 3294969 - RNA, 19 nt, Variola virus
cuauuuguguauucuucua

SEQ ID NO: 3294970 - RNA, 21 nt, Variola virus
ucaguucaauaacuacacauc

SEQ ID NO: 3294971 - RNA, 14 nt, Variola virus
auacuuaaaaugua

SEQ ID NO: 3294972 - RNA, 19 nt, Variola virus
aguaacuauugacuuaaua

SEQ ID NO: 3294973 - RNA, 18 nt, Variola virus
uugauaacucguuuuucu

SEQ ID NO: 3294974 - RNA, 18 nt, Variola virus
uuuuacgaacuaguugua

SEQ ID NO: 3294975 - RNA, 15 nt, Variola virus
gcucaguaaauguau

SEQ ID NO: 3294976 - RNA, 21 nt, Variola virus
gcuaucguagaugugauuuuu

SEQ ID NO: 3294977 - RNA, 14 nt, Variola virus
aggaacauacgaca

SEQ ID NO: 3294978 - RNA, 15 nt, Variola virus
guucaucagauguuc

SEQ ID NO: 3294979 - RNA, 20 nt, Variola virus
ucgcuaauguauagauuguu

SEQ ID NO: 3294980 - RNA, 15 nt, Variola virus
ugucucgaaaucauu

SEQ ID NO: 3294981 - RNA, 23 nt, Variola virus
uaucuccacucucgauaaaucua

SEQ ID NO: 3294982 - RNA, 14 nt, Variola virus
aaauauguaauaau

SEQ ID NO: 3294983 - RNA, 14 nt, Variola virus
aacuaucuguaaaa

SEQ ID NO: 3294984 - RNA, 20 nt, Variola virus
ccggacgacauauuaaucuu

SEQ ID NO: 3294985 - RNA, 12 nt, Variola virus
uugaucuucaaa

SEQ ID NO: 3294986 - RNA, 18 nt, Variola virus
augauccuauucuaaaug

SEQ ID NO: 3294987 - RNA, 17 nt, Variola virus
gucuuaccuuacuaucu

SEQ ID NO: 3294988 - RNA, 18 nt, Variola virus
aaauagguuuuguucuau

SEQ ID NO: 3294989 - RNA, 16 nt, Variola virus
acaaaagguauuacaa

SEQ ID NO: 3294990 - RNA, 22 nt, Variola virus
aauaucuuguucugguuuaaaa

SEQ ID NO: 3294991 - RNA, 19 nt, Variola virus
acauuguccaauccaggac

SEQ ID NO: 3294992 - RNA, 17 nt, Variola virus
gacagcuauguuaucau

SEQ ID NO: 3294993 - RNA, 14 nt, Variola virus
ucuaagauguugua

SEQ ID NO: 3294994 - RNA, 23 nt, Variola virus
cauggauaucuuuaaagaacuaa

SEQ ID NO: 3294995 - RNA, 21 nt, Variola virus
aucaaauuugguguuguuaaa

SEQ ID NO: 3294996 - RNA, 23 nt, Variola virus
acuguuuucuagauggaaauauu

SEQ ID NO: 3294997 - RNA, 17 nt, Variola virus
aaugauaucuuagaaua

SEQ ID NO: 3294998 - RNA, 10 nt, Variola virus
ggauuucaua

SEQ ID NO: 3294999 - RNA, 19 nt, Variola virus
acacugauauuaugaugaa

SEQ ID NO: 3295000 - RNA, 17 nt, Variola virus
uaaaaaguuuuaacaug

SEQ ID NO: 3295001 - RNA, 18 nt, Variola virus
uucaucguaucuagauaa

SEQ ID NO: 3295002 - RNA, 23 nt, Variola virus
guaaacauugacggauaaaacaa

SEQ ID NO: 3295003 - RNA, 14 nt, Variola virus
auuagacauaugau

SEQ ID NO: 3295004 - RNA, 20 nt, Variola virus
uugaaauuguuuuuuauuuu

SEQ ID NO: 3295005 - RNA, 19 nt, Variola virus
cuggcuauuucaaaauaaa

SEQ ID NO: 3295006 - RNA, 15 nt, Variola virus
gaucuaauuuuucau

SEQ ID NO: 3295007 - RNA, 17 nt, Variola virus
uaauauuacuguuaaua

SEQ ID NO: 3295008 - RNA, 18 nt, Variola virus
ugugacaguuuucucauc

SEQ ID NO: 3295009 - RNA, 16 nt, Variola virus
agauauuuuaugggaa

SEQ ID NO: 3295010 - RNA, 22 nt, Variola virus
agucuauugccuuagauacuuu

SEQ ID NO: 3295011 - RNA, 16 nt, Variola virus
gaauaguaaaauuaga

SEQ ID NO: 3295012 - RNA, 21 nt, Variola virus
ccauccaagucaauaucuuua

SEQ ID NO: 3295013 - RNA, 20 nt, Variola virus
auauuguaccaaauuaauga

SEQ ID NO: 3295014 - RNA, 17 nt, Variola virus
aggcaaaagaugucaag

SEQ ID NO: 3295015 - RNA, 22 nt, Variola virus
aagaguuucaaaaauauucauu

SEQ ID NO: 3295016 - RNA, 12 nt, Variola virus
cauccaacaauc

SEQ ID NO: 3295017 - RNA, 17 nt, Variola virus
ccacggauauacaaaac

SEQ ID NO: 3295018 - RNA, 23 nt, Variola virus
uagugccaucagaauaggaugaa

SEQ ID NO: 3295019 - RNA, 23 nt, Variola virus
auuuccaucucuaucuaauacag

SEQ ID NO: 3295020 - RNA, 23 nt, Variola virus
auguuggauuaaucuuuaccaua

SEQ ID NO: 3295021 - RNA, 16 nt, Variola virus
auauuuguuaaugccu

SEQ ID NO: 3295022 - RNA, 22 nt, Variola virus
gaaaaugaaaaaguacuagaua

SEQ ID NO: 3295023 - RNA, 19 nt, Variola virus
augacuuauaaaaauacua

SEQ ID NO: 3295024 - RNA, 15 nt, Variola virus
aucaucuauaugacu

SEQ ID NO: 3295025 - RNA, 15 nt, Variola virus
aucaucuacaucacu

SEQ ID NO: 3295026 - RNA, 14 nt, Variola virus
uaauuaaauuauug

SEQ ID NO: 3295027 - RNA, 17 nt, Variola virus
uaguaccuagaacaaug

SEQ ID NO: 3295028 - RNA, 16 nt, Variola virus
auauuuauaaaguauu

SEQ ID NO: 3295029 - RNA, 21 nt, Variola virus
ccgguucuuaauauuguauug

SEQ ID NO: 3295030 - RNA, 17 nt, Variola virus
auaaauaguaaauacaa

SEQ ID NO: 3295031 - RNA, 19 nt, Variola virus
caauacguguugauaauau

SEQ ID NO: 3295032 - RNA, 14 nt, Variola virus
ugagugauaaacuu

SEQ ID NO: 3295033 - RNA, 23 nt, Variola virus
auaauggugacaggguuagcauu

SEQ ID NO: 3295034 - RNA, 17 nt, Variola virus
aauagugcgaaaucauu

SEQ ID NO: 3295035 - RNA, 16 nt, Variola virus
acuauggcaauaauug

SEQ ID NO: 3295036 - RNA, 14 nt, Variola virus
auaucuagacacaa

SEQ ID NO: 3295037 - RNA, 18 nt, Variola virus
auuuucuauuuuuaauuu

SEQ ID NO: 3295038 - RNA, 14 nt, Variola virus
aauauuuuauuuca

SEQ ID NO: 3295039 - RNA, 12 nt, Variola virus
ccaauacauguu

SEQ ID NO: 3295040 - RNA, 21 nt, Variola virus
gaguuaagccaauagaaauau

SEQ ID NO: 3295041 - RNA, 17 nt, Variola virus
auauuuacacacauaau

SEQ ID NO: 3295042 - RNA, 16 nt, Variola virus
uaucaagauccaugau

SEQ ID NO: 3295043 - RNA, 15 nt, Variola virus
acauaauacucaaua

SEQ ID NO: 3295044 - RNA, 15 nt, Variola virus
gugacgucuguggau

SEQ ID NO: 3295045 - RNA, 16 nt, Variola virus
uaucggacuacuuauu

SEQ ID NO: 3295046 - RNA, 11 nt, Variola virus
gauaacuguau

SEQ ID NO: 3295047 - RNA, 13 nt, Variola virus
aauuuuaagaaau

SEQ ID NO: 3295048 - RNA, 18 nt, Variola virus
gcuuuuuugacauauuaa

SEQ ID NO: 3295049 - RNA, 17 nt, Variola virus
cuuggauaaccuucaua

SEQ ID NO: 3295050 - RNA, 17 nt, Variola virus
gcuaaaaucuucaucaa

SEQ ID NO: 3295051 - RNA, 21 nt, Variola virus
gaaaaucagaucugauaauau

SEQ ID NO: 3295052 - RNA, 15 nt, Variola virus
gugaauuuagaaaau

SEQ ID NO: 3295053 - RNA, 15 nt, Variola virus
aaucacuauagaaaa

SEQ ID NO: 3295054 - RNA, 17 nt, Variola virus
auaguaaauacaauaau

SEQ ID NO: 3295055 - RNA, 23 nt, Variola virus
uuagacauaaaaacuaauauuag

SEQ ID NO: 3295056 - RNA, 19 nt, Variola virus
uauaccuuguaauuaaauu

SEQ ID NO: 3295057 - RNA, 18 nt, Variola virus
uucaucggcauauuauua

SEQ ID NO: 3295058 - RNA, 22 nt, Variola virus
aucuaucuuuagcuucugaaau

SEQ ID NO: 3295059 - RNA, 19 nt, Variola virus
ucauguuaacacucuacgu

SEQ ID NO: 3295060 - RNA, 12 nt, Variola virus
aaauaucucauc

SEQ ID NO: 3295061 - RNA, 22 nt, Variola virus
aucuguggaaaauaauacucug

SEQ ID NO: 3295062 - RNA, 22 nt, Variola virus
auaauaauuuaggacuuuguaa

SEQ ID NO: 3295063 - RNA, 22 nt, Variola virus
agccaguagauccaguuauuaa

SEQ ID NO: 3295064 - RNA, 16 nt, Variola virus
cuaaguccuauucucg

SEQ ID NO: 3295065 - RNA, 12 nt, Variola virus
cgauguuagaac

SEQ ID NO: 3295066 - RNA, 15 nt, Variola virus
auccauauuucuuaa

SEQ ID NO: 3295067 - RNA, 16 nt, Variola virus
aacaguauguaaaagu

SEQ ID NO: 3295068 - RNA, 15 nt, Variola virus
ucuuauauacacagu

SEQ ID NO: 3295069 - RNA, 14 nt, Variola virus
auauguaucauaau

SEQ ID NO: 3295070 - RNA, 21 nt, Variola virus
aacgaguacuuuaaagaagua

SEQ ID NO: 3295071 - RNA, 15 nt, Variola virus
gagcaaguagaaaac

SEQ ID NO: 3295072 - RNA, 18 nt, Variola virus
aaguucuggcaauguuuc

SEQ ID NO: 3295073 - RNA, 15 nt, Variola virus
acauguauuaccguu

SEQ ID NO: 3295074 - RNA, 22 nt, Variola virus
uuaguaaaaaauuuauuucuaa

SEQ ID NO: 3295075 - RNA, 16 nt, Variola virus
auuuggauuaauuaga

SEQ ID NO: 3295076 - RNA, 21 nt, Variola virus
aauaucuauguuuaacuuuug

SEQ ID NO: 3295077 - RNA, 15 nt, Variola virus
aaucauuaaaugauu

SEQ ID NO: 3295078 - RNA, 14 nt, Variola virus
gcuuguauguguua

SEQ ID NO: 3295079 - RNA, 13 nt, Variola virus
uaaauauaaacac

SEQ ID NO: 3295080 - RNA, 17 nt, Variola virus
aucgacuauuuuaaaua

SEQ ID NO: 3295081 - RNA, 20 nt, Variola virus
uagugcuauggaacaaaaua

SEQ ID NO: 3295082 - RNA, 14 nt, Variola virus
aaauugguucuuua

SEQ ID NO: 3295083 - RNA, 22 nt, Variola virus
uguaauauuguacgauguaaua

SEQ ID NO: 3295084 - RNA, 18 nt, Variola virus
auuauuagauuuaauagc

SEQ ID NO: 3295085 - RNA, 16 nt, Variola virus
ucaucggaucuguaaa

SEQ ID NO: 3295086 - RNA, 16 nt, Variola virus
cuaauuguuuaaauaa

SEQ ID NO: 3295087 - RNA, 14 nt, Variola virus
acuagaguauauaa

SEQ ID NO: 3295088 - RNA, 23 nt, Variola virus
aagucuuuagucacacaauacua

SEQ ID NO: 3295089 - RNA, 17 nt, Variola virus
aaugacggguuuucuau

SEQ ID NO: 3295090 - RNA, 14 nt, Variola virus
aguuccuuuucuag

SEQ ID NO: 3295091 - RNA, 19 nt, Variola virus
uuccauagaauauauuaau

SEQ ID NO: 3295092 - RNA, 14 nt, Variola virus
aacauaaaaacugu

SEQ ID NO: 3295093 - RNA, 16 nt, Variola virus
agauguuauuaaaugu

SEQ ID NO: 3295094 - RNA, 20 nt, Variola virus
aaugcuaguuuuagaauaac

SEQ ID NO: 3295095 - RNA, 14 nt, Variola virus
auuaucaaaaagaa

SEQ ID NO: 3295096 - RNA, 15 nt, Variola virus
auuagaugagaaauu

SEQ ID NO: 3295097 - RNA, 13 nt, Variola virus
aacucuaaucaaa

SEQ ID NO: 3295098 - RNA, 18 nt, Variola virus
guuggcuaugaucuugua

SEQ ID NO: 3295099 - RNA, 22 nt, Variola virus
gauuaauuguuauuuuauucau

SEQ ID NO: 3295100 - RNA, 23 nt, Variola virus
auauucuauaacuugagacuuga

SEQ ID NO: 3295101 - RNA, 17 nt, Variola virus
uuaacuccucuauuaau

SEQ ID NO: 3295102 - RNA, 21 nt, Variola virus
agauaccucagcguguuaaaa

SEQ ID NO: 3295103 - RNA, 11 nt, Variola virus
ugaauaugaca

SEQ ID NO: 3295104 - RNA, 19 nt, Variola virus
ugucaaugguauguaucua

SEQ ID NO: 3295105 - RNA, 14 nt, Variola virus
cucagaauaucuca

SEQ ID NO: 3295106 - RNA, 18 nt, Variola virus
gaauaucccuaaguucuu

SEQ ID NO: 3295107 - RNA, 16 nt, Variola virus
aaauugcauuugauua

SEQ ID NO: 3295108 - RNA, 15 nt, Variola virus
uguaaauguaguauu

SEQ ID NO: 3295109 - RNA, 18 nt, Variola virus
aguuuauuaucuuuacca

SEQ ID NO: 3295110 - RNA, 20 nt, Variola virus
uacaguguaugguacuaaau

SEQ ID NO: 3295111 - RNA, 22 nt, Variola virus
uaaucuuuauuucguuuucgau

SEQ ID NO: 3295112 - RNA, 13 nt, Variola virus
gaucguuaaugaa

SEQ ID NO: 3295113 - RNA, 19 nt, Variola virus
aaugaugguguauacagua

SEQ ID NO: 3295114 - RNA, 17 nt, Variola virus
cucaauaaaaaauuaau

SEQ ID NO: 3295115 - RNA, 16 nt, Variola virus
aaauuauugcaaacga

SEQ ID NO: 3295116 - RNA, 18 nt, Variola virus
cuacuaccgaugauguaa

SEQ ID NO: 3295117 - RNA, 17 nt, Variola virus
cgaugucuuggaagcaa

SEQ ID NO: 3295118 - RNA, 17 nt, Variola virus
aaauccuucaucacuuc

SEQ ID NO: 3295119 - RNA, 19 nt, Variola virus
auuaauaguuuuauuugaa

SEQ ID NO: 3295120 - RNA, 14 nt, Variola virus
auaaucagauuuac

SEQ ID NO: 3295121 - RNA, 17 nt, Variola virus
auuuuggcguuaucauu

SEQ ID NO: 3295122 - RNA, 16 nt, Variola virus
gcgaugucuuggaagc

SEQ ID NO: 3295123 - RNA, 20 nt, Variola virus
aaauuuuuuuuacaaacauu

SEQ ID NO: 3295124 - RNA, 14 nt, Variola virus
uuuguauaaucuuu

SEQ ID NO: 3295125 - RNA, 19 nt, Variola virus
cagcacggugguagauaua

SEQ ID NO: 3295126 - RNA, 15 nt, Variola virus
agaaaauaacagaua

SEQ ID NO: 3295127 - RNA, 12 nt, Variola virus
aacaauauuaag

SEQ ID NO: 3295128 - RNA, 14 nt, Variola virus
aucuaaaaacaaua

SEQ ID NO: 3295129 - RNA, 17 nt, Variola virus
aaugagagcaaaauaua

SEQ ID NO: 3295130 - RNA, 18 nt, Variola virus
ucgacauucagaaagacg

SEQ ID NO: 3295131 - RNA, 14 nt, Variola virus
uaaagguaaaugua

SEQ ID NO: 3295132 - RNA, 14 nt, Variola virus
gucaucauuaacaa

SEQ ID NO: 3295133 - RNA, 16 nt, Variola virus
aaugaaucccaaacau

SEQ ID NO: 3295134 - RNA, 15 nt, Variola virus
aagcccaaaaccaaa

SEQ ID NO: 3295135 - RNA, 18 nt, Variola virus
ucaauagcaaucaugaaa

SEQ ID NO: 3295136 - RNA, 18 nt, Variola virus
aaauguauauuuuccauu

SEQ ID NO: 3295137 - RNA, 20 nt, Variola virus
aaucaauagaauaaaccauu

SEQ ID NO: 3295138 - RNA, 19 nt, Variola virus
aaaaugcauguacagaauc

SEQ ID NO: 3295139 - RNA, 16 nt, Variola virus
aaucucucucaaauau

SEQ ID NO: 3295140 - RNA, 18 nt, Variola virus
acaucgaauauaaaauaa

SEQ ID NO: 3295141 - RNA, 20 nt, Variola virus
uuauagaacagugucaucua

SEQ ID NO: 3295142 - RNA, 21 nt, Variola virus
aguuauacgucauuucaucug

SEQ ID NO: 3295143 - RNA, 15 nt, Variola virus
uauuccaauguuuaa

SEQ ID NO: 3295144 - RNA, 23 nt, Variola virus
gaccguaccagugacagauauac

SEQ ID NO: 3295145 - RNA, 20 nt, Variola virus
gauauagaaaucggaaauuu

SEQ ID NO: 3295146 - RNA, 23 nt, Variola virus
aauuuguauguuugggagaauua

SEQ ID NO: 3295147 - RNA, 14 nt, Variola virus
ucaauaacuacaca

SEQ ID NO: 3295148 - RNA, 13 nt, Variola virus
gucucuaucuuua

SEQ ID NO: 3295149 - RNA, 18 nt, Variola virus
agagauuucaacagacug

SEQ ID NO: 3295150 - RNA, 15 nt, Variola virus
gaauauaauaaucua

SEQ ID NO: 3295151 - RNA, 14 nt, Variola virus
auucagcugaaaug

SEQ ID NO: 3295152 - RNA, 22 nt, Variola virus
aacagggaauuacuuuaauagu

SEQ ID NO: 3295153 - RNA, 13 nt, Variola virus
cuauauuaauagg

SEQ ID NO: 3295154 - RNA, 11 nt, Variola virus
cucuauuuugg

SEQ ID NO: 3295155 - RNA, 11 nt, Variola virus
aagguauauaa

SEQ ID NO: 3295156 - RNA, 14 nt, Variola virus
cgcccuuguauguu

SEQ ID NO: 3295157 - RNA, 20 nt, Variola virus
auacuaucuggaucuucaca

SEQ ID NO: 3295158 - RNA, 17 nt, Variola virus
aaacucaauuauacucu

SEQ ID NO: 3295159 - RNA, 22 nt, Variola virus
ugacaugauuaagauugcucuu

SEQ ID NO: 3295160 - RNA, 20 nt, Variola virus
gaacauacuuuccuguagua

SEQ ID NO: 3295161 - RNA, 21 nt, Variola virus
ccaucuuuaggcauaaacgau

SEQ ID NO: 3295162 - RNA, 23 nt, Variola virus
aauagauagugcuaaacgacuua

SEQ ID NO: 3295163 - RNA, 15 nt, Variola virus
agauuuuaaaaaacu

SEQ ID NO: 3295164 - RNA, 18 nt, Variola virus
uacuaauacuaauacuac

SEQ ID NO: 3295165 - RNA, 21 nt, Variola virus
cauagaugagguacuauuuua

SEQ ID NO: 3295166 - RNA, 20 nt, Variola virus
cauuucugcauuacaaagaa

SEQ ID NO: 3295167 - RNA, 14 nt, Variola virus
acuuauuaaugaau

SEQ ID NO: 3295168 - RNA, 19 nt, Variola virus
gaaauagcucguuucuauu

SEQ ID NO: 3295169 - RNA, 17 nt, Variola virus
cagugacgucuguggau

SEQ ID NO: 3295170 - RNA, 14 nt, Variola virus
caaaaaauaauaau

SEQ ID NO: 3295171 - RNA, 17 nt, Variola virus
uauaaacucgcuuaaua

SEQ ID NO: 3295172 - RNA, 16 nt, Variola virus
aggaaucguuuauccg

SEQ ID NO: 3295173 - RNA, 16 nt, Variola virus
ucuaaguuaacacaug

SEQ ID NO: 3295174 - RNA, 21 nt, Variola virus
uucuaaacccaaaauguaugu

SEQ ID NO: 3295175 - RNA, 14 nt, Variola virus
augguaaaagaaau

SEQ ID NO: 3295176 - RNA, 18 nt, Variola virus
aaucuguauaucuuucca

SEQ ID NO: 3295177 - RNA, 16 nt, Variola virus
ugauaauccagucuuu

SEQ ID NO: 3295178 - RNA, 23 nt, Variola virus
agacaaaacuauuccaauguuua

SEQ ID NO: 3295179 - RNA, 23 nt, Variola virus
uuuggagaaaggagaaacuguuu

SEQ ID NO: 3295180 - RNA, 18 nt, Variola virus
ucugcuccuuuuucuauu

SEQ ID NO: 3295181 - RNA, 22 nt, Variola virus
gauacacgaaagaaucaaaaga

SEQ ID NO: 3295182 - RNA, 15 nt, Variola virus
aucaucaucugaaau

SEQ ID NO: 3295183 - RNA, 17 nt, Variola virus
ugauaaucaaacacauc

SEQ ID NO: 3295184 - RNA, 19 nt, Variola virus
auguuuauauguuggcaua

SEQ ID NO: 3295185 - RNA, 18 nt, Variola virus
ugggguaaaguaaguauc

SEQ ID NO: 3295186 - RNA, 16 nt, Variola virus
auauauuaagaaguuc

SEQ ID NO: 3295187 - RNA, 17 nt, Variola virus
gacuuuauaauuucauc

SEQ ID NO: 3295188 - RNA, 14 nt, Variola virus
cuaauauauucuua

SEQ ID NO: 3295189 - RNA, 22 nt, Variola virus
uaaugauguauguuuaaacacu

SEQ ID NO: 3295190 - RNA, 19 nt, Variola virus
agaacaaaccaaauauauu

SEQ ID NO: 3295191 - RNA, 22 nt, Variola virus
cuuuugauuugcuuugaauaau

SEQ ID NO: 3295192 - RNA, 20 nt, Variola virus
auuuaacuagauuauacaau

SEQ ID NO: 3295193 - RNA, 21 nt, Variola virus
gcaucuuggaaacauaaaaua

SEQ ID NO: 3295194 - RNA, 22 nt, Variola virus
auaauuaucgcguucagauugu

SEQ ID NO: 3295195 - RNA, 16 nt, Variola virus
gcaauuucugauucua

SEQ ID NO: 3295196 - RNA, 14 nt, Variola virus
cuuauguaugugca

SEQ ID NO: 3295197 - RNA, 19 nt, Variola virus
ugagcauaaacauaauaaa

SEQ ID NO: 3295198 - RNA, 20 nt, Variola virus
guagugcgggcuuaaagcaa

SEQ ID NO: 3295199 - RNA, 16 nt, Variola virus
guaaaacucauuacuu

SEQ ID NO: 3295200 - RNA, 22 nt, Variola virus
aacuauuuggauagacacauau

SEQ ID NO: 3295201 - RNA, 21 nt, Variola virus
uacguuuaucgauguacacau

SEQ ID NO: 3295202 - RNA, 20 nt, Variola virus
uacucuuggucuaauacuga

SEQ ID NO: 3295203 - RNA, 11 nt, Variola virus
auaucauauau

SEQ ID NO: 3295204 - RNA, 20 nt, Variola virus
uguauauaucaugaugauuu

SEQ ID NO: 3295205 - RNA, 12 nt, Variola virus
auuaucaguaau

SEQ ID NO: 3295206 - RNA, 18 nt, Variola virus
ugggacuauauaauuuug

SEQ ID NO: 3295207 - RNA, 18 nt, Variola virus
augaucuauauguuuuau

SEQ ID NO: 3295208 - RNA, 23 nt, Variola virus
acaucggugagugauaugccuau

SEQ ID NO: 3295209 - RNA, 18 nt, Variola virus
aaguauccauuuagcaaa

SEQ ID NO: 3295210 - RNA, 20 nt, Variola virus
augaaauaucuuaaggagaa

SEQ ID NO: 3295211 - RNA, 14 nt, Variola virus
gaaauaauauuaaa

SEQ ID NO: 3295212 - RNA, 17 nt, Variola virus
aaucauguaaauguuua

SEQ ID NO: 3295213 - RNA, 23 nt, Variola virus
cuaucgaaaauugcuauuucaga

SEQ ID NO: 3295214 - RNA, 14 nt, Variola virus
uauuaccuuaauaa

SEQ ID NO: 3295215 - RNA, 21 nt, Variola virus
cuuuaucucuuaguaaguuua

SEQ ID NO: 3295216 - RNA, 18 nt, Variola virus
aguuuauaauaacaagua

SEQ ID NO: 3295217 - RNA, 18 nt, Variola virus
aguucccgcauuaaauaa

SEQ ID NO: 3295218 - RNA, 15 nt, Variola virus
auauuacguaauaga

SEQ ID NO: 3295219 - RNA, 15 nt, Variola virus
uuuaagaauagacag

SEQ ID NO: 3295220 - RNA, 21 nt, Variola virus
uauuuuugacgaugucaagau

SEQ ID NO: 3295221 - RNA, 14 nt, Variola virus
gauaaaguuaucau

SEQ ID NO: 3295222 - RNA, 16 nt, Variola virus
cuaagcgguaaauaau

SEQ ID NO: 3295223 - RNA, 22 nt, Variola virus
cuccagacuuuauaauuucauc

SEQ ID NO: 3295224 - RNA, 19 nt, Variola virus
aucaaggacaguuaaaacu

SEQ ID NO: 3295225 - RNA, 17 nt, Variola virus
uaguuuauuccaaucau

SEQ ID NO: 3295226 - RNA, 19 nt, Variola virus
cuauugaugacacuaguua

SEQ ID NO: 3295227 - RNA, 13 nt, Variola virus
auucacaaauaua

SEQ ID NO: 3295228 - RNA, 17 nt, Variola virus
gguugcagaauauagac

SEQ ID NO: 3295229 - RNA, 13 nt, Variola virus
aacauguuccauu

SEQ ID NO: 3295230 - RNA, 20 nt, Variola virus
ucguauuucauaaaaguuau

SEQ ID NO: 3295231 - RNA, 17 nt, Variola virus
uuaaaacuguuuaagaa

SEQ ID NO: 3295232 - RNA, 14 nt, Variola virus
uuuaguauaaacag

SEQ ID NO: 3295233 - RNA, 22 nt, Variola virus
agcuguuuaucuauacuauuaa

SEQ ID NO: 3295234 - RNA, 18 nt, Variola virus
aaagaccgaauacauaac

SEQ ID NO: 3295235 - RNA, 18 nt, Variola virus
cauaucauacaugauauu

SEQ ID NO: 3295236 - RNA, 17 nt, Variola virus
uuuuaaauccuguauca

SEQ ID NO: 3295237 - RNA, 14 nt, Variola virus
uauuguuacacaac

SEQ ID NO: 3295238 - RNA, 13 nt, Variola virus
gaauauuauaauu

SEQ ID NO: 3295239 - RNA, 19 nt, Variola virus
augaaauauguagucguga

SEQ ID NO: 3295240 - RNA, 24 nt, Variola virus
uauauaagacacagaaauacugua

SEQ ID NO: 3295241 - RNA, 19 nt, Variola virus
guacagaauuaauuagacg

SEQ ID NO: 3295242 - RNA, 20 nt, Variola virus
uaaaacauucucgacuuauu

SEQ ID NO: 3295243 - RNA, 19 nt, Variola virus
ugaggaaauaaaucauaua

SEQ ID NO: 3295244 - RNA, 12 nt, Variola virus
uacauaauauua

SEQ ID NO: 3295245 - RNA, 12 nt, Variola virus
caaaaugauaua

SEQ ID NO: 3295246 - RNA, 22 nt, Variola virus
guagaauuguuugagauauguu

SEQ ID NO: 3295247 - RNA, 15 nt, Variola virus
uuaacagauguagua

SEQ ID NO: 3295248 - RNA, 12 nt, Variola virus
aacaguguguaa

SEQ ID NO: 3295249 - RNA, 21 nt, Variola virus
guagacgagccuagaaaucaa

SEQ ID NO: 3295250 - RNA, 22 nt, Variola virus
ugagauacuaacacauuucaac

SEQ ID NO: 3295251 - RNA, 23 nt, Variola virus
uuaacgucuaccgaaacaucguu

SEQ ID NO: 3295252 - RNA, 17 nt, Variola virus
auuaaacucuacauaau

SEQ ID NO: 3295253 - RNA, 13 nt, Variola virus
cauaagcaucucc

SEQ ID NO: 3295254 - RNA, 18 nt, Variola virus
uacaauauucauauccuu

SEQ ID NO: 3295255 - RNA, 18 nt, Variola virus
cguaucuauaaucaucug

SEQ ID NO: 3295256 - RNA, 14 nt, Variola virus
auaccauuucuagu

SEQ ID NO: 3295257 - RNA, 16 nt, Variola virus
uccaucuacuuuucca

SEQ ID NO: 3295258 - RNA, 15 nt, Variola virus
uaaguauaacacaaa

SEQ ID NO: 3295259 - RNA, 12 nt, Variola virus
ugaaaauuggag

SEQ ID NO: 3295260 - RNA, 18 nt, Variola virus
acuauaaauggagaaugu

SEQ ID NO: 3295261 - RNA, 20 nt, Variola virus
gaagaucgcguuaaucaugu

SEQ ID NO: 3295262 - RNA, 22 nt, Variola virus
cauuagccacguucacuguaaa

SEQ ID NO: 3295263 - RNA, 21 nt, Variola virus
auuaacgaguucaaauaugaa

SEQ ID NO: 3295264 - RNA, 14 nt, Variola virus
cagaaucuagauuc

SEQ ID NO: 3295265 - RNA, 18 nt, Variola virus
agauaugauaaaacuauu

SEQ ID NO: 3295266 - RNA, 16 nt, Variola virus
aggcaguuaaggauaa

SEQ ID NO: 3295267 - RNA, 17 nt, Variola virus
aguaagugucauuuaac

SEQ ID NO: 3295268 - RNA, 17 nt, Variola virus
acauaacagauaguuua

SEQ ID NO: 3295269 - RNA, 21 nt, Variola virus
uguaaaggauauuauauguug

SEQ ID NO: 3295270 - RNA, 22 nt, Variola virus
auaucugauuuuucuucauuua

SEQ ID NO: 3295271 - RNA, 12 nt, Variola virus
aacgugucaucu

SEQ ID NO: 3295272 - RNA, 14 nt, Variola virus
auccugauauuaau

SEQ ID NO: 3295273 - RNA, 21 nt, Variola virus
aauugucuagauaaaauacug

SEQ ID NO: 3295274 - RNA, 20 nt, Variola virus
guuuuacguuauuaaucauc

SEQ ID NO: 3295275 - RNA, 14 nt, Variola virus
aaauauuaauaaca

SEQ ID NO: 3295276 - RNA, 15 nt, Variola virus
aucagaucaaaauua

SEQ ID NO: 3295277 - RNA, 20 nt, Variola virus
uaaauaucauaaucuaaaau

SEQ ID NO: 3295278 - RNA, 18 nt, Variola virus
auuaauauuacuguuaau

SEQ ID NO: 3295279 - RNA, 12 nt, Variola virus
aacuuucuagaa

SEQ ID NO: 3295280 - RNA, 13 nt, Variola virus
aucguuacaaaag

SEQ ID NO: 3295281 - RNA, 18 nt, Variola virus
cuaucccccguauuuaca

SEQ ID NO: 3295282 - RNA, 17 nt, Variola virus
uuuaaaguaaacuucgu

SEQ ID NO: 3295283 - RNA, 17 nt, Variola virus
agauguuaaaugaauua

SEQ ID NO: 3295284 - RNA, 19 nt, Variola virus
gguaauagauuuuucauau

SEQ ID NO: 3295285 - RNA, 13 nt, Variola virus
agcugaaaugaga

SEQ ID NO: 3295286 - RNA, 22 nt, Variola virus
guuuaacaauaaaauuaaucac

SEQ ID NO: 3295287 - RNA, 14 nt, Variola virus
uauaccauuaaaaa

SEQ ID NO: 3295288 - RNA, 14 nt, Variola virus
uaccacuagcaaaa

SEQ ID NO: 3295289 - RNA, 14 nt, Variola virus
cuacauuuggauuu

SEQ ID NO: 3295290 - RNA, 22 nt, Variola virus
guacaaauucuuggauauauga

SEQ ID NO: 3295291 - RNA, 13 nt, Variola virus
caauuccaaagau

SEQ ID NO: 3295292 - RNA, 23 nt, Variola virus
auuacaaaucuagagguagaacu

SEQ ID NO: 3295293 - RNA, 20 nt, Variola virus
uaaguuuauaaauuccacaa

SEQ ID NO: 3295294 - RNA, 14 nt, Variola virus
uugagaaaacauuu

SEQ ID NO: 3295295 - RNA, 23 nt, Variola virus
aaauaauguaagaaauaauauua

SEQ ID NO: 3295296 - RNA, 21 nt, Variola virus
uuugauaaagauagaugauga

SEQ ID NO: 3295297 - RNA, 18 nt, Variola virus
uguauacaccaacuguau

SEQ ID NO: 3295298 - RNA, 13 nt, Variola virus
uaccauucaauau

SEQ ID NO: 3295299 - RNA, 16 nt, Variola virus
uucuacaacauuauua

SEQ ID NO: 3295300 - RNA, 19 nt, Variola virus
ucauuuauugauaauaacu

SEQ ID NO: 3295301 - RNA, 15 nt, Variola virus
aaauagauagaacua

SEQ ID NO: 3295302 - RNA, 13 nt, Variola virus
aggaauauaacgu

SEQ ID NO: 3295303 - RNA, 16 nt, Variola virus
acgauuauuucuaaau

SEQ ID NO: 3295304 - RNA, 13 nt, Variola virus
auauaauucuuua

SEQ ID NO: 3295305 - RNA, 16 nt, Variola virus
uccauuaaauaaugua

SEQ ID NO: 3295306 - RNA, 19 nt, Variola virus
uauaacguuaugaaacgaa

SEQ ID NO: 3295307 - RNA, 12 nt, Variola virus
gaaaauaaugac

SEQ ID NO: 3295308 - RNA, 15 nt, Variola virus
aacccagauaauaac

SEQ ID NO: 3295309 - RNA, 21 nt, Variola virus
ugaaaauuaugugaaacagac

SEQ ID NO: 3295310 - RNA, 20 nt, Variola virus
auuuucaaaagauaguuuuc

SEQ ID NO: 3295311 - RNA, 16 nt, Variola virus
caaaaagauauaaaau

SEQ ID NO: 3295312 - RNA, 19 nt, Variola virus
uaauauucguauuuugcau

SEQ ID NO: 3295313 - RNA, 13 nt, Variola virus
cacagaaauacug

SEQ ID NO: 3295314 - RNA, 22 nt, Variola virus
ugcucuagauacugcaaaacuu

SEQ ID NO: 3295315 - RNA, 14 nt, Variola virus
uuucauguucgaaa

SEQ ID NO: 3295316 - RNA, 14 nt, Variola virus
caaauauuauacau

SEQ ID NO: 3295317 - RNA, 11 nt, Variola virus
aauuuguacau

SEQ ID NO: 3295318 - RNA, 15 nt, Variola virus
aacucguaaaaagau

SEQ ID NO: 3295319 - RNA, 13 nt, Variola virus
aucuaauauaauu

SEQ ID NO: 3295320 - RNA, 22 nt, Variola virus
uaaugcagggugcauauuauua

SEQ ID NO: 3295321 - RNA, 17 nt, Variola virus
uauuucaggaacaggau

SEQ ID NO: 3295322 - RNA, 13 nt, Variola virus
uauccauacauac

SEQ ID NO: 3295323 - RNA, 17 nt, Variola virus
uuagcaaaguuauuaau

SEQ ID NO: 3295324 - RNA, 16 nt, Variola virus
uuauaauauacauaag

SEQ ID NO: 3295325 - RNA, 20 nt, Variola virus
uauuucugucauuaaaucuu

SEQ ID NO: 3295326 - RNA, 18 nt, Variola virus
gacguguuaauaaaaaca

SEQ ID NO: 3295327 - RNA, 15 nt, Variola virus
ugaggugguugcaga

SEQ ID NO: 3295328 - RNA, 21 nt, Variola virus
auguauaauauaaaaacauua

SEQ ID NO: 3295329 - RNA, 14 nt, Variola virus
ugaauauuaaacac

SEQ ID NO: 3295330 - RNA, 17 nt, Variola virus
aacacacgaugaaaaug

SEQ ID NO: 3295331 - RNA, 18 nt, Variola virus
cuguauuggauguaugca

SEQ ID NO: 3295332 - RNA, 13 nt, Variola virus
cuucuagauaucc

SEQ ID NO: 3295333 - RNA, 19 nt, Variola virus
auugauccuagaacuagau

SEQ ID NO: 3295334 - RNA, 22 nt, Variola virus
uuucaauauauuacgguaucua

SEQ ID NO: 3295335 - RNA, 16 nt, Variola virus
auuacguucuaccaau

SEQ ID NO: 3295336 - RNA, 12 nt, Variola virus
aaucaaauacuu

SEQ ID NO: 3295337 - RNA, 14 nt, Variola virus
uuaauggaaacuau

SEQ ID NO: 3295338 - RNA, 19 nt, Variola virus
agauaguccagaaauggaa

SEQ ID NO: 3295339 - RNA, 13 nt, Variola virus
auccuucagaauc

SEQ ID NO: 3295340 - RNA, 20 nt, Variola virus
acucuuggucuaauacugau

SEQ ID NO: 3295341 - RNA, 13 nt, Variola virus
uacgaauaaaaga

SEQ ID NO: 3295342 - RNA, 21 nt, Variola virus
aaucaaaucucuaucgucaca

SEQ ID NO: 3295343 - RNA, 23 nt, Variola virus
auagguguaaaucuagaaauuac

SEQ ID NO: 3295344 - RNA, 20 nt, Variola virus
cuguaucaaccggauuuaaa

SEQ ID NO: 3295345 - RNA, 15 nt, Variola virus
agaauauaaaaaauu

SEQ ID NO: 3295346 - RNA, 19 nt, Variola virus
aucuuauauacacauaauu

SEQ ID NO: 3295347 - RNA, 17 nt, Variola virus
uauuaacccaagcagca

SEQ ID NO: 3295348 - RNA, 17 nt, Variola virus
ugaaguuaugacauuca

SEQ ID NO: 3295349 - RNA, 24 nt, Variola virus
ucuauauauacacuacaauuuagu

SEQ ID NO: 3295350 - RNA, 19 nt, Variola virus
auucagaacucaacucauc

SEQ ID NO: 3295351 - RNA, 19 nt, Variola virus
uauaugcccuauuaucaua

SEQ ID NO: 3295352 - RNA, 15 nt, Variola virus
uuuauaacgaaguag

SEQ ID NO: 3295353 - RNA, 14 nt, Variola virus
uagaaaaaauuacu

SEQ ID NO: 3295354 - RNA, 18 nt, Variola virus
gcaaaacauuauaauaau

SEQ ID NO: 3295355 - RNA, 14 nt, Variola virus
uucauugucauuaa

SEQ ID NO: 3295356 - RNA, 14 nt, Variola virus
uacuagcauauuug

SEQ ID NO: 3295357 - RNA, 23 nt, Variola virus
auuaauauuacuguuaauaacug

SEQ ID NO: 3295358 - RNA, 19 nt, Variola virus
uacaggaguucaguuuuau

SEQ ID NO: 3295359 - RNA, 23 nt, Variola virus
ucauuuuccagaugauauguaug

SEQ ID NO: 3295360 - RNA, 15 nt, Variola virus
ucuagagauuguacu

SEQ ID NO: 3295361 - RNA, 17 nt, Variola virus
cauuuuuuaaguauuug

SEQ ID NO: 3295362 - RNA, 19 nt, Variola virus
aaaaagcuccauauuacaa

SEQ ID NO: 3295363 - RNA, 18 nt, Variola virus
uuauuaaaggaacuaaag

SEQ ID NO: 3295364 - RNA, 16 nt, Variola virus
uagucaucucauuaac

SEQ ID NO: 3295365 - RNA, 21 nt, Variola virus
ucaaaugccuuccaaaguuua

SEQ ID NO: 3295366 - RNA, 21 nt, Variola virus
uuaccaucuucuuugauuaau

SEQ ID NO: 3295367 - RNA, 14 nt, Variola virus
cucauuauuuccca

SEQ ID NO: 3295368 - RNA, 18 nt, Variola virus
cgagauacccaauagaau

SEQ ID NO: 3295369 - RNA, 18 nt, Variola virus
guuaucaaaauauguaga

SEQ ID NO: 3295370 - RNA, 16 nt, Variola virus
gucauagaugaaauac

SEQ ID NO: 3295371 - RNA, 19 nt, Variola virus
gaauauuuugauaaugaac

SEQ ID NO: 3295372 - RNA, 16 nt, Variola virus
gacaaugaauugcaua

SEQ ID NO: 3295373 - RNA, 23 nt, Variola virus
aauacuugacugacuuaaaacuu

SEQ ID NO: 3295374 - RNA, 19 nt, Variola virus
aucacagucuguuuuggua

SEQ ID NO: 3295375 - RNA, 14 nt, Variola virus
aauaguaaaaucua

SEQ ID NO: 3295376 - RNA, 11 nt, Variola virus
gagguauauau

SEQ ID NO: 3295377 - RNA, 16 nt, Variola virus
auaccacuuaaugaca

SEQ ID NO: 3295378 - RNA, 19 nt, Variola virus
uccauauuuugcaauuucu

SEQ ID NO: 3295379 - RNA, 17 nt, Variola virus
ucugaauuuagauaguu

SEQ ID NO: 3295380 - RNA, 16 nt, Variola virus
acugaucccuaauuuc

SEQ ID NO: 3295381 - RNA, 22 nt, Variola virus
aaacuuucuagaacauacugag

SEQ ID NO: 3295382 - RNA, 15 nt, Variola virus
gauauauuaaacaac

SEQ ID NO: 3295383 - RNA, 24 nt, Variola virus
uacuccaaaaaacaaaauaacuag

SEQ ID NO: 3295384 - RNA, 16 nt, Variola virus
uguuuaaauuuuucua

SEQ ID NO: 3295385 - RNA, 17 nt, Variola virus
ugguuuagauauuccua

SEQ ID NO: 3295386 - RNA, 14 nt, Variola virus
uuaaucaauguaca

SEQ ID NO: 3295387 - RNA, 18 nt, Variola virus
cuaguuuucuaaguucua

SEQ ID NO: 3295388 - RNA, 14 nt, Variola virus
acucuuauuauaga

SEQ ID NO: 3295389 - RNA, 22 nt, Variola virus
auagaccgucuacaagaaacuu

SEQ ID NO: 3295390 - RNA, 12 nt, Variola virus
cagauagaaaau

SEQ ID NO: 3295391 - RNA, 17 nt, Variola virus
guucguaaauaauaacu

SEQ ID NO: 3295392 - RNA, 21 nt, Variola virus
acuagacguuuauucucaaau

SEQ ID NO: 3295393 - RNA, 23 nt, Variola virus
gauauaucaaaauuagacuggag

SEQ ID NO: 3295394 - RNA, 16 nt, Variola virus
agagauaauagaaaau

SEQ ID NO: 3295395 - RNA, 14 nt, Variola virus
uuaauccaaauaug

SEQ ID NO: 3295396 - RNA, 16 nt, Variola virus
uauaauucuccugaaa

SEQ ID NO: 3295397 - RNA, 17 nt, Variola virus
gauauugauaucuuuuu

SEQ ID NO: 3295398 - RNA, 15 nt, Variola virus
aguuuuuacacauag

SEQ ID NO: 3295399 - RNA, 23 nt, Variola virus
uauuaacuacggauaacaaaaua

SEQ ID NO: 3295400 - RNA, 17 nt, Variola virus
auacagaaggaaacuuc

SEQ ID NO: 3295401 - RNA, 15 nt, Variola virus
cuucaauaaaaugaa

SEQ ID NO: 3295402 - RNA, 21 nt, Variola virus
aauauauguaaucauuaucca

SEQ ID NO: 3295403 - RNA, 15 nt, Variola virus
gcauuggaagcaacu

SEQ ID NO: 3295404 - RNA, 20 nt, Variola virus
cacugucuggcaauaaauga

SEQ ID NO: 3295405 - RNA, 17 nt, Variola virus
auaacgagaauaucaca

SEQ ID NO: 3295406 - RNA, 14 nt, Variola virus
guaagcauuuccuu

SEQ ID NO: 3295407 - RNA, 15 nt, Variola virus
aauauuauaauacca

SEQ ID NO: 3295408 - RNA, 17 nt, Variola virus
acuucucaguucaauaa

SEQ ID NO: 3295409 - RNA, 20 nt, Variola virus
guaaagacaccgaauacaaa

SEQ ID NO: 3295410 - RNA, 15 nt, Variola virus
aguauuguuuaauaa

SEQ ID NO: 3295411 - RNA, 17 nt, Variola virus
uaaacucacauuucaaa

SEQ ID NO: 3295412 - RNA, 21 nt, Variola virus
agaguauaaaacauuaaaugu

SEQ ID NO: 3295413 - RNA, 14 nt, Variola virus
gcuugaaaauggac

SEQ ID NO: 3295414 - RNA, 22 nt, Variola virus
uaagcaucuuggaaacauaaaa

SEQ ID NO: 3295415 - RNA, 20 nt, Variola virus
cuuccacuguccaaaaugau

SEQ ID NO: 3295416 - RNA, 17 nt, Variola virus
auaucggaauaaguaga

SEQ ID NO: 3295417 - RNA, 18 nt, Variola virus
uacaugagcugaaugaca

SEQ ID NO: 3295418 - RNA, 17 nt, Variola virus
guagauaguuaccaucu

SEQ ID NO: 3295419 - RNA, 20 nt, Variola virus
auuuugggcaaaucuaaaua

SEQ ID NO: 3295420 - RNA, 18 nt, Variola virus
uguauccggcaauauuua

SEQ ID NO: 3295421 - RNA, 18 nt, Variola virus
auuauucauuuucuauuu

SEQ ID NO: 3295422 - RNA, 12 nt, Variola virus
aaccuucuuauu

SEQ ID NO: 3295423 - RNA, 22 nt, Variola virus
ucuaggcgguggauauuucuga

SEQ ID NO: 3295424 - RNA, 14 nt, Variola virus
uuuagucgagauau

SEQ ID NO: 3295425 - RNA, 17 nt, Variola virus
acauacucuaauaggug

SEQ ID NO: 3295426 - RNA, 20 nt, Variola virus
auccaauguguuuaauauau

SEQ ID NO: 3295427 - RNA, 17 nt, Variola virus
agaaugugauaagaucg

SEQ ID NO: 3295428 - RNA, 13 nt, Variola virus
auccauuucuaga

SEQ ID NO: 3295429 - RNA, 21 nt, Variola virus
auauuuuugauggguaagcca

SEQ ID NO: 3295430 - RNA, 20 nt, Variola virus
uauuaugcgauguaaucaua

SEQ ID NO: 3295431 - RNA, 21 nt, Variola virus
cgugguguuaugaaacaugua

SEQ ID NO: 3295432 - RNA, 20 nt, Variola virus
acauauuuguuugauaauua

SEQ ID NO: 3295433 - RNA, 14 nt, Variola virus
auaauagaaaauga

SEQ ID NO: 3295434 - RNA, 19 nt, Variola virus
guauggaauauaauaaucu

SEQ ID NO: 3295435 - RNA, 23 nt, Variola virus
auguuuacggcugcguuaaacau

SEQ ID NO: 3295436 - RNA, 18 nt, Variola virus
gaugcugguuauuacaca

SEQ ID NO: 3295437 - RNA, 20 nt, Variola virus
aaaaauuagaucaaagaaua

SEQ ID NO: 3295438 - RNA, 23 nt, Variola virus
cguuuauacaucgaauauaaaau

SEQ ID NO: 3295439 - RNA, 21 nt, Variola virus
uuaaucaaaugguaaauacug

SEQ ID NO: 3295440 - RNA, 19 nt, Variola virus
ccuaauacaucucuggaaa

SEQ ID NO: 3295441 - RNA, 15 nt, Variola virus
uggugcauucauagc

SEQ ID NO: 3295442 - RNA, 15 nt, Variola virus
caaauaauauucucu

SEQ ID NO: 3295443 - RNA, 13 nt, Variola virus
ggccaaaaugaua

SEQ ID NO: 3295444 - RNA, 16 nt, Variola virus
uuacuuuguggaugau

SEQ ID NO: 3295445 - RNA, 14 nt, Variola virus
uaauauuguuaauu

SEQ ID NO: 3295446 - RNA, 23 nt, Variola virus
aaugauuacuaacgcaacuauau

SEQ ID NO: 3295447 - RNA, 17 nt, Variola virus
agagguagcaagaagau

SEQ ID NO: 3295448 - RNA, 16 nt, Variola virus
uuacucgguuaccauu

SEQ ID NO: 3295449 - RNA, 16 nt, Variola virus
uuauaguuaacauuuu

SEQ ID NO: 3295450 - RNA, 14 nt, Variola virus
caaauuuuacuaca

SEQ ID NO: 3295451 - RNA, 17 nt, Variola virus
gaugagguaaaaaauaa

SEQ ID NO: 3295452 - RNA, 22 nt, Variola virus
auuuggcaguacucauuaauaa

SEQ ID NO: 3295453 - RNA, 21 nt, Variola virus
uguuuaaugaauuacuaaaau

SEQ ID NO: 3295454 - RNA, 15 nt, Variola virus
aguuuguuuuggaaa

SEQ ID NO: 3295455 - RNA, 16 nt, Variola virus
acuagauuauacaaug

SEQ ID NO: 3295456 - RNA, 18 nt, Variola virus
gcuugauaauuagauaua

SEQ ID NO: 3295457 - RNA, 22 nt, Variola virus
auucucaucuaucaucuccaca

SEQ ID NO: 3295458 - RNA, 23 nt, Variola virus
gaacucccacccaugauaaugaa

SEQ ID NO: 3295459 - RNA, 18 nt, Variola virus
auucgaaauuagaaagua

SEQ ID NO: 3295460 - RNA, 21 nt, Variola virus
acauucuuaaccauauaucca

SEQ ID NO: 3295461 - RNA, 18 nt, Variola virus
uuauuucaaaauuauuua

SEQ ID NO: 3295462 - RNA, 19 nt, Variola virus
auauuaaaauucacacauu

SEQ ID NO: 3295463 - RNA, 21 nt, Variola virus
cacuucuucaacuaccaaaaa

SEQ ID NO: 3295464 - RNA, 21 nt, Variola virus
aacuuggaaacaucucuucua

SEQ ID NO: 3295465 - RNA, 16 nt, Variola virus
caugaaucuaaaagaa

SEQ ID NO: 3295466 - RNA, 12 nt, Variola virus
uauucuucauaa

SEQ ID NO: 3295467 - RNA, 20 nt, Variola virus
guaucgacaucuuuauuauu

SEQ ID NO: 3295468 - RNA, 18 nt, Variola virus
auauaccuauuaauacau

SEQ ID NO: 3295469 - RNA, 14 nt, Variola virus
aauaagaacaaagu

SEQ ID NO: 3295470 - RNA, 17 nt, Variola virus
acuaaucgauuuugcau

SEQ ID NO: 3295471 - RNA, 16 nt, Variola virus
uuagcguacacauuuu

SEQ ID NO: 3295472 - RNA, 13 nt, Variola virus
uuuuugacauauu

SEQ ID NO: 3295473 - RNA, 21 nt, Variola virus
cuacagaaggcgaacgcuaua

SEQ ID NO: 3295474 - RNA, 16 nt, Variola virus
aagaauugcaauuuug

SEQ ID NO: 3295475 - RNA, 15 nt, Variola virus
agagacggaaauagu

SEQ ID NO: 3295476 - RNA, 16 nt, Variola virus
acaagauuccuuuucu

SEQ ID NO: 3295477 - RNA, 19 nt, Variola virus
uuauaaacggguguaaaca

SEQ ID NO: 3295478 - RNA, 20 nt, Variola virus
auugugauuuaguauaguau

SEQ ID NO: 3295479 - RNA, 17 nt, Variola virus
uuaaaucccaauucaga

SEQ ID NO: 3295480 - RNA, 14 nt, Variola virus
acagauauuaucau

SEQ ID NO: 3295481 - RNA, 17 nt, Variola virus
auaacucugauuucuug

SEQ ID NO: 3295482 - RNA, 13 nt, Variola virus
ucgcagaugauga

SEQ ID NO: 3295483 - RNA, 20 nt, Variola virus
cauacauguuauuaucacac

SEQ ID NO: 3295484 - RNA, 22 nt, Variola virus
uuaauacagaguuuaauacuaa

SEQ ID NO: 3295485 - RNA, 20 nt, Variola virus
uaaaucuaacauugauuuua

SEQ ID NO: 3295486 - RNA, 17 nt, Variola virus
aguaccgauucuagaua

SEQ ID NO: 3295487 - RNA, 20 nt, Variola virus
cuuugguaauaaaauuauuc

SEQ ID NO: 3295488 - RNA, 16 nt, Variola virus
aaguaauucagacacu

SEQ ID NO: 3295489 - RNA, 23 nt, Variola virus
uaaguuacugcugcaucauauaa

SEQ ID NO: 3295490 - RNA, 16 nt, Variola virus
guaccauuugauuuuc

SEQ ID NO: 3295491 - RNA, 18 nt, Variola virus
augaauggauaccuguau

SEQ ID NO: 3295492 - RNA, 13 nt, Variola virus
caacgaaucccua

SEQ ID NO: 3295493 - RNA, 15 nt, Variola virus
auucuccuauuacau

SEQ ID NO: 3295494 - RNA, 21 nt, Variola virus
uaugacaucaacuacaaauga

SEQ ID NO: 3295495 - RNA, 22 nt, Variola virus
ccagaaaacgacgaagagcaaa

SEQ ID NO: 3295496 - RNA, 13 nt, Variola virus
cuugaaauucucc

SEQ ID NO: 3295497 - RNA, 20 nt, Variola virus
gguauugucugagaaguuua

SEQ ID NO: 3295498 - RNA, 23 nt, Variola virus
ugucuuggaagcaauuacagauu

SEQ ID NO: 3295499 - RNA, 21 nt, Variola virus
gaacucuugaagaugauuuug

SEQ ID NO: 3295500 - RNA, 23 nt, Variola virus
agagauccacugucacuggaaag

SEQ ID NO: 3295501 - RNA, 13 nt, Variola virus
auagaauaaauua

SEQ ID NO: 3295502 - RNA, 16 nt, Variola virus
uaugaggaaaaugauu

SEQ ID NO: 3295503 - RNA, 13 nt, Variola virus
auuauacuuguau

SEQ ID NO: 3295504 - RNA, 20 nt, Variola virus
ucguuauaacucgagaauau

SEQ ID NO: 3295505 - RNA, 22 nt, Variola virus
auuuuuggaagacagccgucgc

SEQ ID NO: 3295506 - RNA, 19 nt, Variola virus
ucuauaucguccuucuuaa

SEQ ID NO: 3295507 - RNA, 21 nt, Variola virus
ucguauaucaucaucugaaau

SEQ ID NO: 3295508 - RNA, 14 nt, Variola virus
guauucaauuacua

SEQ ID NO: 3295509 - RNA, 20 nt, Variola virus
uucaguaaccaaauacauau

SEQ ID NO: 3295510 - RNA, 14 nt, Variola virus
uaaauaaagaagau

SEQ ID NO: 3295511 - RNA, 16 nt, Variola virus
uuuguauaacgucuuu

SEQ ID NO: 3295512 - RNA, 23 nt, Variola virus
guaaauaguuuuacguuauuaau

SEQ ID NO: 3295513 - RNA, 13 nt, Variola virus
uacccaucuuaau

SEQ ID NO: 3295514 - RNA, 15 nt, Variola virus
aaauuauaugaccaa

SEQ ID NO: 3295515 - RNA, 20 nt, Variola virus
auaaaucauauaaaaaauga

SEQ ID NO: 3295516 - RNA, 17 nt, Variola virus
guacauuauuacauaga

SEQ ID NO: 3295517 - RNA, 17 nt, Variola virus
ucuauuguaguguauaa

SEQ ID NO: 3295518 - RNA, 20 nt, Variola virus
uuuuauauguguuugaucua

SEQ ID NO: 3295519 - RNA, 14 nt, Variola virus
auuauacacauuau

SEQ ID NO: 3295520 - RNA, 21 nt, Variola virus
gacaauauuuaguuuauucau

SEQ ID NO: 3295521 - RNA, 14 nt, Variola virus
guuuccuguauucu

SEQ ID NO: 3295522 - RNA, 19 nt, Variola virus
caauauguaucguauucua

SEQ ID NO: 3295523 - RNA, 14 nt, Variola virus
ucuuguucaauaga

SEQ ID NO: 3295524 - RNA, 21 nt, Variola virus
uaagaguguaguaucauagau

SEQ ID NO: 3295525 - RNA, 23 nt, Variola virus
aaauauauuagacaauacuacaa

SEQ ID NO: 3295526 - RNA, 16 nt, Variola virus
agaacaaauguuguag

SEQ ID NO: 3295527 - RNA, 20 nt, Variola virus
uauucucccaccguuauaua

SEQ ID NO: 3295528 - RNA, 17 nt, Variola virus
uagaauuguauaguucu

SEQ ID NO: 3295529 - RNA, 17 nt, Variola virus
agacuguuuauacaaga

SEQ ID NO: 3295530 - RNA, 15 nt, Variola virus
agaucgauagacacu

SEQ ID NO: 3295531 - RNA, 22 nt, Variola virus
augaauaucaggaaauguauaa

SEQ ID NO: 3295532 - RNA, 14 nt, Variola virus
auuagauccaagga

SEQ ID NO: 3295533 - RNA, 22 nt, Variola virus
caaggcuuuaauaucuaaauau

SEQ ID NO: 3295534 - RNA, 14 nt, Variola virus
auagacuaguguau

SEQ ID NO: 3295535 - RNA, 17 nt, Variola virus
aguauauagauaugccu

SEQ ID NO: 3295536 - RNA, 17 nt, Variola virus
uaguauagaacacaugu

SEQ ID NO: 3295537 - RNA, 20 nt, Variola virus
uuacucauuuuuuauaaaaa

SEQ ID NO: 3295538 - RNA, 14 nt, Variola virus
ucgauggucucaca

SEQ ID NO: 3295539 - RNA, 21 nt, Variola virus
aucaugaauggauuuaucauc

SEQ ID NO: 3295540 - RNA, 15 nt, Variola virus
uuuuaauuguaugua

SEQ ID NO: 3295541 - RNA, 18 nt, Variola virus
auaauccgauauaugaug

SEQ ID NO: 3295542 - RNA, 15 nt, Variola virus
uuucuaaguucuaau

SEQ ID NO: 3295543 - RNA, 15 nt, Variola virus
agagaauuauauauu

SEQ ID NO: 3295544 - RNA, 11 nt, Variola virus
aauacuauuau

SEQ ID NO: 3295545 - RNA, 13 nt, Variola virus
uccagauuacuaa

SEQ ID NO: 3295546 - RNA, 17 nt, Variola virus
guuguuaaaaaauuaag

SEQ ID NO: 3295547 - RNA, 18 nt, Variola virus
aaauggaagguauuucca

SEQ ID NO: 3295548 - RNA, 17 nt, Variola virus
uggaugaggaagugaua

SEQ ID NO: 3295549 - RNA, 16 nt, Variola virus
agucucaguuaacuga

SEQ ID NO: 3295550 - RNA, 14 nt, Variola virus
uauaugauaucuuu

SEQ ID NO: 3295551 - RNA, 21 nt, Variola virus
acugucucauacacuacagua

SEQ ID NO: 3295552 - RNA, 19 nt, Variola virus
auuaccaucguuguugaau

SEQ ID NO: 3295553 - RNA, 16 nt, Variola virus
caggagauagauaucc

SEQ ID NO: 3295554 - RNA, 14 nt, Variola virus
ucagacaaccaucu

SEQ ID NO: 3295555 - RNA, 20 nt, Variola virus
auggaacaauaaaagagaau

SEQ ID NO: 3295556 - RNA, 15 nt, Variola virus
agauuaaaaaugguu

SEQ ID NO: 3295557 - RNA, 21 nt, Variola virus
uguuucuacuccauaauacuc

SEQ ID NO: 3295558 - RNA, 20 nt, Variola virus
agaauuuucauggauguaga

SEQ ID NO: 3295559 - RNA, 17 nt, Variola virus
ugcacuugccaugauuc

SEQ ID NO: 3295560 - RNA, 17 nt, Variola virus
agaacaaugucaaaaua

SEQ ID NO: 3295561 - RNA, 17 nt, Variola virus
aggacagaaaaauguua

SEQ ID NO: 3295562 - RNA, 16 nt, Variola virus
uauacuugucaucauu

SEQ ID NO: 3295563 - RNA, 20 nt, Variola virus
cguuauuugagagaucauuu

SEQ ID NO: 3295564 - RNA, 17 nt, Variola virus
uaaugaucuauggauua

SEQ ID NO: 3295565 - RNA, 12 nt, Variola virus
aaaguauaugua

SEQ ID NO: 3295566 - RNA, 23 nt, Variola virus
guaauugacaucuauauauccuu

SEQ ID NO: 3295567 - RNA, 18 nt, Variola virus
guuaguacuacugaagaa

SEQ ID NO: 3295568 - RNA, 14 nt, Variola virus
gcuuuucucuuuua

SEQ ID NO: 3295569 - RNA, 20 nt, Variola virus
uagucaucucauuaacuauu

SEQ ID NO: 3295570 - RNA, 16 nt, Variola virus
auuugauauaaugaau

SEQ ID NO: 3295571 - RNA, 18 nt, Variola virus
ucuauuauauuuaggaua

SEQ ID NO: 3295572 - RNA, 13 nt, Variola virus
auaauauaaucua

SEQ ID NO: 3295573 - RNA, 13 nt, Variola virus
uucacguuccaga

SEQ ID NO: 3295574 - RNA, 17 nt, Variola virus
uuuaaaaacgaaucaga

SEQ ID NO: 3295575 - RNA, 18 nt, Variola virus
gauacauuauaugaugau

SEQ ID NO: 3295576 - RNA, 15 nt, Variola virus
aaugucccuuuaaga

SEQ ID NO: 3295577 - RNA, 14 nt, Variola virus
auuacaaaaucacc

SEQ ID NO: 3295578 - RNA, 15 nt, Variola virus
auugucacuacuaaa

SEQ ID NO: 3295579 - RNA, 14 nt, Variola virus
auauaaaaaaauga

SEQ ID NO: 3295580 - RNA, 15 nt, Variola virus
aauacacauaaugaa

SEQ ID NO: 3295581 - RNA, 17 nt, Variola virus
ugaauguuugaaaacau

SEQ ID NO: 3295582 - RNA, 17 nt, Variola virus
ugaaccgggaucauuau

SEQ ID NO: 3295583 - RNA, 18 nt, Variola virus
ucugauggcgacauaauu

SEQ ID NO: 3295584 - RNA, 19 nt, Variola virus
ucaacacuacccaauaaau

SEQ ID NO: 3295585 - RNA, 17 nt, Variola virus
gaacuagacaauaaugu

SEQ ID NO: 3295586 - RNA, 15 nt, Variola virus
ucuuucguuaaauau

SEQ ID NO: 3295587 - RNA, 21 nt, Variola virus
cauaauuguuagcuguuuuca

SEQ ID NO: 3295588 - RNA, 18 nt, Variola virus
cacaucgacggacaaucu

SEQ ID NO: 3295589 - RNA, 18 nt, Variola virus
cuagugcucaaacaaaau

SEQ ID NO: 3295590 - RNA, 15 nt, Variola virus
acucugaaaagaaag

SEQ ID NO: 3295591 - RNA, 14 nt, Variola virus
auuaucaaauguug

SEQ ID NO: 3295592 - RNA, 21 nt, Variola virus
ccuuuggugaauccaucucua

SEQ ID NO: 3295593 - RNA, 15 nt, Variola virus
auauuauauaaacau

SEQ ID NO: 3295594 - RNA, 15 nt, Variola virus
augguuuucacauuu

SEQ ID NO: 3295595 - RNA, 15 nt, Variola virus
auaucuuguucuaug

SEQ ID NO: 3295596 - RNA, 20 nt, Variola virus
ccauagaguauuauugucga

SEQ ID NO: 3295597 - RNA, 22 nt, Variola virus
gucauaaaaauguuuaaaucaa

SEQ ID NO: 3295598 - RNA, 15 nt, Variola virus
cuaaggguaaaauag

SEQ ID NO: 3295599 - RNA, 15 nt, Variola virus
gucuccaauauauga

SEQ ID NO: 3295600 - RNA, 22 nt, Variola virus
cucaauuucccaaauaacacca

SEQ ID NO: 3295601 - RNA, 20 nt, Variola virus
uucuuccaacucuguuuuaa

SEQ ID NO: 3295602 - RNA, 13 nt, Variola virus
uaugauucuguaa

SEQ ID NO: 3295603 - RNA, 18 nt, Variola virus
uauaaucauuauuaacuu

SEQ ID NO: 3295604 - RNA, 22 nt, Variola virus
guuuaacaaaguuauucaucgu

SEQ ID NO: 3295605 - RNA, 18 nt, Variola virus
auucuauuuuacaaauaa

SEQ ID NO: 3295606 - RNA, 19 nt, Variola virus
uugaugccggacaauagca

SEQ ID NO: 3295607 - RNA, 13 nt, Variola virus
auuauugaugcaa

SEQ ID NO: 3295608 - RNA, 12 nt, Variola virus
auaucauauucu

SEQ ID NO: 3295609 - RNA, 14 nt, Variola virus
cauaaguguauaua

SEQ ID NO: 3295610 - RNA, 15 nt, Variola virus
caauaacauaacucu

SEQ ID NO: 3295611 - RNA, 13 nt, Variola virus
cuuauuaacauuu

SEQ ID NO: 3295612 - RNA, 13 nt, Variola virus
uucuaaauuauuc

SEQ ID NO: 3295613 - RNA, 18 nt, Variola virus
uauauucagggacacuca

SEQ ID NO: 3295614 - RNA, 12 nt, Variola virus
uuccuaccaaac

SEQ ID NO: 3295615 - RNA, 17 nt, Variola virus
auaaacaaacuaauaaa

SEQ ID NO: 3295616 - RNA, 14 nt, Variola virus
aauaauuuaacaau

SEQ ID NO: 3295617 - RNA, 12 nt, Variola virus
uauaaaauacuu

SEQ ID NO: 3295618 - RNA, 20 nt, Variola virus
gacgcauuauauaguuuuua

SEQ ID NO: 3295619 - RNA, 18 nt, Variola virus
gauccauuuauaguuaua

SEQ ID NO: 3295620 - RNA, 14 nt, Variola virus
aaauuaaaaaagau

SEQ ID NO: 3295621 - RNA, 15 nt, Variola virus
caguaagaacauaau

SEQ ID NO: 3295622 - RNA, 14 nt, Variola virus
auuaaucuuuacca

SEQ ID NO: 3295623 - RNA, 14 nt, Variola virus
guuguauauuucuu

SEQ ID NO: 3295624 - RNA, 21 nt, Variola virus
uuguacgaauccaauuuuuca

SEQ ID NO: 3295625 - RNA, 18 nt, Variola virus
cugucaugauaaaaauuu

SEQ ID NO: 3295626 - RNA, 18 nt, Variola virus
uucaauaggguagugaua

SEQ ID NO: 3295627 - RNA, 21 nt, Variola virus
agaauggaaaggaaacuaucu

SEQ ID NO: 3295628 - RNA, 17 nt, Variola virus
uguuauaagauuacuua

SEQ ID NO: 3295629 - RNA, 14 nt, Variola virus
auccaagauacuua

SEQ ID NO: 3295630 - RNA, 18 nt, Variola virus
cauugagugauaaacuug

SEQ ID NO: 3295631 - RNA, 18 nt, Variola virus
cuccagauuucauaauau

SEQ ID NO: 3295632 - RNA, 20 nt, Variola virus
gauaaagacgguacuuauga

SEQ ID NO: 3295633 - RNA, 17 nt, Variola virus
aguucugcgcaaggcau

SEQ ID NO: 3295634 - RNA, 12 nt, Variola virus
aacuuuugcaua

SEQ ID NO: 3295635 - RNA, 22 nt, Variola virus
cagcuucccucuauacucucau

SEQ ID NO: 3295636 - RNA, 16 nt, Variola virus
cauagcauuaauaauu

SEQ ID NO: 3295637 - RNA, 20 nt, Variola virus
ucuaugaauauaauagaugu

SEQ ID NO: 3295638 - RNA, 20 nt, Variola virus
uccguaacggaaauuacaga

SEQ ID NO: 3295639 - RNA, 15 nt, Variola virus
cgaaauaucuuucca

SEQ ID NO: 3295640 - RNA, 22 nt, Variola virus
guuaccucguucugauaauaga

SEQ ID NO: 3295641 - RNA, 21 nt, Variola virus
uaggaaaggagugcauagaua

SEQ ID NO: 3295642 - RNA, 15 nt, Variola virus
auuaauaauauaauu

SEQ ID NO: 3295643 - RNA, 19 nt, Variola virus
cuaauuuauuucuucucuu

SEQ ID NO: 3295644 - RNA, 15 nt, Variola virus
auuuuaucaagacau

SEQ ID NO: 3295645 - RNA, 23 nt, Variola virus
auuuauuggucguccuaugcaua

SEQ ID NO: 3295646 - RNA, 14 nt, Variola virus
ugaaugaauacaga

SEQ ID NO: 3295647 - RNA, 22 nt, Variola virus
aaaucuugucugcuuaauacac

SEQ ID NO: 3295648 - RNA, 19 nt, Variola virus
gacucauaagaaagagaau

SEQ ID NO: 3295649 - RNA, 13 nt, Variola virus
auggaucuggaaa

SEQ ID NO: 3295650 - RNA, 21 nt, Variola virus
auuaugaaaauuauaaugaau

SEQ ID NO: 3295651 - RNA, 13 nt, Variola virus
uagaacuuaacuu

SEQ ID NO: 3295652 - RNA, 22 nt, Variola virus
uuaugauuaguuacgacugaaa

SEQ ID NO: 3295653 - RNA, 12 nt, Variola virus
acuucagaaauu

SEQ ID NO: 3295654 - RNA, 10 nt, Variola virus
uaucucuuuc

SEQ ID NO: 3295655 - RNA, 21 nt, Variola virus
uugauaaauagaaucagauuu

SEQ ID NO: 3295656 - RNA, 14 nt, Variola virus
aucucgucuaaauu

SEQ ID NO: 3295657 - RNA, 22 nt, Variola virus
uucugacgucguucuacauaaa

SEQ ID NO: 3295658 - RNA, 21 nt, Variola virus
gauauacccgaagauauacac

SEQ ID NO: 3295659 - RNA, 17 nt, Variola virus
cuaauucgacuaucgaa

SEQ ID NO: 3295660 - RNA, 22 nt, Variola virus
cccaaucuuguuauaaacacac

SEQ ID NO: 3295661 - RNA, 17 nt, Variola virus
aaauaaaacuauaguau

SEQ ID NO: 3295662 - RNA, 21 nt, Variola virus
ucgcccucaauuucccaaaua

SEQ ID NO: 3295663 - RNA, 21 nt, Variola virus
uauacuuuguaauauaaugau

SEQ ID NO: 3295664 - RNA, 16 nt, Variola virus
aaagguuauaguguac

SEQ ID NO: 3295665 - RNA, 23 nt, Variola virus
uucaaaagauaguuuucaucaga

SEQ ID NO: 3295666 - RNA, 15 nt, Variola virus
auacuuaaaaaauga

SEQ ID NO: 3295667 - RNA, 14 nt, Variola virus
uaaaacauuugcau

SEQ ID NO: 3295668 - RNA, 16 nt, Variola virus
acaccuaauacucugg

SEQ ID NO: 3295669 - RNA, 23 nt, Variola virus
aacacuuauuaaguucuuuuucc

SEQ ID NO: 3295670 - RNA, 22 nt, Variola virus
auuaagacgaauggcucuuccu

SEQ ID NO: 3295671 - RNA, 23 nt, Variola virus
acuagugucuagcauuuuagagc

SEQ ID NO: 3295672 - RNA, 15 nt, Variola virus
aaauauaguagaauu

SEQ ID NO: 3295673 - RNA, 15 nt, Variola virus
aaugcucugcaauaa

SEQ ID NO: 3295674 - RNA, 18 nt, Variola virus
gaugauauucaaacuaau

SEQ ID NO: 3295675 - RNA, 21 nt, Variola virus
ucuaucccccguauuuacauu

SEQ ID NO: 3295676 - RNA, 21 nt, Variola virus
uucagaaaguaauucauuaau

SEQ ID NO: 3295677 - RNA, 17 nt, Variola virus
aaacauucaaccacucu

SEQ ID NO: 3295678 - RNA, 19 nt, Variola virus
uggaaugacgaauccuguu

SEQ ID NO: 3295679 - RNA, 14 nt, Variola virus
cgcgaguauucucu

SEQ ID NO: 3295680 - RNA, 17 nt, Variola virus
cucucaucuacaaaaac

SEQ ID NO: 3295681 - RNA, 21 nt, Variola virus
auauagagaucgaaaaaagag

SEQ ID NO: 3295682 - RNA, 13 nt, Variola virus
ugauuuugaagau

SEQ ID NO: 3295683 - RNA, 12 nt, Variola virus
cuuuaucacuau

SEQ ID NO: 3295684 - RNA, 14 nt, Variola virus
aacuuuaucaucuu

SEQ ID NO: 3295685 - RNA, 14 nt, Variola virus
acuccguagagaaa

SEQ ID NO: 3295686 - RNA, 16 nt, Variola virus
cuuuaacaucacuaau

SEQ ID NO: 3295687 - RNA, 23 nt, Variola virus
aacuacuccauuuuauuguggaa

SEQ ID NO: 3295688 - RNA, 22 nt, Variola virus
agugugagaaaaaauaucuugu

SEQ ID NO: 3295689 - RNA, 13 nt, Variola virus
uaaaaauaaaagu

SEQ ID NO: 3295690 - RNA, 16 nt, Variola virus
uuggaagcaauuacag

SEQ ID NO: 3295691 - RNA, 16 nt, Variola virus
auagaucuuucauuau

SEQ ID NO: 3295692 - RNA, 13 nt, Variola virus
gcgacuaaaucag

SEQ ID NO: 3295693 - RNA, 15 nt, Variola virus
acauuuuuuaguaga

SEQ ID NO: 3295694 - RNA, 21 nt, Variola virus
guuaucaucguauaaauuaaa

SEQ ID NO: 3295695 - RNA, 19 nt, Variola virus
aauuaacgaugguuaaaau

SEQ ID NO: 3295696 - RNA, 12 nt, Variola virus
gaaaaauaauua

SEQ ID NO: 3295697 - RNA, 14 nt, Variola virus
cauaacaaauguau

SEQ ID NO: 3295698 - RNA, 14 nt, Variola virus
aaagaaccauuaca

SEQ ID NO: 3295699 - RNA, 13 nt, Variola virus
acuaaucaaugaa

SEQ ID NO: 3295700 - RNA, 16 nt, Variola virus
caaccuguauacugua

SEQ ID NO: 3295701 - RNA, 13 nt, Variola virus
caacauuccaaag

SEQ ID NO: 3295702 - RNA, 14 nt, Variola virus
gaaaucuaguucug

SEQ ID NO: 3295703 - RNA, 20 nt, Variola virus
uccgauuuaccguuacuaau

SEQ ID NO: 3295704 - RNA, 14 nt, Variola virus
auaggugaaaagau

SEQ ID NO: 3295705 - RNA, 14 nt, Variola virus
aaaagaaaauuugu

SEQ ID NO: 3295706 - RNA, 19 nt, Variola virus
acacaaaaagaaagaauau

SEQ ID NO: 3295707 - RNA, 23 nt, Variola virus
gugacuauuucguucucugaaaa

SEQ ID NO: 3295708 - RNA, 19 nt, Variola virus
aaauacauauuuuuuguaa

SEQ ID NO: 3295709 - RNA, 14 nt, Variola virus
aauugauucuauga

SEQ ID NO: 3295710 - RNA, 13 nt, Variola virus
uuaaucuuauuca

SEQ ID NO: 3295711 - RNA, 13 nt, Variola virus
uuaaacuuauucu

SEQ ID NO: 3295712 - RNA, 16 nt, Variola virus
aacaccuauaagauua

SEQ ID NO: 3295713 - RNA, 18 nt, Variola virus
aucgauaguaaugcauuc

SEQ ID NO: 3295714 - RNA, 12 nt, Variola virus
agcacaaaauaa

SEQ ID NO: 3295715 - RNA, 23 nt, Variola virus
caaauacuugauuccuaggucua

SEQ ID NO: 3295716 - RNA, 21 nt, Variola virus
uuauugggccaguauacuguu

SEQ ID NO: 3295717 - RNA, 18 nt, Variola virus
uacaacuggucauagaaa

SEQ ID NO: 3295718 - RNA, 19 nt, Variola virus
agguguguuuuuuaccauu

SEQ ID NO: 3295719 - RNA, 17 nt, Variola virus
auuaauaaugucuauau

SEQ ID NO: 3295720 - RNA, 16 nt, Variola virus
uuccuaauuaagaaaa

SEQ ID NO: 3295721 - RNA, 21 nt, Variola virus
ugaugguagucaauugauguu

SEQ ID NO: 3295722 - RNA, 20 nt, Variola virus
gagcugauuauuuauuucuu

SEQ ID NO: 3295723 - RNA, 13 nt, Variola virus
cuaucauuuugag

SEQ ID NO: 3295724 - RNA, 21 nt, Variola virus
uaaguaugucgaaucuaaacu

SEQ ID NO: 3295725 - RNA, 16 nt, Variola virus
gaugguuaaaauuaac

SEQ ID NO: 3295726 - RNA, 21 nt, Variola virus
cuugauucuaguaucuuuugu

SEQ ID NO: 3295727 - RNA, 16 nt, Variola virus
agugucguaugaugaa

SEQ ID NO: 3295728 - RNA, 22 nt, Variola virus
uuauacgaaaaaaaucauuaaa

SEQ ID NO: 3295729 - RNA, 15 nt, Variola virus
agauuucaaagaugu

SEQ ID NO: 3295730 - RNA, 17 nt, Variola virus
uccagaugcgagagaau

SEQ ID NO: 3295731 - RNA, 18 nt, Variola virus
auuggggaagguaacaau

SEQ ID NO: 3295732 - RNA, 17 nt, Variola virus
aguaugcuaaacuuuau

SEQ ID NO: 3295733 - RNA, 21 nt, Variola virus
cuucagaauauucuuuucuaa

SEQ ID NO: 3295734 - RNA, 16 nt, Variola virus
ggacaacauguuacua

SEQ ID NO: 3295735 - RNA, 13 nt, Variola virus
aauguaacaucua

SEQ ID NO: 3295736 - RNA, 16 nt, Variola virus
ccauucuaauacuuua

SEQ ID NO: 3295737 - RNA, 18 nt, Variola virus
acaaacaauuaauuaaua

SEQ ID NO: 3295738 - RNA, 17 nt, Variola virus
caagucaaagaaauacg

SEQ ID NO: 3295739 - RNA, 21 nt, Variola virus
aucuguaguauucuugucauu

SEQ ID NO: 3295740 - RNA, 16 nt, Variola virus
auuuuuagugaaacau

SEQ ID NO: 3295741 - RNA, 17 nt, Variola virus
gcgucauuguaaaggaa

SEQ ID NO: 3295742 - RNA, 12 nt, Variola virus
uucagugaagaa

SEQ ID NO: 3295743 - RNA, 16 nt, Variola virus
uguguccggaguuaga

SEQ ID NO: 3295744 - RNA, 17 nt, Variola virus
auuaacuuuaucacaau

SEQ ID NO: 3295745 - RNA, 16 nt, Variola virus
caaacacuuguaaaau

SEQ ID NO: 3295746 - RNA, 13 nt, Variola virus
ugguugcaagauc

SEQ ID NO: 3295747 - RNA, 13 nt, Variola virus
cuuuguuaaaaac

SEQ ID NO: 3295748 - RNA, 23 nt, Variola virus
aacaaacuauuuaucagaacacu

SEQ ID NO: 3295749 - RNA, 22 nt, Variola virus
gauuuuauuuaguguagauaug

SEQ ID NO: 3295750 - RNA, 21 nt, Variola virus
ucuucacuagugggaaucaau

SEQ ID NO: 3295751 - RNA, 13 nt, Variola virus
guaaagauaucua

SEQ ID NO: 3295752 - RNA, 22 nt, Variola virus
ggaauacuaauuauacacauua

SEQ ID NO: 3295753 - RNA, 14 nt, Variola virus
ugugucuacauaaa

SEQ ID NO: 3295754 - RNA, 20 nt, Variola virus
cauauguuuuaauauuuaca

SEQ ID NO: 3295755 - RNA, 17 nt, Variola virus
auauauucgaauucaaa

SEQ ID NO: 3295756 - RNA, 13 nt, Variola virus
uuagauacauagu

SEQ ID NO: 3295757 - RNA, 22 nt, Variola virus
aucugauaaauauacaauagau

SEQ ID NO: 3295758 - RNA, 22 nt, Variola virus
auauugauacguauauuaauga

SEQ ID NO: 3295759 - RNA, 15 nt, Variola virus
gucuccaucggcuuu

SEQ ID NO: 3295760 - RNA, 14 nt, Variola virus
uuuacgcuauuaaa

SEQ ID NO: 3295761 - RNA, 15 nt, Variola virus
uagacauaauaguca

SEQ ID NO: 3295762 - RNA, 21 nt, Variola virus
aaggaaugggguauggagaca

SEQ ID NO: 3295763 - RNA, 17 nt, Variola virus
ucgaggauaucauccaa

SEQ ID NO: 3295764 - RNA, 11 nt, Variola virus
aaaaaaugauc

SEQ ID NO: 3295765 - RNA, 22 nt, Variola virus
cuuuaaguuuuucguuguuaag

SEQ ID NO: 3295766 - RNA, 21 nt, Variola virus
uagaccggauacuagacaucu

SEQ ID NO: 3295767 - RNA, 15 nt, Variola virus
uaauucucuauagaa

SEQ ID NO: 3295768 - RNA, 17 nt, Variola virus
gauaaucguauacuuca

SEQ ID NO: 3295769 - RNA, 21 nt, Variola virus
uacugcaauaauuuucaaaag

SEQ ID NO: 3295770 - RNA, 16 nt, Variola virus
augacgaauugaaaau

SEQ ID NO: 3295771 - RNA, 15 nt, Variola virus
uacucagaggauuac

SEQ ID NO: 3295772 - RNA, 18 nt, Variola virus
augccucagguucaucga

SEQ ID NO: 3295773 - RNA, 17 nt, Variola virus
aaauuugaaagaacuac

SEQ ID NO: 3295774 - RNA, 16 nt, Variola virus
ccaacuuaaacaaaau

SEQ ID NO: 3295775 - RNA, 20 nt, Variola virus
ucgagaugaacauucaucug

SEQ ID NO: 3295776 - RNA, 19 nt, Variola virus
agaauuaacgaaacaaugu

SEQ ID NO: 3295777 - RNA, 20 nt, Variola virus
aucgaagugacacucuauau

SEQ ID NO: 3295778 - RNA, 19 nt, Variola virus
auuaaugcccaauuuggau

SEQ ID NO: 3295779 - RNA, 16 nt, Variola virus
ucagaaauuacaaaca

SEQ ID NO: 3295780 - RNA, 13 nt, Variola virus
gaagaagaaauaa

SEQ ID NO: 3295781 - RNA, 21 nt, Variola virus
aaguuuauacucacaaaacau

SEQ ID NO: 3295782 - RNA, 13 nt, Variola virus
augauaauaggaa

SEQ ID NO: 3295783 - RNA, 13 nt, Variola virus
auuaaacauaaau

SEQ ID NO: 3295784 - RNA, 22 nt, Variola virus
uuacgacacgcauuugaugcac

SEQ ID NO: 3295785 - RNA, 16 nt, Variola virus
gaacuguucaaaauau

SEQ ID NO: 3295786 - RNA, 22 nt, Variola virus
uaauauuggcagcguuguuuau

SEQ ID NO: 3295787 - RNA, 19 nt, Variola virus
aauccagcuagugaauaua

SEQ ID NO: 3295788 - RNA, 13 nt, Variola virus
uaaaauaaauauu

SEQ ID NO: 3295789 - RNA, 17 nt, Variola virus
acacuauucuuaaaugu

SEQ ID NO: 3295790 - RNA, 19 nt, Variola virus
agcauaaacauaauaaaca

SEQ ID NO: 3295791 - RNA, 21 nt, Variola virus
uauuacaaacauguucaaugc

SEQ ID NO: 3295792 - RNA, 19 nt, Variola virus
caaacaaguuaaugagaua

SEQ ID NO: 3295793 - RNA, 15 nt, Variola virus
ugauuucuugaacau

SEQ ID NO: 3295794 - RNA, 18 nt, Variola virus
aauaacuaaaaauguaaa

SEQ ID NO: 3295795 - RNA, 16 nt, Variola virus
ugauauauucuuuaaa

SEQ ID NO: 3295796 - RNA, 18 nt, Variola virus
caaagagaccaaugaauu

SEQ ID NO: 3295797 - RNA, 15 nt, Variola virus
gaacacguuaaacaa

SEQ ID NO: 3295798 - RNA, 14 nt, Variola virus
auccaaucauauau

SEQ ID NO: 3295799 - RNA, 16 nt, Variola virus
ccaguguauaaacgca

SEQ ID NO: 3295800 - RNA, 13 nt, Variola virus
aauauuuaauccu

SEQ ID NO: 3295801 - RNA, 22 nt, Variola virus
aacgagccaguaaucuuaccau

SEQ ID NO: 3295802 - RNA, 23 nt, Variola virus
uguaaacagauaugguguagcau

SEQ ID NO: 3295803 - RNA, 15 nt, Variola virus
uaaugaauuaguguu

SEQ ID NO: 3295804 - RNA, 22 nt, Variola virus
uacuugcacguaaagucuacau

SEQ ID NO: 3295805 - RNA, 17 nt, Variola virus
acuaucaaccacauaau

SEQ ID NO: 3295806 - RNA, 12 nt, Variola virus
uauauucaauau

SEQ ID NO: 3295807 - RNA, 14 nt, Variola virus
uaauucuacaucca

SEQ ID NO: 3295808 - RNA, 22 nt, Variola virus
ucagucuccacacuauucuuaa

SEQ ID NO: 3295809 - RNA, 16 nt, Variola virus
uucccuugucauuaaa

SEQ ID NO: 3295810 - RNA, 15 nt, Variola virus
agaauuuuagacacu

SEQ ID NO: 3295811 - RNA, 16 nt, Variola virus
caagauuccuuuucua

SEQ ID NO: 3295812 - RNA, 17 nt, Variola virus
acauccuuccaagaaga

SEQ ID NO: 3295813 - RNA, 19 nt, Variola virus
auucucaaauccgaaauua

SEQ ID NO: 3295814 - RNA, 21 nt, Variola virus
uggaaaaaugaugaauuaaug

SEQ ID NO: 3295815 - RNA, 17 nt, Variola virus
cguauucugaugauauu

SEQ ID NO: 3295816 - RNA, 17 nt, Variola virus
auaaccuagaaaauaua

SEQ ID NO: 3295817 - RNA, 14 nt, Variola virus
auucguagaaagua

SEQ ID NO: 3295818 - RNA, 20 nt, Variola virus
cuacgaaaacgaaaucugua

SEQ ID NO: 3295819 - RNA, 23 nt, Variola virus
ucuguaguuguauccguuucaga

SEQ ID NO: 3295820 - RNA, 16 nt, Variola virus
aaccagaauuguaaaa

SEQ ID NO: 3295821 - RNA, 13 nt, Variola virus
auaaauaaugaau

SEQ ID NO: 3295822 - RNA, 21 nt, Variola virus
aacuauaaguguguuguaaac

SEQ ID NO: 3295823 - RNA, 15 nt, Variola virus
auaauguuacucaau

SEQ ID NO: 3295824 - RNA, 19 nt, Variola virus
gaaaucuaucuuauauaca

SEQ ID NO: 3295825 - RNA, 23 nt, Variola virus
acguuucauuuuuugucuauaau

SEQ ID NO: 3295826 - RNA, 12 nt, Variola virus
aauacuuaaaaa

SEQ ID NO: 3295827 - RNA, 21 nt, Variola virus
uccacugagaugacuggaaau

SEQ ID NO: 3295828 - RNA, 21 nt, Variola virus
aaugagagcauauuucauuuc

SEQ ID NO: 3295829 - RNA, 21 nt, Variola virus
uaauaaauguuucgauuucaa

SEQ ID NO: 3295830 - RNA, 18 nt, Variola virus
aucuugcaaguuaaauag

SEQ ID NO: 3295831 - RNA, 17 nt, Variola virus
aacuauauauuuguaua

SEQ ID NO: 3295832 - RNA, 21 nt, Variola virus
ccuuuaaaaguaaucaugaaa

SEQ ID NO: 3295833 - RNA, 16 nt, Variola virus
acauaccguuagauaa

SEQ ID NO: 3295834 - RNA, 15 nt, Variola virus
ccauggauaaaguua

SEQ ID NO: 3295835 - RNA, 16 nt, Variola virus
uaauuauaagaaauau

SEQ ID NO: 3295836 - RNA, 16 nt, Variola virus
agaugccgguacuuau

SEQ ID NO: 3295837 - RNA, 12 nt, Variola virus
auuaaaaaagau

SEQ ID NO: 3295838 - RNA, 22 nt, Variola virus
uaccacgcaauuauauaaugua

SEQ ID NO: 3295839 - RNA, 22 nt, Variola virus
uguauccgucaaucuaauauua

SEQ ID NO: 3295840 - RNA, 20 nt, Variola virus
uaucguauuggauucugaaa

SEQ ID NO: 3295841 - RNA, 19 nt, Variola virus
cagagcagucuuucuaaag

SEQ ID NO: 3295842 - RNA, 20 nt, Variola virus
cagaaccuguguuuauagug

SEQ ID NO: 3295843 - RNA, 16 nt, Variola virus
aucuaaaauugcauuu

SEQ ID NO: 3295844 - RNA, 20 nt, Variola virus
uguaaauauccauugucuua

SEQ ID NO: 3295845 - RNA, 16 nt, Variola virus
uucuagaguacugauu

SEQ ID NO: 3295846 - RNA, 16 nt, Variola virus
aaaguauacauguuag

SEQ ID NO: 3295847 - RNA, 12 nt, Variola virus
ugucuacauaaa

SEQ ID NO: 3295848 - RNA, 18 nt, Variola virus
aguaugcagacaaaauga

SEQ ID NO: 3295849 - RNA, 21 nt, Variola virus
auuccaacaacaucaacugaa

SEQ ID NO: 3295850 - RNA, 23 nt, Variola virus
gagaucuaaagccgguguaacau

SEQ ID NO: 3295851 - RNA, 15 nt, Variola virus
guuauuauaaacucu

SEQ ID NO: 3295852 - RNA, 20 nt, Variola virus
ucuuuaguaaacauaucaua

SEQ ID NO: 3295853 - RNA, 16 nt, Variola virus
aaccaauuuguauaug

SEQ ID NO: 3295854 - RNA, 18 nt, Variola virus
guuccguaucuguauuua

SEQ ID NO: 3295855 - RNA, 22 nt, Variola virus
uauuacaagacgucauucuaaa

SEQ ID NO: 3295856 - RNA, 21 nt, Variola virus
ucucugauguuuguuuucgau

SEQ ID NO: 3295857 - RNA, 20 nt, Variola virus
uauuaacuuuguucauuuau

SEQ ID NO: 3295858 - RNA, 19 nt, Variola virus
acaaugaaccguaauauau

SEQ ID NO: 3295859 - RNA, 20 nt, Variola virus
auauucucauggaaauauua

SEQ ID NO: 3295860 - RNA, 17 nt, Variola virus
uuaaaugucauauuaau

SEQ ID NO: 3295861 - RNA, 18 nt, Variola virus
auuauucuacuaucaaag

SEQ ID NO: 3295862 - RNA, 18 nt, Variola virus
auaaaguccaacuauugu

SEQ ID NO: 3295863 - RNA, 13 nt, Variola virus
cauuguaaagccc

SEQ ID NO: 3295864 - RNA, 23 nt, Variola virus
auaucaugaugauuugguuguau

SEQ ID NO: 3295865 - RNA, 13 nt, Variola virus
cuuuaucaagcac

SEQ ID NO: 3295866 - RNA, 16 nt, Variola virus
gauuuaucuguuuugg

SEQ ID NO: 3295867 - RNA, 20 nt, Variola virus
cauuccaagucacuaugugu

SEQ ID NO: 3295868 - RNA, 14 nt, Variola virus
gaagcuauauguaa

SEQ ID NO: 3295869 - RNA, 16 nt, Variola virus
uuaccagaauacuauu

SEQ ID NO: 3295870 - RNA, 15 nt, Variola virus
ugaacgauaauaacu

SEQ ID NO: 3295871 - RNA, 13 nt, Variola virus
ugaaauagaagau

SEQ ID NO: 3295872 - RNA, 21 nt, Variola virus
acagacgacagccuguaacug

SEQ ID NO: 3295873 - RNA, 16 nt, Variola virus
uuauaacuuauugucu

SEQ ID NO: 3295874 - RNA, 14 nt, Variola virus
agauguaaauauau

SEQ ID NO: 3295875 - RNA, 13 nt, Variola virus
aauacuggauaaa

SEQ ID NO: 3295876 - RNA, 15 nt, Variola virus
ucagagaacuucugc

SEQ ID NO: 3295877 - RNA, 15 nt, Variola virus
gaaaugguacaauca

SEQ ID NO: 3295878 - RNA, 13 nt, Variola virus
auuccuugauauc

SEQ ID NO: 3295879 - RNA, 11 nt, Variola virus
ucaaauuauua

SEQ ID NO: 3295880 - RNA, 16 nt, Variola virus
cggcugcguuaaacau

SEQ ID NO: 3295881 - RNA, 14 nt, Variola virus
acgcagauagcuau

SEQ ID NO: 3295882 - RNA, 18 nt, Variola virus
aaugcucaguaaauguau

SEQ ID NO: 3295883 - RNA, 16 nt, Variola virus
ugguuuccuuaucauu

SEQ ID NO: 3295884 - RNA, 14 nt, Variola virus
agauuuuaauguau

SEQ ID NO: 3295885 - RNA, 16 nt, Variola virus
uucugucaacaauguc

SEQ ID NO: 3295886 - RNA, 20 nt, Variola virus
ugacuguagaacucaugaau

SEQ ID NO: 3295887 - RNA, 22 nt, Variola virus
gcuugcauuacagaauaauauu

SEQ ID NO: 3295888 - RNA, 17 nt, Variola virus
ucuauuguuuguuuuaa

SEQ ID NO: 3295889 - RNA, 16 nt, Variola virus
uuuuagaaaauucuaa

SEQ ID NO: 3295890 - RNA, 21 nt, Variola virus
agucacgauaucucuuaaaug

SEQ ID NO: 3295891 - RNA, 19 nt, Variola virus
uaugucuguacaaauguua

SEQ ID NO: 3295892 - RNA, 14 nt, Variola virus
ugaggaaauugaua

SEQ ID NO: 3295893 - RNA, 22 nt, Variola virus
auugucuauaucuaaaaucaua

SEQ ID NO: 3295894 - RNA, 16 nt, Variola virus
uaguuuaucauacuua

SEQ ID NO: 3295895 - RNA, 13 nt, Variola virus
acucucgauaaau

SEQ ID NO: 3295896 - RNA, 21 nt, Variola virus
uauggaugccaacguaguauc

SEQ ID NO: 3295897 - RNA, 16 nt, Variola virus
guguguaacacuuuua

SEQ ID NO: 3295898 - RNA, 19 nt, Variola virus
guuuaaauucuuuaauauc

SEQ ID NO: 3295899 - RNA, 21 nt, Variola virus
cuaauguauagauuguuuuca

SEQ ID NO: 3295900 - RNA, 19 nt, Variola virus
auaccauggaaaaauauua

SEQ ID NO: 3295901 - RNA, 14 nt, Variola virus
aaagguaagaguua

SEQ ID NO: 3295902 - RNA, 12 nt, Variola virus
uacaacuaguga

SEQ ID NO: 3295903 - RNA, 20 nt, Variola virus
uuauaugcuugcauuacaga

SEQ ID NO: 3295904 - RNA, 15 nt, Variola virus
ucgauuuuuagauuu

SEQ ID NO: 3295905 - RNA, 13 nt, Variola virus
ccuguaacaaaaa

SEQ ID NO: 3295906 - RNA, 23 nt, Variola virus
acuuuuauuauggcgucuaagau

SEQ ID NO: 3295907 - RNA, 13 nt, Variola virus
agaaacagaacua

SEQ ID NO: 3295908 - RNA, 18 nt, Variola virus
uaugacuguauuuggauc

SEQ ID NO: 3295909 - RNA, 22 nt, Variola virus
cuuuaacgcccuuguauguuuu

SEQ ID NO: 3295910 - RNA, 22 nt, Variola virus
cuggucuaaaauuuccaucucu

SEQ ID NO: 3295911 - RNA, 21 nt, Variola virus
aauauuauuaccaucuuccgc

SEQ ID NO: 3295912 - RNA, 15 nt, Variola virus
auaacaaguaugaca

SEQ ID NO: 3295913 - RNA, 19 nt, Variola virus
cagguaaaaguacagaauu

SEQ ID NO: 3295914 - RNA, 17 nt, Variola virus
uuauacaguguauguaa

SEQ ID NO: 3295915 - RNA, 19 nt, Variola virus
uaccauuaaagaauucuua

SEQ ID NO: 3295916 - RNA, 12 nt, Variola virus
ccacuuaaauau

SEQ ID NO: 3295917 - RNA, 13 nt, Variola virus
ugguuucaaugag

SEQ ID NO: 3295918 - RNA, 15 nt, Variola virus
guucaaaaauuuaga

SEQ ID NO: 3295919 - RNA, 15 nt, Variola virus
auuagugacggaaaa

SEQ ID NO: 3295920 - RNA, 23 nt, Variola virus
cauaaaugagaugagaagauauu

SEQ ID NO: 3295921 - RNA, 13 nt, Variola virus
uugauuuuggaua

SEQ ID NO: 3295922 - RNA, 19 nt, Variola virus
guaauaaaauuucuauucc

SEQ ID NO: 3295923 - RNA, 18 nt, Variola virus
gauaauuuauacguauca

SEQ ID NO: 3295924 - RNA, 23 nt, Variola virus
aauauaucuauaauuugauccau

SEQ ID NO: 3295925 - RNA, 13 nt, Variola virus
auaugccuauaaa

SEQ ID NO: 3295926 - RNA, 19 nt, Variola virus
uuuuugcaggaaguauauc

SEQ ID NO: 3295927 - RNA, 13 nt, Variola virus
ccaaaucugguaa

SEQ ID NO: 3295928 - RNA, 12 nt, Variola virus
cgucaaacauua

SEQ ID NO: 3295929 - RNA, 15 nt, Variola virus
aaacgaaaacuauau

SEQ ID NO: 3295930 - RNA, 13 nt, Variola virus
aaugcauuuuaua

SEQ ID NO: 3295931 - RNA, 18 nt, Variola virus
uaaguucuuugaucucuu

SEQ ID NO: 3295932 - RNA, 15 nt, Variola virus
acacuuuauacuucu

SEQ ID NO: 3295933 - RNA, 22 nt, Variola virus
ucgggaccaauuacuaauaaag

SEQ ID NO: 3295934 - RNA, 16 nt, Variola virus
aauccgguaaauggaa

SEQ ID NO: 3295935 - RNA, 19 nt, Variola virus
aaauuuuuuauuucaguau

SEQ ID NO: 3295936 - RNA, 13 nt, Variola virus
cuauuauuuugaa

SEQ ID NO: 3295937 - RNA, 15 nt, Variola virus
aguuuuauaacgaag

SEQ ID NO: 3295938 - RNA, 19 nt, Variola virus
ucuucauaugauccaaauu

SEQ ID NO: 3295939 - RNA, 15 nt, Variola virus
ucuucuggaaccuca

SEQ ID NO: 3295940 - RNA, 20 nt, Variola virus
ucuaaaacaauaaaugcauu

SEQ ID NO: 3295941 - RNA, 19 nt, Variola virus
cuguaaauagaacauacuu

SEQ ID NO: 3295942 - RNA, 20 nt, Variola virus
guuauugguauuucuuacau

SEQ ID NO: 3295943 - RNA, 17 nt, Variola virus
caagaacuacaaaaguu

SEQ ID NO: 3295944 - RNA, 17 nt, Variola virus
uucuauggcguacaaag

SEQ ID NO: 3295945 - RNA, 14 nt, Variola virus
auacuccaaauaca

SEQ ID NO: 3295946 - RNA, 15 nt, Variola virus
gauaaaauuaaugag

SEQ ID NO: 3295947 - RNA, 13 nt, Variola virus
aaucaaaaaauaa

SEQ ID NO: 3295948 - RNA, 12 nt, Variola virus
cauaaacaaauu

SEQ ID NO: 3295949 - RNA, 13 nt, Variola virus
cucagaaacagaa

SEQ ID NO: 3295950 - RNA, 13 nt, Variola virus
gacaguaauacau

SEQ ID NO: 3295951 - RNA, 14 nt, Variola virus
aucuuuguuaaaua

SEQ ID NO: 3295952 - RNA, 13 nt, Variola virus
ugaauuguuucuu

SEQ ID NO: 3295953 - RNA, 20 nt, Variola virus
uuuaucauagucuaaagaug

SEQ ID NO: 3295954 - RNA, 16 nt, Variola virus
ucugucgaaaaaguag

SEQ ID NO: 3295955 - RNA, 19 nt, Variola virus
guagaucaaacuuaaauaa

SEQ ID NO: 3295956 - RNA, 19 nt, Variola virus
uaccuauuaauacaucgua

SEQ ID NO: 3295957 - RNA, 23 nt, Variola virus
ccggcauuauagauguguauaca

SEQ ID NO: 3295958 - RNA, 15 nt, Variola virus
ugcgauguuaauuua

SEQ ID NO: 3295959 - RNA, 17 nt, Variola virus
uuauacaagauugaaau

SEQ ID NO: 3295960 - RNA, 20 nt, Variola virus
uucuuacauauuuuuuucuu

SEQ ID NO: 3295961 - RNA, 17 nt, Variola virus
ugacuuucgaaccaauu

SEQ ID NO: 3295962 - RNA, 20 nt, Variola virus
auacuuaaaaaaugaaaaua

SEQ ID NO: 3295963 - RNA, 13 nt, Variola virus
aucacaaacauua

SEQ ID NO: 3295964 - RNA, 19 nt, Variola virus
agacauucccacaguguug

SEQ ID NO: 3295965 - RNA, 18 nt, Variola virus
aaauguccguuauauaau

SEQ ID NO: 3295966 - RNA, 18 nt, Variola virus
aucgauuauauucuaaga

SEQ ID NO: 3295967 - RNA, 17 nt, Variola virus
aguuucugguuuucuau

SEQ ID NO: 3295968 - RNA, 12 nt, Variola virus
aguucugugcag

SEQ ID NO: 3295969 - RNA, 14 nt, Variola virus
auuuacaaaaauuu

SEQ ID NO: 3295970 - RNA, 19 nt, Variola virus
ugucaacaaaaaugugaua

SEQ ID NO: 3295971 - RNA, 20 nt, Variola virus
ucauuauuacgucuguaguc

SEQ ID NO: 3295972 - RNA, 18 nt, Variola virus
cguggauaauauuucuag

SEQ ID NO: 3295973 - RNA, 21 nt, Variola virus
uucuuggcaaaagaauaccaa

SEQ ID NO: 3295974 - RNA, 15 nt, Variola virus
cuggaggaguaagaa

SEQ ID NO: 3295975 - RNA, 13 nt, Variola virus
auguaaaauaaua

SEQ ID NO: 3295976 - RNA, 17 nt, Variola virus
cuauaagccuuuguuua

SEQ ID NO: 3295977 - RNA, 12 nt, Variola virus
uaccgaaaauaa

SEQ ID NO: 3295978 - RNA, 20 nt, Variola virus
aauauaucaugcucaguaau

SEQ ID NO: 3295979 - RNA, 19 nt, Variola virus
ugacuagacugauuucucu

SEQ ID NO: 3295980 - RNA, 20 nt, Variola virus
uauuaucaauucuggauuau

SEQ ID NO: 3295981 - RNA, 20 nt, Variola virus
auuuggaauuuauuaauaca

SEQ ID NO: 3295982 - RNA, 16 nt, Variola virus
gucauauucucauaau

SEQ ID NO: 3295983 - RNA, 21 nt, Variola virus
uaguuuucucuauucugaaau

SEQ ID NO: 3295984 - RNA, 19 nt, Variola virus
uuacuuugaccacauccuu

SEQ ID NO: 3295985 - RNA, 19 nt, Variola virus
aguuucugccauuuaucca

SEQ ID NO: 3295986 - RNA, 20 nt, Variola virus
uguuuuugaacuguucaaaa

SEQ ID NO: 3295987 - RNA, 14 nt, Variola virus
uugacaaauuauuc

SEQ ID NO: 3295988 - RNA, 17 nt, Variola virus
uacucuauaaaauacua

SEQ ID NO: 3295989 - RNA, 16 nt, Variola virus
cauuuucuuacaauua

SEQ ID NO: 3295990 - RNA, 16 nt, Variola virus
uaugaagauaaacacu

SEQ ID NO: 3295991 - RNA, 15 nt, Variola virus
cucuauaaaaaugaa

SEQ ID NO: 3295992 - RNA, 21 nt, Variola virus
cuguacaaauguuaaacauua

SEQ ID NO: 3295993 - RNA, 13 nt, Variola virus
aggagaccaugga

SEQ ID NO: 3295994 - RNA, 19 nt, Variola virus
augauauauuaaacaacga

SEQ ID NO: 3295995 - RNA, 19 nt, Variola virus
acucuguuuuauuaaccga

SEQ ID NO: 3295996 - RNA, 18 nt, Variola virus
uauaaauauauaaugggu

SEQ ID NO: 3295997 - RNA, 19 nt, Variola virus
aagacuccuaccgguguau

SEQ ID NO: 3295998 - RNA, 18 nt, Variola virus
aaaaugaugcuauuagaa

SEQ ID NO: 3295999 - RNA, 23 nt, Variola virus
caacagguggaauaucaauuaau

SEQ ID NO: 3296000 - RNA, 14 nt, Variola virus
uauaaaauauucua

SEQ ID NO: 3296001 - RNA, 14 nt, Variola virus
uaacaaucuuauau

SEQ ID NO: 3296002 - RNA, 23 nt, Variola virus
uucuuagcuugugauuuuuucuu

SEQ ID NO: 3296003 - RNA, 19 nt, Variola virus
auucuacucccuuguguaa

SEQ ID NO: 3296004 - RNA, 16 nt, Variola virus
ucuuuggauauucuaa

SEQ ID NO: 3296005 - RNA, 23 nt, Variola virus
auuuuuuuauucaucaucuucug

SEQ ID NO: 3296006 - RNA, 16 nt, Variola virus
auucuugguaauuaau

SEQ ID NO: 3296007 - RNA, 15 nt, Variola virus
aaagcuauuaucaaa

SEQ ID NO: 3296008 - RNA, 17 nt, Variola virus
uacaguaaaaauaacua

SEQ ID NO: 3296009 - RNA, 13 nt, Variola virus
aguaaucaugaaa

SEQ ID NO: 3296010 - RNA, 20 nt, Variola virus
aacuccggauagagaaauau

SEQ ID NO: 3296011 - RNA, 21 nt, Variola virus
gaguacauuucacagaaacac

SEQ ID NO: 3296012 - RNA, 13 nt, Variola virus
acauaauaguuua

SEQ ID NO: 3296013 - RNA, 12 nt, Variola virus
gaauauugauuu

SEQ ID NO: 3296014 - RNA, 20 nt, Variola virus
agcgagaaauaaucauaaau

SEQ ID NO: 3296015 - RNA, 16 nt, Variola virus
uaggauuuuuccaaag

SEQ ID NO: 3296016 - RNA, 19 nt, Variola virus
cagcuauguuaucaugaaa

SEQ ID NO: 3296017 - RNA, 14 nt, Variola virus
gaagacuccuggua

SEQ ID NO: 3296018 - RNA, 17 nt, Variola virus
aagucgccucaaagaua

SEQ ID NO: 3296019 - RNA, 21 nt, Variola virus
agaauuuaccagauaucuucu

SEQ ID NO: 3296020 - RNA, 16 nt, Variola virus
acauuucucaaaugaa

SEQ ID NO: 3296021 - RNA, 21 nt, Variola virus
auaaacagucuccuaauauaa

SEQ ID NO: 3296022 - RNA, 19 nt, Variola virus
agugacacucuauaucuag

SEQ ID NO: 3296023 - RNA, 22 nt, Variola virus
aucacuaucuucaucauauuca

SEQ ID NO: 3296024 - RNA, 20 nt, Variola virus
aauauggauccgguuaauuu

SEQ ID NO: 3296025 - RNA, 21 nt, Variola virus
auuaaguucuggcaauguuuc

SEQ ID NO: 3296026 - RNA, 17 nt, Variola virus
guaauuguauuauuucc

SEQ ID NO: 3296027 - RNA, 18 nt, Variola virus
gaauacgaugauauuaaa

SEQ ID NO: 3296028 - RNA, 22 nt, Variola virus
uagaucuuccaaucuaucuauu

SEQ ID NO: 3296029 - RNA, 17 nt, Variola virus
cuauuacugacuuuaau

SEQ ID NO: 3296030 - RNA, 18 nt, Variola virus
accacuuauuacuccauu

SEQ ID NO: 3296031 - RNA, 16 nt, Variola virus
caaauaaauacucuau

SEQ ID NO: 3296032 - RNA, 19 nt, Variola virus
cucugacauucagaaagag

SEQ ID NO: 3296033 - RNA, 14 nt, Variola virus
aucauauauguauu

SEQ ID NO: 3296034 - RNA, 23 nt, Variola virus
uaaaguggaagaguauuguacag

SEQ ID NO: 3296035 - RNA, 22 nt, Variola virus
cugccuuuuuauacauauucca

SEQ ID NO: 3296036 - RNA, 13 nt, Variola virus
gaacucuguuucu

SEQ ID NO: 3296037 - RNA, 14 nt, Variola virus
aaucauauaugaua

SEQ ID NO: 3296038 - RNA, 20 nt, Variola virus
uaaacugcgccaaauugugg

SEQ ID NO: 3296039 - RNA, 15 nt, Variola virus
acugaguuuaucacu

SEQ ID NO: 3296040 - RNA, 14 nt, Variola virus
auuuauuaucuugu

SEQ ID NO: 3296041 - RNA, 17 nt, Variola virus
cauguguacuuguacac

SEQ ID NO: 3296042 - RNA, 20 nt, Variola virus
caucgucgucuacuauucua

SEQ ID NO: 3296043 - RNA, 18 nt, Variola virus
aaauuucuuuuucaaaga

SEQ ID NO: 3296044 - RNA, 17 nt, Variola virus
auucuugguuaaacuca

SEQ ID NO: 3296045 - RNA, 16 nt, Variola virus
uuaacuaucuuucaag

SEQ ID NO: 3296046 - RNA, 13 nt, Variola virus
ucaugaauacagu

SEQ ID NO: 3296047 - RNA, 19 nt, Variola virus
aucgcuacaaaacuacuau

SEQ ID NO: 3296048 - RNA, 20 nt, Variola virus
uuuuacuacauaguuaucua

SEQ ID NO: 3296049 - RNA, 13 nt, Variola virus
caaugcucaguaa

SEQ ID NO: 3296050 - RNA, 21 nt, Variola virus
caaauggauguuaauguauua

SEQ ID NO: 3296051 - RNA, 19 nt, Variola virus
aaacaauacucuacuauua

SEQ ID NO: 3296052 - RNA, 15 nt, Variola virus
auacgaaauaaacau

SEQ ID NO: 3296053 - RNA, 23 nt, Variola virus
aaguuucuuuacuguaucuacua

SEQ ID NO: 3296054 - RNA, 14 nt, Variola virus
aucagauucuauau

SEQ ID NO: 3296055 - RNA, 13 nt, Variola virus
auaacaaugacuu

SEQ ID NO: 3296056 - RNA, 14 nt, Variola virus
uuauaucacaugau

SEQ ID NO: 3296057 - RNA, 14 nt, Variola virus
auaauaucagaaug

SEQ ID NO: 3296058 - RNA, 14 nt, Variola virus
uucagaauuucuac

SEQ ID NO: 3296059 - RNA, 11 nt, Variola virus
uauucucuuuc

SEQ ID NO: 3296060 - RNA, 19 nt, Variola virus
agacggagucauaacuauu

SEQ ID NO: 3296061 - RNA, 16 nt, Variola virus
auuuaaauuuaucauc

SEQ ID NO: 3296062 - RNA, 15 nt, Variola virus
aauuauacaagagau

SEQ ID NO: 3296063 - RNA, 13 nt, Variola virus
auaugugaauaug

SEQ ID NO: 3296064 - RNA, 14 nt, Variola virus
uauuuaauaucaaa

SEQ ID NO: 3296065 - RNA, 13 nt, Variola virus
uauaaucuauaaa

SEQ ID NO: 3296066 - RNA, 19 nt, Variola virus
aaaucacuuuuuauacuaa

SEQ ID NO: 3296067 - RNA, 20 nt, Variola virus
uacaauaaacuccguagaga

SEQ ID NO: 3296068 - RNA, 23 nt, Variola virus
accuucuaaugauauauuuucca

SEQ ID NO: 3296069 - RNA, 22 nt, Variola virus
uaaaauagacaauggaauucau

SEQ ID NO: 3296070 - RNA, 18 nt, Variola virus
ugcugaugaugaauacau

SEQ ID NO: 3296071 - RNA, 17 nt, Variola virus
auauucuuuuuuauaga

SEQ ID NO: 3296072 - RNA, 22 nt, Variola virus
uuuguaaauaacuaucuauaaa

SEQ ID NO: 3296073 - RNA, 19 nt, Variola virus
ucacuagguaguaauuuga

SEQ ID NO: 3296074 - RNA, 18 nt, Variola virus
guaauaucgaauauuuua

SEQ ID NO: 3296075 - RNA, 15 nt, Variola virus
guauuccauauggau

SEQ ID NO: 3296076 - RNA, 15 nt, Variola virus
uaucauuuaaacauu

SEQ ID NO: 3296077 - RNA, 15 nt, Variola virus
ugaaauauaguaaua

SEQ ID NO: 3296078 - RNA, 23 nt, Variola virus
cuuccagaauuguaacaacaaug

SEQ ID NO: 3296079 - RNA, 17 nt, Variola virus
gcaaauguauaaaacaa

SEQ ID NO: 3296080 - RNA, 15 nt, Variola virus
uuaacagcuauucaa

SEQ ID NO: 3296081 - RNA, 19 nt, Variola virus
ugagaauccgcugcauauu

SEQ ID NO: 3296082 - RNA, 14 nt, Variola virus
aauucauuccuaua

SEQ ID NO: 3296083 - RNA, 19 nt, Variola virus
accaauuacugauaaugua

SEQ ID NO: 3296084 - RNA, 14 nt, Variola virus
auaugauuacuaga

SEQ ID NO: 3296085 - RNA, 14 nt, Variola virus
auaaaauuacuuaa

SEQ ID NO: 3296086 - RNA, 23 nt, Variola virus
ucuaauauccauuuuacauuauu

SEQ ID NO: 3296087 - RNA, 23 nt, Variola virus
uguuuaacauucuuuuuuggaga

SEQ ID NO: 3296088 - RNA, 14 nt, Variola virus
ucgguuaugaauga

SEQ ID NO: 3296089 - RNA, 14 nt, Variola virus
uaaucguuaucauu

SEQ ID NO: 3296090 - RNA, 21 nt, Variola virus
ugucacucucccuauaucuuc

SEQ ID NO: 3296091 - RNA, 17 nt, Variola virus
uacaaguggcugcuauu

SEQ ID NO: 3296092 - RNA, 15 nt, Variola virus
aaguaaacaauuuua

SEQ ID NO: 3296093 - RNA, 18 nt, Variola virus
uaaugauacagaaaaucu

SEQ ID NO: 3296094 - RNA, 19 nt, Variola virus
gcuucuuccaacucuguuu

SEQ ID NO: 3296095 - RNA, 13 nt, Variola virus
aaacacuguuguu

SEQ ID NO: 3296096 - RNA, 23 nt, Variola virus
auaauaaaucauggggcaaacau

SEQ ID NO: 3296097 - RNA, 21 nt, Variola virus
uuccaauuccguagguaaacg

SEQ ID NO: 3296098 - RNA, 18 nt, Variola virus
aaauaaacaaaauaaugu

SEQ ID NO: 3296099 - RNA, 18 nt, Variola virus
aacuagaaucagaaucua

SEQ ID NO: 3296100 - RNA, 14 nt, Variola virus
gaaauaagagacuu

SEQ ID NO: 3296101 - RNA, 23 nt, Variola virus
uacuuuguggaugaugaugaaau

SEQ ID NO: 3296102 - RNA, 17 nt, Variola virus
aacagaaaaaacaaugu

SEQ ID NO: 3296103 - RNA, 16 nt, Variola virus
ucguucgaucuaaaau

SEQ ID NO: 3296104 - RNA, 23 nt, Variola virus
aauguccaaaucuaguuguggaa

SEQ ID NO: 3296105 - RNA, 18 nt, Variola virus
cauuuuaggauaugcuuu

SEQ ID NO: 3296106 - RNA, 16 nt, Variola virus
aaugugauguaucuau

SEQ ID NO: 3296107 - RNA, 23 nt, Variola virus
ucuaaaacagcugugaauacagc

SEQ ID NO: 3296108 - RNA, 23 nt, Variola virus
uucucuccgguuaauaauucuag

SEQ ID NO: 3296109 - RNA, 23 nt, Variola virus
caguuuuuaauuucuuugguaau

SEQ ID NO: 3296110 - RNA, 13 nt, Variola virus
uacuauaauauua

SEQ ID NO: 3296111 - RNA, 16 nt, Variola virus
caaaaauuacgauauu

SEQ ID NO: 3296112 - RNA, 11 nt, Variola virus
gucuuuucuaa

SEQ ID NO: 3296113 - RNA, 23 nt, Variola virus
ugauucgaauuuaguuucuucga

SEQ ID NO: 3296114 - RNA, 17 nt, Variola virus
uaggugaacaagagaua

SEQ ID NO: 3296115 - RNA, 17 nt, Variola virus
ugauuauucuagccauu

SEQ ID NO: 3296116 - RNA, 14 nt, Variola virus
uuuuacuaaucaua

SEQ ID NO: 3296117 - RNA, 21 nt, Variola virus
gauagguuagaagauaaugaa

SEQ ID NO: 3296118 - RNA, 22 nt, Variola virus
cauuugaugauauguuuggaau

SEQ ID NO: 3296119 - RNA, 23 nt, Variola virus
ugcuuuccuuguugaugaaggau

SEQ ID NO: 3296120 - RNA, 20 nt, Variola virus
uguucacguccaccaaugau

SEQ ID NO: 3296121 - RNA, 19 nt, Variola virus
cauuacauauuauaucaau

SEQ ID NO: 3296122 - RNA, 17 nt, Variola virus
uaaacagaaauauauga

SEQ ID NO: 3296123 - RNA, 19 nt, Variola virus
aauguaauggauagacaau

SEQ ID NO: 3296124 - RNA, 14 nt, Variola virus
ucguauacuagaaa

SEQ ID NO: 3296125 - RNA, 15 nt, Variola virus
aucagauucuuauau

SEQ ID NO: 3296126 - RNA, 16 nt, Variola virus
cagguaggcaguuuua

SEQ ID NO: 3296127 - RNA, 20 nt, Variola virus
uuguauucugaauagaucca

SEQ ID NO: 3296128 - RNA, 20 nt, Variola virus
cauaaucaucacugucauca

SEQ ID NO: 3296129 - RNA, 21 nt, Variola virus
aauacuuuuguuacuaauauc

SEQ ID NO: 3296130 - RNA, 15 nt, Variola virus
aaacgacuuaccgaa

SEQ ID NO: 3296131 - RNA, 23 nt, Variola virus
auucugauuggucaaugugaaug

SEQ ID NO: 3296132 - RNA, 17 nt, Variola virus
agaagauuuaacuagau

SEQ ID NO: 3296133 - RNA, 16 nt, Variola virus
uuacaaacauuacuag

SEQ ID NO: 3296134 - RNA, 19 nt, Variola virus
gauaguauucaagucaaag

SEQ ID NO: 3296135 - RNA, 16 nt, Variola virus
uaaccuccugaaaaug

SEQ ID NO: 3296136 - RNA, 21 nt, Variola virus
uuuacucuucuaaauucauaa

SEQ ID NO: 3296137 - RNA, 19 nt, Variola virus
uuaccaguuccagauuuca

SEQ ID NO: 3296138 - RNA, 15 nt, Variola virus
auguuuuacacguau

SEQ ID NO: 3296139 - RNA, 18 nt, Variola virus
guuaucaugaaauguuug

SEQ ID NO: 3296140 - RNA, 16 nt, Variola virus
acaaccgcuacauaau

SEQ ID NO: 3296141 - RNA, 17 nt, Variola virus
auaugccuuagcaucau

SEQ ID NO: 3296142 - RNA, 20 nt, Variola virus
cuuauuaacuuuaacauguc

SEQ ID NO: 3296143 - RNA, 22 nt, Variola virus
ugccauauguuggaaauacuag

SEQ ID NO: 3296144 - RNA, 19 nt, Variola virus
gaaggaugacaauaaugac

SEQ ID NO: 3296145 - RNA, 19 nt, Variola virus
ccucaaucauguacuagcu

SEQ ID NO: 3296146 - RNA, 21 nt, Variola virus
uaagaaacuaguuuauuguga

SEQ ID NO: 3296147 - RNA, 19 nt, Variola virus
cuguagaauucgaaggaag

SEQ ID NO: 3296148 - RNA, 13 nt, Variola virus
uugcuuuucuaau

SEQ ID NO: 3296149 - RNA, 14 nt, Variola virus
aacuauucaguagu

SEQ ID NO: 3296150 - RNA, 18 nt, Variola virus
aaugacgaauugaaaauu

SEQ ID NO: 3296151 - RNA, 15 nt, Variola virus
uauauuuuauacauu

SEQ ID NO: 3296152 - RNA, 20 nt, Variola virus
uaucaaugauuaguuucuua

SEQ ID NO: 3296153 - RNA, 22 nt, Variola virus
uacuaauaggucuaaaaaccaa

SEQ ID NO: 3296154 - RNA, 18 nt, Variola virus
acuuaacuuuuucuuucu

SEQ ID NO: 3296155 - RNA, 16 nt, Variola virus
gauaucuauacuuacu

SEQ ID NO: 3296156 - RNA, 15 nt, Variola virus
cuguuucuacuaacu

SEQ ID NO: 3296157 - RNA, 21 nt, Variola virus
caauuguauuauugauacaau

SEQ ID NO: 3296158 - RNA, 18 nt, Variola virus
cgauuguauaguuaauaa

SEQ ID NO: 3296159 - RNA, 20 nt, Variola virus
uacaaaauuugcaucuacau

SEQ ID NO: 3296160 - RNA, 14 nt, Variola virus
agaaugaaacagua

SEQ ID NO: 3296161 - RNA, 13 nt, Variola virus
cuugugguaauga

SEQ ID NO: 3296162 - RNA, 22 nt, Variola virus
acuugaucuuuauuuuuugugu

SEQ ID NO: 3296163 - RNA, 18 nt, Variola virus
aucugguagcaaagaaau

SEQ ID NO: 3296164 - RNA, 17 nt, Variola virus
ucuaaaauuacaaacaa

SEQ ID NO: 3296165 - RNA, 15 nt, Variola virus
uaauuacuaaaucug

SEQ ID NO: 3296166 - RNA, 19 nt, Variola virus
aaggauaaaauauuaucca

SEQ ID NO: 3296167 - RNA, 18 nt, Variola virus
acuagucgcguuaauagu

SEQ ID NO: 3296168 - RNA, 21 nt, Variola virus
ugcuugcaacauuaacaucuu

SEQ ID NO: 3296169 - RNA, 20 nt, Variola virus
uauucaucgucgacuaucaa

SEQ ID NO: 3296170 - RNA, 20 nt, Variola virus
agucuuuaaugaauuaacga

SEQ ID NO: 3296171 - RNA, 22 nt, Variola virus
gaagagauuccugacuuugcau

SEQ ID NO: 3296172 - RNA, 16 nt, Variola virus
auauaaauuuaauaag

SEQ ID NO: 3296173 - RNA, 18 nt, Variola virus
agaacaucauuuccaaau

SEQ ID NO: 3296174 - RNA, 20 nt, Variola virus
uaucuacgauuuuuacaaaa

SEQ ID NO: 3296175 - RNA, 13 nt, Variola virus
caugaaagaaaga

SEQ ID NO: 3296176 - RNA, 18 nt, Variola virus
uccgauuguuguguacau

SEQ ID NO: 3296177 - RNA, 19 nt, Variola virus
aucaaagauuaauacauua

SEQ ID NO: 3296178 - RNA, 15 nt, Variola virus
auaaguguguuguaa

SEQ ID NO: 3296179 - RNA, 17 nt, Variola virus
aggagauuaaaggauaa

SEQ ID NO: 3296180 - RNA, 22 nt, Variola virus
uccaauaaauuaucaaauacuu

SEQ ID NO: 3296181 - RNA, 17 nt, Variola virus
caucuaauaauuuggau

SEQ ID NO: 3296182 - RNA, 15 nt, Variola virus
gaaaauuauaaugaa

SEQ ID NO: 3296183 - RNA, 18 nt, Variola virus
agauugguacgaaauaua

SEQ ID NO: 3296184 - RNA, 17 nt, Variola virus
guaaagcguuaaaucaa

SEQ ID NO: 3296185 - RNA, 22 nt, Variola virus
gucucccuuuagauuguuguau

SEQ ID NO: 3296186 - RNA, 22 nt, Variola virus
ggagaugaugcuaaaaaauaua

SEQ ID NO: 3296187 - RNA, 19 nt, Variola virus
aaggauauucucauggaaa

SEQ ID NO: 3296188 - RNA, 23 nt, Variola virus
ucucaucaucagaauaaaucaau

SEQ ID NO: 3296189 - RNA, 14 nt, Variola virus
cuaaucuguucaua

SEQ ID NO: 3296190 - RNA, 18 nt, Variola virus
uaaguaauaacuauguuu

SEQ ID NO: 3296191 - RNA, 18 nt, Variola virus
cggcuaucgacuuaauau

SEQ ID NO: 3296192 - RNA, 15 nt, Variola virus
auuucguuagucaua

SEQ ID NO: 3296193 - RNA, 13 nt, Variola virus
aauaucaggaaau

SEQ ID NO: 3296194 - RNA, 19 nt, Variola virus
uaacuuuuucuuucucagc

SEQ ID NO: 3296195 - RNA, 14 nt, Variola virus
ucauugucuaaaaa

SEQ ID NO: 3296196 - RNA, 16 nt, Variola virus
acuaacuaauguuucu

SEQ ID NO: 3296197 - RNA, 15 nt, Variola virus
gaacgauaauaacuu

SEQ ID NO: 3296198 - RNA, 22 nt, Variola virus
gcuauagaggacaauaauauua

SEQ ID NO: 3296199 - RNA, 17 nt, Variola virus
auuaguggaagaaagau

SEQ ID NO: 3296200 - RNA, 18 nt, Variola virus
acucuuggaauuaauagu

SEQ ID NO: 3296201 - RNA, 18 nt, Variola virus
acgauuaucuauuaaaga

SEQ ID NO: 3296202 - RNA, 15 nt, Variola virus
aacauuuugaaaauu

SEQ ID NO: 3296203 - RNA, 19 nt, Variola virus
aacucuuucgaauacuuau

SEQ ID NO: 3296204 - RNA, 22 nt, Variola virus
uaaguauuuggcuagucaagau

SEQ ID NO: 3296205 - RNA, 14 nt, Variola virus
uuagaauagucucu

SEQ ID NO: 3296206 - RNA, 17 nt, Variola virus
aaaaaugaaaauaaaua

SEQ ID NO: 3296207 - RNA, 17 nt, Variola virus
uuauuauuuuauauuca

SEQ ID NO: 3296208 - RNA, 20 nt, Variola virus
guucauacaugaaaugaucu

SEQ ID NO: 3296209 - RNA, 17 nt, Variola virus
cagugacuguaucacac

SEQ ID NO: 3296210 - RNA, 19 nt, Variola virus
uuacacuauuugucuuaau

SEQ ID NO: 3296211 - RNA, 15 nt, Variola virus
cgcuugguuggauuu

SEQ ID NO: 3296212 - RNA, 15 nt, Variola virus
uguuagcauuucuau

SEQ ID NO: 3296213 - RNA, 20 nt, Variola virus
ccuuugucuaccaucuccuc

SEQ ID NO: 3296214 - RNA, 16 nt, Variola virus
gauguuuguaucaugc

SEQ ID NO: 3296215 - RNA, 22 nt, Variola virus
uaaugacauggacguagauguu

SEQ ID NO: 3296216 - RNA, 22 nt, Variola virus
uaucuacgauuuuuacaaaagu

SEQ ID NO: 3296217 - RNA, 17 nt, Variola virus
uuuuauuuuaucuaauu

SEQ ID NO: 3296218 - RNA, 20 nt, Variola virus
guuccucuguaaauaaaucu

SEQ ID NO: 3296219 - RNA, 15 nt, Variola virus
auuccgcauuaaaug

SEQ ID NO: 3296220 - RNA, 18 nt, Variola virus
auauuugugaaaauauua

SEQ ID NO: 3296221 - RNA, 17 nt, Variola virus
uuuuaaaguuaaucaua

SEQ ID NO: 3296222 - RNA, 21 nt, Variola virus
augucgguuggcauucuauuu

SEQ ID NO: 3296223 - RNA, 17 nt, Variola virus
guauuauaauauacaua

SEQ ID NO: 3296224 - RNA, 19 nt, Variola virus
aggaauacaauacauaccu

SEQ ID NO: 3296225 - RNA, 20 nt, Variola virus
ucacuaauaucaauauacaa

SEQ ID NO: 3296226 - RNA, 21 nt, Variola virus
uaaaucuacuuagauuauucu

SEQ ID NO: 3296227 - RNA, 19 nt, Variola virus
cucauaaguguauauaucu

SEQ ID NO: 3296228 - RNA, 22 nt, Variola virus
aaaacuguccaaauagauguac

SEQ ID NO: 3296229 - RNA, 16 nt, Variola virus
ugcuuuagugaaauuu

SEQ ID NO: 3296230 - RNA, 21 nt, Variola virus
acgagaauggcguuugauaua

SEQ ID NO: 3296231 - RNA, 17 nt, Variola virus
aauucuaggcucaguau

SEQ ID NO: 3296232 - RNA, 14 nt, Variola virus
aaaucuauacugca

SEQ ID NO: 3296233 - RNA, 18 nt, Variola virus
guuccagcuauuccaccu

SEQ ID NO: 3296234 - RNA, 15 nt, Variola virus
ucgaguacgccauau

SEQ ID NO: 3296235 - RNA, 13 nt, Variola virus
agauauauauacu

SEQ ID NO: 3296236 - RNA, 13 nt, Variola virus
ucagacaacaucu

SEQ ID NO: 3296237 - RNA, 23 nt, Variola virus
uuggaggcgaugaucuuaauuuu

SEQ ID NO: 3296238 - RNA, 13 nt, Variola virus
auagaugaaaauc

SEQ ID NO: 3296239 - RNA, 11 nt, Variola virus
auuuauccauc

SEQ ID NO: 3296240 - RNA, 22 nt, Variola virus
ugguaauggguuccgucaaaau

SEQ ID NO: 3296241 - RNA, 19 nt, Variola virus
gauaauagggagaaaugac

SEQ ID NO: 3296242 - RNA, 18 nt, Variola virus
uagcguuauaacaaaauc

SEQ ID NO: 3296243 - RNA, 17 nt, Variola virus
agagaauugcugcaaua

SEQ ID NO: 3296244 - RNA, 18 nt, Variola virus
gaugucaaaggaugaaag

SEQ ID NO: 3296245 - RNA, 17 nt, Variola virus
caaugaacuaauauuua

SEQ ID NO: 3296246 - RNA, 12 nt, Variola virus
aauaaaacauuu

SEQ ID NO: 3296247 - RNA, 15 nt, Variola virus
uugaucuauguaguu

SEQ ID NO: 3296248 - RNA, 19 nt, Variola virus
guacuauugucuaaacaac

SEQ ID NO: 3296249 - RNA, 21 nt, Variola virus
gucauuaaauugugaaucauc

SEQ ID NO: 3296250 - RNA, 15 nt, Variola virus
uaaugaucaucuauu

SEQ ID NO: 3296251 - RNA, 22 nt, Variola virus
gguuucgaagaucuucuuauuu

SEQ ID NO: 3296252 - RNA, 15 nt, Variola virus
caaacauacaucuau

SEQ ID NO: 3296253 - RNA, 16 nt, Variola virus
uaauauaaaagaauau

SEQ ID NO: 3296254 - RNA, 22 nt, Variola virus
gaauaugauuucagauacuaua

SEQ ID NO: 3296255 - RNA, 21 nt, Variola virus
uuacggcugcguuaaacauuc

SEQ ID NO: 3296256 - RNA, 13 nt, Variola virus
uuaaaauauuguu

SEQ ID NO: 3296257 - RNA, 13 nt, Variola virus
uggauauaugaua

SEQ ID NO: 3296258 - RNA, 23 nt, Variola virus
caaauaucggaauaaguagacau

SEQ ID NO: 3296259 - RNA, 13 nt, Variola virus
augucuacauaaa

SEQ ID NO: 3296260 - RNA, 16 nt, Variola virus
agaauuucuacauaau

SEQ ID NO: 3296261 - RNA, 13 nt, Variola virus
aaaauuauaacua

SEQ ID NO: 3296262 - RNA, 18 nt, Variola virus
aaguuaauucagauacua

SEQ ID NO: 3296263 - RNA, 13 nt, Variola virus
cauacuccaucaa

SEQ ID NO: 3296264 - RNA, 18 nt, Variola virus
aucuacguucauauguau

SEQ ID NO: 3296265 - RNA, 19 nt, Variola virus
uauggacgcagauagcuau

SEQ ID NO: 3296266 - RNA, 19 nt, Variola virus
cuauaaaaagaguuucaaa

SEQ ID NO: 3296267 - RNA, 16 nt, Variola virus
agcuauuuaaaugggu

SEQ ID NO: 3296268 - RNA, 22 nt, Variola virus
gaaaauauuuaaaaaauaucua

SEQ ID NO: 3296269 - RNA, 17 nt, Variola virus
ggaugaguuaauguaua

SEQ ID NO: 3296270 - RNA, 20 nt, Variola virus
aagauauagaugaggugguu

SEQ ID NO: 3296271 - RNA, 14 nt, Variola virus
auauucuaugaauu

SEQ ID NO: 3296272 - RNA, 17 nt, Variola virus
aauacuagauucgaaaa

SEQ ID NO: 3296273 - RNA, 12 nt, Variola virus
auaaaauagaca

SEQ ID NO: 3296274 - RNA, 13 nt, Variola virus
cucuaguuucaga

SEQ ID NO: 3296275 - RNA, 13 nt, Variola virus
ucuuauguggauc

SEQ ID NO: 3296276 - RNA, 15 nt, Variola virus
uagcuuuaacagugg

SEQ ID NO: 3296277 - RNA, 14 nt, Variola virus
cugaauaaaacauc

SEQ ID NO: 3296278 - RNA, 17 nt, Variola virus
cuaagacgucucauuuc

SEQ ID NO: 3296279 - RNA, 19 nt, Variola virus
gauagguauugaugaagga

SEQ ID NO: 3296280 - RNA, 21 nt, Variola virus
auuacuacauuauuaaaucau

SEQ ID NO: 3296281 - RNA, 20 nt, Variola virus
uggacgaucuauuagaaaau

SEQ ID NO: 3296282 - RNA, 17 nt, Variola virus
ucauguagaaaaauucu

SEQ ID NO: 3296283 - RNA, 19 nt, Variola virus
auuaacaaauuuuaaacaa

SEQ ID NO: 3296284 - RNA, 14 nt, Variola virus
aaucuaagaaauuu

SEQ ID NO: 3296285 - RNA, 12 nt, Variola virus
gauauuauuaca

SEQ ID NO: 3296286 - RNA, 12 nt, Variola virus
gacuagauggac

SEQ ID NO: 3296287 - RNA, 23 nt, Variola virus
uauacauauuccagaugucauga

SEQ ID NO: 3296288 - RNA, 16 nt, Variola virus
cguauaucaucaucug

SEQ ID NO: 3296289 - RNA, 14 nt, Variola virus
aucaacagaaauau

SEQ ID NO: 3296290 - RNA, 15 nt, Variola virus
gaaaucuguaaucua

SEQ ID NO: 3296291 - RNA, 21 nt, Variola virus
aucugucccauuuugaauauc

SEQ ID NO: 3296292 - RNA, 21 nt, Variola virus
ggacaucaacgccuuagaaau

SEQ ID NO: 3296293 - RNA, 21 nt, Variola virus
ucaauagcaguuuauuaucca

SEQ ID NO: 3296294 - RNA, 17 nt, Variola virus
cguuaaauauaacuggu

SEQ ID NO: 3296295 - RNA, 17 nt, Variola virus
uauaacauuaauaucaa

SEQ ID NO: 3296296 - RNA, 12 nt, Variola virus
guuaauaacauc

SEQ ID NO: 3296297 - RNA, 16 nt, Variola virus
guucuugaucuuauua

SEQ ID NO: 3296298 - RNA, 14 nt, Variola virus
gauuaauaauucau

SEQ ID NO: 3296299 - RNA, 19 nt, Variola virus
gaacguauuaauacuuaau

SEQ ID NO: 3296300 - RNA, 16 nt, Variola virus
uuauacauauuccaga

SEQ ID NO: 3296301 - RNA, 21 nt, Variola virus
uguauucaucgccuaauguau

SEQ ID NO: 3296302 - RNA, 21 nt, Variola virus
gucuaaauuccauagcauauu

SEQ ID NO: 3296303 - RNA, 20 nt, Variola virus
ucaauaacuggcacaacaau

SEQ ID NO: 3296304 - RNA, 20 nt, Variola virus
aauaucgauuagauuuccua

SEQ ID NO: 3296305 - RNA, 22 nt, Variola virus
guuaauaguuggaauaaauaga

SEQ ID NO: 3296306 - RNA, 20 nt, Variola virus
uuuucaaagaaaaagguuug

SEQ ID NO: 3296307 - RNA, 21 nt, Variola virus
auauagcuuucacucauauaa

SEQ ID NO: 3296308 - RNA, 19 nt, Variola virus
gucuucuaaaaauaaaagu

SEQ ID NO: 3296309 - RNA, 20 nt, Variola virus
auuguacgguagaauugaua

SEQ ID NO: 3296310 - RNA, 20 nt, Variola virus
gcaucaacaguuacaaauga

SEQ ID NO: 3296311 - RNA, 17 nt, Variola virus
uuuagacgcuuauuauu

SEQ ID NO: 3296312 - RNA, 23 nt, Variola virus
ucuauuggauauggauuuccaga

SEQ ID NO: 3296313 - RNA, 15 nt, Variola virus
ugaagcauuggaagc

SEQ ID NO: 3296314 - RNA, 19 nt, Variola virus
cauaguggacaacauuaau

SEQ ID NO: 3296315 - RNA, 21 nt, Variola virus
uagaacguuuaacgaggauuu

SEQ ID NO: 3296316 - RNA, 15 nt, Variola virus
aagaggguugguaaa

SEQ ID NO: 3296317 - RNA, 21 nt, Variola virus
aagauuaacuccauaaugucu

SEQ ID NO: 3296318 - RNA, 22 nt, Variola virus
uaccaauaugucuguacaaaug

SEQ ID NO: 3296319 - RNA, 15 nt, Variola virus
auuuagaaaaaagau

SEQ ID NO: 3296320 - RNA, 13 nt, Variola virus
aauuuauauaaau

SEQ ID NO: 3296321 - RNA, 18 nt, Variola virus
acauuuuggcaaauugau

SEQ ID NO: 3296322 - RNA, 16 nt, Variola virus
aagguauaaaauacuu

SEQ ID NO: 3296323 - RNA, 20 nt, Variola virus
uaagaucguagaucucccau

SEQ ID NO: 3296324 - RNA, 16 nt, Variola virus
augagucuuauagcau

SEQ ID NO: 3296325 - RNA, 18 nt, Variola virus
ugacuguuuguacuuuga

SEQ ID NO: 3296326 - RNA, 21 nt, Variola virus
uagaaagcagauuagaugaca

SEQ ID NO: 3296327 - RNA, 15 nt, Variola virus
cggcauuagaugaga

SEQ ID NO: 3296328 - RNA, 19 nt, Variola virus
uagucuaguaucuaaacau

SEQ ID NO: 3296329 - RNA, 23 nt, Variola virus
aauuagaacagggaauuacuuua

SEQ ID NO: 3296330 - RNA, 20 nt, Variola virus
aucaaaugguaaauacugua

SEQ ID NO: 3296331 - RNA, 13 nt, Variola virus
uaaugauaaauuu

SEQ ID NO: 3296332 - RNA, 23 nt, Variola virus
cuauaccauauccuccuguagau

SEQ ID NO: 3296333 - RNA, 18 nt, Variola virus
auguugaacauaaaacua

SEQ ID NO: 3296334 - RNA, 19 nt, Variola virus
ucuauaguuuguuuucauu

SEQ ID NO: 3296335 - RNA, 22 nt, Variola virus
gaaaaaaaucuuuuuuuauucu

SEQ ID NO: 3296336 - RNA, 21 nt, Variola virus
aacaguuugguauuagaauca

SEQ ID NO: 3296337 - RNA, 16 nt, Variola virus
ugaagauaucauuaau

SEQ ID NO: 3296338 - RNA, 17 nt, Variola virus
gaauuaacgagauauau

SEQ ID NO: 3296339 - RNA, 12 nt, Variola virus
gaguaguuuaug

SEQ ID NO: 3296340 - RNA, 18 nt, Variola virus
uuuagagaaugcuaauau

SEQ ID NO: 3296341 - RNA, 22 nt, Variola virus
aaaaguauuaauacaugucuua

SEQ ID NO: 3296342 - RNA, 15 nt, Variola virus
aaagaaaauauggaa

SEQ ID NO: 3296343 - RNA, 17 nt, Variola virus
cacccguagaaauacua

SEQ ID NO: 3296344 - RNA, 17 nt, Variola virus
uugauaaaucuaucuuu

SEQ ID NO: 3296345 - RNA, 17 nt, Variola virus
augcacguaaacauuau

SEQ ID NO: 3296346 - RNA, 18 nt, Variola virus
ucuauaucuauaucuaca

SEQ ID NO: 3296347 - RNA, 16 nt, Variola virus
uagcagcacaaaucaa

SEQ ID NO: 3296348 - RNA, 15 nt, Variola virus
auuaauaagaaugac

SEQ ID NO: 3296349 - RNA, 16 nt, Variola virus
gcauagauguauauag

SEQ ID NO: 3296350 - RNA, 16 nt, Variola virus
guaucauaauauuaau

SEQ ID NO: 3296351 - RNA, 16 nt, Variola virus
accguuguuaaauacu

SEQ ID NO: 3296352 - RNA, 22 nt, Variola virus
uuggagaaacggcaacuggaaa

SEQ ID NO: 3296353 - RNA, 21 nt, Variola virus
agauccacugucacuggaaag

SEQ ID NO: 3296354 - RNA, 18 nt, Variola virus
gauaucauuaauacagua

SEQ ID NO: 3296355 - RNA, 16 nt, Variola virus
auucgaaauuagaaag

SEQ ID NO: 3296356 - RNA, 14 nt, Variola virus
agauacaacaaauu

SEQ ID NO: 3296357 - RNA, 19 nt, Variola virus
auaagaagaggacaaaguu

SEQ ID NO: 3296358 - RNA, 16 nt, Variola virus
aaccacggaucguaau

SEQ ID NO: 3296359 - RNA, 14 nt, Variola virus
uauuuaucuaacau

SEQ ID NO: 3296360 - RNA, 18 nt, Variola virus
caaacgccauaaucugug

SEQ ID NO: 3296361 - RNA, 21 nt, Variola virus
uagaaaaaauuacuccaugga

SEQ ID NO: 3296362 - RNA, 18 nt, Variola virus
aucagaaaggauagagca

SEQ ID NO: 3296363 - RNA, 18 nt, Variola virus
aucuuuaauaucuagauu

SEQ ID NO: 3296364 - RNA, 17 nt, Variola virus
uggucuuguauaucuua

SEQ ID NO: 3296365 - RNA, 22 nt, Variola virus
aauucuuaguuauauauacucu

SEQ ID NO: 3296366 - RNA, 18 nt, Variola virus
aaagauaauacauuuucu

SEQ ID NO: 3296367 - RNA, 19 nt, Variola virus
ccaaaugcugucugugaaa

SEQ ID NO: 3296368 - RNA, 15 nt, Variola virus
auccuaucuaagaug

SEQ ID NO: 3296369 - RNA, 16 nt, Variola virus
uauaaacucucaacau

SEQ ID NO: 3296370 - RNA, 14 nt, Variola virus
aaauauauaaugaa

SEQ ID NO: 3296371 - RNA, 18 nt, Variola virus
uuauuaacuguuucgaua

SEQ ID NO: 3296372 - RNA, 18 nt, Variola virus
auauucguucaauacaaa

SEQ ID NO: 3296373 - RNA, 16 nt, Variola virus
caggggaaugaacagc

SEQ ID NO: 3296374 - RNA, 17 nt, Variola virus
ugacugacuuaaaacuu

SEQ ID NO: 3296375 - RNA, 20 nt, Variola virus
aaccaaggacagaaaaaugu

SEQ ID NO: 3296376 - RNA, 17 nt, Variola virus
uauacugaaaaguuauu

SEQ ID NO: 3296377 - RNA, 14 nt, Variola virus
auguuguuaccaua

SEQ ID NO: 3296378 - RNA, 14 nt, Variola virus
ccagcagcuagaga

SEQ ID NO: 3296379 - RNA, 15 nt, Variola virus
aacuaguauaaaauc

SEQ ID NO: 3296380 - RNA, 15 nt, Variola virus
uauacaagauugaaa

SEQ ID NO: 3296381 - RNA, 17 nt, Variola virus
cauuaacuuuaaugugu

SEQ ID NO: 3296382 - RNA, 17 nt, Variola virus
uuaauagauauauuaau

SEQ ID NO: 3296383 - RNA, 16 nt, Variola virus
uauuaaaauucuuaaa

SEQ ID NO: 3296384 - RNA, 14 nt, Variola virus
aaacagauaaugau

SEQ ID NO: 3296385 - RNA, 13 nt, Variola virus
guuauaaauuagg

SEQ ID NO: 3296386 - RNA, 15 nt, Variola virus
auggacuuaucuaca

SEQ ID NO: 3296387 - RNA, 17 nt, Variola virus
cuaugagugaaggagac

SEQ ID NO: 3296388 - RNA, 19 nt, Variola virus
aacagagccaucuguaaaa

SEQ ID NO: 3296389 - RNA, 12 nt, Variola virus
aagguuguaaau

SEQ ID NO: 3296390 - RNA, 15 nt, Variola virus
aaaauaauaugauua

SEQ ID NO: 3296391 - RNA, 21 nt, Variola virus
auguuaucuacauauuuacca

SEQ ID NO: 3296392 - RNA, 19 nt, Variola virus
guucugauuuuaucuuuua

SEQ ID NO: 3296393 - RNA, 13 nt, Variola virus
uguuaauuuugaa

SEQ ID NO: 3296394 - RNA, 15 nt, Variola virus
uuccaacucuguuuu

SEQ ID NO: 3296395 - RNA, 15 nt, Variola virus
auaauucuucuguau

SEQ ID NO: 3296396 - RNA, 13 nt, Variola virus
auuacuauaaaug

SEQ ID NO: 3296397 - RNA, 15 nt, Variola virus
acauuauaugaugau

SEQ ID NO: 3296398 - RNA, 16 nt, Variola virus
auacucuauucgaaaa

SEQ ID NO: 3296399 - RNA, 15 nt, Variola virus
aauuaucaaauacuu

SEQ ID NO: 3296400 - RNA, 13 nt, Variola virus
aaaugcauacuug

SEQ ID NO: 3296401 - RNA, 21 nt, Variola virus
auacaguguauguaaaaaugu

SEQ ID NO: 3296402 - RNA, 15 nt, Variola virus
agagaaguauuuuau

SEQ ID NO: 3296403 - RNA, 18 nt, Variola virus
agauaguuuuaguuucca

SEQ ID NO: 3296404 - RNA, 19 nt, Variola virus
ugccaaaucuauaagaaaa

SEQ ID NO: 3296405 - RNA, 11 nt, Variola virus
uuguauuuugu

SEQ ID NO: 3296406 - RNA, 22 nt, Variola virus
ugcucggcaguaaucaacaaua

SEQ ID NO: 3296407 - RNA, 21 nt, Variola virus
auaaucccauucuaauacuuu

SEQ ID NO: 3296408 - RNA, 14 nt, Variola virus
acaugucuuaaagu

SEQ ID NO: 3296409 - RNA, 21 nt, Variola virus
ucaacaaucguuaauaaaucu

SEQ ID NO: 3296410 - RNA, 20 nt, Variola virus
cuuuuauuuccacauuagau

SEQ ID NO: 3296411 - RNA, 19 nt, Variola virus
gaaugcagaaaugauuuug

SEQ ID NO: 3296412 - RNA, 15 nt, Variola virus
auucaagucaaagaa

SEQ ID NO: 3296413 - RNA, 11 nt, Variola virus
cucacauuuca

SEQ ID NO: 3296414 - RNA, 21 nt, Variola virus
cauuaaggcguugaugcaauu

SEQ ID NO: 3296415 - RNA, 15 nt, Variola virus
ucuagauaaaaucac

SEQ ID NO: 3296416 - RNA, 16 nt, Variola virus
auacugucaacuauag

SEQ ID NO: 3296417 - RNA, 22 nt, Variola virus
auuaccaucucuaaguuucuuu

SEQ ID NO: 3296418 - RNA, 23 nt, Variola virus
uggaacuccuauuggaauuauuu

SEQ ID NO: 3296419 - RNA, 20 nt, Variola virus
aaauauuucauuagauguua

SEQ ID NO: 3296420 - RNA, 16 nt, Variola virus
ggucuuaguauuuuua

SEQ ID NO: 3296421 - RNA, 16 nt, Variola virus
aaaauauuuauuagaa

SEQ ID NO: 3296422 - RNA, 20 nt, Variola virus
uuaccccucauaguauuaau

SEQ ID NO: 3296423 - RNA, 21 nt, Variola virus
agaaaucauguuauaguguuu

SEQ ID NO: 3296424 - RNA, 22 nt, Variola virus
uguaaaaaacaucacgaaaucu

SEQ ID NO: 3296425 - RNA, 15 nt, Variola virus
agaugguaaacuguu

SEQ ID NO: 3296426 - RNA, 19 nt, Variola virus
aaaaacaucacgaaaucua

SEQ ID NO: 3296427 - RNA, 20 nt, Variola virus
cuauugugucuguuaauaga

SEQ ID NO: 3296428 - RNA, 16 nt, Variola virus
acaaaaagaaagaaua

SEQ ID NO: 3296429 - RNA, 16 nt, Variola virus
acagaaacuuagauua

SEQ ID NO: 3296430 - RNA, 16 nt, Variola virus
agauuuacucugaaaa

SEQ ID NO: 3296431 - RNA, 20 nt, Variola virus
aguguauaacggaaaugaua

SEQ ID NO: 3296432 - RNA, 15 nt, Variola virus
aagacuuugaaauau

SEQ ID NO: 3296433 - RNA, 18 nt, Variola virus
ucgcuccaaauauacauu

SEQ ID NO: 3296434 - RNA, 20 nt, Variola virus
acaggcgaugguaaaaagac

SEQ ID NO: 3296435 - RNA, 22 nt, Variola virus
ggcauacucguccgauuucaua

SEQ ID NO: 3296436 - RNA, 18 nt, Variola virus
acaauagucuguuaauaa

SEQ ID NO: 3296437 - RNA, 13 nt, Variola virus
auauauagaauga

SEQ ID NO: 3296438 - RNA, 15 nt, Variola virus
cgaucuaauaacaau

SEQ ID NO: 3296439 - RNA, 20 nt, Variola virus
aguuguaaaguuaaaauugu

SEQ ID NO: 3296440 - RNA, 23 nt, Variola virus
ucaccgaugaacgucauuucucu

SEQ ID NO: 3296441 - RNA, 21 nt, Variola virus
ccauauauguuuucaucauuu

SEQ ID NO: 3296442 - RNA, 17 nt, Variola virus
caacuuugaauccauuu

SEQ ID NO: 3296443 - RNA, 14 nt, Variola virus
auaacaaaauacaa

SEQ ID NO: 3296444 - RNA, 15 nt, Variola virus
uauuaucucaacaaa

SEQ ID NO: 3296445 - RNA, 23 nt, Variola virus
acuuccucauuaagauugucaug

SEQ ID NO: 3296446 - RNA, 19 nt, Variola virus
aaaggauacuaaacauugu

SEQ ID NO: 3296447 - RNA, 19 nt, Variola virus
acaagacuacaaagaaugu

SEQ ID NO: 3296448 - RNA, 20 nt, Variola virus
auuauaaguaguaguguuuc

SEQ ID NO: 3296449 - RNA, 21 nt, Variola virus
auauucugccguguuuaaaaa

SEQ ID NO: 3296450 - RNA, 16 nt, Variola virus
uaauuagguuguuuau

SEQ ID NO: 3296451 - RNA, 14 nt, Variola virus
cagacauacaguag

SEQ ID NO: 3296452 - RNA, 21 nt, Variola virus
cuuaaaauuuaaaaugguauu

SEQ ID NO: 3296453 - RNA, 17 nt, Variola virus
ucaucuagauaauggga

SEQ ID NO: 3296454 - RNA, 18 nt, Variola virus
cgaaauaaauaaugaauu

SEQ ID NO: 3296455 - RNA, 21 nt, Variola virus
aaacauguucaaugcaauaga

SEQ ID NO: 3296456 - RNA, 21 nt, Variola virus
uuaacuaagucaauuauuuca

SEQ ID NO: 3296457 - RNA, 19 nt, Variola virus
auaagugcgaugauuguac

SEQ ID NO: 3296458 - RNA, 19 nt, Variola virus
accaacagcagaaaaagac

SEQ ID NO: 3296459 - RNA, 19 nt, Variola virus
caaaaccaauuccuuuuug

SEQ ID NO: 3296460 - RNA, 16 nt, Variola virus
uuugauuaguagauau

SEQ ID NO: 3296461 - RNA, 15 nt, Variola virus
aucgcuacaaaacua

SEQ ID NO: 3296462 - RNA, 20 nt, Variola virus
gucucauauaacaacaaaua

SEQ ID NO: 3296463 - RNA, 23 nt, Variola virus
cucuauaaaauacuaaugcaucu

SEQ ID NO: 3296464 - RNA, 20 nt, Variola virus
cuauuucauacuauuuugug

SEQ ID NO: 3296465 - RNA, 20 nt, Variola virus
aucaagagagcagaaauaac

SEQ ID NO: 3296466 - RNA, 20 nt, Variola virus
aucaucugugggaaauggaa

SEQ ID NO: 3296467 - RNA, 14 nt, Variola virus
uguaauuuuauucu

SEQ ID NO: 3296468 - RNA, 14 nt, Variola virus
acucucaaaaugcu

SEQ ID NO: 3296469 - RNA, 23 nt, Variola virus
gauauaauucguggauaaucauu

SEQ ID NO: 3296470 - RNA, 12 nt, Variola virus
ucauugauuuua

SEQ ID NO: 3296471 - RNA, 17 nt, Variola virus
gaaauguguaauaauau

SEQ ID NO: 3296472 - RNA, 21 nt, Variola virus
guaccgauucuagauacaaga

SEQ ID NO: 3296473 - RNA, 15 nt, Variola virus
cucgugcagauaucc

SEQ ID NO: 3296474 - RNA, 21 nt, Variola virus
auuacucuccuagguuucucu

SEQ ID NO: 3296475 - RNA, 17 nt, Variola virus
aguaauaucaugucuaa

SEQ ID NO: 3296476 - RNA, 20 nt, Variola virus
acaaacaauuaauuaauaca

SEQ ID NO: 3296477 - RNA, 20 nt, Variola virus
uaucgcauagaaauacaaaa

SEQ ID NO: 3296478 - RNA, 15 nt, Variola virus
cgaaaagaaacagau

SEQ ID NO: 3296479 - RNA, 15 nt, Variola virus
auaacuauguuuuaa

SEQ ID NO: 3296480 - RNA, 23 nt, Variola virus
ugucuaaugaugaacacaaaugg

SEQ ID NO: 3296481 - RNA, 22 nt, Variola virus
aaaagcuauuaucaaauacugu

SEQ ID NO: 3296482 - RNA, 20 nt, Variola virus
uggauuugguaacuuugaua

SEQ ID NO: 3296483 - RNA, 11 nt, Variola virus
ugauagauauu

SEQ ID NO: 3296484 - RNA, 19 nt, Variola virus
ugucuacgauaaaccaaaa

SEQ ID NO: 3296485 - RNA, 17 nt, Variola virus
uagaucgucauauguca

SEQ ID NO: 3296486 - RNA, 17 nt, Variola virus
ucauuuucuucaacaaa

SEQ ID NO: 3296487 - RNA, 19 nt, Variola virus
auuauauggcacuguguau

SEQ ID NO: 3296488 - RNA, 15 nt, Variola virus
cgcucaaaauagacg

SEQ ID NO: 3296489 - RNA, 16 nt, Variola virus
uuaugccgaacuaaaa

SEQ ID NO: 3296490 - RNA, 17 nt, Variola virus
gaaaauaaaaauguuuu

SEQ ID NO: 3296491 - RNA, 19 nt, Variola virus
aaacuucguaaaauauucu

SEQ ID NO: 3296492 - RNA, 16 nt, Variola virus
caggaauaugacuauu

SEQ ID NO: 3296493 - RNA, 17 nt, Variola virus
accaacacuuaucaauu

SEQ ID NO: 3296494 - RNA, 18 nt, Variola virus
aucaucgugugauaugaa

SEQ ID NO: 3296495 - RNA, 23 nt, Variola virus
uagaaagaaacgauuauuucuaa

SEQ ID NO: 3296496 - RNA, 19 nt, Variola virus
uaagaacuccuaauauguu

SEQ ID NO: 3296497 - RNA, 18 nt, Variola virus
aaaacagaauaucccaaa

SEQ ID NO: 3296498 - RNA, 18 nt, Variola virus
cuaccgcaucaucaucgu

SEQ ID NO: 3296499 - RNA, 13 nt, Variola virus
guauaaaaauuaa

SEQ ID NO: 3296500 - RNA, 13 nt, Variola virus
gacuguauuugga

SEQ ID NO: 3296501 - RNA, 18 nt, Variola virus
guacaggacguaacuaua

SEQ ID NO: 3296502 - RNA, 13 nt, Variola virus
uugucgcacuaua

SEQ ID NO: 3296503 - RNA, 23 nt, Variola virus
acuguagaugguucuuuaauagu

SEQ ID NO: 3296504 - RNA, 16 nt, Variola virus
caucuuacaugaugau

SEQ ID NO: 3296505 - RNA, 14 nt, Variola virus
gauccaacacuauu

SEQ ID NO: 3296506 - RNA, 15 nt, Variola virus
acauaauauauacag

SEQ ID NO: 3296507 - RNA, 14 nt, Variola virus
auugguauaaaugu

SEQ ID NO: 3296508 - RNA, 13 nt, Variola virus
ucaauuaauguac

SEQ ID NO: 3296509 - RNA, 14 nt, Variola virus
aguaacuauguaaa

SEQ ID NO: 3296510 - RNA, 19 nt, Variola virus
uaguagucauugaucuauu

SEQ ID NO: 3296511 - RNA, 21 nt, Variola virus
cuuuuaucguuuaagaauaau

SEQ ID NO: 3296512 - RNA, 14 nt, Variola virus
gucauagaugaaau

SEQ ID NO: 3296513 - RNA, 17 nt, Variola virus
uguuccgaucuuaguaa

SEQ ID NO: 3296514 - RNA, 21 nt, Variola virus
auuccaagucacuauguguaa

SEQ ID NO: 3296515 - RNA, 16 nt, Variola virus
aaugccuuauucucug

SEQ ID NO: 3296516 - RNA, 19 nt, Variola virus
uuaaaaacaguuauuuucu

SEQ ID NO: 3296517 - RNA, 19 nt, Variola virus
agcggauaaugauagaauu

SEQ ID NO: 3296518 - RNA, 15 nt, Variola virus
aguacaucuaucaca

SEQ ID NO: 3296519 - RNA, 15 nt, Variola virus
auuugguaaaaugaa

SEQ ID NO: 3296520 - RNA, 19 nt, Variola virus
ucaguacauagauuaucca

SEQ ID NO: 3296521 - RNA, 12 nt, Variola virus
uaaaacauaaag

SEQ ID NO: 3296522 - RNA, 23 nt, Variola virus
cuugauuauucuauaaguauaaa

SEQ ID NO: 3296523 - RNA, 18 nt, Variola virus
augaauaucacauaucau

SEQ ID NO: 3296524 - RNA, 17 nt, Variola virus
auaaaauguuaauacau

SEQ ID NO: 3296525 - RNA, 14 nt, Variola virus
cuauauuauguuuu

SEQ ID NO: 3296526 - RNA, 22 nt, Variola virus
gauuuuuuuaucccauguuuca

SEQ ID NO: 3296527 - RNA, 24 nt, Variola virus
aguauacgaagaaaaaguaaauac

SEQ ID NO: 3296528 - RNA, 22 nt, Variola virus
auauauuuauagaagauauuac

SEQ ID NO: 3296529 - RNA, 20 nt, Variola virus
caaauggucaaugauaugau

SEQ ID NO: 3296530 - RNA, 17 nt, Variola virus
ucuaucgcauguggaug

SEQ ID NO: 3296531 - RNA, 15 nt, Variola virus
uagacauaauacuau

SEQ ID NO: 3296532 - RNA, 19 nt, Variola virus
uccaaauuuaaauacuuua

SEQ ID NO: 3296533 - RNA, 19 nt, Variola virus
aggacauguaaacuugaca

SEQ ID NO: 3296534 - RNA, 12 nt, Variola virus
cuaaauggauua

SEQ ID NO: 3296535 - RNA, 13 nt, Variola virus
aaaaagauguauu

SEQ ID NO: 3296536 - RNA, 17 nt, Variola virus
uuagacgcuuauuauua

SEQ ID NO: 3296537 - RNA, 12 nt, Variola virus
uaucaauuuauc

SEQ ID NO: 3296538 - RNA, 14 nt, Variola virus
aagcaagaaagaua

SEQ ID NO: 3296539 - RNA, 19 nt, Variola virus
aucauaauccugugcauaa

SEQ ID NO: 3296540 - RNA, 22 nt, Variola virus
ucuucuuauaagauuguagaau

SEQ ID NO: 3296541 - RNA, 13 nt, Variola virus
cgugagauaaagu

SEQ ID NO: 3296542 - RNA, 22 nt, Variola virus
gaacuauaaguguguuguaaac

SEQ ID NO: 3296543 - RNA, 15 nt, Variola virus
ucaaguucuccgcgu

SEQ ID NO: 3296544 - RNA, 18 nt, Variola virus
cauacauuuguaaaagua

SEQ ID NO: 3296545 - RNA, 14 nt, Variola virus
ugccuaguacugua

SEQ ID NO: 3296546 - RNA, 13 nt, Variola virus
caaaaacgauauu

SEQ ID NO: 3296547 - RNA, 24 nt, Variola virus
caucuaccauaauccuauucuuga

SEQ ID NO: 3296548 - RNA, 19 nt, Variola virus
uucagugaagaagugucua

SEQ ID NO: 3296549 - RNA, 13 nt, Variola virus
aacuuuucagaau

SEQ ID NO: 3296550 - RNA, 23 nt, Variola virus
uauuauggaaaucaacauaaugu

SEQ ID NO: 3296551 - RNA, 22 nt, Variola virus
guuauaaccuuaauauaauaga

SEQ ID NO: 3296552 - RNA, 15 nt, Variola virus
ucugaaauaaucaug

SEQ ID NO: 3296553 - RNA, 20 nt, Variola virus
aaacauuauaucguuaucau

SEQ ID NO: 3296554 - RNA, 19 nt, Variola virus
gauaaagauagaugaugau

SEQ ID NO: 3296555 - RNA, 17 nt, Variola virus
cauggaaauuuaacagc

SEQ ID NO: 3296556 - RNA, 14 nt, Variola virus
uguuuuuuaucaua

SEQ ID NO: 3296557 - RNA, 21 nt, Variola virus
guucuauaaucguaaauaauu

SEQ ID NO: 3296558 - RNA, 19 nt, Variola virus
uaaaaauaaacaucaacau

SEQ ID NO: 3296559 - RNA, 16 nt, Variola virus
aucgaguuuaucagag

SEQ ID NO: 3296560 - RNA, 11 nt, Variola virus
uuuucuguaaa

SEQ ID NO: 3296561 - RNA, 21 nt, Variola virus
uauggauuuuuuuaaaaagga

SEQ ID NO: 3296562 - RNA, 13 nt, Variola virus
aacauuaguucca

SEQ ID NO: 3296563 - RNA, 19 nt, Variola virus
auaaaaaguauagguguau

SEQ ID NO: 3296564 - RNA, 13 nt, Variola virus
uaaauaucauaau

SEQ ID NO: 3296565 - RNA, 17 nt, Variola virus
gucauaacuuaguucuu

SEQ ID NO: 3296566 - RNA, 16 nt, Variola virus
gauaaacgugaacagg

SEQ ID NO: 3296567 - RNA, 17 nt, Variola virus
guacuucucccauaaua

SEQ ID NO: 3296568 - RNA, 17 nt, Variola virus
cuaauacaaaaucaucu

SEQ ID NO: 3296569 - RNA, 17 nt, Variola virus
caauaugcgaaucauuu

SEQ ID NO: 3296570 - RNA, 17 nt, Variola virus
acucuguuucuguaucu

SEQ ID NO: 3296571 - RNA, 11 nt, Variola virus
uuuuauacauu

SEQ ID NO: 3296572 - RNA, 22 nt, Variola virus
gaacguaguaguaaguauuuau

SEQ ID NO: 3296573 - RNA, 14 nt, Variola virus
aauuguauauuaca

SEQ ID NO: 3296574 - RNA, 17 nt, Variola virus
uggaucagauguagaua

SEQ ID NO: 3296575 - RNA, 13 nt, Variola virus
aggacaugaugau

SEQ ID NO: 3296576 - RNA, 17 nt, Variola virus
cacacugauauuaugau

SEQ ID NO: 3296577 - RNA, 21 nt, Variola virus
acauuaaauguauauuuucca

SEQ ID NO: 3296578 - RNA, 18 nt, Variola virus
auuguuuugaagaaauga

SEQ ID NO: 3296579 - RNA, 15 nt, Variola virus
uuggauuuuguauua

SEQ ID NO: 3296580 - RNA, 19 nt, Variola virus
gaauaagaguguaguauca

SEQ ID NO: 3296581 - RNA, 20 nt, Variola virus
cucauagucuauuaaguggu

SEQ ID NO: 3296582 - RNA, 21 nt, Variola virus
aaauuuuacaaaucuauaaca

SEQ ID NO: 3296583 - RNA, 20 nt, Variola virus
ucauauaacuucuagaugua

SEQ ID NO: 3296584 - RNA, 13 nt, Variola virus
cuaaucuauuuua

SEQ ID NO: 3296585 - RNA, 16 nt, Variola virus
ucgcgcuuuacauucu

SEQ ID NO: 3296586 - RNA, 17 nt, Variola virus
auacaucuccaaaacua

SEQ ID NO: 3296587 - RNA, 14 nt, Variola virus
uacuugauaagaua

SEQ ID NO: 3296588 - RNA, 22 nt, Variola virus
acauuugggccauuauaccucu

SEQ ID NO: 3296589 - RNA, 11 nt, Variola virus
uuacaaacauu

SEQ ID NO: 3296590 - RNA, 23 nt, Variola virus
auaaucuaguaaaacuuucuagu

SEQ ID NO: 3296591 - RNA, 17 nt, Variola virus
guguauuguucaaauca

SEQ ID NO: 3296592 - RNA, 22 nt, Variola virus
cuuucauuauuacgucuguagu

SEQ ID NO: 3296593 - RNA, 14 nt, Variola virus
gacgugcguaauau

SEQ ID NO: 3296594 - RNA, 18 nt, Variola virus
uguaaaaagauaaacuuu

SEQ ID NO: 3296595 - RNA, 13 nt, Variola virus
uucaauucucgga

SEQ ID NO: 3296596 - RNA, 17 nt, Variola virus
uauaccaacaugucuga

SEQ ID NO: 3296597 - RNA, 22 nt, Variola virus
gaagagaugccucguuccaagu

SEQ ID NO: 3296598 - RNA, 15 nt, Variola virus
auaucaugaaauaua

SEQ ID NO: 3296599 - RNA, 22 nt, Variola virus
gcuaauauuuuauuacaaucau

SEQ ID NO: 3296600 - RNA, 13 nt, Variola virus
uucauuaaucuuu

SEQ ID NO: 3296601 - RNA, 19 nt, Variola virus
ucaagucaauuaucuuauu

SEQ ID NO: 3296602 - RNA, 13 nt, Variola virus
gacaaaaugugau

SEQ ID NO: 3296603 - RNA, 16 nt, Variola virus
gaagauguuagaaaaa

SEQ ID NO: 3296604 - RNA, 21 nt, Variola virus
aagaaugcuucggaauuagaa

SEQ ID NO: 3296605 - RNA, 18 nt, Variola virus
ucaacaauaugcaaauag

SEQ ID NO: 3296606 - RNA, 14 nt, Variola virus
aucaauaaauggau

SEQ ID NO: 3296607 - RNA, 14 nt, Variola virus
gcuuaauaaauguu

SEQ ID NO: 3296608 - RNA, 15 nt, Variola virus
auaaacuuaguguaa

SEQ ID NO: 3296609 - RNA, 13 nt, Variola virus
auauaaaauggau

SEQ ID NO: 3296610 - RNA, 20 nt, Variola virus
cagguaugauagcuccacca

SEQ ID NO: 3296611 - RNA, 20 nt, Variola virus
auaaaaaauacuuaaaaugu

SEQ ID NO: 3296612 - RNA, 16 nt, Variola virus
uuauauaaucuauaaa

SEQ ID NO: 3296613 - RNA, 22 nt, Variola virus
gccaucguguuaaauuuucuaa

SEQ ID NO: 3296614 - RNA, 18 nt, Variola virus
uuacaugugauacauuuu

SEQ ID NO: 3296615 - RNA, 11 nt, Variola virus
aaaaaauggaa

SEQ ID NO: 3296616 - RNA, 11 nt, Variola virus
aauaaauggau

SEQ ID NO: 3296617 - RNA, 13 nt, Variola virus
ucaacuuauucuc

SEQ ID NO: 3296618 - RNA, 20 nt, Variola virus
uaaucguuauuaucaucauu

SEQ ID NO: 3296619 - RNA, 12 nt, Variola virus
guaauuggauuc

SEQ ID NO: 3296620 - RNA, 17 nt, Variola virus
acuaauucauuuucaau

SEQ ID NO: 3296621 - RNA, 15 nt, Variola virus
uuaauaucuauauau

SEQ ID NO: 3296622 - RNA, 18 nt, Variola virus
accucuccuauaugaaua

SEQ ID NO: 3296623 - RNA, 14 nt, Variola virus
caaguauacaauuu

SEQ ID NO: 3296624 - RNA, 17 nt, Variola virus
auuauuaaacaauacuc

SEQ ID NO: 3296625 - RNA, 14 nt, Variola virus
agacuacaauauau

SEQ ID NO: 3296626 - RNA, 12 nt, Variola virus
aauuauauuguc

SEQ ID NO: 3296627 - RNA, 22 nt, Variola virus
cuuuugucguaaauacaugucu

SEQ ID NO: 3296628 - RNA, 21 nt, Variola virus
uguagagaaucgcuagaugcu

SEQ ID NO: 3296629 - RNA, 18 nt, Variola virus
ugauagagguagacuucu

SEQ ID NO: 3296630 - RNA, 14 nt, Variola virus
uacgucgucaaaau

SEQ ID NO: 3296631 - RNA, 21 nt, Variola virus
acuggauauucgauaacagca

SEQ ID NO: 3296632 - RNA, 18 nt, Variola virus
uauauuuguuaacuacau

SEQ ID NO: 3296633 - RNA, 20 nt, Variola virus
aaagauauuaccaguugugg

SEQ ID NO: 3296634 - RNA, 12 nt, Variola virus
uaacugaagaaa

SEQ ID NO: 3296635 - RNA, 16 nt, Variola virus
aagaacaguacucaau

SEQ ID NO: 3296636 - RNA, 15 nt, Variola virus
cuauugccaaauguu

SEQ ID NO: 3296637 - RNA, 14 nt, Variola virus
cgagaccuacagug

SEQ ID NO: 3296638 - RNA, 10 nt, Variola virus
guuacuaucg

SEQ ID NO: 3296639 - RNA, 15 nt, Variola virus
aauuacacauuucca

SEQ ID NO: 3296640 - RNA, 17 nt, Variola virus
uagaauaaauauccuug

SEQ ID NO: 3296641 - RNA, 23 nt, Variola virus
gccauuuucuaugaacaaaucaa

SEQ ID NO: 3296642 - RNA, 14 nt, Variola virus
agcaaaguuauuaa

SEQ ID NO: 3296643 - RNA, 16 nt, Variola virus
agcacuaucauaauua

SEQ ID NO: 3296644 - RNA, 16 nt, Variola virus
acuaugucaaaaauug

SEQ ID NO: 3296645 - RNA, 18 nt, Variola virus
uuaacgaguucaaauaug

SEQ ID NO: 3296646 - RNA, 13 nt, Variola virus
caacaaacauauu

SEQ ID NO: 3296647 - RNA, 17 nt, Variola virus
ucacauaucgcuacaaa

SEQ ID NO: 3296648 - RNA, 18 nt, Variola virus
ugagagaucuacugguga

SEQ ID NO: 3296649 - RNA, 18 nt, Variola virus
aguaugaagauaaacacu

SEQ ID NO: 3296650 - RNA, 18 nt, Variola virus
guguauaacaaucuuaua

SEQ ID NO: 3296651 - RNA, 13 nt, Variola virus
uagucaagaugau

SEQ ID NO: 3296652 - RNA, 13 nt, Variola virus
acugauauucagg

SEQ ID NO: 3296653 - RNA, 18 nt, Variola virus
gaaaacuagauacaaaau

SEQ ID NO: 3296654 - RNA, 22 nt, Variola virus
ucuccgcaauacauuucucaaa

SEQ ID NO: 3296655 - RNA, 18 nt, Variola virus
auguuagagaauauucaa

SEQ ID NO: 3296656 - RNA, 22 nt, Variola virus
aucuaucuuugcauucugaaac

SEQ ID NO: 3296657 - RNA, 22 nt, Variola virus
gacaacaaggcuuuaauaucua

SEQ ID NO: 3296658 - RNA, 17 nt, Variola virus
acugcauuaaacugaua

SEQ ID NO: 3296659 - RNA, 22 nt, Variola virus
gaugucauuccuuauacaauca

SEQ ID NO: 3296660 - RNA, 18 nt, Variola virus
uaucaacggacacaaagu

SEQ ID NO: 3296661 - RNA, 19 nt, Variola virus
cggauguugugaucaucuu

SEQ ID NO: 3296662 - RNA, 14 nt, Variola virus
ugguaucaacagau

SEQ ID NO: 3296663 - RNA, 13 nt, Variola virus
ucgauaauuauua

SEQ ID NO: 3296664 - RNA, 13 nt, Variola virus
auuuguacauuau

SEQ ID NO: 3296665 - RNA, 17 nt, Variola virus
cagaaucccuuuccaaa

SEQ ID NO: 3296666 - RNA, 18 nt, Variola virus
uaacauaaaaauaucauu

SEQ ID NO: 3296667 - RNA, 16 nt, Variola virus
auuuaagguacuagau

SEQ ID NO: 3296668 - RNA, 21 nt, Variola virus
uuucugguuuucuauaaauaa

SEQ ID NO: 3296669 - RNA, 13 nt, Variola virus
cauuuuacauuau

SEQ ID NO: 3296670 - RNA, 16 nt, Variola virus
agucuauaugaucaaa

SEQ ID NO: 3296671 - RNA, 15 nt, Variola virus
cacugucuaaaugua

SEQ ID NO: 3296672 - RNA, 15 nt, Variola virus
uucuuggauuucaua

SEQ ID NO: 3296673 - RNA, 14 nt, Variola virus
gaagacauauuaau

SEQ ID NO: 3296674 - RNA, 17 nt, Variola virus
auuagaauagucucuuu

SEQ ID NO: 3296675 - RNA, 17 nt, Variola virus
uaaaaaaguuaaaacuu

SEQ ID NO: 3296676 - RNA, 23 nt, Variola virus
gucuaucaagauccaugauucua

SEQ ID NO: 3296677 - RNA, 18 nt, Variola virus
augaaggaaagacauuau

SEQ ID NO: 3296678 - RNA, 16 nt, Variola virus
auaacguaauuccaaa

SEQ ID NO: 3296679 - RNA, 22 nt, Variola virus
ucaacgugauuauucuccacca

SEQ ID NO: 3296680 - RNA, 19 nt, Variola virus
ugacuucauugauaucuuu

SEQ ID NO: 3296681 - RNA, 18 nt, Variola virus
aacucuugcuacaaaaug

SEQ ID NO: 3296682 - RNA, 14 nt, Variola virus
aaauugauaaugag

SEQ ID NO: 3296683 - RNA, 20 nt, Variola virus
cacuuaaaucgauauaacag

SEQ ID NO: 3296684 - RNA, 21 nt, Variola virus
ucuaagacgucucauuucuau

SEQ ID NO: 3296685 - RNA, 15 nt, Variola virus
agcuaggcuggaaac

SEQ ID NO: 3296686 - RNA, 17 nt, Variola virus
agauaucuauacuuacu

SEQ ID NO: 3296687 - RNA, 18 nt, Variola virus
uguauaacagagccaucu

SEQ ID NO: 3296688 - RNA, 14 nt, Variola virus
auucaauauuguau

SEQ ID NO: 3296689 - RNA, 18 nt, Variola virus
cuuugaacuguuuaagag

SEQ ID NO: 3296690 - RNA, 21 nt, Variola virus
agugauaaguaauaacuaugu

SEQ ID NO: 3296691 - RNA, 16 nt, Variola virus
aguaucaauaacacaa

SEQ ID NO: 3296692 - RNA, 20 nt, Variola virus
ugaaugcugaugaacagguu

SEQ ID NO: 3296693 - RNA, 21 nt, Variola virus
auauuuggaaucagacacaga

SEQ ID NO: 3296694 - RNA, 22 nt, Variola virus
auauuaggcacagucaaacauu

SEQ ID NO: 3296695 - RNA, 16 nt, Variola virus
uuagauaauuguggua

SEQ ID NO: 3296696 - RNA, 16 nt, Variola virus
ucuaugaauaugauuu

SEQ ID NO: 3296697 - RNA, 14 nt, Variola virus
aggugaacaagaga

SEQ ID NO: 3296698 - RNA, 13 nt, Variola virus
aaccauaaauaca

SEQ ID NO: 3296699 - RNA, 21 nt, Variola virus
agaaauggagagagacuguuu

SEQ ID NO: 3296700 - RNA, 15 nt, Variola virus
gcaucauauaacuaa

SEQ ID NO: 3296701 - RNA, 21 nt, Variola virus
uugacucaugacuucauugau

SEQ ID NO: 3296702 - RNA, 13 nt, Variola virus
agcaaaaaaacug

SEQ ID NO: 3296703 - RNA, 18 nt, Variola virus
ucucguaggcacacaauc

SEQ ID NO: 3296704 - RNA, 16 nt, Variola virus
aacuuuuagaaauaua

SEQ ID NO: 3296705 - RNA, 13 nt, Variola virus
augaacaaagaaa

SEQ ID NO: 3296706 - RNA, 16 nt, Variola virus
auguaucgugccucau

SEQ ID NO: 3296707 - RNA, 16 nt, Variola virus
ugagaagauauucucu

SEQ ID NO: 3296708 - RNA, 22 nt, Variola virus
uauacaaauccauuaauacgga

SEQ ID NO: 3296709 - RNA, 17 nt, Variola virus
cagaaucaguauauauu

SEQ ID NO: 3296710 - RNA, 15 nt, Variola virus
aacuacgucaagacu

SEQ ID NO: 3296711 - RNA, 20 nt, Variola virus
auuugguaaauuauuaucua

SEQ ID NO: 3296712 - RNA, 21 nt, Variola virus
uuaauagugcgaaaucauuca

SEQ ID NO: 3296713 - RNA, 17 nt, Variola virus
gaaaauaaucuaguaaa

SEQ ID NO: 3296714 - RNA, 23 nt, Variola virus
uuaaauuuagagauaauauccug

SEQ ID NO: 3296715 - RNA, 17 nt, Variola virus
aaugcggauuuagaaaa

SEQ ID NO: 3296716 - RNA, 20 nt, Variola virus
uggucaaucccuaagucuuu

SEQ ID NO: 3296717 - RNA, 15 nt, Variola virus
uuaauuucuuuggua

SEQ ID NO: 3296718 - RNA, 21 nt, Variola virus
agguuaaaccuuuauaaacuu

SEQ ID NO: 3296719 - RNA, 17 nt, Variola virus
acacucuauaucuagaa

SEQ ID NO: 3296720 - RNA, 21 nt, Variola virus
gauuuauuugauaaucauguu

SEQ ID NO: 3296721 - RNA, 21 nt, Variola virus
aucuaccauaguuacagaauu

SEQ ID NO: 3296722 - RNA, 17 nt, Variola virus
uaacaaaaauuaugaaa

SEQ ID NO: 3296723 - RNA, 21 nt, Variola virus
auaaccgguaagaauaguaaa

SEQ ID NO: 3296724 - RNA, 13 nt, Variola virus
aauuaaacaaaac

SEQ ID NO: 3296725 - RNA, 17 nt, Variola virus
aaaucguguuuguguag

SEQ ID NO: 3296726 - RNA, 20 nt, Variola virus
acgaaaguauagcuaaugau

SEQ ID NO: 3296727 - RNA, 15 nt, Variola virus
uauaaauguagacuc

SEQ ID NO: 3296728 - RNA, 13 nt, Variola virus
uagaacaacucuc

SEQ ID NO: 3296729 - RNA, 18 nt, Variola virus
agaaaguaucaaaucgau

SEQ ID NO: 3296730 - RNA, 17 nt, Variola virus
gcauuaaugagaagaau

SEQ ID NO: 3296731 - RNA, 14 nt, Variola virus
ucucaaguuacauu

SEQ ID NO: 3296732 - RNA, 20 nt, Variola virus
ucuaagacgucucauuucua

SEQ ID NO: 3296733 - RNA, 18 nt, Variola virus
guaccuauucuagaaaau

SEQ ID NO: 3296734 - RNA, 17 nt, Variola virus
gucaauuauuucaucaa

SEQ ID NO: 3296735 - RNA, 20 nt, Variola virus
uauacacguuagauuauucu

SEQ ID NO: 3296736 - RNA, 13 nt, Variola virus
uuugaacaucuug

SEQ ID NO: 3296737 - RNA, 10 nt, Variola virus
guuacaaaag

SEQ ID NO: 3296738 - RNA, 17 nt, Variola virus
auacuguguaaagaaau

SEQ ID NO: 3296739 - RNA, 21 nt, Variola virus
agaaggauuggucuuaaaaga

SEQ ID NO: 3296740 - RNA, 23 nt, Variola virus
caucuaucaucuccacacaguca

SEQ ID NO: 3296741 - RNA, 14 nt, Variola virus
auuauuucuaaauu

SEQ ID NO: 3296742 - RNA, 20 nt, Variola virus
ugagauugauguaauacuuu

SEQ ID NO: 3296743 - RNA, 19 nt, Variola virus
uuucuaaauuauuccaauu

SEQ ID NO: 3296744 - RNA, 20 nt, Variola virus
uggauggaucauaauugaug

SEQ ID NO: 3296745 - RNA, 14 nt, Variola virus
auuaauuaauacaa

SEQ ID NO: 3296746 - RNA, 22 nt, Variola virus
auguucucaagaacuacaaaag

SEQ ID NO: 3296747 - RNA, 17 nt, Variola virus
acaauacauguacaaau

SEQ ID NO: 3296748 - RNA, 15 nt, Variola virus
aauagcucaauauaa

SEQ ID NO: 3296749 - RNA, 21 nt, Variola virus
guagauaaaaaagauacgcau

SEQ ID NO: 3296750 - RNA, 15 nt, Variola virus
ugauacguauauaca

SEQ ID NO: 3296751 - RNA, 18 nt, Variola virus
accgaagagcagcuauau

SEQ ID NO: 3296752 - RNA, 19 nt, Variola virus
caaauagagauaaaacaag

SEQ ID NO: 3296753 - RNA, 12 nt, Variola virus
gguguaaaagau

SEQ ID NO: 3296754 - RNA, 15 nt, Variola virus
caaaaugaugauaua

SEQ ID NO: 3296755 - RNA, 16 nt, Variola virus
ucauggaauacauaaa

SEQ ID NO: 3296756 - RNA, 15 nt, Variola virus
aauguuauuacuugu

SEQ ID NO: 3296757 - RNA, 15 nt, Variola virus
augcggaugcucagu

SEQ ID NO: 3296758 - RNA, 16 nt, Variola virus
aauaacaauuaacaau

SEQ ID NO: 3296759 - RNA, 23 nt, Variola virus
uuuacaaaaguccggaugcauaa

SEQ ID NO: 3296760 - RNA, 17 nt, Variola virus
aucgcuuaauagacaaa

SEQ ID NO: 3296761 - RNA, 20 nt, Variola virus
uaauagaucaacagaaauau

SEQ ID NO: 3296762 - RNA, 15 nt, Variola virus
cauuagguuaaauga

SEQ ID NO: 3296763 - RNA, 13 nt, Variola virus
uauaaauuuuaga

SEQ ID NO: 3296764 - RNA, 21 nt, Variola virus
aucaauguccugcuauacuuc

SEQ ID NO: 3296765 - RNA, 13 nt, Variola virus
gacgcacauaugc

SEQ ID NO: 3296766 - RNA, 16 nt, Variola virus
uuaaaacacaaauaug

SEQ ID NO: 3296767 - RNA, 14 nt, Variola virus
aacuaggaaauugg

SEQ ID NO: 3296768 - RNA, 22 nt, Variola virus
aucuucaacguauaguuguuga

SEQ ID NO: 3296769 - RNA, 22 nt, Variola virus
auugcuagccuuaucuucuaua

SEQ ID NO: 3296770 - RNA, 13 nt, Variola virus
aauauuauuacca

SEQ ID NO: 3296771 - RNA, 13 nt, Variola virus
agaugaugauaua

SEQ ID NO: 3296772 - RNA, 14 nt, Variola virus
uucuagucuagaaa

SEQ ID NO: 3296773 - RNA, 20 nt, Variola virus
aaucauucucuucuaucuuu

SEQ ID NO: 3296774 - RNA, 23 nt, Variola virus
uuuugauacuauccaauaaacag

SEQ ID NO: 3296775 - RNA, 21 nt, Variola virus
aauaagaacaaaguaaugccu

SEQ ID NO: 3296776 - RNA, 16 nt, Variola virus
auuauccguauuucca

SEQ ID NO: 3296777 - RNA, 13 nt, Variola virus
caggaacuauuaa

SEQ ID NO: 3296778 - RNA, 20 nt, Variola virus
agagcauauuucauuuccaa

SEQ ID NO: 3296779 - RNA, 18 nt, Variola virus
caguagcgagaaagcauc

SEQ ID NO: 3296780 - RNA, 12 nt, Variola virus
acucuucuuauu

SEQ ID NO: 3296781 - RNA, 12 nt, Variola virus
aaugaauguuua

SEQ ID NO: 3296782 - RNA, 16 nt, Variola virus
aauguugggauccaga

SEQ ID NO: 3296783 - RNA, 19 nt, Variola virus
uuucaagccggcuauauau

SEQ ID NO: 3296784 - RNA, 18 nt, Variola virus
aauuuucuauacauagau

SEQ ID NO: 3296785 - RNA, 14 nt, Variola virus
agaauaaaaugauu

SEQ ID NO: 3296786 - RNA, 16 nt, Variola virus
agugaucaaauuauug

SEQ ID NO: 3296787 - RNA, 19 nt, Variola virus
ucugaaaauccacuaacaa

SEQ ID NO: 3296788 - RNA, 18 nt, Variola virus
uuuagaaggaguguuuuc

SEQ ID NO: 3296789 - RNA, 13 nt, Variola virus
gcauuaauaaugu

SEQ ID NO: 3296790 - RNA, 12 nt, Variola virus
uaguagaugcua

SEQ ID NO: 3296791 - RNA, 16 nt, Variola virus
aucuuacauauacaga

SEQ ID NO: 3296792 - RNA, 20 nt, Variola virus
aguuaauggaauaucaaauc

SEQ ID NO: 3296793 - RNA, 19 nt, Variola virus
gucucuuccgcagauaaau

SEQ ID NO: 3296794 - RNA, 22 nt, Variola virus
cauaauacucccacaaauacug

SEQ ID NO: 3296795 - RNA, 15 nt, Variola virus
aaugaauuuagaaau

SEQ ID NO: 3296796 - RNA, 14 nt, Variola virus
aguugauuguaaac

SEQ ID NO: 3296797 - RNA, 15 nt, Variola virus
auucauuaaggagau

SEQ ID NO: 3296798 - RNA, 18 nt, Variola virus
augacauuguaaaagaaa

SEQ ID NO: 3296799 - RNA, 22 nt, Variola virus
uugagauuaaauguaauaacaa

SEQ ID NO: 3296800 - RNA, 15 nt, Variola virus
gucuccaaucuuuug

SEQ ID NO: 3296801 - RNA, 20 nt, Variola virus
cuauuguuuguuuuaauaua

SEQ ID NO: 3296802 - RNA, 20 nt, Variola virus
auaauaacaaguaugacauu

SEQ ID NO: 3296803 - RNA, 23 nt, Variola virus
agacgaguuuaguauucgagaca

SEQ ID NO: 3296804 - RNA, 17 nt, Variola virus
aaucgcgcguuagaaau

SEQ ID NO: 3296805 - RNA, 16 nt, Variola virus
uauauagcacaaaugu

SEQ ID NO: 3296806 - RNA, 15 nt, Variola virus
guuuccaaaaaaugu

SEQ ID NO: 3296807 - RNA, 21 nt, Variola virus
ugaucuuuauuuuuuguguau

SEQ ID NO: 3296808 - RNA, 14 nt, Variola virus
ucauguagauaguu

SEQ ID NO: 3296809 - RNA, 14 nt, Variola virus
gaacaauuuacuuu

SEQ ID NO: 3296810 - RNA, 22 nt, Variola virus
cuaaaaguauagcaucuggagu

SEQ ID NO: 3296811 - RNA, 18 nt, Variola virus
aauguuagaauuagaaaa

SEQ ID NO: 3296812 - RNA, 17 nt, Variola virus
aucuucauuaucugaua

SEQ ID NO: 3296813 - RNA, 21 nt, Variola virus
cuagauagaaagauguagcua

SEQ ID NO: 3296814 - RNA, 19 nt, Variola virus
auaauacuggagaacuuau

SEQ ID NO: 3296815 - RNA, 22 nt, Variola virus
ugucuagaggcuaaaacauauu

SEQ ID NO: 3296816 - RNA, 19 nt, Variola virus
uguuuagaugaaguauuga

SEQ ID NO: 3296817 - RNA, 17 nt, Variola virus
uacauauuauucaaaau

SEQ ID NO: 3296818 - RNA, 19 nt, Variola virus
guuaaaaaauuaaguguua

SEQ ID NO: 3296819 - RNA, 15 nt, Variola virus
acauuuccuacauau

SEQ ID NO: 3296820 - RNA, 20 nt, Variola virus
uaaauugguacucuaucaua

SEQ ID NO: 3296821 - RNA, 14 nt, Variola virus
cuauaauaaugaau

SEQ ID NO: 3296822 - RNA, 21 nt, Variola virus
uuaaguucaccaaacaacuuu

SEQ ID NO: 3296823 - RNA, 19 nt, Variola virus
aucaauucuggauuauccc

SEQ ID NO: 3296824 - RNA, 19 nt, Variola virus
aaaagacuuucguuaauuu

SEQ ID NO: 3296825 - RNA, 21 nt, Variola virus
uuaugacaaaguuuacauucu

SEQ ID NO: 3296826 - RNA, 14 nt, Variola virus
gcugguaaaguaaa

SEQ ID NO: 3296827 - RNA, 20 nt, Variola virus
uauugugcaucgauaucuuu

SEQ ID NO: 3296828 - RNA, 15 nt, Variola virus
uacgucuucuaaaaa

SEQ ID NO: 3296829 - RNA, 20 nt, Variola virus
agacuaggugcuauggaugg

SEQ ID NO: 3296830 - RNA, 12 nt, Variola virus
uggauuuggauu

SEQ ID NO: 3296831 - RNA, 17 nt, Variola virus
gaaaacuauauacuaua

SEQ ID NO: 3296832 - RNA, 18 nt, Variola virus
aaacacugauucagaaau

SEQ ID NO: 3296833 - RNA, 21 nt, Variola virus
acuaguauaaaaucuguaucg

SEQ ID NO: 3296834 - RNA, 19 nt, Variola virus
uccauuauuuauuuacaga

SEQ ID NO: 3296835 - RNA, 17 nt, Variola virus
acaaauggucaaugaua

SEQ ID NO: 3296836 - RNA, 17 nt, Variola virus
uguacauuaauaaauga

SEQ ID NO: 3296837 - RNA, 23 nt, Variola virus
gcaguuagaacgguuauagcauc

SEQ ID NO: 3296838 - RNA, 21 nt, Variola virus
aaguuugaaacgagugaaaaa

SEQ ID NO: 3296839 - RNA, 19 nt, Variola virus
gacaugcuacaaaauaugu

SEQ ID NO: 3296840 - RNA, 17 nt, Variola virus
ucccauucuaauacuuu

SEQ ID NO: 3296841 - RNA, 19 nt, Variola virus
auaacuucuagauguagaa

SEQ ID NO: 3296842 - RNA, 14 nt, Variola virus
aucgauagacacug

SEQ ID NO: 3296843 - RNA, 12 nt, Variola virus
ucccauguuuca

SEQ ID NO: 3296844 - RNA, 21 nt, Variola virus
agacauuguugaauucuguga

SEQ ID NO: 3296845 - RNA, 20 nt, Variola virus
uuauaguguuuaacaaagau

SEQ ID NO: 3296846 - RNA, 21 nt, Variola virus
auauaagacacagaaauacug

SEQ ID NO: 3296847 - RNA, 15 nt, Variola virus
cuucaauagauaccu

SEQ ID NO: 3296848 - RNA, 22 nt, Variola virus
accaauaugucuguacaaaugu

SEQ ID NO: 3296849 - RNA, 20 nt, Variola virus
auaaaaacaauacaguauau

SEQ ID NO: 3296850 - RNA, 15 nt, Variola virus
auaaugaucauauag

SEQ ID NO: 3296851 - RNA, 22 nt, Variola virus
uuaugaauggauaccuguauua

SEQ ID NO: 3296852 - RNA, 15 nt, Variola virus
uaauuccaaaagaug

SEQ ID NO: 3296853 - RNA, 19 nt, Variola virus
guguagcguuuuaaauauu

SEQ ID NO: 3296854 - RNA, 19 nt, Variola virus
augauuauaguuucuauuu

SEQ ID NO: 3296855 - RNA, 16 nt, Variola virus
aagaguuucaaaaaua

SEQ ID NO: 3296856 - RNA, 15 nt, Variola virus
aaaaauguuaauuua

SEQ ID NO: 3296857 - RNA, 20 nt, Variola virus
guuagaucgucuauauauga

SEQ ID NO: 3296858 - RNA, 17 nt, Variola virus
guaauuuaacuauuuua

SEQ ID NO: 3296859 - RNA, 22 nt, Variola virus
aauauaguauauaauaaagaua

SEQ ID NO: 3296860 - RNA, 15 nt, Variola virus
cauaauccauuucca

SEQ ID NO: 3296861 - RNA, 19 nt, Variola virus
guauaauagacauaaugac

SEQ ID NO: 3296862 - RNA, 15 nt, Variola virus
agagagcagaaauaa

SEQ ID NO: 3296863 - RNA, 17 nt, Variola virus
ucuacuauuuguguauu

SEQ ID NO: 3296864 - RNA, 15 nt, Variola virus
gcaauauauauacag

SEQ ID NO: 3296865 - RNA, 15 nt, Variola virus
uaaaaaaaauuauuu

SEQ ID NO: 3296866 - RNA, 14 nt, Variola virus
uguaaauauaucua

SEQ ID NO: 3296867 - RNA, 19 nt, Variola virus
uuuaaugugugaaaacagu

SEQ ID NO: 3296868 - RNA, 15 nt, Variola virus
guaauacuuuuaguu

SEQ ID NO: 3296869 - RNA, 20 nt, Variola virus
gaugaaaaauuuguagauuu

SEQ ID NO: 3296870 - RNA, 15 nt, Variola virus
uauaugagaugacuu

SEQ ID NO: 3296871 - RNA, 18 nt, Variola virus
ucucccauuaucuuggua

SEQ ID NO: 3296872 - RNA, 19 nt, Variola virus
aaauacguucuauugugua

SEQ ID NO: 3296873 - RNA, 20 nt, Variola virus
caacaaauucugcaauaucu

SEQ ID NO: 3296874 - RNA, 18 nt, Variola virus
caucuaguugauauucca

SEQ ID NO: 3296875 - RNA, 16 nt, Variola virus
aauaccaaugcucaag

SEQ ID NO: 3296876 - RNA, 15 nt, Variola virus
uggcaauguuucaua

SEQ ID NO: 3296877 - RNA, 14 nt, Variola virus
ucuaucauagauuu

SEQ ID NO: 3296878 - RNA, 20 nt, Variola virus
aauaugauuagaaguuauau

SEQ ID NO: 3296879 - RNA, 22 nt, Variola virus
cguauacuuuuuaauucucuau

SEQ ID NO: 3296880 - RNA, 12 nt, Variola virus
auauauuuucca

SEQ ID NO: 3296881 - RNA, 20 nt, Variola virus
aauaguagaaucaaaggaua

SEQ ID NO: 3296882 - RNA, 21 nt, Variola virus
uauuggauucguguaaucaua

SEQ ID NO: 3296883 - RNA, 23 nt, Variola virus
aauacaaaacagaaaacaaaguc

SEQ ID NO: 3296884 - RNA, 15 nt, Variola virus
gcauuaaaugaugaa

SEQ ID NO: 3296885 - RNA, 19 nt, Variola virus
cguuaaagaauuuaacaau

SEQ ID NO: 3296886 - RNA, 22 nt, Variola virus
auaacauucuaggaauguuguu

SEQ ID NO: 3296887 - RNA, 18 nt, Variola virus
uuaagaauugucuguaaa

SEQ ID NO: 3296888 - RNA, 22 nt, Variola virus
cuauacauugcgccaucguguu

SEQ ID NO: 3296889 - RNA, 14 nt, Variola virus
cuaugcuauuugcg

SEQ ID NO: 3296890 - RNA, 19 nt, Variola virus
aaguucauuaucugaaaua

SEQ ID NO: 3296891 - RNA, 14 nt, Variola virus
ucauauguaguguu

SEQ ID NO: 3296892 - RNA, 15 nt, Variola virus
auaauuccaucuacu

SEQ ID NO: 3296893 - RNA, 22 nt, Variola virus
aaucguaucggaguacggagau

SEQ ID NO: 3296894 - RNA, 21 nt, Variola virus
auugcauuuugauaguuuauc

SEQ ID NO: 3296895 - RNA, 19 nt, Variola virus
acauccuuccaagaagaag

SEQ ID NO: 3296896 - RNA, 19 nt, Variola virus
caacucucaaguauccauc

SEQ ID NO: 3296897 - RNA, 21 nt, Variola virus
agacaauugacaaaauucaca

SEQ ID NO: 3296898 - RNA, 15 nt, Variola virus
aauucuuaucaauaa

SEQ ID NO: 3296899 - RNA, 22 nt, Variola virus
uguccuauuucaaaaguuuuua

SEQ ID NO: 3296900 - RNA, 13 nt, Variola virus
gacaaauuauucu

SEQ ID NO: 3296901 - RNA, 22 nt, Variola virus
ccaucaaaagcauuaauacagu

SEQ ID NO: 3296902 - RNA, 16 nt, Variola virus
uaauauaaaaacauua

SEQ ID NO: 3296903 - RNA, 15 nt, Variola virus
cuaacuuuaaacaag

SEQ ID NO: 3296904 - RNA, 23 nt, Variola virus
ucuagcuuauugaguggaaaguu

SEQ ID NO: 3296905 - RNA, 21 nt, Variola virus
cuauuguuaaucaugccacca

SEQ ID NO: 3296906 - RNA, 15 nt, Variola virus
uaauucuuucuccac

SEQ ID NO: 3296907 - RNA, 23 nt, Variola virus
guugaucacauuuagauaagaag

SEQ ID NO: 3296908 - RNA, 15 nt, Variola virus
ucuguagucacuuaa

SEQ ID NO: 3296909 - RNA, 12 nt, Variola virus
cuuuaaaaauuu

SEQ ID NO: 3296910 - RNA, 22 nt, Variola virus
auauacucuaaucuuuaauaga

SEQ ID NO: 3296911 - RNA, 22 nt, Variola virus
auguguguccggaguuagaaag

SEQ ID NO: 3296912 - RNA, 13 nt, Variola virus
auuaauaaugacg

SEQ ID NO: 3296913 - RNA, 18 nt, Variola virus
gaguaguacaagaaauac

SEQ ID NO: 3296914 - RNA, 14 nt, Variola virus
uuugcuauuucuau

SEQ ID NO: 3296915 - RNA, 15 nt, Variola virus
cugugcaucaacagu

SEQ ID NO: 3296916 - RNA, 18 nt, Variola virus
uagaaacaugucuagaaa

SEQ ID NO: 3296917 - RNA, 16 nt, Variola virus
aucaacgaguuaaaaa

SEQ ID NO: 3296918 - RNA, 21 nt, Variola virus
cgaucuuguuguuuauuuuca

SEQ ID NO: 3296919 - RNA, 19 nt, Variola virus
caauuaauuaauacaguaa

SEQ ID NO: 3296920 - RNA, 19 nt, Variola virus
cucauuuuuugaauauacu

SEQ ID NO: 3296921 - RNA, 18 nt, Variola virus
ggauuaauauaugucaua

SEQ ID NO: 3296922 - RNA, 15 nt, Variola virus
ucuuaaaaauacuua

SEQ ID NO: 3296923 - RNA, 18 nt, Variola virus
aguuaaaacuuuaucauc

SEQ ID NO: 3296924 - RNA, 20 nt, Variola virus
ugagauguuauuaaauguug

SEQ ID NO: 3296925 - RNA, 18 nt, Variola virus
ucucagaaucaaauauag

SEQ ID NO: 3296926 - RNA, 15 nt, Variola virus
aacaucuaacuauau

SEQ ID NO: 3296927 - RNA, 19 nt, Variola virus
ccauacucgucauccucau

SEQ ID NO: 3296928 - RNA, 15 nt, Variola virus
gauguaguaguauau

SEQ ID NO: 3296929 - RNA, 13 nt, Variola virus
auucguaaaucuu

SEQ ID NO: 3296930 - RNA, 22 nt, Variola virus
gacacugccguauauaggaaaa

SEQ ID NO: 3296931 - RNA, 20 nt, Variola virus
uaaugaugaccuauaugccc

SEQ ID NO: 3296932 - RNA, 17 nt, Variola virus
caaaauccuauauugua

SEQ ID NO: 3296933 - RNA, 13 nt, Variola virus
ucaaaaauuuaga

SEQ ID NO: 3296934 - RNA, 21 nt, Variola virus
uaaaauuagaugugucauacu

SEQ ID NO: 3296935 - RNA, 18 nt, Variola virus
augugaauuuagcauaua

SEQ ID NO: 3296936 - RNA, 21 nt, Variola virus
acaccaucuucauaauaaaua

SEQ ID NO: 3296937 - RNA, 14 nt, Variola virus
agcugcaucuaaau

SEQ ID NO: 3296938 - RNA, 13 nt, Variola virus
uaggauucucauc

SEQ ID NO: 3296939 - RNA, 16 nt, Variola virus
aaguuaaauagaaugc

SEQ ID NO: 3296940 - RNA, 18 nt, Variola virus
auacauaguugugaucau

SEQ ID NO: 3296941 - RNA, 19 nt, Variola virus
aucuggaggauguauauau

SEQ ID NO: 3296942 - RNA, 18 nt, Variola virus
cucaaaugaauaaguuua

SEQ ID NO: 3296943 - RNA, 13 nt, Variola virus
uaaguucuuuaua

SEQ ID NO: 3296944 - RNA, 19 nt, Variola virus
agcgcugaaaauaaagaua

SEQ ID NO: 3296945 - RNA, 16 nt, Variola virus
uaggaguuagaauaau

SEQ ID NO: 3296946 - RNA, 16 nt, Variola virus
auuucaaucaaacaaa

SEQ ID NO: 3296947 - RNA, 23 nt, Variola virus
agaaccacuauguuaauacuuau

SEQ ID NO: 3296948 - RNA, 16 nt, Variola virus
uuaaaaaguuaucuuu

SEQ ID NO: 3296949 - RNA, 23 nt, Variola virus
caaacaauuaauuaauacaguaa

SEQ ID NO: 3296950 - RNA, 14 nt, Variola virus
uaucccccguauuu

SEQ ID NO: 3296951 - RNA, 16 nt, Variola virus
ccuauaaacaugaauu

SEQ ID NO: 3296952 - RNA, 19 nt, Variola virus
aaagauuugcuucuaaaau

SEQ ID NO: 3296953 - RNA, 12 nt, Variola virus
aucguccuaaua

SEQ ID NO: 3296954 - RNA, 18 nt, Variola virus
uagacauuagauaugcca

SEQ ID NO: 3296955 - RNA, 17 nt, Variola virus
aaucccgucucagaaag

SEQ ID NO: 3296956 - RNA, 14 nt, Variola virus
uuaauauuacuguu

SEQ ID NO: 3296957 - RNA, 14 nt, Variola virus
uagcgacaggugau

SEQ ID NO: 3296958 - RNA, 20 nt, Variola virus
cuauaaaaaaaauaauaauu

SEQ ID NO: 3296959 - RNA, 11 nt, Variola virus
auauggaugag

SEQ ID NO: 3296960 - RNA, 15 nt, Variola virus
gaacauaauaauaua

SEQ ID NO: 3296961 - RNA, 22 nt, Variola virus
aaacacgucaaagguuaacauc

SEQ ID NO: 3296962 - RNA, 17 nt, Variola virus
ugauuaguauuuucuau

SEQ ID NO: 3296963 - RNA, 15 nt, Variola virus
gauagaacaaaauac

SEQ ID NO: 3296964 - RNA, 20 nt, Variola virus
ucauuaacuagacguuuauu

SEQ ID NO: 3296965 - RNA, 13 nt, Variola virus
acgucauuucauc

SEQ ID NO: 3296966 - RNA, 17 nt, Variola virus
aaugcuugaaaauggac

SEQ ID NO: 3296967 - RNA, 15 nt, Variola virus
auccuauucuaaaug

SEQ ID NO: 3296968 - RNA, 15 nt, Variola virus
ugcaacauuaacauc

SEQ ID NO: 3296969 - RNA, 22 nt, Variola virus
uauagauggagguaauuggcau

SEQ ID NO: 3296970 - RNA, 17 nt, Variola virus
aauuaaucauauacaac

SEQ ID NO: 3296971 - RNA, 21 nt, Variola virus
caucagauguuccggaaagag

SEQ ID NO: 3296972 - RNA, 16 nt, Variola virus
cuaguacugaggauuu

SEQ ID NO: 3296973 - RNA, 15 nt, Variola virus
aucuuuguucuuaag

SEQ ID NO: 3296974 - RNA, 14 nt, Variola virus
cgauaauagauagu

SEQ ID NO: 3296975 - RNA, 22 nt, Variola virus
uuacacuacauuuuuaucauaa

SEQ ID NO: 3296976 - RNA, 15 nt, Variola virus
auucuucgguaacuu

SEQ ID NO: 3296977 - RNA, 22 nt, Variola virus
ugauaugauuuuuaaucaagau

SEQ ID NO: 3296978 - RNA, 21 nt, Variola virus
ggacagauacuacuauuuguc

SEQ ID NO: 3296979 - RNA, 18 nt, Variola virus
auuauuacauagauguau

SEQ ID NO: 3296980 - RNA, 19 nt, Variola virus
agaaaacaaagucuagauu

SEQ ID NO: 3296981 - RNA, 18 nt, Variola virus
aauaaacaucaacauugu

SEQ ID NO: 3296982 - RNA, 20 nt, Variola virus
acugcaaaacuuaaauguua

SEQ ID NO: 3296983 - RNA, 15 nt, Variola virus
uaugacuaaacauuu

SEQ ID NO: 3296984 - RNA, 14 nt, Variola virus
gugauaauuuccag

SEQ ID NO: 3296985 - RNA, 18 nt, Variola virus
uacuaauaggucuaaaaa

SEQ ID NO: 3296986 - RNA, 24 nt, Variola virus
ugaaaugauaccaguaauuuacug

SEQ ID NO: 3296987 - RNA, 22 nt, Variola virus
cuuucaaugcacgggcacugau

SEQ ID NO: 3296988 - RNA, 22 nt, Variola virus
gacauaagucgccucaaagaua

SEQ ID NO: 3296989 - RNA, 12 nt, Variola virus
uuacuauuuugg

SEQ ID NO: 3296990 - RNA, 14 nt, Variola virus
cuuccaacauaaua

SEQ ID NO: 3296991 - RNA, 18 nt, Variola virus
uaucaauccaacaaaugc

SEQ ID NO: 3296992 - RNA, 22 nt, Variola virus
aauaauguaguaaauauaaaau

SEQ ID NO: 3296993 - RNA, 15 nt, Variola virus
acugauucagaaaug

SEQ ID NO: 3296994 - RNA, 20 nt, Variola virus
agaaaugaaguuaugacauu

SEQ ID NO: 3296995 - RNA, 22 nt, Variola virus
uauccaguuaagagaauaauag

SEQ ID NO: 3296996 - RNA, 18 nt, Variola virus
augcuauaccuaauacua

SEQ ID NO: 3296997 - RNA, 17 nt, Variola virus
uucucuuugauaaaagu

SEQ ID NO: 3296998 - RNA, 13 nt, Variola virus
gauucuuauucac

SEQ ID NO: 3296999 - RNA, 20 nt, Variola virus
gaauccaucucuauguuuca

SEQ ID NO: 3297000 - RNA, 16 nt, Variola virus
uaaagaaaagauaucc

SEQ ID NO: 3297001 - RNA, 13 nt, Variola virus
guuuaauauccuu

SEQ ID NO: 3297002 - RNA, 18 nt, Variola virus
cuauaaaacuacuacaau

SEQ ID NO: 3297003 - RNA, 23 nt, Variola virus
acuaaucgauuuugcauacucua

SEQ ID NO: 3297004 - RNA, 21 nt, Variola virus
gaauauugggcaaagauauuu

SEQ ID NO: 3297005 - RNA, 17 nt, Variola virus
uaguuuaucuuuuucua

SEQ ID NO: 3297006 - RNA, 19 nt, Variola virus
cguauaaaguuauauaauu

SEQ ID NO: 3297007 - RNA, 18 nt, Variola virus
uacauacgaauaacaaaa

SEQ ID NO: 3297008 - RNA, 14 nt, Variola virus
auguguagaauuaa

SEQ ID NO: 3297009 - RNA, 21 nt, Variola virus
cagcuccccuacguaucuaua

SEQ ID NO: 3297010 - RNA, 23 nt, Variola virus
ucaucauuaacaauccaauaaua

SEQ ID NO: 3297011 - RNA, 19 nt, Variola virus
aaucaaggaacuaaauaga

SEQ ID NO: 3297012 - RNA, 13 nt, Variola virus
agucgcuauuuuu

SEQ ID NO: 3297013 - RNA, 14 nt, Variola virus
ggaucuuaccaucu

SEQ ID NO: 3297014 - RNA, 19 nt, Variola virus
aaaguagaaaauauauucu

SEQ ID NO: 3297015 - RNA, 19 nt, Variola virus
ucuauuaauuauagaugua

SEQ ID NO: 3297016 - RNA, 19 nt, Variola virus
acgacucauuuaguuuauu

SEQ ID NO: 3297017 - RNA, 21 nt, Variola virus
uaucgauuagucuuaaugaua

SEQ ID NO: 3297018 - RNA, 17 nt, Variola virus
gccuuauauagcacuuu

SEQ ID NO: 3297019 - RNA, 18 nt, Variola virus
acguaaugaaguuaauga

SEQ ID NO: 3297020 - RNA, 17 nt, Variola virus
gauauaucaaaauuaga

SEQ ID NO: 3297021 - RNA, 18 nt, Variola virus
aucuacucauagaaaggu

SEQ ID NO: 3297022 - RNA, 19 nt, Variola virus
guuaauuaugcaaauuuga

SEQ ID NO: 3297023 - RNA, 18 nt, Variola virus
agauauaccagaacuauu

SEQ ID NO: 3297024 - RNA, 21 nt, Variola virus
aucuauuaaacagaaauggug

SEQ ID NO: 3297025 - RNA, 23 nt, Variola virus
auuaaaaacaaacuuuuuauccu

SEQ ID NO: 3297026 - RNA, 22 nt, Variola virus
uggcaacgacuauuuuagaaau

SEQ ID NO: 3297027 - RNA, 20 nt, Variola virus
ugaacuauuucuugaaugag

SEQ ID NO: 3297028 - RNA, 20 nt, Variola virus
auacuuuguccguaaaacau

SEQ ID NO: 3297029 - RNA, 13 nt, Variola virus
gugauuuuccaac

SEQ ID NO: 3297030 - RNA, 17 nt, Variola virus
uaaugacaauaauuaug

SEQ ID NO: 3297031 - RNA, 20 nt, Variola virus
uauccaaggacaaggaugaa

SEQ ID NO: 3297032 - RNA, 17 nt, Variola virus
agucuacugcuagaaaa

SEQ ID NO: 3297033 - RNA, 13 nt, Variola virus
gucucuuaaagga

SEQ ID NO: 3297034 - RNA, 17 nt, Variola virus
aaaugguaaauacugua

SEQ ID NO: 3297035 - RNA, 14 nt, Variola virus
cauauucuacucuu

SEQ ID NO: 3297036 - RNA, 15 nt, Variola virus
uauaauuuuuggaca

SEQ ID NO: 3297037 - RNA, 23 nt, Variola virus
uauggucucaucguuguuuagaa

SEQ ID NO: 3297038 - RNA, 15 nt, Variola virus
aauuuaaaaugagua

SEQ ID NO: 3297039 - RNA, 14 nt, Variola virus
uaauaguguuugaa

SEQ ID NO: 3297040 - RNA, 14 nt, Variola virus
aucuuauuuagaga

SEQ ID NO: 3297041 - RNA, 20 nt, Variola virus
uugauccuagaacuagauau

SEQ ID NO: 3297042 - RNA, 21 nt, Variola virus
aucgcuauaauucauauuaau

SEQ ID NO: 3297043 - RNA, 16 nt, Variola virus
caaguaacaacaaaaa

SEQ ID NO: 3297044 - RNA, 12 nt, Variola virus
uccaauguuuaa

SEQ ID NO: 3297045 - RNA, 15 nt, Variola virus
auuauuugacuuugu

SEQ ID NO: 3297046 - RNA, 19 nt, Variola virus
auucugccguguuuaaaaa

SEQ ID NO: 3297047 - RNA, 19 nt, Variola virus
gcgauuguagauaaugaaa

SEQ ID NO: 3297048 - RNA, 21 nt, Variola virus
uuauacaucgaauauaaaaua

SEQ ID NO: 3297049 - RNA, 22 nt, Variola virus
aaacuuuagaagaauaucucaa

SEQ ID NO: 3297050 - RNA, 12 nt, Variola virus
aaucugaaaaug

SEQ ID NO: 3297051 - RNA, 16 nt, Variola virus
gaaaauuuauaaacua

SEQ ID NO: 3297052 - RNA, 20 nt, Variola virus
cgauuuauaaaaaaauaccg

SEQ ID NO: 3297053 - RNA, 18 nt, Variola virus
uaccuuucuacaugaaau

SEQ ID NO: 3297054 - RNA, 12 nt, Variola virus
auaaaaauaugg

SEQ ID NO: 3297055 - RNA, 14 nt, Variola virus
gauuauacagguua

SEQ ID NO: 3297056 - RNA, 16 nt, Variola virus
auuuauuuaaaaugau

SEQ ID NO: 3297057 - RNA, 17 nt, Variola virus
agaacuaccaauauguc

SEQ ID NO: 3297058 - RNA, 10 nt, Variola virus
guauuuccau

SEQ ID NO: 3297059 - RNA, 22 nt, Variola virus
uaaauaauucucugaugucauu

SEQ ID NO: 3297060 - RNA, 22 nt, Variola virus
aguuuucucuuggcuucuucca

SEQ ID NO: 3297061 - RNA, 22 nt, Variola virus
gcacuguguauuauuuaguuca

SEQ ID NO: 3297062 - RNA, 16 nt, Variola virus
ugguuuaguucaucua

SEQ ID NO: 3297063 - RNA, 21 nt, Variola virus
caaaauacucaggaagauauu

SEQ ID NO: 3297064 - RNA, 17 nt, Variola virus
ugugacuagacugauuu

SEQ ID NO: 3297065 - RNA, 23 nt, Variola virus
acuauuacagaaguuuuaaaaga

SEQ ID NO: 3297066 - RNA, 17 nt, Variola virus
auaauaugacucaugau

SEQ ID NO: 3297067 - RNA, 20 nt, Variola virus
uagagaccgcgucuguuaua

SEQ ID NO: 3297068 - RNA, 15 nt, Variola virus
uaugacuuaauagca

SEQ ID NO: 3297069 - RNA, 21 nt, Variola virus
accaauaaaaauaaacuagaa

SEQ ID NO: 3297070 - RNA, 14 nt, Variola virus
uuuacucuucuaaa

SEQ ID NO: 3297071 - RNA, 15 nt, Variola virus
uaucuaauaauauua

SEQ ID NO: 3297072 - RNA, 12 nt, Variola virus
aguaaauacaau

SEQ ID NO: 3297073 - RNA, 12 nt, Variola virus
acuacaauaauu

SEQ ID NO: 3297074 - RNA, 23 nt, Variola virus
agggguuguauuguuauuuuaca

SEQ ID NO: 3297075 - RNA, 19 nt, Variola virus
uaccuggaauguaaagccc

SEQ ID NO: 3297076 - RNA, 22 nt, Variola virus
acgaucgauacuuugguuuauu

SEQ ID NO: 3297077 - RNA, 14 nt, Variola virus
auucacuuaacaau

SEQ ID NO: 3297078 - RNA, 12 nt, Variola virus
ucaauuauacuc

SEQ ID NO: 3297079 - RNA, 15 nt, Variola virus
agauacauaaaacuu

SEQ ID NO: 3297080 - RNA, 21 nt, Variola virus
augucaaaggaugaaagaaag

SEQ ID NO: 3297081 - RNA, 22 nt, Variola virus
aguacucucuuauaaaguggau

SEQ ID NO: 3297082 - RNA, 13 nt, Variola virus
ggaggaauugaua

SEQ ID NO: 3297083 - RNA, 12 nt, Variola virus
gaaaaaauaacu

SEQ ID NO: 3297084 - RNA, 16 nt, Variola virus
auuucaaauauauuua

SEQ ID NO: 3297085 - RNA, 23 nt, Variola virus
gauuggucuuaaaagauauuaau

SEQ ID NO: 3297086 - RNA, 20 nt, Variola virus
cuucuaaugauauauuuucc

SEQ ID NO: 3297087 - RNA, 19 nt, Variola virus
ggaaaggaugauucaucaa

SEQ ID NO: 3297088 - RNA, 22 nt, Variola virus
agucacgaucaccacuuucaua

SEQ ID NO: 3297089 - RNA, 14 nt, Variola virus
aguaaaaagacuaa

SEQ ID NO: 3297090 - RNA, 14 nt, Variola virus
acauugauuaaaga

SEQ ID NO: 3297091 - RNA, 15 nt, Variola virus
gaagugguuaaucuu

SEQ ID NO: 3297092 - RNA, 16 nt, Variola virus
aauugauaauauaaau

SEQ ID NO: 3297093 - RNA, 19 nt, Variola virus
acaauuauuauauaauucu

SEQ ID NO: 3297094 - RNA, 12 nt, Variola virus
aauaauguucaa

SEQ ID NO: 3297095 - RNA, 13 nt, Variola virus
cuugcaaguuaaa

SEQ ID NO: 3297096 - RNA, 21 nt, Variola virus
uuuaucuuucccccuagauac

SEQ ID NO: 3297097 - RNA, 13 nt, Variola virus
augauacgugcau

SEQ ID NO: 3297098 - RNA, 22 nt, Variola virus
gaucuauucaagaugaaaucgu

SEQ ID NO: 3297099 - RNA, 21 nt, Variola virus
agaauuauaccaauagauaau

SEQ ID NO: 3297100 - RNA, 21 nt, Variola virus
auggucauguuuauuucuagc

SEQ ID NO: 3297101 - RNA, 15 nt, Variola virus
aguuauuuacuuuga

SEQ ID NO: 3297102 - RNA, 15 nt, Variola virus
agguagcaaaaaaac

SEQ ID NO: 3297103 - RNA, 16 nt, Variola virus
ucuaucuuuuauuuua

SEQ ID NO: 3297104 - RNA, 18 nt, Variola virus
uuuaaauagcauagauau

SEQ ID NO: 3297105 - RNA, 20 nt, Variola virus
aucagaugauaucaguauau

SEQ ID NO: 3297106 - RNA, 12 nt, Variola virus
acuauugccauc

SEQ ID NO: 3297107 - RNA, 16 nt, Variola virus
cgaaacuuagaagagu

SEQ ID NO: 3297108 - RNA, 19 nt, Variola virus
gaugaauuaucguuauuau

SEQ ID NO: 3297109 - RNA, 16 nt, Variola virus
auuuucuacaauaacu

SEQ ID NO: 3297110 - RNA, 23 nt, Variola virus
ugcaucuauauaaucuuuuucau

SEQ ID NO: 3297111 - RNA, 23 nt, Variola virus
auguacucacggcuacggcauua

SEQ ID NO: 3297112 - RNA, 18 nt, Variola virus
ugauauguauauuauuca

SEQ ID NO: 3297113 - RNA, 14 nt, Variola virus
aggaagaaaauauu

SEQ ID NO: 3297114 - RNA, 12 nt, Variola virus
uaauauaaacau

SEQ ID NO: 3297115 - RNA, 17 nt, Variola virus
aagucuuacaauguuug

SEQ ID NO: 3297116 - RNA, 23 nt, Variola virus
gauauuuagcaauuucugauucu

SEQ ID NO: 3297117 - RNA, 12 nt, Variola virus
uuuuccaugaua

SEQ ID NO: 3297118 - RNA, 14 nt, Variola virus
ggaugauaugaaga

SEQ ID NO: 3297119 - RNA, 14 nt, Variola virus
aauuauuauccaau

SEQ ID NO: 3297120 - RNA, 18 nt, Variola virus
uaaauuaguagaaaauac

SEQ ID NO: 3297121 - RNA, 19 nt, Variola virus
auuuguucguaugucauaa

SEQ ID NO: 3297122 - RNA, 14 nt, Variola virus
ucacguuaauaacg

SEQ ID NO: 3297123 - RNA, 16 nt, Variola virus
caucaaaaaacaacug

SEQ ID NO: 3297124 - RNA, 13 nt, Variola virus
aaaauauguauaa

SEQ ID NO: 3297125 - RNA, 21 nt, Variola virus
aaauuauuccaauuauuugaa

SEQ ID NO: 3297126 - RNA, 18 nt, Variola virus
ucaaaaaaagauuauucg

SEQ ID NO: 3297127 - RNA, 15 nt, Variola virus
aaguaaauacugaau

SEQ ID NO: 3297128 - RNA, 21 nt, Variola virus
gaucagguaaaacaauaaucg

SEQ ID NO: 3297129 - RNA, 15 nt, Variola virus
aucuuuuuaggaaug

SEQ ID NO: 3297130 - RNA, 20 nt, Variola virus
uucuaauggaugauguucua

SEQ ID NO: 3297131 - RNA, 15 nt, Variola virus
gaaagcgagaaauaa

SEQ ID NO: 3297132 - RNA, 20 nt, Variola virus
aauucuacaacauuauuaua

SEQ ID NO: 3297133 - RNA, 19 nt, Variola virus
auaagagaucuaguaacua

SEQ ID NO: 3297134 - RNA, 12 nt, Variola virus
ucugaauuauug

SEQ ID NO: 3297135 - RNA, 14 nt, Variola virus
acaauuuuaacaga

SEQ ID NO: 3297136 - RNA, 16 nt, Variola virus
ugggcucaaugucuua

SEQ ID NO: 3297137 - RNA, 16 nt, Variola virus
ccaucgauuguuuauu

SEQ ID NO: 3297138 - RNA, 14 nt, Variola virus
aaacauauucuaug

SEQ ID NO: 3297139 - RNA, 17 nt, Variola virus
cuagaauuagaauuaca

SEQ ID NO: 3297140 - RNA, 18 nt, Variola virus
cagaauagauauuaaugu

SEQ ID NO: 3297141 - RNA, 16 nt, Variola virus
aacucaucuaccauuu

SEQ ID NO: 3297142 - RNA, 20 nt, Variola virus
auuccuaccaaacaaaauuu

SEQ ID NO: 3297143 - RNA, 19 nt, Variola virus
auuucuuauguuauuaaug

SEQ ID NO: 3297144 - RNA, 20 nt, Variola virus
aaauauuuucguugugaaga

SEQ ID NO: 3297145 - RNA, 15 nt, Variola virus
acuuugguaaauguu

SEQ ID NO: 3297146 - RNA, 21 nt, Variola virus
cacguaaccauucuaaacaau

SEQ ID NO: 3297147 - RNA, 13 nt, Variola virus
agaaauauauauu

SEQ ID NO: 3297148 - RNA, 16 nt, Variola virus
aaugugaaugaaaaua

SEQ ID NO: 3297149 - RNA, 15 nt, Variola virus
caagauaagcaaacg

SEQ ID NO: 3297150 - RNA, 13 nt, Variola virus
gucguaugaugaa

SEQ ID NO: 3297151 - RNA, 13 nt, Variola virus
guauugauaaaau

SEQ ID NO: 3297152 - RNA, 22 nt, Variola virus
guaaaccgauaguguauaaaga

SEQ ID NO: 3297153 - RNA, 20 nt, Variola virus
aauaagaaauaugaaaucua

SEQ ID NO: 3297154 - RNA, 14 nt, Variola virus
cgaaccagaaagug

SEQ ID NO: 3297155 - RNA, 21 nt, Variola virus
acuaauuaagcauauucuuaa

SEQ ID NO: 3297156 - RNA, 16 nt, Variola virus
accaaaucaaaacaaa

SEQ ID NO: 3297157 - RNA, 14 nt, Variola virus
auauaguaccuaga

SEQ ID NO: 3297158 - RNA, 14 nt, Variola virus
uuguacaaauuccu

SEQ ID NO: 3297159 - RNA, 14 nt, Variola virus
caucaaaaaacaac

SEQ ID NO: 3297160 - RNA, 17 nt, Variola virus
cuacaguaauguccaaa

SEQ ID NO: 3297161 - RNA, 14 nt, Variola virus
auaauuauaagacu

SEQ ID NO: 3297162 - RNA, 22 nt, Variola virus
aacaucuaauugugauaaaugu

SEQ ID NO: 3297163 - RNA, 17 nt, Variola virus
aauaaauauaacuuauu

SEQ ID NO: 3297164 - RNA, 22 nt, Variola virus
cuccuguaucuguuaaaacuac

SEQ ID NO: 3297165 - RNA, 14 nt, Variola virus
auaacuuuuucaau

SEQ ID NO: 3297166 - RNA, 14 nt, Variola virus
uaaacuuuaacaau

SEQ ID NO: 3297167 - RNA, 19 nt, Variola virus
acagaugagagauaauaua

SEQ ID NO: 3297168 - RNA, 18 nt, Variola virus
aauuacugauaauguaga

SEQ ID NO: 3297169 - RNA, 23 nt, Variola virus
uagauucuauugugucuguuaau

SEQ ID NO: 3297170 - RNA, 14 nt, Variola virus
uaaacgcguguaau

SEQ ID NO: 3297171 - RNA, 23 nt, Variola virus
agaaauaaaggcagaaauacaau

SEQ ID NO: 3297172 - RNA, 12 nt, Variola virus
auuauucauuuu

SEQ ID NO: 3297173 - RNA, 15 nt, Variola virus
aaagucugaucuuaa

SEQ ID NO: 3297174 - RNA, 16 nt, Variola virus
caaauggauguuaaug

SEQ ID NO: 3297175 - RNA, 16 nt, Variola virus
ucauuaacuagacguu

SEQ ID NO: 3297176 - RNA, 21 nt, Variola virus
cucguaugaaagauuaauuug

SEQ ID NO: 3297177 - RNA, 21 nt, Variola virus
uauucaucgucgacuaucaac

SEQ ID NO: 3297178 - RNA, 14 nt, Variola virus
uaaaccauuuuuca

SEQ ID NO: 3297179 - RNA, 20 nt, Variola virus
aaaacauuauaauaauauaa

SEQ ID NO: 3297180 - RNA, 22 nt, Variola virus
aguacccacugaugagauguua

SEQ ID NO: 3297181 - RNA, 14 nt, Variola virus
aaauauauacuuca

SEQ ID NO: 3297182 - RNA, 16 nt, Variola virus
uuguagauuuaucaua

SEQ ID NO: 3297183 - RNA, 18 nt, Variola virus
uuuauuagcguacacauu

SEQ ID NO: 3297184 - RNA, 12 nt, Variola virus
uucaucagauau

SEQ ID NO: 3297185 - RNA, 20 nt, Variola virus
gaagaauucuagaucaagaa

SEQ ID NO: 3297186 - RNA, 12 nt, Variola virus
auuacaaacaug

SEQ ID NO: 3297187 - RNA, 17 nt, Variola virus
uaguaaucguuaucauu

SEQ ID NO: 3297188 - RNA, 14 nt, Variola virus
guacaacauuccaa

SEQ ID NO: 3297189 - RNA, 19 nt, Variola virus
ucucuauucugaaauaauu

SEQ ID NO: 3297190 - RNA, 19 nt, Variola virus
cuauuagaucauuaacaga

SEQ ID NO: 3297191 - RNA, 15 nt, Variola virus
uacccaauaaaaugu

SEQ ID NO: 3297192 - RNA, 19 nt, Variola virus
guaucgacgguaaauggaa

SEQ ID NO: 3297193 - RNA, 20 nt, Variola virus
uauuucaaaauuauuuacca

SEQ ID NO: 3297194 - RNA, 19 nt, Variola virus
uuuauaucugauuuuucuu

SEQ ID NO: 3297195 - RNA, 18 nt, Variola virus
ucaguugcuguugaagag

SEQ ID NO: 3297196 - RNA, 19 nt, Variola virus
ucuaaugugauucucugaa

SEQ ID NO: 3297197 - RNA, 13 nt, Variola virus
aaauaaugaccaa

SEQ ID NO: 3297198 - RNA, 15 nt, Variola virus
gugcagauaaucauu

SEQ ID NO: 3297199 - RNA, 15 nt, Variola virus
ucguacuauauacaa

SEQ ID NO: 3297200 - RNA, 20 nt, Variola virus
uaguuuguaauuuuaacaua

SEQ ID NO: 3297201 - RNA, 16 nt, Variola virus
aucuaauuuacuaucu

SEQ ID NO: 3297202 - RNA, 23 nt, Variola virus
uucuccaugaauuaauacauauu

SEQ ID NO: 3297203 - RNA, 13 nt, Variola virus
aggaacaaauauu

SEQ ID NO: 3297204 - RNA, 12 nt, Variola virus
ccauuuuagaga

SEQ ID NO: 3297205 - RNA, 16 nt, Variola virus
uguaauuacauacuuu

SEQ ID NO: 3297206 - RNA, 13 nt, Variola virus
uagcaauugcauu

SEQ ID NO: 3297207 - RNA, 16 nt, Variola virus
cauuagagaaauguac

SEQ ID NO: 3297208 - RNA, 17 nt, Variola virus
uccaaaaagaaugagua

SEQ ID NO: 3297209 - RNA, 20 nt, Variola virus
cgacuacucuggguaacaaa

SEQ ID NO: 3297210 - RNA, 19 nt, Variola virus
ucuauuccaaauauucaga

SEQ ID NO: 3297211 - RNA, 18 nt, Variola virus
aaucuagauuccaaucau

SEQ ID NO: 3297212 - RNA, 16 nt, Variola virus
gauccaggguauuaua

SEQ ID NO: 3297213 - RNA, 13 nt, Variola virus
ucaauuuguacau

SEQ ID NO: 3297214 - RNA, 15 nt, Variola virus
cuaaacuuauuuaga

SEQ ID NO: 3297215 - RNA, 16 nt, Variola virus
cgcuuaacaucuucua

SEQ ID NO: 3297216 - RNA, 20 nt, Variola virus
acuucucuguccuuaauaag

SEQ ID NO: 3297217 - RNA, 17 nt, Variola virus
uauaaaauagaaaauaa

SEQ ID NO: 3297218 - RNA, 21 nt, Variola virus
uccauaaacaauauuaaggag

SEQ ID NO: 3297219 - RNA, 21 nt, Variola virus
acaaauaauuacaaaaccgau

SEQ ID NO: 3297220 - RNA, 12 nt, Variola virus
cuucaucuguaa

SEQ ID NO: 3297221 - RNA, 16 nt, Variola virus
acuagacuauuaauaa

SEQ ID NO: 3297222 - RNA, 19 nt, Variola virus
uuagaucuuuuacacuguu

SEQ ID NO: 3297223 - RNA, 20 nt, Variola virus
uauaaaggaauaaaauauga

SEQ ID NO: 3297224 - RNA, 21 nt, Variola virus
uugucguaaauacaugucuaa

SEQ ID NO: 3297225 - RNA, 15 nt, Variola virus
caucuguuguaucau

SEQ ID NO: 3297226 - RNA, 17 nt, Variola virus
uauaaaucaaauacuug

SEQ ID NO: 3297227 - RNA, 19 nt, Variola virus
auuaaucuaguagaaaaga

SEQ ID NO: 3297228 - RNA, 16 nt, Variola virus
cuguauuaaagauauu

SEQ ID NO: 3297229 - RNA, 20 nt, Variola virus
uaaaccaucuuacuuaaaau

SEQ ID NO: 3297230 - RNA, 17 nt, Variola virus
acauacgucuauuucua

SEQ ID NO: 3297231 - RNA, 19 nt, Variola virus
uagaugaacuuuaauucaa

SEQ ID NO: 3297232 - RNA, 13 nt, Variola virus
uucuagaccaaaa

SEQ ID NO: 3297233 - RNA, 19 nt, Variola virus
uucuaaaaugguaaacuuu

SEQ ID NO: 3297234 - RNA, 19 nt, Variola virus
cauguaacaauauuacaau

SEQ ID NO: 3297235 - RNA, 20 nt, Variola virus
ucuucgaaaagaaacagaua

SEQ ID NO: 3297236 - RNA, 15 nt, Variola virus
aaauuauaaugaaua

SEQ ID NO: 3297237 - RNA, 16 nt, Variola virus
augaagaauggaugau

SEQ ID NO: 3297238 - RNA, 14 nt, Variola virus
uaguuuauaucuuu

SEQ ID NO: 3297239 - RNA, 13 nt, Variola virus
uucaggaacauaa

SEQ ID NO: 3297240 - RNA, 21 nt, Variola virus
aauauuuaguuuauucauaau

SEQ ID NO: 3297241 - RNA, 14 nt, Variola virus
cugucaauaagaca

SEQ ID NO: 3297242 - RNA, 24 nt, Variola virus
caacaugauuauucuacuaucaaa

SEQ ID NO: 3297243 - RNA, 20 nt, Variola virus
acaaagauaccgaagaauua

SEQ ID NO: 3297244 - RNA, 19 nt, Variola virus
acauuaaucuauuagaauu

SEQ ID NO: 3297245 - RNA, 18 nt, Variola virus
uaaagucuacauugucau

SEQ ID NO: 3297246 - RNA, 18 nt, Variola virus
aaugacaucgcauuuaua

SEQ ID NO: 3297247 - RNA, 21 nt, Variola virus
acgucuccaauauaugauaac

SEQ ID NO: 3297248 - RNA, 17 nt, Variola virus
uuaaauccuuguuugau

SEQ ID NO: 3297249 - RNA, 19 nt, Variola virus
aauuauuuuuucuuaguaa

SEQ ID NO: 3297250 - RNA, 14 nt, Variola virus
auuuucuaacguga

SEQ ID NO: 3297251 - RNA, 18 nt, Variola virus
gaauauuuugauaaugaa

SEQ ID NO: 3297252 - RNA, 19 nt, Variola virus
guuauucucggaugcuaaa

SEQ ID NO: 3297253 - RNA, 22 nt, Variola virus
uuuucuacugaugcauguauuu

SEQ ID NO: 3297254 - RNA, 15 nt, Variola virus
agugcacuuagucca

SEQ ID NO: 3297255 - RNA, 23 nt, Variola virus
accaaugaauggauuaccguguu

SEQ ID NO: 3297256 - RNA, 15 nt, Variola virus
guguuuuaguuuauc

SEQ ID NO: 3297257 - RNA, 17 nt, Variola virus
aacuagucuauuucaua

SEQ ID NO: 3297258 - RNA, 16 nt, Variola virus
ccacuuugguaaaauc

SEQ ID NO: 3297259 - RNA, 17 nt, Variola virus
ucaugauggaugugugu

SEQ ID NO: 3297260 - RNA, 18 nt, Variola virus
cauguaugagaaaaacug

SEQ ID NO: 3297261 - RNA, 19 nt, Variola virus
cgaaugccaauguuaauuu

SEQ ID NO: 3297262 - RNA, 21 nt, Variola virus
gcaguuuuauuuuaucuuuua

SEQ ID NO: 3297263 - RNA, 17 nt, Variola virus
auaaacuagaaaaacuu

SEQ ID NO: 3297264 - RNA, 22 nt, Variola virus
acuauacauuuccgaaugaaug

SEQ ID NO: 3297265 - RNA, 15 nt, Variola virus
uauccagaugagucc

SEQ ID NO: 3297266 - RNA, 18 nt, Variola virus
cacauccaucaauuguaa

SEQ ID NO: 3297267 - RNA, 18 nt, Variola virus
uaucuacgauccaucaaa

SEQ ID NO: 3297268 - RNA, 17 nt, Variola virus
auaauuuagauacuuua

SEQ ID NO: 3297269 - RNA, 18 nt, Variola virus
caacuaguaucaucucua

SEQ ID NO: 3297270 - RNA, 18 nt, Variola virus
ucuuaacaaguucucaau

SEQ ID NO: 3297271 - RNA, 15 nt, Variola virus
auggaaauauuaaag

SEQ ID NO: 3297272 - RNA, 13 nt, Variola virus
caaguauaaugau

SEQ ID NO: 3297273 - RNA, 18 nt, Variola virus
cugacgauauuagaugau

SEQ ID NO: 3297274 - RNA, 19 nt, Variola virus
uuccuggaauaucauuaac

SEQ ID NO: 3297275 - RNA, 16 nt, Variola virus
acauuuguauaaucuu

SEQ ID NO: 3297276 - RNA, 20 nt, Variola virus
acuaguggcagacugugcau

SEQ ID NO: 3297277 - RNA, 18 nt, Variola virus
uuucacaucguauuuuaa

SEQ ID NO: 3297278 - RNA, 14 nt, Variola virus
gaccuccuccacca

SEQ ID NO: 3297279 - RNA, 22 nt, Variola virus
aaaauuauacuguaacacaaug

SEQ ID NO: 3297280 - RNA, 22 nt, Variola virus
uggagaauguuccuaauguaua

SEQ ID NO: 3297281 - RNA, 12 nt, Variola virus
ccuccuccacca

SEQ ID NO: 3297282 - RNA, 15 nt, Variola virus
gauagacacauaugc

SEQ ID NO: 3297283 - RNA, 15 nt, Variola virus
uguccuaaaauacua

SEQ ID NO: 3297284 - RNA, 17 nt, Variola virus
aguuacaacuauuacaa

SEQ ID NO: 3297285 - RNA, 16 nt, Variola virus
cuacucauagaaaggu

SEQ ID NO: 3297286 - RNA, 14 nt, Variola virus
cuauggaacaaaau

SEQ ID NO: 3297287 - RNA, 23 nt, Variola virus
ugacaagauccaucuacuuuucc

SEQ ID NO: 3297288 - RNA, 14 nt, Variola virus
aucaaaacaaaauu

SEQ ID NO: 3297289 - RNA, 19 nt, Variola virus
auguucugauuuuaucuuu

SEQ ID NO: 3297290 - RNA, 15 nt, Variola virus
uuaauaauuguauug

SEQ ID NO: 3297291 - RNA, 21 nt, Variola virus
uaguugucuuagccuuaucaa

SEQ ID NO: 3297292 - RNA, 16 nt, Variola virus
aucgcauagaaauaca

SEQ ID NO: 3297293 - RNA, 14 nt, Variola virus
gguggauauuucug

SEQ ID NO: 3297294 - RNA, 15 nt, Variola virus
aacuauuuuuaacuu

SEQ ID NO: 3297295 - RNA, 18 nt, Variola virus
cauccguuguuauauacc

SEQ ID NO: 3297296 - RNA, 20 nt, Variola virus
augagacagauuaucauaua

SEQ ID NO: 3297297 - RNA, 21 nt, Variola virus
uuuuauuuuuggaauaaucuc

SEQ ID NO: 3297298 - RNA, 20 nt, Variola virus
caaagauauagaacacauaa

SEQ ID NO: 3297299 - RNA, 23 nt, Variola virus
acucuauuggauauggauuucca

SEQ ID NO: 3297300 - RNA, 13 nt, Variola virus
uugaauugcgauu

SEQ ID NO: 3297301 - RNA, 16 nt, Variola virus
caggcugucggagcca

SEQ ID NO: 3297302 - RNA, 14 nt, Variola virus
uagcaucaaaacua

SEQ ID NO: 3297303 - RNA, 13 nt, Variola virus
ucaaaagaaaucu

SEQ ID NO: 3297304 - RNA, 16 nt, Variola virus
uguauuaagaacagaa

SEQ ID NO: 3297305 - RNA, 20 nt, Variola virus
agagaucuucguuaaaaagu

SEQ ID NO: 3297306 - RNA, 16 nt, Variola virus
aacgucauaaaaaugu

SEQ ID NO: 3297307 - RNA, 14 nt, Variola virus
uaagccaaacucau

SEQ ID NO: 3297308 - RNA, 21 nt, Variola virus
ccgaaauugaccgagaaagaa

SEQ ID NO: 3297309 - RNA, 18 nt, Variola virus
caauaccaaagaaggaag

SEQ ID NO: 3297310 - RNA, 14 nt, Variola virus
auagcuacaguaaa

SEQ ID NO: 3297311 - RNA, 21 nt, Variola virus
aacuacaucgguaucuagauc

SEQ ID NO: 3297312 - RNA, 22 nt, Variola virus
guuuauaauuacaacauaauaa

SEQ ID NO: 3297313 - RNA, 21 nt, Variola virus
aucaucguuaggauuugguaa

SEQ ID NO: 3297314 - RNA, 14 nt, Variola virus
augcguacauaacu

SEQ ID NO: 3297315 - RNA, 15 nt, Variola virus
ucaauaaaugauuca

SEQ ID NO: 3297316 - RNA, 13 nt, Variola virus
gauagacuuucuc

SEQ ID NO: 3297317 - RNA, 16 nt, Variola virus
uacauaauucuucugu

SEQ ID NO: 3297318 - RNA, 12 nt, Variola virus
gcugaaaugaga

SEQ ID NO: 3297319 - RNA, 15 nt, Variola virus
cauuaccucaugaac

SEQ ID NO: 3297320 - RNA, 19 nt, Variola virus
ugacuccuuucuaauauag

SEQ ID NO: 3297321 - RNA, 14 nt, Variola virus
gcuauaaugaugau

SEQ ID NO: 3297322 - RNA, 21 nt, Variola virus
gucuaaauccaacuauagaca

SEQ ID NO: 3297323 - RNA, 22 nt, Variola virus
ucucuguuuaaugaauuacuaa

SEQ ID NO: 3297324 - RNA, 16 nt, Variola virus
guuaagccugaauuua

SEQ ID NO: 3297325 - RNA, 17 nt, Variola virus
aggagucgccaaaugua

SEQ ID NO: 3297326 - RNA, 16 nt, Variola virus
ugugauguuacggaua

SEQ ID NO: 3297327 - RNA, 14 nt, Variola virus
auuauauaauguau

SEQ ID NO: 3297328 - RNA, 17 nt, Variola virus
guacuuugaugauuuuu

SEQ ID NO: 3297329 - RNA, 20 nt, Variola virus
aucgauccucacuucgaaga

SEQ ID NO: 3297330 - RNA, 17 nt, Variola virus
gaccaagacacauaugg

SEQ ID NO: 3297331 - RNA, 18 nt, Variola virus
auaaucguauuuguguga

SEQ ID NO: 3297332 - RNA, 14 nt, Variola virus
uuaguuauugcaau

SEQ ID NO: 3297333 - RNA, 15 nt, Variola virus
cagggagccacagaa

SEQ ID NO: 3297334 - RNA, 17 nt, Variola virus
aaaaauaugggaaucua

SEQ ID NO: 3297335 - RNA, 14 nt, Variola virus
uagagaacauaaug

SEQ ID NO: 3297336 - RNA, 20 nt, Variola virus
aaucaguugcuguugaagag

SEQ ID NO: 3297337 - RNA, 14 nt, Variola virus
uuuuuauacauauu

SEQ ID NO: 3297338 - RNA, 15 nt, Variola virus
aauaaauuuuuccaa

SEQ ID NO: 3297339 - RNA, 14 nt, Variola virus
auuauuuuucacca

SEQ ID NO: 3297340 - RNA, 23 nt, Variola virus
auaauaccuucuacuaugcaauu

SEQ ID NO: 3297341 - RNA, 16 nt, Variola virus
aauaaguauagcaaau

SEQ ID NO: 3297342 - RNA, 14 nt, Variola virus
cgguuuuaacuuua

SEQ ID NO: 3297343 - RNA, 23 nt, Variola virus
aacucguuuuucuuaagaaauau

SEQ ID NO: 3297344 - RNA, 16 nt, Variola virus
auaucuauaugagaug

SEQ ID NO: 3297345 - RNA, 21 nt, Variola virus
uagcuaaagauuugucacaau

SEQ ID NO: 3297346 - RNA, 14 nt, Variola virus
uuuagauuuauuuu

SEQ ID NO: 3297347 - RNA, 21 nt, Variola virus
uugucauguugauacaucacu

SEQ ID NO: 3297348 - RNA, 14 nt, Variola virus
ucguccuuaaccaa

SEQ ID NO: 3297349 - RNA, 12 nt, Variola virus
uuaauauuauca

SEQ ID NO: 3297350 - RNA, 20 nt, Variola virus
ucuuugaugguguuagcaua

SEQ ID NO: 3297351 - RNA, 22 nt, Variola virus
gugucuuaucucguccuugguu

SEQ ID NO: 3297352 - RNA, 17 nt, Variola virus
uuaaacuacuacguucu

SEQ ID NO: 3297353 - RNA, 14 nt, Variola virus
guuaaagaaauuaa

SEQ ID NO: 3297354 - RNA, 16 nt, Variola virus
auaagaaauauauacu

SEQ ID NO: 3297355 - RNA, 16 nt, Variola virus
aauuaaucaaauggua

SEQ ID NO: 3297356 - RNA, 12 nt, Variola virus
auuuuaaauaca

SEQ ID NO: 3297357 - RNA, 13 nt, Variola virus
aauauguagaaaa

SEQ ID NO: 3297358 - RNA, 16 nt, Variola virus
cuaucagugaucuguu

SEQ ID NO: 3297359 - RNA, 20 nt, Variola virus
augagauuauuaaguauuua

SEQ ID NO: 3297360 - RNA, 14 nt, Variola virus
uaggguaucuaauu

SEQ ID NO: 3297361 - RNA, 12 nt, Variola virus
guuuaauaacuu

SEQ ID NO: 3297362 - RNA, 14 nt, Variola virus
uauaugauuaucaa

SEQ ID NO: 3297363 - RNA, 17 nt, Variola virus
gcagcgaacuugauauu

SEQ ID NO: 3297364 - RNA, 17 nt, Variola virus
uggaagguuuguauucu

SEQ ID NO: 3297365 - RNA, 14 nt, Variola virus
ccauugaaaacuau

SEQ ID NO: 3297366 - RNA, 15 nt, Variola virus
cuuuguuggaagaau

SEQ ID NO: 3297367 - RNA, 20 nt, Variola virus
uuuauaaacaugaaaccacu

SEQ ID NO: 3297368 - RNA, 20 nt, Variola virus
caaaagugacgucuuguauu

SEQ ID NO: 3297369 - RNA, 17 nt, Variola virus
auuguaaaagaaauaua

SEQ ID NO: 3297370 - RNA, 23 nt, Variola virus
auaguuaucuaucuuaaagacua

SEQ ID NO: 3297371 - RNA, 19 nt, Variola virus
aucagucaagauacagaaa

SEQ ID NO: 3297372 - RNA, 23 nt, Variola virus
guuucaaccgcguuaacauauga

SEQ ID NO: 3297373 - RNA, 22 nt, Variola virus
gacauaccugaucuacguucua

SEQ ID NO: 3297374 - RNA, 18 nt, Variola virus
ucuagccauaucuaaagc

SEQ ID NO: 3297375 - RNA, 20 nt, Variola virus
auaacguuagccaccacuuc

SEQ ID NO: 3297376 - RNA, 14 nt, Variola virus
aaaaauaauauuca

SEQ ID NO: 3297377 - RNA, 21 nt, Variola virus
uaaucuaaaauaguucuguaa

SEQ ID NO: 3297378 - RNA, 23 nt, Variola virus
aaucuguacuauguguuaaaaga

SEQ ID NO: 3297379 - RNA, 16 nt, Variola virus
acacgagccuuuauua

SEQ ID NO: 3297380 - RNA, 12 nt, Variola virus
aacaguauuauu

SEQ ID NO: 3297381 - RNA, 18 nt, Variola virus
ucaaaaugcugauuucga

SEQ ID NO: 3297382 - RNA, 12 nt, Variola virus
auucauuuccau

SEQ ID NO: 3297383 - RNA, 22 nt, Variola virus
cuaauagcgaucauucgcuuaa

SEQ ID NO: 3297384 - RNA, 14 nt, Variola virus
aauucauuagaaua

SEQ ID NO: 3297385 - RNA, 18 nt, Variola virus
uuguaaagaaauuauuuu

SEQ ID NO: 3297386 - RNA, 14 nt, Variola virus
aauauauuaccaug

SEQ ID NO: 3297387 - RNA, 19 nt, Variola virus
uaacaaaaauuaugaaaua

SEQ ID NO: 3297388 - RNA, 22 nt, Variola virus
aaugugauucucugaaaaugua

SEQ ID NO: 3297389 - RNA, 22 nt, Variola virus
auuaagaacccguuuauacagu

SEQ ID NO: 3297390 - RNA, 16 nt, Variola virus
gcaagacuaacacaca

SEQ ID NO: 3297391 - RNA, 16 nt, Variola virus
auuagagguaugggau

SEQ ID NO: 3297392 - RNA, 14 nt, Variola virus
gaauaaauuauuau

SEQ ID NO: 3297393 - RNA, 20 nt, Variola virus
aaauaacaccauuacacgaa

SEQ ID NO: 3297394 - RNA, 19 nt, Variola virus
uuuuugccaaauuuaucua

SEQ ID NO: 3297395 - RNA, 17 nt, Variola virus
aagagcaaauaucucau

SEQ ID NO: 3297396 - RNA, 18 nt, Variola virus
aacagaaacguuuagaga

SEQ ID NO: 3297397 - RNA, 17 nt, Variola virus
aacacauccgucaaaga

SEQ ID NO: 3297398 - RNA, 19 nt, Variola virus
aucccuuugauaaauagua

SEQ ID NO: 3297399 - RNA, 18 nt, Variola virus
agauuaccuauucacuua

SEQ ID NO: 3297400 - RNA, 14 nt, Variola virus
cuuacuaucuuuuu

SEQ ID NO: 3297401 - RNA, 16 nt, Variola virus
caaguaugacauugua

SEQ ID NO: 3297402 - RNA, 23 nt, Variola virus
agauuuuccauccacaauuauug

SEQ ID NO: 3297403 - RNA, 18 nt, Variola virus
aaauuuuuuauacauuau

SEQ ID NO: 3297404 - RNA, 22 nt, Variola virus
aaauugauagagaguucauuua

SEQ ID NO: 3297405 - RNA, 23 nt, Variola virus
auagauucauucuuuauagaaug

SEQ ID NO: 3297406 - RNA, 15 nt, Variola virus
uuggcgguucuaaug

SEQ ID NO: 3297407 - RNA, 11 nt, Variola virus
gagauaaaaga

SEQ ID NO: 3297408 - RNA, 16 nt, Variola virus
ucuaaaccuucuuauu

SEQ ID NO: 3297409 - RNA, 23 nt, Variola virus
aaacagauauaguuuuucuggaa

SEQ ID NO: 3297410 - RNA, 17 nt, Variola virus
uaacgaggacaaacuau

SEQ ID NO: 3297411 - RNA, 21 nt, Variola virus
uauguuuauuagcguacacau

SEQ ID NO: 3297412 - RNA, 23 nt, Variola virus
acuuuacaaacgauguacugaag

SEQ ID NO: 3297413 - RNA, 17 nt, Variola virus
ccggugagaacaugaga

SEQ ID NO: 3297414 - RNA, 13 nt, Variola virus
uacacagaaucag

SEQ ID NO: 3297415 - RNA, 16 nt, Variola virus
agaagcguguuauugu

SEQ ID NO: 3297416 - RNA, 15 nt, Variola virus
ucuauaagguuucuu

SEQ ID NO: 3297417 - RNA, 14 nt, Variola virus
acaaaucuggaaaa

SEQ ID NO: 3297418 - RNA, 16 nt, Variola virus
gcaucuaguugauauu

SEQ ID NO: 3297419 - RNA, 17 nt, Variola virus
auccaauauuauugaaa

SEQ ID NO: 3297420 - RNA, 22 nt, Variola virus
uuaagcauauucuuaauauuag

SEQ ID NO: 3297421 - RNA, 19 nt, Variola virus
uuuuccaucuauguagaau

SEQ ID NO: 3297422 - RNA, 14 nt, Variola virus
auacguaaugaagu

SEQ ID NO: 3297423 - RNA, 22 nt, Variola virus
cuaaaacuacguucgaugaauu

SEQ ID NO: 3297424 - RNA, 12 nt, Variola virus
uauuuuaaugag

SEQ ID NO: 3297425 - RNA, 18 nt, Variola virus
auguaauggauaauuucc

SEQ ID NO: 3297426 - RNA, 17 nt, Variola virus
ucuauugugucuguuaa

SEQ ID NO: 3297427 - RNA, 20 nt, Variola virus
cauuuggagaguauccucua

SEQ ID NO: 3297428 - RNA, 14 nt, Variola virus
gcuauuaaucuuua

SEQ ID NO: 3297429 - RNA, 21 nt, Variola virus
agauaaugauauauuaaacaa

SEQ ID NO: 3297430 - RNA, 22 nt, Variola virus
uguauauaggucagauacuggu

SEQ ID NO: 3297431 - RNA, 17 nt, Variola virus
ucuauuccuagaagugu

SEQ ID NO: 3297432 - RNA, 21 nt, Variola virus
agucauuccaucauuuaagaa

SEQ ID NO: 3297433 - RNA, 18 nt, Variola virus
uucguagaaaguaucuua

SEQ ID NO: 3297434 - RNA, 15 nt, Variola virus
agaauuaacuaguau

SEQ ID NO: 3297435 - RNA, 15 nt, Variola virus
uuaaucauugauuca

SEQ ID NO: 3297436 - RNA, 18 nt, Variola virus
uuccauccacaauuauug

SEQ ID NO: 3297437 - RNA, 17 nt, Variola virus
gaauauacaaguauuau

SEQ ID NO: 3297438 - RNA, 12 nt, Variola virus
aauaacaaauac

SEQ ID NO: 3297439 - RNA, 20 nt, Variola virus
uugcguacauugcucguaaa

SEQ ID NO: 3297440 - RNA, 17 nt, Variola virus
cugaauauagaacauca

SEQ ID NO: 3297441 - RNA, 14 nt, Variola virus
uacgaaaaaacuuu

SEQ ID NO: 3297442 - RNA, 18 nt, Variola virus
caaucuaagaaauuuaaa

SEQ ID NO: 3297443 - RNA, 14 nt, Variola virus
aaucaaacaaaaaa

SEQ ID NO: 3297444 - RNA, 15 nt, Variola virus
ucauuuccugcacgu

SEQ ID NO: 3297445 - RNA, 22 nt, Variola virus
caaaauucagauucuaucuuua

SEQ ID NO: 3297446 - RNA, 16 nt, Variola virus
cguuaaagguaacaau

SEQ ID NO: 3297447 - RNA, 16 nt, Variola virus
aagaugauauaaguua

SEQ ID NO: 3297448 - RNA, 16 nt, Variola virus
auauuaucguuuguaa

SEQ ID NO: 3297449 - RNA, 18 nt, Variola virus
auauucucuauuaaauac

SEQ ID NO: 3297450 - RNA, 20 nt, Variola virus
uauaauguaacguuuauaua

SEQ ID NO: 3297451 - RNA, 22 nt, Variola virus
cuuguaauugugggaacauaau

SEQ ID NO: 3297452 - RNA, 21 nt, Variola virus
aacuccacccauuacauauau

SEQ ID NO: 3297453 - RNA, 16 nt, Variola virus
aauccaugaauaaagu

SEQ ID NO: 3297454 - RNA, 18 nt, Variola virus
uaccaaucauuuauugau

SEQ ID NO: 3297455 - RNA, 19 nt, Variola virus
auucucuuaauuauaacga

SEQ ID NO: 3297456 - RNA, 21 nt, Variola virus
gaucccauacuugauaagaua

SEQ ID NO: 3297457 - RNA, 17 nt, Variola virus
uaugucaaaaauuguag

SEQ ID NO: 3297458 - RNA, 16 nt, Variola virus
gaauaaucguuauuau

SEQ ID NO: 3297459 - RNA, 23 nt, Variola virus
ugaacccguuaauguauaucuuu

SEQ ID NO: 3297460 - RNA, 19 nt, Variola virus
guauaauuuuuauguuuua

SEQ ID NO: 3297461 - RNA, 16 nt, Variola virus
auaaugaguuagauua

SEQ ID NO: 3297462 - RNA, 19 nt, Variola virus
ugcuauuaagguuaaggau

SEQ ID NO: 3297463 - RNA, 20 nt, Variola virus
uaauaugagugauaaaaucc

SEQ ID NO: 3297464 - RNA, 14 nt, Variola virus
auaucaacaaaauu

SEQ ID NO: 3297465 - RNA, 12 nt, Variola virus
aaacuuacagaa

SEQ ID NO: 3297466 - RNA, 21 nt, Variola virus
agaauugcaauuuugauguau

SEQ ID NO: 3297467 - RNA, 15 nt, Variola virus
gacacucuauaucua

SEQ ID NO: 3297468 - RNA, 13 nt, Variola virus
uauugaguggaaa

SEQ ID NO: 3297469 - RNA, 18 nt, Variola virus
auaacguuggcaauacua

SEQ ID NO: 3297470 - RNA, 18 nt, Variola virus
uaacuccagaacaucuuc

SEQ ID NO: 3297471 - RNA, 19 nt, Variola virus
auuacaagaaauauggauc

SEQ ID NO: 3297472 - RNA, 20 nt, Variola virus
cuauuuuaacaaagcaucua

SEQ ID NO: 3297473 - RNA, 18 nt, Variola virus
ccauugcuagucacuuua

SEQ ID NO: 3297474 - RNA, 18 nt, Variola virus
acagaguuuucagaagau

SEQ ID NO: 3297475 - RNA, 17 nt, Variola virus
cauccaagucaauaucu

SEQ ID NO: 3297476 - RNA, 19 nt, Variola virus
ugucuacauaaauaugcaa

SEQ ID NO: 3297477 - RNA, 24 nt, Variola virus
uaucgauguggaaauuacacugua

SEQ ID NO: 3297478 - RNA, 20 nt, Variola virus
aaugucgcaauuuguauuau

SEQ ID NO: 3297479 - RNA, 15 nt, Variola virus
caagcgauucuuuca

SEQ ID NO: 3297480 - RNA, 15 nt, Variola virus
uaaaguaauaaucuu

SEQ ID NO: 3297481 - RNA, 15 nt, Variola virus
uguuuccauagauuu

SEQ ID NO: 3297482 - RNA, 18 nt, Variola virus
ggcuaaaacauauuucuu

SEQ ID NO: 3297483 - RNA, 14 nt, Variola virus
uuuggcucuucuau

SEQ ID NO: 3297484 - RNA, 12 nt, Variola virus
aacauaaugccg

SEQ ID NO: 3297485 - RNA, 15 nt, Variola virus
auguuaggaaauauu

SEQ ID NO: 3297486 - RNA, 22 nt, Variola virus
acuuacagauggauaaaacuuc

SEQ ID NO: 3297487 - RNA, 17 nt, Variola virus
guguaucgacaucuuua

SEQ ID NO: 3297488 - RNA, 13 nt, Variola virus
gcauuugaugcac

SEQ ID NO: 3297489 - RNA, 14 nt, Variola virus
auuauuuauaccuc

SEQ ID NO: 3297490 - RNA, 15 nt, Variola virus
agauagaaaugaauu

SEQ ID NO: 3297491 - RNA, 16 nt, Variola virus
aucauguuaaugucuu

SEQ ID NO: 3297492 - RNA, 21 nt, Variola virus
uauuguuuggguaaaacagau

SEQ ID NO: 3297493 - RNA, 23 nt, Variola virus
cgucuaagauauucuuccaucaa

SEQ ID NO: 3297494 - RNA, 15 nt, Variola virus
uaacuauuaauauua

SEQ ID NO: 3297495 - RNA, 14 nt, Variola virus
uccauaauccucua

SEQ ID NO: 3297496 - RNA, 18 nt, Variola virus
aucgucuauauaugaaua

SEQ ID NO: 3297497 - RNA, 17 nt, Variola virus
acauuauuaaucagaau

SEQ ID NO: 3297498 - RNA, 22 nt, Variola virus
agauucgcauuucuauacuugu

SEQ ID NO: 3297499 - RNA, 12 nt, Variola virus
ugaaacaaagaa

SEQ ID NO: 3297500 - RNA, 16 nt, Variola virus
auuauuuuuacagcga

SEQ ID NO: 3297501 - RNA, 17 nt, Variola virus
gaaaacauuuuuaucau

SEQ ID NO: 3297502 - RNA, 23 nt, Variola virus
ugugaauguauucacuuaacaau

SEQ ID NO: 3297503 - RNA, 17 nt, Variola virus
uagucagaccauucuug

SEQ ID NO: 3297504 - RNA, 22 nt, Variola virus
uccauaggcaguccagaaauau

SEQ ID NO: 3297505 - RNA, 16 nt, Variola virus
aacaguucuaccacca

SEQ ID NO: 3297506 - RNA, 18 nt, Variola virus
gccaaaaugauagauauu

SEQ ID NO: 3297507 - RNA, 17 nt, Variola virus
aaauaugaaaucuaucu

SEQ ID NO: 3297508 - RNA, 15 nt, Variola virus
aucguuauuauauaa

SEQ ID NO: 3297509 - RNA, 22 nt, Variola virus
agggaacuaauccacauaugau

SEQ ID NO: 3297510 - RNA, 13 nt, Variola virus
uggaugaccauau

SEQ ID NO: 3297511 - RNA, 18 nt, Variola virus
auuacgcaucuguaaaag

SEQ ID NO: 3297512 - RNA, 15 nt, Variola virus
auauucucauggaaa

SEQ ID NO: 3297513 - RNA, 14 nt, Variola virus
aaugauauauuaaa

SEQ ID NO: 3297514 - RNA, 17 nt, Variola virus
acauuuuuauaaauaga

SEQ ID NO: 3297515 - RNA, 16 nt, Variola virus
gcuaauaaauaaugau

SEQ ID NO: 3297516 - RNA, 18 nt, Variola virus
aagguguugauuaccauu

SEQ ID NO: 3297517 - RNA, 18 nt, Variola virus
caaaaagggauauauauu

SEQ ID NO: 3297518 - RNA, 12 nt, Variola virus
cagcauuacuug

SEQ ID NO: 3297519 - RNA, 18 nt, Variola virus
auagaauuuauaacauga

SEQ ID NO: 3297520 - RNA, 16 nt, Variola virus
cuauaucaaugccuuu

SEQ ID NO: 3297521 - RNA, 18 nt, Variola virus
auuuuaagauuuuaaaug

SEQ ID NO: 3297522 - RNA, 16 nt, Variola virus
gcugcaucuaaauuaa

SEQ ID NO: 3297523 - RNA, 15 nt, Variola virus
aucucagugcaaaga

SEQ ID NO: 3297524 - RNA, 18 nt, Variola virus
auacagacaauugacaaa

SEQ ID NO: 3297525 - RNA, 19 nt, Variola virus
aaaucauccguuguuauau

SEQ ID NO: 3297526 - RNA, 18 nt, Variola virus
cauaaaccgaucacuaau

SEQ ID NO: 3297527 - RNA, 21 nt, Variola virus
guuaauugucuauaaauuaga

SEQ ID NO: 3297528 - RNA, 19 nt, Variola virus
auaccuuuaacuucuggaa

SEQ ID NO: 3297529 - RNA, 16 nt, Variola virus
acgacucacaauagaa

SEQ ID NO: 3297530 - RNA, 21 nt, Variola virus
augauaugauuuuuaaucaag

SEQ ID NO: 3297531 - RNA, 21 nt, Variola virus
ugcaacgaauuauuagucugu

SEQ ID NO: 3297532 - RNA, 23 nt, Variola virus
auagaacacccguagaaauacua

SEQ ID NO: 3297533 - RNA, 17 nt, Variola virus
uagaacuuuuaauuuug

SEQ ID NO: 3297534 - RNA, 22 nt, Variola virus
aaauggauaauauccauauuga

SEQ ID NO: 3297535 - RNA, 13 nt, Variola virus
cauaagcgcuaua

SEQ ID NO: 3297536 - RNA, 15 nt, Variola virus
caaaucaguaacuau

SEQ ID NO: 3297537 - RNA, 16 nt, Variola virus
guauacgcagaaaaga

SEQ ID NO: 3297538 - RNA, 23 nt, Variola virus
cuucaucaaccgaguuguuaauc

SEQ ID NO: 3297539 - RNA, 11 nt, Variola virus
uuaaaaaugau

SEQ ID NO: 3297540 - RNA, 13 nt, Variola virus
gcacauuauucua

SEQ ID NO: 3297541 - RNA, 17 nt, Variola virus
gcauuacagaauaauau

SEQ ID NO: 3297542 - RNA, 18 nt, Variola virus
uaauugcucguugguauu

SEQ ID NO: 3297543 - RNA, 15 nt, Variola virus
ucucauuuucuucaa

SEQ ID NO: 3297544 - RNA, 17 nt, Variola virus
accaccaaauaaaauuc

SEQ ID NO: 3297545 - RNA, 22 nt, Variola virus
guauaucaacaucuaccuuauu

SEQ ID NO: 3297546 - RNA, 23 nt, Variola virus
aagguggauucgguaguauuuau

SEQ ID NO: 3297547 - RNA, 14 nt, Variola virus
ggaguaauugauua

SEQ ID NO: 3297548 - RNA, 16 nt, Variola virus
guucaccuucuauaga

SEQ ID NO: 3297549 - RNA, 20 nt, Variola virus
ucacaacaauuuauuucuaa

SEQ ID NO: 3297550 - RNA, 20 nt, Variola virus
uacgucgcagaauucuaaau

SEQ ID NO: 3297551 - RNA, 18 nt, Variola virus
aucgauauugaaaaugac

SEQ ID NO: 3297552 - RNA, 16 nt, Variola virus
acggcaaaagauauau

SEQ ID NO: 3297553 - RNA, 14 nt, Variola virus
uaauucauacacca

SEQ ID NO: 3297554 - RNA, 19 nt, Variola virus
aagaccgaauacauaacag

SEQ ID NO: 3297555 - RNA, 16 nt, Variola virus
uaaacuguuuguauaa

SEQ ID NO: 3297556 - RNA, 13 nt, Variola virus
ucggaucuaaaau

SEQ ID NO: 3297557 - RNA, 21 nt, Variola virus
ccuaguacugaggauuuacua

SEQ ID NO: 3297558 - RNA, 15 nt, Variola virus
guccguuauauaauc

SEQ ID NO: 3297559 - RNA, 21 nt, Variola virus
cuccucauuacguuucauuuu

SEQ ID NO: 3297560 - RNA, 20 nt, Variola virus
uccaaacuguugacuucacu

SEQ ID NO: 3297561 - RNA, 19 nt, Variola virus
acauucauuaauaauacag

SEQ ID NO: 3297562 - RNA, 21 nt, Variola virus
auacaauaaauguuuaaacau

SEQ ID NO: 3297563 - RNA, 21 nt, Variola virus
cauauauguuuucaucauuuc

SEQ ID NO: 3297564 - RNA, 16 nt, Variola virus
cuauauaauaaaugua

SEQ ID NO: 3297565 - RNA, 15 nt, Variola virus
auaacuacauauucu

SEQ ID NO: 3297566 - RNA, 13 nt, Variola virus
guuaguaaucaug

SEQ ID NO: 3297567 - RNA, 22 nt, Variola virus
aacgaacgcggugugaauguac

SEQ ID NO: 3297568 - RNA, 16 nt, Variola virus
ccauuggcaaaguauc

SEQ ID NO: 3297569 - RNA, 17 nt, Variola virus
ucaaaucgauaguguag

SEQ ID NO: 3297570 - RNA, 13 nt, Variola virus
uacaucaaucuua

SEQ ID NO: 3297571 - RNA, 18 nt, Variola virus
uucacauuguaacuauuc

SEQ ID NO: 3297572 - RNA, 17 nt, Variola virus
aacgacuuauaauuaau

SEQ ID NO: 3297573 - RNA, 22 nt, Variola virus
ucuuuuaaaucccaauucagaa

SEQ ID NO: 3297574 - RNA, 18 nt, Variola virus
uccaaaaacacaacaaau

SEQ ID NO: 3297575 - RNA, 15 nt, Variola virus
gauaaugaacauaua

SEQ ID NO: 3297576 - RNA, 20 nt, Variola virus
acagcacuguggaugugaca

SEQ ID NO: 3297577 - RNA, 18 nt, Variola virus
uaagacguuguaucucuu

SEQ ID NO: 3297578 - RNA, 12 nt, Variola virus
cgcauuaaauga

SEQ ID NO: 3297579 - RNA, 14 nt, Variola virus
auuaacagcuuuaa

SEQ ID NO: 3297580 - RNA, 21 nt, Variola virus
cagauauuccgacaaaggauu

SEQ ID NO: 3297581 - RNA, 15 nt, Variola virus
uacuaaagaaacugu

SEQ ID NO: 3297582 - RNA, 16 nt, Variola virus
auugacuaagaauuau

SEQ ID NO: 3297583 - RNA, 22 nt, Variola virus
auguuaauaacaucagaaaaug

SEQ ID NO: 3297584 - RNA, 20 nt, Variola virus
acuugccaugauucguuaua

SEQ ID NO: 3297585 - RNA, 14 nt, Variola virus
uguugaacaucagu

SEQ ID NO: 3297586 - RNA, 13 nt, Variola virus
aacaaucuagaca

SEQ ID NO: 3297587 - RNA, 15 nt, Variola virus
aucguacuauauaca

SEQ ID NO: 3297588 - RNA, 19 nt, Variola virus
uucuccggccacuauuauu

SEQ ID NO: 3297589 - RNA, 17 nt, Variola virus
aauauaguuaguauaac

SEQ ID NO: 3297590 - RNA, 15 nt, Variola virus
cggaauaaguagaca

SEQ ID NO: 3297591 - RNA, 20 nt, Variola virus
agcgcauguacauauuugua

SEQ ID NO: 3297592 - RNA, 21 nt, Variola virus
aacggaagaugcaauaguaau

SEQ ID NO: 3297593 - RNA, 16 nt, Variola virus
ucacucuucgaaaaga

SEQ ID NO: 3297594 - RNA, 16 nt, Variola virus
gcacaaugauaaugaa

SEQ ID NO: 3297595 - RNA, 19 nt, Variola virus
ucucguauucaguuucauc

SEQ ID NO: 3297596 - RNA, 15 nt, Variola virus
uuaaaacguccucua

SEQ ID NO: 3297597 - RNA, 19 nt, Variola virus
aucuagcgucgacaucuau

SEQ ID NO: 3297598 - RNA, 22 nt, Variola virus
auuaacuacggauaacaaaaua

SEQ ID NO: 3297599 - RNA, 22 nt, Variola virus
auuucuuuuuucuggcauaacu

SEQ ID NO: 3297600 - RNA, 21 nt, Variola virus
auaaauacccuuccaaauaau

SEQ ID NO: 3297601 - RNA, 18 nt, Variola virus
cauaaaggaauauacaaa

SEQ ID NO: 3297602 - RNA, 15 nt, Variola virus
auacagaauuuguaa

SEQ ID NO: 3297603 - RNA, 17 nt, Variola virus
auacuuuucuaauucua

SEQ ID NO: 3297604 - RNA, 15 nt, Variola virus
caucuaccaauucau

SEQ ID NO: 3297605 - RNA, 14 nt, Variola virus
aaauaaaacuauag

SEQ ID NO: 3297606 - RNA, 22 nt, Variola virus
auauagucgaacguuaguucca

SEQ ID NO: 3297607 - RNA, 19 nt, Variola virus
ucacaacuuuacuguuuuu

SEQ ID NO: 3297608 - RNA, 22 nt, Variola virus
aauucauuauuaaacaguuuaa

SEQ ID NO: 3297609 - RNA, 15 nt, Variola virus
gcguucauuggaaaa

SEQ ID NO: 3297610 - RNA, 11 nt, Variola virus
ucgauacuuuu

SEQ ID NO: 3297611 - RNA, 15 nt, Variola virus
auuauaccuaaugag

SEQ ID NO: 3297612 - RNA, 16 nt, Variola virus
gacaauacuguauuau

SEQ ID NO: 3297613 - RNA, 15 nt, Variola virus
uguucaacaaacuaa

SEQ ID NO: 3297614 - RNA, 14 nt, Variola virus
agaacauaauaaua

SEQ ID NO: 3297615 - RNA, 16 nt, Variola virus
gaauuauuuacaaaau

SEQ ID NO: 3297616 - RNA, 21 nt, Variola virus
auauucauuaauuuagauaga

SEQ ID NO: 3297617 - RNA, 18 nt, Variola virus
uccaugcaacauuuccua

SEQ ID NO: 3297618 - RNA, 13 nt, Variola virus
aauugguauaaau

SEQ ID NO: 3297619 - RNA, 13 nt, Variola virus
uucgaaaauacua

SEQ ID NO: 3297620 - RNA, 21 nt, Variola virus
uugauaaagccuuccuugcaa

SEQ ID NO: 3297621 - RNA, 17 nt, Variola virus
uguaauuccaguaauug

SEQ ID NO: 3297622 - RNA, 23 nt, Variola virus
caaauuacgagccaaaucuucuu

SEQ ID NO: 3297623 - RNA, 23 nt, Variola virus
gcuauaugauaaccaacuacaga

SEQ ID NO: 3297624 - RNA, 19 nt, Variola virus
uccaauaaacagucuuuaa

SEQ ID NO: 3297625 - RNA, 21 nt, Variola virus
gaaccacuauguuaauacuua

SEQ ID NO: 3297626 - RNA, 21 nt, Variola virus
agaauaugauccguaacauau

SEQ ID NO: 3297627 - RNA, 19 nt, Variola virus
agauucuacaaguaacaac

SEQ ID NO: 3297628 - RNA, 20 nt, Variola virus
uuaauauuacauauuuuuca

SEQ ID NO: 3297629 - RNA, 10 nt, Variola virus
uucaacaaug

SEQ ID NO: 3297630 - RNA, 20 nt, Variola virus
auaaauauccuuggaauuga

SEQ ID NO: 3297631 - RNA, 15 nt, Variola virus
uguaauuuuauucuu

SEQ ID NO: 3297632 - RNA, 14 nt, Variola virus
cugacauucagaaa

SEQ ID NO: 3297633 - RNA, 17 nt, Variola virus
aucguuaucauuaauaa

SEQ ID NO: 3297634 - RNA, 18 nt, Variola virus
aacuuauuagauagagau

SEQ ID NO: 3297635 - RNA, 14 nt, Variola virus
uuccaagaaacuaa

SEQ ID NO: 3297636 - RNA, 14 nt, Variola virus
gaaacuaucuuuuu

SEQ ID NO: 3297637 - RNA, 16 nt, Variola virus
agaagauuaaacauau

SEQ ID NO: 3297638 - RNA, 22 nt, Variola virus
uagaaauaagagacuuaaacaa

SEQ ID NO: 3297639 - RNA, 21 nt, Variola virus
aauagaggagccauuaaaugu

SEQ ID NO: 3297640 - RNA, 18 nt, Variola virus
uaaaccgauaguguauaa

SEQ ID NO: 3297641 - RNA, 14 nt, Variola virus
ucuccagaaaucug

SEQ ID NO: 3297642 - RNA, 13 nt, Variola virus
aauauuuuaccuu

SEQ ID NO: 3297643 - RNA, 20 nt, Variola virus
ccuuccacauccaugagauu

SEQ ID NO: 3297644 - RNA, 18 nt, Variola virus
uucuaaaaaaauauuaac

SEQ ID NO: 3297645 - RNA, 13 nt, Variola virus
ucaucuacaaaaa

SEQ ID NO: 3297646 - RNA, 12 nt, Variola virus
uccagaauguac

SEQ ID NO: 3297647 - RNA, 16 nt, Variola virus
agggcuaaaugucuag

SEQ ID NO: 3297648 - RNA, 19 nt, Variola virus
agcugauagcaauucaugu

SEQ ID NO: 3297649 - RNA, 17 nt, Variola virus
cagaugcaccauauuua

SEQ ID NO: 3297650 - RNA, 18 nt, Variola virus
ugugaagguuuagauguc

SEQ ID NO: 3297651 - RNA, 23 nt, Variola virus
agcaauuagugccguauacuuua

SEQ ID NO: 3297652 - RNA, 17 nt, Variola virus
aggaagaauaucauauu

SEQ ID NO: 3297653 - RNA, 19 nt, Variola virus
auuaauaacauuacauauu

SEQ ID NO: 3297654 - RNA, 18 nt, Variola virus
uuagcuguuuucauuaag

SEQ ID NO: 3297655 - RNA, 20 nt, Variola virus
agucagcaucagcauuugac

SEQ ID NO: 3297656 - RNA, 16 nt, Variola virus
cagauacaaauuuuaa

SEQ ID NO: 3297657 - RNA, 19 nt, Variola virus
uagaaccacuauguuaaua

SEQ ID NO: 3297658 - RNA, 17 nt, Variola virus
gaugccaucauagauau

SEQ ID NO: 3297659 - RNA, 12 nt, Variola virus
aauuaugaugau

SEQ ID NO: 3297660 - RNA, 23 nt, Variola virus
uuaccacaauguauaauauaaga

SEQ ID NO: 3297661 - RNA, 14 nt, Variola virus
aacuauauaaugaa

SEQ ID NO: 3297662 - RNA, 19 nt, Variola virus
aagauauaugauucuaaua

SEQ ID NO: 3297663 - RNA, 19 nt, Variola virus
cugucugcagccauuuuua

SEQ ID NO: 3297664 - RNA, 21 nt, Variola virus
uguacauauuuguacauuauu

SEQ ID NO: 3297665 - RNA, 13 nt, Variola virus
aauauccucaaua

SEQ ID NO: 3297666 - RNA, 13 nt, Variola virus
uauuguagcauua

SEQ ID NO: 3297667 - RNA, 21 nt, Variola virus
acgaaccagaaagugcaaaug

SEQ ID NO: 3297668 - RNA, 20 nt, Variola virus
acaacuuucucgugguggug

SEQ ID NO: 3297669 - RNA, 21 nt, Variola virus
uaacucauugcuuucuagaau

SEQ ID NO: 3297670 - RNA, 20 nt, Variola virus
uacucaguugaacagaugau

SEQ ID NO: 3297671 - RNA, 21 nt, Variola virus
aucuauaaaacgauuaaacaa

SEQ ID NO: 3297672 - RNA, 15 nt, Variola virus
auuaagugacauuau

SEQ ID NO: 3297673 - RNA, 13 nt, Variola virus
aaguuguuaaaaa

SEQ ID NO: 3297674 - RNA, 16 nt, Variola virus
aaaccauguugugaaa

SEQ ID NO: 3297675 - RNA, 17 nt, Variola virus
auugacauauguaaaua

SEQ ID NO: 3297676 - RNA, 17 nt, Variola virus
ucuuaaaagguuucaua

SEQ ID NO: 3297677 - RNA, 19 nt, Variola virus
cacaugaagaaaaacaccu

SEQ ID NO: 3297678 - RNA, 21 nt, Variola virus
uaucaccuguuugcaugguga

SEQ ID NO: 3297679 - RNA, 19 nt, Variola virus
uuccauuggccucauuaac

SEQ ID NO: 3297680 - RNA, 13 nt, Variola virus
ugauauuuggauc

SEQ ID NO: 3297681 - RNA, 14 nt, Variola virus
uaaaacagauuucu

SEQ ID NO: 3297682 - RNA, 18 nt, Variola virus
caccaucuucauaauaaa

SEQ ID NO: 3297683 - RNA, 23 nt, Variola virus
acguaucaccaacggaaauggua

SEQ ID NO: 3297684 - RNA, 17 nt, Variola virus
aauuuuaagaaauggug

SEQ ID NO: 3297685 - RNA, 18 nt, Variola virus
gucgucuuuugaucuuua

SEQ ID NO: 3297686 - RNA, 23 nt, Variola virus
uuaugacaaaguuuacauucuuu

SEQ ID NO: 3297687 - RNA, 14 nt, Variola virus
ucuagauauuagua

SEQ ID NO: 3297688 - RNA, 19 nt, Variola virus
auuaucuagucacugacug

SEQ ID NO: 3297689 - RNA, 20 nt, Variola virus
aucaaucuagcauuucuagc

SEQ ID NO: 3297690 - RNA, 17 nt, Variola virus
ucuauuuugucauuaac

SEQ ID NO: 3297691 - RNA, 17 nt, Variola virus
ucgcaaauucuagucuu

SEQ ID NO: 3297692 - RNA, 15 nt, Variola virus
cagaaggaaacuucu

SEQ ID NO: 3297693 - RNA, 21 nt, Variola virus
aucagucaccaguuaauauau

SEQ ID NO: 3297694 - RNA, 19 nt, Variola virus
cuuuuguccuaaaauacua

SEQ ID NO: 3297695 - RNA, 23 nt, Variola virus
accaauuacugauaauguagaaa

SEQ ID NO: 3297696 - RNA, 11 nt, Variola virus
uguauuuccau

SEQ ID NO: 3297697 - RNA, 18 nt, Variola virus
ucauucacggaacuacau

SEQ ID NO: 3297698 - RNA, 19 nt, Variola virus
gaaaaauguuagaauuaga

SEQ ID NO: 3297699 - RNA, 13 nt, Variola virus
gaauaagcuauau

SEQ ID NO: 3297700 - RNA, 23 nt, Variola virus
acauuauuuacaucuaauuuacu

SEQ ID NO: 3297701 - RNA, 15 nt, Variola virus
uacuacuucauuaau

SEQ ID NO: 3297702 - RNA, 18 nt, Variola virus
uuuaauuuggucauucuu

SEQ ID NO: 3297703 - RNA, 17 nt, Variola virus
cuuuagaaauuguauuc

SEQ ID NO: 3297704 - RNA, 18 nt, Variola virus
cucuauucgaaaacucua

SEQ ID NO: 3297705 - RNA, 21 nt, Variola virus
uaaaauccaugagaucuaauu

SEQ ID NO: 3297706 - RNA, 13 nt, Variola virus
uaaaacaauaaau

SEQ ID NO: 3297707 - RNA, 21 nt, Variola virus
acgaugguuuucacauuuaac

SEQ ID NO: 3297708 - RNA, 13 nt, Variola virus
aauauuuuucuau

SEQ ID NO: 3297709 - RNA, 14 nt, Variola virus
auacauaaagaacg

SEQ ID NO: 3297710 - RNA, 17 nt, Variola virus
uauaacuucuaaucuug

SEQ ID NO: 3297711 - RNA, 18 nt, Variola virus
auaguaguacacaacaug

SEQ ID NO: 3297712 - RNA, 17 nt, Variola virus
ucaaauccgaaauuaga

SEQ ID NO: 3297713 - RNA, 20 nt, Variola virus
ggcggaguaaguguugagcu

SEQ ID NO: 3297714 - RNA, 14 nt, Variola virus
augacgcaguaaca

SEQ ID NO: 3297715 - RNA, 20 nt, Variola virus
cccaaaauguauguguugaa

SEQ ID NO: 3297716 - RNA, 14 nt, Variola virus
guuuaaaacuucua

SEQ ID NO: 3297717 - RNA, 16 nt, Variola virus
aauauuauacaugaua

SEQ ID NO: 3297718 - RNA, 14 nt, Variola virus
cugauugugucuca

SEQ ID NO: 3297719 - RNA, 15 nt, Variola virus
uuaaucuuuaaaauu

SEQ ID NO: 3297720 - RNA, 15 nt, Variola virus
ucuucugaaacacca

SEQ ID NO: 3297721 - RNA, 15 nt, Variola virus
aauuacacuauuugu

SEQ ID NO: 3297722 - RNA, 19 nt, Variola virus
aacucgcuuaauaucuucu

SEQ ID NO: 3297723 - RNA, 21 nt, Variola virus
aaauauaucauucgauaagau

SEQ ID NO: 3297724 - RNA, 14 nt, Variola virus
acuucgcaauaauu

SEQ ID NO: 3297725 - RNA, 21 nt, Variola virus
uguaaauauaucaauaagcau

SEQ ID NO: 3297726 - RNA, 23 nt, Variola virus
uaaaaaaauaggugaugaugcaa

SEQ ID NO: 3297727 - RNA, 13 nt, Variola virus
guuuccuguaaau

SEQ ID NO: 3297728 - RNA, 16 nt, Variola virus
aauuuauuauuuauga

SEQ ID NO: 3297729 - RNA, 18 nt, Variola virus
aaauguauaaaaacuaau

SEQ ID NO: 3297730 - RNA, 14 nt, Variola virus
aagaccaguucauu

SEQ ID NO: 3297731 - RNA, 22 nt, Variola virus
uuuaaacuguccuauaaccucu

SEQ ID NO: 3297732 - RNA, 19 nt, Variola virus
gaagagauuucaacagacu

SEQ ID NO: 3297733 - RNA, 13 nt, Variola virus
guucaacaaacua

SEQ ID NO: 3297734 - RNA, 15 nt, Variola virus
gauuaucguuuucau

SEQ ID NO: 3297735 - RNA, 17 nt, Variola virus
auaaaaaauaaguauau

SEQ ID NO: 3297736 - RNA, 21 nt, Variola virus
uucguuagauuuucuacagau

SEQ ID NO: 3297737 - RNA, 21 nt, Variola virus
cuauuaguuguuccaauaaau

SEQ ID NO: 3297738 - RNA, 18 nt, Variola virus
uucaccaaacaacuuuua

SEQ ID NO: 3297739 - RNA, 14 nt, Variola virus
uacuauuuugguau

SEQ ID NO: 3297740 - RNA, 11 nt, Variola virus
gacaaauguaa

SEQ ID NO: 3297741 - RNA, 14 nt, Variola virus
gaaugcuguuauau

SEQ ID NO: 3297742 - RNA, 21 nt, Variola virus
auaaaucacuuuuuauacuaa

SEQ ID NO: 3297743 - RNA, 10 nt, Variola virus
ucucuauaga

SEQ ID NO: 3297744 - RNA, 15 nt, Variola virus
uauucuuaaauguca

SEQ ID NO: 3297745 - RNA, 22 nt, Variola virus
agaggaccguugggaauuuuau

SEQ ID NO: 3297746 - RNA, 17 nt, Variola virus
aucuguggcguugcaua

SEQ ID NO: 3297747 - RNA, 23 nt, Variola virus
aaaaauacaucuguuucagcuaa

SEQ ID NO: 3297748 - RNA, 22 nt, Variola virus
agaaacgauuauuucuaaauua

SEQ ID NO: 3297749 - RNA, 17 nt, Variola virus
uauuaaccacauaucug

SEQ ID NO: 3297750 - RNA, 14 nt, Variola virus
uuauguuauuuugu

SEQ ID NO: 3297751 - RNA, 23 nt, Variola virus
acuucugcagaauaauuagaaau

SEQ ID NO: 3297752 - RNA, 14 nt, Variola virus
agucaauaaaagag

SEQ ID NO: 3297753 - RNA, 13 nt, Variola virus
aaucuaacagaua

SEQ ID NO: 3297754 - RNA, 20 nt, Variola virus
aacaguuaucaaaauaugua

SEQ ID NO: 3297755 - RNA, 21 nt, Variola virus
aaaaacaucacgaaaucuaua

SEQ ID NO: 3297756 - RNA, 22 nt, Variola virus
auacgaauaucguucucuaaau

SEQ ID NO: 3297757 - RNA, 23 nt, Variola virus
cagucuggaaacuaucacguuua

SEQ ID NO: 3297758 - RNA, 23 nt, Variola virus
ugacaucauacuagauaaaucgu

SEQ ID NO: 3297759 - RNA, 16 nt, Variola virus
uaaauuguauaaguau

SEQ ID NO: 3297760 - RNA, 13 nt, Variola virus
gauuguaaugaac

SEQ ID NO: 3297761 - RNA, 15 nt, Variola virus
guacaauaccuuugu

SEQ ID NO: 3297762 - RNA, 22 nt, Variola virus
cuauacaaaaucguucugcuaa

SEQ ID NO: 3297763 - RNA, 13 nt, Variola virus
cuaauauaaucuu

SEQ ID NO: 3297764 - RNA, 14 nt, Variola virus
uuacaaauaaaagu

SEQ ID NO: 3297765 - RNA, 14 nt, Variola virus
uaggaguaucuauu

SEQ ID NO: 3297766 - RNA, 17 nt, Variola virus
acuucauugauaucuuu

SEQ ID NO: 3297767 - RNA, 19 nt, Variola virus
cuagguacaucauuuagau

SEQ ID NO: 3297768 - RNA, 23 nt, Variola virus
cccagauguucuauaaacuuggc

SEQ ID NO: 3297769 - RNA, 23 nt, Variola virus
uucaagauaaauaaucaaaauug

SEQ ID NO: 3297770 - RNA, 15 nt, Variola virus
auuugagaaaacauu

SEQ ID NO: 3297771 - RNA, 19 nt, Variola virus
aguauaaaguccaacuauu

SEQ ID NO: 3297772 - RNA, 20 nt, Variola virus
uaguuuccuuaacaaaucua

SEQ ID NO: 3297773 - RNA, 22 nt, Variola virus
aauaauuuaggacuuuguaaua

SEQ ID NO: 3297774 - RNA, 15 nt, Variola virus
aaugacgaugauaug

SEQ ID NO: 3297775 - RNA, 14 nt, Variola virus
aguaagaauaagac

SEQ ID NO: 3297776 - RNA, 22 nt, Variola virus
aaaagauuuauaaugucuacau

SEQ ID NO: 3297777 - RNA, 16 nt, Variola virus
cagaugucagcaucug

SEQ ID NO: 3297778 - RNA, 21 nt, Variola virus
gaacuuacugacaaaguuaag

SEQ ID NO: 3297779 - RNA, 13 nt, Variola virus
accacuucucuau

SEQ ID NO: 3297780 - RNA, 21 nt, Variola virus
augcgacgaguuagaaagaua

SEQ ID NO: 3297781 - RNA, 14 nt, Variola virus
auguuaaaaaaaca

SEQ ID NO: 3297782 - RNA, 18 nt, Variola virus
gauccaucaaaaaacaac

SEQ ID NO: 3297783 - RNA, 16 nt, Variola virus
uacuuguuggugaaau

SEQ ID NO: 3297784 - RNA, 15 nt, Variola virus
uuauucucuacgagu

SEQ ID NO: 3297785 - RNA, 19 nt, Variola virus
uuaaaacuugauaauuaau

SEQ ID NO: 3297786 - RNA, 18 nt, Variola virus
acuaacucucuaauggau

SEQ ID NO: 3297787 - RNA, 17 nt, Variola virus
uuaauuaauacaauguc

SEQ ID NO: 3297788 - RNA, 19 nt, Variola virus
aggcuuuaauaucuaaaua

SEQ ID NO: 3297789 - RNA, 16 nt, Variola virus
augugcuaaaaucacu

SEQ ID NO: 3297790 - RNA, 17 nt, Variola virus
agaauuuagauacaucu

SEQ ID NO: 3297791 - RNA, 15 nt, Variola virus
uuauugcaaacgaug

SEQ ID NO: 3297792 - RNA, 16 nt, Variola virus
uauuuuucuaacguug

SEQ ID NO: 3297793 - RNA, 15 nt, Variola virus
uguaaccuuaacaau

SEQ ID NO: 3297794 - RNA, 18 nt, Variola virus
uuuguaacugacuuuaga

SEQ ID NO: 3297795 - RNA, 17 nt, Variola virus
acaaacauacucuaaua

SEQ ID NO: 3297796 - RNA, 22 nt, Variola virus
gaaaauaaugacgcguacgaua

SEQ ID NO: 3297797 - RNA, 22 nt, Variola virus
ugaucuaguuacaacuauuaca

SEQ ID NO: 3297798 - RNA, 17 nt, Variola virus
guuacauguuuaaauaa

SEQ ID NO: 3297799 - RNA, 12 nt, Variola virus
aacaaaauacuc

SEQ ID NO: 3297800 - RNA, 20 nt, Variola virus
uauugcaaaucacucaauau

SEQ ID NO: 3297801 - RNA, 12 nt, Variola virus
gauuauuuucau

SEQ ID NO: 3297802 - RNA, 15 nt, Variola virus
agcacgauaacuuau

SEQ ID NO: 3297803 - RNA, 19 nt, Variola virus
aucaguaucuucuuuaucu

SEQ ID NO: 3297804 - RNA, 17 nt, Variola virus
uguauaucuauaauguu

SEQ ID NO: 3297805 - RNA, 14 nt, Variola virus
cuacaacagauauu

SEQ ID NO: 3297806 - RNA, 14 nt, Variola virus
uaucucucuuggua

SEQ ID NO: 3297807 - RNA, 21 nt, Variola virus
aguaaguacaucaucuagaga

SEQ ID NO: 3297808 - RNA, 13 nt, Variola virus
agugcuucuucuu

SEQ ID NO: 3297809 - RNA, 21 nt, Variola virus
auguaaagcauuauucuugaa

SEQ ID NO: 3297810 - RNA, 19 nt, Variola virus
gcaucuauauaaucuuuuu

SEQ ID NO: 3297811 - RNA, 21 nt, Variola virus
uauauaguuuuuacacauaga

SEQ ID NO: 3297812 - RNA, 23 nt, Variola virus
acaugguuaaaguacauguacaa

SEQ ID NO: 3297813 - RNA, 17 nt, Variola virus
ucuagagugaguuuagg

SEQ ID NO: 3297814 - RNA, 19 nt, Variola virus
cuaccagucuacauuuugc

SEQ ID NO: 3297815 - RNA, 21 nt, Variola virus
aaacaguuuuaccguuuguau

SEQ ID NO: 3297816 - RNA, 17 nt, Variola virus
ucucacaaaaaaguuuu

SEQ ID NO: 3297817 - RNA, 16 nt, Variola virus
uagagauaaaacaagu

SEQ ID NO: 3297818 - RNA, 20 nt, Variola virus
uuuuaucgauucaucuaauu

SEQ ID NO: 3297819 - RNA, 18 nt, Variola virus
gaugucaaugguauguau

SEQ ID NO: 3297820 - RNA, 16 nt, Variola virus
uuugucauuaacuuua

SEQ ID NO: 3297821 - RNA, 21 nt, Variola virus
uuuauaucauuuguuuuaauu

SEQ ID NO: 3297822 - RNA, 19 nt, Variola virus
gauagcuuccagauuuaaa

SEQ ID NO: 3297823 - RNA, 20 nt, Variola virus
auauuacuauuggcaauugu

SEQ ID NO: 3297824 - RNA, 20 nt, Variola virus
cuucuauuaaccacauaucu

SEQ ID NO: 3297825 - RNA, 14 nt, Variola virus
aauaucauauguag

SEQ ID NO: 3297826 - RNA, 18 nt, Variola virus
uaguaugacuuacuugua

SEQ ID NO: 3297827 - RNA, 16 nt, Variola virus
uauuccuguuaucauc

SEQ ID NO: 3297828 - RNA, 14 nt, Variola virus
ugaguuaauaugca

SEQ ID NO: 3297829 - RNA, 16 nt, Variola virus
aaugcuuuagugaaau

SEQ ID NO: 3297830 - RNA, 20 nt, Variola virus
uaucaagcgauucuuucaau

SEQ ID NO: 3297831 - RNA, 12 nt, Variola virus
uugucuagauaa

SEQ ID NO: 3297832 - RNA, 15 nt, Variola virus
ccuuaagaauaucca

SEQ ID NO: 3297833 - RNA, 16 nt, Variola virus
ucgauaccuagaagau

SEQ ID NO: 3297834 - RNA, 23 nt, Variola virus
uaaaauauuguuaaauaauggau

SEQ ID NO: 3297835 - RNA, 18 nt, Variola virus
auuauuguguuuguguag

SEQ ID NO: 3297836 - RNA, 18 nt, Variola virus
augaggugguugcagaau

SEQ ID NO: 3297837 - RNA, 19 nt, Variola virus
uaaguuggucacauacuuu

SEQ ID NO: 3297838 - RNA, 14 nt, Variola virus
auuuacacacauaa

SEQ ID NO: 3297839 - RNA, 15 nt, Variola virus
gaaaauucaaauaga

SEQ ID NO: 3297840 - RNA, 20 nt, Variola virus
uuuccauggcccauucuauu

SEQ ID NO: 3297841 - RNA, 21 nt, Variola virus
uaaaaauagagcccaaagcua

SEQ ID NO: 3297842 - RNA, 14 nt, Variola virus
aggauaaauuauuu

SEQ ID NO: 3297843 - RNA, 21 nt, Variola virus
auuauucuccaccacauagac

SEQ ID NO: 3297844 - RNA, 19 nt, Variola virus
guauacauaauauuaucau

SEQ ID NO: 3297845 - RNA, 21 nt, Variola virus
acagucguucaacugucuuuc

SEQ ID NO: 3297846 - RNA, 20 nt, Variola virus
uaauuggcuaguauuuaaca

SEQ ID NO: 3297847 - RNA, 18 nt, Variola virus
augagacagauuaucaua

SEQ ID NO: 3297848 - RNA, 13 nt, Variola virus
aaauauaacuauu

SEQ ID NO: 3297849 - RNA, 15 nt, Variola virus
uggaauaaauuauua

SEQ ID NO: 3297850 - RNA, 22 nt, Variola virus
agaaaucccaccuuauuauauu

SEQ ID NO: 3297851 - RNA, 13 nt, Variola virus
auaguaaaguaac

SEQ ID NO: 3297852 - RNA, 20 nt, Variola virus
aauaaauguccacuauacau

SEQ ID NO: 3297853 - RNA, 20 nt, Variola virus
aucagcaucuugaauagaaa

SEQ ID NO: 3297854 - RNA, 20 nt, Variola virus
aacacguuaaacaaaaaucu

SEQ ID NO: 3297855 - RNA, 14 nt, Variola virus
gucugaacaucaau

SEQ ID NO: 3297856 - RNA, 16 nt, Variola virus
cauaaauuauuucauu

SEQ ID NO: 3297857 - RNA, 13 nt, Variola virus
augauagaaucug

SEQ ID NO: 3297858 - RNA, 18 nt, Variola virus
uaaauguuguaauuguau

SEQ ID NO: 3297859 - RNA, 14 nt, Variola virus
auuacaaaccuguc

SEQ ID NO: 3297860 - RNA, 19 nt, Variola virus
agcagcugcagcaacuucu

SEQ ID NO: 3297861 - RNA, 20 nt, Variola virus
aauuucuagaauaucaucuc

SEQ ID NO: 3297862 - RNA, 19 nt, Variola virus
ucacuauguguaagaagau

SEQ ID NO: 3297863 - RNA, 14 nt, Variola virus
uuacgaauaaaaga

SEQ ID NO: 3297864 - RNA, 14 nt, Variola virus
auacuuaaaaaugg

SEQ ID NO: 3297865 - RNA, 20 nt, Variola virus
uuuagcaaggucccuaauau

SEQ ID NO: 3297866 - RNA, 14 nt, Variola virus
aauguccacaaaug

SEQ ID NO: 3297867 - RNA, 15 nt, Variola virus
gauaaagauauauga

SEQ ID NO: 3297868 - RNA, 13 nt, Variola virus
agaaauauauacu

SEQ ID NO: 3297869 - RNA, 12 nt, Variola virus
aauuaaauggau

SEQ ID NO: 3297870 - RNA, 16 nt, Variola virus
uacuacuuuaccaaaa

SEQ ID NO: 3297871 - RNA, 15 nt, Variola virus
cgaauccuguuucua

SEQ ID NO: 3297872 - RNA, 22 nt, Variola virus
auuucaacaauaaugagaaugu

SEQ ID NO: 3297873 - RNA, 15 nt, Variola virus
cucucuuuuagagau

SEQ ID NO: 3297874 - RNA, 13 nt, Variola virus
auccaauaauuua

SEQ ID NO: 3297875 - RNA, 21 nt, Variola virus
ugaagaagagguaagauaucu

SEQ ID NO: 3297876 - RNA, 14 nt, Variola virus
uucaacauguuuaa

SEQ ID NO: 3297877 - RNA, 16 nt, Variola virus
aagauuguguagaaau

SEQ ID NO: 3297878 - RNA, 14 nt, Variola virus
caaacugcugaagu

SEQ ID NO: 3297879 - RNA, 17 nt, Variola virus
aaaauguauaacaaaug

SEQ ID NO: 3297880 - RNA, 20 nt, Variola virus
acuuaaaacuugauaauuaa

SEQ ID NO: 3297881 - RNA, 22 nt, Variola virus
auaaucauuauuaacuuuauca

SEQ ID NO: 3297882 - RNA, 20 nt, Variola virus
uauccaguuccuuuucuagu

SEQ ID NO: 3297883 - RNA, 17 nt, Variola virus
aucuuauaaaacuguca

SEQ ID NO: 3297884 - RNA, 21 nt, Variola virus
uuaaaaauaagaaugaaauaa

SEQ ID NO: 3297885 - RNA, 18 nt, Variola virus
cuuuguauucaguauuuu

SEQ ID NO: 3297886 - RNA, 13 nt, Variola virus
cuggaauuucagu

SEQ ID NO: 3297887 - RNA, 17 nt, Variola virus
ucuucaaaugaaguagg

SEQ ID NO: 3297888 - RNA, 18 nt, Variola virus
aaugaguuauuaagaaau

SEQ ID NO: 3297889 - RNA, 20 nt, Variola virus
uguuaguacuacugaagaac

SEQ ID NO: 3297890 - RNA, 15 nt, Variola virus
uucuauuuuuauucu

SEQ ID NO: 3297891 - RNA, 22 nt, Variola virus
acuauaggugucccgucaguau

SEQ ID NO: 3297892 - RNA, 14 nt, Variola virus
gccgaacuaaaaaa

SEQ ID NO: 3297893 - RNA, 16 nt, Variola virus
acaagaugaaaaauuu

SEQ ID NO: 3297894 - RNA, 13 nt, Variola virus
agaauuaaaagag

SEQ ID NO: 3297895 - RNA, 14 nt, Variola virus
uaauuuuacuagau

SEQ ID NO: 3297896 - RNA, 15 nt, Variola virus
cacauuuaugauaug

SEQ ID NO: 3297897 - RNA, 13 nt, Variola virus
aacauaaaaauau

SEQ ID NO: 3297898 - RNA, 17 nt, Variola virus
uuuguaccuuuguacau

SEQ ID NO: 3297899 - RNA, 13 nt, Variola virus
uuuauuaucuaca

SEQ ID NO: 3297900 - RNA, 12 nt, Variola virus
ccaauaaaugac

SEQ ID NO: 3297901 - RNA, 22 nt, Variola virus
acuuuuuuacccacuauaaaau

SEQ ID NO: 3297902 - RNA, 12 nt, Variola virus
uaucuaaagcuu

SEQ ID NO: 3297903 - RNA, 17 nt, Variola virus
aucagauaaguaugaag

SEQ ID NO: 3297904 - RNA, 21 nt, Variola virus
ugacaauauuauuaugaagac

SEQ ID NO: 3297905 - RNA, 12 nt, Variola virus
cauguauuuccu

SEQ ID NO: 3297906 - RNA, 21 nt, Variola virus
ugagauguguuuacacuaacu

SEQ ID NO: 3297907 - RNA, 16 nt, Variola virus
auuucaucuguaguau

SEQ ID NO: 3297908 - RNA, 21 nt, Variola virus
caauaugccacaccaucuuca

SEQ ID NO: 3297909 - RNA, 22 nt, Variola virus
cucagauucaguuucucaucuu

SEQ ID NO: 3297910 - RNA, 21 nt, Variola virus
auucauuaggauuaucaaauc

SEQ ID NO: 3297911 - RNA, 23 nt, Variola virus
agguggauucaguacaauguuau

SEQ ID NO: 3297912 - RNA, 24 nt, Variola virus
aucuuuguuggaucagucucuaag

SEQ ID NO: 3297913 - RNA, 17 nt, Variola virus
aucuaggaguaauuaag

SEQ ID NO: 3297914 - RNA, 14 nt, Variola virus
caucauuaucauuu

SEQ ID NO: 3297915 - RNA, 13 nt, Variola virus
caguagucauugu

SEQ ID NO: 3297916 - RNA, 18 nt, Variola virus
acauaggauuaaaaauaa

SEQ ID NO: 3297917 - RNA, 16 nt, Variola virus
aggggagguaaauaua

SEQ ID NO: 3297918 - RNA, 19 nt, Variola virus
ucgacaucuggauuucaga

SEQ ID NO: 3297919 - RNA, 21 nt, Variola virus
acaaaaccgauaaauggaaau

SEQ ID NO: 3297920 - RNA, 16 nt, Variola virus
uaucugguucuaaaag

SEQ ID NO: 3297921 - RNA, 17 nt, Variola virus
uaugcauguuugcccuu

SEQ ID NO: 3297922 - RNA, 14 nt, Variola virus
accauauacugagu

SEQ ID NO: 3297923 - RNA, 21 nt, Variola virus
uuuugaaggauuggacaaauc

SEQ ID NO: 3297924 - RNA, 21 nt, Variola virus
agaauagugggcuuacaugua

SEQ ID NO: 3297925 - RNA, 14 nt, Variola virus
gauaaaauacugaa

SEQ ID NO: 3297926 - RNA, 16 nt, Variola virus
uauaaucugaugaaca

SEQ ID NO: 3297927 - RNA, 15 nt, Variola virus
aagauuuuaaaugua

SEQ ID NO: 3297928 - RNA, 17 nt, Variola virus
guuaauaaucucaucau

SEQ ID NO: 3297929 - RNA, 16 nt, Variola virus
augaaagaaagaagac

SEQ ID NO: 3297930 - RNA, 15 nt, Variola virus
ucauucguaaaucuu

SEQ ID NO: 3297931 - RNA, 20 nt, Variola virus
aaaccaauguaggucuaaau

SEQ ID NO: 3297932 - RNA, 21 nt, Variola virus
agaauuuguaccaacaaacug

SEQ ID NO: 3297933 - RNA, 22 nt, Variola virus
auuuagaaaacucucuaucucu

SEQ ID NO: 3297934 - RNA, 16 nt, Variola virus
agaacuaccaauaugu

SEQ ID NO: 3297935 - RNA, 20 nt, Variola virus
agagguucccaauuccaaag

SEQ ID NO: 3297936 - RNA, 18 nt, Variola virus
uaucuuaaauaacucauu

SEQ ID NO: 3297937 - RNA, 14 nt, Variola virus
uauuaaccacauau

SEQ ID NO: 3297938 - RNA, 23 nt, Variola virus
auauauuuucacuuuaucucauu

SEQ ID NO: 3297939 - RNA, 14 nt, Variola virus
gaacagaugauaua

SEQ ID NO: 3297940 - RNA, 21 nt, Variola virus
aaaguacucaauaaauuaaag

SEQ ID NO: 3297941 - RNA, 19 nt, Variola virus
ucacuauaauauaaucuag

SEQ ID NO: 3297942 - RNA, 19 nt, Variola virus
ugauugugucucaaaugcc

SEQ ID NO: 3297943 - RNA, 16 nt, Variola virus
ucauccguuguuauau

SEQ ID NO: 3297944 - RNA, 12 nt, Variola virus
auuguuuaagau

SEQ ID NO: 3297945 - RNA, 16 nt, Variola virus
cuuugaucucuuuugu

SEQ ID NO: 3297946 - RNA, 17 nt, Variola virus
agacuaugggaauauau

SEQ ID NO: 3297947 - RNA, 16 nt, Variola virus
agaccauuuaauacga

SEQ ID NO: 3297948 - RNA, 17 nt, Variola virus
uauaccaauauuauucu

SEQ ID NO: 3297949 - RNA, 19 nt, Variola virus
auccagaauguacacuauu

SEQ ID NO: 3297950 - RNA, 20 nt, Variola virus
cuaguuuuagaauaacauua

SEQ ID NO: 3297951 - RNA, 14 nt, Variola virus
auucuaucucuaag

SEQ ID NO: 3297952 - RNA, 22 nt, Variola virus
aaauaggaguuagaauaauaau

SEQ ID NO: 3297953 - RNA, 13 nt, Variola virus
augucuucaauuc

SEQ ID NO: 3297954 - RNA, 21 nt, Variola virus
gucuguaacucugauaaucuc

SEQ ID NO: 3297955 - RNA, 15 nt, Variola virus
acauauaguggauua

SEQ ID NO: 3297956 - RNA, 21 nt, Variola virus
uaauccagaauguacacuauu

SEQ ID NO: 3297957 - RNA, 16 nt, Variola virus
uacuuuauuacuccau

SEQ ID NO: 3297958 - RNA, 13 nt, Variola virus
gauaguaaugcau

SEQ ID NO: 3297959 - RNA, 19 nt, Variola virus
guguauuuuugacguaaau

SEQ ID NO: 3297960 - RNA, 23 nt, Variola virus
acuuugauuucuuaucuguaguu

SEQ ID NO: 3297961 - RNA, 15 nt, Variola virus
caucauuaucauuuu

SEQ ID NO: 3297962 - RNA, 22 nt, Variola virus
uaacuccaggccguuuguuucc

SEQ ID NO: 3297963 - RNA, 17 nt, Variola virus
cagacucauuauuuccc

SEQ ID NO: 3297964 - RNA, 17 nt, Variola virus
aauauuuguuaucauga

SEQ ID NO: 3297965 - RNA, 15 nt, Variola virus
aagaaguuagaaagu

SEQ ID NO: 3297966 - RNA, 21 nt, Variola virus
aaguaaagaaaagauauccag

SEQ ID NO: 3297967 - RNA, 23 nt, Variola virus
cauaaugaugguguauacaguau

SEQ ID NO: 3297968 - RNA, 18 nt, Variola virus
aauccuuaaguucauaau

SEQ ID NO: 3297969 - RNA, 20 nt, Variola virus
auaucgucaccgaugucaaa

SEQ ID NO: 3297970 - RNA, 16 nt, Variola virus
ugucaauugauucuua

SEQ ID NO: 3297971 - RNA, 16 nt, Variola virus
uuaacacguugucuuu

SEQ ID NO: 3297972 - RNA, 12 nt, Variola virus
cuucuaucuuua

SEQ ID NO: 3297973 - RNA, 14 nt, Variola virus
auuaaaaccuaauu

SEQ ID NO: 3297974 - RNA, 16 nt, Variola virus
ugauuauucuccacca

SEQ ID NO: 3297975 - RNA, 15 nt, Variola virus
uaauuuuucauuaac

SEQ ID NO: 3297976 - RNA, 15 nt, Variola virus
cauugauuuauuuga

SEQ ID NO: 3297977 - RNA, 16 nt, Variola virus
uaacuauuuagcaaaa

SEQ ID NO: 3297978 - RNA, 23 nt, Variola virus
aauuuguaaagacgaaacaaaau

SEQ ID NO: 3297979 - RNA, 17 nt, Variola virus
acaaaguaauuggauuc

SEQ ID NO: 3297980 - RNA, 22 nt, Variola virus
ucuacuaagcccaaaaccaaac

SEQ ID NO: 3297981 - RNA, 21 nt, Variola virus
auagaugagguacuauuuuau

SEQ ID NO: 3297982 - RNA, 19 nt, Variola virus
auauugucccaauguuucg

SEQ ID NO: 3297983 - RNA, 12 nt, Variola virus
auauauuguuaa

SEQ ID NO: 3297984 - RNA, 13 nt, Variola virus
uuaucuuucuugc

SEQ ID NO: 3297985 - RNA, 19 nt, Variola virus
ucuauuugucaauauguca

SEQ ID NO: 3297986 - RNA, 19 nt, Variola virus
agcugugaguauuaaugau

SEQ ID NO: 3297987 - RNA, 13 nt, Variola virus
agaacguaaauua

SEQ ID NO: 3297988 - RNA, 17 nt, Variola virus
aucauauauauacugaa

SEQ ID NO: 3297989 - RNA, 16 nt, Variola virus
aauguauacaaaugua

SEQ ID NO: 3297990 - RNA, 15 nt, Variola virus
uucugauuuuaucuu

SEQ ID NO: 3297991 - RNA, 17 nt, Variola virus
ucaaguuuguaggaaag

SEQ ID NO: 3297992 - RNA, 19 nt, Variola virus
aguuucaucaauaaaggau

SEQ ID NO: 3297993 - RNA, 17 nt, Variola virus
acgauacuaugcauauu

SEQ ID NO: 3297994 - RNA, 21 nt, Variola virus
uggaguauauauuuaucucuu

SEQ ID NO: 3297995 - RNA, 14 nt, Variola virus
agauaucucauuaa

SEQ ID NO: 3297996 - RNA, 14 nt, Variola virus
gacacagauaucua

SEQ ID NO: 3297997 - RNA, 18 nt, Variola virus
uacaugauaggaagaaaa

SEQ ID NO: 3297998 - RNA, 19 nt, Variola virus
cuauaaaacgauuaaacaa

SEQ ID NO: 3297999 - RNA, 16 nt, Variola virus
agaaagugcaaaugag

SEQ ID NO: 3298000 - RNA, 18 nt, Variola virus
uaacacacucuaccaguu

SEQ ID NO: 3298001 - RNA, 18 nt, Variola virus
cagaaucccuuuccaaag

SEQ ID NO: 3298002 - RNA, 14 nt, Variola virus
ugccugccuguauu

SEQ ID NO: 3298003 - RNA, 11 nt, Variola virus
cauuaugaauu

SEQ ID NO: 3298004 - RNA, 19 nt, Variola virus
gacaugguaucaacagaua

SEQ ID NO: 3298005 - RNA, 20 nt, Variola virus
uacuaaaucuguauaucuuu

SEQ ID NO: 3298006 - RNA, 17 nt, Variola virus
uauauacucuauuucaa

SEQ ID NO: 3298007 - RNA, 16 nt, Variola virus
uacccaaaucugaaaa

SEQ ID NO: 3298008 - RNA, 14 nt, Variola virus
auuuuaaaaaacug

SEQ ID NO: 3298009 - RNA, 18 nt, Variola virus
acaucuaccuuauuuccc

SEQ ID NO: 3298010 - RNA, 20 nt, Variola virus
uaacacaaauuauauuauua

SEQ ID NO: 3298011 - RNA, 21 nt, Variola virus
uaguucugaccagcaacucau

SEQ ID NO: 3298012 - RNA, 18 nt, Variola virus
augauaaugauaaugacg

SEQ ID NO: 3298013 - RNA, 16 nt, Variola virus
uugauacggcuauucu

SEQ ID NO: 3298014 - RNA, 13 nt, Variola virus
uaaacauuauuga

SEQ ID NO: 3298015 - RNA, 11 nt, Variola virus
agaaaacauuu

SEQ ID NO: 3298016 - RNA, 23 nt, Variola virus
aaguuagaagagucauuaaaaua

SEQ ID NO: 3298017 - RNA, 17 nt, Variola virus
uaaaaugugguaugucu

SEQ ID NO: 3298018 - RNA, 17 nt, Variola virus
guaucgaaaaacuuuaa

SEQ ID NO: 3298019 - RNA, 14 nt, Variola virus
cuaucauguauuug

SEQ ID NO: 3298020 - RNA, 20 nt, Variola virus
caaacuuaaucuuauuagaa

SEQ ID NO: 3298021 - RNA, 20 nt, Variola virus
ugugaugcuguagcaucaaa

SEQ ID NO: 3298022 - RNA, 14 nt, Variola virus
gcagaauauuucua

SEQ ID NO: 3298023 - RNA, 20 nt, Variola virus
uccauuuaaggcuuuaaaau

SEQ ID NO: 3298024 - RNA, 18 nt, Variola virus
uucguuuuuauaugugac

SEQ ID NO: 3298025 - RNA, 18 nt, Variola virus
uauccucuauuauacauu

SEQ ID NO: 3298026 - RNA, 13 nt, Variola virus
cuauuuuaauagg

SEQ ID NO: 3298027 - RNA, 14 nt, Variola virus
agauaguaaauaga

SEQ ID NO: 3298028 - RNA, 15 nt, Variola virus
auagcaucauugcua

SEQ ID NO: 3298029 - RNA, 17 nt, Variola virus
accucuaguuucagaau

SEQ ID NO: 3298030 - RNA, 20 nt, Variola virus
uuaggcacagucaaacauuc

SEQ ID NO: 3298031 - RNA, 15 nt, Variola virus
cauuccaguauucuu

SEQ ID NO: 3298032 - RNA, 14 nt, Variola virus
uagaugaauuauua

SEQ ID NO: 3298033 - RNA, 18 nt, Variola virus
auuauuuuauauucauuu

SEQ ID NO: 3298034 - RNA, 19 nt, Variola virus
gcaugauaauauagaagau

SEQ ID NO: 3298035 - RNA, 22 nt, Variola virus
ucaucacugucaucaguuaugu

SEQ ID NO: 3298036 - RNA, 14 nt, Variola virus
uuauaacauuuucc

SEQ ID NO: 3298037 - RNA, 22 nt, Variola virus
uuucaucuuucuccaauacuaa

SEQ ID NO: 3298038 - RNA, 17 nt, Variola virus
cauggcuucuuccauag

SEQ ID NO: 3298039 - RNA, 21 nt, Variola virus
uuauacuucuccaacaucgau

SEQ ID NO: 3298040 - RNA, 17 nt, Variola virus
cauuaucgauacuaauu

SEQ ID NO: 3298041 - RNA, 13 nt, Variola virus
agaaaucauauau

SEQ ID NO: 3298042 - RNA, 16 nt, Variola virus
cagugacagauauaca

SEQ ID NO: 3298043 - RNA, 16 nt, Variola virus
ugguuaaaaccuuugc

SEQ ID NO: 3298044 - RNA, 22 nt, Variola virus
uuauuucaaagacuaacuuaua

SEQ ID NO: 3298045 - RNA, 22 nt, Variola virus
auauaaaaacuuauuacauagu

SEQ ID NO: 3298046 - RNA, 16 nt, Variola virus
agaaugcauacugucu

SEQ ID NO: 3298047 - RNA, 12 nt, Variola virus
auucuuucaaag

SEQ ID NO: 3298048 - RNA, 19 nt, Variola virus
aagucugauauucagaaag

SEQ ID NO: 3298049 - RNA, 12 nt, Variola virus
aauaaaucaugg

SEQ ID NO: 3298050 - RNA, 20 nt, Variola virus
acuuuauugccuguaauaau

SEQ ID NO: 3298051 - RNA, 16 nt, Variola virus
aauaguuauuagaaua

SEQ ID NO: 3298052 - RNA, 17 nt, Variola virus
uaagacaugacacaaag

SEQ ID NO: 3298053 - RNA, 19 nt, Variola virus
uucuaucuuuaauaucuag

SEQ ID NO: 3298054 - RNA, 13 nt, Variola virus
uuaagaauaaucc

SEQ ID NO: 3298055 - RNA, 16 nt, Variola virus
auaaagauauaaauga

SEQ ID NO: 3298056 - RNA, 16 nt, Variola virus
uagcagauagauaaag

SEQ ID NO: 3298057 - RNA, 22 nt, Variola virus
aaucauucaaaaaucuaucacu

SEQ ID NO: 3298058 - RNA, 12 nt, Variola virus
uaagcauauucu

SEQ ID NO: 3298059 - RNA, 21 nt, Variola virus
augacuucguaagaaauaaua

SEQ ID NO: 3298060 - RNA, 22 nt, Variola virus
agaccaagcuucgucguagaaa

SEQ ID NO: 3298061 - RNA, 18 nt, Variola virus
uuguaaauguaacguauu

SEQ ID NO: 3298062 - RNA, 17 nt, Variola virus
aucauguguaaaaaguu

SEQ ID NO: 3298063 - RNA, 12 nt, Variola virus
uuuuuauuccua

SEQ ID NO: 3298064 - RNA, 18 nt, Variola virus
uagaacaaugucaaaaua

SEQ ID NO: 3298065 - RNA, 19 nt, Variola virus
uaacaauuauuauaauugu

SEQ ID NO: 3298066 - RNA, 19 nt, Variola virus
ucauugaugaugugagaga

SEQ ID NO: 3298067 - RNA, 17 nt, Variola virus
uaguuauuacuuuucuc

SEQ ID NO: 3298068 - RNA, 17 nt, Variola virus
cagauaugguuaaauca

SEQ ID NO: 3298069 - RNA, 16 nt, Variola virus
uagauuuuaucuaauu

SEQ ID NO: 3298070 - RNA, 17 nt, Variola virus
agaaaugaaauuacucg

SEQ ID NO: 3298071 - RNA, 18 nt, Variola virus
ggguuguuacgaugauga

SEQ ID NO: 3298072 - RNA, 19 nt, Variola virus
uaacacuauacgacacuau

SEQ ID NO: 3298073 - RNA, 16 nt, Variola virus
uuuagaagugauucuu

SEQ ID NO: 3298074 - RNA, 23 nt, Variola virus
auuaacaagaauacgucaaggaa

SEQ ID NO: 3298075 - RNA, 17 nt, Variola virus
agaugccgguacuuaug

SEQ ID NO: 3298076 - RNA, 22 nt, Variola virus
uauggauuuggucauaauagaa

SEQ ID NO: 3298077 - RNA, 23 nt, Variola virus
uuacggauaucuaauaauauuag

SEQ ID NO: 3298078 - RNA, 15 nt, Variola virus
aaucuguauaucuuu

SEQ ID NO: 3298079 - RNA, 23 nt, Variola virus
uuaucuccucuaugcaacuguaa

SEQ ID NO: 3298080 - RNA, 13 nt, Variola virus
auaauaucuauau

SEQ ID NO: 3298081 - RNA, 19 nt, Variola virus
uagaugccauaucauacau

SEQ ID NO: 3298082 - RNA, 19 nt, Variola virus
caauuguuugauauauaau

SEQ ID NO: 3298083 - RNA, 16 nt, Variola virus
gagcguaaaaguaaac

SEQ ID NO: 3298084 - RNA, 17 nt, Variola virus
ucucucagguacagauu

SEQ ID NO: 3298085 - RNA, 14 nt, Variola virus
uaaucgauuuugca

SEQ ID NO: 3298086 - RNA, 17 nt, Variola virus
acuguauccucaaacau

SEQ ID NO: 3298087 - RNA, 16 nt, Variola virus
caaccuacacuauuau

SEQ ID NO: 3298088 - RNA, 23 nt, Variola virus
guaacuucgucguaaagcguuaa

SEQ ID NO: 3298089 - RNA, 16 nt, Variola virus
cuauaucauucucaaa

SEQ ID NO: 3298090 - RNA, 13 nt, Variola virus
uacaaaacgacuu

SEQ ID NO: 3298091 - RNA, 17 nt, Variola virus
aauaacauaggauuaaa

SEQ ID NO: 3298092 - RNA, 14 nt, Variola virus
agauaucuucucaa

SEQ ID NO: 3298093 - RNA, 19 nt, Variola virus
cuaauauuauuaccaucuu

SEQ ID NO: 3298094 - RNA, 15 nt, Variola virus
augucaaaaaaagau

SEQ ID NO: 3298095 - RNA, 21 nt, Variola virus
cagcauagacuuugccacaac

SEQ ID NO: 3298096 - RNA, 19 nt, Variola virus
auaagaaugacuccuauau

SEQ ID NO: 3298097 - RNA, 13 nt, Variola virus
auugaagaaggag

SEQ ID NO: 3298098 - RNA, 20 nt, Variola virus
auaucuuuacuaagaaaguu

SEQ ID NO: 3298099 - RNA, 13 nt, Variola virus
aaauacuuuauca

SEQ ID NO: 3298100 - RNA, 21 nt, Variola virus
caacuaucguuggaaaaugau

SEQ ID NO: 3298101 - RNA, 13 nt, Variola virus
aucguauauuaag

SEQ ID NO: 3298102 - RNA, 14 nt, Variola virus
aaaacauaaucaag

SEQ ID NO: 3298103 - RNA, 19 nt, Variola virus
agagauuuaacuguucauc

SEQ ID NO: 3298104 - RNA, 15 nt, Variola virus
uuagaugaauuauua

SEQ ID NO: 3298105 - RNA, 22 nt, Variola virus
auuuacagauuuaguuguuuaa

SEQ ID NO: 3298106 - RNA, 20 nt, Variola virus
uguaacuauucaguaguguu

SEQ ID NO: 3298107 - RNA, 16 nt, Variola virus
acuaacaauaacuaga

SEQ ID NO: 3298108 - RNA, 19 nt, Variola virus
ucugaaguaguuucuaaua

SEQ ID NO: 3298109 - RNA, 13 nt, Variola virus
aucuaguuaccuu

SEQ ID NO: 3298110 - RNA, 15 nt, Variola virus
uaccauuucauugau

SEQ ID NO: 3298111 - RNA, 12 nt, Variola virus
gucuuauccauu

SEQ ID NO: 3298112 - RNA, 14 nt, Variola virus
aucagcgauuccua

SEQ ID NO: 3298113 - RNA, 16 nt, Variola virus
gacauaacuaaucaua

SEQ ID NO: 3298114 - RNA, 15 nt, Variola virus
auggcgaaauuauug

SEQ ID NO: 3298115 - RNA, 18 nt, Variola virus
agacuaacaguaugcauu

SEQ ID NO: 3298116 - RNA, 16 nt, Variola virus
agaauugucuguaaac

SEQ ID NO: 3298117 - RNA, 17 nt, Variola virus
ucgauaacuguagucuu

SEQ ID NO: 3298118 - RNA, 15 nt, Variola virus
cauagaauaaauauc

SEQ ID NO: 3298119 - RNA, 17 nt, Variola virus
uacuguauuaagaacag

SEQ ID NO: 3298120 - RNA, 19 nt, Variola virus
ucaauuaauaaaguaguau

SEQ ID NO: 3298121 - RNA, 22 nt, Variola virus
aauauggagagguguauuucca

SEQ ID NO: 3298122 - RNA, 16 nt, Variola virus
cuaugauuaaaucguu

SEQ ID NO: 3298123 - RNA, 18 nt, Variola virus
aaauguacuguauauaau

SEQ ID NO: 3298124 - RNA, 22 nt, Variola virus
aaguuacaaacaacuaggaaau

SEQ ID NO: 3298125 - RNA, 21 nt, Variola virus
uucuggaauaggauaauaauu

SEQ ID NO: 3298126 - RNA, 13 nt, Variola virus
augugaaacagac

SEQ ID NO: 3298127 - RNA, 14 nt, Variola virus
agauagaaaugaau

SEQ ID NO: 3298128 - RNA, 19 nt, Variola virus
cuacaaaaaggacauguaa

SEQ ID NO: 3298129 - RNA, 14 nt, Variola virus
aaagaguuugugaa

SEQ ID NO: 3298130 - RNA, 17 nt, Variola virus
aacagcuuuaacagaug

SEQ ID NO: 3298131 - RNA, 14 nt, Variola virus
gaaaauguaauaaa

SEQ ID NO: 3298132 - RNA, 21 nt, Variola virus
agucaucuuauguuuuuaaga

SEQ ID NO: 3298133 - RNA, 15 nt, Variola virus
cauuccauuguacaa

SEQ ID NO: 3298134 - RNA, 22 nt, Variola virus
cucuauuggauauggauuucca

SEQ ID NO: 3298135 - RNA, 15 nt, Variola virus
auagaauuuauauau

SEQ ID NO: 3298136 - RNA, 18 nt, Variola virus
aggaaauugauaaugagu

SEQ ID NO: 3298137 - RNA, 21 nt, Variola virus
ugccauauguuggaaauacua

SEQ ID NO: 3298138 - RNA, 17 nt, Variola virus
gaaucuagguauuucuu

SEQ ID NO: 3298139 - RNA, 17 nt, Variola virus
uauaagauuaucaaaau

SEQ ID NO: 3298140 - RNA, 23 nt, Variola virus
auaauagguguaaaucuagaaau

SEQ ID NO: 3298141 - RNA, 14 nt, Variola virus
uaucaucuaucaga

SEQ ID NO: 3298142 - RNA, 19 nt, Variola virus
caaaauauguuucaaucau

SEQ ID NO: 3298143 - RNA, 23 nt, Variola virus
uuacuuuuaguuuuuuuagaaaa

SEQ ID NO: 3298144 - RNA, 16 nt, Variola virus
cuuagauaaaaaauua

SEQ ID NO: 3298145 - RNA, 19 nt, Variola virus
acuaaguauauacacagaa

SEQ ID NO: 3298146 - RNA, 18 nt, Variola virus
aguacagaauuaauuaga

SEQ ID NO: 3298147 - RNA, 14 nt, Variola virus
uagauuguuuucag

SEQ ID NO: 3298148 - RNA, 21 nt, Variola virus
auacuguagaugguucuuuaa

SEQ ID NO: 3298149 - RNA, 15 nt, Variola virus
uaaaucguauauguu

SEQ ID NO: 3298150 - RNA, 19 nt, Variola virus
cuaauucuauauuguuaua

SEQ ID NO: 3298151 - RNA, 16 nt, Variola virus
cuaguuaaaauuuuaa

SEQ ID NO: 3298152 - RNA, 20 nt, Variola virus
aauucuccagacaauacucu

SEQ ID NO: 3298153 - RNA, 18 nt, Variola virus
cuaguggaauugaaaauu

SEQ ID NO: 3298154 - RNA, 21 nt, Variola virus
gacauugauauauauauuaag

SEQ ID NO: 3298155 - RNA, 17 nt, Variola virus
caguacaucuaucacag

SEQ ID NO: 3298156 - RNA, 20 nt, Variola virus
aaaucauuaaaugauuguau

SEQ ID NO: 3298157 - RNA, 23 nt, Variola virus
uuauacuaccagacgacauagaa

SEQ ID NO: 3298158 - RNA, 16 nt, Variola virus
aucauguguaaaaagu

SEQ ID NO: 3298159 - RNA, 21 nt, Variola virus
auuuguaauaauccuaucuaa

SEQ ID NO: 3298160 - RNA, 17 nt, Variola virus
auaaaggagaaggaaaa

SEQ ID NO: 3298161 - RNA, 16 nt, Variola virus
uaccuagaacaauguc

SEQ ID NO: 3298162 - RNA, 18 nt, Variola virus
guauuuuuggugauaaau

SEQ ID NO: 3298163 - RNA, 22 nt, Variola virus
ggaaaacuuuaauaacaaagaa

SEQ ID NO: 3298164 - RNA, 15 nt, Variola virus
gauacuauaaugaaa

SEQ ID NO: 3298165 - RNA, 17 nt, Variola virus
aaauguuuauaguauua

SEQ ID NO: 3298166 - RNA, 16 nt, Variola virus
ccuauucuaaauggau

SEQ ID NO: 3298167 - RNA, 22 nt, Variola virus
cuaaucuaaacgcguuagauaa

SEQ ID NO: 3298168 - RNA, 17 nt, Variola virus
acgcaucuguaaaagaa

SEQ ID NO: 3298169 - RNA, 15 nt, Variola virus
uaacgaggauacauc

SEQ ID NO: 3298170 - RNA, 15 nt, Variola virus
aagauaaaagaauuc

SEQ ID NO: 3298171 - RNA, 16 nt, Variola virus
ucuccagauuucauaa

SEQ ID NO: 3298172 - RNA, 15 nt, Variola virus
uuaaggggaaaaagc

SEQ ID NO: 3298173 - RNA, 17 nt, Variola virus
aguuacgacugaaauaa

SEQ ID NO: 3298174 - RNA, 18 nt, Variola virus
caaacaggaaagaaguau

SEQ ID NO: 3298175 - RNA, 23 nt, Variola virus
auuauguaaauaucuuuaauaca

SEQ ID NO: 3298176 - RNA, 14 nt, Variola virus
aacuugacaaaaau

SEQ ID NO: 3298177 - RNA, 20 nt, Variola virus
ggaacuauuccguauuuauc

SEQ ID NO: 3298178 - RNA, 20 nt, Variola virus
auaagcuauauaauaaaugu

SEQ ID NO: 3298179 - RNA, 14 nt, Variola virus
acauguuuaauaua

SEQ ID NO: 3298180 - RNA, 20 nt, Variola virus
uaaucaaaauugucuaugau

SEQ ID NO: 3298181 - RNA, 16 nt, Variola virus
auucuuaagacacauu

SEQ ID NO: 3298182 - RNA, 18 nt, Variola virus
agcuuccagauuuaaaaa

SEQ ID NO: 3298183 - RNA, 16 nt, Variola virus
auuucauauaguugaa

SEQ ID NO: 3298184 - RNA, 18 nt, Variola virus
uaucgcagaugaaacgga

SEQ ID NO: 3298185 - RNA, 16 nt, Variola virus
ugucuacauaaaucua

SEQ ID NO: 3298186 - RNA, 21 nt, Variola virus
ucaauuucccaaauaacacca

SEQ ID NO: 3298187 - RNA, 21 nt, Variola virus
auacucuacagaguugauugu

SEQ ID NO: 3298188 - RNA, 12 nt, Variola virus
uguaagaaauaa

SEQ ID NO: 3298189 - RNA, 15 nt, Variola virus
ccuggaaaaauacuu

SEQ ID NO: 3298190 - RNA, 13 nt, Variola virus
uauagagaaguau

SEQ ID NO: 3298191 - RNA, 15 nt, Variola virus
cuccgcucucaaugc

SEQ ID NO: 3298192 - RNA, 15 nt, Variola virus
uagcugaauguuaua

SEQ ID NO: 3298193 - RNA, 13 nt, Variola virus
uguaauagaauuu

SEQ ID NO: 3298194 - RNA, 21 nt, Variola virus
uaugaauccgaugaucucacu

SEQ ID NO: 3298195 - RNA, 13 nt, Variola virus
uacuuuguaagau

SEQ ID NO: 3298196 - RNA, 21 nt, Variola virus
acuccucuauuuaauacuuua

SEQ ID NO: 3298197 - RNA, 15 nt, Variola virus
caaaauagagccaaa

SEQ ID NO: 3298198 - RNA, 15 nt, Variola virus
caaauggucaaugau

SEQ ID NO: 3298199 - RNA, 16 nt, Variola virus
uuaauacaucaucuaa

SEQ ID NO: 3298200 - RNA, 14 nt, Variola virus
aaaucaagacuaca

SEQ ID NO: 3298201 - RNA, 16 nt, Variola virus
aggaugacucucaaau

SEQ ID NO: 3298202 - RNA, 13 nt, Variola virus
uuuaauuuguuga

SEQ ID NO: 3298203 - RNA, 22 nt, Variola virus
guuuuuaggauugauaaucaac

SEQ ID NO: 3298204 - RNA, 22 nt, Variola virus
cggacuuauauagcuuauucca

SEQ ID NO: 3298205 - RNA, 16 nt, Variola virus
auauaucuuauaucuc

SEQ ID NO: 3298206 - RNA, 23 nt, Variola virus
aguuugacgaccucgacauuauu

SEQ ID NO: 3298207 - RNA, 12 nt, Variola virus
cgaggagacugu

SEQ ID NO: 3298208 - RNA, 21 nt, Variola virus
uuacagaauaauauucacagg

SEQ ID NO: 3298209 - RNA, 16 nt, Variola virus
aggugcaacaauuuuu

SEQ ID NO: 3298210 - RNA, 20 nt, Variola virus
cacuauaucaguaucuucuu

SEQ ID NO: 3298211 - RNA, 16 nt, Variola virus
cacguugucuuucaag

SEQ ID NO: 3298212 - RNA, 16 nt, Variola virus
uuuuagaaauauacag

SEQ ID NO: 3298213 - RNA, 12 nt, Variola virus
ggaaaaugaaaa

SEQ ID NO: 3298214 - RNA, 16 nt, Variola virus
uauugcaaaucacuca

SEQ ID NO: 3298215 - RNA, 16 nt, Variola virus
uuucuauauagcuauu

SEQ ID NO: 3298216 - RNA, 17 nt, Variola virus
aauugggguauuaauaa

SEQ ID NO: 3298217 - RNA, 19 nt, Variola virus
uucuggaacauuaaaugua

SEQ ID NO: 3298218 - RNA, 14 nt, Variola virus
uauguauacauaau

SEQ ID NO: 3298219 - RNA, 17 nt, Variola virus
aguaugaagaaaaaugu

SEQ ID NO: 3298220 - RNA, 22 nt, Variola virus
aggauguauauaucaugaugau

SEQ ID NO: 3298221 - RNA, 23 nt, Variola virus
cucguaaauugggauaaaaauua

SEQ ID NO: 3298222 - RNA, 13 nt, Variola virus
gucccaauguuuc

SEQ ID NO: 3298223 - RNA, 19 nt, Variola virus
gcauaauccuuguaaugau

SEQ ID NO: 3298224 - RNA, 21 nt, Variola virus
uauaccaaggauaaaauauca

SEQ ID NO: 3298225 - RNA, 23 nt, Variola virus
cuacaguaggcauaccauuagau

SEQ ID NO: 3298226 - RNA, 14 nt, Variola virus
uguccacuauacau

SEQ ID NO: 3298227 - RNA, 15 nt, Variola virus
ucaugaagagauguu

SEQ ID NO: 3298228 - RNA, 17 nt, Variola virus
aguauaccaaacauagu

SEQ ID NO: 3298229 - RNA, 15 nt, Variola virus
aaaaucuacagauga

SEQ ID NO: 3298230 - RNA, 14 nt, Variola virus
agauuaggaaaugu

SEQ ID NO: 3298231 - RNA, 19 nt, Variola virus
uucucucagguacagauuu

SEQ ID NO: 3298232 - RNA, 19 nt, Variola virus
gauuugucacaauaugaau

SEQ ID NO: 3298233 - RNA, 14 nt, Variola virus
uacaauuuuaucau

SEQ ID NO: 3298234 - RNA, 21 nt, Variola virus
gauagaugauucgauaaauaa

SEQ ID NO: 3298235 - RNA, 19 nt, Variola virus
ugaaaucaguggaguagua

SEQ ID NO: 3298236 - RNA, 19 nt, Variola virus
gccaaauguucaauaucua

SEQ ID NO: 3298237 - RNA, 14 nt, Variola virus
uacgauuaucuauu

SEQ ID NO: 3298238 - RNA, 20 nt, Variola virus
uaaauuuuagaaauaacauu

SEQ ID NO: 3298239 - RNA, 18 nt, Variola virus
ugauguacaccaucaaau

SEQ ID NO: 3298240 - RNA, 15 nt, Variola virus
cgggaucauuauuua

SEQ ID NO: 3298241 - RNA, 13 nt, Variola virus
acggauauggaug

SEQ ID NO: 3298242 - RNA, 23 nt, Variola virus
ugagaaaagguucuaucaacaau

SEQ ID NO: 3298243 - RNA, 14 nt, Variola virus
uauuaaucaaucau

SEQ ID NO: 3298244 - RNA, 16 nt, Variola virus
caauaguagcuauuac

SEQ ID NO: 3298245 - RNA, 17 nt, Variola virus
auccgauacuuguaaga

SEQ ID NO: 3298246 - RNA, 19 nt, Variola virus
gauaucuuuacuaagaaag

SEQ ID NO: 3298247 - RNA, 13 nt, Variola virus
uugaaauguguaa

SEQ ID NO: 3298248 - RNA, 17 nt, Variola virus
uaucuacacaaauagaa

SEQ ID NO: 3298249 - RNA, 18 nt, Variola virus
ugauaucuaguauugaua

SEQ ID NO: 3298250 - RNA, 20 nt, Variola virus
agcuggaaaaaguuguucca

SEQ ID NO: 3298251 - RNA, 23 nt, Variola virus
guuaauaacugccggauaaaagu

SEQ ID NO: 3298252 - RNA, 21 nt, Variola virus
guugauaauaucuauauauga

SEQ ID NO: 3298253 - RNA, 15 nt, Variola virus
ucauccaguugaaug

SEQ ID NO: 3298254 - RNA, 16 nt, Variola virus
aacaguaucagauaau

SEQ ID NO: 3298255 - RNA, 16 nt, Variola virus
ucuguacaaauuauug

SEQ ID NO: 3298256 - RNA, 14 nt, Variola virus
gcuauaaaugaauu

SEQ ID NO: 3298257 - RNA, 13 nt, Variola virus
ugaagauacuguu

SEQ ID NO: 3298258 - RNA, 19 nt, Variola virus
aaaauaaucauacaaucua

SEQ ID NO: 3298259 - RNA, 18 nt, Variola virus
uagccgcgguaacuuuua

SEQ ID NO: 3298260 - RNA, 13 nt, Variola virus
acucuuaauuaug

SEQ ID NO: 3298261 - RNA, 17 nt, Variola virus
ccucaaacucuauuuua

SEQ ID NO: 3298262 - RNA, 15 nt, Variola virus
gauaguguauaaaga

SEQ ID NO: 3298263 - RNA, 22 nt, Variola virus
auaacagcuuagauuuaacguu

SEQ ID NO: 3298264 - RNA, 23 nt, Variola virus
aagaugcuacagcguuuacuauu

SEQ ID NO: 3298265 - RNA, 21 nt, Variola virus
uggaauucaguuggaauauug

SEQ ID NO: 3298266 - RNA, 14 nt, Variola virus
auuauguauaccuu

SEQ ID NO: 3298267 - RNA, 19 nt, Variola virus
uguauaucuaacguauucu

SEQ ID NO: 3298268 - RNA, 16 nt, Variola virus
aauggcauacauagaa

SEQ ID NO: 3298269 - RNA, 14 nt, Variola virus
acugaagagacuga

SEQ ID NO: 3298270 - RNA, 21 nt, Variola virus
ccauccauugcguugaaugau

SEQ ID NO: 3298271 - RNA, 15 nt, Variola virus
agugcaaugaauauc

SEQ ID NO: 3298272 - RNA, 12 nt, Variola virus
gucaaucauguu

SEQ ID NO: 3298273 - RNA, 18 nt, Variola virus
aucguauaaauacugucu

SEQ ID NO: 3298274 - RNA, 18 nt, Variola virus
gacucaguauacaaaaau

SEQ ID NO: 3298275 - RNA, 18 nt, Variola virus
guauaugugaauaugaca

SEQ ID NO: 3298276 - RNA, 23 nt, Variola virus
augaaagauacaacaaauuaaau

SEQ ID NO: 3298277 - RNA, 23 nt, Variola virus
cuaaugaguuauuaagaaauaca

SEQ ID NO: 3298278 - RNA, 15 nt, Variola virus
aaauauucuacauau

SEQ ID NO: 3298279 - RNA, 22 nt, Variola virus
auaauagguuguaauacauaua

SEQ ID NO: 3298280 - RNA, 15 nt, Variola virus
uaucauuaacuguug

SEQ ID NO: 3298281 - RNA, 17 nt, Variola virus
ucuugugcuguuauaua

SEQ ID NO: 3298282 - RNA, 22 nt, Variola virus
aguuaucugguaaguucauuau

SEQ ID NO: 3298283 - RNA, 14 nt, Variola virus
guaaaauauucuuu

SEQ ID NO: 3298284 - RNA, 16 nt, Variola virus
uauugaagauaaugug

SEQ ID NO: 3298285 - RNA, 20 nt, Variola virus
aacaucuuggggaaauaugg

SEQ ID NO: 3298286 - RNA, 19 nt, Variola virus
gaguauuaaccaugaaaga

SEQ ID NO: 3298287 - RNA, 22 nt, Variola virus
gcuacacccacuagaaaccacg

SEQ ID NO: 3298288 - RNA, 16 nt, Variola virus
aguuuucuuucaaaau

SEQ ID NO: 3298289 - RNA, 14 nt, Variola virus
gaauacuaaauuga

SEQ ID NO: 3298290 - RNA, 21 nt, Variola virus
uugagaaaagguucuaucaac

SEQ ID NO: 3298291 - RNA, 18 nt, Variola virus
aucucuauaauaucuagu

SEQ ID NO: 3298292 - RNA, 23 nt, Variola virus
ggagaauacaaagcguacagaua

SEQ ID NO: 3298293 - RNA, 16 nt, Variola virus
uuaucucaguacauag

SEQ ID NO: 3298294 - RNA, 14 nt, Variola virus
uugauuaguauaac

SEQ ID NO: 3298295 - RNA, 22 nt, Variola virus
uuaccaucuuccgccaauauag

SEQ ID NO: 3298296 - RNA, 17 nt, Variola virus
auccagauaauaaccuc

SEQ ID NO: 3298297 - RNA, 22 nt, Variola virus
acauauuuuagaacagaaauac

SEQ ID NO: 3298298 - RNA, 20 nt, Variola virus
ucuaauugugacauuauguu

SEQ ID NO: 3298299 - RNA, 18 nt, Variola virus
guucaucauauaaucauc

SEQ ID NO: 3298300 - RNA, 15 nt, Variola virus
ucuuguaucauauau

SEQ ID NO: 3298301 - RNA, 23 nt, Variola virus
auuggauucguguaaucauauau

SEQ ID NO: 3298302 - RNA, 16 nt, Variola virus
gcaauuauauaaugua

SEQ ID NO: 3298303 - RNA, 21 nt, Variola virus
ucuagguagaccguuaaugaa

SEQ ID NO: 3298304 - RNA, 16 nt, Variola virus
gcaggagauagauauc

SEQ ID NO: 3298305 - RNA, 12 nt, Variola virus
ucgaauacuuau

SEQ ID NO: 3298306 - RNA, 19 nt, Variola virus
aaauuucuagugcuuguau

SEQ ID NO: 3298307 - RNA, 20 nt, Variola virus
acauccaaaauacaaaaugu

SEQ ID NO: 3298308 - RNA, 14 nt, Variola virus
auugccuuuaagac

SEQ ID NO: 3298309 - RNA, 14 nt, Variola virus
acagauuuaacaau

SEQ ID NO: 3298310 - RNA, 18 nt, Variola virus
aaguugggacugacagau

SEQ ID NO: 3298311 - RNA, 15 nt, Variola virus
aauucccaaucuugu

SEQ ID NO: 3298312 - RNA, 18 nt, Variola virus
auaccacauacaaaacua

SEQ ID NO: 3298313 - RNA, 12 nt, Variola virus
guacuacagaua

SEQ ID NO: 3298314 - RNA, 17 nt, Variola virus
ucuuccaauaaaugucc

SEQ ID NO: 3298315 - RNA, 19 nt, Variola virus
cgcggaaaaaacauaauag

SEQ ID NO: 3298316 - RNA, 17 nt, Variola virus
agagcuucguauacucu

SEQ ID NO: 3298317 - RNA, 22 nt, Variola virus
agaguccuauauauuugaaaau

SEQ ID NO: 3298318 - RNA, 16 nt, Variola virus
aaauauuacagauuuu

SEQ ID NO: 3298319 - RNA, 12 nt, Variola virus
gugauuaaacau

SEQ ID NO: 3298320 - RNA, 20 nt, Variola virus
uuaucacauaucacauuaau

SEQ ID NO: 3298321 - RNA, 17 nt, Variola virus
uuaauaaaguaugaaca

SEQ ID NO: 3298322 - RNA, 18 nt, Variola virus
uggaucuaugguuuccau

SEQ ID NO: 3298323 - RNA, 18 nt, Variola virus
gcuauauaauaaauguau

SEQ ID NO: 3298324 - RNA, 17 nt, Variola virus
ugugucuccauguacau

SEQ ID NO: 3298325 - RNA, 14 nt, Variola virus
ugauuauuagauuu

SEQ ID NO: 3298326 - RNA, 19 nt, Variola virus
gaggaaaucguauaaauac

SEQ ID NO: 3298327 - RNA, 18 nt, Variola virus
aauuaccaacuaaaaguc

SEQ ID NO: 3298328 - RNA, 20 nt, Variola virus
ugucuagcauuuuagagcau

SEQ ID NO: 3298329 - RNA, 20 nt, Variola virus
aacuauaauggugcuuguau

SEQ ID NO: 3298330 - RNA, 18 nt, Variola virus
cuacagauguaagauacu

SEQ ID NO: 3298331 - RNA, 15 nt, Variola virus
agauugaaauuauau

SEQ ID NO: 3298332 - RNA, 20 nt, Variola virus
aaaucguauaaauacugucu

SEQ ID NO: 3298333 - RNA, 21 nt, Variola virus
auuuauugcacgguaaggaag

SEQ ID NO: 3298334 - RNA, 20 nt, Variola virus
gaauagaguaggaaguuuaa

SEQ ID NO: 3298335 - RNA, 16 nt, Variola virus
aguaaugaucaucuau

SEQ ID NO: 3298336 - RNA, 19 nt, Variola virus
aucuucguuaaaaaguuuu

SEQ ID NO: 3298337 - RNA, 17 nt, Variola virus
auuugauaaagauagau

SEQ ID NO: 3298338 - RNA, 20 nt, Variola virus
augugauuuuaucaaacaug

SEQ ID NO: 3298339 - RNA, 21 nt, Variola virus
auugguuccgagucacaaaua

SEQ ID NO: 3298340 - RNA, 22 nt, Variola virus
auuuaccaucccauauauucca

SEQ ID NO: 3298341 - RNA, 14 nt, Variola virus
guaaaauaaucaua

SEQ ID NO: 3298342 - RNA, 15 nt, Variola virus
gcaacuaucauuuua

SEQ ID NO: 3298343 - RNA, 21 nt, Variola virus
ucguucaacugucuuucaaga

SEQ ID NO: 3298344 - RNA, 18 nt, Variola virus
uuauagggaaauacuguu

SEQ ID NO: 3298345 - RNA, 21 nt, Variola virus
aucaacuucuugcgugucuuu

SEQ ID NO: 3298346 - RNA, 11 nt, Variola virus
aagaagagaau

SEQ ID NO: 3298347 - RNA, 21 nt, Variola virus
auuuuacuacauaguuaucua

SEQ ID NO: 3298348 - RNA, 15 nt, Variola virus
ccuuuaaauccucua

SEQ ID NO: 3298349 - RNA, 13 nt, Variola virus
agucaauaucuuu

SEQ ID NO: 3298350 - RNA, 14 nt, Variola virus
uaguuuuuacacau

SEQ ID NO: 3298351 - RNA, 20 nt, Variola virus
agacguacauggaaaggaaa

SEQ ID NO: 3298352 - RNA, 21 nt, Variola virus
aaauccuuguuugauaaaugu

SEQ ID NO: 3298353 - RNA, 14 nt, Variola virus
aaacuuuuagaaau

SEQ ID NO: 3298354 - RNA, 13 nt, Variola virus
uauacaacuuuua

SEQ ID NO: 3298355 - RNA, 15 nt, Variola virus
uucucguuuccaaaa

SEQ ID NO: 3298356 - RNA, 15 nt, Variola virus
auauagaucaaucau

SEQ ID NO: 3298357 - RNA, 17 nt, Variola virus
gaugagaacagaagcgu

SEQ ID NO: 3298358 - RNA, 17 nt, Variola virus
uaauuuuagcagaauau

SEQ ID NO: 3298359 - RNA, 13 nt, Variola virus
aaaauaauaauua

SEQ ID NO: 3298360 - RNA, 17 nt, Variola virus
acaucuauauacuauau

SEQ ID NO: 3298361 - RNA, 12 nt, Variola virus
auauuucugaag

SEQ ID NO: 3298362 - RNA, 17 nt, Variola virus
uaauacuaauuauauca

SEQ ID NO: 3298363 - RNA, 19 nt, Variola virus
aauuccuuugcuauuucua

SEQ ID NO: 3298364 - RNA, 13 nt, Variola virus
ucuauaacaaaug

SEQ ID NO: 3298365 - RNA, 21 nt, Variola virus
aauaauuuaccucguacuaua

SEQ ID NO: 3298366 - RNA, 15 nt, Variola virus
uguugauaaaaugca

SEQ ID NO: 3298367 - RNA, 20 nt, Variola virus
uauaaucuucgucuauuaca

SEQ ID NO: 3298368 - RNA, 16 nt, Variola virus
uuuaguuuauucauaa

SEQ ID NO: 3298369 - RNA, 12 nt, Variola virus
ucauaucuguaa

SEQ ID NO: 3298370 - RNA, 19 nt, Variola virus
aucaucuagagaauccaca

SEQ ID NO: 3298371 - RNA, 16 nt, Variola virus
uaguuuuucuaccuca

SEQ ID NO: 3298372 - RNA, 12 nt, Variola virus
uauuuucuucua

SEQ ID NO: 3298373 - RNA, 15 nt, Variola virus
cccacguuuaaacau

SEQ ID NO: 3298374 - RNA, 16 nt, Variola virus
uaccagaauacuauuu

SEQ ID NO: 3298375 - RNA, 14 nt, Variola virus
aaguaaucaugaaa

SEQ ID NO: 3298376 - RNA, 23 nt, Variola virus
aauuuaguuacugcuauacagau

SEQ ID NO: 3298377 - RNA, 18 nt, Variola virus
uuacgacgagcauauuca

SEQ ID NO: 3298378 - RNA, 22 nt, Variola virus
ucaagaacuacaaaaguuuucu

SEQ ID NO: 3298379 - RNA, 22 nt, Variola virus
ccaaucugggcguauaaugaau

SEQ ID NO: 3298380 - RNA, 21 nt, Variola virus
uucuaagaaaucuauaauauc

SEQ ID NO: 3298381 - RNA, 17 nt, Variola virus
auaaaggacagaaauau

SEQ ID NO: 3298382 - RNA, 18 nt, Variola virus
auuuuaauaguauccauu

SEQ ID NO: 3298383 - RNA, 13 nt, Variola virus
agucugucaaauc

SEQ ID NO: 3298384 - RNA, 22 nt, Variola virus
accaguucauucaagauaagca

SEQ ID NO: 3298385 - RNA, 17 nt, Variola virus
aucaauuucaaaaagag

SEQ ID NO: 3298386 - RNA, 11 nt, Variola virus
uguuuaagaua

SEQ ID NO: 3298387 - RNA, 15 nt, Variola virus
acaucaucauuuacc

SEQ ID NO: 3298388 - RNA, 14 nt, Variola virus
uaauacuguuuucu

SEQ ID NO: 3298389 - RNA, 16 nt, Variola virus
auaucguucucuaaau

SEQ ID NO: 3298390 - RNA, 15 nt, Variola virus
caaaguuaguacaga

SEQ ID NO: 3298391 - RNA, 15 nt, Variola virus
cauuaauuauaacgg

SEQ ID NO: 3298392 - RNA, 17 nt, Variola virus
agacuacaauauauucu

SEQ ID NO: 3298393 - RNA, 23 nt, Variola virus
cauucgacucaguauacaaaaau

SEQ ID NO: 3298394 - RNA, 17 nt, Variola virus
uauucuuuauuaucaga

SEQ ID NO: 3298395 - RNA, 17 nt, Variola virus
aagucaacguuuacauu

SEQ ID NO: 3298396 - RNA, 18 nt, Variola virus
cuguauccucaaacaucc

SEQ ID NO: 3298397 - RNA, 15 nt, Variola virus
aaaauaguucuguaa

SEQ ID NO: 3298398 - RNA, 17 nt, Variola virus
aacaaauagcuacagua

SEQ ID NO: 3298399 - RNA, 12 nt, Variola virus
agauuuagaaau

SEQ ID NO: 3298400 - RNA, 14 nt, Variola virus
gauaaauaguauca

SEQ ID NO: 3298401 - RNA, 16 nt, Variola virus
uaaucaaaaucuuaau

SEQ ID NO: 3298402 - RNA, 24 nt, Variola virus
caucuaacuauaugauauccacua

SEQ ID NO: 3298403 - RNA, 13 nt, Variola virus
cuaguuguagaau

SEQ ID NO: 3298404 - RNA, 23 nt, Variola virus
gcuauaauccgauauaugaugaa

SEQ ID NO: 3298405 - RNA, 12 nt, Variola virus
gcagaugaugau

SEQ ID NO: 3298406 - RNA, 17 nt, Variola virus
uauuagagauaccaaag

SEQ ID NO: 3298407 - RNA, 18 nt, Variola virus
aauauuguguuagccauu

SEQ ID NO: 3298408 - RNA, 16 nt, Variola virus
guuuuauauacaucuu

SEQ ID NO: 3298409 - RNA, 18 nt, Variola virus
uacgauuuucuucuuuga

SEQ ID NO: 3298410 - RNA, 11 nt, Variola virus
guauaaucaua

SEQ ID NO: 3298411 - RNA, 13 nt, Variola virus
uacaaauagagau

SEQ ID NO: 3298412 - RNA, 16 nt, Variola virus
ucauccgaucauuaau

SEQ ID NO: 3298413 - RNA, 21 nt, Variola virus
ucagugcacucauguaaccaa

SEQ ID NO: 3298414 - RNA, 17 nt, Variola virus
gacgcguucauuggaaa

SEQ ID NO: 3298415 - RNA, 18 nt, Variola virus
guucauaagucuaauaga

SEQ ID NO: 3298416 - RNA, 20 nt, Variola virus
aucuaaagaugaugcuauuu

SEQ ID NO: 3298417 - RNA, 18 nt, Variola virus
aauagucuuguaaagaua

SEQ ID NO: 3298418 - RNA, 21 nt, Variola virus
cgaauuauuucuuuguuuaua

SEQ ID NO: 3298419 - RNA, 13 nt, Variola virus
aaaugugauguau

SEQ ID NO: 3298420 - RNA, 21 nt, Variola virus
gaaagcaguugcgaacaacaa

SEQ ID NO: 3298421 - RNA, 16 nt, Variola virus
caucgucucaucuguu

SEQ ID NO: 3298422 - RNA, 17 nt, Variola virus
agaauuaggagaacuua

SEQ ID NO: 3298423 - RNA, 23 nt, Variola virus
cuuuuuauaucuggcucucucug

SEQ ID NO: 3298424 - RNA, 14 nt, Variola virus
acuuuauauuuccu

SEQ ID NO: 3298425 - RNA, 14 nt, Variola virus
cuucuaucuuuagu

SEQ ID NO: 3298426 - RNA, 11 nt, Variola virus
auuuggagaac

SEQ ID NO: 3298427 - RNA, 23 nt, Variola virus
caauuaguagaguuuuauaacga

SEQ ID NO: 3298428 - RNA, 21 nt, Variola virus
acacauccgucaaagaaauaa

SEQ ID NO: 3298429 - RNA, 15 nt, Variola virus
auaugauagaaauga

SEQ ID NO: 3298430 - RNA, 14 nt, Variola virus
ugauucuaucuaca

SEQ ID NO: 3298431 - RNA, 21 nt, Variola virus
auguuugauaaaaauauguau

SEQ ID NO: 3298432 - RNA, 22 nt, Variola virus
acaacaaggcuuuaauaucuaa

SEQ ID NO: 3298433 - RNA, 24 nt, Variola virus
uuaauaacauuacauauuauauca

SEQ ID NO: 3298434 - RNA, 23 nt, Variola virus
gacauccaugguggaauaaacua

SEQ ID NO: 3298435 - RNA, 17 nt, Variola virus
uaacauuaaguaaaucc

SEQ ID NO: 3298436 - RNA, 14 nt, Variola virus
aucuggcucucucu

SEQ ID NO: 3298437 - RNA, 19 nt, Variola virus
cuguauaucucauuaagcu

SEQ ID NO: 3298438 - RNA, 20 nt, Variola virus
aaugaaguaguugcauagau

SEQ ID NO: 3298439 - RNA, 20 nt, Variola virus
uccgagauaauuucuccaga

SEQ ID NO: 3298440 - RNA, 19 nt, Variola virus
cuaguuucagaauuuucua

SEQ ID NO: 3298441 - RNA, 23 nt, Variola virus
uaaaagucugaucuuaacuccuc

SEQ ID NO: 3298442 - RNA, 19 nt, Variola virus
ccaaaucuaguuguggaaa

SEQ ID NO: 3298443 - RNA, 18 nt, Variola virus
agugucuacuuaaaugua

SEQ ID NO: 3298444 - RNA, 20 nt, Variola virus
auucgcaaacuauucuaaua

SEQ ID NO: 3298445 - RNA, 23 nt, Variola virus
auauucuucuacgaucucacuaa

SEQ ID NO: 3298446 - RNA, 23 nt, Variola virus
ugcauacaauacuagucuagaaa

SEQ ID NO: 3298447 - RNA, 13 nt, Variola virus
uccagauauauau

SEQ ID NO: 3298448 - RNA, 15 nt, Variola virus
aauaacaucagaaaa

SEQ ID NO: 3298449 - RNA, 13 nt, Variola virus
aucucuuucagua

SEQ ID NO: 3298450 - RNA, 13 nt, Variola virus
gaguguagaaaac

SEQ ID NO: 3298451 - RNA, 16 nt, Variola virus
agucauguuaaaaaug

SEQ ID NO: 3298452 - RNA, 20 nt, Variola virus
auuaacuuuaacaugucuac

SEQ ID NO: 3298453 - RNA, 22 nt, Variola virus
acguuuagccgccuuuaauaga

SEQ ID NO: 3298454 - RNA, 19 nt, Variola virus
uucauaaauaaaaacuugg

SEQ ID NO: 3298455 - RNA, 16 nt, Variola virus
auaauaggguaucuaa

SEQ ID NO: 3298456 - RNA, 12 nt, Variola virus
auaugacuguau

SEQ ID NO: 3298457 - RNA, 18 nt, Variola virus
acaauuucacaaauggau

SEQ ID NO: 3298458 - RNA, 21 nt, Variola virus
gaucagaaauacgguuuuucu

SEQ ID NO: 3298459 - RNA, 20 nt, Variola virus
uacacauauggaauauaucu

SEQ ID NO: 3298460 - RNA, 19 nt, Variola virus
aaucaguacuaauuuccaa

SEQ ID NO: 3298461 - RNA, 22 nt, Variola virus
uucuagaaguugauacaacaua

SEQ ID NO: 3298462 - RNA, 21 nt, Variola virus
uuucgauucuggcuauuucaa

SEQ ID NO: 3298463 - RNA, 22 nt, Variola virus
accuauggauacgguacacgua

SEQ ID NO: 3298464 - RNA, 20 nt, Variola virus
uuuuaggaauccauguauua

SEQ ID NO: 3298465 - RNA, 22 nt, Variola virus
uucauccuuugauaauuuucca

SEQ ID NO: 3298466 - RNA, 22 nt, Variola virus
cguagcgucuagucuuaaaugg

SEQ ID NO: 3298467 - RNA, 11 nt, Variola virus
uuuauuucuag

SEQ ID NO: 3298468 - RNA, 22 nt, Variola virus
aucccguacucccaauauguau

SEQ ID NO: 3298469 - RNA, 21 nt, Variola virus
gagauuuguuuuguuaaacaa

SEQ ID NO: 3298470 - RNA, 16 nt, Variola virus
uucuaguuaucaugua

SEQ ID NO: 3298471 - RNA, 14 nt, Variola virus
uuauaaaaaacuuu

SEQ ID NO: 3298472 - RNA, 19 nt, Variola virus
acgaucaaccaaaaaggau

SEQ ID NO: 3298473 - RNA, 15 nt, Variola virus
ucauucaucuagaau

SEQ ID NO: 3298474 - RNA, 13 nt, Variola virus
cuuaaucauguga

SEQ ID NO: 3298475 - RNA, 18 nt, Variola virus
uuggacaaaucuggaaaa

SEQ ID NO: 3298476 - RNA, 22 nt, Variola virus
caagagugauuugagaacaucc

SEQ ID NO: 3298477 - RNA, 22 nt, Variola virus
auuaacuuccacauuaauacag

SEQ ID NO: 3298478 - RNA, 20 nt, Variola virus
aauauagcauagauccguga

SEQ ID NO: 3298479 - RNA, 22 nt, Variola virus
aaccaguacucucuuauaaagu

SEQ ID NO: 3298480 - RNA, 15 nt, Variola virus
uaaugucucuauaaa

SEQ ID NO: 3298481 - RNA, 22 nt, Variola virus
aauaaauggagaauaauuggaa

SEQ ID NO: 3298482 - RNA, 19 nt, Variola virus
acgaucuuuuauuucugau

SEQ ID NO: 3298483 - RNA, 23 nt, Variola virus
gccaauugauaguaaauaaugag

SEQ ID NO: 3298484 - RNA, 21 nt, Variola virus
acaauagauggauaauggaag

SEQ ID NO: 3298485 - RNA, 17 nt, Variola virus
aguaauuuguucaaaau

SEQ ID NO: 3298486 - RNA, 12 nt, Variola virus
uccaaauaacuc

SEQ ID NO: 3298487 - RNA, 15 nt, Variola virus
aguccagaaauggaa

SEQ ID NO: 3298488 - RNA, 16 nt, Variola virus
uguaaaagcauauguu

SEQ ID NO: 3298489 - RNA, 15 nt, Variola virus
gacucugguauuuau

SEQ ID NO: 3298490 - RNA, 19 nt, Variola virus
auuaagccgccauugauua

SEQ ID NO: 3298491 - RNA, 23 nt, Variola virus
ugacuguagauauuauauagaua

SEQ ID NO: 3298492 - RNA, 23 nt, Variola virus
guauucucagaguugacgaauau

SEQ ID NO: 3298493 - RNA, 15 nt, Variola virus
acaauguauaauaua

SEQ ID NO: 3298494 - RNA, 15 nt, Variola virus
gauaguaaaauaaag

SEQ ID NO: 3298495 - RNA, 16 nt, Variola virus
aaaacauuaaucaaua

SEQ ID NO: 3298496 - RNA, 15 nt, Variola virus
auacuacuaaugaca

SEQ ID NO: 3298497 - RNA, 23 nt, Variola virus
agaaaaucagaucugauaauauu

SEQ ID NO: 3298498 - RNA, 20 nt, Variola virus
ugcguacuucagguuucuua

SEQ ID NO: 3298499 - RNA, 18 nt, Variola virus
acuauuccaaaugaugau

SEQ ID NO: 3298500 - RNA, 20 nt, Variola virus
ucaagccggcuauauauucu

SEQ ID NO: 3298501 - RNA, 17 nt, Variola virus
aaugcgaggaaauguau

SEQ ID NO: 3298502 - RNA, 15 nt, Variola virus
uacauuuucuuacaa

SEQ ID NO: 3298503 - RNA, 21 nt, Variola virus
ccaaucaacgaauauccacua

SEQ ID NO: 3298504 - RNA, 15 nt, Variola virus
uucugcuaaauuuuc

SEQ ID NO: 3298505 - RNA, 15 nt, Variola virus
auaauauuagauuua

SEQ ID NO: 3298506 - RNA, 11 nt, Variola virus
aaguauaacga

SEQ ID NO: 3298507 - RNA, 15 nt, Variola virus
ucguaugauuucagu

SEQ ID NO: 3298508 - RNA, 21 nt, Variola virus
guuacuaacgugauuauuauu

SEQ ID NO: 3298509 - RNA, 19 nt, Variola virus
cauuuaaaguuacaaacaa

SEQ ID NO: 3298510 - RNA, 12 nt, Variola virus
uuuucuuaaaac

SEQ ID NO: 3298511 - RNA, 14 nt, Variola virus
acaucggaaauaua

SEQ ID NO: 3298512 - RNA, 14 nt, Variola virus
auaaagucugucaa

SEQ ID NO: 3298513 - RNA, 23 nt, Variola virus
gcuauauagaugacgauccuuua

SEQ ID NO: 3298514 - RNA, 21 nt, Variola virus
auucaagcaaaaacaaaaaac

SEQ ID NO: 3298515 - RNA, 16 nt, Variola virus
aaucucuaucgucaca

SEQ ID NO: 3298516 - RNA, 16 nt, Variola virus
ucagaaagcuguggau

SEQ ID NO: 3298517 - RNA, 19 nt, Variola virus
aacgaucuaauaacaaugu

SEQ ID NO: 3298518 - RNA, 18 nt, Variola virus
uauaugucaaccauuacu

SEQ ID NO: 3298519 - RNA, 17 nt, Variola virus
aguuccgagauaauuuc

SEQ ID NO: 3298520 - RNA, 18 nt, Variola virus
uacccaacaauacauuua

SEQ ID NO: 3298521 - RNA, 20 nt, Variola virus
guagucaaugaaacauuuga

SEQ ID NO: 3298522 - RNA, 14 nt, Variola virus
acuaaauccgagaa

SEQ ID NO: 3298523 - RNA, 20 nt, Variola virus
auuaacuguugccaaugaug

SEQ ID NO: 3298524 - RNA, 18 nt, Variola virus
ucuagucgcaucucuuaa

SEQ ID NO: 3298525 - RNA, 13 nt, Variola virus
gcgucuaaaucaa

SEQ ID NO: 3298526 - RNA, 22 nt, Variola virus
agaucguuggacauuggauaau

SEQ ID NO: 3298527 - RNA, 15 nt, Variola virus
cuaaaacauauuucu

SEQ ID NO: 3298528 - RNA, 19 nt, Variola virus
auauuggagcaaaauccua

SEQ ID NO: 3298529 - RNA, 17 nt, Variola virus
cauggaaaaauauuaca

SEQ ID NO: 3298530 - RNA, 22 nt, Variola virus
caggaaacgcuguauauggaaa

SEQ ID NO: 3298531 - RNA, 13 nt, Variola virus
uaguuuuuuucau

SEQ ID NO: 3298532 - RNA, 23 nt, Variola virus
uccauuagccuuuccacuucugc

SEQ ID NO: 3298533 - RNA, 14 nt, Variola virus
cucaccucuauauu

SEQ ID NO: 3298534 - RNA, 17 nt, Variola virus
ucgauaacagcauuugu

SEQ ID NO: 3298535 - RNA, 14 nt, Variola virus
guaaguacaucauc

SEQ ID NO: 3298536 - RNA, 10 nt, Variola virus
uguagaaaag

SEQ ID NO: 3298537 - RNA, 20 nt, Variola virus
agaacccauuagguuaaaug

SEQ ID NO: 3298538 - RNA, 20 nt, Variola virus
ucguacaguagagauauuug

SEQ ID NO: 3298539 - RNA, 23 nt, Variola virus
accaauauuggaauuauaauaua

SEQ ID NO: 3298540 - RNA, 22 nt, Variola virus
guacuaauaaggaacuagaauu

SEQ ID NO: 3298541 - RNA, 15 nt, Variola virus
acguagaaaacggau

SEQ ID NO: 3298542 - RNA, 20 nt, Variola virus
aacuguagagggucaacaau

SEQ ID NO: 3298543 - RNA, 23 nt, Variola virus
acgucuagaguuuauaucaauaa

SEQ ID NO: 3298544 - RNA, 19 nt, Variola virus
aaucauaacaguaguuuaa

SEQ ID NO: 3298545 - RNA, 23 nt, Variola virus
cuuucggcgguugccauagaaua

SEQ ID NO: 3298546 - RNA, 13 nt, Variola virus
aauccugaauaua

SEQ ID NO: 3298547 - RNA, 15 nt, Variola virus
ucuuccuucgauaga

SEQ ID NO: 3298548 - RNA, 15 nt, Variola virus
uagaaacauauucua

SEQ ID NO: 3298549 - RNA, 19 nt, Variola virus
acuuaauaggcaucauuua

SEQ ID NO: 3298550 - RNA, 16 nt, Variola virus
aguauccaucacuucu

SEQ ID NO: 3298551 - RNA, 14 nt, Variola virus
agaaaucaacuuau

SEQ ID NO: 3298552 - RNA, 16 nt, Variola virus
uacguaucauaucuuc

SEQ ID NO: 3298553 - RNA, 17 nt, Variola virus
acaaacaacuaggaaau

SEQ ID NO: 3298554 - RNA, 14 nt, Variola virus
aauucgaaggaagu

SEQ ID NO: 3298555 - RNA, 14 nt, Variola virus
agaggauaacuauu

SEQ ID NO: 3298556 - RNA, 22 nt, Variola virus
ucucugaauauagaacaucauu

SEQ ID NO: 3298557 - RNA, 13 nt, Variola virus
auagacaaaauag

SEQ ID NO: 3298558 - RNA, 22 nt, Variola virus
cagugaagaagugucuauaaau

SEQ ID NO: 3298559 - RNA, 15 nt, Variola virus
agacuuugaaauaua

SEQ ID NO: 3298560 - RNA, 21 nt, Variola virus
uauccgacaacguuacucaaa

SEQ ID NO: 3298561 - RNA, 20 nt, Variola virus
aaaagaaauauauguggugu

SEQ ID NO: 3298562 - RNA, 13 nt, Variola virus
uguaaauaucuuu

SEQ ID NO: 3298563 - RNA, 21 nt, Variola virus
auacuacuacuuguaagaaug

SEQ ID NO: 3298564 - RNA, 14 nt, Variola virus
gcacacaauacaga

SEQ ID NO: 3298565 - RNA, 18 nt, Variola virus
uguuaaaaauaugugcuc

SEQ ID NO: 3298566 - RNA, 21 nt, Variola virus
uauuuugcuacaccuguugaa

SEQ ID NO: 3298567 - RNA, 18 nt, Variola virus
cgacaucuggauuucaga

SEQ ID NO: 3298568 - RNA, 14 nt, Variola virus
auggaaaucaacau

SEQ ID NO: 3298569 - RNA, 22 nt, Variola virus
gguugccgcaaauagauagaac

SEQ ID NO: 3298570 - RNA, 18 nt, Variola virus
agaugucugugaacuauu

SEQ ID NO: 3298571 - RNA, 23 nt, Variola virus
aguggaucgguucagcauuuaau

SEQ ID NO: 3298572 - RNA, 23 nt, Variola virus
auuuuuuuuaaaaaaaaauacuu

SEQ ID NO: 3298573 - RNA, 22 nt, Variola virus
cugaaaauauauugauaauauu

SEQ ID NO: 3298574 - RNA, 20 nt, Variola virus
auacgaauaucguucucuaa

SEQ ID NO: 3298575 - RNA, 22 nt, Variola virus
cuacauaguuaucuaucuuaaa

SEQ ID NO: 3298576 - RNA, 12 nt, Variola virus
agcugaaaugag

SEQ ID NO: 3298577 - RNA, 21 nt, Variola virus
aguuuucagaagauaauuauc

SEQ ID NO: 3298578 - RNA, 16 nt, Variola virus
ugauauaguaauauua

SEQ ID NO: 3298579 - RNA, 16 nt, Variola virus
uugaucuuauuauaca

SEQ ID NO: 3298580 - RNA, 21 nt, Variola virus
aguauaaugauaucuaugauu

SEQ ID NO: 3298581 - RNA, 15 nt, Variola virus
uacauacuaauauua

SEQ ID NO: 3298582 - RNA, 20 nt, Variola virus
cgauacauccuucuauguua

SEQ ID NO: 3298583 - RNA, 17 nt, Variola virus
gaagucggauuauguaa

SEQ ID NO: 3298584 - RNA, 18 nt, Variola virus
acuuuaucagaucaaaau

SEQ ID NO: 3298585 - RNA, 20 nt, Variola virus
aauguugauaaaaugcauga

SEQ ID NO: 3298586 - RNA, 16 nt, Variola virus
acaauaaaaaaaauug

SEQ ID NO: 3298587 - RNA, 14 nt, Variola virus
auuaauacauuauu

SEQ ID NO: 3298588 - RNA, 19 nt, Variola virus
auucugaugauauuagaac

SEQ ID NO: 3298589 - RNA, 20 nt, Variola virus
gagcaaaaguaguucaacau

SEQ ID NO: 3298590 - RNA, 21 nt, Variola virus
uuaccuugaaaauaaauacag

SEQ ID NO: 3298591 - RNA, 21 nt, Variola virus
caauguagaaauuagaaagau

SEQ ID NO: 3298592 - RNA, 22 nt, Variola virus
aauaccgacgcgucugaauauc

SEQ ID NO: 3298593 - RNA, 14 nt, Variola virus
agauuuuaaaugua

SEQ ID NO: 3298594 - RNA, 19 nt, Variola virus
ucaucaaaagacuuaugau

SEQ ID NO: 3298595 - RNA, 20 nt, Variola virus
caaguaggauuuuuccaaag

SEQ ID NO: 3298596 - RNA, 16 nt, Variola virus
aguucuuaauacuucg

SEQ ID NO: 3298597 - RNA, 22 nt, Variola virus
uauauccuacaccggaagagau

SEQ ID NO: 3298598 - RNA, 16 nt, Variola virus
gaaaauaaauaauggu

SEQ ID NO: 3298599 - RNA, 20 nt, Variola virus
auuuuaucaagacauaugca

SEQ ID NO: 3298600 - RNA, 21 nt, Variola virus
cgaaauagauuauuuaacagc

SEQ ID NO: 3298601 - RNA, 14 nt, Variola virus
ucacuucaauaaau

SEQ ID NO: 3298602 - RNA, 19 nt, Variola virus
cagcaggaauaccaacaaa

SEQ ID NO: 3298603 - RNA, 18 nt, Variola virus
auauuuacaguuacuaaa

SEQ ID NO: 3298604 - RNA, 18 nt, Variola virus
cuuugguucuuuaaaaga

SEQ ID NO: 3298605 - RNA, 15 nt, Variola virus
aaagaaucaucauau

SEQ ID NO: 3298606 - RNA, 20 nt, Variola virus
uaucaucacaacuuaaugaa

SEQ ID NO: 3298607 - RNA, 19 nt, Variola virus
guauccggcaauauuuauu

SEQ ID NO: 3298608 - RNA, 19 nt, Variola virus
uagaggaucuauuagaugu

SEQ ID NO: 3298609 - RNA, 10 nt, Variola virus
aaaaaacaac

SEQ ID NO: 3298610 - RNA, 21 nt, Variola virus
auacugcuccagaauuaauaa

SEQ ID NO: 3298611 - RNA, 20 nt, Variola virus
acuuuaucaucuuauauaga

SEQ ID NO: 3298612 - RNA, 23 nt, Variola virus
guucagaaucgcgauucuaaaac

SEQ ID NO: 3298613 - RNA, 17 nt, Variola virus
guccaacgcuuggcuga

SEQ ID NO: 3298614 - RNA, 19 nt, Variola virus
acauuuuccauuuauaaca

SEQ ID NO: 3298615 - RNA, 17 nt, Variola virus
aucuaauggauaaacug

SEQ ID NO: 3298616 - RNA, 14 nt, Variola virus
ccauauuuuuugca

SEQ ID NO: 3298617 - RNA, 18 nt, Variola virus
uuauacaguguauguaaa

SEQ ID NO: 3298618 - RNA, 19 nt, Variola virus
cuaaucuauuuuaucauuu

SEQ ID NO: 3298619 - RNA, 15 nt, Variola virus
gucaaaacauaauac

SEQ ID NO: 3298620 - RNA, 11 nt, Variola virus
gucuaguuuug

SEQ ID NO: 3298621 - RNA, 15 nt, Variola virus
ucauaauaucuuuaa

SEQ ID NO: 3298622 - RNA, 15 nt, Variola virus
cagcauaaacacaaa

SEQ ID NO: 3298623 - RNA, 23 nt, Variola virus
aaggauuugcuuaaaggaagaau

SEQ ID NO: 3298624 - RNA, 15 nt, Variola virus
cauccaagucaauau

SEQ ID NO: 3298625 - RNA, 16 nt, Variola virus
uguuagaguaucuaca

SEQ ID NO: 3298626 - RNA, 19 nt, Variola virus
auacauaauucuucuguua

SEQ ID NO: 3298627 - RNA, 16 nt, Variola virus
gcaucaugaauacagu

SEQ ID NO: 3298628 - RNA, 16 nt, Variola virus
uauacuguuaaaugua

SEQ ID NO: 3298629 - RNA, 13 nt, Variola virus
aagauuguagaau

SEQ ID NO: 3298630 - RNA, 18 nt, Variola virus
aagugcacguuuacauau

SEQ ID NO: 3298631 - RNA, 20 nt, Variola virus
uauugauaaagaucuaaaaa

SEQ ID NO: 3298632 - RNA, 23 nt, Variola virus
aacagucuccuaauauaacagua

SEQ ID NO: 3298633 - RNA, 16 nt, Variola virus
auuuuuuaugaauauc

SEQ ID NO: 3298634 - RNA, 18 nt, Variola virus
aaacuuauuuagaauauc

SEQ ID NO: 3298635 - RNA, 14 nt, Variola virus
uucccauucuaaug

SEQ ID NO: 3298636 - RNA, 17 nt, Variola virus
caauucgguuaugaaug

SEQ ID NO: 3298637 - RNA, 22 nt, Variola virus
aaugacuuauuaaaaaacauau

SEQ ID NO: 3298638 - RNA, 21 nt, Variola virus
uaauaaaaguggaagucauuu

SEQ ID NO: 3298639 - RNA, 16 nt, Variola virus
agauaucuauauaauu

SEQ ID NO: 3298640 - RNA, 17 nt, Variola virus
ggcaaagucaaaugauu

SEQ ID NO: 3298641 - RNA, 16 nt, Variola virus
uaaagaugaugcuauu

SEQ ID NO: 3298642 - RNA, 17 nt, Variola virus
ucccaauuccaaagauc

SEQ ID NO: 3298643 - RNA, 19 nt, Variola virus
accaugucguuaacuauaa

SEQ ID NO: 3298644 - RNA, 14 nt, Variola virus
agucuuucuccaua

SEQ ID NO: 3298645 - RNA, 22 nt, Variola virus
ucuuggaaacauaaaauaacuc

SEQ ID NO: 3298646 - RNA, 14 nt, Variola virus
ucaaucauguacua

SEQ ID NO: 3298647 - RNA, 17 nt, Variola virus
uaucuuccgucaaggau

SEQ ID NO: 3298648 - RNA, 21 nt, Variola virus
auuuuaagaaaugguguaacu

SEQ ID NO: 3298649 - RNA, 13 nt, Variola virus
acauuaaauguau

SEQ ID NO: 3298650 - RNA, 17 nt, Variola virus
auguagugacgauguau

SEQ ID NO: 3298651 - RNA, 17 nt, Variola virus
uuuauaaaaaacuuuua

SEQ ID NO: 3298652 - RNA, 19 nt, Variola virus
auacauuaaguaaaguaaa

SEQ ID NO: 3298653 - RNA, 21 nt, Variola virus
agaaguaccuggaauguaaag

SEQ ID NO: 3298654 - RNA, 12 nt, Variola virus
aauguaaagaua

SEQ ID NO: 3298655 - RNA, 19 nt, Variola virus
aucuauacugcagaauaga

SEQ ID NO: 3298656 - RNA, 14 nt, Variola virus
auacauaguuguga

SEQ ID NO: 3298657 - RNA, 12 nt, Variola virus
uaucaaaucuag

SEQ ID NO: 3298658 - RNA, 15 nt, Variola virus
aacgaggacaaacua

SEQ ID NO: 3298659 - RNA, 17 nt, Variola virus
uauuggugcauuaauaa

SEQ ID NO: 3298660 - RNA, 20 nt, Variola virus
gucacauacuuuguaaucua

SEQ ID NO: 3298661 - RNA, 16 nt, Variola virus
ucagauuauuuaacaa

SEQ ID NO: 3298662 - RNA, 21 nt, Variola virus
uaaagcgaaaaauaauuauuc

SEQ ID NO: 3298663 - RNA, 22 nt, Variola virus
auacauagaguuaagagaaauu

SEQ ID NO: 3298664 - RNA, 16 nt, Variola virus
uacugaagaacuaaaa

SEQ ID NO: 3298665 - RNA, 18 nt, Variola virus
agacguggagaucuagaa

SEQ ID NO: 3298666 - RNA, 16 nt, Variola virus
ugccgaauagaguucu

SEQ ID NO: 3298667 - RNA, 16 nt, Variola virus
cgggaauuaauguccu

SEQ ID NO: 3298668 - RNA, 14 nt, Variola virus
uaguauaauauuua

SEQ ID NO: 3298669 - RNA, 17 nt, Variola virus
aguauggcgacauugau

SEQ ID NO: 3298670 - RNA, 12 nt, Variola virus
uuaugugaaaca

SEQ ID NO: 3298671 - RNA, 22 nt, Variola virus
auuaugaucuugauuuauagau

SEQ ID NO: 3298672 - RNA, 13 nt, Variola virus
auaugugcacaua

SEQ ID NO: 3298673 - RNA, 13 nt, Variola virus
cggaaaguauuuc

SEQ ID NO: 3298674 - RNA, 19 nt, Variola virus
ugaaucauauauguauuca

SEQ ID NO: 3298675 - RNA, 22 nt, Variola virus
uuuuaacuaguguagaaaacag

SEQ ID NO: 3298676 - RNA, 17 nt, Variola virus
cucuuccaucaccaaaa

SEQ ID NO: 3298677 - RNA, 14 nt, Variola virus
cguaaaaagauucu

SEQ ID NO: 3298678 - RNA, 19 nt, Variola virus
augacgcauauucuacucu

SEQ ID NO: 3298679 - RNA, 15 nt, Variola virus
auagcauaaaugcua

SEQ ID NO: 3298680 - RNA, 22 nt, Variola virus
aaaauauggaauuguauuuucu

SEQ ID NO: 3298681 - RNA, 17 nt, Variola virus
agccuuuugauaaaucu

SEQ ID NO: 3298682 - RNA, 20 nt, Variola virus
cucuaugacuucaucaucug

SEQ ID NO: 3298683 - RNA, 14 nt, Variola virus
gaauuguaacuuga

SEQ ID NO: 3298684 - RNA, 23 nt, Variola virus
ugagaaugaauacgaauucuaug

SEQ ID NO: 3298685 - RNA, 20 nt, Variola virus
ccaaggacagaaaaauguua

SEQ ID NO: 3298686 - RNA, 17 nt, Variola virus
aacuguguuucagguau

SEQ ID NO: 3298687 - RNA, 23 nt, Variola virus
agaaaguaaguaugucgaaucua

SEQ ID NO: 3298688 - RNA, 15 nt, Variola virus
cuacguuuggagaca

SEQ ID NO: 3298689 - RNA, 20 nt, Variola virus
aucaacagauagcuugaaug

SEQ ID NO: 3298690 - RNA, 23 nt, Variola virus
agugauauagaucccaaaucuuc

SEQ ID NO: 3298691 - RNA, 16 nt, Variola virus
auggauggaugaugca

SEQ ID NO: 3298692 - RNA, 15 nt, Variola virus
ucuacgaagaaaguu

SEQ ID NO: 3298693 - RNA, 21 nt, Variola virus
acuuuuucaucuuuacauacu

SEQ ID NO: 3298694 - RNA, 20 nt, Variola virus
aucaggauauaaagaaaaau

SEQ ID NO: 3298695 - RNA, 22 nt, Variola virus
cugaaaauuggaguuagguauu

SEQ ID NO: 3298696 - RNA, 14 nt, Variola virus
acucagaagacuau

SEQ ID NO: 3298697 - RNA, 20 nt, Variola virus
uggauacggcacuagguaca

SEQ ID NO: 3298698 - RNA, 17 nt, Variola virus
ugauuauuuuuugguau

SEQ ID NO: 3298699 - RNA, 17 nt, Variola virus
uacacggcauaguuucu

SEQ ID NO: 3298700 - RNA, 22 nt, Variola virus
uauguuuauuuagauacagaug

SEQ ID NO: 3298701 - RNA, 12 nt, Variola virus
auaaaaaguaau

SEQ ID NO: 3298702 - RNA, 20 nt, Variola virus
aucuuguucugguuuaaaaa

SEQ ID NO: 3298703 - RNA, 12 nt, Variola virus
caguugaacaga

SEQ ID NO: 3298704 - RNA, 18 nt, Variola virus
uccucauuacguuucauu

SEQ ID NO: 3298705 - RNA, 11 nt, Variola virus
ggcaucuuuuu

SEQ ID NO: 3298706 - RNA, 18 nt, Variola virus
uaaauuuaauaagacuuu

SEQ ID NO: 3298707 - RNA, 22 nt, Variola virus
gaugauguucuaccuauuucau

SEQ ID NO: 3298708 - RNA, 21 nt, Variola virus
ucuuccagcauccguuucuaa

SEQ ID NO: 3298709 - RNA, 21 nt, Variola virus
guauuucucuacaauauuaau

SEQ ID NO: 3298710 - RNA, 14 nt, Variola virus
ucucagguacagau

SEQ ID NO: 3298711 - RNA, 13 nt, Variola virus
uagaauaucacau

SEQ ID NO: 3298712 - RNA, 19 nt, Variola virus
auuugucugcuuucuuuua

SEQ ID NO: 3298713 - RNA, 13 nt, Variola virus
agacacugucaca

SEQ ID NO: 3298714 - RNA, 19 nt, Variola virus
agaauaucuauacauaccu

SEQ ID NO: 3298715 - RNA, 22 nt, Variola virus
aauaguuuccaccaaaagacua

SEQ ID NO: 3298716 - RNA, 15 nt, Variola virus
aaaaguacagaauua

SEQ ID NO: 3298717 - RNA, 17 nt, Variola virus
ucacugucacugucacu

SEQ ID NO: 3298718 - RNA, 16 nt, Variola virus
cacuuacagaaaagau

SEQ ID NO: 3298719 - RNA, 18 nt, Variola virus
agcuaaaauauuuucuag

SEQ ID NO: 3298720 - RNA, 15 nt, Variola virus
aauaacuaugauauc

SEQ ID NO: 3298721 - RNA, 14 nt, Variola virus
accaugaaagaaag

SEQ ID NO: 3298722 - RNA, 17 nt, Variola virus
augucuggaauaguaaa

SEQ ID NO: 3298723 - RNA, 16 nt, Variola virus
aguuauaauauuucca

SEQ ID NO: 3298724 - RNA, 19 nt, Variola virus
aaugagauacauaaaacuu

SEQ ID NO: 3298725 - RNA, 21 nt, Variola virus
caaaacuucacagaugauaau

SEQ ID NO: 3298726 - RNA, 16 nt, Variola virus
uggaaaggaaauuaug

SEQ ID NO: 3298727 - RNA, 23 nt, Variola virus
caccgagggaaaaucuaaaguug

SEQ ID NO: 3298728 - RNA, 18 nt, Variola virus
gaauuugauccuaccaaa

SEQ ID NO: 3298729 - RNA, 13 nt, Variola virus
uauacuaauauga

SEQ ID NO: 3298730 - RNA, 14 nt, Variola virus
ccuaucauguauuu

SEQ ID NO: 3298731 - RNA, 18 nt, Variola virus
aaaucacacgaugugucu

SEQ ID NO: 3298732 - RNA, 15 nt, Variola virus
gaagacaauaaugac

SEQ ID NO: 3298733 - RNA, 18 nt, Variola virus
aaugagauguuaaaugaa

SEQ ID NO: 3298734 - RNA, 14 nt, Variola virus
auacauugaauauu

SEQ ID NO: 3298735 - RNA, 14 nt, Variola virus
gauauaaauaauau

SEQ ID NO: 3298736 - RNA, 14 nt, Variola virus
agcauaaacuauac

SEQ ID NO: 3298737 - RNA, 16 nt, Variola virus
uaagccugaauuuauu

SEQ ID NO: 3298738 - RNA, 20 nt, Variola virus
augaucugucuuauaugaag

SEQ ID NO: 3298739 - RNA, 14 nt, Variola virus
aaagaaguauacua

SEQ ID NO: 3298740 - RNA, 21 nt, Variola virus
aauuacugauaauguagaaaa

SEQ ID NO: 3298741 - RNA, 22 nt, Variola virus
guuuuaacgaauuauauagucu

SEQ ID NO: 3298742 - RNA, 18 nt, Variola virus
auuucuucucuucguaua

SEQ ID NO: 3298743 - RNA, 20 nt, Variola virus
auaacguuaucauuuucuac

SEQ ID NO: 3298744 - RNA, 21 nt, Variola virus
augauacgauacuauauguau

SEQ ID NO: 3298745 - RNA, 18 nt, Variola virus
uaugauccguaacauaua

SEQ ID NO: 3298746 - RNA, 15 nt, Variola virus
guuuuuuuagaaaau

SEQ ID NO: 3298747 - RNA, 22 nt, Variola virus
auauuuuucuauguuaggaaua

SEQ ID NO: 3298748 - RNA, 15 nt, Variola virus
acacuguuaaaguua

SEQ ID NO: 3298749 - RNA, 21 nt, Variola virus
aaaccaacgaggaggaauauc

SEQ ID NO: 3298750 - RNA, 15 nt, Variola virus
aucauacuuagaauu

SEQ ID NO: 3298751 - RNA, 13 nt, Variola virus
guauuugauuuug

SEQ ID NO: 3298752 - RNA, 12 nt, Variola virus
caacucucuuuu

SEQ ID NO: 3298753 - RNA, 13 nt, Variola virus
augucuccaauuu

SEQ ID NO: 3298754 - RNA, 13 nt, Variola virus
guaaauaauacau

SEQ ID NO: 3298755 - RNA, 14 nt, Variola virus
acauucauuaauaa

SEQ ID NO: 3298756 - RNA, 15 nt, Variola virus
cgucuagaugauaua

SEQ ID NO: 3298757 - RNA, 22 nt, Variola virus
accauaauccuauucuugaucu

SEQ ID NO: 3298758 - RNA, 14 nt, Variola virus
agaugcaauacaaa

SEQ ID NO: 3298759 - RNA, 16 nt, Variola virus
agugauucaaaaggac

SEQ ID NO: 3298760 - RNA, 17 nt, Variola virus
ggucuaaagaauaucuu

SEQ ID NO: 3298761 - RNA, 16 nt, Variola virus
aacuagaguaaaaauc

SEQ ID NO: 3298762 - RNA, 23 nt, Variola virus
cuagcuuuauacacaucucuuca

SEQ ID NO: 3298763 - RNA, 18 nt, Variola virus
auccuuguucagauacua

SEQ ID NO: 3298764 - RNA, 22 nt, Variola virus
aaauaucauuuuuugaauauau

SEQ ID NO: 3298765 - RNA, 23 nt, Variola virus
aauaagauaguucgcaacaaagu

SEQ ID NO: 3298766 - RNA, 15 nt, Variola virus
gccgauaaacaaauc

SEQ ID NO: 3298767 - RNA, 18 nt, Variola virus
gacaaaguccuaguugua

SEQ ID NO: 3298768 - RNA, 11 nt, Variola virus
uauuauacaug

SEQ ID NO: 3298769 - RNA, 13 nt, Variola virus
uaacacauuuuca

SEQ ID NO: 3298770 - RNA, 20 nt, Variola virus
uauccaacuuaacaaaucuu

SEQ ID NO: 3298771 - RNA, 13 nt, Variola virus
uaaauaaaugucc

SEQ ID NO: 3298772 - RNA, 17 nt, Variola virus
uacacaaggcauugucu

SEQ ID NO: 3298773 - RNA, 14 nt, Variola virus
aauucuuuaauauc

SEQ ID NO: 3298774 - RNA, 23 nt, Variola virus
ggacauaagucgccucaaagaua

SEQ ID NO: 3298775 - RNA, 14 nt, Variola virus
aauaaucauacaau

SEQ ID NO: 3298776 - RNA, 18 nt, Variola virus
ucccgcauuuauacauau

SEQ ID NO: 3298777 - RNA, 13 nt, Variola virus
gucaaagaaauac

SEQ ID NO: 3298778 - RNA, 21 nt, Variola virus
uucaagaucuaauauucuaga

SEQ ID NO: 3298779 - RNA, 17 nt, Variola virus
aucuggaaaaucuauau

SEQ ID NO: 3298780 - RNA, 22 nt, Variola virus
caugguaucgauuacaccucua

SEQ ID NO: 3298781 - RNA, 17 nt, Variola virus
aaaauucuaauggauga

SEQ ID NO: 3298782 - RNA, 15 nt, Variola virus
ucgaaugucauauac

SEQ ID NO: 3298783 - RNA, 19 nt, Variola virus
auucucugaaaauguaaau

SEQ ID NO: 3298784 - RNA, 20 nt, Variola virus
cacuagaagagaauacacau

SEQ ID NO: 3298785 - RNA, 23 nt, Variola virus
gugaaauacuuuauuacuccauu

SEQ ID NO: 3298786 - RNA, 18 nt, Variola virus
guaaauauucuaaaucaa

SEQ ID NO: 3298787 - RNA, 18 nt, Variola virus
ggaacgugauaguuucuc

SEQ ID NO: 3298788 - RNA, 21 nt, Variola virus
ggaagcaauuacagauuucuc

SEQ ID NO: 3298789 - RNA, 19 nt, Variola virus
caaucaaaagacuauacau

SEQ ID NO: 3298790 - RNA, 16 nt, Variola virus
uucuccaauacuaauu

SEQ ID NO: 3298791 - RNA, 20 nt, Variola virus
ggccuguucauaaauaaaaa

SEQ ID NO: 3298792 - RNA, 14 nt, Variola virus
guuaaguuacucau

SEQ ID NO: 3298793 - RNA, 13 nt, Variola virus
uuugauucgaauu

SEQ ID NO: 3298794 - RNA, 13 nt, Variola virus
aucaugaaauaua

SEQ ID NO: 3298795 - RNA, 17 nt, Variola virus
aaauaacaauuaacaau

SEQ ID NO: 3298796 - RNA, 22 nt, Variola virus
ugaauuugauuauuuugaagac

SEQ ID NO: 3298797 - RNA, 13 nt, Variola virus
gcauuuauacaua

SEQ ID NO: 3298798 - RNA, 19 nt, Variola virus
aaaaggcgguaauagaaua

SEQ ID NO: 3298799 - RNA, 17 nt, Variola virus
cgauaacggaauagacu

SEQ ID NO: 3298800 - RNA, 14 nt, Variola virus
gccauuauuagaaa

SEQ ID NO: 3298801 - RNA, 20 nt, Variola virus
cagauccucccguuaaaacc

SEQ ID NO: 3298802 - RNA, 15 nt, Variola virus
acaaaaauacauaaa

SEQ ID NO: 3298803 - RNA, 15 nt, Variola virus
guuagagacaaaaga

SEQ ID NO: 3298804 - RNA, 22 nt, Variola virus
ucuuuuugauuaccuuacucau

SEQ ID NO: 3298805 - RNA, 19 nt, Variola virus
uaacgaguuccauuuauau

SEQ ID NO: 3298806 - RNA, 21 nt, Variola virus
cuaaaacugaagagacugauu

SEQ ID NO: 3298807 - RNA, 13 nt, Variola virus
auuauuacagagu

SEQ ID NO: 3298808 - RNA, 13 nt, Variola virus
uugaaaauuauuu

SEQ ID NO: 3298809 - RNA, 15 nt, Variola virus
aucuacuagaaagau

SEQ ID NO: 3298810 - RNA, 14 nt, Variola virus
auacgagucauuau

SEQ ID NO: 3298811 - RNA, 19 nt, Variola virus
auuuuaauucuagacuauu

SEQ ID NO: 3298812 - RNA, 16 nt, Variola virus
aucacuacaauaauua

SEQ ID NO: 3298813 - RNA, 22 nt, Variola virus
ggaaaucacaaugacuuuauca

SEQ ID NO: 3298814 - RNA, 22 nt, Variola virus
acuacuaggagggaaaaugaag

SEQ ID NO: 3298815 - RNA, 16 nt, Variola virus
guaauacccauguuua

SEQ ID NO: 3298816 - RNA, 14 nt, Variola virus
acucacguuaauaa

SEQ ID NO: 3298817 - RNA, 16 nt, Variola virus
agauuuuuuaaaggau

SEQ ID NO: 3298818 - RNA, 21 nt, Variola virus
acaaaaauugugacuuuguua

SEQ ID NO: 3298819 - RNA, 22 nt, Variola virus
aauuguuuuuguacauaauaga

SEQ ID NO: 3298820 - RNA, 19 nt, Variola virus
uggaauaucauuaacuguu

SEQ ID NO: 3298821 - RNA, 13 nt, Variola virus
aaagauuuaagaa

SEQ ID NO: 3298822 - RNA, 21 nt, Variola virus
ugugucuacauaaauaugcaa

SEQ ID NO: 3298823 - RNA, 22 nt, Variola virus
auaguuuucucuauucugaaau

SEQ ID NO: 3298824 - RNA, 21 nt, Variola virus
ggaaaagucaaagucguuuaa

SEQ ID NO: 3298825 - RNA, 21 nt, Variola virus
auuccuucucguaggcacaca

SEQ ID NO: 3298826 - RNA, 18 nt, Variola virus
aacuguggauacucugua

SEQ ID NO: 3298827 - RNA, 17 nt, Variola virus
ucggcaaucuuucucaa

SEQ ID NO: 3298828 - RNA, 23 nt, Variola virus
auuguaugacuuaauagcaucau

SEQ ID NO: 3298829 - RNA, 16 nt, Variola virus
uccaggauucuccuaa

SEQ ID NO: 3298830 - RNA, 13 nt, Variola virus
uaaguuucaagau

SEQ ID NO: 3298831 - RNA, 16 nt, Variola virus
uuaguuuuuggauaga

SEQ ID NO: 3298832 - RNA, 23 nt, Variola virus
ucaagccggcuauauauucugcu

SEQ ID NO: 3298833 - RNA, 12 nt, Variola virus
auaucuauaaug

SEQ ID NO: 3298834 - RNA, 14 nt, Variola virus
auagauagaacuac

SEQ ID NO: 3298835 - RNA, 16 nt, Variola virus
gcaaaaauaauaugau

SEQ ID NO: 3298836 - RNA, 22 nt, Variola virus
uacaagaaauacuuccauccga

SEQ ID NO: 3298837 - RNA, 16 nt, Variola virus
aauugucuauaaauua

SEQ ID NO: 3298838 - RNA, 22 nt, Variola virus
uuaauauuaaaaauacaucugu

SEQ ID NO: 3298839 - RNA, 12 nt, Variola virus
uguaguaguaua

SEQ ID NO: 3298840 - RNA, 20 nt, Variola virus
aauaaauguuucgauuucaa

SEQ ID NO: 3298841 - RNA, 20 nt, Variola virus
uguaucauaauauuaaucau

SEQ ID NO: 3298842 - RNA, 13 nt, Variola virus
uccgaguaaaaug

SEQ ID NO: 3298843 - RNA, 17 nt, Variola virus
agucuaccgaucucuuu

SEQ ID NO: 3298844 - RNA, 14 nt, Variola virus
caaaucaaaaguau

SEQ ID NO: 3298845 - RNA, 19 nt, Variola virus
uucaaguccaauguuuuua

SEQ ID NO: 3298846 - RNA, 14 nt, Variola virus
cugcuauaauuaag

SEQ ID NO: 3298847 - RNA, 15 nt, Variola virus
cacuguggaugugac

SEQ ID NO: 3298848 - RNA, 23 nt, Variola virus
uuagauauagaagguaaacauca

SEQ ID NO: 3298849 - RNA, 12 nt, Variola virus
guacauauuaau

SEQ ID NO: 3298850 - RNA, 19 nt, Variola virus
auggaaaucaacauaaugu

SEQ ID NO: 3298851 - RNA, 17 nt, Variola virus
agaccgucuacaagaaa

SEQ ID NO: 3298852 - RNA, 19 nt, Variola virus
uguuuucaucauuucacaa

SEQ ID NO: 3298853 - RNA, 18 nt, Variola virus
auugacauaguuaaauaa

SEQ ID NO: 3298854 - RNA, 21 nt, Variola virus
auuuguauaaucuuuaacaaa

SEQ ID NO: 3298855 - RNA, 19 nt, Variola virus
aaaacguggaaagaaucua

SEQ ID NO: 3298856 - RNA, 22 nt, Variola virus
auaaacaacuaaaaugugguau

SEQ ID NO: 3298857 - RNA, 19 nt, Variola virus
ugugucuccauguacauac

SEQ ID NO: 3298858 - RNA, 14 nt, Variola virus
ucauauaacacuca

SEQ ID NO: 3298859 - RNA, 19 nt, Variola virus
ugauaguauggcauucauu

SEQ ID NO: 3298860 - RNA, 22 nt, Variola virus
auaguucguguacuagucauaa

SEQ ID NO: 3298861 - RNA, 19 nt, Variola virus
cuucagacaacaucucaga

SEQ ID NO: 3298862 - RNA, 18 nt, Variola virus
uguaugauaaaauucuua

SEQ ID NO: 3298863 - RNA, 18 nt, Variola virus
uuagucacacaauacuac

SEQ ID NO: 3298864 - RNA, 15 nt, Variola virus
augaaauauauuaac

SEQ ID NO: 3298865 - RNA, 22 nt, Variola virus
auaaaccauccauucauauaca

SEQ ID NO: 3298866 - RNA, 21 nt, Variola virus
uguccuugcguuuuucugaua

SEQ ID NO: 3298867 - RNA, 13 nt, Variola virus
uugguguaaaucu

SEQ ID NO: 3298868 - RNA, 12 nt, Variola virus
agauacuugaag

SEQ ID NO: 3298869 - RNA, 18 nt, Variola virus
aucuucuauaucuagauu

SEQ ID NO: 3298870 - RNA, 20 nt, Variola virus
auacaaauaugucuuuguua

SEQ ID NO: 3298871 - RNA, 23 nt, Variola virus
uaauccugaauauauugauuuuc

SEQ ID NO: 3298872 - RNA, 14 nt, Variola virus
augagggaaaagau

SEQ ID NO: 3298873 - RNA, 15 nt, Variola virus
auuauucgagugaaa

SEQ ID NO: 3298874 - RNA, 20 nt, Variola virus
aauccauucucucaaucacu

SEQ ID NO: 3298875 - RNA, 19 nt, Variola virus
guuacauuuccaugucaaa

SEQ ID NO: 3298876 - RNA, 15 nt, Variola virus
caacaaguauacaau

SEQ ID NO: 3298877 - RNA, 22 nt, Variola virus
ccagauuuaaaaagguucacau

SEQ ID NO: 3298878 - RNA, 15 nt, Variola virus
uaaucuuuguuggau

SEQ ID NO: 3298879 - RNA, 14 nt, Variola virus
ucaacucaugugua

SEQ ID NO: 3298880 - RNA, 16 nt, Variola virus
uuaaugaaacaucguu

SEQ ID NO: 3298881 - RNA, 18 nt, Variola virus
cggagauuuaaucuguaa

SEQ ID NO: 3298882 - RNA, 17 nt, Variola virus
aauaugauuagaaguua

SEQ ID NO: 3298883 - RNA, 20 nt, Variola virus
uuaaaguuucugaaauaaga

SEQ ID NO: 3298884 - RNA, 23 nt, Variola virus
acaugcgguaaagauauuucuca

SEQ ID NO: 3298885 - RNA, 16 nt, Variola virus
uacauaaaaaaaaugu

SEQ ID NO: 3298886 - RNA, 19 nt, Variola virus
acacauucuuuagaacuuc

SEQ ID NO: 3298887 - RNA, 22 nt, Variola virus
aguacuucucccauaauacuuu

SEQ ID NO: 3298888 - RNA, 19 nt, Variola virus
cauuuauggcguauacaac

SEQ ID NO: 3298889 - RNA, 13 nt, Variola virus
uucuacaauaacu

SEQ ID NO: 3298890 - RNA, 16 nt, Variola virus
uacuauccaucagaau

SEQ ID NO: 3298891 - RNA, 21 nt, Variola virus
gaaucauaaaaaaaaguuuua

SEQ ID NO: 3298892 - RNA, 15 nt, Variola virus
uuaauucucucaggu

SEQ ID NO: 3298893 - RNA, 14 nt, Variola virus
caaacuguaaaugu

SEQ ID NO: 3298894 - RNA, 15 nt, Variola virus
aacgauauuugugaa

SEQ ID NO: 3298895 - RNA, 19 nt, Variola virus
auaucgguaccguuaaaga

SEQ ID NO: 3298896 - RNA, 23 nt, Variola virus
auaucucguuuagaaaaaugcua

SEQ ID NO: 3298897 - RNA, 14 nt, Variola virus
agaaggaguguuuu

SEQ ID NO: 3298898 - RNA, 18 nt, Variola virus
auuuuccaaauacaucca

SEQ ID NO: 3298899 - RNA, 16 nt, Variola virus
auuuauguuuuaaaua

SEQ ID NO: 3298900 - RNA, 15 nt, Variola virus
ucaacaaucguuaau

SEQ ID NO: 3298901 - RNA, 18 nt, Variola virus
uaaaauuaaauaguagua

SEQ ID NO: 3298902 - RNA, 23 nt, Variola virus
auaucuaggcgguggauauuucu

SEQ ID NO: 3298903 - RNA, 22 nt, Variola virus
agagauuggguuaauaaauaca

SEQ ID NO: 3298904 - RNA, 23 nt, Variola virus
guuccguuggaugguaauaaacu

SEQ ID NO: 3298905 - RNA, 17 nt, Variola virus
auaaacaacauaauaca

SEQ ID NO: 3298906 - RNA, 15 nt, Variola virus
guauaucuauaucaa

SEQ ID NO: 3298907 - RNA, 11 nt, Variola virus
uaacugaagaa

SEQ ID NO: 3298908 - RNA, 14 nt, Variola virus
guuaaagaucuuaa

SEQ ID NO: 3298909 - RNA, 15 nt, Variola virus
uugucuuaacuauaa

SEQ ID NO: 3298910 - RNA, 16 nt, Variola virus
auuacuuuaauaguug

SEQ ID NO: 3298911 - RNA, 18 nt, Variola virus
aagccuuaugcauccaaa

SEQ ID NO: 3298912 - RNA, 23 nt, Variola virus
auuccggcguaugaauugacauu

SEQ ID NO: 3298913 - RNA, 12 nt, Variola virus
cuaccuauuuca

SEQ ID NO: 3298914 - RNA, 17 nt, Variola virus
ugaaugguaaagaaugc

SEQ ID NO: 3298915 - RNA, 17 nt, Variola virus
uuaugaugauacauuuu

SEQ ID NO: 3298916 - RNA, 13 nt, Variola virus
acauuuuaaaaua

SEQ ID NO: 3298917 - RNA, 14 nt, Variola virus
auuucaaaauguua

SEQ ID NO: 3298918 - RNA, 18 nt, Variola virus
aauguagaaauuagaaag

SEQ ID NO: 3298919 - RNA, 20 nt, Variola virus
uauuagaaauuuaucaauau

SEQ ID NO: 3298920 - RNA, 21 nt, Variola virus
uaucucguccuugguuuacau

SEQ ID NO: 3298921 - RNA, 23 nt, Variola virus
cauaaacaauauuaaggagauuc

SEQ ID NO: 3298922 - RNA, 21 nt, Variola virus
uuuuuagaaaaaacaucauuu

SEQ ID NO: 3298923 - RNA, 14 nt, Variola virus
gaaucugaaaaugu

SEQ ID NO: 3298924 - RNA, 21 nt, Variola virus
cauggcucguaccaacaguaa

SEQ ID NO: 3298925 - RNA, 20 nt, Variola virus
aucuaaagauaaucuucucu

SEQ ID NO: 3298926 - RNA, 13 nt, Variola virus
uguucaaaugccu

SEQ ID NO: 3298927 - RNA, 15 nt, Variola virus
aaucuuauaucuucu

SEQ ID NO: 3298928 - RNA, 17 nt, Variola virus
gauuucugauuauucac

SEQ ID NO: 3298929 - RNA, 16 nt, Variola virus
gaucuuaccaucuucu

SEQ ID NO: 3298930 - RNA, 22 nt, Variola virus
aaucaggguuaucaaaguguuu

SEQ ID NO: 3298931 - RNA, 15 nt, Variola virus
aguaaccaaaaugaa

SEQ ID NO: 3298932 - RNA, 20 nt, Variola virus
gauaaaaaggaaucuauuaa

SEQ ID NO: 3298933 - RNA, 22 nt, Variola virus
aaaguuuuuaagagauaaucua

SEQ ID NO: 3298934 - RNA, 15 nt, Variola virus
ugagugcagaugcug

SEQ ID NO: 3298935 - RNA, 14 nt, Variola virus
uugguaaauuccau

SEQ ID NO: 3298936 - RNA, 15 nt, Variola virus
ggauaugucuagaac

SEQ ID NO: 3298937 - RNA, 22 nt, Variola virus
auuagcggcauaggaacauuuc

SEQ ID NO: 3298938 - RNA, 22 nt, Variola virus
gcuuuugcgaucaauaaaugga

SEQ ID NO: 3298939 - RNA, 18 nt, Variola virus
cucuacucauuucauuau

SEQ ID NO: 3298940 - RNA, 17 nt, Variola virus
aguuauccgaucuaaaa

SEQ ID NO: 3298941 - RNA, 20 nt, Variola virus
aauauaaaaaaauaaauaua

SEQ ID NO: 3298942 - RNA, 13 nt, Variola virus
aguaaucauguaa

SEQ ID NO: 3298943 - RNA, 19 nt, Variola virus
ucgaucggugaaaagucuu

SEQ ID NO: 3298944 - RNA, 12 nt, Variola virus
cucuuuaauagc

SEQ ID NO: 3298945 - RNA, 15 nt, Variola virus
uuccaucuagacuau

SEQ ID NO: 3298946 - RNA, 16 nt, Variola virus
agaccaucuaacagaa

SEQ ID NO: 3298947 - RNA, 21 nt, Variola virus
aucuauaaaauuuuaauuaag

SEQ ID NO: 3298948 - RNA, 17 nt, Variola virus
uuaaauaacucauuuau

SEQ ID NO: 3298949 - RNA, 15 nt, Variola virus
auauccauaggaaag

SEQ ID NO: 3298950 - RNA, 17 nt, Variola virus
ggacacgacauagagag

SEQ ID NO: 3298951 - RNA, 14 nt, Variola virus
gugaaucuguucaa

SEQ ID NO: 3298952 - RNA, 18 nt, Variola virus
acuucagaugauggugca

SEQ ID NO: 3298953 - RNA, 15 nt, Variola virus
auuacaaauacuuua

SEQ ID NO: 3298954 - RNA, 14 nt, Variola virus
ugaacuauuucuug

SEQ ID NO: 3298955 - RNA, 15 nt, Variola virus
cauagaugaaauacu

SEQ ID NO: 3298956 - RNA, 19 nt, Variola virus
auguccucaaauaaauacu

SEQ ID NO: 3298957 - RNA, 19 nt, Variola virus
aaucauuuuuuuaaaacug

SEQ ID NO: 3298958 - RNA, 16 nt, Variola virus
aucugauuuauuuccu

SEQ ID NO: 3298959 - RNA, 21 nt, Variola virus
uuacaauguagaaauuagaaa

SEQ ID NO: 3298960 - RNA, 14 nt, Variola virus
aaugcagaaaugau

SEQ ID NO: 3298961 - RNA, 19 nt, Variola virus
uauuccuuucauuaacaau

SEQ ID NO: 3298962 - RNA, 12 nt, Variola virus
uaaaaauuauua

SEQ ID NO: 3298963 - RNA, 20 nt, Variola virus
ucuauuucaucguuuuguau

SEQ ID NO: 3298964 - RNA, 22 nt, Variola virus
uauucuaucccccguauuuaca

SEQ ID NO: 3298965 - RNA, 16 nt, Variola virus
uguguucuuguguaau

SEQ ID NO: 3298966 - RNA, 19 nt, Variola virus
auuaauacggcagcaacua

SEQ ID NO: 3298967 - RNA, 20 nt, Variola virus
caaauuuauuccauauuuua

SEQ ID NO: 3298968 - RNA, 12 nt, Variola virus
uucauuaauuuc

SEQ ID NO: 3298969 - RNA, 13 nt, Variola virus
gaaaagauucuuu

SEQ ID NO: 3298970 - RNA, 21 nt, Variola virus
auguguuucccaaacaaaaug

SEQ ID NO: 3298971 - RNA, 18 nt, Variola virus
uguuagaagucuuaaaaa

SEQ ID NO: 3298972 - RNA, 15 nt, Variola virus
uaucuauguuaucau

SEQ ID NO: 3298973 - RNA, 16 nt, Variola virus
uuguacuaaacacacu

SEQ ID NO: 3298974 - RNA, 21 nt, Variola virus
agaaauccaaauaaaauggau

SEQ ID NO: 3298975 - RNA, 15 nt, Variola virus
uaaacauaucauaau

SEQ ID NO: 3298976 - RNA, 13 nt, Variola virus
agauauaugguuu

SEQ ID NO: 3298977 - RNA, 13 nt, Variola virus
uauauguuuucau

SEQ ID NO: 3298978 - RNA, 14 nt, Variola virus
uccauuuuacauua

SEQ ID NO: 3298979 - RNA, 17 nt, Variola virus
auuaccauagaagaugu

SEQ ID NO: 3298980 - RNA, 13 nt, Variola virus
uguacuuaacaug

SEQ ID NO: 3298981 - RNA, 18 nt, Variola virus
cauaauccuuguaaugau

SEQ ID NO: 3298982 - RNA, 14 nt, Variola virus
uguaugaaaugcuu

SEQ ID NO: 3298983 - RNA, 17 nt, Variola virus
auacucuacagaguuga

SEQ ID NO: 3298984 - RNA, 16 nt, Variola virus
gaaagagauaauagaa

SEQ ID NO: 3298985 - RNA, 15 nt, Variola virus
auugugcgacacuag

SEQ ID NO: 3298986 - RNA, 13 nt, Variola virus
auguggaauuaug

SEQ ID NO: 3298987 - RNA, 20 nt, Variola virus
ugaaguuggcgcauaucuuu

SEQ ID NO: 3298988 - RNA, 21 nt, Variola virus
aguauccguauaaaaaucgau

SEQ ID NO: 3298989 - RNA, 16 nt, Variola virus
uacgaacaauaucuua

SEQ ID NO: 3298990 - RNA, 19 nt, Variola virus
acuuccaauaaaauuacuu

SEQ ID NO: 3298991 - RNA, 16 nt, Variola virus
guauuggauguaugca

SEQ ID NO: 3298992 - RNA, 21 nt, Variola virus
agaaauggaagaguuaauaaa

SEQ ID NO: 3298993 - RNA, 13 nt, Variola virus
uccuuaaaguaac

SEQ ID NO: 3298994 - RNA, 19 nt, Variola virus
aguguagcguuuuaaauau

SEQ ID NO: 3298995 - RNA, 14 nt, Variola virus
uucucugaauauag

SEQ ID NO: 3298996 - RNA, 20 nt, Variola virus
aaucagucauaacaaaugua

SEQ ID NO: 3298997 - RNA, 15 nt, Variola virus
agaacggagaauugu

SEQ ID NO: 3298998 - RNA, 23 nt, Variola virus
agauuagucagaccauucuuggu

SEQ ID NO: 3298999 - RNA, 13 nt, Variola virus
cguaccaguuuca

SEQ ID NO: 3299000 - RNA, 18 nt, Variola virus
guauuguuuaauaaaaca

SEQ ID NO: 3299001 - RNA, 21 nt, Variola virus
gcauucuauucgaauaaugag

SEQ ID NO: 3299002 - RNA, 23 nt, Variola virus
uggaucaucgugugauaugaaca

SEQ ID NO: 3299003 - RNA, 21 nt, Variola virus
cgggucaucugguuuaggaaa

SEQ ID NO: 3299004 - RNA, 23 nt, Variola virus
caaaaguaguucaacauaauauu

SEQ ID NO: 3299005 - RNA, 15 nt, Variola virus
cuaacacauuucaac

SEQ ID NO: 3299006 - RNA, 11 nt, Variola virus
aaguaaaugaa

SEQ ID NO: 3299007 - RNA, 21 nt, Variola virus
cucuaaacaauuggacaaauu

SEQ ID NO: 3299008 - RNA, 18 nt, Variola virus
gauuucuuaucuguaguu

SEQ ID NO: 3299009 - RNA, 14 nt, Variola virus
acuugauaauuaau

SEQ ID NO: 3299010 - RNA, 15 nt, Variola virus
aaaauuuaaagaaug

SEQ ID NO: 3299011 - RNA, 14 nt, Variola virus
agaaucucaugaau

SEQ ID NO: 3299012 - RNA, 16 nt, Variola virus
uuaauacggaauauag

SEQ ID NO: 3299013 - RNA, 19 nt, Variola virus
cuauuuuuuuauacuucua

SEQ ID NO: 3299014 - RNA, 21 nt, Variola virus
gaauaacuguaauuuuauucu

SEQ ID NO: 3299015 - RNA, 18 nt, Variola virus
aauuccguuaauauuaaa

SEQ ID NO: 3299016 - RNA, 15 nt, Variola virus
uuucuacuagacuau

SEQ ID NO: 3299017 - RNA, 22 nt, Variola virus
auuaguaaggcuuuagaaacuu

SEQ ID NO: 3299018 - RNA, 14 nt, Variola virus
ugacuuaguucuua

SEQ ID NO: 3299019 - RNA, 21 nt, Variola virus
caaauauucacaagaugaauu

SEQ ID NO: 3299020 - RNA, 20 nt, Variola virus
uacuuguuaguaguuagaua

SEQ ID NO: 3299021 - RNA, 21 nt, Variola virus
cacuaucaaucgauaacaagg

SEQ ID NO: 3299022 - RNA, 15 nt, Variola virus
aacuucguaaaauau

SEQ ID NO: 3299023 - RNA, 22 nt, Variola virus
acucaugaaucuaaaagaauug

SEQ ID NO: 3299024 - RNA, 21 nt, Variola virus
aaagacaucauauauagaaug

SEQ ID NO: 3299025 - RNA, 12 nt, Variola virus
aaaaauuauccu

SEQ ID NO: 3299026 - RNA, 15 nt, Variola virus
uagauauaaauucaa

SEQ ID NO: 3299027 - RNA, 14 nt, Variola virus
uugcuuuucuaauc

SEQ ID NO: 3299028 - RNA, 14 nt, Variola virus
uacuauacacaaug

SEQ ID NO: 3299029 - RNA, 14 nt, Variola virus
aacuguauaaaaug

SEQ ID NO: 3299030 - RNA, 12 nt, Variola virus
auguaaaugaua

SEQ ID NO: 3299031 - RNA, 24 nt, Variola virus
aucaacauaaugucauaguugaac

SEQ ID NO: 3299032 - RNA, 19 nt, Variola virus
guaucgcccuaauauuauu

SEQ ID NO: 3299033 - RNA, 18 nt, Variola virus
ccaagaaacagucagcug

SEQ ID NO: 3299034 - RNA, 22 nt, Variola virus
uuaaagagacuacaauauauuc

SEQ ID NO: 3299035 - RNA, 16 nt, Variola virus
aaagauuaauacauua

SEQ ID NO: 3299036 - RNA, 15 nt, Variola virus
acgaaugguuucauc

SEQ ID NO: 3299037 - RNA, 23 nt, Variola virus
aacugcguuguuucaugacaauc

SEQ ID NO: 3299038 - RNA, 15 nt, Variola virus
caucucuauguuuca

SEQ ID NO: 3299039 - RNA, 15 nt, Variola virus
acacgagccuuuauu

SEQ ID NO: 3299040 - RNA, 19 nt, Variola virus
cugcagccauuuuuaugau

SEQ ID NO: 3299041 - RNA, 19 nt, Variola virus
cagauaaucagccauaauu

SEQ ID NO: 3299042 - RNA, 14 nt, Variola virus
agaaguuuuaucca

SEQ ID NO: 3299043 - RNA, 16 nt, Variola virus
cauaaacaauauaaau

SEQ ID NO: 3299044 - RNA, 17 nt, Variola virus
auucgaaaacucuaaga

SEQ ID NO: 3299045 - RNA, 14 nt, Variola virus
ugaugauagagaua

SEQ ID NO: 3299046 - RNA, 20 nt, Variola virus
uaaacuauuuuaccagcauu

SEQ ID NO: 3299047 - RNA, 23 nt, Variola virus
guauccacuuuaauaauaucaua

SEQ ID NO: 3299048 - RNA, 18 nt, Variola virus
ucuaucuuuaguaguguu

SEQ ID NO: 3299049 - RNA, 21 nt, Variola virus
aaauuacgagccaaaucuucu

SEQ ID NO: 3299050 - RNA, 21 nt, Variola virus
agaauaugucucuuaacuauu

SEQ ID NO: 3299051 - RNA, 13 nt, Variola virus
gaaauauauuaag

SEQ ID NO: 3299052 - RNA, 23 nt, Variola virus
ucauaucuagaaugaagauauca

SEQ ID NO: 3299053 - RNA, 17 nt, Variola virus
acggcaacuggaaaguc

SEQ ID NO: 3299054 - RNA, 21 nt, Variola virus
aucuccucuaugcaacuguaa

SEQ ID NO: 3299055 - RNA, 12 nt, Variola virus
auaaucaaacac

SEQ ID NO: 3299056 - RNA, 22 nt, Variola virus
uaaguucuggaauauuaucauc

SEQ ID NO: 3299057 - RNA, 20 nt, Variola virus
auaauauuuguuaucaugau

SEQ ID NO: 3299058 - RNA, 14 nt, Variola virus
aagauguuagaaaa

SEQ ID NO: 3299059 - RNA, 22 nt, Variola virus
aacaaaugcaccaaaguuauau

SEQ ID NO: 3299060 - RNA, 17 nt, Variola virus
agcauugcuuucauuau

SEQ ID NO: 3299061 - RNA, 16 nt, Variola virus
uagauuauaauccuua

SEQ ID NO: 3299062 - RNA, 15 nt, Variola virus
agaugagaacucuau

SEQ ID NO: 3299063 - RNA, 22 nt, Variola virus
uacgcauucacucauacaugua

SEQ ID NO: 3299064 - RNA, 22 nt, Variola virus
gaaaauucuaauggaugauguu

SEQ ID NO: 3299065 - RNA, 13 nt, Variola virus
aaacaugugguau

SEQ ID NO: 3299066 - RNA, 18 nt, Variola virus
auguaacccgugcauauu

SEQ ID NO: 3299067 - RNA, 16 nt, Variola virus
uaaaauaaaagaguau

SEQ ID NO: 3299068 - RNA, 12 nt, Variola virus
ucugaagaagag

SEQ ID NO: 3299069 - RNA, 13 nt, Variola virus
aaaagauaauaca

SEQ ID NO: 3299070 - RNA, 16 nt, Variola virus
uagaauuucauuuugu

SEQ ID NO: 3299071 - RNA, 23 nt, Variola virus
ugucaauacuuuuguuacuaaua

SEQ ID NO: 3299072 - RNA, 14 nt, Variola virus
accacauaauacaa

SEQ ID NO: 3299073 - RNA, 15 nt, Variola virus
uaauauccaaucuua

SEQ ID NO: 3299074 - RNA, 19 nt, Variola virus
gauucaucaagguauauaa

SEQ ID NO: 3299075 - RNA, 15 nt, Variola virus
uuuaaacaguuuauu

SEQ ID NO: 3299076 - RNA, 20 nt, Variola virus
auaaaccauuagauaaaguu

SEQ ID NO: 3299077 - RNA, 18 nt, Variola virus
cucuauucugaaauaauu

SEQ ID NO: 3299078 - RNA, 13 nt, Variola virus
cauaauauauaca

SEQ ID NO: 3299079 - RNA, 15 nt, Variola virus
auuaugaaacuauau

SEQ ID NO: 3299080 - RNA, 19 nt, Variola virus
agcuucuccuccuauuugu

SEQ ID NO: 3299081 - RNA, 15 nt, Variola virus
uugaucagaaugaau

SEQ ID NO: 3299082 - RNA, 21 nt, Variola virus
uucuuagcgaaugaugcagac

SEQ ID NO: 3299083 - RNA, 17 nt, Variola virus
gcauggucuuguaauau

SEQ ID NO: 3299084 - RNA, 19 nt, Variola virus
cuauuaucuccguuauaga

SEQ ID NO: 3299085 - RNA, 23 nt, Variola virus
auuccaggaucuagauaauuaau

SEQ ID NO: 3299086 - RNA, 14 nt, Variola virus
aaauagggauguuu

SEQ ID NO: 3299087 - RNA, 21 nt, Variola virus
gaucuuaacuccucuauuaau

SEQ ID NO: 3299088 - RNA, 23 nt, Variola virus
auucagauaaucagccauaauua

SEQ ID NO: 3299089 - RNA, 19 nt, Variola virus
uagauuggagucuacuaau

SEQ ID NO: 3299090 - RNA, 17 nt, Variola virus
aucugccgaauacagug

SEQ ID NO: 3299091 - RNA, 14 nt, Variola virus
uauccaagaaaaag

SEQ ID NO: 3299092 - RNA, 17 nt, Variola virus
aauauccagaauguuuc

SEQ ID NO: 3299093 - RNA, 18 nt, Variola virus
cucucuucaacaucuuua

SEQ ID NO: 3299094 - RNA, 15 nt, Variola virus
uccuaguacacaaua

SEQ ID NO: 3299095 - RNA, 20 nt, Variola virus
guauuuuuuaugacaaacuu

SEQ ID NO: 3299096 - RNA, 16 nt, Variola virus
ugaagccauugaaaac

SEQ ID NO: 3299097 - RNA, 16 nt, Variola virus
aaccuuugcaaauaca

SEQ ID NO: 3299098 - RNA, 16 nt, Variola virus
auguaugcuaauagcg

SEQ ID NO: 3299099 - RNA, 17 nt, Variola virus
acauguguuuuaauaua

SEQ ID NO: 3299100 - RNA, 15 nt, Variola virus
acugacagauguguu

SEQ ID NO: 3299101 - RNA, 23 nt, Variola virus
uucccaaugguuucaucaauaga

SEQ ID NO: 3299102 - RNA, 15 nt, Variola virus
uaauuucuagaauau

SEQ ID NO: 3299103 - RNA, 18 nt, Variola virus
gaauaauguucaaaucua

SEQ ID NO: 3299104 - RNA, 15 nt, Variola virus
gaagauuauauucua

SEQ ID NO: 3299105 - RNA, 12 nt, Variola virus
acucaaacagaa

SEQ ID NO: 3299106 - RNA, 21 nt, Variola virus
aucgauguuauuaucaaaguc

SEQ ID NO: 3299107 - RNA, 13 nt, Variola virus
gauguucauauau

SEQ ID NO: 3299108 - RNA, 21 nt, Variola virus
ccauagucuucaauaauucua

SEQ ID NO: 3299109 - RNA, 16 nt, Variola virus
cagucaaauucgguaa

SEQ ID NO: 3299110 - RNA, 18 nt, Variola virus
auaaauugguaaauccua

SEQ ID NO: 3299111 - RNA, 23 nt, Variola virus
aauucuauaauaaacuuuaauga

SEQ ID NO: 3299112 - RNA, 18 nt, Variola virus
caauuauacuagaacuau

SEQ ID NO: 3299113 - RNA, 16 nt, Variola virus
aguuuaucauacuuag

SEQ ID NO: 3299114 - RNA, 19 nt, Variola virus
guuagaugauuauaaagga

SEQ ID NO: 3299115 - RNA, 21 nt, Variola virus
aucauggcggugccagaaauu

SEQ ID NO: 3299116 - RNA, 20 nt, Variola virus
uaauuguuuaccgguguaau

SEQ ID NO: 3299117 - RNA, 13 nt, Variola virus
auauuugaaaauc

SEQ ID NO: 3299118 - RNA, 20 nt, Variola virus
aauacauauuuuuuguaaaa

SEQ ID NO: 3299119 - RNA, 15 nt, Variola virus
aacagauaguuuauu

SEQ ID NO: 3299120 - RNA, 13 nt, Variola virus
aaguauaaauacc

SEQ ID NO: 3299121 - RNA, 19 nt, Variola virus
aaaucggauggauugguaa

SEQ ID NO: 3299122 - RNA, 20 nt, Variola virus
agucaauaaaggcaaagaua

SEQ ID NO: 3299123 - RNA, 15 nt, Variola virus
uuauuagauuuggua

SEQ ID NO: 3299124 - RNA, 13 nt, Variola virus
cauauucucauaa

SEQ ID NO: 3299125 - RNA, 22 nt, Variola virus
aaucaguuacaaaacguuuaua

SEQ ID NO: 3299126 - RNA, 21 nt, Variola virus
gaaauagcgcugaaaauaaag

SEQ ID NO: 3299127 - RNA, 18 nt, Variola virus
uuauuccaauuauuugaa

SEQ ID NO: 3299128 - RNA, 13 nt, Variola virus
gaggagaaguaau

SEQ ID NO: 3299129 - RNA, 17 nt, Variola virus
uacguaucaccaacgga

SEQ ID NO: 3299130 - RNA, 13 nt, Variola virus
aucuauuagaaaa

SEQ ID NO: 3299131 - RNA, 17 nt, Variola virus
auccuaacuuuaaacaa

SEQ ID NO: 3299132 - RNA, 15 nt, Variola virus
gaaauaaauaaugaa

SEQ ID NO: 3299133 - RNA, 23 nt, Variola virus
caaaauuaaccgauaaaaagacu

SEQ ID NO: 3299134 - RNA, 21 nt, Variola virus
caugauucuaucucuaagacg

SEQ ID NO: 3299135 - RNA, 18 nt, Variola virus
auguuuccgagaaauaua

SEQ ID NO: 3299136 - RNA, 14 nt, Variola virus
auccacuucuucca

SEQ ID NO: 3299137 - RNA, 20 nt, Variola virus
cuauauuuguuccuguagau

SEQ ID NO: 3299138 - RNA, 17 nt, Variola virus
aaaacgauuggaaucua

SEQ ID NO: 3299139 - RNA, 14 nt, Variola virus
auaaccauuucuau

SEQ ID NO: 3299140 - RNA, 22 nt, Variola virus
cccaauagaauaguauucucag

SEQ ID NO: 3299141 - RNA, 16 nt, Variola virus
gaauuuauuucuaauu

SEQ ID NO: 3299142 - RNA, 16 nt, Variola virus
uccacauuaauacagc

SEQ ID NO: 3299143 - RNA, 19 nt, Variola virus
aaguuuggguaaauaacua

SEQ ID NO: 3299144 - RNA, 9 nt, Variola virus
uuaccaucg

SEQ ID NO: 3299145 - RNA, 14 nt, Variola virus
auaaugaacauagu

SEQ ID NO: 3299146 - RNA, 15 nt, Variola virus
cauauaaauauaauu

SEQ ID NO: 3299147 - RNA, 19 nt, Variola virus
caaccaucucauaaaauag

SEQ ID NO: 3299148 - RNA, 23 nt, Variola virus
aacuaccaauaugucuguacaaa

SEQ ID NO: 3299149 - RNA, 14 nt, Variola virus
uauuauacuuguau

SEQ ID NO: 3299150 - RNA, 15 nt, Variola virus
auaagccaaagcauu

SEQ ID NO: 3299151 - RNA, 13 nt, Variola virus
ugacgacaaacag

SEQ ID NO: 3299152 - RNA, 15 nt, Variola virus
aaacuuuuuagaaau

SEQ ID NO: 3299153 - RNA, 18 nt, Variola virus
aagaacgauguacaacug

SEQ ID NO: 3299154 - RNA, 18 nt, Variola virus
augucuguacaaauguua

SEQ ID NO: 3299155 - RNA, 15 nt, Variola virus
uguauguuugggaga

SEQ ID NO: 3299156 - RNA, 18 nt, Variola virus
uauaccuuguaauuaaau

SEQ ID NO: 3299157 - RNA, 17 nt, Variola virus
uagaugucgaagacuua

SEQ ID NO: 3299158 - RNA, 15 nt, Variola virus
gauguauaaguuuua

SEQ ID NO: 3299159 - RNA, 12 nt, Variola virus
uuccucauuaag

SEQ ID NO: 3299160 - RNA, 17 nt, Variola virus
auagauaaguauuuacu

SEQ ID NO: 3299161 - RNA, 15 nt, Variola virus
guauuaacuauauca

SEQ ID NO: 3299162 - RNA, 22 nt, Variola virus
accauaacuguauaaaauggag

SEQ ID NO: 3299163 - RNA, 17 nt, Variola virus
aauucaaauagauguuc

SEQ ID NO: 3299164 - RNA, 22 nt, Variola virus
aaauaaaacaaggauucguuua

SEQ ID NO: 3299165 - RNA, 15 nt, Variola virus
uguuaagaauuuaga

SEQ ID NO: 3299166 - RNA, 16 nt, Variola virus
aucauaauaugagaug

SEQ ID NO: 3299167 - RNA, 22 nt, Variola virus
uagagugaguuuaggauucauu

SEQ ID NO: 3299168 - RNA, 13 nt, Variola virus
gacuaucaacaau

SEQ ID NO: 3299169 - RNA, 21 nt, Variola virus
ucguaugucauaaauucuuua

SEQ ID NO: 3299170 - RNA, 24 nt, Variola virus
uagucgguuaauguuguauuucau

SEQ ID NO: 3299171 - RNA, 22 nt, Variola virus
aaauugcgacacuauucaugua

SEQ ID NO: 3299172 - RNA, 22 nt, Variola virus
uuacauuaaauguauauuuucc

SEQ ID NO: 3299173 - RNA, 18 nt, Variola virus
guacaccaucaaauuguu

SEQ ID NO: 3299174 - RNA, 14 nt, Variola virus
cacugauauuauga

SEQ ID NO: 3299175 - RNA, 17 nt, Variola virus
uuaucucuauucaucau

SEQ ID NO: 3299176 - RNA, 18 nt, Variola virus
ucaaaaauauucauuaau

SEQ ID NO: 3299177 - RNA, 21 nt, Variola virus
cauguuacacuauauaacaau

SEQ ID NO: 3299178 - RNA, 21 nt, Variola virus
cuagugcuuguauguguuaua

SEQ ID NO: 3299179 - RNA, 16 nt, Variola virus
aguugcugaugaugaa

SEQ ID NO: 3299180 - RNA, 19 nt, Variola virus
uugauuuaaagucuagagu

SEQ ID NO: 3299181 - RNA, 14 nt, Variola virus
uccauuuucuguaa

SEQ ID NO: 3299182 - RNA, 23 nt, Variola virus
gcugcuaugauaauuagaucauu

SEQ ID NO: 3299183 - RNA, 16 nt, Variola virus
uucuagaaaaaauuac

SEQ ID NO: 3299184 - RNA, 14 nt, Variola virus
aaugacauggaaau

SEQ ID NO: 3299185 - RNA, 15 nt, Variola virus
auuuuaacauaugau

SEQ ID NO: 3299186 - RNA, 18 nt, Variola virus
guuagaaagcagauuaga

SEQ ID NO: 3299187 - RNA, 17 nt, Variola virus
aguggugugaauacaac

SEQ ID NO: 3299188 - RNA, 15 nt, Variola virus
uuuaauaucuaaaua

SEQ ID NO: 3299189 - RNA, 14 nt, Variola virus
aaguuucugaaaua

SEQ ID NO: 3299190 - RNA, 16 nt, Variola virus
uaaauauccauugucu

SEQ ID NO: 3299191 - RNA, 18 nt, Variola virus
aagucgacaaccaaacgu

SEQ ID NO: 3299192 - RNA, 19 nt, Variola virus
auauccguuaaguuuguau

SEQ ID NO: 3299193 - RNA, 14 nt, Variola virus
agaguuuaauacua

SEQ ID NO: 3299194 - RNA, 13 nt, Variola virus
uucuauguaucua

SEQ ID NO: 3299195 - RNA, 21 nt, Variola virus
gguagauuuguucuauagagc

SEQ ID NO: 3299196 - RNA, 22 nt, Variola virus
ccucuauuauacauuuaauguu

SEQ ID NO: 3299197 - RNA, 18 nt, Variola virus
gauaacacauuuucaucu

SEQ ID NO: 3299198 - RNA, 21 nt, Variola virus
uaaucuguacuucuauacaaa

SEQ ID NO: 3299199 - RNA, 13 nt, Variola virus
cauguuggaauag

SEQ ID NO: 3299200 - RNA, 18 nt, Variola virus
uuagaaacuucaaagauu

SEQ ID NO: 3299201 - RNA, 12 nt, Variola virus
cucuauaauauu

SEQ ID NO: 3299202 - RNA, 14 nt, Variola virus
ccgucuaucaucua

SEQ ID NO: 3299203 - RNA, 17 nt, Variola virus
auggaccgucggacagu

SEQ ID NO: 3299204 - RNA, 14 nt, Variola virus
auauucaucagaua

SEQ ID NO: 3299205 - RNA, 19 nt, Variola virus
auaauccggauguugugua

SEQ ID NO: 3299206 - RNA, 15 nt, Variola virus
acuggcguuguucaa

SEQ ID NO: 3299207 - RNA, 16 nt, Variola virus
accaaauuaaugaaua

SEQ ID NO: 3299208 - RNA, 18 nt, Variola virus
ucauccuuguucaucauu

SEQ ID NO: 3299209 - RNA, 22 nt, Variola virus
aaguuuuauagagauagaugaa

SEQ ID NO: 3299210 - RNA, 14 nt, Variola virus
aacuacaaaaaugc

SEQ ID NO: 3299211 - RNA, 15 nt, Variola virus
gagaaaauagauauc

SEQ ID NO: 3299212 - RNA, 15 nt, Variola virus
aacuguucaaaauau

SEQ ID NO: 3299213 - RNA, 19 nt, Variola virus
guuccguguguaauaaccu

SEQ ID NO: 3299214 - RNA, 14 nt, Variola virus
auggaguuguaaau

SEQ ID NO: 3299215 - RNA, 15 nt, Variola virus
gauggauauauuaaa

SEQ ID NO: 3299216 - RNA, 19 nt, Variola virus
auuucuuuuucaaagaaaa

SEQ ID NO: 3299217 - RNA, 22 nt, Variola virus
gaaaaguuauuaucuguagacg

SEQ ID NO: 3299218 - RNA, 15 nt, Variola virus
augaacaaaucaaua

SEQ ID NO: 3299219 - RNA, 17 nt, Variola virus
aggagcaccagaaguau

SEQ ID NO: 3299220 - RNA, 14 nt, Variola virus
ccuuaauauaauag

SEQ ID NO: 3299221 - RNA, 20 nt, Variola virus
aaccaugcuacaaucauuau

SEQ ID NO: 3299222 - RNA, 21 nt, Variola virus
aggauauacucaauagaauuu

SEQ ID NO: 3299223 - RNA, 18 nt, Variola virus
guuaaaaaaauuauccua

SEQ ID NO: 3299224 - RNA, 22 nt, Variola virus
uauuuuacauggauuuaucaua

SEQ ID NO: 3299225 - RNA, 12 nt, Variola virus
gacguagaaaac

SEQ ID NO: 3299226 - RNA, 19 nt, Variola virus
cuuuggagucucaucuuua

SEQ ID NO: 3299227 - RNA, 21 nt, Variola virus
gauaaguuucggcacauauua

SEQ ID NO: 3299228 - RNA, 11 nt, Variola virus
cuaaugauaua

SEQ ID NO: 3299229 - RNA, 15 nt, Variola virus
ucauuuuauaauugu

SEQ ID NO: 3299230 - RNA, 16 nt, Variola virus
uaacuuuaauguguga

SEQ ID NO: 3299231 - RNA, 13 nt, Variola virus
auaguacauuccc

SEQ ID NO: 3299232 - RNA, 16 nt, Variola virus
acagaugauauaucca

SEQ ID NO: 3299233 - RNA, 23 nt, Variola virus
caacaagucauuacuaauagagu

SEQ ID NO: 3299234 - RNA, 19 nt, Variola virus
guuuuggauuauaaucauc

SEQ ID NO: 3299235 - RNA, 17 nt, Variola virus
agaauauccucuagaga

SEQ ID NO: 3299236 - RNA, 18 nt, Variola virus
acuuuacuggguauucca

SEQ ID NO: 3299237 - RNA, 17 nt, Variola virus
cuaguagcgaaaacuau

SEQ ID NO: 3299238 - RNA, 13 nt, Variola virus
uugauucuaguau

SEQ ID NO: 3299239 - RNA, 19 nt, Variola virus
acuucuguauguacagcau

SEQ ID NO: 3299240 - RNA, 20 nt, Variola virus
auauauuaauacacauaaug

SEQ ID NO: 3299241 - RNA, 12 nt, Variola virus
auccaaacauua

SEQ ID NO: 3299242 - RNA, 22 nt, Variola virus
cgagugaguacggauuaaacau

SEQ ID NO: 3299243 - RNA, 21 nt, Variola virus
gcucuuuguccauuauuucua

SEQ ID NO: 3299244 - RNA, 12 nt, Variola virus
agaagaaauuga

SEQ ID NO: 3299245 - RNA, 12 nt, Variola virus
ucauuagauguu

SEQ ID NO: 3299246 - RNA, 18 nt, Variola virus
caacaaucuaauacaaaa

SEQ ID NO: 3299247 - RNA, 12 nt, Variola virus
aacuaaaaaugu

SEQ ID NO: 3299248 - RNA, 22 nt, Variola virus
agaugaaaaauuuuccacaucu

SEQ ID NO: 3299249 - RNA, 20 nt, Variola virus
agcauuauugguauucuucu

SEQ ID NO: 3299250 - RNA, 14 nt, Variola virus
agauggucugaaau

SEQ ID NO: 3299251 - RNA, 22 nt, Variola virus
auaaagaaaugucuacauaaau

SEQ ID NO: 3299252 - RNA, 21 nt, Variola virus
gauccaauaaauuaucaaaua

SEQ ID NO: 3299253 - RNA, 18 nt, Variola virus
gccaacagguuaaagaaa

SEQ ID NO: 3299254 - RNA, 16 nt, Variola virus
aacaaauauuggcaua

SEQ ID NO: 3299255 - RNA, 12 nt, Variola virus
aucucaaaauag

SEQ ID NO: 3299256 - RNA, 15 nt, Variola virus
aauugcgaauguuuu

SEQ ID NO: 3299257 - RNA, 19 nt, Variola virus
ucacagaauccgaguaaaa

SEQ ID NO: 3299258 - RNA, 15 nt, Variola virus
uaguuuuacuaucau

SEQ ID NO: 3299259 - RNA, 20 nt, Variola virus
cgucucauuucuaucuguuu

SEQ ID NO: 3299260 - RNA, 17 nt, Variola virus
accaaaaaggauaaaga

SEQ ID NO: 3299261 - RNA, 19 nt, Variola virus
gaacauggguuacauauca

SEQ ID NO: 3299262 - RNA, 17 nt, Variola virus
gucccucauaauaaauu

SEQ ID NO: 3299263 - RNA, 21 nt, Variola virus
ucuuaaagccauacauuuaga

SEQ ID NO: 3299264 - RNA, 16 nt, Variola virus
aauaucuagauuauaa

SEQ ID NO: 3299265 - RNA, 11 nt, Variola virus
ggcaaauuguc

SEQ ID NO: 3299266 - RNA, 18 nt, Variola virus
augacgauccuuuaagag

SEQ ID NO: 3299267 - RNA, 12 nt, Variola virus
auuauaccaaaa

SEQ ID NO: 3299268 - RNA, 21 nt, Variola virus
caauccguaacggaaauuaca

SEQ ID NO: 3299269 - RNA, 16 nt, Variola virus
agugucuauaaaugua

SEQ ID NO: 3299270 - RNA, 12 nt, Variola virus
ccuuaucuucua

SEQ ID NO: 3299271 - RNA, 20 nt, Variola virus
acauaagccauuaacagcuu

SEQ ID NO: 3299272 - RNA, 17 nt, Variola virus
uagauuaugaagaauac

SEQ ID NO: 3299273 - RNA, 14 nt, Variola virus
aaaccaauuuguau

SEQ ID NO: 3299274 - RNA, 20 nt, Variola virus
aacaucgaagaugaaucaaa

SEQ ID NO: 3299275 - RNA, 17 nt, Variola virus
aacuuaaacaaaauaca

SEQ ID NO: 3299276 - RNA, 16 nt, Variola virus
uuagaaggaguguuuu

SEQ ID NO: 3299277 - RNA, 15 nt, Variola virus
acuauaauuuuguga

SEQ ID NO: 3299278 - RNA, 23 nt, Variola virus
cuauuagaguauugcauuuugau

SEQ ID NO: 3299279 - RNA, 15 nt, Variola virus
auuggaacauaagau

SEQ ID NO: 3299280 - RNA, 16 nt, Variola virus
ucaaaauuuauuugau

SEQ ID NO: 3299281 - RNA, 16 nt, Variola virus
auaauuuagauacuuu

SEQ ID NO: 3299282 - RNA, 21 nt, Variola virus
aauccucuauuuauugacauu

SEQ ID NO: 3299283 - RNA, 22 nt, Variola virus
auaucacaucaaguacaaaaua

SEQ ID NO: 3299284 - RNA, 22 nt, Variola virus
aauaagcuauauaauaaaugua

SEQ ID NO: 3299285 - RNA, 16 nt, Variola virus
gauagcaaagagauga

SEQ ID NO: 3299286 - RNA, 21 nt, Variola virus
auagauauaauuaucacauau

SEQ ID NO: 3299287 - RNA, 14 nt, Variola virus
aaucguuuaucuuu

SEQ ID NO: 3299288 - RNA, 22 nt, Variola virus
uagauaauaauaucguccuuaa

SEQ ID NO: 3299289 - RNA, 18 nt, Variola virus
auaucugaguaugaugau

SEQ ID NO: 3299290 - RNA, 15 nt, Variola virus
auaaguguugucaaa

SEQ ID NO: 3299291 - RNA, 16 nt, Variola virus
auucauuuucaauaau

SEQ ID NO: 3299292 - RNA, 21 nt, Variola virus
guacuucucccauaauacuuu

SEQ ID NO: 3299293 - RNA, 20 nt, Variola virus
uugcacaauccaaacuuuuu

SEQ ID NO: 3299294 - RNA, 20 nt, Variola virus
aggguccauuuucuguaaau

SEQ ID NO: 3299295 - RNA, 15 nt, Variola virus
agucauguuaaaaau

SEQ ID NO: 3299296 - RNA, 24 nt, Variola virus
gauauaggguucuuuauaaugcau

SEQ ID NO: 3299297 - RNA, 18 nt, Variola virus
aucuuguucagaaauaua

SEQ ID NO: 3299298 - RNA, 22 nt, Variola virus
uaaguaguuggaagaaucucau

SEQ ID NO: 3299299 - RNA, 10 nt, Variola virus
caaauacuug

SEQ ID NO: 3299300 - RNA, 15 nt, Variola virus
auguuucauaaaaug

SEQ ID NO: 3299301 - RNA, 21 nt, Variola virus
auguguauacaucgguaaaua

SEQ ID NO: 3299302 - RNA, 16 nt, Variola virus
auaauuuuuauguuuu

SEQ ID NO: 3299303 - RNA, 23 nt, Variola virus
uauuugcgaggaugacucucaaa

SEQ ID NO: 3299304 - RNA, 12 nt, Variola virus
agcaaaaacaaa

SEQ ID NO: 3299305 - RNA, 17 nt, Variola virus
auacaauggaugauaug

SEQ ID NO: 3299306 - RNA, 17 nt, Variola virus
gaauacauaaagaacga

SEQ ID NO: 3299307 - RNA, 21 nt, Variola virus
uaggaccacuagcaaaagaua

SEQ ID NO: 3299308 - RNA, 19 nt, Variola virus
ucauucgcuuaacaucuuc

SEQ ID NO: 3299309 - RNA, 19 nt, Variola virus
ccaccuccgucaucaucuc

SEQ ID NO: 3299310 - RNA, 13 nt, Variola virus
auaacaauggcug

SEQ ID NO: 3299311 - RNA, 15 nt, Variola virus
aauaccaaaaugaug

SEQ ID NO: 3299312 - RNA, 16 nt, Variola virus
acaauaguuagauaca

SEQ ID NO: 3299313 - RNA, 17 nt, Variola virus
agauaauauuagacaua

SEQ ID NO: 3299314 - RNA, 18 nt, Variola virus
uuugauauaggugcaaaa

SEQ ID NO: 3299315 - RNA, 17 nt, Variola virus
gauaaauuaaugaucua

SEQ ID NO: 3299316 - RNA, 18 nt, Variola virus
uucuggaauauuaucauc

SEQ ID NO: 3299317 - RNA, 17 nt, Variola virus
aguuuuuaggaaauauu

SEQ ID NO: 3299318 - RNA, 22 nt, Variola virus
aaacucgucuccccaaacauug

SEQ ID NO: 3299319 - RNA, 22 nt, Variola virus
uauacauguuagagaauauuca

SEQ ID NO: 3299320 - RNA, 19 nt, Variola virus
aucuaaucuguucauauac

SEQ ID NO: 3299321 - RNA, 17 nt, Variola virus
auuuuguggugcaacuu

SEQ ID NO: 3299322 - RNA, 20 nt, Variola virus
uuggcacgaacaaaaauacg

SEQ ID NO: 3299323 - RNA, 15 nt, Variola virus
gcuacagaaagguag

SEQ ID NO: 3299324 - RNA, 16 nt, Variola virus
cuuaaacuuauucuua

SEQ ID NO: 3299325 - RNA, 17 nt, Variola virus
augauugauuagaaaau

SEQ ID NO: 3299326 - RNA, 16 nt, Variola virus
cucaucggaucuguaa

SEQ ID NO: 3299327 - RNA, 23 nt, Variola virus
uaacgaacgcggugugaauguac

SEQ ID NO: 3299328 - RNA, 23 nt, Variola virus
gaauagccaccggaaacuuucua

SEQ ID NO: 3299329 - RNA, 17 nt, Variola virus
aguauaaaguuuauaca

SEQ ID NO: 3299330 - RNA, 21 nt, Variola virus
guucuaucuucuaaaaaaucu

SEQ ID NO: 3299331 - RNA, 13 nt, Variola virus
aauugucuagaua

SEQ ID NO: 3299332 - RNA, 11 nt, Variola virus
cuuccacauua

SEQ ID NO: 3299333 - RNA, 16 nt, Variola virus
ucaguaacuauguuca

SEQ ID NO: 3299334 - RNA, 23 nt, Variola virus
uguuacucaguugaacagaugau

SEQ ID NO: 3299335 - RNA, 12 nt, Variola virus
aaaauauuagaa

SEQ ID NO: 3299336 - RNA, 19 nt, Variola virus
cgauauuaaccuaaaagag

SEQ ID NO: 3299337 - RNA, 14 nt, Variola virus
agcgguguuauuau

SEQ ID NO: 3299338 - RNA, 18 nt, Variola virus
uauuaaaauuauuucuaa

SEQ ID NO: 3299339 - RNA, 19 nt, Variola virus
auaggaucuauaauaaugu

SEQ ID NO: 3299340 - RNA, 22 nt, Variola virus
ggaccacauccuucuucaucaa

SEQ ID NO: 3299341 - RNA, 19 nt, Variola virus
auaaaacuauaaauaugca

SEQ ID NO: 3299342 - RNA, 15 nt, Variola virus
aauaguuuuuaacua

SEQ ID NO: 3299343 - RNA, 21 nt, Variola virus
auauagaaccugaucuggaaa

SEQ ID NO: 3299344 - RNA, 15 nt, Variola virus
cuguaaaaaacauca

SEQ ID NO: 3299345 - RNA, 17 nt, Variola virus
ugguacgaaauauauug

SEQ ID NO: 3299346 - RNA, 18 nt, Variola virus
uagacgguuccaaagauc

SEQ ID NO: 3299347 - RNA, 16 nt, Variola virus
acuaccgaguuuaaaa

SEQ ID NO: 3299348 - RNA, 22 nt, Variola virus
gauuaaacuuuaaugauugcau

SEQ ID NO: 3299349 - RNA, 19 nt, Variola virus
ugguauuagaaucaaggau

SEQ ID NO: 3299350 - RNA, 18 nt, Variola virus
cuaaugaugcagauaucg

SEQ ID NO: 3299351 - RNA, 21 nt, Variola virus
gaguauugguaauguacaaac

SEQ ID NO: 3299352 - RNA, 21 nt, Variola virus
uacaaucaaaccuauaacauu

SEQ ID NO: 3299353 - RNA, 20 nt, Variola virus
auaaacucagauaauagcaa

SEQ ID NO: 3299354 - RNA, 12 nt, Variola virus
uuaccaacaaua

SEQ ID NO: 3299355 - RNA, 15 nt, Variola virus
uaaugauauaucuug

SEQ ID NO: 3299356 - RNA, 17 nt, Variola virus
uccauaauuuucucucg

SEQ ID NO: 3299357 - RNA, 20 nt, Variola virus
auauaucaguuaaugcaucu

SEQ ID NO: 3299358 - RNA, 12 nt, Variola virus
gaguuuaaaacu

SEQ ID NO: 3299359 - RNA, 21 nt, Variola virus
aacugcauccuucuaagauua

SEQ ID NO: 3299360 - RNA, 16 nt, Variola virus
uaagagaucaaagcau

SEQ ID NO: 3299361 - RNA, 19 nt, Variola virus
gaacuaauccacauaugau

SEQ ID NO: 3299362 - RNA, 22 nt, Variola virus
ucuaccgcggagccgaaaauau

SEQ ID NO: 3299363 - RNA, 18 nt, Variola virus
cacgguaauaaaauguca

SEQ ID NO: 3299364 - RNA, 23 nt, Variola virus
uauagauucuugguaauuaauag

SEQ ID NO: 3299365 - RNA, 15 nt, Variola virus
uaacgcauuaaugag

SEQ ID NO: 3299366 - RNA, 20 nt, Variola virus
auaucuucuuuuuauaucca

SEQ ID NO: 3299367 - RNA, 15 nt, Variola virus
uaaaccauguuguga

SEQ ID NO: 3299368 - RNA, 14 nt, Variola virus
ugacauuuuggauu

SEQ ID NO: 3299369 - RNA, 15 nt, Variola virus
guuucuaaauuuuua

SEQ ID NO: 3299370 - RNA, 21 nt, Variola virus
acgauaaaaauaauauuguuu

SEQ ID NO: 3299371 - RNA, 14 nt, Variola virus
aauaauucuagacg

SEQ ID NO: 3299372 - RNA, 18 nt, Variola virus
uagucuguguuacauaau

SEQ ID NO: 3299373 - RNA, 14 nt, Variola virus
aacgccuuagaaau

SEQ ID NO: 3299374 - RNA, 12 nt, Variola virus
aaagcauauguu

SEQ ID NO: 3299375 - RNA, 13 nt, Variola virus
guacuuaaugaag

SEQ ID NO: 3299376 - RNA, 14 nt, Variola virus
uugaaguaauuuuc

SEQ ID NO: 3299377 - RNA, 15 nt, Variola virus
auucgauacaaacuc

SEQ ID NO: 3299378 - RNA, 21 nt, Variola virus
auauagucuguguuacauaau

SEQ ID NO: 3299379 - RNA, 23 nt, Variola virus
aaacaacugaagaaaauucucca

SEQ ID NO: 3299380 - RNA, 13 nt, Variola virus
aaacacgauguuu

SEQ ID NO: 3299381 - RNA, 23 nt, Variola virus
aaaccaucuuacuuaaaauaugu

SEQ ID NO: 3299382 - RNA, 16 nt, Variola virus
ugauacaccuguaauc

SEQ ID NO: 3299383 - RNA, 13 nt, Variola virus
aaucgauguguca

SEQ ID NO: 3299384 - RNA, 17 nt, Variola virus
aaugcucaguaaaugua

SEQ ID NO: 3299385 - RNA, 19 nt, Variola virus
ucagaguucagugaagaag

SEQ ID NO: 3299386 - RNA, 15 nt, Variola virus
cuacauaaaacauca

SEQ ID NO: 3299387 - RNA, 18 nt, Variola virus
gccuccacuagaagagaa

SEQ ID NO: 3299388 - RNA, 20 nt, Variola virus
aaaauaugaaauaaguacaa

SEQ ID NO: 3299389 - RNA, 13 nt, Variola virus
uuaacuugacauu

SEQ ID NO: 3299390 - RNA, 14 nt, Variola virus
uguccuaaaauacu

SEQ ID NO: 3299391 - RNA, 19 nt, Variola virus
auuaauacacauaaugaag

SEQ ID NO: 3299392 - RNA, 14 nt, Variola virus
acauugauuaaauu

SEQ ID NO: 3299393 - RNA, 20 nt, Variola virus
ugacauuuuccuuguaucca

SEQ ID NO: 3299394 - RNA, 23 nt, Variola virus
acauauggaauauaucuauaauu

SEQ ID NO: 3299395 - RNA, 16 nt, Variola virus
ucaauaguuucauaau

SEQ ID NO: 3299396 - RNA, 16 nt, Variola virus
gauaaagauauaugau

SEQ ID NO: 3299397 - RNA, 18 nt, Variola virus
uugaccacggcuuccauu

SEQ ID NO: 3299398 - RNA, 14 nt, Variola virus
gcuaugagggaaaa

SEQ ID NO: 3299399 - RNA, 18 nt, Variola virus
agagaacauauaaaugua

SEQ ID NO: 3299400 - RNA, 23 nt, Variola virus
gcaucauacgaaaauagauucua

SEQ ID NO: 3299401 - RNA, 20 nt, Variola virus
cugcagaauaauuagaaauu

SEQ ID NO: 3299402 - RNA, 14 nt, Variola virus
cauuaauacaguaa

SEQ ID NO: 3299403 - RNA, 21 nt, Variola virus
agaagcauacgccaaauaucu

SEQ ID NO: 3299404 - RNA, 23 nt, Variola virus
gaagaacguguauuaaauagaau

SEQ ID NO: 3299405 - RNA, 21 nt, Variola virus
cuuaacuuuuucuuucucagc

SEQ ID NO: 3299406 - RNA, 14 nt, Variola virus
acaguacauaguau

SEQ ID NO: 3299407 - RNA, 22 nt, Variola virus
aauaccacugaauguuugaaaa

SEQ ID NO: 3299408 - RNA, 21 nt, Variola virus
uggaagaaggauggaaagaua

SEQ ID NO: 3299409 - RNA, 13 nt, Variola virus
cuaacacauuuca

SEQ ID NO: 3299410 - RNA, 18 nt, Variola virus
uuggaaucacaaacauua

SEQ ID NO: 3299411 - RNA, 20 nt, Variola virus
gucuagcaaugaucuaaauu

SEQ ID NO: 3299412 - RNA, 13 nt, Variola virus
guucuaacaucau

SEQ ID NO: 3299413 - RNA, 21 nt, Variola virus
aauacuuugguaguauacaag

SEQ ID NO: 3299414 - RNA, 21 nt, Variola virus
uaaauauaucuacaauuauug

SEQ ID NO: 3299415 - RNA, 15 nt, Variola virus
acgaugucaauaaug

SEQ ID NO: 3299416 - RNA, 21 nt, Variola virus
caauuuuguauuauucugaau

SEQ ID NO: 3299417 - RNA, 22 nt, Variola virus
aaaaugaugcuauuagaauuua

SEQ ID NO: 3299418 - RNA, 18 nt, Variola virus
aaugcuaguuuuagaaua

SEQ ID NO: 3299419 - RNA, 17 nt, Variola virus
auagcuuuuauuuccac

SEQ ID NO: 3299420 - RNA, 18 nt, Variola virus
auauuuugggcaaaucua

SEQ ID NO: 3299421 - RNA, 13 nt, Variola virus
acaacauauaauu

SEQ ID NO: 3299422 - RNA, 21 nt, Variola virus
cauuuaguuuauuacuauuac

SEQ ID NO: 3299423 - RNA, 17 nt, Variola virus
uagaaaguaauggauua

SEQ ID NO: 3299424 - RNA, 21 nt, Variola virus
acaaacuguucucuuaugaau

SEQ ID NO: 3299425 - RNA, 18 nt, Variola virus
acuguguucaagucauaa

SEQ ID NO: 3299426 - RNA, 15 nt, Variola virus
gugucuagacgaaau

SEQ ID NO: 3299427 - RNA, 16 nt, Variola virus
uaaaaagguagauguu

SEQ ID NO: 3299428 - RNA, 19 nt, Variola virus
caguaaaaauaacuagaau

SEQ ID NO: 3299429 - RNA, 21 nt, Variola virus
aacaucuuuguaaacagauau

SEQ ID NO: 3299430 - RNA, 15 nt, Variola virus
acggguucucaauau

SEQ ID NO: 3299431 - RNA, 16 nt, Variola virus
acuauaccauauccuc

SEQ ID NO: 3299432 - RNA, 14 nt, Variola virus
auuuagaaaugaag

SEQ ID NO: 3299433 - RNA, 23 nt, Variola virus
acacuuauauucuuuguuauuau

SEQ ID NO: 3299434 - RNA, 23 nt, Variola virus
auggaagguauuuccaucuaucu

SEQ ID NO: 3299435 - RNA, 20 nt, Variola virus
gauuacuuugacaaauguag

SEQ ID NO: 3299436 - RNA, 18 nt, Variola virus
ucuagauccucucuucaa

SEQ ID NO: 3299437 - RNA, 16 nt, Variola virus
auguuacaaugucuag

SEQ ID NO: 3299438 - RNA, 12 nt, Variola virus
uauuuuaucauu

SEQ ID NO: 3299439 - RNA, 22 nt, Variola virus
ugauuucucucauaaauacaga

SEQ ID NO: 3299440 - RNA, 18 nt, Variola virus
uagaaaaaacauguggua

SEQ ID NO: 3299441 - RNA, 21 nt, Variola virus
guucuagcccucuucaagaac

SEQ ID NO: 3299442 - RNA, 14 nt, Variola virus
aaaagaucauacaa

SEQ ID NO: 3299443 - RNA, 22 nt, Variola virus
uucaaccacucucgauacauca

SEQ ID NO: 3299444 - RNA, 20 nt, Variola virus
uggaaauuacacuguaucca

SEQ ID NO: 3299445 - RNA, 17 nt, Variola virus
aaaaggucauaacaagu

SEQ ID NO: 3299446 - RNA, 15 nt, Variola virus
uggccaagaaaauag

SEQ ID NO: 3299447 - RNA, 22 nt, Variola virus
ucaauagaauaaaccauuuugu

SEQ ID NO: 3299448 - RNA, 15 nt, Variola virus
cauuguuauguauuu

SEQ ID NO: 3299449 - RNA, 18 nt, Variola virus
auuacuugauauaguaau

SEQ ID NO: 3299450 - RNA, 14 nt, Variola virus
guuauaaucaaaga

SEQ ID NO: 3299451 - RNA, 15 nt, Variola virus
ucaacaccauuauua

SEQ ID NO: 3299452 - RNA, 22 nt, Variola virus
uuauugguauuucuuacauaaa

SEQ ID NO: 3299453 - RNA, 14 nt, Variola virus
auaacauuacuagu

SEQ ID NO: 3299454 - RNA, 15 nt, Variola virus
accacaggagaaugg

SEQ ID NO: 3299455 - RNA, 18 nt, Variola virus
augaguaaaaucaaacac

SEQ ID NO: 3299456 - RNA, 19 nt, Variola virus
auauuuagcaauuucugau

SEQ ID NO: 3299457 - RNA, 16 nt, Variola virus
acuaauuauacacauu

SEQ ID NO: 3299458 - RNA, 18 nt, Variola virus
gaggacuuggauguuugu

SEQ ID NO: 3299459 - RNA, 15 nt, Variola virus
acagacuacuuuccu

SEQ ID NO: 3299460 - RNA, 13 nt, Variola virus
ggaauuuuaucga

SEQ ID NO: 3299461 - RNA, 18 nt, Variola virus
ugaauucucauuuugcau

SEQ ID NO: 3299462 - RNA, 20 nt, Variola virus
uuuguaccaacaaacuguuc

SEQ ID NO: 3299463 - RNA, 18 nt, Variola virus
auuuuuuauaaacaugaa

SEQ ID NO: 3299464 - RNA, 20 nt, Variola virus
aagauggauggaugaugcau

SEQ ID NO: 3299465 - RNA, 22 nt, Variola virus
aaucauuaaaaaaauuaacuga

SEQ ID NO: 3299466 - RNA, 14 nt, Variola virus
cuuuauuaaaucau

SEQ ID NO: 3299467 - RNA, 13 nt, Variola virus
cggauaguuuaag

SEQ ID NO: 3299468 - RNA, 18 nt, Variola virus
guuuccaguuauaaaaca

SEQ ID NO: 3299469 - RNA, 20 nt, Variola virus
aguaucuuuuguucuagaug

SEQ ID NO: 3299470 - RNA, 21 nt, Variola virus
uagacauuguacaauaugugu

SEQ ID NO: 3299471 - RNA, 22 nt, Variola virus
aggaauuggaauccaauuguuu

SEQ ID NO: 3299472 - RNA, 18 nt, Variola virus
augucaaaacuuguucaa

SEQ ID NO: 3299473 - RNA, 13 nt, Variola virus
cuaguucucucuc

SEQ ID NO: 3299474 - RNA, 17 nt, Variola virus
agauagagauucaaugg

SEQ ID NO: 3299475 - RNA, 23 nt, Variola virus
uaugacaucaacuacaaaugaua

SEQ ID NO: 3299476 - RNA, 15 nt, Variola virus
uuaaaaauaugugcu

SEQ ID NO: 3299477 - RNA, 21 nt, Variola virus
uaggcauaccauuagauaauc

SEQ ID NO: 3299478 - RNA, 19 nt, Variola virus
cauaaauaguaaauacaau

SEQ ID NO: 3299479 - RNA, 17 nt, Variola virus
uaguaucauccacauau

SEQ ID NO: 3299480 - RNA, 15 nt, Variola virus
ucacuauagaaaaug

SEQ ID NO: 3299481 - RNA, 18 nt, Variola virus
agagaaggcuauaaagua

SEQ ID NO: 3299482 - RNA, 13 nt, Variola virus
ucgaauaaaguau

SEQ ID NO: 3299483 - RNA, 22 nt, Variola virus
aacugcguugauuaaaaaagau

SEQ ID NO: 3299484 - RNA, 15 nt, Variola virus
aaauuagaucaaaga

SEQ ID NO: 3299485 - RNA, 20 nt, Variola virus
uuaagcaacaugucuuuaaa

SEQ ID NO: 3299486 - RNA, 15 nt, Variola virus
aacucaguuaacaua

SEQ ID NO: 3299487 - RNA, 22 nt, Variola virus
aacauuaaaaugucuacagaua

SEQ ID NO: 3299488 - RNA, 19 nt, Variola virus
ucaaaugauuaauaaguau

SEQ ID NO: 3299489 - RNA, 19 nt, Variola virus
uaaaaauuaaaaaaucacu

SEQ ID NO: 3299490 - RNA, 14 nt, Variola virus
guuacgaugaugaa

SEQ ID NO: 3299491 - RNA, 16 nt, Variola virus
auauucuguuguguca

SEQ ID NO: 3299492 - RNA, 17 nt, Variola virus
auauaacuucugguaaa

SEQ ID NO: 3299493 - RNA, 15 nt, Variola virus
agaaacagaacuauu

SEQ ID NO: 3299494 - RNA, 20 nt, Variola virus
agaauaccaguauuguuuaa

SEQ ID NO: 3299495 - RNA, 13 nt, Variola virus
uguuuuuguacau

SEQ ID NO: 3299496 - RNA, 16 nt, Variola virus
uacuguaacacaauga

SEQ ID NO: 3299497 - RNA, 13 nt, Variola virus
auggaaaaacaaa

SEQ ID NO: 3299498 - RNA, 20 nt, Variola virus
cugagcaaacucucaaaaga

SEQ ID NO: 3299499 - RNA, 17 nt, Variola virus
aauuuuuuuucuagaua

SEQ ID NO: 3299500 - RNA, 18 nt, Variola virus
aaagucuacauugucauu

SEQ ID NO: 3299501 - RNA, 23 nt, Variola virus
uauguaacagacgagauaguuuu

SEQ ID NO: 3299502 - RNA, 16 nt, Variola virus
gaaguggauauacaua

SEQ ID NO: 3299503 - RNA, 19 nt, Variola virus
auaugugcuaaaaaguuuu

SEQ ID NO: 3299504 - RNA, 21 nt, Variola virus
uauaaaaauacuaaaacugaa

SEQ ID NO: 3299505 - RNA, 23 nt, Variola virus
agacuccauccguaaaaaugcau

SEQ ID NO: 3299506 - RNA, 17 nt, Variola virus
uaaguauaaacuauaaa

SEQ ID NO: 3299507 - RNA, 22 nt, Variola virus
uacgaagaaaaaguaaauacug

SEQ ID NO: 3299508 - RNA, 17 nt, Variola virus
uaguacaagaaauacuu

SEQ ID NO: 3299509 - RNA, 16 nt, Variola virus
uagagauuauaucuuu

SEQ ID NO: 3299510 - RNA, 17 nt, Variola virus
aguaauaccaaaaugau

SEQ ID NO: 3299511 - RNA, 23 nt, Variola virus
auggauuuuuuuaaaaaggaaau

SEQ ID NO: 3299512 - RNA, 16 nt, Variola virus
guaguccuacguuauu

SEQ ID NO: 3299513 - RNA, 17 nt, Variola virus
caguacacgaaugauuu

SEQ ID NO: 3299514 - RNA, 22 nt, Variola virus
acugauuaauaagaucuucuau

SEQ ID NO: 3299515 - RNA, 12 nt, Variola virus
aucuauaaaagu

SEQ ID NO: 3299516 - RNA, 19 nt, Variola virus
uugccaucacucucauaau

SEQ ID NO: 3299517 - RNA, 16 nt, Variola virus
aaucuaaaagaauugg

SEQ ID NO: 3299518 - RNA, 20 nt, Variola virus
uagauaucaaauccaaugga

SEQ ID NO: 3299519 - RNA, 21 nt, Variola virus
uauaaaguccgcacuacuguu

SEQ ID NO: 3299520 - RNA, 22 nt, Variola virus
uauaaucuuuuucaucuuguga

SEQ ID NO: 3299521 - RNA, 16 nt, Variola virus
cgauggucuauacaau

SEQ ID NO: 3299522 - RNA, 14 nt, Variola virus
uuuacaaaacuggu

SEQ ID NO: 3299523 - RNA, 19 nt, Variola virus
agugaaauguugucauuau

SEQ ID NO: 3299524 - RNA, 13 nt, Variola virus
uccacauccauga

SEQ ID NO: 3299525 - RNA, 20 nt, Variola virus
ccaaaggauguuuaacauuc

SEQ ID NO: 3299526 - RNA, 20 nt, Variola virus
cuuguuugauaaauguagcu

SEQ ID NO: 3299527 - RNA, 19 nt, Variola virus
gaacuaaaaaacgaaauau

SEQ ID NO: 3299528 - RNA, 20 nt, Variola virus
auauaaauccaguaauauca

SEQ ID NO: 3299529 - RNA, 23 nt, Variola virus
guauagaguuugcggauaaugau

SEQ ID NO: 3299530 - RNA, 16 nt, Variola virus
aaacuaaacuuauuua

SEQ ID NO: 3299531 - RNA, 13 nt, Variola virus
auucaucaaugau

SEQ ID NO: 3299532 - RNA, 17 nt, Variola virus
gaugugucuacauaaau

SEQ ID NO: 3299533 - RNA, 18 nt, Variola virus
aauaucauauuacgaaau

SEQ ID NO: 3299534 - RNA, 21 nt, Variola virus
acgauuauuucuaaauuauuc

SEQ ID NO: 3299535 - RNA, 15 nt, Variola virus
aacaguuuuaccguu

SEQ ID NO: 3299536 - RNA, 19 nt, Variola virus
auuuauuuucggguuuaaa

SEQ ID NO: 3299537 - RNA, 14 nt, Variola virus
ucucauaaauacag

SEQ ID NO: 3299538 - RNA, 15 nt, Variola virus
auuaaauucuggaau

SEQ ID NO: 3299539 - RNA, 17 nt, Variola virus
uaucaucucuaucauaa

SEQ ID NO: 3299540 - RNA, 19 nt, Variola virus
auaaaauccaugagaucua

SEQ ID NO: 3299541 - RNA, 22 nt, Variola virus
uucuuaacaaagagaacguauu

SEQ ID NO: 3299542 - RNA, 14 nt, Variola virus
uuacaacauaauaa

SEQ ID NO: 3299543 - RNA, 13 nt, Variola virus
gaagauauuacau

SEQ ID NO: 3299544 - RNA, 15 nt, Variola virus
uagguaucaaagaua

SEQ ID NO: 3299545 - RNA, 15 nt, Variola virus
auagauucuugguaa

SEQ ID NO: 3299546 - RNA, 20 nt, Variola virus
aguaauggguuauuguggau

SEQ ID NO: 3299547 - RNA, 19 nt, Variola virus
uacuccuuucuuaaugcau

SEQ ID NO: 3299548 - RNA, 18 nt, Variola virus
ugacggaugaucauacau

SEQ ID NO: 3299549 - RNA, 18 nt, Variola virus
aguauugacaauacugua

SEQ ID NO: 3299550 - RNA, 19 nt, Variola virus
ugauugacaaauuauucua

SEQ ID NO: 3299551 - RNA, 23 nt, Variola virus
ucuuuaauaucgacaauuucaua

SEQ ID NO: 3299552 - RNA, 13 nt, Variola virus
uccauuuauacau

SEQ ID NO: 3299553 - RNA, 21 nt, Variola virus
aaaucagauaucgauguuaua

SEQ ID NO: 3299554 - RNA, 12 nt, Variola virus
agauaauacaaa

SEQ ID NO: 3299555 - RNA, 14 nt, Variola virus
auaaacuaacacaa

SEQ ID NO: 3299556 - RNA, 14 nt, Variola virus
cagucuuuaaugaa

SEQ ID NO: 3299557 - RNA, 18 nt, Variola virus
agaaauagcgcugaaaau

SEQ ID NO: 3299558 - RNA, 17 nt, Variola virus
cuauauggauauucaua

SEQ ID NO: 3299559 - RNA, 13 nt, Variola virus
auaaaaucuauau

SEQ ID NO: 3299560 - RNA, 21 nt, Variola virus
agacguuucauaauaauacau

SEQ ID NO: 3299561 - RNA, 15 nt, Variola virus
aauuaaaaaucgaua

SEQ ID NO: 3299562 - RNA, 17 nt, Variola virus
ugucgccaaucuuacac

SEQ ID NO: 3299563 - RNA, 13 nt, Variola virus
acauucagaaaga

SEQ ID NO: 3299564 - RNA, 16 nt, Variola virus
uauguaagacuugugg

SEQ ID NO: 3299565 - RNA, 14 nt, Variola virus
agaauaucuauaca

SEQ ID NO: 3299566 - RNA, 13 nt, Variola virus
ugauugaacgauu

SEQ ID NO: 3299567 - RNA, 21 nt, Variola virus
uaacgcaccuauaaagacuuu

SEQ ID NO: 3299568 - RNA, 16 nt, Variola virus
uccuaacuuuaaacaa

SEQ ID NO: 3299569 - RNA, 18 nt, Variola virus
gaauggcguuugauauau

SEQ ID NO: 3299570 - RNA, 14 nt, Variola virus
agaaauuaauagaa

SEQ ID NO: 3299571 - RNA, 17 nt, Variola virus
ugauaggcaauaaacau

SEQ ID NO: 3299572 - RNA, 20 nt, Variola virus
caugagaauggaaaggaaac

SEQ ID NO: 3299573 - RNA, 15 nt, Variola virus
aucuuauucaagcaa

SEQ ID NO: 3299574 - RNA, 20 nt, Variola virus
cuguaagcguugucuguauu

SEQ ID NO: 3299575 - RNA, 22 nt, Variola virus
uaccaaagacuuugaaauauag

SEQ ID NO: 3299576 - RNA, 20 nt, Variola virus
uaacaugcauuugaaaagau

SEQ ID NO: 3299577 - RNA, 16 nt, Variola virus
gaauuaauagauauau

SEQ ID NO: 3299578 - RNA, 20 nt, Variola virus
uaaucagucauaacaaaugu

SEQ ID NO: 3299579 - RNA, 23 nt, Variola virus
gcaauuuuauugcuaauaaugac

SEQ ID NO: 3299580 - RNA, 16 nt, Variola virus
auuugucgcauuccuu

SEQ ID NO: 3299581 - RNA, 16 nt, Variola virus
uaucaauaccuuuucu

SEQ ID NO: 3299582 - RNA, 21 nt, Variola virus
guucagugacgucuguggaug

SEQ ID NO: 3299583 - RNA, 19 nt, Variola virus
auaccuuuccuggaauauc

SEQ ID NO: 3299584 - RNA, 22 nt, Variola virus
ucaagccggcuauauauucugc

SEQ ID NO: 3299585 - RNA, 18 nt, Variola virus
cguauaacaguaaaagaa

SEQ ID NO: 3299586 - RNA, 16 nt, Variola virus
acuauauguaaauaau

SEQ ID NO: 3299587 - RNA, 11 nt, Variola virus
aaucuggaaaa

SEQ ID NO: 3299588 - RNA, 21 nt, Variola virus
aauauaaauuaauuuaccauc

SEQ ID NO: 3299589 - RNA, 20 nt, Variola virus
ucccuauuaaaauucuuaaa

SEQ ID NO: 3299590 - RNA, 23 nt, Variola virus
aucuaacaaaaauuaugaaauaa

SEQ ID NO: 3299591 - RNA, 16 nt, Variola virus
ugucuaucucuguaaa

SEQ ID NO: 3299592 - RNA, 22 nt, Variola virus
auccuaaagguaaauguaaauu

SEQ ID NO: 3299593 - RNA, 17 nt, Variola virus
uagaaggaguguuuucu

SEQ ID NO: 3299594 - RNA, 12 nt, Variola virus
ucauuuccaaau

SEQ ID NO: 3299595 - RNA, 17 nt, Variola virus
aucuuuuguucuagaug

SEQ ID NO: 3299596 - RNA, 17 nt, Variola virus
agugcuauuuugacaua

SEQ ID NO: 3299597 - RNA, 17 nt, Variola virus
uuuacuaaagauacaaa

SEQ ID NO: 3299598 - RNA, 12 nt, Variola virus
uagaaauuauuu

SEQ ID NO: 3299599 - RNA, 17 nt, Variola virus
auccuauaacuucuaau

SEQ ID NO: 3299600 - RNA, 16 nt, Variola virus
gucacauaguguuuua

SEQ ID NO: 3299601 - RNA, 17 nt, Variola virus
gcauaggaacauuucug

SEQ ID NO: 3299602 - RNA, 17 nt, Variola virus
uauauuagacaauacua

SEQ ID NO: 3299603 - RNA, 18 nt, Variola virus
uaaaauaggaaguaaugu

SEQ ID NO: 3299604 - RNA, 20 nt, Variola virus
ugucuacacauccuuuugua

SEQ ID NO: 3299605 - RNA, 22 nt, Variola virus
acuggugaguuaauauucaugu

SEQ ID NO: 3299606 - RNA, 16 nt, Variola virus
aaaauacuuaaaaugu

SEQ ID NO: 3299607 - RNA, 20 nt, Variola virus
aacaucuuuguaaacagaua

SEQ ID NO: 3299608 - RNA, 18 nt, Variola virus
cuguagaagcuaacauac

SEQ ID NO: 3299609 - RNA, 19 nt, Variola virus
caugucuauuguuaaucau

SEQ ID NO: 3299610 - RNA, 16 nt, Variola virus
gcgcuagucaucucau

SEQ ID NO: 3299611 - RNA, 20 nt, Variola virus
aauaacuauguuuuaaaaau

SEQ ID NO: 3299612 - RNA, 18 nt, Variola virus
agcucaauauaaaugcgu

SEQ ID NO: 3299613 - RNA, 18 nt, Variola virus
cauaguuuguaucaauaa

SEQ ID NO: 3299614 - RNA, 17 nt, Variola virus
guuaagagaauaauaga

SEQ ID NO: 3299615 - RNA, 13 nt, Variola virus
aaaguauauguag

SEQ ID NO: 3299616 - RNA, 17 nt, Variola virus
aucgauacauauaugca

SEQ ID NO: 3299617 - RNA, 22 nt, Variola virus
ugccacgaauaaaaaauacuua

SEQ ID NO: 3299618 - RNA, 14 nt, Variola virus
auaauagacauaau

SEQ ID NO: 3299619 - RNA, 23 nt, Variola virus
uaauauugugaaugguaaagaau

SEQ ID NO: 3299620 - RNA, 14 nt, Variola virus
gauuuuuccaaagu

SEQ ID NO: 3299621 - RNA, 18 nt, Variola virus
aguagacauuuuuaacau

SEQ ID NO: 3299622 - RNA, 20 nt, Variola virus
cagaauuguaacaacaaugu

SEQ ID NO: 3299623 - RNA, 13 nt, Variola virus
uaauauagaagau

SEQ ID NO: 3299624 - RNA, 19 nt, Variola virus
uggaauagaugaaggaaua

SEQ ID NO: 3299625 - RNA, 12 nt, Variola virus
cugaaaauuaaa

SEQ ID NO: 3299626 - RNA, 14 nt, Variola virus
ucguaaaaaguuuu

SEQ ID NO: 3299627 - RNA, 17 nt, Variola virus
gauaugaacauauucau

SEQ ID NO: 3299628 - RNA, 19 nt, Variola virus
auacacguauaaaaaauau

SEQ ID NO: 3299629 - RNA, 20 nt, Variola virus
caguaauauacugaucccua

SEQ ID NO: 3299630 - RNA, 21 nt, Variola virus
cauuuaucacaaaaaaaacuu

SEQ ID NO: 3299631 - RNA, 22 nt, Variola virus
agaauucuuagucaauggagaa

SEQ ID NO: 3299632 - RNA, 15 nt, Variola virus
acgaugauuucugaa

SEQ ID NO: 3299633 - RNA, 13 nt, Variola virus
augagaacauagu

SEQ ID NO: 3299634 - RNA, 20 nt, Variola virus
cauauuugaacuuaacuuca

SEQ ID NO: 3299635 - RNA, 20 nt, Variola virus
guuuuagagacuuugaagcu

SEQ ID NO: 3299636 - RNA, 20 nt, Variola virus
caauaugucuguacaaaugu

SEQ ID NO: 3299637 - RNA, 16 nt, Variola virus
aauguacuguauauaa

SEQ ID NO: 3299638 - RNA, 16 nt, Variola virus
cuaaacacgauguuua

SEQ ID NO: 3299639 - RNA, 12 nt, Variola virus
uauaauaucuug

SEQ ID NO: 3299640 - RNA, 17 nt, Variola virus
uaauauuaguacuauau

SEQ ID NO: 3299641 - RNA, 15 nt, Variola virus
uagucuguacaaaag

SEQ ID NO: 3299642 - RNA, 19 nt, Variola virus
uuuuuaaagguaucuaaug

SEQ ID NO: 3299643 - RNA, 17 nt, Variola virus
auaucagacgauccaca

SEQ ID NO: 3299644 - RNA, 20 nt, Variola virus
cuacuacacuucuagauauc

SEQ ID NO: 3299645 - RNA, 22 nt, Variola virus
uugaucucaucauuccauaauu

SEQ ID NO: 3299646 - RNA, 15 nt, Variola virus
aguggaauugaaaau

SEQ ID NO: 3299647 - RNA, 15 nt, Variola virus
aaucuguaucgaaug

SEQ ID NO: 3299648 - RNA, 22 nt, Variola virus
uacaggaucuagcaaaggaaau

SEQ ID NO: 3299649 - RNA, 12 nt, Variola virus
uauuaauacagg

SEQ ID NO: 3299650 - RNA, 16 nt, Variola virus
ugaucaaaaagagauu

SEQ ID NO: 3299651 - RNA, 19 nt, Variola virus
aaaaauuaauacaucauca

SEQ ID NO: 3299652 - RNA, 14 nt, Variola virus
uaaaacauuuccua

SEQ ID NO: 3299653 - RNA, 14 nt, Variola virus
ucuagcauuucuag

SEQ ID NO: 3299654 - RNA, 17 nt, Variola virus
uaacaacucaaacaucu

SEQ ID NO: 3299655 - RNA, 21 nt, Variola virus
aauucauacaccauuaauaga

SEQ ID NO: 3299656 - RNA, 23 nt, Variola virus
uagaugucaaugaagaguacaca

SEQ ID NO: 3299657 - RNA, 20 nt, Variola virus
uguauaauaagaugcaaaca

SEQ ID NO: 3299658 - RNA, 17 nt, Variola virus
uaguguuggauaucuuc

SEQ ID NO: 3299659 - RNA, 19 nt, Variola virus
uguaaaaagauaaacuuua

SEQ ID NO: 3299660 - RNA, 15 nt, Variola virus
auaguauucuuguau

SEQ ID NO: 3299661 - RNA, 20 nt, Variola virus
aauacgguaccgcaauuuug

SEQ ID NO: 3299662 - RNA, 23 nt, Variola virus
accaaucugggcguauaaugaau

SEQ ID NO: 3299663 - RNA, 20 nt, Variola virus
acuaccgaguuuaaaacuuc

SEQ ID NO: 3299664 - RNA, 20 nt, Variola virus
uauuuuaacgucuaaaugua

SEQ ID NO: 3299665 - RNA, 20 nt, Variola virus
cuaaagacucuaaaugguug

SEQ ID NO: 3299666 - RNA, 19 nt, Variola virus
acaauuuucgccuugaauu

SEQ ID NO: 3299667 - RNA, 18 nt, Variola virus
aauauaguaguuagauua

SEQ ID NO: 3299668 - RNA, 14 nt, Variola virus
uacucaaauagcac

SEQ ID NO: 3299669 - RNA, 16 nt, Variola virus
aguuuauuauauaccg

SEQ ID NO: 3299670 - RNA, 22 nt, Variola virus
aauuauugauaccuuuaaaagu

SEQ ID NO: 3299671 - RNA, 17 nt, Variola virus
caaauagagcaauuacu

SEQ ID NO: 3299672 - RNA, 19 nt, Variola virus
gggacgcguauauguuucu

SEQ ID NO: 3299673 - RNA, 19 nt, Variola virus
caccauauagaucaaucau

SEQ ID NO: 3299674 - RNA, 21 nt, Variola virus
uauguccauuaaaguuaaauu

SEQ ID NO: 3299675 - RNA, 13 nt, Variola virus
gaauucaaaauau

SEQ ID NO: 3299676 - RNA, 21 nt, Variola virus
aauaugguauggguucugaua

SEQ ID NO: 3299677 - RNA, 14 nt, Variola virus
auuacuaaacauuu

SEQ ID NO: 3299678 - RNA, 20 nt, Variola virus
ugggaaaaacgaaauuaucg

SEQ ID NO: 3299679 - RNA, 22 nt, Variola virus
uugaaccaguccauggaaaaga

SEQ ID NO: 3299680 - RNA, 15 nt, Variola virus
aaaucaucuuauuua

SEQ ID NO: 3299681 - RNA, 18 nt, Variola virus
auacgaagaaaaaguaaa

SEQ ID NO: 3299682 - RNA, 14 nt, Variola virus
aguaaugauugcau

SEQ ID NO: 3299683 - RNA, 15 nt, Variola virus
auaauccuuguaaug

SEQ ID NO: 3299684 - RNA, 15 nt, Variola virus
ugguugauaguuguu

SEQ ID NO: 3299685 - RNA, 20 nt, Variola virus
uauaacuucugguaaauauu

SEQ ID NO: 3299686 - RNA, 14 nt, Variola virus
acgcguauauguuu

SEQ ID NO: 3299687 - RNA, 18 nt, Variola virus
cauuacaaagaagaacug

SEQ ID NO: 3299688 - RNA, 12 nt, Variola virus
gauaucaacaag

SEQ ID NO: 3299689 - RNA, 16 nt, Variola virus
acauacuaucuuuaau

SEQ ID NO: 3299690 - RNA, 13 nt, Variola virus
cggaacaauaaac

SEQ ID NO: 3299691 - RNA, 14 nt, Variola virus
auuacgugauguga

SEQ ID NO: 3299692 - RNA, 20 nt, Variola virus
aauauacuuuguguuucaug

SEQ ID NO: 3299693 - RNA, 22 nt, Variola virus
acguuugguaauggcaauguau

SEQ ID NO: 3299694 - RNA, 13 nt, Variola virus
auauauacaguag

SEQ ID NO: 3299695 - RNA, 16 nt, Variola virus
gacuguuuauacaaga

SEQ ID NO: 3299696 - RNA, 14 nt, Variola virus
ucuacuauucuauu

SEQ ID NO: 3299697 - RNA, 19 nt, Variola virus
aucuauuaaagacagagau

SEQ ID NO: 3299698 - RNA, 13 nt, Variola virus
gcguauuuaagag

SEQ ID NO: 3299699 - RNA, 19 nt, Variola virus
aaaaucaggguuaucaaag

SEQ ID NO: 3299700 - RNA, 18 nt, Variola virus
uaauccaaugauacuuuu

SEQ ID NO: 3299701 - RNA, 12 nt, Variola virus
cagaauaucuau

SEQ ID NO: 3299702 - RNA, 16 nt, Variola virus
auuaaucguuuuugaa

SEQ ID NO: 3299703 - RNA, 15 nt, Variola virus
gaauauauguuuaua

SEQ ID NO: 3299704 - RNA, 15 nt, Variola virus
auggaucuaguauua

SEQ ID NO: 3299705 - RNA, 18 nt, Variola virus
aaacucguaaaaagauua

SEQ ID NO: 3299706 - RNA, 16 nt, Variola virus
uuacauucucauuaau

SEQ ID NO: 3299707 - RNA, 19 nt, Variola virus
uaaguuccauuacaaauau

SEQ ID NO: 3299708 - RNA, 20 nt, Variola virus
auucaagauuuuauuaucga

SEQ ID NO: 3299709 - RNA, 22 nt, Variola virus
cucuauaguuuguuuucauuau

SEQ ID NO: 3299710 - RNA, 18 nt, Variola virus
auauucgauaacagcauu

SEQ ID NO: 3299711 - RNA, 19 nt, Variola virus
uuauguaguaaagaugcua

SEQ ID NO: 3299712 - RNA, 18 nt, Variola virus
gugguuagcauauaccuc

SEQ ID NO: 3299713 - RNA, 17 nt, Variola virus
uacguauuauauaugua

SEQ ID NO: 3299714 - RNA, 20 nt, Variola virus
gcagguacuauaauauuaaa

SEQ ID NO: 3299715 - RNA, 17 nt, Variola virus
cgugauauuaucuucau

SEQ ID NO: 3299716 - RNA, 13 nt, Variola virus
augauauaagacu

SEQ ID NO: 3299717 - RNA, 14 nt, Variola virus
uaccuuguauacau

SEQ ID NO: 3299718 - RNA, 18 nt, Variola virus
uccuaaacuuuguaucug

SEQ ID NO: 3299719 - RNA, 22 nt, Variola virus
aaaaagauuaccguaugauaug

SEQ ID NO: 3299720 - RNA, 17 nt, Variola virus
uaucaauccaacaaaug

SEQ ID NO: 3299721 - RNA, 17 nt, Variola virus
aaucaaaccuuacugaa

SEQ ID NO: 3299722 - RNA, 19 nt, Variola virus
uaguuuccuuaacaaaucu

SEQ ID NO: 3299723 - RNA, 23 nt, Variola virus
uaaacuaauucauuuucaauaau

SEQ ID NO: 3299724 - RNA, 15 nt, Variola virus
caugggacuauauaa

SEQ ID NO: 3299725 - RNA, 21 nt, Variola virus
gugucaaacuguguagcuaga

SEQ ID NO: 3299726 - RNA, 12 nt, Variola virus
caaauuauucua

SEQ ID NO: 3299727 - RNA, 16 nt, Variola virus
ugcauaaucagauucu

SEQ ID NO: 3299728 - RNA, 19 nt, Variola virus
auuugaaguauuuguugua

SEQ ID NO: 3299729 - RNA, 15 nt, Variola virus
gauuguauugguaaa

SEQ ID NO: 3299730 - RNA, 23 nt, Variola virus
auaucaucacaacuuaaugaaga

SEQ ID NO: 3299731 - RNA, 17 nt, Variola virus
uacgcauuacaguuuuu

SEQ ID NO: 3299732 - RNA, 17 nt, Variola virus
guauauacauagauaua

SEQ ID NO: 3299733 - RNA, 20 nt, Variola virus
aaaauuuuuuagauguagua

SEQ ID NO: 3299734 - RNA, 14 nt, Variola virus
aaaccuaugauauc

SEQ ID NO: 3299735 - RNA, 17 nt, Variola virus
cuaccauaucagcucuc

SEQ ID NO: 3299736 - RNA, 15 nt, Variola virus
agagugauaauauau

SEQ ID NO: 3299737 - RNA, 18 nt, Variola virus
uaguucaucuaugaaugu

SEQ ID NO: 3299738 - RNA, 19 nt, Variola virus
aucaauuuugaaaauacuu

SEQ ID NO: 3299739 - RNA, 19 nt, Variola virus
ucaucuauagaucauguaa

SEQ ID NO: 3299740 - RNA, 13 nt, Variola virus
agguaaauguaaa

SEQ ID NO: 3299741 - RNA, 22 nt, Variola virus
aauacgauccaagguuagagaa

SEQ ID NO: 3299742 - RNA, 16 nt, Variola virus
gaacagauaguuuauc

SEQ ID NO: 3299743 - RNA, 16 nt, Variola virus
ucuguaaaagaaucau

SEQ ID NO: 3299744 - RNA, 20 nt, Variola virus
auaauuuuaccagaauacua

SEQ ID NO: 3299745 - RNA, 16 nt, Variola virus
aaaaugugauauagaa

SEQ ID NO: 3299746 - RNA, 17 nt, Variola virus
cucuauuuugucauuaa

SEQ ID NO: 3299747 - RNA, 12 nt, Variola virus
uaaggauucauu

SEQ ID NO: 3299748 - RNA, 14 nt, Variola virus
aauacagaucaaaa

SEQ ID NO: 3299749 - RNA, 20 nt, Variola virus
caucggaaaaaaaucuuuuu

SEQ ID NO: 3299750 - RNA, 14 nt, Variola virus
cgauugaauucucu

SEQ ID NO: 3299751 - RNA, 13 nt, Variola virus
aacgccuuagaaa

SEQ ID NO: 3299752 - RNA, 23 nt, Variola virus
gacauuaugcuaccaucaugaau

SEQ ID NO: 3299753 - RNA, 14 nt, Variola virus
gucauguuggaaua

SEQ ID NO: 3299754 - RNA, 22 nt, Variola virus
cguauguauuuguguacaguga

SEQ ID NO: 3299755 - RNA, 18 nt, Variola virus
agaugauguuaacuaugu

SEQ ID NO: 3299756 - RNA, 19 nt, Variola virus
ucgauuguuuauuguauau

SEQ ID NO: 3299757 - RNA, 14 nt, Variola virus
gagugcuguggaaa

SEQ ID NO: 3299758 - RNA, 16 nt, Variola virus
auagaggauauuucau

SEQ ID NO: 3299759 - RNA, 15 nt, Variola virus
gaauuaguuaaucuu

SEQ ID NO: 3299760 - RNA, 22 nt, Variola virus
acuguauuuggaucuuuuguac

SEQ ID NO: 3299761 - RNA, 13 nt, Variola virus
uauugauucuaga

SEQ ID NO: 3299762 - RNA, 13 nt, Variola virus
aagagcaaacauc

SEQ ID NO: 3299763 - RNA, 16 nt, Variola virus
auaacuggauauagaa

SEQ ID NO: 3299764 - RNA, 19 nt, Variola virus
aguacuguucauacaugau

SEQ ID NO: 3299765 - RNA, 17 nt, Variola virus
auguuugacugaauaua

SEQ ID NO: 3299766 - RNA, 13 nt, Variola virus
uaugcuguuuauc

SEQ ID NO: 3299767 - RNA, 12 nt, Variola virus
aaugaugauguu

SEQ ID NO: 3299768 - RNA, 16 nt, Variola virus
cgugauauuaucuuca

SEQ ID NO: 3299769 - RNA, 19 nt, Variola virus
cuuaacuugcaaaauguaa

SEQ ID NO: 3299770 - RNA, 19 nt, Variola virus
cuuuuaucgcguagauaua

SEQ ID NO: 3299771 - RNA, 15 nt, Variola virus
agaaaauauaaauua

SEQ ID NO: 3299772 - RNA, 15 nt, Variola virus
uaggaccacuagcaa

SEQ ID NO: 3299773 - RNA, 22 nt, Variola virus
gucuagagcaucaauguccugc

SEQ ID NO: 3299774 - RNA, 19 nt, Variola virus
auauucuugucauguugau

SEQ ID NO: 3299775 - RNA, 17 nt, Variola virus
ugcauucguuuaaagau

SEQ ID NO: 3299776 - RNA, 20 nt, Variola virus
uaaacuacgugaacauaugg

SEQ ID NO: 3299777 - RNA, 20 nt, Variola virus
uuacacaacgcgauauauaa

SEQ ID NO: 3299778 - RNA, 15 nt, Variola virus
uguaaaucuagaaau

SEQ ID NO: 3299779 - RNA, 14 nt, Variola virus
gauuaguaaauuca

SEQ ID NO: 3299780 - RNA, 21 nt, Variola virus
ugaagauggauucauccuuaa

SEQ ID NO: 3299781 - RNA, 18 nt, Variola virus
uuaaauuauugauauuca

SEQ ID NO: 3299782 - RNA, 14 nt, Variola virus
caaacaugcgaaau

SEQ ID NO: 3299783 - RNA, 16 nt, Variola virus
acacuuagagaacuua

SEQ ID NO: 3299784 - RNA, 19 nt, Variola virus
aggucacaucguauacuuu

SEQ ID NO: 3299785 - RNA, 15 nt, Variola virus
acaugcaaggcauuu

SEQ ID NO: 3299786 - RNA, 19 nt, Variola virus
auagacaaugcuaauauau

SEQ ID NO: 3299787 - RNA, 13 nt, Variola virus
guguuauuuuuua

SEQ ID NO: 3299788 - RNA, 17 nt, Variola virus
gauucaugauaguuuua

SEQ ID NO: 3299789 - RNA, 15 nt, Variola virus
guauuuuuuaugaca

SEQ ID NO: 3299790 - RNA, 18 nt, Variola virus
uaaaauccuccuaucaau

SEQ ID NO: 3299791 - RNA, 13 nt, Variola virus
aacuguuuguaua

SEQ ID NO: 3299792 - RNA, 19 nt, Variola virus
auaauucauaagaaucuac

SEQ ID NO: 3299793 - RNA, 22 nt, Variola virus
agaucuacuggugaaaugugac

SEQ ID NO: 3299794 - RNA, 17 nt, Variola virus
ugaguauuuuacucauu

SEQ ID NO: 3299795 - RNA, 18 nt, Variola virus
aauaaucuaguaaaacuu

SEQ ID NO: 3299796 - RNA, 21 nt, Variola virus
auucccuggcgcguuuaagau

SEQ ID NO: 3299797 - RNA, 18 nt, Variola virus
aucauucauuccuccaua

SEQ ID NO: 3299798 - RNA, 16 nt, Variola virus
auucuaugucuauuau

SEQ ID NO: 3299799 - RNA, 19 nt, Variola virus
uacuucuuuacgguaucua

SEQ ID NO: 3299800 - RNA, 18 nt, Variola virus
uaugaucguuuuaauauu

SEQ ID NO: 3299801 - RNA, 17 nt, Variola virus
uaguuacuuuaauaacc

SEQ ID NO: 3299802 - RNA, 12 nt, Variola virus
aauuuauacaaa

SEQ ID NO: 3299803 - RNA, 22 nt, Variola virus
cagauuuaguauuaaacagauc

SEQ ID NO: 3299804 - RNA, 13 nt, Variola virus
caauauauucuau

SEQ ID NO: 3299805 - RNA, 19 nt, Variola virus
guuuaacaaaguuauucau

SEQ ID NO: 3299806 - RNA, 15 nt, Variola virus
cacauacaaaacuag

SEQ ID NO: 3299807 - RNA, 22 nt, Variola virus
aauacaucaucaauuuugaaaa

SEQ ID NO: 3299808 - RNA, 20 nt, Variola virus
guauuuuaucucuauucauc

SEQ ID NO: 3299809 - RNA, 20 nt, Variola virus
ucaauacaccaauagaugau

SEQ ID NO: 3299810 - RNA, 17 nt, Variola virus
gaauauguuauaauaga

SEQ ID NO: 3299811 - RNA, 16 nt, Variola virus
ucuuuuucccagcauu

SEQ ID NO: 3299812 - RNA, 20 nt, Variola virus
agaucaaaauuaacaaaauu

SEQ ID NO: 3299813 - RNA, 16 nt, Variola virus
cucccaccaaauuaau

SEQ ID NO: 3299814 - RNA, 23 nt, Variola virus
ucugauuuuaucuuuuagagguu

SEQ ID NO: 3299815 - RNA, 15 nt, Variola virus
uucaaccauucauaa

SEQ ID NO: 3299816 - RNA, 18 nt, Variola virus
auaucagcauugcuuuca

SEQ ID NO: 3299817 - RNA, 19 nt, Variola virus
uacuugacugacuuaaaac

SEQ ID NO: 3299818 - RNA, 13 nt, Variola virus
uccuauuaugaaa

SEQ ID NO: 3299819 - RNA, 12 nt, Variola virus
uguuuucucaau

SEQ ID NO: 3299820 - RNA, 13 nt, Variola virus
ucguucucuaaau

SEQ ID NO: 3299821 - RNA, 13 nt, Variola virus
acauuuccuacau

SEQ ID NO: 3299822 - RNA, 19 nt, Variola virus
auaaacugcgccaaauugu

SEQ ID NO: 3299823 - RNA, 13 nt, Variola virus
acauuuauaucca

SEQ ID NO: 3299824 - RNA, 17 nt, Variola virus
gcaguaauauuguuaau

SEQ ID NO: 3299825 - RNA, 22 nt, Variola virus
auauggaaaaguucaacaugau

SEQ ID NO: 3299826 - RNA, 15 nt, Variola virus
aucuauaucaucuau

SEQ ID NO: 3299827 - RNA, 18 nt, Variola virus
guuuaagagauucaauuu

SEQ ID NO: 3299828 - RNA, 13 nt, Variola virus
ucgucucucuuag

SEQ ID NO: 3299829 - RNA, 19 nt, Variola virus
uccauuggaaaaacacagu

SEQ ID NO: 3299830 - RNA, 16 nt, Variola virus
agaaauaucuauaauu

SEQ ID NO: 3299831 - RNA, 14 nt, Variola virus
gacuacuuauucua

SEQ ID NO: 3299832 - RNA, 14 nt, Variola virus
cacuauucauguaa

SEQ ID NO: 3299833 - RNA, 11 nt, Variola virus
guuuucaucag

SEQ ID NO: 3299834 - RNA, 21 nt, Variola virus
agaaaaucagaucugauaaua

SEQ ID NO: 3299835 - RNA, 16 nt, Variola virus
uaccucauuuaucaug

SEQ ID NO: 3299836 - RNA, 23 nt, Variola virus
auugaugcgaauagcagauagau

SEQ ID NO: 3299837 - RNA, 13 nt, Variola virus
guauauuauucau

SEQ ID NO: 3299838 - RNA, 21 nt, Variola virus
agcaaaaaaugauagaaauau

SEQ ID NO: 3299839 - RNA, 14 nt, Variola virus
uacguuacuaaaau

SEQ ID NO: 3299840 - RNA, 13 nt, Variola virus
cgguuuuucuugg

SEQ ID NO: 3299841 - RNA, 13 nt, Variola virus
uaaagucauuaau

SEQ ID NO: 3299842 - RNA, 13 nt, Variola virus
uagagaucuaauu

SEQ ID NO: 3299843 - RNA, 16 nt, Variola virus
aauugugauuuaguau

SEQ ID NO: 3299844 - RNA, 15 nt, Variola virus
aagaaauuaauaaag

SEQ ID NO: 3299845 - RNA, 23 nt, Variola virus
uuacaccggccaaguaugcauaa

SEQ ID NO: 3299846 - RNA, 13 nt, Variola virus
acaauauauucua

SEQ ID NO: 3299847 - RNA, 15 nt, Variola virus
gaauauauaauucuu

SEQ ID NO: 3299848 - RNA, 17 nt, Variola virus
uccuccuguagauaugu

SEQ ID NO: 3299849 - RNA, 12 nt, Variola virus
auagaagauuac

SEQ ID NO: 3299850 - RNA, 12 nt, Variola virus
uuuuguaauaag

SEQ ID NO: 3299851 - RNA, 20 nt, Variola virus
caauucauguuuaaaaugau

SEQ ID NO: 3299852 - RNA, 20 nt, Variola virus
guagcaagauuuuuaaacaa

SEQ ID NO: 3299853 - RNA, 19 nt, Variola virus
guuaauuuaucacauauca

SEQ ID NO: 3299854 - RNA, 21 nt, Variola virus
aauguagugauagauaugaua

SEQ ID NO: 3299855 - RNA, 22 nt, Variola virus
uguucaagaauauacaaguauu

SEQ ID NO: 3299856 - RNA, 20 nt, Variola virus
auugauuacuuugacaaaug

SEQ ID NO: 3299857 - RNA, 21 nt, Variola virus
gccauagauuuauaauacuuu

SEQ ID NO: 3299858 - RNA, 17 nt, Variola virus
uguuguaaacacauauu

SEQ ID NO: 3299859 - RNA, 20 nt, Variola virus
acauucaaccacucucgaua

SEQ ID NO: 3299860 - RNA, 14 nt, Variola virus
ucugguugaagaaa

SEQ ID NO: 3299861 - RNA, 14 nt, Variola virus
aagaauucggaaau

SEQ ID NO: 3299862 - RNA, 14 nt, Variola virus
cuauucauguaaug

SEQ ID NO: 3299863 - RNA, 14 nt, Variola virus
ugagauauauacac

SEQ ID NO: 3299864 - RNA, 13 nt, Variola virus
acuuguuuaauga

SEQ ID NO: 3299865 - RNA, 22 nt, Variola virus
gaagagucgcgaauaacgauau

SEQ ID NO: 3299866 - RNA, 12 nt, Variola virus
gaauuagaaaag

SEQ ID NO: 3299867 - RNA, 23 nt, Variola virus
uaaguagagauucggguacugua

SEQ ID NO: 3299868 - RNA, 17 nt, Variola virus
ugcuguuccucuguaaa

SEQ ID NO: 3299869 - RNA, 17 nt, Variola virus
cauaauaaauuuuucca

SEQ ID NO: 3299870 - RNA, 24 nt, Variola virus
cugucuaucaagauccaugauucu

SEQ ID NO: 3299871 - RNA, 19 nt, Variola virus
uuaaaauaaauauucuuca

SEQ ID NO: 3299872 - RNA, 20 nt, Variola virus
uaaagcgugugcguguauag

SEQ ID NO: 3299873 - RNA, 15 nt, Variola virus
auauuccauuaauga

SEQ ID NO: 3299874 - RNA, 16 nt, Variola virus
aaagcgugauuuuaau

SEQ ID NO: 3299875 - RNA, 15 nt, Variola virus
aacacgauuuaaaau

SEQ ID NO: 3299876 - RNA, 20 nt, Variola virus
ucuguugguuuucuuauaua

SEQ ID NO: 3299877 - RNA, 12 nt, Variola virus
cuaggauacaua

SEQ ID NO: 3299878 - RNA, 22 nt, Variola virus
guauuuuuuaugacaaacuuua

SEQ ID NO: 3299879 - RNA, 22 nt, Variola virus
auguacguagcguacaaaauua

SEQ ID NO: 3299880 - RNA, 19 nt, Variola virus
aucauuuaaacauuuaacu

SEQ ID NO: 3299881 - RNA, 22 nt, Variola virus
aaauugguagcugaauguuaua

SEQ ID NO: 3299882 - RNA, 16 nt, Variola virus
agaaucuaaugaugac

SEQ ID NO: 3299883 - RNA, 18 nt, Variola virus
ucucuaucuguuuccauu

SEQ ID NO: 3299884 - RNA, 20 nt, Variola virus
auaauggucgaacacaguau

SEQ ID NO: 3299885 - RNA, 16 nt, Variola virus
ucguuuuucuuaagaa

SEQ ID NO: 3299886 - RNA, 23 nt, Variola virus
aaaugacuaauuuuguagcauua

SEQ ID NO: 3299887 - RNA, 17 nt, Variola virus
acauccggcaaaaauaa

SEQ ID NO: 3299888 - RNA, 22 nt, Variola virus
acaaugacucuaucaacuauag

SEQ ID NO: 3299889 - RNA, 20 nt, Variola virus
uugccguugucuguauucau

SEQ ID NO: 3299890 - RNA, 18 nt, Variola virus
accaauaaaaauaaacua

SEQ ID NO: 3299891 - RNA, 13 nt, Variola virus
auauaucuaauaa

SEQ ID NO: 3299892 - RNA, 20 nt, Variola virus
aauauaugcaaaauaauauc

SEQ ID NO: 3299893 - RNA, 21 nt, Variola virus
uaggguaaucuuguaucuauu

SEQ ID NO: 3299894 - RNA, 12 nt, Variola virus
auuuuucaauua

SEQ ID NO: 3299895 - RNA, 15 nt, Variola virus
agagcagucuuucua

SEQ ID NO: 3299896 - RNA, 15 nt, Variola virus
gacuaucuuuugaaa

SEQ ID NO: 3299897 - RNA, 14 nt, Variola virus
uaccacauacaaaa

SEQ ID NO: 3299898 - RNA, 19 nt, Variola virus
uugaauaggaguuugaaua

SEQ ID NO: 3299899 - RNA, 20 nt, Variola virus
cucgauacaucaacucucuc

SEQ ID NO: 3299900 - RNA, 20 nt, Variola virus
aaacacugauucagaaaugg

SEQ ID NO: 3299901 - RNA, 17 nt, Variola virus
cuuuuuauccucauuaa

SEQ ID NO: 3299902 - RNA, 18 nt, Variola virus
ugccuauuaggacagaua

SEQ ID NO: 3299903 - RNA, 21 nt, Variola virus
gagcuaaccacauuagauauu

SEQ ID NO: 3299904 - RNA, 11 nt, Variola virus
cuguagaaaaa

SEQ ID NO: 3299905 - RNA, 15 nt, Variola virus
cauuaucaaaaagaa

SEQ ID NO: 3299906 - RNA, 15 nt, Variola virus
acuuuuguuacuaau

SEQ ID NO: 3299907 - RNA, 15 nt, Variola virus
aucaggaaaaaagau

SEQ ID NO: 3299908 - RNA, 13 nt, Variola virus
acagauuucggaa

SEQ ID NO: 3299909 - RNA, 22 nt, Variola virus
gccuuauucucuggagaaaaga

SEQ ID NO: 3299910 - RNA, 19 nt, Variola virus
gaugucaaaggaugaaaga

SEQ ID NO: 3299911 - RNA, 18 nt, Variola virus
aaucugaaccaucaucug

SEQ ID NO: 3299912 - RNA, 22 nt, Variola virus
gccuucauaaggaaacuuuugu

SEQ ID NO: 3299913 - RNA, 13 nt, Variola virus
cgacaagauaucg

SEQ ID NO: 3299914 - RNA, 15 nt, Variola virus
uuuauacuucuaaug

SEQ ID NO: 3299915 - RNA, 15 nt, Variola virus
uguuuaaaucaaaau

SEQ ID NO: 3299916 - RNA, 12 nt, Variola virus
aaauaauccaac

SEQ ID NO: 3299917 - RNA, 14 nt, Variola virus
auuaacaagaauac

SEQ ID NO: 3299918 - RNA, 14 nt, Variola virus
cugauuuauguuuu

SEQ ID NO: 3299919 - RNA, 18 nt, Variola virus
ucguaguaaguuaaccaa

SEQ ID NO: 3299920 - RNA, 20 nt, Variola virus
agauccucucuuaaaugaau

SEQ ID NO: 3299921 - RNA, 18 nt, Variola virus
agaauuaggagaacuuau

SEQ ID NO: 3299922 - RNA, 21 nt, Variola virus
gguaauacgcucaucaaguac

SEQ ID NO: 3299923 - RNA, 16 nt, Variola virus
uaaauuuucuauacau

SEQ ID NO: 3299924 - RNA, 15 nt, Variola virus
ugugugugugguaua

SEQ ID NO: 3299925 - RNA, 16 nt, Variola virus
gacgaguguaaacacu

SEQ ID NO: 3299926 - RNA, 13 nt, Variola virus
aggauaucaaaua

SEQ ID NO: 3299927 - RNA, 16 nt, Variola virus
uacaaaaaauaaaaga

SEQ ID NO: 3299928 - RNA, 20 nt, Variola virus
uagcugaaacaaagaauugc

SEQ ID NO: 3299929 - RNA, 15 nt, Variola virus
augacgauaacauuc

SEQ ID NO: 3299930 - RNA, 23 nt, Variola virus
uuaaaauaguuuauaacauuaau

SEQ ID NO: 3299931 - RNA, 17 nt, Variola virus
acaagauuccuuuucua

SEQ ID NO: 3299932 - RNA, 14 nt, Variola virus
ugcagaauauuucu

SEQ ID NO: 3299933 - RNA, 21 nt, Variola virus
cuugagagcauccaguaugaa

SEQ ID NO: 3299934 - RNA, 14 nt, Variola virus
ugaagcucaucuug

SEQ ID NO: 3299935 - RNA, 16 nt, Variola virus
caaaaaguaagauauu

SEQ ID NO: 3299936 - RNA, 21 nt, Variola virus
gaguauaaauuuuagaaauaa

SEQ ID NO: 3299937 - RNA, 14 nt, Variola virus
cguguacaaaaaug

SEQ ID NO: 3299938 - RNA, 22 nt, Variola virus
uaaguauagcaaauaaaaucua

SEQ ID NO: 3299939 - RNA, 19 nt, Variola virus
guuaacuuugauuauccua

SEQ ID NO: 3299940 - RNA, 19 nt, Variola virus
acagauauuacaaccagug

SEQ ID NO: 3299941 - RNA, 13 nt, Variola virus
uucacauaaaaga

SEQ ID NO: 3299942 - RNA, 16 nt, Variola virus
cuuugaauccauuuuc

SEQ ID NO: 3299943 - RNA, 12 nt, Variola virus
aauauagaauau

SEQ ID NO: 3299944 - RNA, 22 nt, Variola virus
acagaagauagcaaagagauga

SEQ ID NO: 3299945 - RNA, 16 nt, Variola virus
aaauaauuauucuuua

SEQ ID NO: 3299946 - RNA, 19 nt, Variola virus
uaauaguuuaucauacuua

SEQ ID NO: 3299947 - RNA, 15 nt, Variola virus
uuuagacguagaaaa

SEQ ID NO: 3299948 - RNA, 15 nt, Variola virus
guauauaaauacuuu

SEQ ID NO: 3299949 - RNA, 19 nt, Variola virus
cauauuuauucuauggaug

SEQ ID NO: 3299950 - RNA, 14 nt, Variola virus
aucuccaucaaaug

SEQ ID NO: 3299951 - RNA, 23 nt, Variola virus
aguuguuauaaaggacagaaaua

SEQ ID NO: 3299952 - RNA, 23 nt, Variola virus
aaauuaaccgauaaaaagacuuu

SEQ ID NO: 3299953 - RNA, 17 nt, Variola virus
auaauugcuuuucuaau

SEQ ID NO: 3299954 - RNA, 20 nt, Variola virus
aaagucuacauugucauuau

SEQ ID NO: 3299955 - RNA, 14 nt, Variola virus
caauauaucaucua

SEQ ID NO: 3299956 - RNA, 19 nt, Variola virus
auuacgguaucuacuagau

SEQ ID NO: 3299957 - RNA, 19 nt, Variola virus
agucagacuuguauucaac

SEQ ID NO: 3299958 - RNA, 19 nt, Variola virus
acagcuaacgaaagcaaag

SEQ ID NO: 3299959 - RNA, 20 nt, Variola virus
ugaagcauuggaagcaacua

SEQ ID NO: 3299960 - RNA, 17 nt, Variola virus
ugccuguaauaauuucu

SEQ ID NO: 3299961 - RNA, 17 nt, Variola virus
uccuugguuuacaugga

SEQ ID NO: 3299962 - RNA, 19 nt, Variola virus
uaacgauaacgucauuaau

SEQ ID NO: 3299963 - RNA, 19 nt, Variola virus
cuugguuuacauggaucag

SEQ ID NO: 3299964 - RNA, 18 nt, Variola virus
aaaauaaacacauagaaa

SEQ ID NO: 3299965 - RNA, 15 nt, Variola virus
auuuucaucuagaua

SEQ ID NO: 3299966 - RNA, 18 nt, Variola virus
cauaguggacaacauuaa

SEQ ID NO: 3299967 - RNA, 16 nt, Variola virus
cagaaauauauauauu

SEQ ID NO: 3299968 - RNA, 20 nt, Variola virus
cauauacugauaauaaugaa

SEQ ID NO: 3299969 - RNA, 20 nt, Variola virus
auauuacaaacuauagaaau

SEQ ID NO: 3299970 - RNA, 21 nt, Variola virus
gaauauguuauaauagagaua

SEQ ID NO: 3299971 - RNA, 20 nt, Variola virus
ugucgaaucuaaacuagugg

SEQ ID NO: 3299972 - RNA, 18 nt, Variola virus
agaacggagaauaucuau

SEQ ID NO: 3299973 - RNA, 15 nt, Variola virus
gaucuccaacaaauu

SEQ ID NO: 3299974 - RNA, 19 nt, Variola virus
aaucugguggauacucuag

SEQ ID NO: 3299975 - RNA, 15 nt, Variola virus
aaagguagaccuaau

SEQ ID NO: 3299976 - RNA, 15 nt, Variola virus
gaaaucaacaaucua

SEQ ID NO: 3299977 - RNA, 22 nt, Variola virus
aguauuaucgacguaacuauau

SEQ ID NO: 3299978 - RNA, 23 nt, Variola virus
caagaauccgaucccacuucugu

SEQ ID NO: 3299979 - RNA, 19 nt, Variola virus
auacaugucuuagauguuc

SEQ ID NO: 3299980 - RNA, 15 nt, Variola virus
aacuaaauuaacaau

SEQ ID NO: 3299981 - RNA, 15 nt, Variola virus
ugaauguuugaaaac

SEQ ID NO: 3299982 - RNA, 17 nt, Variola virus
uauccuauauacgaaaa

SEQ ID NO: 3299983 - RNA, 18 nt, Variola virus
auaaucuaaaauaguucu

SEQ ID NO: 3299984 - RNA, 19 nt, Variola virus
aauugcgauuauaagauua

SEQ ID NO: 3299985 - RNA, 19 nt, Variola virus
uauuaagaaauacaucaaa

SEQ ID NO: 3299986 - RNA, 19 nt, Variola virus
uuccugacgucuagaguuu

SEQ ID NO: 3299987 - RNA, 21 nt, Variola virus
uucacauucaccggaaacuag

SEQ ID NO: 3299988 - RNA, 15 nt, Variola virus
aacucuuugacauau

SEQ ID NO: 3299989 - RNA, 13 nt, Variola virus
uaugcuuucauaa

SEQ ID NO: 3299990 - RNA, 17 nt, Variola virus
caaugaacuaauaugau

SEQ ID NO: 3299991 - RNA, 20 nt, Variola virus
aagucccucauagaaugaua

SEQ ID NO: 3299992 - RNA, 16 nt, Variola virus
uucaaaagauaguuuu

SEQ ID NO: 3299993 - RNA, 12 nt, Variola virus
cgccucaaaugu

SEQ ID NO: 3299994 - RNA, 19 nt, Variola virus
ccauuuuuaugaucgucuu

SEQ ID NO: 3299995 - RNA, 13 nt, Variola virus
aauuugacuacau

SEQ ID NO: 3299996 - RNA, 23 nt, Variola virus
aaaaugaaucuaaacaaaaucua

SEQ ID NO: 3299997 - RNA, 19 nt, Variola virus
acuaacgaaauuaauauga

SEQ ID NO: 3299998 - RNA, 17 nt, Variola virus
aaugauuuagaaaugaa

SEQ ID NO: 3299999 - RNA, 17 nt, Variola virus
uaagacugcuaaaugua

SEQ ID NO: 3300000 - RNA, 17 nt, Variola virus
gaauguuauaaaaaugc

SEQ ID NO: 3300001 - RNA, 16 nt, Variola virus
uugagacuaucaacag

SEQ ID NO: 3300002 - RNA, 21 nt, Variola virus
gaucuauuagaaaauucucuu

SEQ ID NO: 3300003 - RNA, 18 nt, Variola virus
ugcuucaacgaggaagau

SEQ ID NO: 3300004 - RNA, 19 nt, Variola virus
gucuaugaauaugauuuuu

SEQ ID NO: 3300005 - RNA, 18 nt, Variola virus
acuauuugucuuaauaga

SEQ ID NO: 3300006 - RNA, 21 nt, Variola virus
gauucgcaaacuauucuaaua

SEQ ID NO: 3300007 - RNA, 22 nt, Variola virus
ccaauaauguauagacaauuau

SEQ ID NO: 3300008 - RNA, 19 nt, Variola virus
ugauugauuauuucaaaga

SEQ ID NO: 3300009 - RNA, 13 nt, Variola virus
aacagucuguuca

SEQ ID NO: 3300010 - RNA, 14 nt, Variola virus
cuaguacuguaaaa

SEQ ID NO: 3300011 - RNA, 16 nt, Variola virus
uaggcuauaaauauua

SEQ ID NO: 3300012 - RNA, 14 nt, Variola virus
acguaauaaugaag

SEQ ID NO: 3300013 - RNA, 20 nt, Variola virus
ucuagauacuagaguaguau

SEQ ID NO: 3300014 - RNA, 14 nt, Variola virus
agaaauaauauuaa

SEQ ID NO: 3300015 - RNA, 17 nt, Variola virus
acuuuguggaugaugau

SEQ ID NO: 3300016 - RNA, 18 nt, Variola virus
acauuguauuaugaugaa

SEQ ID NO: 3300017 - RNA, 15 nt, Variola virus
auaaaauuaauaaua

SEQ ID NO: 3300018 - RNA, 15 nt, Variola virus
auaauauuaauauua

SEQ ID NO: 3300019 - RNA, 21 nt, Variola virus
uucaucagauuauuuaacaau

SEQ ID NO: 3300020 - RNA, 13 nt, Variola virus
aacacuuuucuau

SEQ ID NO: 3300021 - RNA, 17 nt, Variola virus
uaccguuguuacuccau

SEQ ID NO: 3300022 - RNA, 15 nt, Variola virus
gaaaaucuaauaacu

SEQ ID NO: 3300023 - RNA, 16 nt, Variola virus
guucuauaaacugaau

SEQ ID NO: 3300024 - RNA, 21 nt, Variola virus
ucguugguaggauaauacauc

SEQ ID NO: 3300025 - RNA, 19 nt, Variola virus
caaaaucuaaacaaauauu

SEQ ID NO: 3300026 - RNA, 14 nt, Variola virus
auaucaggaaaugu

SEQ ID NO: 3300027 - RNA, 22 nt, Variola virus
uuaaauaacccaaguauugaaa

SEQ ID NO: 3300028 - RNA, 16 nt, Variola virus
uauuccaaucauugau

SEQ ID NO: 3300029 - RNA, 16 nt, Variola virus
ugauguaaaauuuuug

SEQ ID NO: 3300030 - RNA, 22 nt, Variola virus
gcugcuggaucuaaauauuuua

SEQ ID NO: 3300031 - RNA, 15 nt, Variola virus
ucuuguauaucuuaa

SEQ ID NO: 3300032 - RNA, 18 nt, Variola virus
agaaucaauauuaauauu

SEQ ID NO: 3300033 - RNA, 13 nt, Variola virus
aaucuauaauauc

SEQ ID NO: 3300034 - RNA, 24 nt, Variola virus
aaagaacggagaauaucuauacau

SEQ ID NO: 3300035 - RNA, 15 nt, Variola virus
aacgaugauauguau

SEQ ID NO: 3300036 - RNA, 13 nt, Variola virus
guucuaaauggau

SEQ ID NO: 3300037 - RNA, 17 nt, Variola virus
uggaauuguauauuaca

SEQ ID NO: 3300038 - RNA, 16 nt, Variola virus
uuaaaaugauuauucc

SEQ ID NO: 3300039 - RNA, 17 nt, Variola virus
cugaaacaguaugauuu

SEQ ID NO: 3300040 - RNA, 22 nt, Variola virus
aauggcaauaacuaaaaaugua

SEQ ID NO: 3300041 - RNA, 21 nt, Variola virus
auaccuuaccgccuucauaag

SEQ ID NO: 3300042 - RNA, 14 nt, Variola virus
uuacuacauuauua

SEQ ID NO: 3300043 - RNA, 20 nt, Variola virus
uacuccucauuacguuucau

SEQ ID NO: 3300044 - RNA, 14 nt, Variola virus
aucauguaaauguu

SEQ ID NO: 3300045 - RNA, 20 nt, Variola virus
guucauccuuguucaucauu

SEQ ID NO: 3300046 - RNA, 19 nt, Variola virus
uugauucuuauucacuaua

SEQ ID NO: 3300047 - RNA, 18 nt, Variola virus
cagucccaugguuccaua

SEQ ID NO: 3300048 - RNA, 17 nt, Variola virus
gcaaucuaacauuuuua

SEQ ID NO: 3300049 - RNA, 20 nt, Variola virus
aucaaaaaggagaauacuau

SEQ ID NO: 3300050 - RNA, 15 nt, Variola virus
agauuacucauguaa

SEQ ID NO: 3300051 - RNA, 17 nt, Variola virus
uaaugagcaaauuuauu

SEQ ID NO: 3300052 - RNA, 19 nt, Variola virus
acuggucauagaaaaugau

SEQ ID NO: 3300053 - RNA, 21 nt, Variola virus
auuugacuaaaucuuaauagu

SEQ ID NO: 3300054 - RNA, 12 nt, Variola virus
gucgcacgcucc

SEQ ID NO: 3300055 - RNA, 16 nt, Variola virus
aaugcagggugcauau

SEQ ID NO: 3300056 - RNA, 23 nt, Variola virus
cacugucucauacacuacaguaa

SEQ ID NO: 3300057 - RNA, 17 nt, Variola virus
uuuacgguaucuaauau

SEQ ID NO: 3300058 - RNA, 22 nt, Variola virus
aacuuuaauucaaauuuccauu

SEQ ID NO: 3300059 - RNA, 15 nt, Variola virus
cauggucuagaugua

SEQ ID NO: 3300060 - RNA, 22 nt, Variola virus
ucucucaaucacuacaucuuua

SEQ ID NO: 3300061 - RNA, 15 nt, Variola virus
uaauccuguguuuau

SEQ ID NO: 3300062 - RNA, 18 nt, Variola virus
ucuccauaaagaaauuag

SEQ ID NO: 3300063 - RNA, 20 nt, Variola virus
agccugaagcucaucuuguu

SEQ ID NO: 3300064 - RNA, 22 nt, Variola virus
acuauugaaguacuuaaugaag

SEQ ID NO: 3300065 - RNA, 14 nt, Variola virus
gugguguaaucuua

SEQ ID NO: 3300066 - RNA, 23 nt, Variola virus
ugcaucuaaaagcgaugcuacgc

SEQ ID NO: 3300067 - RNA, 20 nt, Variola virus
auuacauuuuuauaaauaga

SEQ ID NO: 3300068 - RNA, 15 nt, Variola virus
uaauagacuaucaga

SEQ ID NO: 3300069 - RNA, 16 nt, Variola virus
uuuguaauugugacau

SEQ ID NO: 3300070 - RNA, 21 nt, Variola virus
cucuguagacgauacuugacu

SEQ ID NO: 3300071 - RNA, 18 nt, Variola virus
agcauuuguaauaauccu

SEQ ID NO: 3300072 - RNA, 17 nt, Variola virus
auuagcgauagaacguu

SEQ ID NO: 3300073 - RNA, 18 nt, Variola virus
uuuggaucuuuuguacau

SEQ ID NO: 3300074 - RNA, 22 nt, Variola virus
aaaacuauuacuaggagaauua

SEQ ID NO: 3300075 - RNA, 21 nt, Variola virus
auaauuugaccugauuacauu

SEQ ID NO: 3300076 - RNA, 12 nt, Variola virus
ugacgaagagau

SEQ ID NO: 3300077 - RNA, 14 nt, Variola virus
gauuauaugauaua

SEQ ID NO: 3300078 - RNA, 16 nt, Variola virus
uguugacgacauauau

SEQ ID NO: 3300079 - RNA, 23 nt, Variola virus
ugaauauauuaaaguuauuuaug

SEQ ID NO: 3300080 - RNA, 15 nt, Variola virus
aauagauuuuucaua

SEQ ID NO: 3300081 - RNA, 15 nt, Variola virus
auaaacaugucuauu

SEQ ID NO: 3300082 - RNA, 15 nt, Variola virus
cuggaauagguauau

SEQ ID NO: 3300083 - RNA, 16 nt, Variola virus
auaucuacuagaaaga

SEQ ID NO: 3300084 - RNA, 21 nt, Variola virus
gucguucuuccucaaguucuc

SEQ ID NO: 3300085 - RNA, 13 nt, Variola virus
ugauauuuucuau

SEQ ID NO: 3300086 - RNA, 21 nt, Variola virus
uaggugccaccaauaaacuau

SEQ ID NO: 3300087 - RNA, 13 nt, Variola virus
uaaagauauuucu

SEQ ID NO: 3300088 - RNA, 23 nt, Variola virus
auuuaguuucuucgauauuggau

SEQ ID NO: 3300089 - RNA, 16 nt, Variola virus
aacguucauagaauuu

SEQ ID NO: 3300090 - RNA, 20 nt, Variola virus
gccauugaaaacuauuucuu

SEQ ID NO: 3300091 - RNA, 20 nt, Variola virus
auaaaaccaugaaauauauu

SEQ ID NO: 3300092 - RNA, 20 nt, Variola virus
aagcguguaaacgaaaacua

SEQ ID NO: 3300093 - RNA, 22 nt, Variola virus
uuaaacuguaucgaucauucuu

SEQ ID NO: 3300094 - RNA, 17 nt, Variola virus
auuacuaggagaauuau

SEQ ID NO: 3300095 - RNA, 19 nt, Variola virus
uuuuucuucauuuauuaua

SEQ ID NO: 3300096 - RNA, 17 nt, Variola virus
aacgauaccaucuucug

SEQ ID NO: 3300097 - RNA, 22 nt, Variola virus
uauagaauguuuccaaugagua

SEQ ID NO: 3300098 - RNA, 13 nt, Variola virus
uauacccaaagag

SEQ ID NO: 3300099 - RNA, 19 nt, Variola virus
guauucauuuaucacaaaa

SEQ ID NO: 3300100 - RNA, 14 nt, Variola virus
uaggauacaagauc

SEQ ID NO: 3300101 - RNA, 22 nt, Variola virus
auacuucauuucuaaaauagua

SEQ ID NO: 3300102 - RNA, 16 nt, Variola virus
ccauuuuaaaaucauu

SEQ ID NO: 3300103 - RNA, 21 nt, Variola virus
auucaauuacuacaaaaauua

SEQ ID NO: 3300104 - RNA, 19 nt, Variola virus
uuaaacuaauucauuuuca

SEQ ID NO: 3300105 - RNA, 21 nt, Variola virus
acagucugcgaacuuuaaaca

SEQ ID NO: 3300106 - RNA, 20 nt, Variola virus
ucgacuauuuuaaauagcau

SEQ ID NO: 3300107 - RNA, 22 nt, Variola virus
guaucaucucuacauuguuuac

SEQ ID NO: 3300108 - RNA, 17 nt, Variola virus
cuuaaagacuauaccau

SEQ ID NO: 3300109 - RNA, 13 nt, Variola virus
uauaauauuuccu

SEQ ID NO: 3300110 - RNA, 19 nt, Variola virus
aacucauugcuuucuagaa

SEQ ID NO: 3300111 - RNA, 13 nt, Variola virus
uauuuuacucauu

SEQ ID NO: 3300112 - RNA, 11 nt, Variola virus
uuuaacagaug

SEQ ID NO: 3300113 - RNA, 18 nt, Variola virus
auaaucaucgaauacuuu

SEQ ID NO: 3300114 - RNA, 19 nt, Variola virus
aguaugacguugaacuaau

SEQ ID NO: 3300115 - RNA, 16 nt, Variola virus
uuuugauacuauccaa

SEQ ID NO: 3300116 - RNA, 15 nt, Variola virus
aaucaaaacaaaauu

SEQ ID NO: 3300117 - RNA, 18 nt, Variola virus
guauaaauacccuuccaa

SEQ ID NO: 3300118 - RNA, 19 nt, Variola virus
guguauacaguauaggaaa

SEQ ID NO: 3300119 - RNA, 20 nt, Variola virus
uuugaaauaucuuaugauga

SEQ ID NO: 3300120 - RNA, 16 nt, Variola virus
ugacuccuauauuucc

SEQ ID NO: 3300121 - RNA, 18 nt, Variola virus
uguauguuuaaacacucu

SEQ ID NO: 3300122 - RNA, 22 nt, Variola virus
aacaucucagacagucuggucu

SEQ ID NO: 3300123 - RNA, 18 nt, Variola virus
aguagugauuuugaagau

SEQ ID NO: 3300124 - RNA, 20 nt, Variola virus
aucuagauuguuuaauauau

SEQ ID NO: 3300125 - RNA, 18 nt, Variola virus
ccaugauuaaauauuuua

SEQ ID NO: 3300126 - RNA, 22 nt, Variola virus
uuagaaaacucucuaucucuua

SEQ ID NO: 3300127 - RNA, 13 nt, Variola virus
cucuacucuagau

SEQ ID NO: 3300128 - RNA, 14 nt, Variola virus
uuucagucauugau

SEQ ID NO: 3300129 - RNA, 13 nt, Variola virus
auaucgaugugga

SEQ ID NO: 3300130 - RNA, 17 nt, Variola virus
acaaguuuucauaucau

SEQ ID NO: 3300131 - RNA, 19 nt, Variola virus
guauccagguagacauaga

SEQ ID NO: 3300132 - RNA, 13 nt, Variola virus
gaacuaauaugau

SEQ ID NO: 3300133 - RNA, 22 nt, Variola virus
auuaagcaacaugucuuuaaau

SEQ ID NO: 3300134 - RNA, 21 nt, Variola virus
uauacuugucaucauuucuaa

SEQ ID NO: 3300135 - RNA, 19 nt, Variola virus
cgaacuaccugauuuugca

SEQ ID NO: 3300136 - RNA, 16 nt, Variola virus
aacguguauuaaauag

SEQ ID NO: 3300137 - RNA, 17 nt, Variola virus
acuuccaauaaaauuac

SEQ ID NO: 3300138 - RNA, 17 nt, Variola virus
agaaaaaaaauugaauu

SEQ ID NO: 3300139 - RNA, 18 nt, Variola virus
auaucauugucuaauaga

SEQ ID NO: 3300140 - RNA, 15 nt, Variola virus
uaucgcgacauauau

SEQ ID NO: 3300141 - RNA, 14 nt, Variola virus
aauaucagagagau

SEQ ID NO: 3300142 - RNA, 22 nt, Variola virus
uaaacguuguuuacucauauag

SEQ ID NO: 3300143 - RNA, 13 nt, Variola virus
aauacguugaaaa

SEQ ID NO: 3300144 - RNA, 13 nt, Variola virus
guuuuuuagaucu

SEQ ID NO: 3300145 - RNA, 15 nt, Variola virus
uaguauaaauaguua

SEQ ID NO: 3300146 - RNA, 16 nt, Variola virus
agguucccaauuccaa

SEQ ID NO: 3300147 - RNA, 18 nt, Variola virus
cuuaaaauauguaacaau

SEQ ID NO: 3300148 - RNA, 15 nt, Variola virus
ucacaaauacuacaa

SEQ ID NO: 3300149 - RNA, 15 nt, Variola virus
acuuccguuuaaaaa

SEQ ID NO: 3300150 - RNA, 19 nt, Variola virus
aauuccgcauuaaaugaug

SEQ ID NO: 3300151 - RNA, 13 nt, Variola virus
acucuaaguuugu

SEQ ID NO: 3300152 - RNA, 16 nt, Variola virus
ugaucuaacuaagaua

SEQ ID NO: 3300153 - RNA, 13 nt, Variola virus
uagauuaucuauu

SEQ ID NO: 3300154 - RNA, 16 nt, Variola virus
uguauccauacauaca

SEQ ID NO: 3300155 - RNA, 12 nt, Variola virus
aaaauucuccac

SEQ ID NO: 3300156 - RNA, 24 nt, Variola virus
cccaugcuauauuccuguuaucau

SEQ ID NO: 3300157 - RNA, 20 nt, Variola virus
uacaucuaaauuuuuacuau

SEQ ID NO: 3300158 - RNA, 21 nt, Variola virus
uuagucuuaaugauacacuaa

SEQ ID NO: 3300159 - RNA, 23 nt, Variola virus
gcguguuuuaaauccuuaauaua

SEQ ID NO: 3300160 - RNA, 18 nt, Variola virus
accgaguuuaaaacuucu

SEQ ID NO: 3300161 - RNA, 15 nt, Variola virus
auauucacaaauaua

SEQ ID NO: 3300162 - RNA, 15 nt, Variola virus
aguuuauaaaaauuu

SEQ ID NO: 3300163 - RNA, 23 nt, Variola virus
guacuguucauacaugaugagau

SEQ ID NO: 3300164 - RNA, 19 nt, Variola virus
uauucugaaacaguaugau

SEQ ID NO: 3300165 - RNA, 16 nt, Variola virus
gguuaacaucuuauaa

SEQ ID NO: 3300166 - RNA, 21 nt, Variola virus
ugaucuaucgaaaauugcuau

SEQ ID NO: 3300167 - RNA, 18 nt, Variola virus
gacaccuaagaagaaugu

SEQ ID NO: 3300168 - RNA, 16 nt, Variola virus
gcggagauuuaaucug

SEQ ID NO: 3300169 - RNA, 19 nt, Variola virus
guacauacgucuauuucua

SEQ ID NO: 3300170 - RNA, 21 nt, Variola virus
auuauuggguaaguuuaaaaa

SEQ ID NO: 3300171 - RNA, 22 nt, Variola virus
uaauccuauucuugaucucauc

SEQ ID NO: 3300172 - RNA, 22 nt, Variola virus
uaacagaacauuugcaaagauu

SEQ ID NO: 3300173 - RNA, 19 nt, Variola virus
guuucacuaguaccuuuau

SEQ ID NO: 3300174 - RNA, 23 nt, Variola virus
uucguaaaaaaguuaaaacuugu

SEQ ID NO: 3300175 - RNA, 15 nt, Variola virus
uuaguuccaacaauu

SEQ ID NO: 3300176 - RNA, 18 nt, Variola virus
auaacaaaugcagaaauu

SEQ ID NO: 3300177 - RNA, 22 nt, Variola virus
caaucuuacagaaguucaugau

SEQ ID NO: 3300178 - RNA, 17 nt, Variola virus
uauuuaacgauucuuca

SEQ ID NO: 3300179 - RNA, 18 nt, Variola virus
gauaauaauuaauaucua

SEQ ID NO: 3300180 - RNA, 13 nt, Variola virus
uuaauaguuuuua

SEQ ID NO: 3300181 - RNA, 22 nt, Variola virus
uaauagcaucaucuuuaucauu

SEQ ID NO: 3300182 - RNA, 14 nt, Variola virus
auauuuuuuaacua

SEQ ID NO: 3300183 - RNA, 16 nt, Variola virus
cgcuuaauaucuucug

SEQ ID NO: 3300184 - RNA, 13 nt, Variola virus
gacaucucagaau

SEQ ID NO: 3300185 - RNA, 20 nt, Variola virus
uaaacaaucugucgaaaaag

SEQ ID NO: 3300186 - RNA, 14 nt, Variola virus
guuuagaugucgaa

SEQ ID NO: 3300187 - RNA, 13 nt, Variola virus
gcuauuacuuauu

SEQ ID NO: 3300188 - RNA, 16 nt, Variola virus
ugauacagaaaaucuu

SEQ ID NO: 3300189 - RNA, 21 nt, Variola virus
gaacuauuuuuuuauacuucu

SEQ ID NO: 3300190 - RNA, 13 nt, Variola virus
ugaaauaacucuu

SEQ ID NO: 3300191 - RNA, 12 nt, Variola virus
aucauuucacaa

SEQ ID NO: 3300192 - RNA, 17 nt, Variola virus
auguuugggagaauuaa

SEQ ID NO: 3300193 - RNA, 12 nt, Variola virus
gcaaucaugaaa

SEQ ID NO: 3300194 - RNA, 15 nt, Variola virus
guuaaaguaaucauu

SEQ ID NO: 3300195 - RNA, 14 nt, Variola virus
acagcguaaaacac

SEQ ID NO: 3300196 - RNA, 19 nt, Variola virus
uguaaauuaggagaaacaa

SEQ ID NO: 3300197 - RNA, 13 nt, Variola virus
ucaagucauaaau

SEQ ID NO: 3300198 - RNA, 18 nt, Variola virus
uaaagacccaaaugucug

SEQ ID NO: 3300199 - RNA, 18 nt, Variola virus
acagagccaucuguaaaa

SEQ ID NO: 3300200 - RNA, 16 nt, Variola virus
aacaugcuuuucuaua

SEQ ID NO: 3300201 - RNA, 19 nt, Variola virus
acuuccguuuaaaaauggu

SEQ ID NO: 3300202 - RNA, 17 nt, Variola virus
auacauucgaaaaaucu

SEQ ID NO: 3300203 - RNA, 18 nt, Variola virus
uuccaaucuauugcuacu

SEQ ID NO: 3300204 - RNA, 21 nt, Variola virus
cagaacgaauuaugauagaaa

SEQ ID NO: 3300205 - RNA, 21 nt, Variola virus
uaaaguaugaacaaagaaaug

SEQ ID NO: 3300206 - RNA, 21 nt, Variola virus
auuuccaaagauacacacauu

SEQ ID NO: 3300207 - RNA, 12 nt, Variola virus
aagaauggauga

SEQ ID NO: 3300208 - RNA, 14 nt, Variola virus
uauuugucuuugaa

SEQ ID NO: 3300209 - RNA, 18 nt, Variola virus
auaaacaccaagaaagcu

SEQ ID NO: 3300210 - RNA, 19 nt, Variola virus
uaagagauaucuaucuauu

SEQ ID NO: 3300211 - RNA, 15 nt, Variola virus
cauaauauuaaacac

SEQ ID NO: 3300212 - RNA, 14 nt, Variola virus
uagaucucuagaau

SEQ ID NO: 3300213 - RNA, 18 nt, Variola virus
auaugccuccagaaguug

SEQ ID NO: 3300214 - RNA, 23 nt, Variola virus
aauaauacaauauuuuucguuua

SEQ ID NO: 3300215 - RNA, 22 nt, Variola virus
aaugugguaugucuccauuaca

SEQ ID NO: 3300216 - RNA, 20 nt, Variola virus
aaacgacauugucagaaauu

SEQ ID NO: 3300217 - RNA, 21 nt, Variola virus
uuaaguucuggaauauuauca

SEQ ID NO: 3300218 - RNA, 16 nt, Variola virus
uauucccaaacauaca

SEQ ID NO: 3300219 - RNA, 17 nt, Variola virus
ucacuaacaauaacuag

SEQ ID NO: 3300220 - RNA, 13 nt, Variola virus
uacugcaauaaaa

SEQ ID NO: 3300221 - RNA, 23 nt, Variola virus
auuaccauagaagauguuagaaa

SEQ ID NO: 3300222 - RNA, 16 nt, Variola virus
guauuuuauuuuggaa

SEQ ID NO: 3300223 - RNA, 18 nt, Variola virus
ggauuaucaaaucuuuaa

SEQ ID NO: 3300224 - RNA, 13 nt, Variola virus
uuaucauacuguc

SEQ ID NO: 3300225 - RNA, 15 nt, Variola virus
acaggaaagaaguau

SEQ ID NO: 3300226 - RNA, 15 nt, Variola virus
ccaugaaagaaagaa

SEQ ID NO: 3300227 - RNA, 22 nt, Variola virus
ucguauuccugacgucuagagu

SEQ ID NO: 3300228 - RNA, 21 nt, Variola virus
guccauuaaaguuaaauugug

SEQ ID NO: 3300229 - RNA, 22 nt, Variola virus
accauccuuuaaaaaaaaugau

SEQ ID NO: 3300230 - RNA, 12 nt, Variola virus
cauuggaagcaa

SEQ ID NO: 3300231 - RNA, 16 nt, Variola virus
ucauauggaagauguu

SEQ ID NO: 3300232 - RNA, 17 nt, Variola virus
uaaauguauauuuucca

SEQ ID NO: 3300233 - RNA, 16 nt, Variola virus
aaccaugagugugaaa

SEQ ID NO: 3300234 - RNA, 22 nt, Variola virus
uauauaagacacagaaauacug

SEQ ID NO: 3300235 - RNA, 14 nt, Variola virus
uugaaaauuauuuu

SEQ ID NO: 3300236 - RNA, 21 nt, Variola virus
uacgcuauuaaucuuuaaaau

SEQ ID NO: 3300237 - RNA, 19 nt, Variola virus
aauuuccgucuaucaucua

SEQ ID NO: 3300238 - RNA, 12 nt, Variola virus
gccaacaaauau

SEQ ID NO: 3300239 - RNA, 13 nt, Variola virus
acguuaacagaga

SEQ ID NO: 3300240 - RNA, 20 nt, Variola virus
uuucauuuguauacacauaa

SEQ ID NO: 3300241 - RNA, 20 nt, Variola virus
acauuagaccguuuaauaga

SEQ ID NO: 3300242 - RNA, 17 nt, Variola virus
auguuggcaacgacaaa

SEQ ID NO: 3300243 - RNA, 15 nt, Variola virus
uaaacuaacuacaaa

SEQ ID NO: 3300244 - RNA, 19 nt, Variola virus
uggaccauuaauaggaaaa

SEQ ID NO: 3300245 - RNA, 21 nt, Variola virus
gcuacucguuuggaaucacaa

SEQ ID NO: 3300246 - RNA, 22 nt, Variola virus
auuuuguaguuaauuuaucaca

SEQ ID NO: 3300247 - RNA, 14 nt, Variola virus
ugguuuaauuauuu

SEQ ID NO: 3300248 - RNA, 21 nt, Variola virus
uuuucacuuuuuauaauuuua

SEQ ID NO: 3300249 - RNA, 15 nt, Variola virus
caugauuaguauuuu

SEQ ID NO: 3300250 - RNA, 13 nt, Variola virus
auuaccuuaauaa

SEQ ID NO: 3300251 - RNA, 23 nt, Variola virus
uaaagaaguagcuaauguuguga

SEQ ID NO: 3300252 - RNA, 20 nt, Variola virus
acaguguaugaaaaguuaca

SEQ ID NO: 3300253 - RNA, 13 nt, Variola virus
aucacuucaauaa

SEQ ID NO: 3300254 - RNA, 14 nt, Variola virus
uaucucuuaaugag

SEQ ID NO: 3300255 - RNA, 12 nt, Variola virus
uaacuauuugca

SEQ ID NO: 3300256 - RNA, 22 nt, Variola virus
acauucaugauaaacuuaauga

SEQ ID NO: 3300257 - RNA, 16 nt, Variola virus
cauaacuguauaaaau

SEQ ID NO: 3300258 - RNA, 20 nt, Variola virus
uuaguaucuagcucuguaaa

SEQ ID NO: 3300259 - RNA, 20 nt, Variola virus
aaauaaaaagguagauguuc

SEQ ID NO: 3300260 - RNA, 14 nt, Variola virus
cuguagauaguuuu

SEQ ID NO: 3300261 - RNA, 19 nt, Variola virus
caauaaaaauaaacuagaa

SEQ ID NO: 3300262 - RNA, 21 nt, Variola virus
gaacacgauuauuauaaaaua

SEQ ID NO: 3300263 - RNA, 13 nt, Variola virus
uagugauagauuu

SEQ ID NO: 3300264 - RNA, 14 nt, Variola virus
aaagaauccuacau

SEQ ID NO: 3300265 - RNA, 16 nt, Variola virus
cgacucaguauacaaa

SEQ ID NO: 3300266 - RNA, 16 nt, Variola virus
auccucagacacagau

SEQ ID NO: 3300267 - RNA, 14 nt, Variola virus
cacagucaaacauu

SEQ ID NO: 3300268 - RNA, 16 nt, Variola virus
uguuucuuacauauuu

SEQ ID NO: 3300269 - RNA, 13 nt, Variola virus
accaaacauucuu

SEQ ID NO: 3300270 - RNA, 22 nt, Variola virus
acaauuuuuuuauaauaauucu

SEQ ID NO: 3300271 - RNA, 18 nt, Variola virus
ugaauauaauagauguau

SEQ ID NO: 3300272 - RNA, 15 nt, Variola virus
uagugacauaaacau

SEQ ID NO: 3300273 - RNA, 19 nt, Variola virus
auuauagcaauauguguaa

SEQ ID NO: 3300274 - RNA, 14 nt, Variola virus
augaaaaaaaacac

SEQ ID NO: 3300275 - RNA, 16 nt, Variola virus
caucgcauacaaaaac

SEQ ID NO: 3300276 - RNA, 17 nt, Variola virus
acguauugauaaauaga

SEQ ID NO: 3300277 - RNA, 14 nt, Variola virus
cguauauguuucua

SEQ ID NO: 3300278 - RNA, 14 nt, Variola virus
aaaagcauacguac

SEQ ID NO: 3300279 - RNA, 19 nt, Variola virus
ugccaaaguuuaaacugaa

SEQ ID NO: 3300280 - RNA, 15 nt, Variola virus
agcucaauauaaaug

SEQ ID NO: 3300281 - RNA, 22 nt, Variola virus
uauaguuaauaguguacuacaa

SEQ ID NO: 3300282 - RNA, 22 nt, Variola virus
auauagucuguguuacauaaua

SEQ ID NO: 3300283 - RNA, 20 nt, Variola virus
agucauaucuagaaugaaga

SEQ ID NO: 3300284 - RNA, 18 nt, Variola virus
cagaauauauaagacaca

SEQ ID NO: 3300285 - RNA, 17 nt, Variola virus
gucuuccuuauguagag

SEQ ID NO: 3300286 - RNA, 22 nt, Variola virus
ucuauccauuugucuuccuuaa

SEQ ID NO: 3300287 - RNA, 22 nt, Variola virus
aaugauuauguuguuaugagug

SEQ ID NO: 3300288 - RNA, 15 nt, Variola virus
auggauauauuaaag

SEQ ID NO: 3300289 - RNA, 19 nt, Variola virus
cgccucaguugucauaaac

SEQ ID NO: 3300290 - RNA, 13 nt, Variola virus
auaaauagacaaa

SEQ ID NO: 3300291 - RNA, 22 nt, Variola virus
agugggaugaaauccuauuuua

SEQ ID NO: 3300292 - RNA, 20 nt, Variola virus
uuuaauuucuuguaaucauu

SEQ ID NO: 3300293 - RNA, 22 nt, Variola virus
uaacuaugauaucucuauuaau

SEQ ID NO: 3300294 - RNA, 17 nt, Variola virus
cauucugcaauauuguu

SEQ ID NO: 3300295 - RNA, 13 nt, Variola virus
uuacauucucauu

SEQ ID NO: 3300296 - RNA, 16 nt, Variola virus
uucaaaauuauuuacc

SEQ ID NO: 3300297 - RNA, 20 nt, Variola virus
acuuauggacaacagaggau

SEQ ID NO: 3300298 - RNA, 13 nt, Variola virus
cuaacuuaucuag

SEQ ID NO: 3300299 - RNA, 13 nt, Variola virus
aagagaauuuucu

SEQ ID NO: 3300300 - RNA, 15 nt, Variola virus
auacgucaaggaaag

SEQ ID NO: 3300301 - RNA, 16 nt, Variola virus
gaaagugcaaaugagg

SEQ ID NO: 3300302 - RNA, 23 nt, Variola virus
uuaaaaaguugacagaaccuugu

SEQ ID NO: 3300303 - RNA, 19 nt, Variola virus
gaaugaagauaucauuaau

SEQ ID NO: 3300304 - RNA, 20 nt, Variola virus
uugauggaaguaaaagauuu

SEQ ID NO: 3300305 - RNA, 15 nt, Variola virus
ugaagaagaaaacaa

SEQ ID NO: 3300306 - RNA, 22 nt, Variola virus
aaaugguguaacucucuggaag

SEQ ID NO: 3300307 - RNA, 16 nt, Variola virus
acuaauacaucugaaa

SEQ ID NO: 3300308 - RNA, 19 nt, Variola virus
agaucugcguguaaaaagu

SEQ ID NO: 3300309 - RNA, 14 nt, Variola virus
aggagauauugaaa

SEQ ID NO: 3300310 - RNA, 16 nt, Variola virus
aaaagacguaaauauu

SEQ ID NO: 3300311 - RNA, 17 nt, Variola virus
ucuucuauuuuaucauu

SEQ ID NO: 3300312 - RNA, 23 nt, Variola virus
uuuacacaguaaccaaaaugaaa

SEQ ID NO: 3300313 - RNA, 17 nt, Variola virus
caaaauauaauguugua

SEQ ID NO: 3300314 - RNA, 22 nt, Variola virus
auaguauauacguuauugucaa

SEQ ID NO: 3300315 - RNA, 18 nt, Variola virus
acauauaacuuuccauca

SEQ ID NO: 3300316 - RNA, 14 nt, Variola virus
auaugcaacuauaa

SEQ ID NO: 3300317 - RNA, 13 nt, Variola virus
gcaauaauacaac

SEQ ID NO: 3300318 - RNA, 18 nt, Variola virus
uaacauguuauagaauau

SEQ ID NO: 3300319 - RNA, 12 nt, Variola virus
cgucaguauuua

SEQ ID NO: 3300320 - RNA, 22 nt, Variola virus
acucuaagaacuuauuaaugaa

SEQ ID NO: 3300321 - RNA, 18 nt, Variola virus
acaacaaaugauaaucaa

SEQ ID NO: 3300322 - RNA, 18 nt, Variola virus
uuaucaucauccauuaau

SEQ ID NO: 3300323 - RNA, 22 nt, Variola virus
auacuuuaacaucacuaauauc

SEQ ID NO: 3300324 - RNA, 22 nt, Variola virus
gcaaaaaaucugauagaaagaa

SEQ ID NO: 3300325 - RNA, 22 nt, Variola virus
uaugagggaaaagauucucauu

SEQ ID NO: 3300326 - RNA, 14 nt, Variola virus
uaucaauagcaguu

SEQ ID NO: 3300327 - RNA, 23 nt, Variola virus
auugaugugucuguuuauacaau

SEQ ID NO: 3300328 - RNA, 20 nt, Variola virus
uaacaguuuugcuaauuaau

SEQ ID NO: 3300329 - RNA, 13 nt, Variola virus
gauguacauguau

SEQ ID NO: 3300330 - RNA, 12 nt, Variola virus
ucuucuaucaaa

SEQ ID NO: 3300331 - RNA, 13 nt, Variola virus
auacuaucaaaau

SEQ ID NO: 3300332 - RNA, 14 nt, Variola virus
cuuuuguuuagaau

SEQ ID NO: 3300333 - RNA, 18 nt, Variola virus
cgaugauuaaugacgaua

SEQ ID NO: 3300334 - RNA, 22 nt, Variola virus
ugauaguauuccaauaucugag

SEQ ID NO: 3300335 - RNA, 13 nt, Variola virus
uaugaaucuggau

SEQ ID NO: 3300336 - RNA, 20 nt, Variola virus
ucauacgauaugccuccaga

SEQ ID NO: 3300337 - RNA, 23 nt, Variola virus
aauucucuuacgucgauauuucu

SEQ ID NO: 3300338 - RNA, 19 nt, Variola virus
auaugucuagaacggcaau

SEQ ID NO: 3300339 - RNA, 11 nt, Variola virus
caaagaaagag

SEQ ID NO: 3300340 - RNA, 16 nt, Variola virus
cauuaaaaugauuauu

SEQ ID NO: 3300341 - RNA, 19 nt, Variola virus
uuuaucaaccauucaaaaa

SEQ ID NO: 3300342 - RNA, 18 nt, Variola virus
uugcucaaauaauacuau

SEQ ID NO: 3300343 - RNA, 16 nt, Variola virus
gucuaguaaguagaaa

SEQ ID NO: 3300344 - RNA, 14 nt, Variola virus
acauguauuaaaga

SEQ ID NO: 3300345 - RNA, 22 nt, Variola virus
guuagauauuuagcaauugcau

SEQ ID NO: 3300346 - RNA, 19 nt, Variola virus
gacuaucagacucuucuau

SEQ ID NO: 3300347 - RNA, 18 nt, Variola virus
aauaguauacgcagaaaa

SEQ ID NO: 3300348 - RNA, 19 nt, Variola virus
acguuucugucaacaaugu

SEQ ID NO: 3300349 - RNA, 17 nt, Variola virus
ucuaaucacuuuaacuu

SEQ ID NO: 3300350 - RNA, 21 nt, Variola virus
aaugauacacuaaguauauac

SEQ ID NO: 3300351 - RNA, 16 nt, Variola virus
ucuuggauuucauaua

SEQ ID NO: 3300352 - RNA, 20 nt, Variola virus
gagaucuaaacgaucuaguu

SEQ ID NO: 3300353 - RNA, 13 nt, Variola virus
aauaaugaauauu

SEQ ID NO: 3300354 - RNA, 21 nt, Variola virus
uacagauuguaguucuauaau

SEQ ID NO: 3300355 - RNA, 17 nt, Variola virus
cucccuuguguaacguu

SEQ ID NO: 3300356 - RNA, 16 nt, Variola virus
uagauuuuccauccac

SEQ ID NO: 3300357 - RNA, 24 nt, Variola virus
ugaauuguuucuuuuagaagugau

SEQ ID NO: 3300358 - RNA, 23 nt, Variola virus
ucaauguccugcuauacuucggc

SEQ ID NO: 3300359 - RNA, 20 nt, Variola virus
agauacauuacaucuugaua

SEQ ID NO: 3300360 - RNA, 20 nt, Variola virus
acuguuuucuagauggaaau

SEQ ID NO: 3300361 - RNA, 15 nt, Variola virus
aaauuuaaaaugagu

SEQ ID NO: 3300362 - RNA, 15 nt, Variola virus
ucauugcuuucuaga

SEQ ID NO: 3300363 - RNA, 15 nt, Variola virus
cucaccaauaauuuu

SEQ ID NO: 3300364 - RNA, 14 nt, Variola virus
auuaucuacagaug

SEQ ID NO: 3300365 - RNA, 22 nt, Variola virus
uccauucucucaaucacuacau

SEQ ID NO: 3300366 - RNA, 13 nt, Variola virus
uuacaucauuaag

SEQ ID NO: 3300367 - RNA, 20 nt, Variola virus
cauuacuaguugauaacaau

SEQ ID NO: 3300368 - RNA, 14 nt, Variola virus
accuagaacaaugu

SEQ ID NO: 3300369 - RNA, 16 nt, Variola virus
aauauuuacuaauauc

SEQ ID NO: 3300370 - RNA, 21 nt, Variola virus
ugauuaaucaauuaguagaga

SEQ ID NO: 3300371 - RNA, 19 nt, Variola virus
uacuauauacaauaucacu

SEQ ID NO: 3300372 - RNA, 15 nt, Variola virus
gauaaugauaaugac

SEQ ID NO: 3300373 - RNA, 21 nt, Variola virus
aaguaauuuucuuuguuggaa

SEQ ID NO: 3300374 - RNA, 17 nt, Variola virus
auaaaauuaaugagauu

SEQ ID NO: 3300375 - RNA, 19 nt, Variola virus
cucauguaaccuacuagaa

SEQ ID NO: 3300376 - RNA, 20 nt, Variola virus
aggauuuacuaaguaauuac

SEQ ID NO: 3300377 - RNA, 17 nt, Variola virus
uaauguuguuaccauau

SEQ ID NO: 3300378 - RNA, 17 nt, Variola virus
aacaaauagacuuuuua

SEQ ID NO: 3300379 - RNA, 17 nt, Variola virus
ccauauauccaauaaag

SEQ ID NO: 3300380 - RNA, 19 nt, Variola virus
uaggauuuuggacuuauau

SEQ ID NO: 3300381 - RNA, 21 nt, Variola virus
aaguauuuuuagagcucuugg

SEQ ID NO: 3300382 - RNA, 15 nt, Variola virus
agaaucguaauggau

SEQ ID NO: 3300383 - RNA, 11 nt, Variola virus
ucauuaaacag

SEQ ID NO: 3300384 - RNA, 14 nt, Variola virus
caggaauagaugua

SEQ ID NO: 3300385 - RNA, 24 nt, Variola virus
uauacugaguuggcuaugaucuug

SEQ ID NO: 3300386 - RNA, 20 nt, Variola virus
aaugaauggcguaccaguuu

SEQ ID NO: 3300387 - RNA, 23 nt, Variola virus
uuuaacuugcgggguuaaucuca

SEQ ID NO: 3300388 - RNA, 12 nt, Variola virus
uuuuauaaacaa

SEQ ID NO: 3300389 - RNA, 15 nt, Variola virus
caauaaaaaaaauug

SEQ ID NO: 3300390 - RNA, 21 nt, Variola virus
caaacaauccaaaaaaugaaa

SEQ ID NO: 3300391 - RNA, 15 nt, Variola virus
auuuugucauuaacu

SEQ ID NO: 3300392 - RNA, 14 nt, Variola virus
caugucaacaaaaa

SEQ ID NO: 3300393 - RNA, 15 nt, Variola virus
uauuaauccuuugau

SEQ ID NO: 3300394 - RNA, 19 nt, Variola virus
uacaucuauauugcuacau

SEQ ID NO: 3300395 - RNA, 17 nt, Variola virus
auuccaauuauuugaac

SEQ ID NO: 3300396 - RNA, 15 nt, Variola virus
ccauuaaucacugau

SEQ ID NO: 3300397 - RNA, 15 nt, Variola virus
uuaaaucguuguucu

SEQ ID NO: 3300398 - RNA, 14 nt, Variola virus
aaaagacuauacau

SEQ ID NO: 3300399 - RNA, 14 nt, Variola virus
cauuuauacacaau

SEQ ID NO: 3300400 - RNA, 19 nt, Variola virus
auauagucuuguuaaacgu

SEQ ID NO: 3300401 - RNA, 14 nt, Variola virus
ucucucaaaucaga

SEQ ID NO: 3300402 - RNA, 14 nt, Variola virus
aauacuuaaaaaug

SEQ ID NO: 3300403 - RNA, 19 nt, Variola virus
uacuagugguaucaagaag

SEQ ID NO: 3300404 - RNA, 18 nt, Variola virus
uaccagugauuauccauu

SEQ ID NO: 3300405 - RNA, 14 nt, Variola virus
uucaacaguuucua

SEQ ID NO: 3300406 - RNA, 19 nt, Variola virus
aacuuuaaacagaaauaua

SEQ ID NO: 3300407 - RNA, 22 nt, Variola virus
uuaacucauugcuuucuagaau

SEQ ID NO: 3300408 - RNA, 18 nt, Variola virus
caaaaagggugcgguacu

SEQ ID NO: 3300409 - RNA, 19 nt, Variola virus
cuuaauaacaaaacuaauu

SEQ ID NO: 3300410 - RNA, 16 nt, Variola virus
uacaugauuaauacau

SEQ ID NO: 3300411 - RNA, 18 nt, Variola virus
ucuauacccauuauguaa

SEQ ID NO: 3300412 - RNA, 18 nt, Variola virus
ugaauauagaacaucauu

SEQ ID NO: 3300413 - RNA, 20 nt, Variola virus
caaaaccaacacuuaucaau

SEQ ID NO: 3300414 - RNA, 22 nt, Variola virus
acauccaggguccauuuucugu

SEQ ID NO: 3300415 - RNA, 17 nt, Variola virus
uauuccguauuuaucua

SEQ ID NO: 3300416 - RNA, 14 nt, Variola virus
uaaauguaaauuca

SEQ ID NO: 3300417 - RNA, 14 nt, Variola virus
uaaugcuacagaua

SEQ ID NO: 3300418 - RNA, 23 nt, Variola virus
auuuucagcauggauuucucaua

SEQ ID NO: 3300419 - RNA, 19 nt, Variola virus
guucuacauaaaacaucau

SEQ ID NO: 3300420 - RNA, 12 nt, Variola virus
aaauuuuucuac

SEQ ID NO: 3300421 - RNA, 17 nt, Variola virus
accguguguaaaaugac

SEQ ID NO: 3300422 - RNA, 20 nt, Variola virus
agaacaaugucaaaauauga

SEQ ID NO: 3300423 - RNA, 16 nt, Variola virus
guaaaacaaaauuaga

SEQ ID NO: 3300424 - RNA, 23 nt, Variola virus
caauauagucuguguuacauaau

SEQ ID NO: 3300425 - RNA, 14 nt, Variola virus
auguuggaaauacu

SEQ ID NO: 3300426 - RNA, 15 nt, Variola virus
uauuuccaucaugau

SEQ ID NO: 3300427 - RNA, 17 nt, Variola virus
augauguuuuuagaaaa

SEQ ID NO: 3300428 - RNA, 20 nt, Variola virus
agcauauuguaauaucuuaa

SEQ ID NO: 3300429 - RNA, 19 nt, Variola virus
augaacacaaaugguguau

SEQ ID NO: 3300430 - RNA, 18 nt, Variola virus
ucucuaagacgucucauu

SEQ ID NO: 3300431 - RNA, 20 nt, Variola virus
aaguauuugaacauguagau

SEQ ID NO: 3300432 - RNA, 16 nt, Variola virus
aacaauuccacaaauu

SEQ ID NO: 3300433 - RNA, 16 nt, Variola virus
acguuuaaacauucuu

SEQ ID NO: 3300434 - RNA, 19 nt, Variola virus
aguucauauuuauuagaua

SEQ ID NO: 3300435 - RNA, 22 nt, Variola virus
uaauuuccaacccuucagaaua

SEQ ID NO: 3300436 - RNA, 12 nt, Variola virus
aauaagaaauac

SEQ ID NO: 3300437 - RNA, 21 nt, Variola virus
accaucucauaaaauaguucu

SEQ ID NO: 3300438 - RNA, 18 nt, Variola virus
auuauaaucauuauuaac

SEQ ID NO: 3300439 - RNA, 16 nt, Variola virus
aucacacuuaaaauaa

SEQ ID NO: 3300440 - RNA, 22 nt, Variola virus
ucucaugucuaagaauuacaaa

SEQ ID NO: 3300441 - RNA, 19 nt, Variola virus
aaacauguaugagaaaaac

SEQ ID NO: 3300442 - RNA, 18 nt, Variola virus
uuuuguggacauuuucua

SEQ ID NO: 3300443 - RNA, 18 nt, Variola virus
uaguagcgaaaacuauau

SEQ ID NO: 3300444 - RNA, 15 nt, Variola virus
agacagagauacuaa

SEQ ID NO: 3300445 - RNA, 19 nt, Variola virus
acaacgagagauauuuuca

SEQ ID NO: 3300446 - RNA, 18 nt, Variola virus
aauucauagcugagaaua

SEQ ID NO: 3300447 - RNA, 22 nt, Variola virus
uauaaauaaaagacaaaucuug

SEQ ID NO: 3300448 - RNA, 22 nt, Variola virus
aucucuaacgagugaucaaauu

SEQ ID NO: 3300449 - RNA, 14 nt, Variola virus
aacgguauaugaau

SEQ ID NO: 3300450 - RNA, 20 nt, Variola virus
uccucaacgugauuauucuc

SEQ ID NO: 3300451 - RNA, 16 nt, Variola virus
uauaucuaacaucuug

SEQ ID NO: 3300452 - RNA, 23 nt, Variola virus
caugugacuuuucucuaaaugau

SEQ ID NO: 3300453 - RNA, 15 nt, Variola virus
auaagaugcaaacau

SEQ ID NO: 3300454 - RNA, 21 nt, Variola virus
uuccguuggaugguaauaaac

SEQ ID NO: 3300455 - RNA, 12 nt, Variola virus
uauagaacauca

SEQ ID NO: 3300456 - RNA, 22 nt, Variola virus
gauaauaaaauuacuaguauca

SEQ ID NO: 3300457 - RNA, 15 nt, Variola virus
uuaaaaacaaacuuu

SEQ ID NO: 3300458 - RNA, 21 nt, Variola virus
auaacaaguuuccuguaaauu

SEQ ID NO: 3300459 - RNA, 18 nt, Variola virus
augaaauaaguacaauga

SEQ ID NO: 3300460 - RNA, 21 nt, Variola virus
caaucggauuaauaucucuau

SEQ ID NO: 3300461 - RNA, 19 nt, Variola virus
cuaguggcagacugugcau

SEQ ID NO: 3300462 - RNA, 16 nt, Variola virus
auacaauaaauguuua

SEQ ID NO: 3300463 - RNA, 13 nt, Variola virus
aauaaaagaacua

SEQ ID NO: 3300464 - RNA, 20 nt, Variola virus
cguugaugaggcacauaaua

SEQ ID NO: 3300465 - RNA, 10 nt, Variola virus
gaucugaaga

SEQ ID NO: 3300466 - RNA, 17 nt, Variola virus
caugauuccguauucug

SEQ ID NO: 3300467 - RNA, 13 nt, Variola virus
aucauuucuauaa

SEQ ID NO: 3300468 - RNA, 23 nt, Variola virus
gaaacauauucuaugaauuuaua

SEQ ID NO: 3300469 - RNA, 21 nt, Variola virus
aucauuaaugauauaguuuuu

SEQ ID NO: 3300470 - RNA, 20 nt, Variola virus
uuucucuuuuuauccucauu

SEQ ID NO: 3300471 - RNA, 16 nt, Variola virus
aauauaccauuaaaaa

SEQ ID NO: 3300472 - RNA, 17 nt, Variola virus
uaauaucagaauugucu

SEQ ID NO: 3300473 - RNA, 17 nt, Variola virus
ucaaaauauauagagaa

SEQ ID NO: 3300474 - RNA, 19 nt, Variola virus
cguauaaaaaauauaacau

SEQ ID NO: 3300475 - RNA, 18 nt, Variola virus
uauuauccaauuauuaua

SEQ ID NO: 3300476 - RNA, 18 nt, Variola virus
uuuacuguggcuagauac

SEQ ID NO: 3300477 - RNA, 20 nt, Variola virus
gucaucaaguagugauuuug

SEQ ID NO: 3300478 - RNA, 23 nt, Variola virus
uugaaacugaauagaugcaucua

SEQ ID NO: 3300479 - RNA, 14 nt, Variola virus
uaugugcauuacca

SEQ ID NO: 3300480 - RNA, 18 nt, Variola virus
ugguaguugaaucaacau

SEQ ID NO: 3300481 - RNA, 16 nt, Variola virus
uguguugaacaucagu

SEQ ID NO: 3300482 - RNA, 16 nt, Variola virus
aaaucaguaacuaugu

SEQ ID NO: 3300483 - RNA, 17 nt, Variola virus
ucauaauaugagauguu

SEQ ID NO: 3300484 - RNA, 20 nt, Variola virus
ugacuaguuguagaauuuga

SEQ ID NO: 3300485 - RNA, 17 nt, Variola virus
acaacauguuauaacua

SEQ ID NO: 3300486 - RNA, 16 nt, Variola virus
aauguguuaaaaagaa

SEQ ID NO: 3300487 - RNA, 19 nt, Variola virus
agaaacauaacaaugagua

SEQ ID NO: 3300488 - RNA, 15 nt, Variola virus
auggucagugcauaa

SEQ ID NO: 3300489 - RNA, 14 nt, Variola virus
uguaaaaauauguu

SEQ ID NO: 3300490 - RNA, 18 nt, Variola virus
aggguaucuaauuuccug

SEQ ID NO: 3300491 - RNA, 16 nt, Variola virus
ucaauucgagaaagau

SEQ ID NO: 3300492 - RNA, 14 nt, Variola virus
cgauuuuaaaucau

SEQ ID NO: 3300493 - RNA, 18 nt, Variola virus
agauguuugagaauauau

SEQ ID NO: 3300494 - RNA, 15 nt, Variola virus
acggaaguaaacgaa

SEQ ID NO: 3300495 - RNA, 12 nt, Variola virus
acaauauaacau

SEQ ID NO: 3300496 - RNA, 20 nt, Variola virus
auagugacauaaacauagaa

SEQ ID NO: 3300497 - RNA, 13 nt, Variola virus
gccgcaugaugaa

SEQ ID NO: 3300498 - RNA, 22 nt, Variola virus
aaacaauuucacaaauggaugu

SEQ ID NO: 3300499 - RNA, 17 nt, Variola virus
uagauucagaaaugcua

SEQ ID NO: 3300500 - RNA, 21 nt, Variola virus
ccugguagacggaauguuuua

SEQ ID NO: 3300501 - RNA, 18 nt, Variola virus
uagugcucaaacaaaaug

SEQ ID NO: 3300502 - RNA, 21 nt, Variola virus
aaucaguacguucuucauuua

SEQ ID NO: 3300503 - RNA, 20 nt, Variola virus
acaaaacguuuauaugaagu

SEQ ID NO: 3300504 - RNA, 15 nt, Variola virus
uaaaaauaaacauug

SEQ ID NO: 3300505 - RNA, 17 nt, Variola virus
aacaugugugaaaauau

SEQ ID NO: 3300506 - RNA, 16 nt, Variola virus
uuaaaauauauuauca

SEQ ID NO: 3300507 - RNA, 20 nt, Variola virus
caucuauuguuauauaacaa

SEQ ID NO: 3300508 - RNA, 16 nt, Variola virus
cauaacauguaucaau

SEQ ID NO: 3300509 - RNA, 15 nt, Variola virus
aaauacguccaucag

SEQ ID NO: 3300510 - RNA, 19 nt, Variola virus
gguaaggucuuagaaauag

SEQ ID NO: 3300511 - RNA, 23 nt, Variola virus
uuuagaucauuaacucuagaaau

SEQ ID NO: 3300512 - RNA, 20 nt, Variola virus
uaguaaaauaaucauacaau

SEQ ID NO: 3300513 - RNA, 20 nt, Variola virus
cuaagcaauagguaauaacu

SEQ ID NO: 3300514 - RNA, 20 nt, Variola virus
gaucuauauguuuuauuaau

SEQ ID NO: 3300515 - RNA, 19 nt, Variola virus
ccaaacuccauaauuugcu

SEQ ID NO: 3300516 - RNA, 13 nt, Variola virus
aaguuaugacauu

SEQ ID NO: 3300517 - RNA, 17 nt, Variola virus
uucauuaauuucugaua

SEQ ID NO: 3300518 - RNA, 14 nt, Variola virus
aaucuguuucuaaa

SEQ ID NO: 3300519 - RNA, 22 nt, Variola virus
aacugaaucaccuaccuuagau

SEQ ID NO: 3300520 - RNA, 18 nt, Variola virus
acaauaguguucugaauu

SEQ ID NO: 3300521 - RNA, 22 nt, Variola virus
agcauucuuuccagaacuauau

SEQ ID NO: 3300522 - RNA, 19 nt, Variola virus
guaauaccaguuauguuca

SEQ ID NO: 3300523 - RNA, 13 nt, Variola virus
uuuuuagcaaggu

SEQ ID NO: 3300524 - RNA, 23 nt, Variola virus
acuauuaaaacuaacaaauccgu

SEQ ID NO: 3300525 - RNA, 20 nt, Variola virus
uguucacaaaaauacauaaa

SEQ ID NO: 3300526 - RNA, 16 nt, Variola virus
acaaacaggauaucua

SEQ ID NO: 3300527 - RNA, 17 nt, Variola virus
ugaugaacuaauaaagg

SEQ ID NO: 3300528 - RNA, 22 nt, Variola virus
uaacaggucauauucucauaau

SEQ ID NO: 3300529 - RNA, 17 nt, Variola virus
gaauguuuuacucugga

SEQ ID NO: 3300530 - RNA, 23 nt, Variola virus
gauggugccaccguaguguauau

SEQ ID NO: 3300531 - RNA, 23 nt, Variola virus
guacccuggauacgaaauaaauu

SEQ ID NO: 3300532 - RNA, 14 nt, Variola virus
uccuauuacauaua

SEQ ID NO: 3300533 - RNA, 15 nt, Variola virus
uaucucuuaaaugcu

SEQ ID NO: 3300534 - RNA, 22 nt, Variola virus
aagccacguaggaguuaucaca

SEQ ID NO: 3300535 - RNA, 20 nt, Variola virus
auaauggcgcuaucuuuuaa

SEQ ID NO: 3300536 - RNA, 18 nt, Variola virus
ucuagaucucuagaauau

SEQ ID NO: 3300537 - RNA, 12 nt, Variola virus
ugacacauauca

SEQ ID NO: 3300538 - RNA, 16 nt, Variola virus
uaaaccagacaaccac

SEQ ID NO: 3300539 - RNA, 14 nt, Variola virus
cuauaaguauaaau

SEQ ID NO: 3300540 - RNA, 13 nt, Variola virus
auaagaaauauga

SEQ ID NO: 3300541 - RNA, 21 nt, Variola virus
aucuagacuuucuguuauuau

SEQ ID NO: 3300542 - RNA, 21 nt, Variola virus
auuaaaauaaauauucuucau

SEQ ID NO: 3300543 - RNA, 13 nt, Variola virus
uaucuauacauac

SEQ ID NO: 3300544 - RNA, 21 nt, Variola virus
agauauaaaaugcguauucca

SEQ ID NO: 3300545 - RNA, 14 nt, Variola virus
auggauaauucucc

SEQ ID NO: 3300546 - RNA, 12 nt, Variola virus
auaauuucuaga

SEQ ID NO: 3300547 - RNA, 15 nt, Variola virus
cucaacgcgauaucu

SEQ ID NO: 3300548 - RNA, 16 nt, Variola virus
auaucuauucagauac

SEQ ID NO: 3300549 - RNA, 17 nt, Variola virus
aucauacauuaugaacu

SEQ ID NO: 3300550 - RNA, 22 nt, Variola virus
uguguggaugcuacuucaucua

SEQ ID NO: 3300551 - RNA, 19 nt, Variola virus
uaagacguauucucuacau

SEQ ID NO: 3300552 - RNA, 15 nt, Variola virus
caauaauaguaacau

SEQ ID NO: 3300553 - RNA, 14 nt, Variola virus
auaucaucaaacaa

SEQ ID NO: 3300554 - RNA, 17 nt, Variola virus
gacacuauucauguaau

SEQ ID NO: 3300555 - RNA, 13 nt, Variola virus
acacauuaacauc

SEQ ID NO: 3300556 - RNA, 15 nt, Variola virus
auuaagacauauauu

SEQ ID NO: 3300557 - RNA, 18 nt, Variola virus
uuauauacucuaaucuuu

SEQ ID NO: 3300558 - RNA, 17 nt, Variola virus
ggaauauauuuggauuu

SEQ ID NO: 3300559 - RNA, 19 nt, Variola virus
guaucgcauuaauacuguu

SEQ ID NO: 3300560 - RNA, 20 nt, Variola virus
acauuucagcaaucuaacau

SEQ ID NO: 3300561 - RNA, 15 nt, Variola virus
auuuuauacuagagu

SEQ ID NO: 3300562 - RNA, 20 nt, Variola virus
uagcguugcuucuacauaaa

SEQ ID NO: 3300563 - RNA, 15 nt, Variola virus
auccgauaaacauug

SEQ ID NO: 3300564 - RNA, 21 nt, Variola virus
ugacuauuguguguaaaguau

SEQ ID NO: 3300565 - RNA, 20 nt, Variola virus
uccguauuguauuagaguau

SEQ ID NO: 3300566 - RNA, 15 nt, Variola virus
uauauauuugaaaau

SEQ ID NO: 3300567 - RNA, 20 nt, Variola virus
guauacacaaaaagaaagaa

SEQ ID NO: 3300568 - RNA, 19 nt, Variola virus
ugcuaauauauucuuacag

SEQ ID NO: 3300569 - RNA, 14 nt, Variola virus
agucuuaaugauac

SEQ ID NO: 3300570 - RNA, 15 nt, Variola virus
auguuggaaauacua

SEQ ID NO: 3300571 - RNA, 22 nt, Variola virus
ggagaguauccucuaugaagaa

SEQ ID NO: 3300572 - RNA, 17 nt, Variola virus
gccgucuuuaucucuua

SEQ ID NO: 3300573 - RNA, 21 nt, Variola virus
aucauauuccggcguaugaau

SEQ ID NO: 3300574 - RNA, 18 nt, Variola virus
ugaacauaaaacuaauau

SEQ ID NO: 3300575 - RNA, 23 nt, Variola virus
uacuacaauacgguuuaccgaaa

SEQ ID NO: 3300576 - RNA, 14 nt, Variola virus
auguuauaaaaaug

SEQ ID NO: 3300577 - RNA, 18 nt, Variola virus
aguaugacuuacuuguau

SEQ ID NO: 3300578 - RNA, 12 nt, Variola virus
aaauacuaguau

SEQ ID NO: 3300579 - RNA, 16 nt, Variola virus
aaucggagaauguuuc

SEQ ID NO: 3300580 - RNA, 20 nt, Variola virus
uagcguguuuuaaauccuua

SEQ ID NO: 3300581 - RNA, 15 nt, Variola virus
aauccaaacaucacu

SEQ ID NO: 3300582 - RNA, 17 nt, Variola virus
gaauaucugaugauauu

SEQ ID NO: 3300583 - RNA, 15 nt, Variola virus
gugaagaauggaaac

SEQ ID NO: 3300584 - RNA, 13 nt, Variola virus
ucuaucucaaaau

SEQ ID NO: 3300585 - RNA, 20 nt, Variola virus
aguuuggcaauuaaaaauua

SEQ ID NO: 3300586 - RNA, 20 nt, Variola virus
augucaaaacuuguucaauu

SEQ ID NO: 3300587 - RNA, 23 nt, Variola virus
uuuaauauccaaucuuauuacuu

SEQ ID NO: 3300588 - RNA, 23 nt, Variola virus
ucugaucuuaacuccucuauuaa

SEQ ID NO: 3300589 - RNA, 20 nt, Variola virus
cuggcauuggcuagguauau

SEQ ID NO: 3300590 - RNA, 15 nt, Variola virus
auccaugucugaaac

SEQ ID NO: 3300591 - RNA, 13 nt, Variola virus
ucuaaaauguaua

SEQ ID NO: 3300592 - RNA, 15 nt, Variola virus
gugaguuuuccuuaa

SEQ ID NO: 3300593 - RNA, 15 nt, Variola virus
ccucagguagguuua

SEQ ID NO: 3300594 - RNA, 15 nt, Variola virus
agaugauaucaguau

SEQ ID NO: 3300595 - RNA, 21 nt, Variola virus
cgugagaauauacuacaauug

SEQ ID NO: 3300596 - RNA, 12 nt, Variola virus
guaaagaaggag

SEQ ID NO: 3300597 - RNA, 22 nt, Variola virus
aucacauuauaugauucuguaa

SEQ ID NO: 3300598 - RNA, 13 nt, Variola virus
cugcaauaaaaca

SEQ ID NO: 3300599 - RNA, 15 nt, Variola virus
aaauaguuauuagaa

SEQ ID NO: 3300600 - RNA, 19 nt, Variola virus
gcaaucacuacaauaauua

SEQ ID NO: 3300601 - RNA, 23 nt, Variola virus
uaacaccuauaagauuaucaaaa

SEQ ID NO: 3300602 - RNA, 15 nt, Variola virus
gauauuaauaaugau

SEQ ID NO: 3300603 - RNA, 19 nt, Variola virus
cuccacaguuuuuaauuuc

SEQ ID NO: 3300604 - RNA, 12 nt, Variola virus
cgucuguggaug

SEQ ID NO: 3300605 - RNA, 12 nt, Variola virus
aacaucaagaau

SEQ ID NO: 3300606 - RNA, 14 nt, Variola virus
aaguagaaaauaua

SEQ ID NO: 3300607 - RNA, 15 nt, Variola virus
acaaauuacaauaau

SEQ ID NO: 3300608 - RNA, 22 nt, Variola virus
ucauggaauacauaaagaacga

SEQ ID NO: 3300609 - RNA, 18 nt, Variola virus
aaauuaucaaauacuuca

SEQ ID NO: 3300610 - RNA, 15 nt, Variola virus
uccaaguucuauagu

SEQ ID NO: 3300611 - RNA, 18 nt, Variola virus
gauauccuaucuauuauu

SEQ ID NO: 3300612 - RNA, 22 nt, Variola virus
agaaaagauuaagauuaaacau

SEQ ID NO: 3300613 - RNA, 18 nt, Variola virus
gaccgguuuaucauuaau

SEQ ID NO: 3300614 - RNA, 22 nt, Variola virus
uauaucgcauauuuauaucgug

SEQ ID NO: 3300615 - RNA, 20 nt, Variola virus
aaccagguaggcaguuuuau

SEQ ID NO: 3300616 - RNA, 13 nt, Variola virus
ccagauugaacau

SEQ ID NO: 3300617 - RNA, 24 nt, Variola virus
acagcagaaaaagacgagaucuga

SEQ ID NO: 3300618 - RNA, 22 nt, Variola virus
caauuaguagaguuuuauaacg

SEQ ID NO: 3300619 - RNA, 20 nt, Variola virus
auaucggacgcagaaauugg

SEQ ID NO: 3300620 - RNA, 12 nt, Variola virus
cguuuuucugau

SEQ ID NO: 3300621 - RNA, 15 nt, Variola virus
aucucgaugaaaaua

SEQ ID NO: 3300622 - RNA, 15 nt, Variola virus
uauuagaaauacacu

SEQ ID NO: 3300623 - RNA, 21 nt, Variola virus
uaaaagaauuuuuucggguuc

SEQ ID NO: 3300624 - RNA, 21 nt, Variola virus
cauaccaucuaucaaacaaaa

SEQ ID NO: 3300625 - RNA, 15 nt, Variola virus
uauauuagagaagau

SEQ ID NO: 3300626 - RNA, 23 nt, Variola virus
caaccauuaacggaugaaaauaa

SEQ ID NO: 3300627 - RNA, 17 nt, Variola virus
uaauauccgcuauuaca

SEQ ID NO: 3300628 - RNA, 21 nt, Variola virus
auaaucagucauaacaaaugu

SEQ ID NO: 3300629 - RNA, 12 nt, Variola virus
aaauccaaauuu

SEQ ID NO: 3300630 - RNA, 13 nt, Variola virus
caaaucuggaaaa

SEQ ID NO: 3300631 - RNA, 23 nt, Variola virus
uaaacauauagggaaucauauau

SEQ ID NO: 3300632 - RNA, 13 nt, Variola virus
auucuauacuuaa

SEQ ID NO: 3300633 - RNA, 11 nt, Variola virus
gcauagauaua

SEQ ID NO: 3300634 - RNA, 15 nt, Variola virus
gaaucauacaaaaau

SEQ ID NO: 3300635 - RNA, 19 nt, Variola virus
aucauguaaggcauacauu

SEQ ID NO: 3300636 - RNA, 12 nt, Variola virus
caaaacuauuau

SEQ ID NO: 3300637 - RNA, 18 nt, Variola virus
aaucauggggcaaacauu

SEQ ID NO: 3300638 - RNA, 19 nt, Variola virus
caaaaugaugauauacgau

SEQ ID NO: 3300639 - RNA, 13 nt, Variola virus
ucgucuaaaguuu

SEQ ID NO: 3300640 - RNA, 14 nt, Variola virus
cagucacagacacu

SEQ ID NO: 3300641 - RNA, 22 nt, Variola virus
aaccaguaucucuuaacgaugu

SEQ ID NO: 3300642 - RNA, 15 nt, Variola virus
cuuuacuaagaaagu

SEQ ID NO: 3300643 - RNA, 16 nt, Variola virus
aacgugauggauauau

SEQ ID NO: 3300644 - RNA, 22 nt, Variola virus
uuggacucuauguauucagaau

SEQ ID NO: 3300645 - RNA, 19 nt, Variola virus
cucauaauguaaagauauu

SEQ ID NO: 3300646 - RNA, 13 nt, Variola virus
uuauuacuagaau

SEQ ID NO: 3300647 - RNA, 20 nt, Variola virus
ucaggaauccaaagagcuau

SEQ ID NO: 3300648 - RNA, 21 nt, Variola virus
uccuaucuauuauugaugcaa

SEQ ID NO: 3300649 - RNA, 20 nt, Variola virus
gucuaaguauagaucaaaag

SEQ ID NO: 3300650 - RNA, 19 nt, Variola virus
ugagauuaaauguaauaac

SEQ ID NO: 3300651 - RNA, 13 nt, Variola virus
gauaauaaaucaa

SEQ ID NO: 3300652 - RNA, 14 nt, Variola virus
cauagccaauggau

SEQ ID NO: 3300653 - RNA, 19 nt, Variola virus
guuuuacguuauuaaucau

SEQ ID NO: 3300654 - RNA, 18 nt, Variola virus
caugaugauuuaugguga

SEQ ID NO: 3300655 - RNA, 21 nt, Variola virus
cagaaauauaugagauguagu

SEQ ID NO: 3300656 - RNA, 21 nt, Variola virus
auuauuuuucaccauauagau

SEQ ID NO: 3300657 - RNA, 15 nt, Variola virus
uccacuauacauucu

SEQ ID NO: 3300658 - RNA, 13 nt, Variola virus
ugaacaauugucu

SEQ ID NO: 3300659 - RNA, 14 nt, Variola virus
auccggauucauga

SEQ ID NO: 3300660 - RNA, 24 nt, Variola virus
aucuaauaacaauguagguacuau

SEQ ID NO: 3300661 - RNA, 19 nt, Variola virus
uugcuagacaccuuuucaa

SEQ ID NO: 3300662 - RNA, 22 nt, Variola virus
gauacguacugucuauaaugac

SEQ ID NO: 3300663 - RNA, 20 nt, Variola virus
aagaacccguuuauacagug

SEQ ID NO: 3300664 - RNA, 17 nt, Variola virus
aucuuuaugaauuacuu

SEQ ID NO: 3300665 - RNA, 18 nt, Variola virus
uucgcaaacuauucuaau

SEQ ID NO: 3300666 - RNA, 18 nt, Variola virus
aacugccggauaaaagug

SEQ ID NO: 3300667 - RNA, 18 nt, Variola virus
gauuuguaucucuuuucu

SEQ ID NO: 3300668 - RNA, 19 nt, Variola virus
agacuuugccacaacagaa

SEQ ID NO: 3300669 - RNA, 16 nt, Variola virus
acuuggcgauucuaua

SEQ ID NO: 3300670 - RNA, 15 nt, Variola virus
uagauucacauaaag

SEQ ID NO: 3300671 - RNA, 23 nt, Variola virus
acuuccauacgacgaaaauggua

SEQ ID NO: 3300672 - RNA, 20 nt, Variola virus
uuuuaucaggauaaauacau

SEQ ID NO: 3300673 - RNA, 16 nt, Variola virus
caaauguaguaaauau

SEQ ID NO: 3300674 - RNA, 23 nt, Variola virus
ugagaguauugguaauguacaaa

SEQ ID NO: 3300675 - RNA, 20 nt, Variola virus
gcaaacacuuuccugauuua

SEQ ID NO: 3300676 - RNA, 23 nt, Variola virus
aauacgucuugcacguaaucuau

SEQ ID NO: 3300677 - RNA, 17 nt, Variola virus
auuuauacguaucauuu

SEQ ID NO: 3300678 - RNA, 15 nt, Variola virus
caaauggauaauuua

SEQ ID NO: 3300679 - RNA, 19 nt, Variola virus
ugguuguagcgguuggaua

SEQ ID NO: 3300680 - RNA, 12 nt, Variola virus
ucaguuaucauc

SEQ ID NO: 3300681 - RNA, 21 nt, Variola virus
auguuggaauagcgaauguau

SEQ ID NO: 3300682 - RNA, 18 nt, Variola virus
acacugcgaucugaauaa

SEQ ID NO: 3300683 - RNA, 18 nt, Variola virus
auucgacucaacauaaau

SEQ ID NO: 3300684 - RNA, 21 nt, Variola virus
uggcuucuuccauaguuagaa

SEQ ID NO: 3300685 - RNA, 16 nt, Variola virus
acuuuaauaacaaaga

SEQ ID NO: 3300686 - RNA, 18 nt, Variola virus
augcgauucaaaaaagaa

SEQ ID NO: 3300687 - RNA, 18 nt, Variola virus
agaacucuguuucuguau

SEQ ID NO: 3300688 - RNA, 12 nt, Variola virus
aaguaaauacug

SEQ ID NO: 3300689 - RNA, 16 nt, Variola virus
cgaacguauuacuaug

SEQ ID NO: 3300690 - RNA, 19 nt, Variola virus
caaaaagagagucaauguu

SEQ ID NO: 3300691 - RNA, 18 nt, Variola virus
aggaaaaugauuaaauua

SEQ ID NO: 3300692 - RNA, 19 nt, Variola virus
aacauaagcuuuucaaaau

SEQ ID NO: 3300693 - RNA, 20 nt, Variola virus
uaagugcgaugauuguacac

SEQ ID NO: 3300694 - RNA, 21 nt, Variola virus
aucugauaagauaucuucuca

SEQ ID NO: 3300695 - RNA, 12 nt, Variola virus
gcacgaacaaaa

SEQ ID NO: 3300696 - RNA, 15 nt, Variola virus
acccaguuaguuuua

SEQ ID NO: 3300697 - RNA, 15 nt, Variola virus
auuuuggaaaaauug

SEQ ID NO: 3300698 - RNA, 22 nt, Variola virus
uagauccuucaauaacuuauag

SEQ ID NO: 3300699 - RNA, 13 nt, Variola virus
auuuaaucuaucu

SEQ ID NO: 3300700 - RNA, 13 nt, Variola virus
caauaaguaguau

SEQ ID NO: 3300701 - RNA, 19 nt, Variola virus
gaacuaucauagaugagaa

SEQ ID NO: 3300702 - RNA, 14 nt, Variola virus
aaauuuuagaaaua

SEQ ID NO: 3300703 - RNA, 12 nt, Variola virus
caucaucaucuu

SEQ ID NO: 3300704 - RNA, 16 nt, Variola virus
aucucguccuugguuu

SEQ ID NO: 3300705 - RNA, 14 nt, Variola virus
aguuuuaacuggua

SEQ ID NO: 3300706 - RNA, 18 nt, Variola virus
uuccaucuagacuauauu

SEQ ID NO: 3300707 - RNA, 22 nt, Variola virus
uacaaugaacgauaauauucua

SEQ ID NO: 3300708 - RNA, 16 nt, Variola virus
uauacagcauuacauu

SEQ ID NO: 3300709 - RNA, 22 nt, Variola virus
ucuauacgauaguuuguuucua

SEQ ID NO: 3300710 - RNA, 16 nt, Variola virus
ucagauuuauacauau

SEQ ID NO: 3300711 - RNA, 14 nt, Variola virus
auaaagaugauaua

SEQ ID NO: 3300712 - RNA, 21 nt, Variola virus
uauaccacuauggauaccuug

SEQ ID NO: 3300713 - RNA, 13 nt, Variola virus
auucccaaaauuu

SEQ ID NO: 3300714 - RNA, 14 nt, Variola virus
aaaagaaucaucau

SEQ ID NO: 3300715 - RNA, 18 nt, Variola virus
agcauauucuuaauauua

SEQ ID NO: 3300716 - RNA, 20 nt, Variola virus
cauuagaggauuuaucacau

SEQ ID NO: 3300717 - RNA, 19 nt, Variola virus
cgaauaauucuaauaaacu

SEQ ID NO: 3300718 - RNA, 16 nt, Variola virus
aaauuuuaaaaaaugg

SEQ ID NO: 3300719 - RNA, 18 nt, Variola virus
ucuauguugauagaaguu

SEQ ID NO: 3300720 - RNA, 14 nt, Variola virus
acggugaauacaau

SEQ ID NO: 3300721 - RNA, 21 nt, Variola virus
uguaauugugggaacauaauu

SEQ ID NO: 3300722 - RNA, 19 nt, Variola virus
cagaggaacgccauauauu

SEQ ID NO: 3300723 - RNA, 13 nt, Variola virus
uugguuucuaaau

SEQ ID NO: 3300724 - RNA, 13 nt, Variola virus
uauuauugaagau

SEQ ID NO: 3300725 - RNA, 15 nt, Variola virus
aacgacuuaauuaca

SEQ ID NO: 3300726 - RNA, 19 nt, Variola virus
uaauuuguaaaccaucuua

SEQ ID NO: 3300727 - RNA, 17 nt, Variola virus
uuaagcaacaugucuuu

SEQ ID NO: 3300728 - RNA, 20 nt, Variola virus
acuauugaaguacuuaauga

SEQ ID NO: 3300729 - RNA, 19 nt, Variola virus
ucaaugauuaguuucuuaa

SEQ ID NO: 3300730 - RNA, 16 nt, Variola virus
cagauuuuaaaaacug

SEQ ID NO: 3300731 - RNA, 17 nt, Variola virus
ugacuagacugauuucu

SEQ ID NO: 3300732 - RNA, 15 nt, Variola virus
uaaaaugauaaaugc

SEQ ID NO: 3300733 - RNA, 19 nt, Variola virus
ucugccuuuuuauacauau

SEQ ID NO: 3300734 - RNA, 17 nt, Variola virus
uguugaugauaucuaca

SEQ ID NO: 3300735 - RNA, 19 nt, Variola virus
uauuaucaucauuaucauu

SEQ ID NO: 3300736 - RNA, 19 nt, Variola virus
auaauuuaguguuuaaauu

SEQ ID NO: 3300737 - RNA, 20 nt, Variola virus
auuuuucuucauuuauuaua

SEQ ID NO: 3300738 - RNA, 19 nt, Variola virus
auccugugcauaaauuaaa

SEQ ID NO: 3300739 - RNA, 23 nt, Variola virus
guaaaaagacgaagcuaauuaga

SEQ ID NO: 3300740 - RNA, 14 nt, Variola virus
aaguacagaauuaa

SEQ ID NO: 3300741 - RNA, 20 nt, Variola virus
aaaccauuuuucagaaagua

SEQ ID NO: 3300742 - RNA, 21 nt, Variola virus
cagugggugguucuguaucac

SEQ ID NO: 3300743 - RNA, 18 nt, Variola virus
augugcuaaaaaguuuuc

SEQ ID NO: 3300744 - RNA, 22 nt, Variola virus
accguauguucugauuuuaucu

SEQ ID NO: 3300745 - RNA, 12 nt, Variola virus
uaacaauaugcu

SEQ ID NO: 3300746 - RNA, 16 nt, Variola virus
agaagucgucaagcau

SEQ ID NO: 3300747 - RNA, 13 nt, Variola virus
aucaauuaaauaa

SEQ ID NO: 3300748 - RNA, 18 nt, Variola virus
auauagugaaacaaaaua

SEQ ID NO: 3300749 - RNA, 13 nt, Variola virus
aaaaauaacaauu

SEQ ID NO: 3300750 - RNA, 17 nt, Variola virus
uuauauacacauaauua

SEQ ID NO: 3300751 - RNA, 18 nt, Variola virus
acuuuuuuauccaacaau

SEQ ID NO: 3300752 - RNA, 15 nt, Variola virus
cucauuuaucauguu

SEQ ID NO: 3300753 - RNA, 13 nt, Variola virus
gaacuaccaauau

SEQ ID NO: 3300754 - RNA, 13 nt, Variola virus
uggauguagauuu

SEQ ID NO: 3300755 - RNA, 23 nt, Variola virus
uagaggaaguauaaaaauuaaac

SEQ ID NO: 3300756 - RNA, 17 nt, Variola virus
auggaguaaguaguuua

SEQ ID NO: 3300757 - RNA, 18 nt, Variola virus
auuguuaauuauuucuaa

SEQ ID NO: 3300758 - RNA, 19 nt, Variola virus
cuuauaauuaauguccaag

SEQ ID NO: 3300759 - RNA, 13 nt, Variola virus
uuuaauauuucga

SEQ ID NO: 3300760 - RNA, 14 nt, Variola virus
uuguuuuauucaaa

SEQ ID NO: 3300761 - RNA, 18 nt, Variola virus
aaggauaaccuagaaaau

SEQ ID NO: 3300762 - RNA, 22 nt, Variola virus
acgcagaaaagauaccacgagu

SEQ ID NO: 3300763 - RNA, 13 nt, Variola virus
aucaauaagcauu

SEQ ID NO: 3300764 - RNA, 18 nt, Variola virus
uuguacauucuuaaccau

SEQ ID NO: 3300765 - RNA, 23 nt, Variola virus
uacauucucauuaauuaaccauu

SEQ ID NO: 3300766 - RNA, 15 nt, Variola virus
gguuuaaagaaauac

SEQ ID NO: 3300767 - RNA, 14 nt, Variola virus
auggauuacgugau

SEQ ID NO: 3300768 - RNA, 16 nt, Variola virus
auuauuccuaauuaag

SEQ ID NO: 3300769 - RNA, 23 nt, Variola virus
aaauugcgacacuauucauguaa

SEQ ID NO: 3300770 - RNA, 22 nt, Variola virus
aguauaaacuauaaacuaaaaa

SEQ ID NO: 3300771 - RNA, 13 nt, Variola virus
aaaagcuuaaaau

SEQ ID NO: 3300772 - RNA, 14 nt, Variola virus
acuugauacagcca

SEQ ID NO: 3300773 - RNA, 18 nt, Variola virus
auagacuuguauaugcca

SEQ ID NO: 3300774 - RNA, 17 nt, Variola virus
uaacaaccucuuuaaua

SEQ ID NO: 3300775 - RNA, 18 nt, Variola virus
gauaaaacgauaaaagau

SEQ ID NO: 3300776 - RNA, 16 nt, Variola virus
acuaaagaaacgaaua

SEQ ID NO: 3300777 - RNA, 15 nt, Variola virus
gucuagccacagaaa

SEQ ID NO: 3300778 - RNA, 17 nt, Variola virus
uuacauuucuuguuuuu

SEQ ID NO: 3300779 - RNA, 16 nt, Variola virus
aauauugugaauggua

SEQ ID NO: 3300780 - RNA, 17 nt, Variola virus
agauucacauaaaggau

SEQ ID NO: 3300781 - RNA, 20 nt, Variola virus
guaccagaaggaacauacga

SEQ ID NO: 3300782 - RNA, 20 nt, Variola virus
uaaaacucugauuauugucu

SEQ ID NO: 3300783 - RNA, 15 nt, Variola virus
acagaaauaugugaa

SEQ ID NO: 3300784 - RNA, 21 nt, Variola virus
auuaucauuagucauguuaaa

SEQ ID NO: 3300785 - RNA, 15 nt, Variola virus
cuucuuguauuuccu

SEQ ID NO: 3300786 - RNA, 15 nt, Variola virus
guaacgcguggaaaa

SEQ ID NO: 3300787 - RNA, 11 nt, Variola virus
aacacaaauau

SEQ ID NO: 3300788 - RNA, 22 nt, Variola virus
acaacgacgaaccaaaaugaau

SEQ ID NO: 3300789 - RNA, 22 nt, Variola virus
auaagcuauauaauaaauguau

SEQ ID NO: 3300790 - RNA, 18 nt, Variola virus
acaacaaugucucgaaau

SEQ ID NO: 3300791 - RNA, 17 nt, Variola virus
uauuuuuuaucuaaaaa

SEQ ID NO: 3300792 - RNA, 15 nt, Variola virus
uaaaauuaacaagga

SEQ ID NO: 3300793 - RNA, 16 nt, Variola virus
agaaugcagaaaugau

SEQ ID NO: 3300794 - RNA, 17 nt, Variola virus
gaugaaggaauaaucuc

SEQ ID NO: 3300795 - RNA, 16 nt, Variola virus
aauacauuaauugcca

SEQ ID NO: 3300796 - RNA, 12 nt, Variola virus
uaaauauccauu

SEQ ID NO: 3300797 - RNA, 17 nt, Variola virus
aauuucugguuagauaa

SEQ ID NO: 3300798 - RNA, 17 nt, Variola virus
uauacggcaacagcuuc

SEQ ID NO: 3300799 - RNA, 15 nt, Variola virus
auuaccaucucuaag

SEQ ID NO: 3300800 - RNA, 14 nt, Variola virus
agaaaauauaaauu

SEQ ID NO: 3300801 - RNA, 21 nt, Variola virus
ucauauacguucgucaccaga

SEQ ID NO: 3300802 - RNA, 20 nt, Variola virus
gaaaacucucuaucucuuaa

SEQ ID NO: 3300803 - RNA, 14 nt, Variola virus
aaugguacagaaaa

SEQ ID NO: 3300804 - RNA, 15 nt, Variola virus
uuauauuuuucuuaa

SEQ ID NO: 3300805 - RNA, 17 nt, Variola virus
acuauuauguuuaaaga

SEQ ID NO: 3300806 - RNA, 22 nt, Variola virus
uaacuaucuguaaaagcauaug

SEQ ID NO: 3300807 - RNA, 13 nt, Variola virus
gaaucguauauau

SEQ ID NO: 3300808 - RNA, 23 nt, Variola virus
cacucgacugaauauuagcacau

SEQ ID NO: 3300809 - RNA, 15 nt, Variola virus
cuaaacauaaacaac

SEQ ID NO: 3300810 - RNA, 11 nt, Variola virus
uggaauuauuu

SEQ ID NO: 3300811 - RNA, 16 nt, Variola virus
aggcuguagucuuggu

SEQ ID NO: 3300812 - RNA, 14 nt, Variola virus
aauucaauaucuuu

SEQ ID NO: 3300813 - RNA, 19 nt, Variola virus
uuuaaacaagaaaguuauc

SEQ ID NO: 3300814 - RNA, 16 nt, Variola virus
aaucuaauacaaaauc

SEQ ID NO: 3300815 - RNA, 21 nt, Variola virus
acugucuggcaauaaaugaua

SEQ ID NO: 3300816 - RNA, 13 nt, Variola virus
uccguuuguacau

SEQ ID NO: 3300817 - RNA, 22 nt, Variola virus
auacuagaguuguuaaaguuaa

SEQ ID NO: 3300818 - RNA, 17 nt, Variola virus
caauaaaacauuuccua

SEQ ID NO: 3300819 - RNA, 18 nt, Variola virus
aaacugaaaauauauuga

SEQ ID NO: 3300820 - RNA, 17 nt, Variola virus
uuucguauaauuuuuaa

SEQ ID NO: 3300821 - RNA, 14 nt, Variola virus
uauuuguuaucaug

SEQ ID NO: 3300822 - RNA, 19 nt, Variola virus
uauaauuuacucucuauaa

SEQ ID NO: 3300823 - RNA, 17 nt, Variola virus
uauuacuaggagaauua

SEQ ID NO: 3300824 - RNA, 22 nt, Variola virus
aucaauuauguaaauaucuuua

SEQ ID NO: 3300825 - RNA, 16 nt, Variola virus
uuuacagaucuaguau

SEQ ID NO: 3300826 - RNA, 22 nt, Variola virus
uaacgccuauacuauguuauau

SEQ ID NO: 3300827 - RNA, 22 nt, Variola virus
aauuuauuucuucucuucguau

SEQ ID NO: 3300828 - RNA, 13 nt, Variola virus
agaaauaugugaa

SEQ ID NO: 3300829 - RNA, 14 nt, Variola virus
cuggauauuacaaa

SEQ ID NO: 3300830 - RNA, 16 nt, Variola virus
gcaaaauaguaaugau

SEQ ID NO: 3300831 - RNA, 13 nt, Variola virus
uggaaaaaugaug

SEQ ID NO: 3300832 - RNA, 13 nt, Variola virus
cuuguauuuugau

SEQ ID NO: 3300833 - RNA, 16 nt, Variola virus
uucuaaugcuguacua

SEQ ID NO: 3300834 - RNA, 17 nt, Variola virus
cauacgacgaaaauggu

SEQ ID NO: 3300835 - RNA, 17 nt, Variola virus
ucuagacgugaugugua

SEQ ID NO: 3300836 - RNA, 13 nt, Variola virus
uuauuaauucucu

SEQ ID NO: 3300837 - RNA, 17 nt, Variola virus
gccgcuauaaugaugau

SEQ ID NO: 3300838 - RNA, 15 nt, Variola virus
uaccaucuucuuuga

SEQ ID NO: 3300839 - RNA, 20 nt, Variola virus
gccuaauguaucgauaauua

SEQ ID NO: 3300840 - RNA, 16 nt, Variola virus
auaucuauaucuacau

SEQ ID NO: 3300841 - RNA, 19 nt, Variola virus
auauucuaacgauaauaga

SEQ ID NO: 3300842 - RNA, 22 nt, Variola virus
aggaccacuagcaaaagauaaa

SEQ ID NO: 3300843 - RNA, 22 nt, Variola virus
aucauauuccggcguaugaauu

SEQ ID NO: 3300844 - RNA, 18 nt, Variola virus
aaauaacaguaucauuua

SEQ ID NO: 3300845 - RNA, 21 nt, Variola virus
uuguuacccaugaucuauaaa

SEQ ID NO: 3300846 - RNA, 13 nt, Variola virus
gaauuaauaauau

SEQ ID NO: 3300847 - RNA, 18 nt, Variola virus
uacuuuuugcguauacau

SEQ ID NO: 3300848 - RNA, 12 nt, Variola virus
aauuaugauacu

SEQ ID NO: 3300849 - RNA, 15 nt, Variola virus
guacaauauguguua

SEQ ID NO: 3300850 - RNA, 17 nt, Variola virus
ccaaucuauaauaucuu

SEQ ID NO: 3300851 - RNA, 13 nt, Variola virus
augauaacuagau

SEQ ID NO: 3300852 - RNA, 12 nt, Variola virus
auaauuuuacca

SEQ ID NO: 3300853 - RNA, 17 nt, Variola virus
ccaucucuauguuucag

SEQ ID NO: 3300854 - RNA, 21 nt, Variola virus
uaaacacuaguauagcagaag

SEQ ID NO: 3300855 - RNA, 16 nt, Variola virus
aaucucaauuagaaua

SEQ ID NO: 3300856 - RNA, 13 nt, Variola virus
uaguuaguauaac

SEQ ID NO: 3300857 - RNA, 17 nt, Variola virus
gaaaugaugaaggaaag

SEQ ID NO: 3300858 - RNA, 17 nt, Variola virus
uuucaaucucuucuauu

SEQ ID NO: 3300859 - RNA, 21 nt, Variola virus
aucgcccgcgagcgagagaag

SEQ ID NO: 3300860 - RNA, 18 nt, Variola virus
cacgaaaucuauagguaa

SEQ ID NO: 3300861 - RNA, 20 nt, Variola virus
acugacuucuaacaaacauc

SEQ ID NO: 3300862 - RNA, 23 nt, Variola virus
acuuguauaugccaaaguuuaaa

SEQ ID NO: 3300863 - RNA, 13 nt, Variola virus
cguucuacauaaa

SEQ ID NO: 3300864 - RNA, 20 nt, Variola virus
uaucuauuuuaacaaagcau

SEQ ID NO: 3300865 - RNA, 17 nt, Variola virus
uaaacuauaaacuaaaa

SEQ ID NO: 3300866 - RNA, 20 nt, Variola virus
ugauguauaacaacugucaa

SEQ ID NO: 3300867 - RNA, 18 nt, Variola virus
auaacauauuuuucuaug

SEQ ID NO: 3300868 - RNA, 21 nt, Variola virus
gccaacucucaaaaugcugau

SEQ ID NO: 3300869 - RNA, 22 nt, Variola virus
uuguacacuucuauaguaucua

SEQ ID NO: 3300870 - RNA, 20 nt, Variola virus
ccagucugaacaucaaucuu

SEQ ID NO: 3300871 - RNA, 15 nt, Variola virus
uaaauuauuaucuac

SEQ ID NO: 3300872 - RNA, 12 nt, Variola virus
agcgaauuauuu

SEQ ID NO: 3300873 - RNA, 14 nt, Variola virus
aucacaagaaguua

SEQ ID NO: 3300874 - RNA, 18 nt, Variola virus
cauugcgcuauacaguau

SEQ ID NO: 3300875 - RNA, 11 nt, Variola virus
gaauaagaaca

SEQ ID NO: 3300876 - RNA, 15 nt, Variola virus
uaaacuauuguuaug

SEQ ID NO: 3300877 - RNA, 14 nt, Variola virus
aguuguaucaucua

SEQ ID NO: 3300878 - RNA, 12 nt, Variola virus
agaugucauuau

SEQ ID NO: 3300879 - RNA, 23 nt, Variola virus
ggaaaaaaaucuuuuuuuauucu

SEQ ID NO: 3300880 - RNA, 19 nt, Variola virus
auaccgaucacguucuagu

SEQ ID NO: 3300881 - RNA, 17 nt, Variola virus
uauauucauuuaauauu

SEQ ID NO: 3300882 - RNA, 15 nt, Variola virus
ccguuuaauuuccua

SEQ ID NO: 3300883 - RNA, 16 nt, Variola virus
ugaaaugcuacauaac

SEQ ID NO: 3300884 - RNA, 15 nt, Variola virus
aguuuuauaaacucg

SEQ ID NO: 3300885 - RNA, 16 nt, Variola virus
ccaauauggcaauuau

SEQ ID NO: 3300886 - RNA, 23 nt, Variola virus
caucagcaaaacaguuacuauua

SEQ ID NO: 3300887 - RNA, 22 nt, Variola virus
acggagucauaacuauuuuacc

SEQ ID NO: 3300888 - RNA, 21 nt, Variola virus
cacaaagaauuuuagacacua

SEQ ID NO: 3300889 - RNA, 19 nt, Variola virus
gaacuauaaaacuacuaca

SEQ ID NO: 3300890 - RNA, 21 nt, Variola virus
ugaugcguuccauuuguguau

SEQ ID NO: 3300891 - RNA, 19 nt, Variola virus
caccuuauccucagacaca

SEQ ID NO: 3300892 - RNA, 18 nt, Variola virus
acaugcgguucaaaauag

SEQ ID NO: 3300893 - RNA, 20 nt, Variola virus
gccaaaacuucacagaugau

SEQ ID NO: 3300894 - RNA, 15 nt, Variola virus
cuuuguaauauugua

SEQ ID NO: 3300895 - RNA, 20 nt, Variola virus
auaggauacuuuaugaaugg

SEQ ID NO: 3300896 - RNA, 13 nt, Variola virus
auauauuagaaau

SEQ ID NO: 3300897 - RNA, 13 nt, Variola virus
aguuauauauacu

SEQ ID NO: 3300898 - RNA, 16 nt, Variola virus
acaacgucucauauaa

SEQ ID NO: 3300899 - RNA, 19 nt, Variola virus
gacauuguauuaugaugaa

SEQ ID NO: 3300900 - RNA, 15 nt, Variola virus
acuuuuuauacuaau

SEQ ID NO: 3300901 - RNA, 22 nt, Variola virus
aaucuaacauugauuuuaaaau

SEQ ID NO: 3300902 - RNA, 20 nt, Variola virus
gauccugcauagaaauaucu

SEQ ID NO: 3300903 - RNA, 21 nt, Variola virus
augaaccaauacaauguaaag

SEQ ID NO: 3300904 - RNA, 15 nt, Variola virus
caaccgaaaucaugg

SEQ ID NO: 3300905 - RNA, 16 nt, Variola virus
ugaauucucauuuugc

SEQ ID NO: 3300906 - RNA, 12 nt, Variola virus
uuaaaauuauua

SEQ ID NO: 3300907 - RNA, 20 nt, Variola virus
caguauugacaauacuguau

SEQ ID NO: 3300908 - RNA, 18 nt, Variola virus
uaauuaauuucucguaaa

SEQ ID NO: 3300909 - RNA, 17 nt, Variola virus
auuauucuuaaaugccu

SEQ ID NO: 3300910 - RNA, 19 nt, Variola virus
auuuuaguuaacaacuauu

SEQ ID NO: 3300911 - RNA, 14 nt, Variola virus
gagagauagaagaa

SEQ ID NO: 3300912 - RNA, 12 nt, Variola virus
ugucuuggaagc

SEQ ID NO: 3300913 - RNA, 11 nt, Variola virus
uccucaucugu

SEQ ID NO: 3300914 - RNA, 15 nt, Variola virus
cugauuuauuuccua

SEQ ID NO: 3300915 - RNA, 15 nt, Variola virus
uauuaucauuaguca

SEQ ID NO: 3300916 - RNA, 20 nt, Variola virus
caaauauauuacuagacaau

SEQ ID NO: 3300917 - RNA, 21 nt, Variola virus
uaucuuuuagagguucccaau

SEQ ID NO: 3300918 - RNA, 22 nt, Variola virus
gaaaaacacauaacugaagaaa

SEQ ID NO: 3300919 - RNA, 14 nt, Variola virus
ucugguuuaggaaa

SEQ ID NO: 3300920 - RNA, 19 nt, Variola virus
aaaacuuuuuagaaauguu

SEQ ID NO: 3300921 - RNA, 18 nt, Variola virus
gaauaauguuucuauguu

SEQ ID NO: 3300922 - RNA, 16 nt, Variola virus
acaacauuccaaagau

SEQ ID NO: 3300923 - RNA, 21 nt, Variola virus
guugaucuucaaauuccacca

SEQ ID NO: 3300924 - RNA, 17 nt, Variola virus
acgauaacauucuagga

SEQ ID NO: 3300925 - RNA, 17 nt, Variola virus
uauaauuuaccgcuaua

SEQ ID NO: 3300926 - RNA, 14 nt, Variola virus
ccuauuuguagaag

SEQ ID NO: 3300927 - RNA, 18 nt, Variola virus
caguuuucucaucacuua

SEQ ID NO: 3300928 - RNA, 18 nt, Variola virus
ggaaauguuauagaaaau

SEQ ID NO: 3300929 - RNA, 18 nt, Variola virus
agugauauugauaucuuu

SEQ ID NO: 3300930 - RNA, 16 nt, Variola virus
agaucuuaagaaaauu

SEQ ID NO: 3300931 - RNA, 16 nt, Variola virus
guuaauaguaaaugaa

SEQ ID NO: 3300932 - RNA, 23 nt, Variola virus
gaaaauaaaucacugacgauauu

SEQ ID NO: 3300933 - RNA, 15 nt, Variola virus
auccauaucguauau

SEQ ID NO: 3300934 - RNA, 19 nt, Variola virus
auuauucagauacgucuau

SEQ ID NO: 3300935 - RNA, 21 nt, Variola virus
uuuguccauuauuucuauauu

SEQ ID NO: 3300936 - RNA, 19 nt, Variola virus
ucuguaauaguuuccacca

SEQ ID NO: 3300937 - RNA, 15 nt, Variola virus
cuuguauauauuguu

SEQ ID NO: 3300938 - RNA, 16 nt, Variola virus
acuuugauuucuuauc

SEQ ID NO: 3300939 - RNA, 16 nt, Variola virus
caacuuacuaggcagc

SEQ ID NO: 3300940 - RNA, 15 nt, Variola virus
uuaccagauaucuuc

SEQ ID NO: 3300941 - RNA, 19 nt, Variola virus
uacgcgcauuaaacuuuuc

SEQ ID NO: 3300942 - RNA, 20 nt, Variola virus
ucccaaauguuggaaaauag

SEQ ID NO: 3300943 - RNA, 19 nt, Variola virus
uuacgacgugcuaaucuag

SEQ ID NO: 3300944 - RNA, 22 nt, Variola virus
agguacauggucuagauguaaa

SEQ ID NO: 3300945 - RNA, 15 nt, Variola virus
uggaucaaauggaua

SEQ ID NO: 3300946 - RNA, 19 nt, Variola virus
ucaucuuguucagaaauau

SEQ ID NO: 3300947 - RNA, 15 nt, Variola virus
augcgauuggauaag

SEQ ID NO: 3300948 - RNA, 14 nt, Variola virus
aauauaaaaugaua

SEQ ID NO: 3300949 - RNA, 15 nt, Variola virus
gcaauaaauaugauu

SEQ ID NO: 3300950 - RNA, 15 nt, Variola virus
auuaacagaaaaaac

SEQ ID NO: 3300951 - RNA, 15 nt, Variola virus
cauucgaagacgcua

SEQ ID NO: 3300952 - RNA, 19 nt, Variola virus
caaaaaacgacgauuggaa

SEQ ID NO: 3300953 - RNA, 13 nt, Variola virus
auauguauuuccu

SEQ ID NO: 3300954 - RNA, 15 nt, Variola virus
acuaaaucuucacau

SEQ ID NO: 3300955 - RNA, 17 nt, Variola virus
uauacauaauauuauca

SEQ ID NO: 3300956 - RNA, 20 nt, Variola virus
uuauuuuaggaucauauuua

SEQ ID NO: 3300957 - RNA, 20 nt, Variola virus
uaacaaaaucaggaaaaaag

SEQ ID NO: 3300958 - RNA, 22 nt, Variola virus
aaguuuuaucucuuucucucuu

SEQ ID NO: 3300959 - RNA, 20 nt, Variola virus
cuagaugauauagugaaaca

SEQ ID NO: 3300960 - RNA, 18 nt, Variola virus
acuacgcgauuauuuuca

SEQ ID NO: 3300961 - RNA, 22 nt, Variola virus
auauccuuuagaguauuucuca

SEQ ID NO: 3300962 - RNA, 19 nt, Variola virus
acauacagcgaauggaaua

SEQ ID NO: 3300963 - RNA, 23 nt, Variola virus
ucaaacacaucuacgaacaauau

SEQ ID NO: 3300964 - RNA, 20 nt, Variola virus
gcauucuaucuuuaagggau

SEQ ID NO: 3300965 - RNA, 15 nt, Variola virus
gccuuuuuauacaua

SEQ ID NO: 3300966 - RNA, 19 nt, Variola virus
accaugaaauugagaagau

SEQ ID NO: 3300967 - RNA, 20 nt, Variola virus
aaaguaucgcccuaauauua

SEQ ID NO: 3300968 - RNA, 13 nt, Variola virus
acuaauaaagaag

SEQ ID NO: 3300969 - RNA, 23 nt, Variola virus
uuuguuuaaacguuuguaguuua

SEQ ID NO: 3300970 - RNA, 22 nt, Variola virus
uauuagaucuccagauuucaua

SEQ ID NO: 3300971 - RNA, 23 nt, Variola virus
acauuaaguaaauccuuaaguuc

SEQ ID NO: 3300972 - RNA, 15 nt, Variola virus
guaucauuuaaacau

SEQ ID NO: 3300973 - RNA, 19 nt, Variola virus
auuaccauguaugauaaaa

SEQ ID NO: 3300974 - RNA, 20 nt, Variola virus
aacacuauacuuauauuaau

SEQ ID NO: 3300975 - RNA, 21 nt, Variola virus
auugacuaauaaauuaaauau

SEQ ID NO: 3300976 - RNA, 20 nt, Variola virus
agccuuaagaaaacuagaua

SEQ ID NO: 3300977 - RNA, 15 nt, Variola virus
guaauaucugauuua

SEQ ID NO: 3300978 - RNA, 20 nt, Variola virus
uaaacuugugcuaaucucuu

SEQ ID NO: 3300979 - RNA, 15 nt, Variola virus
aauuaugauagaaau

SEQ ID NO: 3300980 - RNA, 20 nt, Variola virus
cacuaaaaugauuaaacaau

SEQ ID NO: 3300981 - RNA, 21 nt, Variola virus
agugcgguuuuaccuauuuua

SEQ ID NO: 3300982 - RNA, 21 nt, Variola virus
uacauccugccauuaagaaac

SEQ ID NO: 3300983 - RNA, 14 nt, Variola virus
aauaguuucauaau

SEQ ID NO: 3300984 - RNA, 19 nt, Variola virus
caaauugcauauuuggaag

SEQ ID NO: 3300985 - RNA, 22 nt, Variola virus
auauagcggaugaaaaauuugu

SEQ ID NO: 3300986 - RNA, 15 nt, Variola virus
aagcuuuuagaauau

SEQ ID NO: 3300987 - RNA, 11 nt, Variola virus
auaauuuuacc

SEQ ID NO: 3300988 - RNA, 16 nt, Variola virus
uaaaauggauaauggu

SEQ ID NO: 3300989 - RNA, 16 nt, Variola virus
uacugucgcuaucauu

SEQ ID NO: 3300990 - RNA, 21 nt, Variola virus
gauuuccgaaguucagcuucu

SEQ ID NO: 3300991 - RNA, 14 nt, Variola virus
aauugcuuuucuaa

SEQ ID NO: 3300992 - RNA, 19 nt, Variola virus
uguuuaacaaaguuauuca

SEQ ID NO: 3300993 - RNA, 17 nt, Variola virus
caacucucucauuuucu

SEQ ID NO: 3300994 - RNA, 15 nt, Variola virus
aauguaguaaauaua

SEQ ID NO: 3300995 - RNA, 22 nt, Variola virus
cauugacggauaaaacaaaaau

SEQ ID NO: 3300996 - RNA, 14 nt, Variola virus
acgcgaacaucuuu

SEQ ID NO: 3300997 - RNA, 23 nt, Variola virus
ucgcaaacuauucuaauacauaa

SEQ ID NO: 3300998 - RNA, 18 nt, Variola virus
ccaaguaaugaucaucua

SEQ ID NO: 3300999 - RNA, 20 nt, Variola virus
ccaaauuuguuuuguuuauu

SEQ ID NO: 3301000 - RNA, 15 nt, Variola virus
auuucacuaauuaau

SEQ ID NO: 3301001 - RNA, 14 nt, Variola virus
auacgauuaauagc

SEQ ID NO: 3301002 - RNA, 20 nt, Variola virus
acauaguguuuuauauucca

SEQ ID NO: 3301003 - RNA, 20 nt, Variola virus
aaggcaacaaagaaauuuuu

SEQ ID NO: 3301004 - RNA, 12 nt, Variola virus
cauaacauaauu

SEQ ID NO: 3301005 - RNA, 14 nt, Variola virus
aaauggaucucaua

SEQ ID NO: 3301006 - RNA, 21 nt, Variola virus
cggauaaugauagacaagaua

SEQ ID NO: 3301007 - RNA, 14 nt, Variola virus
agugcaaugaauau

SEQ ID NO: 3301008 - RNA, 15 nt, Variola virus
uaccuagaacaaugu

SEQ ID NO: 3301009 - RNA, 21 nt, Variola virus
uaaacccucgaucaugaaugg

SEQ ID NO: 3301010 - RNA, 14 nt, Variola virus
uguacauuauuaca

SEQ ID NO: 3301011 - RNA, 22 nt, Variola virus
gcucuagauauuaguauuuuua

SEQ ID NO: 3301012 - RNA, 18 nt, Variola virus
aggauuggucuuaaaaga

SEQ ID NO: 3301013 - RNA, 16 nt, Variola virus
cgaucucaaucaucuu

SEQ ID NO: 3301014 - RNA, 22 nt, Variola virus
cgagugaaaaaauaauuucuac

SEQ ID NO: 3301015 - RNA, 19 nt, Variola virus
uuuaaacagagaaaucagu

SEQ ID NO: 3301016 - RNA, 16 nt, Variola virus
uagauuuguaucucuu

SEQ ID NO: 3301017 - RNA, 13 nt, Variola virus
uauuaaauuuaga

SEQ ID NO: 3301018 - RNA, 21 nt, Variola virus
acaaauucuuggauauaugau

SEQ ID NO: 3301019 - RNA, 19 nt, Variola virus
aguauaucuacacauauau

SEQ ID NO: 3301020 - RNA, 23 nt, Variola virus
cagucauuccaucauuuaagaag

SEQ ID NO: 3301021 - RNA, 15 nt, Variola virus
agacgcucaaaauag

SEQ ID NO: 3301022 - RNA, 23 nt, Variola virus
uccggcauuauagauguguauac

SEQ ID NO: 3301023 - RNA, 18 nt, Variola virus
aggauaucaaauacgcau

SEQ ID NO: 3301024 - RNA, 12 nt, Variola virus
auacuauauaca

SEQ ID NO: 3301025 - RNA, 15 nt, Variola virus
agaauuuucauggau

SEQ ID NO: 3301026 - RNA, 19 nt, Variola virus
aauuugauccauguucaua

SEQ ID NO: 3301027 - RNA, 20 nt, Variola virus
cuacaaauuuggauauucua

SEQ ID NO: 3301028 - RNA, 14 nt, Variola virus
uguaucuauaucug

SEQ ID NO: 3301029 - RNA, 17 nt, Variola virus
aauagugccaucagaau

SEQ ID NO: 3301030 - RNA, 19 nt, Variola virus
ccaucguguuaaauuuucu

SEQ ID NO: 3301031 - RNA, 16 nt, Variola virus
guauuugaaaauggaa

SEQ ID NO: 3301032 - RNA, 20 nt, Variola virus
aauaucaggaaauguauaaa

SEQ ID NO: 3301033 - RNA, 13 nt, Variola virus
gagauuaaugcua

SEQ ID NO: 3301034 - RNA, 16 nt, Variola virus
gucaauggagaaauac

SEQ ID NO: 3301035 - RNA, 21 nt, Variola virus
cagagaggcggucuugauauu

SEQ ID NO: 3301036 - RNA, 14 nt, Variola virus
aaaucgcaucuucu

SEQ ID NO: 3301037 - RNA, 11 nt, Variola virus
aaaaaaugaua

SEQ ID NO: 3301038 - RNA, 21 nt, Variola virus
agcuccuacaggaauaucuuu

SEQ ID NO: 3301039 - RNA, 15 nt, Variola virus
auauuaaaauagcua

SEQ ID NO: 3301040 - RNA, 16 nt, Variola virus
acgacuuauaauuaau

SEQ ID NO: 3301041 - RNA, 14 nt, Variola virus
ccaggcuauguuuc

SEQ ID NO: 3301042 - RNA, 15 nt, Variola virus
aaaauggauuacuua

SEQ ID NO: 3301043 - RNA, 18 nt, Variola virus
auuaaaguuaaauugugu

SEQ ID NO: 3301044 - RNA, 13 nt, Variola virus
gaauaaaguauau

SEQ ID NO: 3301045 - RNA, 22 nt, Variola virus
aaauguuugauaaaaauaugua

SEQ ID NO: 3301046 - RNA, 15 nt, Variola virus
acuuuagaagaauau

SEQ ID NO: 3301047 - RNA, 15 nt, Variola virus
uacgucaucaaaaau

SEQ ID NO: 3301048 - RNA, 13 nt, Variola virus
aguacuuaaugaa

SEQ ID NO: 3301049 - RNA, 20 nt, Variola virus
aagaauuuguuguuucuauu

SEQ ID NO: 3301050 - RNA, 14 nt, Variola virus
uaggauaauaauua

SEQ ID NO: 3301051 - RNA, 16 nt, Variola virus
guuaaugagguaggaa

SEQ ID NO: 3301052 - RNA, 20 nt, Variola virus
acauuaguucccaaugaauc

SEQ ID NO: 3301053 - RNA, 16 nt, Variola virus
auugaacgguaucuuc

SEQ ID NO: 3301054 - RNA, 19 nt, Variola virus
auuggauaguuuuuuugaa

SEQ ID NO: 3301055 - RNA, 16 nt, Variola virus
uguaacguuagacauu

SEQ ID NO: 3301056 - RNA, 13 nt, Variola virus
aauggcaaaugua

SEQ ID NO: 3301057 - RNA, 15 nt, Variola virus
aucauuuaaacauuu

SEQ ID NO: 3301058 - RNA, 18 nt, Variola virus
aauaugcuaguuaauagu

SEQ ID NO: 3301059 - RNA, 13 nt, Variola virus
aacuauuuagaaa

SEQ ID NO: 3301060 - RNA, 12 nt, Variola virus
uucucuagauac

SEQ ID NO: 3301061 - RNA, 16 nt, Variola virus
caacuuuauuagauaa

SEQ ID NO: 3301062 - RNA, 11 nt, Variola virus
gcguacaaaag

SEQ ID NO: 3301063 - RNA, 21 nt, Variola virus
uauaauucguuuuuauaugug

SEQ ID NO: 3301064 - RNA, 19 nt, Variola virus
ucguacauaacuuguacag

SEQ ID NO: 3301065 - RNA, 12 nt, Variola virus
gcuacaguaaaa

SEQ ID NO: 3301066 - RNA, 17 nt, Variola virus
ucuagauguagaagcau

SEQ ID NO: 3301067 - RNA, 19 nt, Variola virus
uuauuacuuaaguuguaaa

SEQ ID NO: 3301068 - RNA, 14 nt, Variola virus
uuuauauuaaauau

SEQ ID NO: 3301069 - RNA, 13 nt, Variola virus
gaagauaaugaau

SEQ ID NO: 3301070 - RNA, 20 nt, Variola virus
auucucugaaaauguaaauc

SEQ ID NO: 3301071 - RNA, 15 nt, Variola virus
guuaucuauuucaaa

SEQ ID NO: 3301072 - RNA, 23 nt, Variola virus
aucuauuagaagcuaacaaaauu

SEQ ID NO: 3301073 - RNA, 18 nt, Variola virus
uggauuaucccuuugaua

SEQ ID NO: 3301074 - RNA, 13 nt, Variola virus
aggaauaugguuu

SEQ ID NO: 3301075 - RNA, 17 nt, Variola virus
aagauaugguaaaauua

SEQ ID NO: 3301076 - RNA, 21 nt, Variola virus
uccuaauauugguacaugccu

SEQ ID NO: 3301077 - RNA, 14 nt, Variola virus
cugguuuagauauu

SEQ ID NO: 3301078 - RNA, 17 nt, Variola virus
caguguauguaaaaaug

SEQ ID NO: 3301079 - RNA, 20 nt, Variola virus
acucauauaguauugaacag

SEQ ID NO: 3301080 - RNA, 18 nt, Variola virus
ucagucuggaaacuauca

SEQ ID NO: 3301081 - RNA, 22 nt, Variola virus
gauaaguuuaaggcguuugcau

SEQ ID NO: 3301082 - RNA, 14 nt, Variola virus
acaguuauauaucu

SEQ ID NO: 3301083 - RNA, 15 nt, Variola virus
gcuguggaaauuaaa

SEQ ID NO: 3301084 - RNA, 13 nt, Variola virus
uacaauacaugua

SEQ ID NO: 3301085 - RNA, 22 nt, Variola virus
ucaacgcuggaaucaauacuca

SEQ ID NO: 3301086 - RNA, 19 nt, Variola virus
auuaaaaaacauauauaau

SEQ ID NO: 3301087 - RNA, 20 nt, Variola virus
cauccuuugauaauuuucca

SEQ ID NO: 3301088 - RNA, 19 nt, Variola virus
augaucgucuuuuguggaa

SEQ ID NO: 3301089 - RNA, 20 nt, Variola virus
uaaaauuauugauauguaua

SEQ ID NO: 3301090 - RNA, 22 nt, Variola virus
cuagugccgaacauuaacauuu

SEQ ID NO: 3301091 - RNA, 18 nt, Variola virus
auaucuuaaucauauucu

SEQ ID NO: 3301092 - RNA, 17 nt, Variola virus
uuaaucguacucauuau

SEQ ID NO: 3301093 - RNA, 16 nt, Variola virus
uuauagagauagauga

SEQ ID NO: 3301094 - RNA, 12 nt, Variola virus
cuaucuuuagag

SEQ ID NO: 3301095 - RNA, 16 nt, Variola virus
uacacguaccagcauu

SEQ ID NO: 3301096 - RNA, 18 nt, Variola virus
aauuguauauuacacauu

SEQ ID NO: 3301097 - RNA, 23 nt, Variola virus
guuaaaugguucgauauaaagga

SEQ ID NO: 3301098 - RNA, 17 nt, Variola virus
aaguaugaagaaaaaug

SEQ ID NO: 3301099 - RNA, 22 nt, Variola virus
auaccuuugguucuuuaaaaga

SEQ ID NO: 3301100 - RNA, 18 nt, Variola virus
guaugucuuauguauauu

SEQ ID NO: 3301101 - RNA, 13 nt, Variola virus
auacgucuuuauu

SEQ ID NO: 3301102 - RNA, 20 nt, Variola virus
caauugcauucccaucauuu

SEQ ID NO: 3301103 - RNA, 14 nt, Variola virus
ugagcacugaaaac

SEQ ID NO: 3301104 - RNA, 19 nt, Variola virus
cgucuaaaucaaugcaugu

SEQ ID NO: 3301105 - RNA, 13 nt, Variola virus
auucugaauagau

SEQ ID NO: 3301106 - RNA, 19 nt, Variola virus
aucuuuggagaaucaucua

SEQ ID NO: 3301107 - RNA, 17 nt, Variola virus
gugauggauuuaaacau

SEQ ID NO: 3301108 - RNA, 22 nt, Variola virus
uguuuagaaauagcucuuagua

SEQ ID NO: 3301109 - RNA, 22 nt, Variola virus
uagacugacuucuaacaaacau

SEQ ID NO: 3301110 - RNA, 23 nt, Variola virus
aaaaggaauuuaccagugauuau

SEQ ID NO: 3301111 - RNA, 18 nt, Variola virus
aucauaaauuauuucauu

SEQ ID NO: 3301112 - RNA, 15 nt, Variola virus
auacacacuaauaaa

SEQ ID NO: 3301113 - RNA, 19 nt, Variola virus
cuuaaaauauaaugauaua

SEQ ID NO: 3301114 - RNA, 17 nt, Variola virus
auuuaauuguauaccuu

SEQ ID NO: 3301115 - RNA, 15 nt, Variola virus
aucugauuccauaua

SEQ ID NO: 3301116 - RNA, 13 nt, Variola virus
uuaucaucauuau

SEQ ID NO: 3301117 - RNA, 20 nt, Variola virus
gaauauacuucauaaaagaa

SEQ ID NO: 3301118 - RNA, 13 nt, Variola virus
uuugcauucuauu

SEQ ID NO: 3301119 - RNA, 22 nt, Variola virus
uuagcaugaauccauucuaaug

SEQ ID NO: 3301120 - RNA, 12 nt, Variola virus
uuuaacacuaua

SEQ ID NO: 3301121 - RNA, 13 nt, Variola virus
gauguaguaauau

SEQ ID NO: 3301122 - RNA, 17 nt, Variola virus
aaagucaucucuuguau

SEQ ID NO: 3301123 - RNA, 18 nt, Variola virus
auggaugagaacacguau

SEQ ID NO: 3301124 - RNA, 20 nt, Variola virus
uaaauuuaucaauaaaugug

SEQ ID NO: 3301125 - RNA, 16 nt, Variola virus
uaacugcuacacaaau

SEQ ID NO: 3301126 - RNA, 18 nt, Variola virus
aaaaggaguucaaauagu

SEQ ID NO: 3301127 - RNA, 17 nt, Variola virus
aaacgauuaaacaauau

SEQ ID NO: 3301128 - RNA, 22 nt, Variola virus
agaaauauauacuucaauugau

SEQ ID NO: 3301129 - RNA, 23 nt, Variola virus
cuuaauccuucuagaauuagaau

SEQ ID NO: 3301130 - RNA, 18 nt, Variola virus
auauuaaacacuaguaua

SEQ ID NO: 3301131 - RNA, 13 nt, Variola virus
auuucuuaucugu

SEQ ID NO: 3301132 - RNA, 16 nt, Variola virus
agucaaccaaauaaua

SEQ ID NO: 3301133 - RNA, 21 nt, Variola virus
ucagaagugugaauaugaucu

SEQ ID NO: 3301134 - RNA, 21 nt, Variola virus
auacuaaaggcaacaaagaaa

SEQ ID NO: 3301135 - RNA, 20 nt, Variola virus
uagaugauaauuuauacaaa

SEQ ID NO: 3301136 - RNA, 16 nt, Variola virus
aauuuguucaaaauag

SEQ ID NO: 3301137 - RNA, 12 nt, Variola virus
aaaaaucuguuu

SEQ ID NO: 3301138 - RNA, 12 nt, Variola virus
aaaaaucucacc

SEQ ID NO: 3301139 - RNA, 18 nt, Variola virus
ccaucugucauauuuaga

SEQ ID NO: 3301140 - RNA, 20 nt, Variola virus
uuaaugaagaacacauauuu

SEQ ID NO: 3301141 - RNA, 23 nt, Variola virus
aauauuguaacaauuuauuuugu

SEQ ID NO: 3301142 - RNA, 11 nt, Variola virus
aaauaucucau

SEQ ID NO: 3301143 - RNA, 13 nt, Variola virus
uucauucguaaau

SEQ ID NO: 3301144 - RNA, 16 nt, Variola virus
acgucaucaaaaauag

SEQ ID NO: 3301145 - RNA, 14 nt, Variola virus
uuccugaauacuau

SEQ ID NO: 3301146 - RNA, 18 nt, Variola virus
uccuauucccaacaaugu

SEQ ID NO: 3301147 - RNA, 22 nt, Variola virus
cagaucaaaaaauauaguucca

SEQ ID NO: 3301148 - RNA, 15 nt, Variola virus
caaugagauaaauau

SEQ ID NO: 3301149 - RNA, 15 nt, Variola virus
auauaaguaguguaa

SEQ ID NO: 3301150 - RNA, 12 nt, Variola virus
uuaaauauuaau

SEQ ID NO: 3301151 - RNA, 16 nt, Variola virus
aaucuugauuacaaaa

SEQ ID NO: 3301152 - RNA, 19 nt, Variola virus
auauuguacgguagaauug

SEQ ID NO: 3301153 - RNA, 15 nt, Variola virus
auuaaacuaauucau

SEQ ID NO: 3301154 - RNA, 21 nt, Variola virus
cagacaaucacguacaaagaa

SEQ ID NO: 3301155 - RNA, 16 nt, Variola virus
ugccaauguuaauuuc

SEQ ID NO: 3301156 - RNA, 19 nt, Variola virus
aguaaagauuucaaagaug

SEQ ID NO: 3301157 - RNA, 13 nt, Variola virus
acguuaaacauua

SEQ ID NO: 3301158 - RNA, 19 nt, Variola virus
ucuagauacuagaguagua

SEQ ID NO: 3301159 - RNA, 16 nt, Variola virus
uagacagaauaucgug

SEQ ID NO: 3301160 - RNA, 15 nt, Variola virus
uuaacuguucaucgu

SEQ ID NO: 3301161 - RNA, 17 nt, Variola virus
aucuagaaauuacauaa

SEQ ID NO: 3301162 - RNA, 15 nt, Variola virus
caguuaauauauuua

SEQ ID NO: 3301163 - RNA, 15 nt, Variola virus
caauugucuauacaa

SEQ ID NO: 3301164 - RNA, 14 nt, Variola virus
uauauuuuauacau

SEQ ID NO: 3301165 - RNA, 16 nt, Variola virus
ugucugcuuucuuuua

SEQ ID NO: 3301166 - RNA, 16 nt, Variola virus
guaauaccaaaaugau

SEQ ID NO: 3301167 - RNA, 23 nt, Variola virus
uauauucaguaaccaaauacaua

SEQ ID NO: 3301168 - RNA, 19 nt, Variola virus
uuauuuagauacagaugua

SEQ ID NO: 3301169 - RNA, 17 nt, Variola virus
auaauagggagaaauga

SEQ ID NO: 3301170 - RNA, 14 nt, Variola virus
ucaucaaaauacug

SEQ ID NO: 3301171 - RNA, 15 nt, Variola virus
uuuuauuaaaugacg

SEQ ID NO: 3301172 - RNA, 15 nt, Variola virus
aaccaagaaacaguc

SEQ ID NO: 3301173 - RNA, 15 nt, Variola virus
uugacaaauuauucu

SEQ ID NO: 3301174 - RNA, 12 nt, Variola virus
uuccuuauucuu

SEQ ID NO: 3301175 - RNA, 18 nt, Variola virus
gcugaacacguuaaacaa

SEQ ID NO: 3301176 - RNA, 21 nt, Variola virus
uacgagccaaaucuucuucua

SEQ ID NO: 3301177 - RNA, 17 nt, Variola virus
auuuccaucuaucuagu

SEQ ID NO: 3301178 - RNA, 18 nt, Variola virus
agcuguacaccauagcac

SEQ ID NO: 3301179 - RNA, 21 nt, Variola virus
aggccgcucguggauacuuau

SEQ ID NO: 3301180 - RNA, 14 nt, Variola virus
uuuauccuauauau

SEQ ID NO: 3301181 - RNA, 20 nt, Variola virus
guuucauaauaauacauaua

SEQ ID NO: 3301182 - RNA, 20 nt, Variola virus
cuuccuaggauagcuuuagu

SEQ ID NO: 3301183 - RNA, 17 nt, Variola virus
gaaguuguauacuaucg

SEQ ID NO: 3301184 - RNA, 17 nt, Variola virus
caaucuuauaucuucuu

SEQ ID NO: 3301185 - RNA, 23 nt, Variola virus
caaacugcguuaauguauucucu

SEQ ID NO: 3301186 - RNA, 18 nt, Variola virus
ugaugucguuaaauuuga

SEQ ID NO: 3301187 - RNA, 19 nt, Variola virus
auccaauuguuugauauau

SEQ ID NO: 3301188 - RNA, 17 nt, Variola virus
uaaacacgauauagaca

SEQ ID NO: 3301189 - RNA, 16 nt, Variola virus
aaauacauguaacaaa

SEQ ID NO: 3301190 - RNA, 19 nt, Variola virus
caacguguuagaucgucua

SEQ ID NO: 3301191 - RNA, 16 nt, Variola virus
agaucauacagucaca

SEQ ID NO: 3301192 - RNA, 17 nt, Variola virus
gcuaauaucuauauauu

SEQ ID NO: 3301193 - RNA, 18 nt, Variola virus
auacacuaaguauauaca

SEQ ID NO: 3301194 - RNA, 22 nt, Variola virus
auauguaggaggaauaucugau

SEQ ID NO: 3301195 - RNA, 13 nt, Variola virus
caguuaucaucua

SEQ ID NO: 3301196 - RNA, 14 nt, Variola virus
cagaguuuagauua

SEQ ID NO: 3301197 - RNA, 17 nt, Variola virus
acacuaauuaagauaua

SEQ ID NO: 3301198 - RNA, 14 nt, Variola virus
guuauauaauuauc

SEQ ID NO: 3301199 - RNA, 14 nt, Variola virus
auagauaucaaaau

SEQ ID NO: 3301200 - RNA, 13 nt, Variola virus
aguacggauuaaa

SEQ ID NO: 3301201 - RNA, 15 nt, Variola virus
gaggaagacacauua

SEQ ID NO: 3301202 - RNA, 16 nt, Variola virus
aaacaaaauuagaaag

SEQ ID NO: 3301203 - RNA, 13 nt, Variola virus
aauauucuguucu

SEQ ID NO: 3301204 - RNA, 19 nt, Variola virus
acccauuagguuaaaugau

SEQ ID NO: 3301205 - RNA, 13 nt, Variola virus
aaacaucucuucu

SEQ ID NO: 3301206 - RNA, 14 nt, Variola virus
gucacuauuaaaga

SEQ ID NO: 3301207 - RNA, 14 nt, Variola virus
acauggaggcacua

SEQ ID NO: 3301208 - RNA, 22 nt, Variola virus
auauacauuuucaaauaauaaa

SEQ ID NO: 3301209 - RNA, 16 nt, Variola virus
gaauagugguauauaa

SEQ ID NO: 3301210 - RNA, 22 nt, Variola virus
cuaaugauguaucuacacaaac

SEQ ID NO: 3301211 - RNA, 15 nt, Variola virus
auaacgucucuguau

SEQ ID NO: 3301212 - RNA, 21 nt, Variola virus
uguuauacacggucuagagca

SEQ ID NO: 3301213 - RNA, 16 nt, Variola virus
cgauagugauuuugag

SEQ ID NO: 3301214 - RNA, 17 nt, Variola virus
uuagauaauugugguaa

SEQ ID NO: 3301215 - RNA, 16 nt, Variola virus
acauaguuaucuaucu

SEQ ID NO: 3301216 - RNA, 17 nt, Variola virus
uauaaaucauauuuaga

SEQ ID NO: 3301217 - RNA, 21 nt, Variola virus
ugacggagcccaauuuuggug

SEQ ID NO: 3301218 - RNA, 16 nt, Variola virus
cauacuguaccaauaa

SEQ ID NO: 3301219 - RNA, 18 nt, Variola virus
uuuuaaacaacuaaacag

SEQ ID NO: 3301220 - RNA, 14 nt, Variola virus
acuauucauguaau

SEQ ID NO: 3301221 - RNA, 18 nt, Variola virus
auuaaugggcuuaguaaa

SEQ ID NO: 3301222 - RNA, 21 nt, Variola virus
cuaacagaauuuauuguaaca

SEQ ID NO: 3301223 - RNA, 21 nt, Variola virus
acaacuuuuaaauacaaauau

SEQ ID NO: 3301224 - RNA, 14 nt, Variola virus
ucuagauauccaga

SEQ ID NO: 3301225 - RNA, 14 nt, Variola virus
gcauuauuaagaca

SEQ ID NO: 3301226 - RNA, 14 nt, Variola virus
uuccauaacagugu

SEQ ID NO: 3301227 - RNA, 18 nt, Variola virus
cuuucuguauccagguag

SEQ ID NO: 3301228 - RNA, 21 nt, Variola virus
cauaaacaauauuaaggagau

SEQ ID NO: 3301229 - RNA, 17 nt, Variola virus
cucaaauaaauacucua

SEQ ID NO: 3301230 - RNA, 21 nt, Variola virus
uaguuguauacugagaauuaa

SEQ ID NO: 3301231 - RNA, 18 nt, Variola virus
uauuuuuuuauacuucua

SEQ ID NO: 3301232 - RNA, 21 nt, Variola virus
aauacauuucucaaaugaaua

SEQ ID NO: 3301233 - RNA, 22 nt, Variola virus
uugcaaauuccggauacaugaa

SEQ ID NO: 3301234 - RNA, 13 nt, Variola virus
agaugcuauguau

SEQ ID NO: 3301235 - RNA, 23 nt, Variola virus
ugauagauacgcguucucuggag

SEQ ID NO: 3301236 - RNA, 16 nt, Variola virus
auuuucauuuaaauga

SEQ ID NO: 3301237 - RNA, 23 nt, Variola virus
cuacguagacuagacuguuuaua

SEQ ID NO: 3301238 - RNA, 19 nt, Variola virus
agaauuaaaucuaacgaga

SEQ ID NO: 3301239 - RNA, 22 nt, Variola virus
ucaugaacaaucacaagaauag

SEQ ID NO: 3301240 - RNA, 19 nt, Variola virus
uucuauacgucuuuauuuu

SEQ ID NO: 3301241 - RNA, 14 nt, Variola virus
auaaugaucauaua

SEQ ID NO: 3301242 - RNA, 16 nt, Variola virus
ucuuaucaauuucuga

SEQ ID NO: 3301243 - RNA, 17 nt, Variola virus
agaucuaauaaauggag

SEQ ID NO: 3301244 - RNA, 17 nt, Variola virus
auugaauaggaguuuga

SEQ ID NO: 3301245 - RNA, 14 nt, Variola virus
uuuagaaaaacuuu

SEQ ID NO: 3301246 - RNA, 18 nt, Variola virus
aucauuaggaaucuaucc

SEQ ID NO: 3301247 - RNA, 18 nt, Variola virus
auauagcuuuuauuucca

SEQ ID NO: 3301248 - RNA, 14 nt, Variola virus
ccaaguuauugcuu

SEQ ID NO: 3301249 - RNA, 18 nt, Variola virus
augaauuuagaaaugauu

SEQ ID NO: 3301250 - RNA, 13 nt, Variola virus
uuuagaaacauaa

SEQ ID NO: 3301251 - RNA, 21 nt, Variola virus
auuuaucgauuagucuuaaug

SEQ ID NO: 3301252 - RNA, 20 nt, Variola virus
auuaccggucauauuaauaa

SEQ ID NO: 3301253 - RNA, 19 nt, Variola virus
uaccaguuaagucaauaau

SEQ ID NO: 3301254 - RNA, 21 nt, Variola virus
uuucaauaguaucgaaaacag

SEQ ID NO: 3301255 - RNA, 17 nt, Variola virus
uguaauugugacaucau

SEQ ID NO: 3301256 - RNA, 17 nt, Variola virus
cgauaacuugauuucaa

SEQ ID NO: 3301257 - RNA, 17 nt, Variola virus
guuagcaauuucaaaau

SEQ ID NO: 3301258 - RNA, 19 nt, Variola virus
gccuccacuagaagagaau

SEQ ID NO: 3301259 - RNA, 22 nt, Variola virus
uacugaagaagaaaacaaacau

SEQ ID NO: 3301260 - RNA, 19 nt, Variola virus
uacuuucaaugagauaaau

SEQ ID NO: 3301261 - RNA, 16 nt, Variola virus
ucauccgauauuauug

SEQ ID NO: 3301262 - RNA, 22 nt, Variola virus
uguaaaguaucuagcaaagauu

SEQ ID NO: 3301263 - RNA, 16 nt, Variola virus
cagucuaguauacaua

SEQ ID NO: 3301264 - RNA, 22 nt, Variola virus
uuaacacuauacuuauauuaau

SEQ ID NO: 3301265 - RNA, 21 nt, Variola virus
caaagcggguuauaaaguaaa

SEQ ID NO: 3301266 - RNA, 16 nt, Variola virus
auaaaaacauuauucu

SEQ ID NO: 3301267 - RNA, 20 nt, Variola virus
aauaugaaaucuaucuuaua

SEQ ID NO: 3301268 - RNA, 20 nt, Variola virus
ggacaaaauccauauuucuu

SEQ ID NO: 3301269 - RNA, 20 nt, Variola virus
ugccaaugauguuaggaaau

SEQ ID NO: 3301270 - RNA, 20 nt, Variola virus
cuuuuagaagugauucuuug

SEQ ID NO: 3301271 - RNA, 18 nt, Variola virus
ucauauaucugcucuuaa

SEQ ID NO: 3301272 - RNA, 16 nt, Variola virus
ugagauaucucauuaa

SEQ ID NO: 3301273 - RNA, 16 nt, Variola virus
aguuagaaaguauuuu

SEQ ID NO: 3301274 - RNA, 19 nt, Variola virus
auuuuaacgacgacauauu

SEQ ID NO: 3301275 - RNA, 19 nt, Variola virus
guaucgauaauuauuucug

SEQ ID NO: 3301276 - RNA, 15 nt, Variola virus
uaugauaucucuauu

SEQ ID NO: 3301277 - RNA, 20 nt, Variola virus
uagagugaguuuaggauuca

SEQ ID NO: 3301278 - RNA, 22 nt, Variola virus
ggaucacaacaauuuauuucua

SEQ ID NO: 3301279 - RNA, 21 nt, Variola virus
agaaauaacaggcuaaaaugu

SEQ ID NO: 3301280 - RNA, 13 nt, Variola virus
augaugacgguau

SEQ ID NO: 3301281 - RNA, 22 nt, Variola virus
gucaacaaguuggaugauauua

SEQ ID NO: 3301282 - RNA, 15 nt, Variola virus
uuaguauaacuaaag

SEQ ID NO: 3301283 - RNA, 15 nt, Variola virus
ucccuuguguaacgu

SEQ ID NO: 3301284 - RNA, 19 nt, Variola virus
uacgccuuuaaauccucua

SEQ ID NO: 3301285 - RNA, 14 nt, Variola virus
ggcauguguuuccc

SEQ ID NO: 3301286 - RNA, 20 nt, Variola virus
gaguuuaucacuaaguucug

SEQ ID NO: 3301287 - RNA, 15 nt, Variola virus
uaggugcaauagcau

SEQ ID NO: 3301288 - RNA, 21 nt, Variola virus
aaaaaucugauagaaagaaua

SEQ ID NO: 3301289 - RNA, 19 nt, Variola virus
auuagacguaguuuaucau

SEQ ID NO: 3301290 - RNA, 18 nt, Variola virus
uguauaugugaauaugac

SEQ ID NO: 3301291 - RNA, 17 nt, Variola virus
agaaaaguccuagaauu

SEQ ID NO: 3301292 - RNA, 17 nt, Variola virus
auuuuuaaacuguuugu

SEQ ID NO: 3301293 - RNA, 17 nt, Variola virus
aucuagauaauuaauaa

SEQ ID NO: 3301294 - RNA, 21 nt, Variola virus
caaaauguauguguugaacau

SEQ ID NO: 3301295 - RNA, 14 nt, Variola virus
uucaacuaccaaaa

SEQ ID NO: 3301296 - RNA, 15 nt, Variola virus
auuuauauaacucau

SEQ ID NO: 3301297 - RNA, 13 nt, Variola virus
aacaguaaaagaa

SEQ ID NO: 3301298 - RNA, 18 nt, Variola virus
aaucaacagaaguuaaua

SEQ ID NO: 3301299 - RNA, 22 nt, Variola virus
acuccaaugacugaauacauua

SEQ ID NO: 3301300 - RNA, 16 nt, Variola virus
cagcgaacuugauauu

SEQ ID NO: 3301301 - RNA, 22 nt, Variola virus
aagauaugggaguaguugaaau

SEQ ID NO: 3301302 - RNA, 22 nt, Variola virus
gcguucaacauuuuauggaaac

SEQ ID NO: 3301303 - RNA, 18 nt, Variola virus
gauaaaauccuccuauca

SEQ ID NO: 3301304 - RNA, 15 nt, Variola virus
caaaaaauaaaagau

SEQ ID NO: 3301305 - RNA, 18 nt, Variola virus
auccaaauggaucucaua

SEQ ID NO: 3301306 - RNA, 15 nt, Variola virus
aggaucgacuccaua

SEQ ID NO: 3301307 - RNA, 19 nt, Variola virus
aauaucuuuaauacagagu

SEQ ID NO: 3301308 - RNA, 12 nt, Variola virus
cgaauaaaagau

SEQ ID NO: 3301309 - RNA, 15 nt, Variola virus
auuucaaucaaacaa

SEQ ID NO: 3301310 - RNA, 22 nt, Variola virus
ugauuaaugauuuagaaaugaa

SEQ ID NO: 3301311 - RNA, 15 nt, Variola virus
uuaaauaucugugaa

SEQ ID NO: 3301312 - RNA, 17 nt, Variola virus
auacugaguuggcuaug

SEQ ID NO: 3301313 - RNA, 22 nt, Variola virus
aagcauauucuuaauauuagaa

SEQ ID NO: 3301314 - RNA, 19 nt, Variola virus
aaugccugccuguauuaua

SEQ ID NO: 3301315 - RNA, 16 nt, Variola virus
guuuaacaaaguuauu

SEQ ID NO: 3301316 - RNA, 21 nt, Variola virus
aguaacggacuuaacaugaga

SEQ ID NO: 3301317 - RNA, 18 nt, Variola virus
ucuuuaaaguuucugaaa

SEQ ID NO: 3301318 - RNA, 24 nt, Variola virus
cuacagucguucaacugucuuuca

SEQ ID NO: 3301319 - RNA, 16 nt, Variola virus
auggucucacaaaaaa

SEQ ID NO: 3301320 - RNA, 16 nt, Variola virus
uaccgaagaauuaaau

SEQ ID NO: 3301321 - RNA, 14 nt, Variola virus
uagauauuaaacaa

SEQ ID NO: 3301322 - RNA, 21 nt, Variola virus
aguaugcauuauccaaaauau

SEQ ID NO: 3301323 - RNA, 16 nt, Variola virus
cuuauucauauuuuag

SEQ ID NO: 3301324 - RNA, 14 nt, Variola virus
caguaguucauuau

SEQ ID NO: 3301325 - RNA, 15 nt, Variola virus
acgguaauaaaaugu

SEQ ID NO: 3301326 - RNA, 22 nt, Variola virus
ugguuccacaauucauuuccau

SEQ ID NO: 3301327 - RNA, 16 nt, Variola virus
ucaaguaaagauuuca

SEQ ID NO: 3301328 - RNA, 21 nt, Variola virus
uauaugaacgauaauaacuua

SEQ ID NO: 3301329 - RNA, 18 nt, Variola virus
gaaauugguuuauaaugu

SEQ ID NO: 3301330 - RNA, 23 nt, Variola virus
aaaaguuuuccaucuauguagaa

SEQ ID NO: 3301331 - RNA, 17 nt, Variola virus
cagauguauaaguuuua

SEQ ID NO: 3301332 - RNA, 22 nt, Variola virus
acucuaucauggcaauaauaca

SEQ ID NO: 3301333 - RNA, 17 nt, Variola virus
aagcgaauuacucuguc

SEQ ID NO: 3301334 - RNA, 21 nt, Variola virus
uggaagacgcuauaucaaaau

SEQ ID NO: 3301335 - RNA, 21 nt, Variola virus
cgaauauugggcaaagauauu

SEQ ID NO: 3301336 - RNA, 17 nt, Variola virus
aguuucuagauacuaga

SEQ ID NO: 3301337 - RNA, 21 nt, Variola virus
guaaacaauacuucugaagaa

SEQ ID NO: 3301338 - RNA, 23 nt, Variola virus
agaaauuauuuuuacuaauagaa

SEQ ID NO: 3301339 - RNA, 19 nt, Variola virus
acuagcucgagaaugaaua

SEQ ID NO: 3301340 - RNA, 16 nt, Variola virus
uuucgaagaucuucuu

SEQ ID NO: 3301341 - RNA, 19 nt, Variola virus
uuauuagucugucuguaga

SEQ ID NO: 3301342 - RNA, 18 nt, Variola virus
aacuauaucuauguugau

SEQ ID NO: 3301343 - RNA, 19 nt, Variola virus
ucaaacaucugcauuauca

SEQ ID NO: 3301344 - RNA, 18 nt, Variola virus
aaauucuaggcucaguau

SEQ ID NO: 3301345 - RNA, 12 nt, Variola virus
ccauuuaaauau

SEQ ID NO: 3301346 - RNA, 15 nt, Variola virus
guuucagcgugauuu

SEQ ID NO: 3301347 - RNA, 17 nt, Variola virus
cuucuuuuuauauccaa

SEQ ID NO: 3301348 - RNA, 22 nt, Variola virus
acuauuccuagcaucagcaaaa

SEQ ID NO: 3301349 - RNA, 16 nt, Variola virus
auaaguguagaaauua

SEQ ID NO: 3301350 - RNA, 20 nt, Variola virus
cugauuaauaagaucuucua

SEQ ID NO: 3301351 - RNA, 14 nt, Variola virus
aaguacaucaucua

SEQ ID NO: 3301352 - RNA, 20 nt, Variola virus
aucaucuauagaucauguaa

SEQ ID NO: 3301353 - RNA, 17 nt, Variola virus
cugggguaaaguaagua

SEQ ID NO: 3301354 - RNA, 19 nt, Variola virus
aucccauucuaauacuuua

SEQ ID NO: 3301355 - RNA, 22 nt, Variola virus
auuaaagauacaaaacguaauu

SEQ ID NO: 3301356 - RNA, 22 nt, Variola virus
auuuguuaaagugggacaugau

SEQ ID NO: 3301357 - RNA, 13 nt, Variola virus
uagaagagaauac

SEQ ID NO: 3301358 - RNA, 12 nt, Variola virus
gauauuaguaca

SEQ ID NO: 3301359 - RNA, 14 nt, Variola virus
guauacuucaucag

SEQ ID NO: 3301360 - RNA, 21 nt, Variola virus
uaaacaaacuaauaaacauuc

SEQ ID NO: 3301361 - RNA, 15 nt, Variola virus
auaucacaaaaauaa

SEQ ID NO: 3301362 - RNA, 19 nt, Variola virus
guagaagaacucuguuucu

SEQ ID NO: 3301363 - RNA, 19 nt, Variola virus
uaagcgcuauauaaaucau

SEQ ID NO: 3301364 - RNA, 20 nt, Variola virus
acauuaucaaaaagaacgau

SEQ ID NO: 3301365 - RNA, 15 nt, Variola virus
uauuuuuuuuaucaa

SEQ ID NO: 3301366 - RNA, 17 nt, Variola virus
uacuugaaauucuccag

SEQ ID NO: 3301367 - RNA, 21 nt, Variola virus
cagcuacuugagauaccaaag

SEQ ID NO: 3301368 - RNA, 19 nt, Variola virus
cauaacaaauguauacuau

SEQ ID NO: 3301369 - RNA, 17 nt, Variola virus
aauagcaaccaauguuu

SEQ ID NO: 3301370 - RNA, 21 nt, Variola virus
aauaugucaucuauggaauua

SEQ ID NO: 3301371 - RNA, 13 nt, Variola virus
cuguuuauacaag

SEQ ID NO: 3301372 - RNA, 21 nt, Variola virus
cauaaucgucgacaaaguacu

SEQ ID NO: 3301373 - RNA, 19 nt, Variola virus
aagaucacuaauucuaguc

SEQ ID NO: 3301374 - RNA, 21 nt, Variola virus
auuugguauaaagagauagau

SEQ ID NO: 3301375 - RNA, 17 nt, Variola virus
ucguacuuuauaucgug

SEQ ID NO: 3301376 - RNA, 15 nt, Variola virus
aagauuguagaauca

SEQ ID NO: 3301377 - RNA, 22 nt, Variola virus
uauuagauaauaaacagaauag

SEQ ID NO: 3301378 - RNA, 16 nt, Variola virus
uguucuuggauuucau

SEQ ID NO: 3301379 - RNA, 13 nt, Variola virus
ucauuaauacagu

SEQ ID NO: 3301380 - RNA, 13 nt, Variola virus
ucauaaauacaga

SEQ ID NO: 3301381 - RNA, 13 nt, Variola virus
cauaaacauuauu

SEQ ID NO: 3301382 - RNA, 19 nt, Variola virus
aauucaccuucacaaaaua

SEQ ID NO: 3301383 - RNA, 19 nt, Variola virus
aaaucauggggcaaacauu

SEQ ID NO: 3301384 - RNA, 21 nt, Variola virus
auggaauuaucaucaaaaaac

SEQ ID NO: 3301385 - RNA, 11 nt, Variola virus
acgauaaaaga

SEQ ID NO: 3301386 - RNA, 18 nt, Variola virus
aucacuaucucccaggag

SEQ ID NO: 3301387 - RNA, 22 nt, Variola virus
uaccaacaugucugauauuuug

SEQ ID NO: 3301388 - RNA, 21 nt, Variola virus
cauacguaccagcuauguuua

SEQ ID NO: 3301389 - RNA, 19 nt, Variola virus
uagcaacaguaguucuugc

SEQ ID NO: 3301390 - RNA, 21 nt, Variola virus
uauuuuuucuggcauuaucua

SEQ ID NO: 3301391 - RNA, 14 nt, Variola virus
aaaccaaaucuuga

SEQ ID NO: 3301392 - RNA, 17 nt, Variola virus
uauccagcuaacuuauu

SEQ ID NO: 3301393 - RNA, 19 nt, Variola virus
auucuaaaacuauaaaaca

SEQ ID NO: 3301394 - RNA, 21 nt, Variola virus
aaaucuucuucuacauuuuca

SEQ ID NO: 3301395 - RNA, 13 nt, Variola virus
aggacuauuagaa

SEQ ID NO: 3301396 - RNA, 18 nt, Variola virus
aagauaccgaagaauuaa

SEQ ID NO: 3301397 - RNA, 19 nt, Variola virus
gucggaguaguacaagaaa

SEQ ID NO: 3301398 - RNA, 16 nt, Variola virus
gaaagacgaauauuau

SEQ ID NO: 3301399 - RNA, 17 nt, Variola virus
auacgcauguagaaugu

SEQ ID NO: 3301400 - RNA, 20 nt, Variola virus
gacuucauugauaucuuuau

SEQ ID NO: 3301401 - RNA, 13 nt, Variola virus
auagauagaacua

SEQ ID NO: 3301402 - RNA, 19 nt, Variola virus
cuccagaugauguuacaau

SEQ ID NO: 3301403 - RNA, 23 nt, Variola virus
auuguccaucuauuacaaacaug

SEQ ID NO: 3301404 - RNA, 20 nt, Variola virus
cuauaauggaguuguaaaug

SEQ ID NO: 3301405 - RNA, 21 nt, Variola virus
aauuacagaguuuucagaaga

SEQ ID NO: 3301406 - RNA, 15 nt, Variola virus
acaaguauaaugaua

SEQ ID NO: 3301407 - RNA, 22 nt, Variola virus
aguauuucuguggauuaauaga

SEQ ID NO: 3301408 - RNA, 13 nt, Variola virus
uuacauuucuugu

SEQ ID NO: 3301409 - RNA, 15 nt, Variola virus
cacucucgaaaucac

SEQ ID NO: 3301410 - RNA, 14 nt, Variola virus
gaauagacuuucug

SEQ ID NO: 3301411 - RNA, 16 nt, Variola virus
uaguauugacaaauau

SEQ ID NO: 3301412 - RNA, 19 nt, Variola virus
augugaucuaugacaucau

SEQ ID NO: 3301413 - RNA, 18 nt, Variola virus
aucucuuuuccaugccuc

SEQ ID NO: 3301414 - RNA, 14 nt, Variola virus
ggaagaguaggaag

SEQ ID NO: 3301415 - RNA, 14 nt, Variola virus
gaauaucauauuac

SEQ ID NO: 3301416 - RNA, 22 nt, Variola virus
auguacuguauauaauaguuuc

SEQ ID NO: 3301417 - RNA, 19 nt, Variola virus
accauuagauaaaguugau

SEQ ID NO: 3301418 - RNA, 13 nt, Variola virus
auucauauagaac

SEQ ID NO: 3301419 - RNA, 12 nt, Variola virus
uaauguuguauu

SEQ ID NO: 3301420 - RNA, 21 nt, Variola virus
auacuaccaaccuacacuauu

SEQ ID NO: 3301421 - RNA, 11 nt, Variola virus
auuguauauag

SEQ ID NO: 3301422 - RNA, 20 nt, Variola virus
auacaacgugaaauacuuua

SEQ ID NO: 3301423 - RNA, 17 nt, Variola virus
acaaaaaagcucaauaa

SEQ ID NO: 3301424 - RNA, 18 nt, Variola virus
auuaaacguauaaaaacg

SEQ ID NO: 3301425 - RNA, 14 nt, Variola virus
auauaaucuagaca

SEQ ID NO: 3301426 - RNA, 17 nt, Variola virus
uccaaauugcgacacua

SEQ ID NO: 3301427 - RNA, 12 nt, Variola virus
guauaauagacc

SEQ ID NO: 3301428 - RNA, 13 nt, Variola virus
uuguauuauucug

SEQ ID NO: 3301429 - RNA, 15 nt, Variola virus
aucauguagauaguu

SEQ ID NO: 3301430 - RNA, 20 nt, Variola virus
uuuaaauauuauauaaacau

SEQ ID NO: 3301431 - RNA, 15 nt, Variola virus
ucguucuuaucccaa

SEQ ID NO: 3301432 - RNA, 20 nt, Variola virus
ugacgaacguauuacuauga

SEQ ID NO: 3301433 - RNA, 16 nt, Variola virus
cuucuaaugcuguacu

SEQ ID NO: 3301434 - RNA, 16 nt, Variola virus
aguauaccaacuauau

SEQ ID NO: 3301435 - RNA, 17 nt, Variola virus
auaaugacgauaacauu

SEQ ID NO: 3301436 - RNA, 15 nt, Variola virus
auaugcuacauguaa

SEQ ID NO: 3301437 - RNA, 18 nt, Variola virus
caauuuugauguauaaca

SEQ ID NO: 3301438 - RNA, 14 nt, Variola virus
aaauaaucauguaa

SEQ ID NO: 3301439 - RNA, 14 nt, Variola virus
aacgcaucuagacu

SEQ ID NO: 3301440 - RNA, 12 nt, Variola virus
uauugcaucaaa

SEQ ID NO: 3301441 - RNA, 19 nt, Variola virus
ucuauuaaagauuguuuaa

SEQ ID NO: 3301442 - RNA, 21 nt, Variola virus
accaauagaaguuuucccaaa

SEQ ID NO: 3301443 - RNA, 21 nt, Variola virus
uaucgcuggaagggacuauau

SEQ ID NO: 3301444 - RNA, 23 nt, Variola virus
aguuuccuuaacaaaucuaacug

SEQ ID NO: 3301445 - RNA, 17 nt, Variola virus
cgucuauauaguauuuu

SEQ ID NO: 3301446 - RNA, 19 nt, Variola virus
ucaaagggaccuaaaucua

SEQ ID NO: 3301447 - RNA, 19 nt, Variola virus
gaaucuauuacugacuuua

SEQ ID NO: 3301448 - RNA, 14 nt, Variola virus
auuucaacaggcau

SEQ ID NO: 3301449 - RNA, 15 nt, Variola virus
agauccuguuagaua

SEQ ID NO: 3301450 - RNA, 17 nt, Variola virus
aaauaucauaaauauau

SEQ ID NO: 3301451 - RNA, 13 nt, Variola virus
uauuuauacuacu

SEQ ID NO: 3301452 - RNA, 15 nt, Variola virus
uccggucgaugauga

SEQ ID NO: 3301453 - RNA, 15 nt, Variola virus
agaaaaggauguauu

SEQ ID NO: 3301454 - RNA, 16 nt, Variola virus
gaauaaauuauaucua

SEQ ID NO: 3301455 - RNA, 14 nt, Variola virus
uaaauaucauuaau

SEQ ID NO: 3301456 - RNA, 23 nt, Variola virus
augguaaggucuuagaaauagac

SEQ ID NO: 3301457 - RNA, 19 nt, Variola virus
auaucaucaaaauacugga

SEQ ID NO: 3301458 - RNA, 14 nt, Variola virus
gacaaauuauucua

SEQ ID NO: 3301459 - RNA, 13 nt, Variola virus
auagaaaaugauu

SEQ ID NO: 3301460 - RNA, 19 nt, Variola virus
acuaauucauuuucaauaa

SEQ ID NO: 3301461 - RNA, 16 nt, Variola virus
uauuaaaacuaucaau

SEQ ID NO: 3301462 - RNA, 21 nt, Variola virus
aaacucgucuccccaaacauu

SEQ ID NO: 3301463 - RNA, 19 nt, Variola virus
guuaaauuuuacaaaucua

SEQ ID NO: 3301464 - RNA, 21 nt, Variola virus
auacauugaucuauguaguuu

SEQ ID NO: 3301465 - RNA, 23 nt, Variola virus
aaacaaggauucguuuacucuca

SEQ ID NO: 3301466 - RNA, 19 nt, Variola virus
gacagaagaauaugaugau

SEQ ID NO: 3301467 - RNA, 15 nt, Variola virus
uuaaucuauuagaau

SEQ ID NO: 3301468 - RNA, 14 nt, Variola virus
guauucuaauuuua

SEQ ID NO: 3301469 - RNA, 14 nt, Variola virus
aauuuauuucuaau

SEQ ID NO: 3301470 - RNA, 17 nt, Variola virus
cgaaaauugcuauuuca

SEQ ID NO: 3301471 - RNA, 14 nt, Variola virus
acauuuaugauaug

SEQ ID NO: 3301472 - RNA, 15 nt, Variola virus
auuuuauuuuggaaa

SEQ ID NO: 3301473 - RNA, 18 nt, Variola virus
gaauauugauuuacuaaa

SEQ ID NO: 3301474 - RNA, 12 nt, Variola virus
cuauaacuucua

SEQ ID NO: 3301475 - RNA, 23 nt, Variola virus
uauagagcccacguuuaaacauu

SEQ ID NO: 3301476 - RNA, 20 nt, Variola virus
uaacuguugccaaugauguu

SEQ ID NO: 3301477 - RNA, 20 nt, Variola virus
aaaacuauaugucuguagaa

SEQ ID NO: 3301478 - RNA, 17 nt, Variola virus
ugauauuuugauguaca

SEQ ID NO: 3301479 - RNA, 17 nt, Variola virus
aucauguagaaaaauuc

SEQ ID NO: 3301480 - RNA, 14 nt, Variola virus
accaauaaacuauu

SEQ ID NO: 3301481 - RNA, 23 nt, Variola virus
uuaauaaacacggguucgucuuu

SEQ ID NO: 3301482 - RNA, 21 nt, Variola virus
cuaaguucuuugaucucuuuu

SEQ ID NO: 3301483 - RNA, 14 nt, Variola virus
gccaacuauacauc

SEQ ID NO: 3301484 - RNA, 21 nt, Variola virus
acggaugaaaauaagaaaaau

SEQ ID NO: 3301485 - RNA, 17 nt, Variola virus
uaaagaaaugucuacau

SEQ ID NO: 3301486 - RNA, 14 nt, Variola virus
ugguaauauggaua

SEQ ID NO: 3301487 - RNA, 12 nt, Variola virus
guuauuuacagc

SEQ ID NO: 3301488 - RNA, 14 nt, Variola virus
ucuugcucaaauaa

SEQ ID NO: 3301489 - RNA, 17 nt, Variola virus
aucuaucaaacaaaauu

SEQ ID NO: 3301490 - RNA, 16 nt, Variola virus
cucugaccuaaaggug

SEQ ID NO: 3301491 - RNA, 18 nt, Variola virus
gaaucaaauauagaucuu

SEQ ID NO: 3301492 - RNA, 21 nt, Variola virus
ugccacgaauaaaaaauacuu

SEQ ID NO: 3301493 - RNA, 12 nt, Variola virus
acuuuuaaauac

SEQ ID NO: 3301494 - RNA, 13 nt, Variola virus
auaacaaauacua

SEQ ID NO: 3301495 - RNA, 21 nt, Variola virus
uaguaugaagauaaacacuca

SEQ ID NO: 3301496 - RNA, 14 nt, Variola virus
ucuauagucagaau

SEQ ID NO: 3301497 - RNA, 17 nt, Variola virus
aucuuuaauagaacucu

SEQ ID NO: 3301498 - RNA, 16 nt, Variola virus
agacguacuccagaua

SEQ ID NO: 3301499 - RNA, 16 nt, Variola virus
ucaaaauauuaaacca

SEQ ID NO: 3301500 - RNA, 16 nt, Variola virus
aagucacuaacugaua

SEQ ID NO: 3301501 - RNA, 14 nt, Variola virus
cuuaauuauaacga

SEQ ID NO: 3301502 - RNA, 24 nt, Variola virus
uccucagauuuauacauauucuaa

SEQ ID NO: 3301503 - RNA, 22 nt, Variola virus
caauagugucuacuuaaaugua

SEQ ID NO: 3301504 - RNA, 14 nt, Variola virus
cuaacuccuugguu

SEQ ID NO: 3301505 - RNA, 13 nt, Variola virus
guaaaaaauguac

SEQ ID NO: 3301506 - RNA, 20 nt, Variola virus
cuucauucguaaaucuuuuc

SEQ ID NO: 3301507 - RNA, 22 nt, Variola virus
acuuaaugaagauuuauuucca

SEQ ID NO: 3301508 - RNA, 21 nt, Variola virus
uaacuuccacauuaauacagc

SEQ ID NO: 3301509 - RNA, 22 nt, Variola virus
ucaccguuacgguaauuuuuga

SEQ ID NO: 3301510 - RNA, 19 nt, Variola virus
uauuauaaacucucaacau

SEQ ID NO: 3301511 - RNA, 15 nt, Variola virus
acaauaaacaaaaua

SEQ ID NO: 3301512 - RNA, 22 nt, Variola virus
cuucuaugagauugaucaugua

SEQ ID NO: 3301513 - RNA, 12 nt, Variola virus
aauauuaaacac

SEQ ID NO: 3301514 - RNA, 14 nt, Variola virus
acauuuuauuucua

SEQ ID NO: 3301515 - RNA, 20 nt, Variola virus
cagugacgucuguggaugga

SEQ ID NO: 3301516 - RNA, 23 nt, Variola virus
cauuaaguucacuagaauaucca

SEQ ID NO: 3301517 - RNA, 24 nt, Variola virus
aacacuccggaaaaauaauuucca

SEQ ID NO: 3301518 - RNA, 18 nt, Variola virus
ccaaauuuguuuuguuua

SEQ ID NO: 3301519 - RNA, 17 nt, Variola virus
cuauauauucugcuaua

SEQ ID NO: 3301520 - RNA, 13 nt, Variola virus
guucguucuggga

SEQ ID NO: 3301521 - RNA, 15 nt, Variola virus
ugauuagaauucauc

SEQ ID NO: 3301522 - RNA, 20 nt, Variola virus
auaaugucugacaagauccg

SEQ ID NO: 3301523 - RNA, 16 nt, Variola virus
auaaaaauuauguuuu

SEQ ID NO: 3301524 - RNA, 11 nt, Variola virus
cuauagaaaau

SEQ ID NO: 3301525 - RNA, 21 nt, Variola virus
auuucaaagguguguacuuua

SEQ ID NO: 3301526 - RNA, 22 nt, Variola virus
cuaaacuaacuccuugguuuca

SEQ ID NO: 3301527 - RNA, 22 nt, Variola virus
gucaaccuuuguuguacaaauu

SEQ ID NO: 3301528 - RNA, 14 nt, Variola virus
uuaaaguuauuaau

SEQ ID NO: 3301529 - RNA, 15 nt, Variola virus
uuacuagauuaaaaa

SEQ ID NO: 3301530 - RNA, 17 nt, Variola virus
cuagauauauuaauaac

SEQ ID NO: 3301531 - RNA, 16 nt, Variola virus
auaagaaauaugaaau

SEQ ID NO: 3301532 - RNA, 22 nt, Variola virus
uacgccaaauaucucaaagaug

SEQ ID NO: 3301533 - RNA, 19 nt, Variola virus
uagaaaaacuauaucuaug

SEQ ID NO: 3301534 - RNA, 21 nt, Variola virus
agaggaugaaauagauagaau

SEQ ID NO: 3301535 - RNA, 21 nt, Variola virus
augaaugcaagacucacgcau

SEQ ID NO: 3301536 - RNA, 14 nt, Variola virus
agguaaauguaaau

SEQ ID NO: 3301537 - RNA, 12 nt, Variola virus
auguaaaaucau

SEQ ID NO: 3301538 - RNA, 19 nt, Variola virus
auguauuguuuaguuacuc

SEQ ID NO: 3301539 - RNA, 20 nt, Variola virus
acgauucuucacaagugaaa

SEQ ID NO: 3301540 - RNA, 16 nt, Variola virus
ucgacucaguauacaa

SEQ ID NO: 3301541 - RNA, 17 nt, Variola virus
aguacuccguuuacaga

SEQ ID NO: 3301542 - RNA, 17 nt, Variola virus
aguguuaaaaaauggau

SEQ ID NO: 3301543 - RNA, 16 nt, Variola virus
guucucaauacaccaa

SEQ ID NO: 3301544 - RNA, 23 nt, Variola virus
uuccuauagccguucuuguaauu

SEQ ID NO: 3301545 - RNA, 17 nt, Variola virus
ccauguuucaucuauca

SEQ ID NO: 3301546 - RNA, 12 nt, Variola virus
ucaaauguagug

SEQ ID NO: 3301547 - RNA, 15 nt, Variola virus
gacacgacauagaga

SEQ ID NO: 3301548 - RNA, 16 nt, Variola virus
cuuauuacuccauuau

SEQ ID NO: 3301549 - RNA, 11 nt, Variola virus
ggaaaaugcua

SEQ ID NO: 3301550 - RNA, 14 nt, Variola virus
auuuuauugcuaau

SEQ ID NO: 3301551 - RNA, 19 nt, Variola virus
augaauuacuuuacauaua

SEQ ID NO: 3301552 - RNA, 15 nt, Variola virus
uuaguaaucauguaa

SEQ ID NO: 3301553 - RNA, 22 nt, Variola virus
auuauuuuaauuucugaugugc

SEQ ID NO: 3301554 - RNA, 17 nt, Variola virus
gacauauccgaugaugu

SEQ ID NO: 3301555 - RNA, 14 nt, Variola virus
gcgcauaucuuuuu

SEQ ID NO: 3301556 - RNA, 13 nt, Variola virus
uuaauuaaccauu

SEQ ID NO: 3301557 - RNA, 20 nt, Variola virus
uauauauacugaaaaguuau

SEQ ID NO: 3301558 - RNA, 20 nt, Variola virus
aggauauacucaauagaauu

SEQ ID NO: 3301559 - RNA, 22 nt, Variola virus
aauacuuuuuuuauuaaaugac

SEQ ID NO: 3301560 - RNA, 17 nt, Variola virus
ucaaguuaugaaaauag

SEQ ID NO: 3301561 - RNA, 10 nt, Variola virus
aaaauacuua

SEQ ID NO: 3301562 - RNA, 20 nt, Variola virus
agugguauauaauccaucaa

SEQ ID NO: 3301563 - RNA, 15 nt, Variola virus
cuuuaaaagaaacug

SEQ ID NO: 3301564 - RNA, 20 nt, Variola virus
guaauaucaugucuaaugau

SEQ ID NO: 3301565 - RNA, 23 nt, Variola virus
uagcaaacaugauagcugugaua

SEQ ID NO: 3301566 - RNA, 18 nt, Variola virus
uuuguucuuaagacuaua

SEQ ID NO: 3301567 - RNA, 14 nt, Variola virus
auaacuuauccgaa

SEQ ID NO: 3301568 - RNA, 16 nt, Variola virus
uauauuccgauuucaa

SEQ ID NO: 3301569 - RNA, 17 nt, Variola virus
uucuguacaaauuauug

SEQ ID NO: 3301570 - RNA, 15 nt, Variola virus
caacguaauaaugaa

SEQ ID NO: 3301571 - RNA, 14 nt, Variola virus
guaaauaacaauga

SEQ ID NO: 3301572 - RNA, 14 nt, Variola virus
acaaaggagaugau

SEQ ID NO: 3301573 - RNA, 13 nt, Variola virus
gacagaaaaaugu

SEQ ID NO: 3301574 - RNA, 15 nt, Variola virus
ugacuccaucuuuua

SEQ ID NO: 3301575 - RNA, 20 nt, Variola virus
gaacaucauuuccaaaucua

SEQ ID NO: 3301576 - RNA, 16 nt, Variola virus
aaguuuuuauucucuu

SEQ ID NO: 3301577 - RNA, 17 nt, Variola virus
uuaaugauucauuauca

SEQ ID NO: 3301578 - RNA, 18 nt, Variola virus
gaaauuuauacucaucau

SEQ ID NO: 3301579 - RNA, 21 nt, Variola virus
ucucaaaugaauaaguuuauu

SEQ ID NO: 3301580 - RNA, 17 nt, Variola virus
acuugagacuugauaga

SEQ ID NO: 3301581 - RNA, 15 nt, Variola virus
uggauguacauguau

SEQ ID NO: 3301582 - RNA, 19 nt, Variola virus
aaccugaucuggaaaauaa

SEQ ID NO: 3301583 - RNA, 15 nt, Variola virus
uaaagguaacaauau

SEQ ID NO: 3301584 - RNA, 18 nt, Variola virus
guacauuuuuaaacuguu

SEQ ID NO: 3301585 - RNA, 16 nt, Variola virus
uauaaucguuaaauuu

SEQ ID NO: 3301586 - RNA, 22 nt, Variola virus
auacauuuugcauuagauuuac

SEQ ID NO: 3301587 - RNA, 17 nt, Variola virus
uacaaauuuuaagaaau

SEQ ID NO: 3301588 - RNA, 16 nt, Variola virus
aguccuauauauuuga

SEQ ID NO: 3301589 - RNA, 15 nt, Variola virus
aucuaauauaucacu

SEQ ID NO: 3301590 - RNA, 12 nt, Variola virus
agauaaauggaa

SEQ ID NO: 3301591 - RNA, 19 nt, Variola virus
gcaguggaguuauaugaau

SEQ ID NO: 3301592 - RNA, 16 nt, Variola virus
uugguauuucuuacau

SEQ ID NO: 3301593 - RNA, 13 nt, Variola virus
aaauuagaaagua

SEQ ID NO: 3301594 - RNA, 19 nt, Variola virus
uacacaucuaucaagugau

SEQ ID NO: 3301595 - RNA, 22 nt, Variola virus
ucuaucguuauaacucgagaau

SEQ ID NO: 3301596 - RNA, 22 nt, Variola virus
gaacauccuccggaguauuaau

SEQ ID NO: 3301597 - RNA, 19 nt, Variola virus
caguuaagucaauaauauu

SEQ ID NO: 3301598 - RNA, 17 nt, Variola virus
uauuauaaaaaaguuuu

SEQ ID NO: 3301599 - RNA, 22 nt, Variola virus
ucucaugguaucgauuacaccu

SEQ ID NO: 3301600 - RNA, 15 nt, Variola virus
aaucauauuuagaaa

SEQ ID NO: 3301601 - RNA, 22 nt, Variola virus
ugccguuuauaggucuagccac

SEQ ID NO: 3301602 - RNA, 22 nt, Variola virus
uguaauaucuuaaauaacucau

SEQ ID NO: 3301603 - RNA, 14 nt, Variola virus
uaauaaauguuucg

SEQ ID NO: 3301604 - RNA, 17 nt, Variola virus
cuaugucucuuauuaga

SEQ ID NO: 3301605 - RNA, 14 nt, Variola virus
caaauuaaauucug

SEQ ID NO: 3301606 - RNA, 19 nt, Variola virus
uauaaaacgauuaaacaau

SEQ ID NO: 3301607 - RNA, 16 nt, Variola virus
aagauuacuacacuug

SEQ ID NO: 3301608 - RNA, 18 nt, Variola virus
uuguuuuaauuuuaggac

SEQ ID NO: 3301609 - RNA, 23 nt, Variola virus
uugauuuggaauucuuuuucgac

SEQ ID NO: 3301610 - RNA, 19 nt, Variola virus
uuauuuuaucuuuuacuac

SEQ ID NO: 3301611 - RNA, 14 nt, Human
cugaucucucguga

SEQ ID NO: 3301612 - RNA, 18 nt, Human
cugaucucucgugauuga

SEQ ID NO: 3301613 - RNA, 17 nt, Human
cugaucucucgugauug

SEQ ID NO: 3301614 - RNA, 21 nt, Human
cugaggaauccagacccggcu

SEQ ID NO: 3301615 - RNA, 19 nt, Human
cugacccugcuucaaauau

SEQ ID NO: 3301616 - RNA, 22 nt, Human
cugagcugggaugauuggaggg

SEQ ID NO: 3301617 - RNA, 12 nt, Human
cugagcugggau

SEQ ID NO: 3301618 - RNA, 14 nt, Human
cugaggggccucuu

SEQ ID NO: 3301619 - RNA, 23 nt, Human
cugaggaauccagacccggcugc

SEQ ID NO: 3301620 - RNA, 12 nt, Human
cugaggugggag

SEQ ID NO: 3301621 - RNA, 13 nt, Human
cugaggugggagg

SEQ ID NO: 3301622 - RNA, 22 nt, Human
cugaggugggaggaucucuuga

SEQ ID NO: 3301623 - RNA, 18 nt, Human
cucugcacaagcugcacc

SEQ ID NO: 3301624 - RNA, 17 nt, Human
cucugcacaagcugcac

SEQ ID NO: 3301625 - RNA, 24 nt, Human
cucuugauucauaaugacuuaagc

SEQ ID NO: 3301626 - RNA, 14 nt, Human
cucuugagccuggg

SEQ ID NO: 3301627 - RNA, 13 nt, Human
cucuugagccugg

SEQ ID NO: 3301628 - RNA, 15 nt, Human
cucuugagccuggga

SEQ ID NO: 3301629 - RNA, 23 nt, Human
cucuugagccuugaacuuugacc

SEQ ID NO: 3301630 - RNA, 22 nt, Human
cucuugauucauaaugacuuaa

SEQ ID NO: 3301631 - RNA, 13 nt, Human
cugacacacagcu

SEQ ID NO: 3301632 - RNA, 15 nt, Human
cugacacacagcucu

SEQ ID NO: 3301633 - RNA, 16 nt, Human
cugacacacagcucug

SEQ ID NO: 3301634 - RNA, 17 nt, Human
cugacacacagcucugu

SEQ ID NO: 3301635 - RNA, 18 nt, Human
cugacacacagcucuguc

SEQ ID NO: 3301636 - RNA, 19 nt, Human
cugacacacagcucugucc

SEQ ID NO: 3301637 - RNA, 20 nt, Human
cugacacacagcucuguccu

SEQ ID NO: 3301638 - RNA, 21 nt, Human
cugacacacagcucuguccug

SEQ ID NO: 3301639 - RNA, 22 nt, Human
cugacacacagcucuguccugg

SEQ ID NO: 3301640 - RNA, 23 nt, Human
cugacacacagcucuguccuggg

SEQ ID NO: 3301641 - RNA, 24 nt, Human
cuccuuuucacaguucucuccuuc

SEQ ID NO: 3301642 - RNA, 23 nt, Human
cuccuuugugaggaagccgcugg

SEQ ID NO: 3301643 - RNA, 22 nt, Human
cuccuuuagcgcccaguugggu

SEQ ID NO: 3301644 - RNA, 16 nt, Human
cuccuuuagcgcccag

SEQ ID NO: 3301645 - RNA, 17 nt, Human
cuccuuuagcgcccagu

SEQ ID NO: 3301646 - RNA, 22 nt, Human
cuccuagccugugccucuggga

SEQ ID NO: 3301647 - RNA, 23 nt, Human
cucgguguggagaagcggcuggc

SEQ ID NO: 3301648 - RNA, 11 nt, Human
cucggugccuu

SEQ ID NO: 3301649 - RNA, 10 nt, Human
cucuccucug

SEQ ID NO: 3301650 - RNA, 16 nt, Human
cucuccgaccagacac

SEQ ID NO: 3301651 - RNA, 20 nt, Human
cucuccuccuuuucacaguu

SEQ ID NO: 3301652 - RNA, 13 nt, Human
cucuccuccuuuu

SEQ ID NO: 3301653 - RNA, 13 nt, Human
cucucccuuggau

SEQ ID NO: 3301654 - RNA, 16 nt, Human
cucugcacaagcugca

SEQ ID NO: 3301655 - RNA, 18 nt, Human
cuccaggugcacaagcuc

SEQ ID NO: 3301656 - RNA, 20 nt, Human
cuccaggugcacaagcucca

SEQ ID NO: 3301657 - RNA, 19 nt, Human
cuccaggugcacaagcucc

SEQ ID NO: 3301658 - RNA, 14 nt, Human
cucccaccucagcc

SEQ ID NO: 3301659 - RNA, 16 nt, Human
cucccaccucagccuc

SEQ ID NO: 3301660 - RNA, 17 nt, Human
cucccaccucagccucc

SEQ ID NO: 3301661 - RNA, 13 nt, Human
cucccaccucagc

SEQ ID NO: 3301662 - RNA, 23 nt, Human
cuccaggcuguaucccaugagcc

SEQ ID NO: 3301663 - RNA, 22 nt, Human
cuccaggcuguaucccaugagc

SEQ ID NO: 3301664 - RNA, 21 nt, Human
cuccagaauuucccaaagcag

SEQ ID NO: 3301665 - RNA, 16 nt, Human
cucagaaucucaaaua

SEQ ID NO: 3301666 - RNA, 17 nt, Human
cucagaaucucaaauaa

SEQ ID NO: 3301667 - RNA, 11 nt, Human
cuccagacaca

SEQ ID NO: 3301668 - RNA, 22 nt, Human
cuccagaauuucccaaagcagu

SEQ ID NO: 3301669 - RNA, 22 nt, Human
cuccgcuuucuacccagcgagc

SEQ ID NO: 3301670 - RNA, 21 nt, Human
cuccgcuuucuacccagcgag

SEQ ID NO: 3301671 - RNA, 20 nt, Human
cuccgcuuucuacccagcga

SEQ ID NO: 3301672 - RNA, 19 nt, Human
cucccucuuucccucccuu

SEQ ID NO: 3301673 - RNA, 16 nt, Human
cucccucccucuuucc

SEQ ID NO: 3301674 - RNA, 15 nt, Human
cucccucuuucccuc

SEQ ID NO: 3301675 - RNA, 13 nt, Human
cucaccucucccu

SEQ ID NO: 3301676 - RNA, 17 nt, Human
cucaccucucccuugga

SEQ ID NO: 3301677 - RNA, 16 nt, Human
cucaccucucccuugg

SEQ ID NO: 3301678 - RNA, 15 nt, Human
cucaccucucccuug

SEQ ID NO: 3301679 - RNA, 14 nt, Human
cucaccucucccuu

SEQ ID NO: 3301680 - RNA, 13 nt, Human
cucaccugccccu

SEQ ID NO: 3301681 - RNA, 16 nt, Human
cucaccugccccucaa

SEQ ID NO: 3301682 - RNA, 14 nt, Human
cucaccugccccuc

SEQ ID NO: 3301683 - RNA, 18 nt, Human
cucaccugccccucaacu

SEQ ID NO: 3301684 - RNA, 16 nt, Human
cuauguugcccaggca

SEQ ID NO: 3301685 - RNA, 17 nt, Human
cucaaaaaaagaaaaag

SEQ ID NO: 3301686 - RNA, 18 nt, Human
cucaaaaaaagaaaaaga

SEQ ID NO: 3301687 - RNA, 14 nt, Human
cuauguugcccagg

SEQ ID NO: 3301688 - RNA, 15 nt, Human
cuauguugcccaggc

SEQ ID NO: 3301689 - RNA, 22 nt, Human
cuauguguagggcgggaggaug

SEQ ID NO: 3301690 - RNA, 16 nt, Human
cuauguaucaaugagu

SEQ ID NO: 3301691 - RNA, 17 nt, Human
cuaugugagcacaaagg

SEQ ID NO: 3301692 - RNA, 18 nt, Human
cuaucucccccagcccca

SEQ ID NO: 3301693 - RNA, 19 nt, Human
cuauguaucaaugaguaac

SEQ ID NO: 3301694 - RNA, 20 nt, Human
cuaucucccccagccccauc

SEQ ID NO: 3301695 - RNA, 12 nt, Human
cucaaauaacua

SEQ ID NO: 3301696 - RNA, 14 nt, Human
cucacaaaggaugc

SEQ ID NO: 3301697 - RNA, 14 nt, Human
cucacacaugagca

SEQ ID NO: 3301698 - RNA, 19 nt, Human
cuaguuugauuaaauucuu

SEQ ID NO: 3301699 - RNA, 17 nt, Human
cuaguuugauuaaauuc

SEQ ID NO: 3301700 - RNA, 14 nt, Human
cuagggaagauaau

SEQ ID NO: 3301701 - RNA, 20 nt, Human
cuaguuugauuaaauucuug

SEQ ID NO: 3301702 - RNA, 15 nt, Human
cuaguuugauuaaau

SEQ ID NO: 3301703 - RNA, 19 nt, Human
cuagcauacguacacauuu

SEQ ID NO: 3301704 - RNA, 18 nt, Human
cuagcauacguacacauu

SEQ ID NO: 3301705 - RNA, 16 nt, Human
cuagcauacguacaca

SEQ ID NO: 3301706 - RNA, 13 nt, Human
cuaggccugggga

SEQ ID NO: 3301707 - RNA, 12 nt, Human
cuaggccugggg

SEQ ID NO: 3301708 - RNA, 14 nt, Human
cuaggccuggccag

SEQ ID NO: 3301709 - RNA, 15 nt, Human
cuaggccuggccaga

SEQ ID NO: 3301710 - RNA, 18 nt, Human
cuaggccuggccagaugc

SEQ ID NO: 3301711 - RNA, 19 nt, Human
cuaggccuggccagaugca

SEQ ID NO: 3301712 - RNA, 13 nt, Human
cuaggccuggcca

SEQ ID NO: 3301713 - RNA, 17 nt, Human
cuagccagaggagagag

SEQ ID NO: 3301714 - RNA, 19 nt, Human
cuagccagaggagagagga

SEQ ID NO: 3301715 - RNA, 23 nt, Human
cuaccugaggggccucuuauggg

SEQ ID NO: 3301716 - RNA, 19 nt, Human
cuaccugaggggccucuua

SEQ ID NO: 3301717 - RNA, 16 nt, Human
cuaccugaggggccuc

SEQ ID NO: 3301718 - RNA, 15 nt, Human
cuaccugaggggccu

SEQ ID NO: 3301719 - RNA, 13 nt, Human
cguacacauuuua

SEQ ID NO: 3301720 - RNA, 13 nt, Human
cguuaaaauacca

SEQ ID NO: 3301721 - RNA, 19 nt, Human
cuaaaguguauuuuuuuac

SEQ ID NO: 3301722 - RNA, 19 nt, Human
cuaaaggcuaccuuuguau

SEQ ID NO: 3301723 - RNA, 17 nt, Human
cuaaaggcuaccuuugu

SEQ ID NO: 3301724 - RNA, 22 nt, Human
cuaaaguguauuuuuuuacuaa

SEQ ID NO: 3301725 - RNA, 15 nt, Human
cuaaagcugccagcc

SEQ ID NO: 3301726 - RNA, 11 nt, Human
cuaaagcugcc

SEQ ID NO: 3301727 - RNA, 16 nt, Human
cuaaaggcuaccuuug

SEQ ID NO: 3301728 - RNA, 15 nt, Human
cuaaaggcuaccuuu

SEQ ID NO: 3301729 - RNA, 14 nt, Human
cuaaagcugccagc

SEQ ID NO: 3301730 - RNA, 17 nt, Human
cggagaaaggaagggcu

SEQ ID NO: 3301731 - RNA, 20 nt, Human
cgcuggggccaguugguccc

SEQ ID NO: 3301732 - RNA, 17 nt, Human
cgcuggggccaguuggu

SEQ ID NO: 3301733 - RNA, 16 nt, Human
cgccuuaaggauguuc

SEQ ID NO: 3301734 - RNA, 13 nt, Human
cgcugccccuggc

SEQ ID NO: 3301735 - RNA, 17 nt, Human
cgcugccccuggcagcc

SEQ ID NO: 3301736 - RNA, 16 nt, Human
cgcugccccuggcagc

SEQ ID NO: 3301737 - RNA, 19 nt, Human
cgcuggaccuugaacuggg

SEQ ID NO: 3301738 - RNA, 23 nt, Human
cgcuggaccuugaacuggguacu

SEQ ID NO: 3301739 - RNA, 18 nt, Human
cgcugccccuggcagccc

SEQ ID NO: 3301740 - RNA, 22 nt, Human
cccaggcuuagucacugagaca

SEQ ID NO: 3301741 - RNA, 20 nt, Human
cccaggcuuagucacugaga

SEQ ID NO: 3301742 - RNA, 18 nt, Human
cccaggaaaggcuccagg

SEQ ID NO: 3301743 - RNA, 17 nt, Human
cccaggaaaggcuccag

SEQ ID NO: 3301744 - RNA, 16 nt, Human
cccaggaaaggcucca

SEQ ID NO: 3301745 - RNA, 15 nt, Human
cccaggaaaggcucc

SEQ ID NO: 3301746 - RNA, 23 nt, Human
cccagcaagugagagcugggugu

SEQ ID NO: 3301747 - RNA, 20 nt, Human
cccauccucuguacagagcc

SEQ ID NO: 3301748 - RNA, 22 nt, Human
cccauccucuguacagagccca

SEQ ID NO: 3301749 - RNA, 21 nt, Human
cccauccucuguacagagccc

SEQ ID NO: 3301750 - RNA, 15 nt, Human
cccauuugcuccuuu

SEQ ID NO: 3301751 - RNA, 13 nt, Human
cccauucugccug

SEQ ID NO: 3301752 - RNA, 19 nt, Human
cccauucugccugcccagg

SEQ ID NO: 3301753 - RNA, 14 nt, Human
cccauucugccugc

SEQ ID NO: 3301754 - RNA, 15 nt, Human
cccauucugccugcc

SEQ ID NO: 3301755 - RNA, 15 nt, Human
ccccagauugcaaca

SEQ ID NO: 3301756 - RNA, 20 nt, Human
ccccagauugcaacaggcug

SEQ ID NO: 3301757 - RNA, 14 nt, Human
ccccgcacugggcu

SEQ ID NO: 3301758 - RNA, 23 nt, Human
ccccgaggccuucucugaaggac

SEQ ID NO: 3301759 - RNA, 16 nt, Human
cccggccccugcuggu

SEQ ID NO: 3301760 - RNA, 15 nt, Human
cccggccccugcugg

SEQ ID NO: 3301761 - RNA, 12 nt, Human
cccgggaagggg

SEQ ID NO: 3301762 - RNA, 15 nt, Human
cccgggaagggggcu

SEQ ID NO: 3301763 - RNA, 13 nt, Human
ccccuucugaccc

SEQ ID NO: 3301764 - RNA, 14 nt, Human
ccccuucugaccca

SEQ ID NO: 3301765 - RNA, 16 nt, Human
cccgaauagcugggac

SEQ ID NO: 3301766 - RNA, 17 nt, Human
cccgaauagcugggacu

SEQ ID NO: 3301767 - RNA, 18 nt, Human
cccgaauagcugggacua

SEQ ID NO: 3301768 - RNA, 17 nt, Human
cccggccaccugcggug

SEQ ID NO: 3301769 - RNA, 16 nt, Human
cccucaacucuccucc

SEQ ID NO: 3301770 - RNA, 16 nt, Human
cccucaacaccucugc

SEQ ID NO: 3301771 - RNA, 21 nt, Human
cccgggaagggggcugggaca

SEQ ID NO: 3301772 - RNA, 18 nt, Human
cccgggaagggggcuggg

SEQ ID NO: 3301773 - RNA, 15 nt, Human
ccccugacaacacuc

SEQ ID NO: 3301774 - RNA, 14 nt, Human
ccccugccacccug

SEQ ID NO: 3301775 - RNA, 16 nt, Human
ccccugccacccuggg

SEQ ID NO: 3301776 - RNA, 16 nt, Human
cccaacucaccccagc

SEQ ID NO: 3301777 - RNA, 15 nt, Human
cccaacucaccccag

SEQ ID NO: 3301778 - RNA, 20 nt, Human
cccaacucaccccagcccca

SEQ ID NO: 3301779 - RNA, 17 nt, Human
cccaacucaccccagcc

SEQ ID NO: 3301780 - RNA, 13 nt, Human
cccaagcucugcu

SEQ ID NO: 3301781 - RNA, 14 nt, Human
cccaagcucugcuc

SEQ ID NO: 3301782 - RNA, 12 nt, Human
cccaagcucugc

SEQ ID NO: 3301783 - RNA, 12 nt, Human
cccacucccugc

SEQ ID NO: 3301784 - RNA, 13 nt, Human
cccacucccugca

SEQ ID NO: 3301785 - RNA, 23 nt, Human
cccacugcuuuuggucuguguga

SEQ ID NO: 3301786 - RNA, 22 nt, Human
cccacugcuuuuggucugugug

SEQ ID NO: 3301787 - RNA, 23 nt, Human
ccaguuggguggaugccuggugg

SEQ ID NO: 3301788 - RNA, 13 nt, Human
ccaguuggucccc

SEQ ID NO: 3301789 - RNA, 20 nt, Human
ccaguuggucccccuuccau

SEQ ID NO: 3301790 - RNA, 18 nt, Human
ccaguuggucccccuucc

SEQ ID NO: 3301791 - RNA, 18 nt, Human
ccauccagguucagcuug

SEQ ID NO: 3301792 - RNA, 19 nt, Human
ccauccagguucagcuugu

SEQ ID NO: 3301793 - RNA, 20 nt, Human
ccaucccauaugccugggca

SEQ ID NO: 3301794 - RNA, 19 nt, Human
ccaucccauaugccugggc

SEQ ID NO: 3301795 - RNA, 21 nt, Human
ccaucccauaugccugggcag

SEQ ID NO: 3301796 - RNA, 22 nt, Human
ccauccccuguagagugggagc

SEQ ID NO: 3301797 - RNA, 18 nt, Human
ccaugaguccccuguuug

SEQ ID NO: 3301798 - RNA, 23 nt, Human
ccaugaggaacaaggcaaggcug

SEQ ID NO: 3301799 - RNA, 18 nt, Human
ccaugaggaacaaggcaa

SEQ ID NO: 3301800 - RNA, 20 nt, Human
ccaugaggaacaaggcaagg

SEQ ID NO: 3301801 - RNA, 17 nt, Human
ccagccccauccucugu

SEQ ID NO: 3301802 - RNA, 15 nt, Human
ccagccccauccucu

SEQ ID NO: 3301803 - RNA, 17 nt, Human
ccagccccagugcccac

SEQ ID NO: 3301804 - RNA, 14 nt, Human
ccagcagagcaccu

SEQ ID NO: 3301805 - RNA, 13 nt, Human
ccagcagagcacc

SEQ ID NO: 3301806 - RNA, 12 nt, Human
ccagcagagcac

SEQ ID NO: 3301807 - RNA, 18 nt, Human
ccagccccuucugaccca

SEQ ID NO: 3301808 - RNA, 24 nt, Human
ccagccccuucugacccaugcugc

SEQ ID NO: 3301809 - RNA, 23 nt, Human
ccagccccuucugacccaugcug

SEQ ID NO: 3301810 - RNA, 21 nt, Human
ccaggggaaaaucagccugcu

SEQ ID NO: 3301811 - RNA, 12 nt, Human
ccaggcuggcgu

SEQ ID NO: 3301812 - RNA, 23 nt, Human
ccaggcaggucuugaacuccugg

SEQ ID NO: 3301813 - RNA, 12 nt, Human
ccaggcaggucu

SEQ ID NO: 3301814 - RNA, 14 nt, Human
ccaggcaggucuug

SEQ ID NO: 3301815 - RNA, 13 nt, Human
ccuccgccucuug

SEQ ID NO: 3301816 - RNA, 14 nt, Human
ccuccgccucuugg

SEQ ID NO: 3301817 - RNA, 20 nt, Human
ccuccuuugugaggaagccg

SEQ ID NO: 3301818 - RNA, 23 nt, Human
ccuccuuugugaggaagccgcug

SEQ ID NO: 3301819 - RNA, 18 nt, Human
ccuccuuuucacaguucu

SEQ ID NO: 3301820 - RNA, 12 nt, Human
ccucccaucacc

SEQ ID NO: 3301821 - RNA, 16 nt, Human
ccuccaagaccuucuc

SEQ ID NO: 3301822 - RNA, 19 nt, Human
ccuccaagaccuucuccuu

SEQ ID NO: 3301823 - RNA, 17 nt, Human
ccuccaagaccuucucc

SEQ ID NO: 3301824 - RNA, 17 nt, Human
ccucccaucacccgcua

SEQ ID NO: 3301825 - RNA, 20 nt, Human
ccucaagugauucuccugcc

SEQ ID NO: 3301826 - RNA, 18 nt, Human
ccucaggcaggugggaug

SEQ ID NO: 3301827 - RNA, 12 nt, Human
ccucaggcaggu

SEQ ID NO: 3301828 - RNA, 18 nt, Human
ccucauuagcauuuugcu

SEQ ID NO: 3301829 - RNA, 15 nt, Human
ccucaaccuccuggg

SEQ ID NO: 3301830 - RNA, 19 nt, Human
ccucaacucuccuccagag

SEQ ID NO: 3301831 - RNA, 23 nt, Human
ccucaacucuccuccagagucag

SEQ ID NO: 3301832 - RNA, 21 nt, Human
ccucaacucuccuccagaguc

SEQ ID NO: 3301833 - RNA, 16 nt, Human
ccucaacaccucugca

SEQ ID NO: 3301834 - RNA, 18 nt, Human
ccgcagcccugcagaggg

SEQ ID NO: 3301835 - RNA, 14 nt, Human
ccgcagcccugcag

SEQ ID NO: 3301836 - RNA, 14 nt, Human
cccuccuuucacca

SEQ ID NO: 3301837 - RNA, 21 nt, Human
cccugugaguacuacaguccu

SEQ ID NO: 3301838 - RNA, 15 nt, Human
cccugugauggggcc

SEQ ID NO: 3301839 - RNA, 23 nt, Human
cccugugaguacuacaguccucc

SEQ ID NO: 3301840 - RNA, 23 nt, Human
cccuuuuuuggcugcugaaggcu

SEQ ID NO: 3301841 - RNA, 22 nt, Human
cccuuuuuuggcugcugaaggc

SEQ ID NO: 3301842 - RNA, 21 nt, Human
cccuuuuuuggcugcugaagg

SEQ ID NO: 3301843 - RNA, 14 nt, Human
cccuucucuccagc

SEQ ID NO: 3301844 - RNA, 17 nt, Human
ccggccaccugcggugc

SEQ ID NO: 3301845 - RNA, 18 nt, Human
ccggccaccugcggugcu

SEQ ID NO: 3301846 - RNA, 22 nt, Human
ccuagccuuagaagucacacag

SEQ ID NO: 3301847 - RNA, 19 nt, Human
ccuagccuuagaagucaca

SEQ ID NO: 3301848 - RNA, 23 nt, Human
ccuagccugugccucugggacug

SEQ ID NO: 3301849 - RNA, 21 nt, Human
ccuagcauacguacacauuuu

SEQ ID NO: 3301850 - RNA, 20 nt, Human
ccuagccugugccucuggga

SEQ ID NO: 3301851 - RNA, 17 nt, Human
ccugcccaccuggccuc

SEQ ID NO: 3301852 - RNA, 15 nt, Human
ccugcccaccuggcc

SEQ ID NO: 3301853 - RNA, 16 nt, Human
ccugccucagccuccc

SEQ ID NO: 3301854 - RNA, 15 nt, Human
ccugccucagccucc

SEQ ID NO: 3301855 - RNA, 21 nt, Human
ccugcccaggccccugccacc

SEQ ID NO: 3301856 - RNA, 14 nt, Human
ccugccucagccuc

SEQ ID NO: 3301857 - RNA, 18 nt, Human
ccugcccaggccccugcc

SEQ ID NO: 3301858 - RNA, 19 nt, Human
ccugcccaggccccugcca

SEQ ID NO: 3301859 - RNA, 18 nt, Human
ccugcccaccuggccucu

SEQ ID NO: 3301860 - RNA, 16 nt, Human
ccugaggggccucuua

SEQ ID NO: 3301861 - RNA, 14 nt, Human
ccugcaggcagcca

SEQ ID NO: 3301862 - RNA, 13 nt, Human
ccugcaggcagcc

SEQ ID NO: 3301863 - RNA, 12 nt, Human
ccugcaggcagc

SEQ ID NO: 3301864 - RNA, 16 nt, Human
ccucuuucccucccuu

SEQ ID NO: 3301865 - RNA, 19 nt, Human
ccucuuucccucccuuccu

SEQ ID NO: 3301866 - RNA, 15 nt, Human
ccucuuugagugaag

SEQ ID NO: 3301867 - RNA, 15 nt, Human
ccugguggcaguggg

SEQ ID NO: 3301868 - RNA, 18 nt, Human
ccugguggcagugggagc

SEQ ID NO: 3301869 - RNA, 19 nt, Human
ccugguggcagugggagcu

SEQ ID NO: 3301870 - RNA, 13 nt, Human
ccugguguggaag

SEQ ID NO: 3301871 - RNA, 15 nt, Human
ccuggggagaaagua

SEQ ID NO: 3301872 - RNA, 20 nt, Human
ccuggccugagcugggauga

SEQ ID NO: 3301873 - RNA, 22 nt, Human
ccuggccucaagugauucuccu

SEQ ID NO: 3301874 - RNA, 21 nt, Human
ccuggccccucagggucccug

SEQ ID NO: 3301875 - RNA, 20 nt, Human
ccuggccccucagggucccu

SEQ ID NO: 3301876 - RNA, 18 nt, Human
ccuggccccucagggucc

SEQ ID NO: 3301877 - RNA, 16 nt, Human
ccuggccccucagggu

SEQ ID NO: 3301878 - RNA, 18 nt, Human
ccuggauggggcugcacc

SEQ ID NO: 3301879 - RNA, 17 nt, Human
ccuggauggggcugcac

SEQ ID NO: 3301880 - RNA, 15 nt, Human
ccuggauggggcugc

SEQ ID NO: 3301881 - RNA, 21 nt, Human
cacuacauucuguuaaucauu

SEQ ID NO: 3301882 - RNA, 17 nt, Human
cacuacauucuguuaau

SEQ ID NO: 3301883 - RNA, 16 nt, Human
cacuacauucuguuaa

SEQ ID NO: 3301884 - RNA, 13 nt, Human
cacuccagccugg

SEQ ID NO: 3301885 - RNA, 14 nt, Human
cacuccagccuggg

SEQ ID NO: 3301886 - RNA, 20 nt, Human
cacucugucgcccagucugg

SEQ ID NO: 3301887 - RNA, 14 nt, Human
cacggcucacugca

SEQ ID NO: 3301888 - RNA, 17 nt, Human
cacggccaggccagagg

SEQ ID NO: 3301889 - RNA, 12 nt, Human
cacggccaggcc

SEQ ID NO: 3301890 - RNA, 19 nt, Human
cacucuuauugcccacgcu

SEQ ID NO: 3301891 - RNA, 20 nt, Human
cacucuuauugcccacgcug

SEQ ID NO: 3301892 - RNA, 21 nt, Human
cacucuuauugcccacgcugg

SEQ ID NO: 3301893 - RNA, 22 nt, Human
cacucuuauugcccacgcugga

SEQ ID NO: 3301894 - RNA, 14 nt, Human
caccuuucccaucu

SEQ ID NO: 3301895 - RNA, 17 nt, Human
caccuuuguccccaccg

SEQ ID NO: 3301896 - RNA, 14 nt, Human
caccuuggcugcag

SEQ ID NO: 3301897 - RNA, 18 nt, Human
caccuuggcugcagggag

SEQ ID NO: 3301898 - RNA, 15 nt, Human
caccuuggcugcagg

SEQ ID NO: 3301899 - RNA, 16 nt, Human
caccuuggcugcaggg

SEQ ID NO: 3301900 - RNA, 16 nt, Human
cagaaguuucugccgc

SEQ ID NO: 3301901 - RNA, 14 nt, Human
cagaaguuucugcc

SEQ ID NO: 3301902 - RNA, 16 nt, Human
cagaaauguacagcaa

SEQ ID NO: 3301903 - RNA, 17 nt, Human
cacuguugcccaggcug

SEQ ID NO: 3301904 - RNA, 23 nt, Human
cacuguugcccaggcuggcgugc

SEQ ID NO: 3301905 - RNA, 18 nt, Human
cacuguugcccaggcugg

SEQ ID NO: 3301906 - RNA, 19 nt, Human
cacuguugcccaggcuggc

SEQ ID NO: 3301907 - RNA, 17 nt, Human
cacugccaugccagcuu

SEQ ID NO: 3301908 - RNA, 20 nt, Human
cacugcagccucaaccuccu

SEQ ID NO: 3301909 - RNA, 21 nt, Human
cacugcagccucaaccuccug

SEQ ID NO: 3301910 - RNA, 22 nt, Human
cacugcagccucaaccuccugg

SEQ ID NO: 3301911 - RNA, 23 nt, Human
cacugcagccucaaccuccuggg

SEQ ID NO: 3301912 - RNA, 19 nt, Human
cacugcagccucaaccucc

SEQ ID NO: 3301913 - RNA, 14 nt, Human
cacugcagccucaa

SEQ ID NO: 3301914 - RNA, 13 nt, Human
cacuuucuagcca

SEQ ID NO: 3301915 - RNA, 17 nt, Human
cacuuucuagccagagg

SEQ ID NO: 3301916 - RNA, 16 nt, Human
cacuuucuagccagag

SEQ ID NO: 3301917 - RNA, 18 nt, Human
cacuuguguuaugaagca

SEQ ID NO: 3301918 - RNA, 16 nt, Human
caaggcaaggcuguca

SEQ ID NO: 3301919 - RNA, 17 nt, Human
caaggcaaggcugucaa

SEQ ID NO: 3301920 - RNA, 18 nt, Human
caaggcaaggcugucaau

SEQ ID NO: 3301921 - RNA, 21 nt, Human
caaggccaaaggaagcacaug

SEQ ID NO: 3301922 - RNA, 20 nt, Human
caaggccaaaggaagcacau

SEQ ID NO: 3301923 - RNA, 19 nt, Human
caaggccaaaggaagcaca

SEQ ID NO: 3301924 - RNA, 19 nt, Human
cacaagagcccaggccucc

SEQ ID NO: 3301925 - RNA, 18 nt, Human
cacaagagcccaggccuc

SEQ ID NO: 3301926 - RNA, 19 nt, Human
cacaagcuccaagcuccca

SEQ ID NO: 3301927 - RNA, 18 nt, Human
cacaagcuccaagcuccc

SEQ ID NO: 3301928 - RNA, 20 nt, Human
cacaagagcccaggccuccu

SEQ ID NO: 3301929 - RNA, 17 nt, Human
cacaagagcccaggccu

SEQ ID NO: 3301930 - RNA, 16 nt, Human
caauggcagccuuggc

SEQ ID NO: 3301931 - RNA, 12 nt, Human
caaugcuggcug

SEQ ID NO: 3301932 - RNA, 20 nt, Human
caaugcuggcuguuggcugg

SEQ ID NO: 3301933 - RNA, 21 nt, Human
caaugcuggcuguuggcuggg

SEQ ID NO: 3301934 - RNA, 13 nt, Human
caaugcuggcugu

SEQ ID NO: 3301935 - RNA, 20 nt, Human
cacaagcuccaagcucccag

SEQ ID NO: 3301936 - RNA, 16 nt, Human
cacccaggagccccga

SEQ ID NO: 3301937 - RNA, 18 nt, Human
cacccaccucagccuccc

SEQ ID NO: 3301938 - RNA, 13 nt, Human
caccagccccagu

SEQ ID NO: 3301939 - RNA, 17 nt, Human
cacccaccucagccucc

SEQ ID NO: 3301940 - RNA, 20 nt, Human
cacauuuuauuuuauuaugc

SEQ ID NO: 3301941 - RNA, 19 nt, Human
cacauuuuauuuuauuaug

SEQ ID NO: 3301942 - RNA, 17 nt, Human
cacauuuuauuuuauua

SEQ ID NO: 3301943 - RNA, 14 nt, Human
caccaacgucugug

SEQ ID NO: 3301944 - RNA, 14 nt, Human
cacagacccugccc

SEQ ID NO: 3301945 - RNA, 13 nt, Human
cacagacccugcc

SEQ ID NO: 3301946 - RNA, 17 nt, Human
cacagacccugcccugu

SEQ ID NO: 3301947 - RNA, 16 nt, Human
cacagacccugcccug

SEQ ID NO: 3301948 - RNA, 11 nt, Human
cacagcucugu

SEQ ID NO: 3301949 - RNA, 14 nt, Human
cacagcucuguccu

SEQ ID NO: 3301950 - RNA, 17 nt, Human
cacagcucuucuccagg

SEQ ID NO: 3301951 - RNA, 14 nt, Human
cacagcucuucucc

SEQ ID NO: 3301952 - RNA, 15 nt, Human
cacagcucuucucca

SEQ ID NO: 3301953 - RNA, 15 nt, Human
cacagcucuguccug

SEQ ID NO: 3301954 - RNA, 16 nt, Human
cacagcucuguccugg

SEQ ID NO: 3301955 - RNA, 18 nt, Human
cacagcucuguccuggga

SEQ ID NO: 3301956 - RNA, 10 nt, Human
cacagcucuu

SEQ ID NO: 3301957 - RNA, 11 nt, Human
cacacauuuuu

SEQ ID NO: 3301958 - RNA, 10 nt, Human
cacacauuuu

SEQ ID NO: 3301959 - RNA, 20 nt, Human
cacacauuuuuuaaaugcac

SEQ ID NO: 3301960 - RNA, 19 nt, Human
cacacauuuuuuaaaugca

SEQ ID NO: 3301961 - RNA, 16 nt, Human
cacacauuuuuuaaau

SEQ ID NO: 3301962 - RNA, 12 nt, Human
cacacauuuuuu

SEQ ID NO: 3301963 - RNA, 16 nt, Human
caagaccacguuucua

SEQ ID NO: 3301964 - RNA, 18 nt, Human
caagaccacguuucuaaa

SEQ ID NO: 3301965 - RNA, 17 nt, Human
caagaccacguuucuaa

SEQ ID NO: 3301966 - RNA, 22 nt, Human
caagaauugaagcaggacuaaa

SEQ ID NO: 3301967 - RNA, 14 nt, Human
caacucuccuccag

SEQ ID NO: 3301968 - RNA, 18 nt, Human
caacucaccccagcccca

SEQ ID NO: 3301969 - RNA, 17 nt, Human
caacucaccccagcccc

SEQ ID NO: 3301970 - RNA, 22 nt, Human
caaagcagugcaugcugucccu

SEQ ID NO: 3301971 - RNA, 21 nt, Human
caaagcagugcaugcuguccc

SEQ ID NO: 3301972 - RNA, 18 nt, Human
caaagcagugcaugcugu

SEQ ID NO: 3301973 - RNA, 16 nt, Human
caaagauauuuugcuu

SEQ ID NO: 3301974 - RNA, 14 nt, Human
caaagauauuuugc

SEQ ID NO: 3301975 - RNA, 22 nt, Human
caaaguagaagucuuagaugua

SEQ ID NO: 3301976 - RNA, 21 nt, Human
caaaguaucccuacuguaauu

SEQ ID NO: 3301977 - RNA, 19 nt, Human
caaaguaucccuacuguaa

SEQ ID NO: 3301978 - RNA, 21 nt, Human
caaaucugcuuuuuaaagaau

SEQ ID NO: 3301979 - RNA, 23 nt, Human
caaaugcuguaacuuucugaaau

SEQ ID NO: 3301980 - RNA, 14 nt, Human
auuuuuagacagag

SEQ ID NO: 3301981 - RNA, 19 nt, Human
auuuuuaagugcugcauuu

SEQ ID NO: 3301982 - RNA, 18 nt, Human
auuuuuaagugcugcauu

SEQ ID NO: 3301983 - RNA, 16 nt, Human
auuuuuaagugcugca

SEQ ID NO: 3301984 - RNA, 16 nt, Human
auuuuuuugagacaga

SEQ ID NO: 3301985 - RNA, 18 nt, Human
auuuuuuuuuccuucagu

SEQ ID NO: 3301986 - RNA, 19 nt, Human
caaaagcugggcagguugg

SEQ ID NO: 3301987 - RNA, 17 nt, Human
auuuuuuuuuccuucag

SEQ ID NO: 3301988 - RNA, 22 nt, Human
auuuuuuuuuccuucagugccu

SEQ ID NO: 3301989 - RNA, 20 nt, Human
auuuuuuuuuccuucagugc

SEQ ID NO: 3301990 - RNA, 16 nt, Human
auuuaaugaaagacug

SEQ ID NO: 3301991 - RNA, 15 nt, Human
auuuaaugaaagacu

SEQ ID NO: 3301992 - RNA, 20 nt, Human
auuuaaugaaagacuguaca

SEQ ID NO: 3301993 - RNA, 14 nt, Human
auuucacucuccuu

SEQ ID NO: 3301994 - RNA, 18 nt, Human
auugcuugagcucaggag

SEQ ID NO: 3301995 - RNA, 23 nt, Human
auuaugcaugaaguaauaugcac

SEQ ID NO: 3301996 - RNA, 19 nt, Human
auuaaaugcccagccccuu

SEQ ID NO: 3301997 - RNA, 17 nt, Human
auuaaaugcccagcccc

SEQ ID NO: 3301998 - RNA, 18 nt, Human
auucaacagguuuuccug

SEQ ID NO: 3301999 - RNA, 14 nt, Human
auucuucugcuuca

SEQ ID NO: 3302000 - RNA, 14 nt, Human
auucuugcaaagua

SEQ ID NO: 3302001 - RNA, 16 nt, Human
auucuugcaaaguauc

SEQ ID NO: 3302002 - RNA, 15 nt, Human
auucuugcaaaguau

SEQ ID NO: 3302003 - RNA, 19 nt, Human
auucuucugcuucagccuc

SEQ ID NO: 3302004 - RNA, 20 nt, Human
auucuucugcuucagccucc

SEQ ID NO: 3302005 - RNA, 22 nt, Human
auucuucuguacgucugacagg

SEQ ID NO: 3302006 - RNA, 18 nt, Human
auucucuaguuugauuaa

SEQ ID NO: 3302007 - RNA, 17 nt, Human
auucucuaguuugauua

SEQ ID NO: 3302008 - RNA, 22 nt, Human
auucuccuuguguuacuaaguu

SEQ ID NO: 3302009 - RNA, 21 nt, Human
auucuccuuguguuacuaagu

SEQ ID NO: 3302010 - RNA, 19 nt, Human
auucuccuuguguuacuaa

SEQ ID NO: 3302011 - RNA, 18 nt, Human
auucuccuuguguuacua

SEQ ID NO: 3302012 - RNA, 17 nt, Human
auucuccuuguguuacu

SEQ ID NO: 3302013 - RNA, 15 nt, Human
cagcggggacagcuc

SEQ ID NO: 3302014 - RNA, 14 nt, Human
cagcggggacagcu

SEQ ID NO: 3302015 - RNA, 16 nt, Human
cagcggggacagcucc

SEQ ID NO: 3302016 - RNA, 17 nt, Human
cagcggggacagcuccu

SEQ ID NO: 3302017 - RNA, 21 nt, Human
cagccgagauagccaaggcca

SEQ ID NO: 3302018 - RNA, 20 nt, Human
cagccgagauagccaaggcc

SEQ ID NO: 3302019 - RNA, 15 nt, Human
cagcccuuagcaggg

SEQ ID NO: 3302020 - RNA, 16 nt, Human
cagcccuuagcaggga

SEQ ID NO: 3302021 - RNA, 21 nt, Human
cagcccuuagcagggaaacag

SEQ ID NO: 3302022 - RNA, 21 nt, Human
cagccccuggaugcagccuca

SEQ ID NO: 3302023 - RNA, 19 nt, Human
cagccccuggaugcagccu

SEQ ID NO: 3302024 - RNA, 18 nt, Human
cagccccuggaugcagcc

SEQ ID NO: 3302025 - RNA, 17 nt, Human
cagccccuggaugcagc

SEQ ID NO: 3302026 - RNA, 14 nt, Human
cagccccuggaugc

SEQ ID NO: 3302027 - RNA, 13 nt, Human
cagccccuggaug

SEQ ID NO: 3302028 - RNA, 12 nt, Human
cagccccuggau

SEQ ID NO: 3302029 - RNA, 18 nt, Human
cagcuucauuuccugugu

SEQ ID NO: 3302030 - RNA, 15 nt, Human
cagcuucauuuccug

SEQ ID NO: 3302031 - RNA, 18 nt, Human
cagcugugcucuggacag

SEQ ID NO: 3302032 - RNA, 15 nt, Human
caggaaaggcuccag

SEQ ID NO: 3302033 - RNA, 14 nt, Human
caggaaaggcucca

SEQ ID NO: 3302034 - RNA, 22 nt, Human
cagcuccagcucaccagcccca

SEQ ID NO: 3302035 - RNA, 16 nt, Human
cagcuccagcucacca

SEQ ID NO: 3302036 - RNA, 17 nt, Human
cagcuccagcucaccag

SEQ ID NO: 3302037 - RNA, 18 nt, Human
cagcuccagcucaccagc

SEQ ID NO: 3302038 - RNA, 20 nt, Human
cagcuccagcucaccagccc

SEQ ID NO: 3302039 - RNA, 13 nt, Human
cagcuccagcuca

SEQ ID NO: 3302040 - RNA, 14 nt, Human
cagcuccagcucac

SEQ ID NO: 3302041 - RNA, 15 nt, Human
cagcuccagcucacc

SEQ ID NO: 3302042 - RNA, 23 nt, Human
cagcauauucaggaagcucaggg

SEQ ID NO: 3302043 - RNA, 22 nt, Human
cagcauauucaggaagcucagg

SEQ ID NO: 3302044 - RNA, 19 nt, Human
cagcauauucaggaagcuc

SEQ ID NO: 3302045 - RNA, 13 nt, Human
cagccaggccaca

SEQ ID NO: 3302046 - RNA, 12 nt, Human
cagccaggccac

SEQ ID NO: 3302047 - RNA, 20 nt, Human
cagagucagaaguuucugcc

SEQ ID NO: 3302048 - RNA, 20 nt, Human
cagaggggguggccucccaa

SEQ ID NO: 3302049 - RNA, 19 nt, Human
cagaggggguggccuccca

SEQ ID NO: 3302050 - RNA, 17 nt, Human
cagaggggguggccucc

SEQ ID NO: 3302051 - RNA, 18 nt, Human
cagaggggguggccuccc

SEQ ID NO: 3302052 - RNA, 22 nt, Human
cagagggccugcaagggaguga

SEQ ID NO: 3302053 - RNA, 19 nt, Human
cagagggccugcaagggag

SEQ ID NO: 3302054 - RNA, 22 nt, Human
cagaaguuugagaucagccugg

SEQ ID NO: 3302055 - RNA, 23 nt, Human
cagaaguuucugccgcagcccug

SEQ ID NO: 3302056 - RNA, 20 nt, Human
cagaaguuugagaucagccu

SEQ ID NO: 3302057 - RNA, 18 nt, Human
cagagcugccaccugccu

SEQ ID NO: 3302058 - RNA, 16 nt, Human
cagagcugccaccugc

SEQ ID NO: 3302059 - RNA, 17 nt, Human
caggcugggcuucagug

SEQ ID NO: 3302060 - RNA, 16 nt, Human
caggcugggcuucagu

SEQ ID NO: 3302061 - RNA, 15 nt, Human
caggcugggcuucag

SEQ ID NO: 3302062 - RNA, 22 nt, Human
cagggaguccgaaagggacuug

SEQ ID NO: 3302063 - RNA, 18 nt, Human
cagggaggugaccccagg

SEQ ID NO: 3302064 - RNA, 16 nt, Human
caggccagagggagug

SEQ ID NO: 3302065 - RNA, 19 nt, Human
caggccagagggagugaca

SEQ ID NO: 3302066 - RNA, 21 nt, Human
caggccagagggagugacaga

SEQ ID NO: 3302067 - RNA, 17 nt, Human
caggaggccagccuuga

SEQ ID NO: 3302068 - RNA, 22 nt, Human
caggcacccaccaucaugucug

SEQ ID NO: 3302069 - RNA, 23 nt, Human
caggcacccaccaucaugucugg

SEQ ID NO: 3302070 - RNA, 18 nt, Human
caggcacccaccaucaug

SEQ ID NO: 3302071 - RNA, 16 nt, Human
caggaggccagccuug

SEQ ID NO: 3302072 - RNA, 15 nt, Human
caggaggccagccuu

SEQ ID NO: 3302073 - RNA, 14 nt, Human
caggaggccagccu

SEQ ID NO: 3302074 - RNA, 15 nt, Human
cagugccaaaaacaa

SEQ ID NO: 3302075 - RNA, 11 nt, Human
cagugggagcu

SEQ ID NO: 3302076 - RNA, 12 nt, Human
cagugcccacag

SEQ ID NO: 3302077 - RNA, 19 nt, Human
cagucugauucccaagcuc

SEQ ID NO: 3302078 - RNA, 20 nt, Human
cagucugauucccaagcucu

SEQ ID NO: 3302079 - RNA, 19 nt, Human
cagugcaugcugucccuua

SEQ ID NO: 3302080 - RNA, 23 nt, Human
cagugcaugcugucccuuacgug

SEQ ID NO: 3302081 - RNA, 22 nt, Human
cagugcaugcugucccuuacgu

SEQ ID NO: 3302082 - RNA, 21 nt, Human
cagggucucacucugucgccc

SEQ ID NO: 3302083 - RNA, 17 nt, Human
cagggucucacucuguc

SEQ ID NO: 3302084 - RNA, 18 nt, Human
cagggucucacucugucg

SEQ ID NO: 3302085 - RNA, 14 nt, Human
caggugcgaaagga

SEQ ID NO: 3302086 - RNA, 20 nt, Human
caggugcuaggaacacuccu

SEQ ID NO: 3302087 - RNA, 18 nt, Human
caggugcuaggaacacuc

SEQ ID NO: 3302088 - RNA, 14 nt, Human
cagguugguggggg

SEQ ID NO: 3302089 - RNA, 12 nt, Human
caggguuggccc

SEQ ID NO: 3302090 - RNA, 16 nt, Human
caggugauccacccac

SEQ ID NO: 3302091 - RNA, 17 nt, Human
caggugauccacccacc

SEQ ID NO: 3302092 - RNA, 22 nt, Human
caggugcacaagcuccaagcuc

SEQ ID NO: 3302093 - RNA, 19 nt, Human
cagucaccccggccaccug

SEQ ID NO: 3302094 - RNA, 20 nt, Human
cagucaccccggccaccugc

SEQ ID NO: 3302095 - RNA, 22 nt, Human
cagucaccccggccaccugcgg

SEQ ID NO: 3302096 - RNA, 16 nt, Human
cagguuuaagcuguua

SEQ ID NO: 3302097 - RNA, 14 nt, Human
cagguuuaagcugu

SEQ ID NO: 3302098 - RNA, 18 nt, Human
cagguuuaagcuguuacu

SEQ ID NO: 3302099 - RNA, 17 nt, Human
caucccagccccaauga

SEQ ID NO: 3302100 - RNA, 19 nt, Human
caucaggccaggcccucug

SEQ ID NO: 3302101 - RNA, 16 nt, Human
caucaggccaggcccu

SEQ ID NO: 3302102 - RNA, 14 nt, Human
caucaggccaggcc

SEQ ID NO: 3302103 - RNA, 15 nt, Human
caucaggccaggccc

SEQ ID NO: 3302104 - RNA, 14 nt, Human
cauccccuguagag

SEQ ID NO: 3302105 - RNA, 19 nt, Human
caucccauaugccugggca

SEQ ID NO: 3302106 - RNA, 19 nt, Human
cauagcagagaaugaaagg

SEQ ID NO: 3302107 - RNA, 22 nt, Human
cauagcagagaaugaaagggcc

SEQ ID NO: 3302108 - RNA, 20 nt, Human
cauaugccugggcagaagga

SEQ ID NO: 3302109 - RNA, 15 nt, Human
cauaugccugggcag

SEQ ID NO: 3302110 - RNA, 13 nt, Human
cauaugccugggc

SEQ ID NO: 3302111 - RNA, 22 nt, Human
cauaugccugggcagaaggaag

SEQ ID NO: 3302112 - RNA, 15 nt, Human
cauauucaggaagcu

SEQ ID NO: 3302113 - RNA, 14 nt, Human
cauauucaggaagc

SEQ ID NO: 3302114 - RNA, 20 nt, Human
cauauucaggaagcucaggg

SEQ ID NO: 3302115 - RNA, 23 nt, Human
cauuaucuagauacuguaucaug

SEQ ID NO: 3302116 - RNA, 22 nt, Human
cauuaggugugacugaauuucu

SEQ ID NO: 3302117 - RNA, 12 nt, Human
cauguuggccag

SEQ ID NO: 3302118 - RNA, 16 nt, Human
cauguccaagaagccc

SEQ ID NO: 3302119 - RNA, 18 nt, Human
cauguccaagaagcccag

SEQ ID NO: 3302120 - RNA, 20 nt, Human
cauguccaagaagcccagga

SEQ ID NO: 3302121 - RNA, 19 nt, Human
cauguccaagaagcccagg

SEQ ID NO: 3302122 - RNA, 12 nt, Human
cauuccuguucc

SEQ ID NO: 3302123 - RNA, 14 nt, Human
caugcugcccugug

SEQ ID NO: 3302124 - RNA, 23 nt, Human
caugacacgaauauugcugaugg

SEQ ID NO: 3302125 - RNA, 21 nt, Human
caugacacgaauauugcugau

SEQ ID NO: 3302126 - RNA, 23 nt, Human
caugaaguaauaugcacacauuu

SEQ ID NO: 3302127 - RNA, 22 nt, Human
caugaaguaauaugcacacauu

SEQ ID NO: 3302128 - RNA, 19 nt, Human
caugaaguaauaugcacac

SEQ ID NO: 3302129 - RNA, 15 nt, Human
caugaaguaauaugc

SEQ ID NO: 3302130 - RNA, 16 nt, Human
caugcacgugugugca

SEQ ID NO: 3302131 - RNA, 13 nt, Human
caugcuccuggcc

SEQ ID NO: 3302132 - RNA, 13 nt, Human
caugcugcccugu

SEQ ID NO: 3302133 - RNA, 12 nt, Human
caugcugcccug

SEQ ID NO: 3302134 - RNA, 23 nt, Human
caugauuaaccacuucagcugac

SEQ ID NO: 3302135 - RNA, 22 nt, Human
caugauuaaccacuucagcuga

SEQ ID NO: 3302136 - RNA, 15 nt, Human
cauuuggauuggaug

SEQ ID NO: 3302137 - RNA, 17 nt, Human
cauuugucacacacuuu

SEQ ID NO: 3302138 - RNA, 14 nt, Human
cauuuauucugcuc

SEQ ID NO: 3302139 - RNA, 16 nt, Human
cauuuuuuaaaugcac

SEQ ID NO: 3302140 - RNA, 15 nt, Human
cauuuuuuaaaugca

SEQ ID NO: 3302141 - RNA, 19 nt, Human
cauuuuuuaaaugcaccug

SEQ ID NO: 3302142 - RNA, 12 nt, Human
ccaagcuggucc

SEQ ID NO: 3302143 - RNA, 19 nt, Human
ccaagcuggucccacucag

SEQ ID NO: 3302144 - RNA, 14 nt, Human
ccaagaagcccagg

SEQ ID NO: 3302145 - RNA, 15 nt, Human
ccaaggccaaaggaa

SEQ ID NO: 3302146 - RNA, 22 nt, Human
ccaaauggaaaugggcagagca

SEQ ID NO: 3302147 - RNA, 15 nt, Human
ccaacgucugugcca

SEQ ID NO: 3302148 - RNA, 13 nt, Human
ccaacgucugugc

SEQ ID NO: 3302149 - RNA, 13 nt, Human
ccaagaagcccag

SEQ ID NO: 3302150 - RNA, 22 nt, Human
ccacagagaaaguacuucucca

SEQ ID NO: 3302151 - RNA, 18 nt, Human
ccacgcuggaccuugaac

SEQ ID NO: 3302152 - RNA, 18 nt, Human
ccaccuuggcugcaggga

SEQ ID NO: 3302153 - RNA, 19 nt, Human
ccaccuuggcugcagggag

SEQ ID NO: 3302154 - RNA, 12 nt, Human
ccaccuuggcug

SEQ ID NO: 3302155 - RNA, 14 nt, Human
ccaccuuggcugca

SEQ ID NO: 3302156 - RNA, 15 nt, Human
ccaccuuggcugcag

SEQ ID NO: 3302157 - RNA, 16 nt, Human
ccaccuuggcugcagg

SEQ ID NO: 3302158 - RNA, 19 nt, Human
ccaccaucaugucuggcua

SEQ ID NO: 3302159 - RNA, 18 nt, Human
ccaccaucaccagacagg

SEQ ID NO: 3302160 - RNA, 18 nt, Human
ccaccaucaugucuggcu

SEQ ID NO: 3302161 - RNA, 17 nt, Human
gaaccaccacacccagc

SEQ ID NO: 3302162 - RNA, 23 nt, Human
gaaccaccacacccagcccacuu

SEQ ID NO: 3302163 - RNA, 22 nt, Human
gaaccauggucggaaaacaugc

SEQ ID NO: 3302164 - RNA, 13 nt, Human
gaacuccuggccu

SEQ ID NO: 3302165 - RNA, 14 nt, Human
gaacuccuggccuc

SEQ ID NO: 3302166 - RNA, 16 nt, Human
gaagacacugaugggc

SEQ ID NO: 3302167 - RNA, 21 nt, Human
gaagacacugaugggcaaccc

SEQ ID NO: 3302168 - RNA, 13 nt, Human
gaagacagcucuu

SEQ ID NO: 3302169 - RNA, 12 nt, Human
gaagacagcucu

SEQ ID NO: 3302170 - RNA, 15 nt, Human
gaagacagagcuaca

SEQ ID NO: 3302171 - RNA, 13 nt, Human
gaagacagagcua

SEQ ID NO: 3302172 - RNA, 15 nt, Human
gaagacagcucuuau

SEQ ID NO: 3302173 - RNA, 14 nt, Human
gaagacagcucuua

SEQ ID NO: 3302174 - RNA, 21 nt, Human
gaagcacaugccucucucagg

SEQ ID NO: 3302175 - RNA, 16 nt, Human
gaagcaccauaacuuu

SEQ ID NO: 3302176 - RNA, 13 nt, Human
gaagcacagcuuc

SEQ ID NO: 3302177 - RNA, 14 nt, Human
gaagcacagcuuca

SEQ ID NO: 3302178 - RNA, 22 nt, Human
gaagcacaugccucucucaggc

SEQ ID NO: 3302179 - RNA, 17 nt, Human
gaagacucauucuucug

SEQ ID NO: 3302180 - RNA, 18 nt, Human
gaagacucauucuucugu

SEQ ID NO: 3302181 - RNA, 16 nt, Human
gaagacucauucuucu

SEQ ID NO: 3302182 - RNA, 18 nt, Human
gaaccaccacacccagcc

SEQ ID NO: 3302183 - RNA, 20 nt, Human
gaaccaccacacccagccca

SEQ ID NO: 3302184 - RNA, 21 nt, Human
gaaccaccacacccagcccac

SEQ ID NO: 3302185 - RNA, 22 nt, Human
gaaccaccacacccagcccacu

SEQ ID NO: 3302186 - RNA, 23 nt, Human
gaaaagaaaaaugagccuggcaa

SEQ ID NO: 3302187 - RNA, 17 nt, Human
gaaacuggauuaaacuu

SEQ ID NO: 3302188 - RNA, 13 nt, Human
gaaacuggauuaa

SEQ ID NO: 3302189 - RNA, 21 nt, Human
gaaagaaaauaccaaggaaca

SEQ ID NO: 3302190 - RNA, 13 nt, Human
gaaaggcuccagg

SEQ ID NO: 3302191 - RNA, 15 nt, Human
gaaaggcuccaggag

SEQ ID NO: 3302192 - RNA, 14 nt, Human
gaaaggcuccagga

SEQ ID NO: 3302193 - RNA, 12 nt, Human
gaaaggcuccag

SEQ ID NO: 3302194 - RNA, 13 nt, Human
gaaagggcccaga

SEQ ID NO: 3302195 - RNA, 15 nt, Human
gaaagggcccagaga

SEQ ID NO: 3302196 - RNA, 16 nt, Human
gaaagggcccagagag

SEQ ID NO: 3302197 - RNA, 14 nt, Human
cuugguccugcugc

SEQ ID NO: 3302198 - RNA, 22 nt, Human
cuugguagaagcccuucuaccu

SEQ ID NO: 3302199 - RNA, 19 nt, Human
cuuggugucgggcaugaca

SEQ ID NO: 3302200 - RNA, 15 nt, Human
cuugucuuuggaccc

SEQ ID NO: 3302201 - RNA, 13 nt, Human
cuugucuuuggac

SEQ ID NO: 3302202 - RNA, 18 nt, Human
cuugucuuuggacccuga

SEQ ID NO: 3302203 - RNA, 23 nt, Human
cuuuaaugucacaggcaggucca

SEQ ID NO: 3302204 - RNA, 15 nt, Human
cuuucacccuuuucu

SEQ ID NO: 3302205 - RNA, 14 nt, Human
cuuucacccuuuuc

SEQ ID NO: 3302206 - RNA, 20 nt, Human
cuuucacccuuuucuguuug

SEQ ID NO: 3302207 - RNA, 15 nt, Human
cuuucuacccagcga

SEQ ID NO: 3302208 - RNA, 16 nt, Human
cuuucuacccagcgag

SEQ ID NO: 3302209 - RNA, 17 nt, Human
cuuugacgccaucccag

SEQ ID NO: 3302210 - RNA, 16 nt, Human
cuuugacgccauccca

SEQ ID NO: 3302211 - RNA, 21 nt, Human
cuuuuauaaacuuuaccuuuu

SEQ ID NO: 3302212 - RNA, 20 nt, Human
cuuuuauaaacuuuaccuuu

SEQ ID NO: 3302213 - RNA, 22 nt, Human
cuuuguauucucuccuguaccu

SEQ ID NO: 3302214 - RNA, 19 nt, Human
cuuuuauaaacuuuaccuu

SEQ ID NO: 3302215 - RNA, 17 nt, Human
cuuuguauucucuccug

SEQ ID NO: 3302216 - RNA, 13 nt, Human
cuuccuccuggug

SEQ ID NO: 3302217 - RNA, 22 nt, Human
cuuccucuuuccaucuacccuc

SEQ ID NO: 3302218 - RNA, 21 nt, Human
cuuccucuuuccaucuacccu

SEQ ID NO: 3302219 - RNA, 14 nt, Human
cuucuucagagacu

SEQ ID NO: 3302220 - RNA, 13 nt, Human
cuucuucagagac

SEQ ID NO: 3302221 - RNA, 23 nt, Human
cuucugaacuuggcgcugccccu

SEQ ID NO: 3302222 - RNA, 23 nt, Human
cuugaaugaugccaugaggaaca

SEQ ID NO: 3302223 - RNA, 20 nt, Human
cuugacagggcacaccgggc

SEQ ID NO: 3302224 - RNA, 16 nt, Human
cuugacaucaacugca

SEQ ID NO: 3302225 - RNA, 17 nt, Human
cuugauauccucuuuga

SEQ ID NO: 3302226 - RNA, 22 nt, Human
cuugauauccucuuugagugaa

SEQ ID NO: 3302227 - RNA, 18 nt, Human
cuugauguguuaucucuu

SEQ ID NO: 3302228 - RNA, 15 nt, Human
cuugauguguuaucu

SEQ ID NO: 3302229 - RNA, 22 nt, Human
cuuggauuguccccgacccuug

SEQ ID NO: 3302230 - RNA, 24 nt, Human
cuuggauuguccccgacccuugcc

SEQ ID NO: 3302231 - RNA, 23 nt, Human
cuuggauuguccccgacccuugc

SEQ ID NO: 3302232 - RNA, 12 nt, Human
cuugcaaaguau

SEQ ID NO: 3302233 - RNA, 14 nt, Human
cugcuucaaauauu

SEQ ID NO: 3302234 - RNA, 21 nt, Human
cugcuucaaggauccugagcc

SEQ ID NO: 3302235 - RNA, 12 nt, Human
cugcuucaagga

SEQ ID NO: 3302236 - RNA, 19 nt, Human
cugcuucaaauauuucccu

SEQ ID NO: 3302237 - RNA, 23 nt, Human
cugcuucaaggauccugagccag

SEQ ID NO: 3302238 - RNA, 22 nt, Human
cugcuucaaggauccugagcca

SEQ ID NO: 3302239 - RNA, 20 nt, Human
cugcuuuugucuaugggacu

SEQ ID NO: 3302240 - RNA, 20 nt, Human
cugcuucaaggauccugagc

SEQ ID NO: 3302241 - RNA, 19 nt, Human
cugcuuuugucuaugggac

SEQ ID NO: 3302242 - RNA, 21 nt, Human
cugcuuuugucuaugggacuc

SEQ ID NO: 3302243 - RNA, 15 nt, Human
cugccucucccauca

SEQ ID NO: 3302244 - RNA, 22 nt, Human
cugccucucccaucacuucccu

SEQ ID NO: 3302245 - RNA, 23 nt, Human
cugccucucccaucacuucccua

SEQ ID NO: 3302246 - RNA, 17 nt, Human
cugccuguucagcucca

SEQ ID NO: 3302247 - RNA, 18 nt, Human
cugccuguucagcuccag

SEQ ID NO: 3302248 - RNA, 19 nt, Human
cugccuguucagcuccagc

SEQ ID NO: 3302249 - RNA, 20 nt, Human
cugccuguugggccaggagc

SEQ ID NO: 3302250 - RNA, 21 nt, Human
cugcugacuguuuucucuuga

SEQ ID NO: 3302251 - RNA, 18 nt, Human
cugcugacuguuuucucu

SEQ ID NO: 3302252 - RNA, 22 nt, Human
cugccuguugggccaggagccu

SEQ ID NO: 3302253 - RNA, 21 nt, Human
cugccuguugggccaggagcc

SEQ ID NO: 3302254 - RNA, 15 nt, Human
cugccuguucagcuc

SEQ ID NO: 3302255 - RNA, 18 nt, Human
cuggcagaguugaagaca

SEQ ID NO: 3302256 - RNA, 17 nt, Human
cuggcagaguugaagac

SEQ ID NO: 3302257 - RNA, 12 nt, Human
cuggcagccccu

SEQ ID NO: 3302258 - RNA, 11 nt, Human
cuggcagccca

SEQ ID NO: 3302259 - RNA, 22 nt, Human
cuggccccucagggucccuggu

SEQ ID NO: 3302260 - RNA, 12 nt, Human
cugggcagaagg

SEQ ID NO: 3302261 - RNA, 15 nt, Human
cugggcagaaggaag

SEQ ID NO: 3302262 - RNA, 14 nt, Human
cuggggagaaagua

SEQ ID NO: 3302263 - RNA, 18 nt, Human
cuggguucacugcaaccu

SEQ ID NO: 3302264 - RNA, 20 nt, Human
cuggguucacugcaaccucc

SEQ ID NO: 3302265 - RNA, 15 nt, Human
cuggguucacugcaa

SEQ ID NO: 3302266 - RNA, 18 nt, Human
cugugccucugggacugg

SEQ ID NO: 3302267 - RNA, 14 nt, Human
cugugcugcccugc

SEQ ID NO: 3302268 - RNA, 13 nt, Human
cugugcugcccug

SEQ ID NO: 3302269 - RNA, 12 nt, Human
cugugcugcccu

SEQ ID NO: 3302270 - RNA, 19 nt, Human
cugugucagcauagaagua

SEQ ID NO: 3302271 - RNA, 17 nt, Human
cugugucagcauagaag

SEQ ID NO: 3302272 - RNA, 19 nt, Human
cugugcugcccugcccacc

SEQ ID NO: 3302273 - RNA, 18 nt, Human
cugugcugcccugcccac

SEQ ID NO: 3302274 - RNA, 17 nt, Human
cugugcugcccugccca

SEQ ID NO: 3302275 - RNA, 15 nt, Human
cugugcugcccugcc

SEQ ID NO: 3302276 - RNA, 15 nt, Human
cugucgcccagucug

SEQ ID NO: 3302277 - RNA, 16 nt, Human
cugucgcccagucugg

SEQ ID NO: 3302278 - RNA, 20 nt, Human
cugucaauuacaggaaguac

SEQ ID NO: 3302279 - RNA, 19 nt, Human
cugucaauuacaggaagua

SEQ ID NO: 3302280 - RNA, 23 nt, Human
cugucaauuacaggaaguacugg

SEQ ID NO: 3302281 - RNA, 21 nt, Human
cuguccugggagugagcuggu

SEQ ID NO: 3302282 - RNA, 13 nt, Human
cuguagaguggga

SEQ ID NO: 3302283 - RNA, 19 nt, Human
cuuagggaaggauacaaaa

SEQ ID NO: 3302284 - RNA, 21 nt, Human
cuuagggaaggauacaaaagc

SEQ ID NO: 3302285 - RNA, 21 nt, Human
cuuagcagggaaacagcuaau

SEQ ID NO: 3302286 - RNA, 16 nt, Human
cuuaccagcagagcac

SEQ ID NO: 3302287 - RNA, 22 nt, Human
cuuagcucauucuccuuguguu

SEQ ID NO: 3302288 - RNA, 23 nt, Human
cuuagcucauucuccuuguguua

SEQ ID NO: 3302289 - RNA, 15 nt, Human
cuguuggccagugug

SEQ ID NO: 3302290 - RNA, 19 nt, Human
cuguuggcugggggccuca

SEQ ID NO: 3302291 - RNA, 22 nt, Human
cuguuggcugggggccucagug

SEQ ID NO: 3302292 - RNA, 14 nt, Human
cuguuggcuggggg

SEQ ID NO: 3302293 - RNA, 15 nt, Human
cuuaccagcagagca

SEQ ID NO: 3302294 - RNA, 14 nt, Human
cuuaaaacaacacu

SEQ ID NO: 3302295 - RNA, 19 nt, Human
gauucuccugccucagccu

SEQ ID NO: 3302296 - RNA, 20 nt, Human
gauucuccugccucagccuc

SEQ ID NO: 3302297 - RNA, 21 nt, Human
gauucuccugccucagccucc

SEQ ID NO: 3302298 - RNA, 23 nt, Human
gauuuaacagaaauguacagcaa

SEQ ID NO: 3302299 - RNA, 20 nt, Human
gauuuaacagaaauguacag

SEQ ID NO: 3302300 - RNA, 23 nt, Human
gauucuuauggacaaugacccag

SEQ ID NO: 3302301 - RNA, 21 nt, Human
gauucuucugcuucagccucc

SEQ ID NO: 3302302 - RNA, 20 nt, Human
gauucuucugcuucagccuc

SEQ ID NO: 3302303 - RNA, 16 nt, Human
gauuucacucuccuug

SEQ ID NO: 3302304 - RNA, 13 nt, Human
gauuucacucucc

SEQ ID NO: 3302305 - RNA, 19 nt, Human
gauuuaacagaaauguaca

SEQ ID NO: 3302306 - RNA, 18 nt, Human
gauuucacucuccuuggu

SEQ ID NO: 3302307 - RNA, 17 nt, Human
gauuucacucuccuugg

SEQ ID NO: 3302308 - RNA, 22 nt, Human
gauuuuuuuuuccuucagugcc

SEQ ID NO: 3302309 - RNA, 23 nt, Human
gauuuuuuuuuccuucagugccu

SEQ ID NO: 3302310 - RNA, 18 nt, Human
gaucuggguucacugcaa

SEQ ID NO: 3302311 - RNA, 21 nt, Human
gaugaugaaaugaggucagag

SEQ ID NO: 3302312 - RNA, 16 nt, Human
gaugcuuguacauaau

SEQ ID NO: 3302313 - RNA, 14 nt, Human
gaugcuuguacaua

SEQ ID NO: 3302314 - RNA, 11 nt, Human
gcaauaaagca

SEQ ID NO: 3302315 - RNA, 23 nt, Human
gcaauaaggggagaguaacccug

SEQ ID NO: 3302316 - RNA, 12 nt, Human
gcacacaccaga

SEQ ID NO: 3302317 - RNA, 14 nt, Human
gcacacaccagagc

SEQ ID NO: 3302318 - RNA, 15 nt, Human
gcacacaccagagcc

SEQ ID NO: 3302319 - RNA, 16 nt, Human
gcacacaccagagccc

SEQ ID NO: 3302320 - RNA, 17 nt, Human
gcacacaccagagccca

SEQ ID NO: 3302321 - RNA, 18 nt, Human
gcacacaccagagcccac

SEQ ID NO: 3302322 - RNA, 19 nt, Human
gcacacaccagagcccacc

SEQ ID NO: 3302323 - RNA, 18 nt, Human
gcaaccuccgccucuugg

SEQ ID NO: 3302324 - RNA, 22 nt, Human
gcaacccuggugaccagcacca

SEQ ID NO: 3302325 - RNA, 17 nt, Human
gcaacccccagccugcu

SEQ ID NO: 3302326 - RNA, 16 nt, Human
gcaaaagaugcuucuc

SEQ ID NO: 3302327 - RNA, 18 nt, Human
gcaacccccagccugcua

SEQ ID NO: 3302328 - RNA, 15 nt, Human
gcaaaagaugcuucu

SEQ ID NO: 3302329 - RNA, 22 nt, Human
gcacuauaauguaagcucuacu

SEQ ID NO: 3302330 - RNA, 22 nt, Human
gcacuauagccuaggugacaga

SEQ ID NO: 3302331 - RNA, 15 nt, Human
gcacuccagccuggg

SEQ ID NO: 3302332 - RNA, 17 nt, Human
gcacuccagccugggug

SEQ ID NO: 3302333 - RNA, 12 nt, Human
gcaccuccugcc

SEQ ID NO: 3302334 - RNA, 16 nt, Human
gcaccggcuggccugg

SEQ ID NO: 3302335 - RNA, 15 nt, Human
gcaccggcuggccug

SEQ ID NO: 3302336 - RNA, 17 nt, Human
gcaccggcuggccuggc

SEQ ID NO: 3302337 - RNA, 11 nt, Human
gcacacauuuu

SEQ ID NO: 3302338 - RNA, 12 nt, Human
gcacacauuuuu

SEQ ID NO: 3302339 - RNA, 20 nt, Human
gcacacaccagagcccaccu

SEQ ID NO: 3302340 - RNA, 19 nt, Human
gcagcugcgguccacccag

SEQ ID NO: 3302341 - RNA, 22 nt, Human
gcagcugcgguccacccaggag

SEQ ID NO: 3302342 - RNA, 23 nt, Human
gcagcugcgguccacccaggagc

SEQ ID NO: 3302343 - RNA, 13 nt, Human
gcagcugcuuuug

SEQ ID NO: 3302344 - RNA, 20 nt, Human
gcagcugcuuuugucuaugg

SEQ ID NO: 3302345 - RNA, 16 nt, Human
gcagcuugaggguugg

SEQ ID NO: 3302346 - RNA, 19 nt, Human
gcagcuugaggguugggcu

SEQ ID NO: 3302347 - RNA, 21 nt, Human
gcagcuugaggguugggcugg

SEQ ID NO: 3302348 - RNA, 12 nt, Human
gcaggcucucag

SEQ ID NO: 3302349 - RNA, 22 nt, Human
gcaggcucgggcuccccagccc

SEQ ID NO: 3302350 - RNA, 16 nt, Human
gcaggcucucaggcca

SEQ ID NO: 3302351 - RNA, 15 nt, Human
gcaggcucucaggcc

SEQ ID NO: 3302352 - RNA, 14 nt, Human
gcaggcucucaggc

SEQ ID NO: 3302353 - RNA, 13 nt, Human
gcaggcucucagg

SEQ ID NO: 3302354 - RNA, 17 nt, Human
gcaggcucucaggccag

SEQ ID NO: 3302355 - RNA, 13 nt, Human
gcagggaaacagc

SEQ ID NO: 3302356 - RNA, 22 nt, Human
gcagggaaacagcuaaugggac

SEQ ID NO: 3302357 - RNA, 15 nt, Human
gcauaccacuuuugu

SEQ ID NO: 3302358 - RNA, 15 nt, Human
gcauaaaaauuagcc

SEQ ID NO: 3302359 - RNA, 23 nt, Human
gcaguugccagucaccccggcca

SEQ ID NO: 3302360 - RNA, 14 nt, Human
gcaguugccaguca

SEQ ID NO: 3302361 - RNA, 11 nt, Human
gccaaggccaa

SEQ ID NO: 3302362 - RNA, 17 nt, Human
gccaaggccaaaggaag

SEQ ID NO: 3302363 - RNA, 17 nt, Human
gcauccuggcacccggc

SEQ ID NO: 3302364 - RNA, 21 nt, Human
gcauccuggcacccggccccu

SEQ ID NO: 3302365 - RNA, 14 nt, Human
gcauccuggcaccc

SEQ ID NO: 3302366 - RNA, 22 nt, Human
gcauccuggcacccggccccug

SEQ ID NO: 3302367 - RNA, 23 nt, Human
gcauccuggcacccggccccugc

SEQ ID NO: 3302368 - RNA, 17 nt, Human
gcaugugaugagaggaa

SEQ ID NO: 3302369 - RNA, 19 nt, Human
gcaugggaaugaaugucag

SEQ ID NO: 3302370 - RNA, 16 nt, Human
gcaugggaaugaaugu

SEQ ID NO: 3302371 - RNA, 13 nt, Human
gcaugggaaugaa

SEQ ID NO: 3302372 - RNA, 12 nt, Human
gcauuuaaaaga

SEQ ID NO: 3302373 - RNA, 18 nt, Human
gcauugugggaaggggag

SEQ ID NO: 3302374 - RNA, 16 nt, Human
gcauuugaaaauuuug

SEQ ID NO: 3302375 - RNA, 14 nt, Human
gcauuugaaaauuu

SEQ ID NO: 3302376 - RNA, 18 nt, Human
gccaagaauucuuaaaua

SEQ ID NO: 3302377 - RNA, 14 nt, Human
gccaagaauucuua

SEQ ID NO: 3302378 - RNA, 13 nt, Human
gacagcuccuucu

SEQ ID NO: 3302379 - RNA, 14 nt, Human
gacagcuccuucug

SEQ ID NO: 3302380 - RNA, 15 nt, Human
gacagcuccuucugu

SEQ ID NO: 3302381 - RNA, 11 nt, Human
gacagcuccuu

SEQ ID NO: 3302382 - RNA, 15 nt, Human
gaccaucccugaagg

SEQ ID NO: 3302383 - RNA, 14 nt, Human
gaccaucccugaag

SEQ ID NO: 3302384 - RNA, 16 nt, Human
gaccauucuccaccug

SEQ ID NO: 3302385 - RNA, 17 nt, Human
gaccaucccugaaggcc

SEQ ID NO: 3302386 - RNA, 16 nt, Human
gaccaucccugaaggc

SEQ ID NO: 3302387 - RNA, 12 nt, Human
gacccggcugcg

SEQ ID NO: 3302388 - RNA, 13 nt, Human
gacccggcugcgu

SEQ ID NO: 3302389 - RNA, 16 nt, Human
gacccuauugcugcuu

SEQ ID NO: 3302390 - RNA, 13 nt, Human
gacgcugugcugc

SEQ ID NO: 3302391 - RNA, 12 nt, Human
gacgcugugcug

SEQ ID NO: 3302392 - RNA, 21 nt, Human
gacuuuucuguccgagcuuug

SEQ ID NO: 3302393 - RNA, 20 nt, Human
gacuuuuccaacccucauca

SEQ ID NO: 3302394 - RNA, 22 nt, Human
gacuuuguuaguuucuccaagc

SEQ ID NO: 3302395 - RNA, 14 nt, Human
gacuuuggaaagag

SEQ ID NO: 3302396 - RNA, 14 nt, Human
gacuuuggaaagac

SEQ ID NO: 3302397 - RNA, 18 nt, Human
gacuguuuucucuugaga

SEQ ID NO: 3302398 - RNA, 16 nt, Human
gacuguuuucucuuga

SEQ ID NO: 3302399 - RNA, 22 nt, Human
gacuguacaaaguagaagucuu

SEQ ID NO: 3302400 - RNA, 17 nt, Human
gacucaaugcacugaca

SEQ ID NO: 3302401 - RNA, 14 nt, Human
gacucaaugcacug

SEQ ID NO: 3302402 - RNA, 16 nt, Human
gagaagcggcuggcag

SEQ ID NO: 3302403 - RNA, 17 nt, Human
gagaagcggcuggcagc

SEQ ID NO: 3302404 - RNA, 19 nt, Human
gaggccagagacacaagcc

SEQ ID NO: 3302405 - RNA, 20 nt, Human
gaggccagagacacaagccu

SEQ ID NO: 3302406 - RNA, 14 nt, Human
gaggcucugcccuu

SEQ ID NO: 3302407 - RNA, 13 nt, Human
gaggcucugcccu

SEQ ID NO: 3302408 - RNA, 12 nt, Human
gaggcucugccc

SEQ ID NO: 3302409 - RNA, 17 nt, Human
gaggcucugcccuuggu

SEQ ID NO: 3302410 - RNA, 15 nt, Human
gaggcucugcccuug

SEQ ID NO: 3302411 - RNA, 12 nt, Human
gaggggaacaga

SEQ ID NO: 3302412 - RNA, 15 nt, Human
gagggcuccagacac

SEQ ID NO: 3302413 - RNA, 14 nt, Human
gagggcuccagaca

SEQ ID NO: 3302414 - RNA, 13 nt, Human
gagggcuccagac

SEQ ID NO: 3302415 - RNA, 12 nt, Human
gagggcuccaga

SEQ ID NO: 3302416 - RNA, 13 nt, Human
gaggugggauccu

SEQ ID NO: 3302417 - RNA, 16 nt, Human
gaggugggauccucca

SEQ ID NO: 3302418 - RNA, 15 nt, Human
gaggugggauccucc

SEQ ID NO: 3302419 - RNA, 17 nt, Human
gaggugggauccuccag

SEQ ID NO: 3302420 - RNA, 21 nt, Human
gagucacuggaacacuaauga

SEQ ID NO: 3302421 - RNA, 14 nt, Human
gagucacuggaaca

SEQ ID NO: 3302422 - RNA, 19 nt, Human
gaguugauacuacaguuug

SEQ ID NO: 3302423 - RNA, 21 nt, Human
gaguugauagcacagacccug

SEQ ID NO: 3302424 - RNA, 22 nt, Human
gaguugauacuacaguuuguua

SEQ ID NO: 3302425 - RNA, 13 nt, Human
gagugcagugagc

SEQ ID NO: 3302426 - RNA, 18 nt, Human
gagugcagugagccgaga

SEQ ID NO: 3302427 - RNA, 18 nt, Human
gagucagaaguuucugcc

SEQ ID NO: 3302428 - RNA, 14 nt, Human
gagugagacucugu

SEQ ID NO: 3302429 - RNA, 18 nt, Human
gagugagacucugucuca

SEQ ID NO: 3302430 - RNA, 15 nt, Human
gagcugccuguucag

SEQ ID NO: 3302431 - RNA, 16 nt, Human
gagcugccuguucagc

SEQ ID NO: 3302432 - RNA, 19 nt, Human
gagcugccuguucagcucc

SEQ ID NO: 3302433 - RNA, 13 nt, Human
gagccuuccaggg

SEQ ID NO: 3302434 - RNA, 12 nt, Human
gagccuuccagg

SEQ ID NO: 3302435 - RNA, 17 nt, Human
gagcaucaggccaggcc

SEQ ID NO: 3302436 - RNA, 22 nt, Human
gagcaucaggccaggcccucug

SEQ ID NO: 3302437 - RNA, 20 nt, Human
gagcaucaggccaggcccuc

SEQ ID NO: 3302438 - RNA, 23 nt, Human
ggccucaagugauucuccugccu

SEQ ID NO: 3302439 - RNA, 23 nt, Human
ggcccuucucuccagccccugga

SEQ ID NO: 3302440 - RNA, 22 nt, Human
ggcccuucucuccagccccugg

SEQ ID NO: 3302441 - RNA, 13 nt, Human
ggccccugcuggu

SEQ ID NO: 3302442 - RNA, 14 nt, Human
ggccccugcugguu

SEQ ID NO: 3302443 - RNA, 23 nt, Human
ggccccugcugguucaggguugg

SEQ ID NO: 3302444 - RNA, 13 nt, Human
ggcccggcuccag

SEQ ID NO: 3302445 - RNA, 15 nt, Human
ggcccggcuccaggc

SEQ ID NO: 3302446 - RNA, 21 nt, Human
ggcccuucucuccagccccug

SEQ ID NO: 3302447 - RNA, 20 nt, Human
ggcccuucucuccagccccu

SEQ ID NO: 3302448 - RNA, 19 nt, Human
ggcccuucucuccagcccc

SEQ ID NO: 3302449 - RNA, 17 nt, Human
ggccaguuggucccccu

SEQ ID NO: 3302450 - RNA, 14 nt, Human
ggccaguugguccc

SEQ ID NO: 3302451 - RNA, 20 nt, Human
ggccagugugacaaggauug

SEQ ID NO: 3302452 - RNA, 16 nt, Human
ggccagugugacaagg

SEQ ID NO: 3302453 - RNA, 22 nt, Human
ggcagccccuguucuggcagag

SEQ ID NO: 3302454 - RNA, 21 nt, Human
ggcaguggugguuuucuguuc

SEQ ID NO: 3302455 - RNA, 20 nt, Human
ggcaguggugguuuucuguu

SEQ ID NO: 3302456 - RNA, 16 nt, Human
ggagagaagagaaugc

SEQ ID NO: 3302457 - RNA, 23 nt, Human
ggcacucagaagacacugauggg

SEQ ID NO: 3302458 - RNA, 20 nt, Human
ggcacucagaagacacugau

SEQ ID NO: 3302459 - RNA, 13 nt, Human
ggcacaucagcac

SEQ ID NO: 3302460 - RNA, 19 nt, Human
ggcacagaaaauggaagac

SEQ ID NO: 3302461 - RNA, 21 nt, Human
ggcacagaaaauggaagacag

SEQ ID NO: 3302462 - RNA, 20 nt, Human
ggcacagaaaauggaagaca

SEQ ID NO: 3302463 - RNA, 23 nt, Human
ggcagccccauucugccugccca

SEQ ID NO: 3302464 - RNA, 11 nt, Human
ggcagccccug

SEQ ID NO: 3302465 - RNA, 11 nt, Human
ggcucucaggc

SEQ ID NO: 3302466 - RNA, 13 nt, Human
ggcucucaggcca

SEQ ID NO: 3302467 - RNA, 12 nt, Human
ggcucuuccagg

SEQ ID NO: 3302468 - RNA, 22 nt, Human
ggcugcaugcgggcuuccuccu

SEQ ID NO: 3302469 - RNA, 20 nt, Human
ggcugccaaugggagcucau

SEQ ID NO: 3302470 - RNA, 19 nt, Human
ggcugccaaugggagcuca

SEQ ID NO: 3302471 - RNA, 22 nt, Human
ggcugcggaaugaaccacaucu

SEQ ID NO: 3302472 - RNA, 16 nt, Human
ggcugggagagccuuc

SEQ ID NO: 3302473 - RNA, 15 nt, Human
ggcugggagagccuu

SEQ ID NO: 3302474 - RNA, 14 nt, Human
ggcugggagagccu

SEQ ID NO: 3302475 - RNA, 13 nt, Human
ggcugggagagcc

SEQ ID NO: 3302476 - RNA, 18 nt, Human
ggcucagcggggacagcu

SEQ ID NO: 3302477 - RNA, 20 nt, Human
ggcucagguggggucacucu

SEQ ID NO: 3302478 - RNA, 19 nt, Human
ggcucagguggggucacuc

SEQ ID NO: 3302479 - RNA, 19 nt, Human
ggcucagcggggacagcuc

SEQ ID NO: 3302480 - RNA, 15 nt, Human
ggcugggggccucag

SEQ ID NO: 3302481 - RNA, 16 nt, Human
ggcugggggccucagu

SEQ ID NO: 3302482 - RNA, 17 nt, Human
ggcugggggccucagug

SEQ ID NO: 3302483 - RNA, 19 nt, Human
ggcugggggccucagugcc

SEQ ID NO: 3302484 - RNA, 19 nt, Human
ggcuggguggcaccagcag

SEQ ID NO: 3302485 - RNA, 21 nt, Human
ggcuggguucuacccaggugc

SEQ ID NO: 3302486 - RNA, 19 nt, Human
ggcuggguucuacccaggu

SEQ ID NO: 3302487 - RNA, 14 nt, Human
ggcugggggccuca

SEQ ID NO: 3302488 - RNA, 18 nt, Human
ggcuucaguggcagcugc

SEQ ID NO: 3302489 - RNA, 17 nt, Human
ggcuucaguggcagcug

SEQ ID NO: 3302490 - RNA, 19 nt, Human
ggcuucaguggcagcugcu

SEQ ID NO: 3302491 - RNA, 20 nt, Human
ggcuucaguggcagcugcuu

SEQ ID NO: 3302492 - RNA, 18 nt, Human
ggcuguaucccaugagcc

SEQ ID NO: 3302493 - RNA, 16 nt, Human
ggcuuccucauaguau

SEQ ID NO: 3302494 - RNA, 22 nt, Human
ggcuucauccuccucagaucuu

SEQ ID NO: 3302495 - RNA, 18 nt, Human
ggcuucauccuccucaga

SEQ ID NO: 3302496 - RNA, 12 nt, Human
gggacagcuccu

SEQ ID NO: 3302497 - RNA, 13 nt, Human
gggacagcuccuu

SEQ ID NO: 3302498 - RNA, 15 nt, Human
gggacagcuccuucu

SEQ ID NO: 3302499 - RNA, 18 nt, Human
gggaagaagcucucuccu

SEQ ID NO: 3302500 - RNA, 21 nt, Human
ggcuuccuccugguguggaag

SEQ ID NO: 3302501 - RNA, 20 nt, Human
gggaccagagcugccaccug

SEQ ID NO: 3302502 - RNA, 14 nt, Human
gggaccagagcugc

SEQ ID NO: 3302503 - RNA, 12 nt, Human
aaaacccaagug

SEQ ID NO: 3302504 - RNA, 14 nt, Human
aaaacaugcuacac

SEQ ID NO: 3302505 - RNA, 13 nt, Human
aaaacaugcuaca

SEQ ID NO: 3302506 - RNA, 18 nt, Human
aaaacucuccucugcugc

SEQ ID NO: 3302507 - RNA, 23 nt, Human
gggagcaggcucgggcuccccag

SEQ ID NO: 3302508 - RNA, 19 nt, Human
gggagagccuuccaggggu

SEQ ID NO: 3302509 - RNA, 15 nt, Human
gggagagccuuccag

SEQ ID NO: 3302510 - RNA, 16 nt, Human
gggagggagggcucca

SEQ ID NO: 3302511 - RNA, 15 nt, Human
gggagggagggcucc

SEQ ID NO: 3302512 - RNA, 18 nt, Human
gggaggucaaggcugcag

SEQ ID NO: 3302513 - RNA, 21 nt, Human
gggagaaccaaaaagaggcua

SEQ ID NO: 3302514 - RNA, 15 nt, Human
gggacuuggaagcuc

SEQ ID NO: 3302515 - RNA, 17 nt, Human
gggacuuggaagcuccg

SEQ ID NO: 3302516 - RNA, 18 nt, Human
gggacuuggaagcuccgc

SEQ ID NO: 3302517 - RNA, 23 nt, Human
gggacuuggaagcuccgcuuucu

SEQ ID NO: 3302518 - RNA, 20 nt, Human
aaaguacacuguuucaaacu

SEQ ID NO: 3302519 - RNA, 19 nt, Human
aaaguacuucuccacccug

SEQ ID NO: 3302520 - RNA, 20 nt, Human
aaaguacuucuccacccugc

SEQ ID NO: 3302521 - RNA, 21 nt, Human
aaaguacuucuccacccugcu

SEQ ID NO: 3302522 - RNA, 22 nt, Human
guaauuugugauacaaugcugu

SEQ ID NO: 3302523 - RNA, 18 nt, Human
guaauaugcacacauuuu

SEQ ID NO: 3302524 - RNA, 17 nt, Human
guaauaugcacacauuu

SEQ ID NO: 3302525 - RNA, 16 nt, Human
guaauaugcacacauu

SEQ ID NO: 3302526 - RNA, 14 nt, Human
guaauaugcacaca

SEQ ID NO: 3302527 - RNA, 17 nt, Human
aaauacagauagauaua

SEQ ID NO: 3302528 - RNA, 14 nt, Human
aaauauaauugaca

SEQ ID NO: 3302529 - RNA, 11 nt, Human
guagagccagg

SEQ ID NO: 3302530 - RNA, 13 nt, Human
guagagacagggu

SEQ ID NO: 3302531 - RNA, 10 nt, Human
guagagccag

SEQ ID NO: 3302532 - RNA, 15 nt, Human
guagagccagggucu

SEQ ID NO: 3302533 - RNA, 11 nt, Human
guagagacagg

SEQ ID NO: 3302534 - RNA, 12 nt, Human
guagagacaggg

SEQ ID NO: 3302535 - RNA, 18 nt, Human
guagaagcccuucuaccu

SEQ ID NO: 3302536 - RNA, 21 nt, Human
guagaagucuuagauguauau

SEQ ID NO: 3302537 - RNA, 20 nt, Human
guagaaauaucugaaaaugu

SEQ ID NO: 3302538 - RNA, 21 nt, Human
guagaaauaucugaaaaugua

SEQ ID NO: 3302539 - RNA, 23 nt, Human
guagaaauaucugaaaauguaug

SEQ ID NO: 3302540 - RNA, 16 nt, Human
guacuggagaaaaugg

SEQ ID NO: 3302541 - RNA, 15 nt, Human
guacuauguaucaau

SEQ ID NO: 3302542 - RNA, 17 nt, Human
guacuauguaucaauga

SEQ ID NO: 3302543 - RNA, 17 nt, Human
guacuacaguccuccca

SEQ ID NO: 3302544 - RNA, 13 nt, Human
guacuauguauca

SEQ ID NO: 3302545 - RNA, 13 nt, Human
guacccacugcuc

SEQ ID NO: 3302546 - RNA, 14 nt, Human
guacccacugcucu

SEQ ID NO: 3302547 - RNA, 19 nt, Human
guacuacaguccucccauc

SEQ ID NO: 3302548 - RNA, 18 nt, Human
guacuacaguccucccau

SEQ ID NO: 3302549 - RNA, 19 nt, Human
aaauauuaagaaagacuau

SEQ ID NO: 3302550 - RNA, 16 nt, Human
aaaucagcugcuacua

SEQ ID NO: 3302551 - RNA, 12 nt, Human
aaaucagccugc

SEQ ID NO: 3302552 - RNA, 19 nt, Human
aaaucagccguguaaccau

SEQ ID NO: 3302553 - RNA, 12 nt, Human
guacccacugcu

SEQ ID NO: 3302554 - RNA, 16 nt, Human
guacaugaaaacacau

SEQ ID NO: 3302555 - RNA, 15 nt, Human
guacaugaaaacaca

SEQ ID NO: 3302556 - RNA, 14 nt, Human
guacaugaaaacac

SEQ ID NO: 3302557 - RNA, 19 nt, Human
guacauggaauaacaugua

SEQ ID NO: 3302558 - RNA, 20 nt, Human
guacaugaaaacacauuuuu

SEQ ID NO: 3302559 - RNA, 19 nt, Human
guacaugaaaacacauuuu

SEQ ID NO: 3302560 - RNA, 18 nt, Human
guacaugaaaacacauuu

SEQ ID NO: 3302561 - RNA, 17 nt, Human
guacaugaaaacacauu

SEQ ID NO: 3302562 - RNA, 16 nt, Human
aaacauggccuuugcu

SEQ ID NO: 3302563 - RNA, 17 nt, Human
aaacauggccuuugcuu

SEQ ID NO: 3302564 - RNA, 15 nt, Human
ggggaccagagcugc

SEQ ID NO: 3302565 - RNA, 16 nt, Human
ggggaccagagcugcc

SEQ ID NO: 3302566 - RNA, 18 nt, Human
ggggaauguuugccucug

SEQ ID NO: 3302567 - RNA, 22 nt, Human
ggggaauguuugccucugccuc

SEQ ID NO: 3302568 - RNA, 12 nt, Human
gggggccucagu

SEQ ID NO: 3302569 - RNA, 15 nt, Human
gggggccucagugcc

SEQ ID NO: 3302570 - RNA, 17 nt, Human
gggggccucagugccac

SEQ ID NO: 3302571 - RNA, 18 nt, Human
gggggccucagugccacu

SEQ ID NO: 3302572 - RNA, 11 nt, Human
aaacacauuuu

SEQ ID NO: 3302573 - RNA, 20 nt, Human
aaaauuuugauguuuuaagg

SEQ ID NO: 3302574 - RNA, 19 nt, Human
aaaauuuagaaauauaauu

SEQ ID NO: 3302575 - RNA, 13 nt, Human
gggaugagaaagg

SEQ ID NO: 3302576 - RNA, 23 nt, Human
aaaccaagucaagugaaaaagga

SEQ ID NO: 3302577 - RNA, 15 nt, Human
aaacgggcucagcaa

SEQ ID NO: 3302578 - RNA, 19 nt, Human
ggguggcaccagcagccug

SEQ ID NO: 3302579 - RNA, 14 nt, Human
aaacuuaaucuaaa

SEQ ID NO: 3302580 - RNA, 16 nt, Human
aaacuuaaucuaaaug

SEQ ID NO: 3302581 - RNA, 18 nt, Human
aaacuuaaucuaaaugga

SEQ ID NO: 3302582 - RNA, 17 nt, Human
aaacuuaaucuaaaugg

SEQ ID NO: 3302583 - RNA, 19 nt, Human
aaagaugcuucucacugcc

SEQ ID NO: 3302584 - RNA, 14 nt, Human
aaagaugcuucuca

SEQ ID NO: 3302585 - RNA, 17 nt, Human
aaagaugcuucucacug

SEQ ID NO: 3302586 - RNA, 23 nt, Human
aaagacugaguacguugugcauu

SEQ ID NO: 3302587 - RNA, 13 nt, Human
aaagacuguacaa

SEQ ID NO: 3302588 - RNA, 11 nt, Human
gguccugcugc

SEQ ID NO: 3302589 - RNA, 12 nt, Human
gguccugcugca

SEQ ID NO: 3302590 - RNA, 13 nt, Human
gguggaugccugg

SEQ ID NO: 3302591 - RNA, 13 nt, Human
ggugaacagaaca

SEQ ID NO: 3302592 - RNA, 13 nt, Human
ggucgaggcagga

SEQ ID NO: 3302593 - RNA, 18 nt, Human
ggugauccacccaccuca

SEQ ID NO: 3302594 - RNA, 23 nt, Human
ggugauccacccaccucagccuc

SEQ ID NO: 3302595 - RNA, 24 nt, Human
ggugauccacccaccucagccucc

SEQ ID NO: 3302596 - RNA, 12 nt, Human
ggugcaaugacc

SEQ ID NO: 3302597 - RNA, 13 nt, Human
ggugcaaugaccu

SEQ ID NO: 3302598 - RNA, 22 nt, Human
aaagggacuuggaagcuccgcu

SEQ ID NO: 3302599 - RNA, 22 nt, Human
aaaggaaagagggagguaagga

SEQ ID NO: 3302600 - RNA, 17 nt, Human
aaaggagauuggaagga

SEQ ID NO: 3302601 - RNA, 17 nt, Human
aaaggagagcuagcagc

SEQ ID NO: 3302602 - RNA, 21 nt, Human
aaaggagagcuagcagcaggg

SEQ ID NO: 3302603 - RNA, 22 nt, Human
aaagcugccagccgagauagcc

SEQ ID NO: 3302604 - RNA, 15 nt, Human
aaagcucacuuuacu

SEQ ID NO: 3302605 - RNA, 15 nt, Human
aaagcuuguuaagau

SEQ ID NO: 3302606 - RNA, 13 nt, Human
aaagcugcugaca

SEQ ID NO: 3302607 - RNA, 11 nt, Human
gcucugcccuu

SEQ ID NO: 3302608 - RNA, 23 nt, Human
gcucugaucauccacugugccau

SEQ ID NO: 3302609 - RNA, 17 nt, Human
gcucugaucauccacug

SEQ ID NO: 3302610 - RNA, 23 nt, Human
gcucugcaagaauugaagcagga

SEQ ID NO: 3302611 - RNA, 17 nt, Human
gcuccagcucaccagcc

SEQ ID NO: 3302612 - RNA, 18 nt, Human
gcuccagcucaccagccc

SEQ ID NO: 3302613 - RNA, 20 nt, Human
gcuccagcucaccagcccca

SEQ ID NO: 3302614 - RNA, 15 nt, Human
gcuccuggcccacug

SEQ ID NO: 3302615 - RNA, 14 nt, Human
gcuccuggcccacu

SEQ ID NO: 3302616 - RNA, 20 nt, Human
gcuccuggcccacugcaucg

SEQ ID NO: 3302617 - RNA, 19 nt, Human
gcuccuggcccacugcauc

SEQ ID NO: 3302618 - RNA, 18 nt, Human
gcuccuggcccacugcau

SEQ ID NO: 3302619 - RNA, 20 nt, Human
gcgugcacacaccagagccc

SEQ ID NO: 3302620 - RNA, 21 nt, Human
gcgggaggauguucugggaca

SEQ ID NO: 3302621 - RNA, 22 nt, Human
gcgggaggauguucugggacac

SEQ ID NO: 3302622 - RNA, 20 nt, Human
gcgggaggauguucugggac

SEQ ID NO: 3302623 - RNA, 18 nt, Human
gcguuucuaugacacaug

SEQ ID NO: 3302624 - RNA, 19 nt, Human
gcgugcacacaccagagcc

SEQ ID NO: 3302625 - RNA, 23 nt, Human
gcgugcacacaccagagcccacc

SEQ ID NO: 3302626 - RNA, 13 nt, Human
gcuaaugggacac

SEQ ID NO: 3302627 - RNA, 15 nt, Human
gcuaaugggacacua

SEQ ID NO: 3302628 - RNA, 23 nt, Human
gcuaagugauccucccaccucag

SEQ ID NO: 3302629 - RNA, 16 nt, Human
gcucaggugucccugc

SEQ ID NO: 3302630 - RNA, 14 nt, Human
gcucaggugucccu

SEQ ID NO: 3302631 - RNA, 23 nt, Human
gcucagguggggucacucuggca

SEQ ID NO: 3302632 - RNA, 14 nt, Human
gcucagagagggug

SEQ ID NO: 3302633 - RNA, 13 nt, Human
gcucagagagggu

SEQ ID NO: 3302634 - RNA, 17 nt, Human
gcucacugcagccucaa

SEQ ID NO: 3302635 - RNA, 15 nt, Human
gcucacugcagccuc

SEQ ID NO: 3302636 - RNA, 16 nt, Human
gcucacugcagccuca

SEQ ID NO: 3302637 - RNA, 11 nt, Human
gcucacugcag

SEQ ID NO: 3302638 - RNA, 12 nt, Human
gcucacugcagc

SEQ ID NO: 3302639 - RNA, 13 nt, Human
gcucacugcagcc

SEQ ID NO: 3302640 - RNA, 14 nt, Human
gcucacugcagccu

SEQ ID NO: 3302641 - RNA, 18 nt, Human
gcuauucaguaauaacuc

SEQ ID NO: 3302642 - RNA, 20 nt, Human
gcuauucaguaauaacucua

SEQ ID NO: 3302643 - RNA, 17 nt, Human
gcuaggccuggccagau

SEQ ID NO: 3302644 - RNA, 23 nt, Human
gcuaggccuggccagaugcacca

SEQ ID NO: 3302645 - RNA, 16 nt, Human
gcuaggccuggccaga

SEQ ID NO: 3302646 - RNA, 19 nt, Human
gcuauucaguaauaacucu

SEQ ID NO: 3302647 - RNA, 13 nt, Human
gcuaugcauuuga

SEQ ID NO: 3302648 - RNA, 21 nt, Human
gcuagugugguguuuccuggc

SEQ ID NO: 3302649 - RNA, 12 nt, Human
gcuaugcauuug

SEQ ID NO: 3302650 - RNA, 22 nt, Human
gcgaucuggguucacugcaacc

SEQ ID NO: 3302651 - RNA, 16 nt, Human
gccuugaccauucucc

SEQ ID NO: 3302652 - RNA, 20 nt, Human
gccuugaccauucuccaccu

SEQ ID NO: 3302653 - RNA, 19 nt, Human
gccuugaccauucuccacc

SEQ ID NO: 3302654 - RNA, 17 nt, Human
gccuugaccauucucca

SEQ ID NO: 3302655 - RNA, 17 nt, Human
gcgagcccugguggcag

SEQ ID NO: 3302656 - RNA, 15 nt, Human
gcgagcccugguggc

SEQ ID NO: 3302657 - RNA, 13 nt, Human
gccuggccugagc

SEQ ID NO: 3302658 - RNA, 18 nt, Human
gccuggccugagcuggga

SEQ ID NO: 3302659 - RNA, 14 nt, Human
gccuggccugagcu

SEQ ID NO: 3302660 - RNA, 20 nt, Human
gccuggccugagcugggaug

SEQ ID NO: 3302661 - RNA, 18 nt, Human
gccugugccucugggacu

SEQ ID NO: 3302662 - RNA, 13 nt, Human
gccuggcucaggu

SEQ ID NO: 3302663 - RNA, 16 nt, Human
gccugugccucuggga

SEQ ID NO: 3302664 - RNA, 17 nt, Human
gccugugccucugggac

SEQ ID NO: 3302665 - RNA, 14 nt, Human
gccuguugggccag

SEQ ID NO: 3302666 - RNA, 20 nt, Human
gccuguugggccaggagccu

SEQ ID NO: 3302667 - RNA, 18 nt, Human
gccuguugggccaggagc

SEQ ID NO: 3302668 - RNA, 16 nt, Human
gccuguugggccagga

SEQ ID NO: 3302669 - RNA, 15 nt, Human
gccuguugggccagg

SEQ ID NO: 3302670 - RNA, 22 nt, Human
gccugcccaggccccugccacc

SEQ ID NO: 3302671 - RNA, 12 nt, Human
gccugcccaggc

SEQ ID NO: 3302672 - RNA, 15 nt, Human
gccugcccaggcccc

SEQ ID NO: 3302673 - RNA, 20 nt, Human
gccugcccaggccccugcca

SEQ ID NO: 3302674 - RNA, 17 nt, Human
gccucgaacuggcugca

SEQ ID NO: 3302675 - RNA, 19 nt, Human
gccuccugugugugcgccu

SEQ ID NO: 3302676 - RNA, 23 nt, Human
gccuccugugugugcgccuacag

SEQ ID NO: 3302677 - RNA, 16 nt, Human
gccucccaaagugcug

SEQ ID NO: 3302678 - RNA, 13 nt, Human
gccuccugugugu

SEQ ID NO: 3302679 - RNA, 17 nt, Human
gccucccaaagugcugg

SEQ ID NO: 3302680 - RNA, 16 nt, Human
gccucuuaugggcugg

SEQ ID NO: 3302681 - RNA, 18 nt, Human
gccucuuaugggcugggu

SEQ ID NO: 3302682 - RNA, 17 nt, Human
gccucuuaugggcuggg

SEQ ID NO: 3302683 - RNA, 20 nt, Human
gccucgaacuggcugcaaag

SEQ ID NO: 3302684 - RNA, 22 nt, Human
gccucgaacuggcugcaaaggg

SEQ ID NO: 3302685 - RNA, 13 nt, Human
gccugcccaggcc

SEQ ID NO: 3302686 - RNA, 14 nt, Human
gccugcccaggccc

SEQ ID NO: 3302687 - RNA, 14 nt, Human
gccucuuggguuca

SEQ ID NO: 3302688 - RNA, 21 nt, Human
gccucuuaugggcuggguucu

SEQ ID NO: 3302689 - RNA, 21 nt, Human
gcccgggcucugccucccauc

SEQ ID NO: 3302690 - RNA, 23 nt, Human
gcccgggcucugccucccaucac

SEQ ID NO: 3302691 - RNA, 17 nt, Human
gccccugccacccuggg

SEQ ID NO: 3302692 - RNA, 16 nt, Human
gccccugccacccugg

SEQ ID NO: 3302693 - RNA, 20 nt, Human
gccuaggugacagagugaga

SEQ ID NO: 3302694 - RNA, 13 nt, Human
gccuaggugacag

SEQ ID NO: 3302695 - RNA, 14 nt, Human
gccuaggugacaga

SEQ ID NO: 3302696 - RNA, 15 nt, Human
gccuaggugacagag

SEQ ID NO: 3302697 - RNA, 20 nt, Human
gccuagcauacguacacauu

SEQ ID NO: 3302698 - RNA, 22 nt, Human
gccuagcauacguacacauuuu

SEQ ID NO: 3302699 - RNA, 21 nt, Human
gccuagcauacguacacauuu

SEQ ID NO: 3302700 - RNA, 19 nt, Human
gccuagcauacguacacau

SEQ ID NO: 3302701 - RNA, 23 nt, Human
gccuagcauacguacacauuuua

SEQ ID NO: 3302702 - RNA, 16 nt, Human
gcccugcagagggcac

SEQ ID NO: 3302703 - RNA, 18 nt, Human
gcccugcagagggcacag

SEQ ID NO: 3302704 - RNA, 22 nt, Human
gcccugcccaccuggccucugc

SEQ ID NO: 3302705 - RNA, 21 nt, Human
gcccugcccaccuggccucug

SEQ ID NO: 3302706 - RNA, 20 nt, Human
gcccugcccaccuggccucu

SEQ ID NO: 3302707 - RNA, 17 nt, Human
gcccugcccaccuggcc

SEQ ID NO: 3302708 - RNA, 11 nt, Human
gcccugccucc

SEQ ID NO: 3302709 - RNA, 15 nt, Human
gcccugcccaccugg

SEQ ID NO: 3302710 - RNA, 19 nt, Human
gccgcagcccugcagaggg

SEQ ID NO: 3302711 - RNA, 20 nt, Human
gccgcagcccugcagagggc

SEQ ID NO: 3302712 - RNA, 22 nt, Human
gcccuuagcagggaaacagcua

SEQ ID NO: 3302713 - RNA, 13 nt, Human
gcccugccuccuu

SEQ ID NO: 3302714 - RNA, 12 nt, Human
gcccugccuccu

SEQ ID NO: 3302715 - RNA, 19 nt, Human
gcccuuagcagggaaacag

SEQ ID NO: 3302716 - RNA, 20 nt, Human
gcccuuagcagggaaacagc

SEQ ID NO: 3302717 - RNA, 23 nt, Human
gcuggguggcaccagcagccugg

SEQ ID NO: 3302718 - RNA, 22 nt, Human
gcuggguggcaccagcagccug

SEQ ID NO: 3302719 - RNA, 21 nt, Human
gcuggguggcaccagcagccu

SEQ ID NO: 3302720 - RNA, 23 nt, Human
gcugggguggggaccucaggccu

SEQ ID NO: 3302721 - RNA, 15 nt, Human
gcuggcuguuggcug

SEQ ID NO: 3302722 - RNA, 16 nt, Human
gcuggcuguuggcugg

SEQ ID NO: 3302723 - RNA, 13 nt, Human
gcugcuggcuggu

SEQ ID NO: 3302724 - RNA, 15 nt, Human
gcugcugaaggcucg

SEQ ID NO: 3302725 - RNA, 14 nt, Human
gcugcugaaggcuc

SEQ ID NO: 3302726 - RNA, 13 nt, Human
gcugcugaaggcu

SEQ ID NO: 3302727 - RNA, 12 nt, Human
gcugcugaaggc

SEQ ID NO: 3302728 - RNA, 16 nt, Human
gcucugguccauagag

SEQ ID NO: 3302729 - RNA, 15 nt, Human
gcucugguccauaga

SEQ ID NO: 3302730 - RNA, 20 nt, Human
gcuggcgugcaguggugcga

SEQ ID NO: 3302731 - RNA, 18 nt, Human
gcuggagugcagugagcc

SEQ ID NO: 3302732 - RNA, 17 nt, Human
gcuggagugcagugagc

SEQ ID NO: 3302733 - RNA, 22 nt, Human
gcuggagugcagugagccgaga

SEQ ID NO: 3302734 - RNA, 20 nt, Human
gcuggccuggccccucaggg

SEQ ID NO: 3302735 - RNA, 22 nt, Human
gcuuccucauaguaugguggcu

SEQ ID NO: 3302736 - RNA, 23 nt, Human
gcuucuucagagacuccugcagg

SEQ ID NO: 3302737 - RNA, 20 nt, Human
gcuuguaaauagcucaggug

SEQ ID NO: 3302738 - RNA, 14 nt, Human
gcuugagcucagga

SEQ ID NO: 3302739 - RNA, 22 nt, Human
gcuugaccuuuaagagaaauga

SEQ ID NO: 3302740 - RNA, 18 nt, Human
gcuucaaggauccugagc

SEQ ID NO: 3302741 - RNA, 19 nt, Human
gcuucaaggauccugagcc

SEQ ID NO: 3302742 - RNA, 21 nt, Human
gcuucaaggauccugagccag

SEQ ID NO: 3302743 - RNA, 20 nt, Human
gcuucaaggauccugagcca

SEQ ID NO: 3302744 - RNA, 15 nt, Human
gcuucacggaagagc

SEQ ID NO: 3302745 - RNA, 17 nt, Human
gcuucacggaagagccu

SEQ ID NO: 3302746 - RNA, 12 nt, Human
gcuucagccucc

SEQ ID NO: 3302747 - RNA, 18 nt, Human
gcuucacggaagagccuu

SEQ ID NO: 3302748 - RNA, 19 nt, Human
ggaacacuccuucacagau

SEQ ID NO: 3302749 - RNA, 14 nt, Human
ggaacacucugaga

SEQ ID NO: 3302750 - RNA, 12 nt, Human
ggaacacucuga

SEQ ID NO: 3302751 - RNA, 16 nt, Human
ggaacacucugagacu

SEQ ID NO: 3302752 - RNA, 15 nt, Human
ggaacacucugagac

SEQ ID NO: 3302753 - RNA, 15 nt, Human
ggaagagaaaaaaua

SEQ ID NO: 3302754 - RNA, 18 nt, Human
ggaagacuuuggaaagag

SEQ ID NO: 3302755 - RNA, 13 nt, Human
ggaagagaaaaaa

SEQ ID NO: 3302756 - RNA, 22 nt, Human
ggaagacaaugugaaaagaaaa

SEQ ID NO: 3302757 - RNA, 14 nt, Human
ggaagacagcucuu

SEQ ID NO: 3302758 - RNA, 13 nt, Human
ggaagacagcucu

SEQ ID NO: 3302759 - RNA, 12 nt, Human
ggaagacuuugg

SEQ ID NO: 3302760 - RNA, 17 nt, Human
ggaagacuuuggaaaga

SEQ ID NO: 3302761 - RNA, 13 nt, Human
ggaagacuuugga

SEQ ID NO: 3302762 - RNA, 20 nt, Human
ggaaggaaacccagcucugg

SEQ ID NO: 3302763 - RNA, 19 nt, Human
ggaaggaaacccagcucug

SEQ ID NO: 3302764 - RNA, 22 nt, Human
ggaagcucagggccuggcucag

SEQ ID NO: 3302765 - RNA, 11 nt, Human
ggaagcuccgc

SEQ ID NO: 3302766 - RNA, 23 nt, Human
ggaagcucagggccuggcucagg

SEQ ID NO: 3302767 - RNA, 16 nt, Human
ggaaggaaacccagcu

SEQ ID NO: 3302768 - RNA, 17 nt, Human
ggacacuaaccacgcug

SEQ ID NO: 3302769 - RNA, 19 nt, Human
ggacagcuccuucuguccu

SEQ ID NO: 3302770 - RNA, 20 nt, Human
ggacagcuccuucuguccua

SEQ ID NO: 3302771 - RNA, 17 nt, Human
ggacagcuccuucuguc

SEQ ID NO: 3302772 - RNA, 14 nt, Human
ggacacagcucuuc

SEQ ID NO: 3302773 - RNA, 15 nt, Human
ggacacagcucuucu

SEQ ID NO: 3302774 - RNA, 18 nt, Human
ggacacagcucuucucca

SEQ ID NO: 3302775 - RNA, 16 nt, Human
ggaauccagacccggc

SEQ ID NO: 3302776 - RNA, 18 nt, Human
ggaauaacauguaauuaa

SEQ ID NO: 3302777 - RNA, 13 nt, Human
ggacaagagcagg

SEQ ID NO: 3302778 - RNA, 23 nt, Human
ggacaaggaugaucuaggaagac

SEQ ID NO: 3302779 - RNA, 22 nt, Human
ggacaaggaugaucuaggaaga

SEQ ID NO: 3302780 - RNA, 12 nt, Human
ggacccccugaa

SEQ ID NO: 3302781 - RNA, 11 nt, Human
ggacccugagg

SEQ ID NO: 3302782 - RNA, 19 nt, Human
ggacccugaggcccagagg

SEQ ID NO: 3302783 - RNA, 12 nt, Human
ggacccugaggc

SEQ ID NO: 3302784 - RNA, 12 nt, Human
ggaccucaggcc

SEQ ID NO: 3302785 - RNA, 13 nt, Human
ggaccucaggccu

SEQ ID NO: 3302786 - RNA, 20 nt, Human
ggacguguuaugacuccaga

SEQ ID NO: 3302787 - RNA, 15 nt, Human
ggaccucaggccugg

SEQ ID NO: 3302788 - RNA, 14 nt, Human
ggaccucaggccug

SEQ ID NO: 3302789 - RNA, 16 nt, Human
ggagaaaggaagggcu

SEQ ID NO: 3302790 - RNA, 14 nt, Human
ggacuuggaagcuc

SEQ ID NO: 3302791 - RNA, 16 nt, Human
ggacucaaugcacuga

SEQ ID NO: 3302792 - RNA, 20 nt, Human
ggacuaacuugucuuuggac

SEQ ID NO: 3302793 - RNA, 15 nt, Human
ggacucaaugcacug

SEQ ID NO: 3302794 - RNA, 14 nt, Human
ggacuacaggugug

SEQ ID NO: 3302795 - RNA, 24 nt, Human
ggacuaacuugucuuuggacccug

SEQ ID NO: 3302796 - RNA, 14 nt, Human
aaugaaugaaacau

SEQ ID NO: 3302797 - RNA, 14 nt, Human
aaugaaugucagug

SEQ ID NO: 3302798 - RNA, 15 nt, Human
aaugaaugucagugu

SEQ ID NO: 3302799 - RNA, 23 nt, Human
aaucuucugaacuuggcgcugcc

SEQ ID NO: 3302800 - RNA, 15 nt, Human
uaaugucacaggcag

SEQ ID NO: 3302801 - RNA, 16 nt, Human
uaaugucacaggcagg

SEQ ID NO: 3302802 - RNA, 17 nt, Human
uaaugucacaggcaggu

SEQ ID NO: 3302803 - RNA, 23 nt, Human
uaaugugaaacuggauuaaacuu

SEQ ID NO: 3302804 - RNA, 22 nt, Human
uaaugugaaacuggauuaaacu

SEQ ID NO: 3302805 - RNA, 20 nt, Human
uaaugugaaacuggauuaaa

SEQ ID NO: 3302806 - RNA, 12 nt, Human
uaaugugaaacu

SEQ ID NO: 3302807 - RNA, 16 nt, Human
uaauguaagcucuacu

SEQ ID NO: 3302808 - RNA, 17 nt, Human
uaauguaagcucuacug

SEQ ID NO: 3302809 - RNA, 21 nt, Human
uaauauugauaugcuuauaca

SEQ ID NO: 3302810 - RNA, 20 nt, Human
aauacaguaucucagggccu

SEQ ID NO: 3302811 - RNA, 23 nt, Human
uaauacaccacuacauucuguua

SEQ ID NO: 3302812 - RNA, 21 nt, Human
uaauacaccacuacauucugu

SEQ ID NO: 3302813 - RNA, 22 nt, Human
uaauacaccacuacauucuguu

SEQ ID NO: 3302814 - RNA, 16 nt, Human
uacaaaaacauggccu

SEQ ID NO: 3302815 - RNA, 16 nt, Human
uacaagcgugagccac

SEQ ID NO: 3302816 - RNA, 18 nt, Human
uacaagcgugagccacug

SEQ ID NO: 3302817 - RNA, 19 nt, Human
uacaagcgugagccacugc

SEQ ID NO: 3302818 - RNA, 20 nt, Human
uacaagcgugagccacugca

SEQ ID NO: 3302819 - RNA, 18 nt, Human
uaauuuaccugaagucuu

SEQ ID NO: 3302820 - RNA, 17 nt, Human
uaauuuaccugaagucu

SEQ ID NO: 3302821 - RNA, 23 nt, Human
aaugcaaaccaucauugaaaucu

SEQ ID NO: 3302822 - RNA, 22 nt, Human
aaugcaaaccaucauugaaauc

SEQ ID NO: 3302823 - RNA, 18 nt, Human
aaugcacaaacagaggcc

SEQ ID NO: 3302824 - RNA, 21 nt, Human
aaugaaugucagugugacuga

SEQ ID NO: 3302825 - RNA, 20 nt, Human
aaugaaugucagugugacug

SEQ ID NO: 3302826 - RNA, 16 nt, Human
aaugcaaaccaucauu

SEQ ID NO: 3302827 - RNA, 14 nt, Human
aaugcaaaccauca

SEQ ID NO: 3302828 - RNA, 14 nt, Human
aaugaccuuucaau

SEQ ID NO: 3302829 - RNA, 13 nt, Human
aaugaccuuucaa

SEQ ID NO: 3302830 - RNA, 23 nt, Human
uaauuaguuccucauuagcauuu

SEQ ID NO: 3302831 - RNA, 19 nt, Human
aaugcacuuuguucuggcu

SEQ ID NO: 3302832 - RNA, 16 nt, Human
aaugcacuuuguucug

SEQ ID NO: 3302833 - RNA, 13 nt, Human
aaugcacuuuguu

SEQ ID NO: 3302834 - RNA, 20 nt, Human
aaugcacaaacagaggccgc

SEQ ID NO: 3302835 - RNA, 19 nt, Human
aaugcacaaacagaggccg

SEQ ID NO: 3302836 - RNA, 16 nt, Human
aaugguuuucuugugu

SEQ ID NO: 3302837 - RNA, 22 nt, Human
aaugguuuucuuguguguuuau

SEQ ID NO: 3302838 - RNA, 18 nt, Human
aaugguuuucuugugugu

SEQ ID NO: 3302839 - RNA, 17 nt, Human
aaugguuuucuugugug

SEQ ID NO: 3302840 - RNA, 13 nt, Human
aauguaagcucua

SEQ ID NO: 3302841 - RNA, 15 nt, Human
aauguaagcucuacu

SEQ ID NO: 3302842 - RNA, 23 nt, Human
aauguacagcaaggagauuuaca

SEQ ID NO: 3302843 - RNA, 21 nt, Human
aauguacagcaaggagauuua

SEQ ID NO: 3302844 - RNA, 22 nt, Human
uacagcaaggagauuuacaacu

SEQ ID NO: 3302845 - RNA, 18 nt, Human
uacaguccucccaucuca

SEQ ID NO: 3302846 - RNA, 17 nt, Human
uacaguccucccaucuc

SEQ ID NO: 3302847 - RNA, 15 nt, Human
uacaguccucccauc

SEQ ID NO: 3302848 - RNA, 12 nt, Human
uacaguccuccc

SEQ ID NO: 3302849 - RNA, 18 nt, Human
uacaguaucucagggccu

SEQ ID NO: 3302850 - RNA, 15 nt, Human
uacaguaucucaggg

SEQ ID NO: 3302851 - RNA, 13 nt, Human
aaugucacaggca

SEQ ID NO: 3302852 - RNA, 14 nt, Human
aaugucacaggcag

SEQ ID NO: 3302853 - RNA, 22 nt, Human
aaugugaaacuggauuaaacuu

SEQ ID NO: 3302854 - RNA, 16 nt, Human
aauuaacuuuuauaaa

SEQ ID NO: 3302855 - RNA, 22 nt, Human
aauuaacuuuuauaaacuuuac

SEQ ID NO: 3302856 - RNA, 20 nt, Human
aauuaacuuuuauaaacuuu

SEQ ID NO: 3302857 - RNA, 18 nt, Human
aauuaacuuuuauaaacu

SEQ ID NO: 3302858 - RNA, 20 nt, Human
uacccgggaagggggcuggg

SEQ ID NO: 3302859 - RNA, 16 nt, Human
uacccucauguucuua

SEQ ID NO: 3302860 - RNA, 15 nt, Human
uacccucauguucuu

SEQ ID NO: 3302861 - RNA, 20 nt, Human
uacccuggcacuauaaugua

SEQ ID NO: 3302862 - RNA, 22 nt, Human
uacccuggcacuauaauguaag

SEQ ID NO: 3302863 - RNA, 17 nt, Human
uaccacuuuuguucuug

SEQ ID NO: 3302864 - RNA, 17 nt, Human
uaccauccccuguagag

SEQ ID NO: 3302865 - RNA, 15 nt, Human
uagaagucacacagu

SEQ ID NO: 3302866 - RNA, 21 nt, Human
uagacagagucucacuguugc

SEQ ID NO: 3302867 - RNA, 16 nt, Human
uagacaauuuauuaug

SEQ ID NO: 3302868 - RNA, 16 nt, Human
uagaagucacacagua

SEQ ID NO: 3302869 - RNA, 16 nt, Human
uagaagucuuagaugu

SEQ ID NO: 3302870 - RNA, 17 nt, Human
uagaagucuuagaugua

SEQ ID NO: 3302871 - RNA, 18 nt, Human
uagaagucuuagauguau

SEQ ID NO: 3302872 - RNA, 19 nt, Human
uagaagucuuagauguaua

SEQ ID NO: 3302873 - RNA, 17 nt, Human
aauuuuuuugagacaga

SEQ ID NO: 3302874 - RNA, 13 nt, Human
acaaaaacauggc

SEQ ID NO: 3302875 - RNA, 22 nt, Human
aauuuuuuuaucgucacugcuu

SEQ ID NO: 3302876 - RNA, 17 nt, Human
aauuuuuauuaaauuau

SEQ ID NO: 3302877 - RNA, 18 nt, Human
aauuuuuauuaaauuaug

SEQ ID NO: 3302878 - RNA, 14 nt, Human
uagacagucccugc

SEQ ID NO: 3302879 - RNA, 12 nt, Human
uagacagucccu

SEQ ID NO: 3302880 - RNA, 12 nt, Human
acaacacucaca

SEQ ID NO: 3302881 - RNA, 15 nt, Human
acaacaacaaaauga

SEQ ID NO: 3302882 - RNA, 17 nt, Human
acaagagcccaggccuc

SEQ ID NO: 3302883 - RNA, 18 nt, Human
acaagcgugagccacugc

SEQ ID NO: 3302884 - RNA, 13 nt, Human
acaagcugcaccc

SEQ ID NO: 3302885 - RNA, 20 nt, Human
acaagcgugagccacugcac

SEQ ID NO: 3302886 - RNA, 21 nt, Human
acaagcgugagccacugcacc

SEQ ID NO: 3302887 - RNA, 12 nt, Human
acaagccacccc

SEQ ID NO: 3302888 - RNA, 24 nt, Human
uagcacagacccugcccugugggc

SEQ ID NO: 3302889 - RNA, 22 nt, Human
uagauuuuagacccuauugcug

SEQ ID NO: 3302890 - RNA, 19 nt, Human
uagcacagacccugcccug

SEQ ID NO: 3302891 - RNA, 18 nt, Human
uagcacagacccugcccu

SEQ ID NO: 3302892 - RNA, 17 nt, Human
uagcacagacccugccc

SEQ ID NO: 3302893 - RNA, 16 nt, Human
uagcacagacccugcc

SEQ ID NO: 3302894 - RNA, 14 nt, Human
uacguacacauuuu

SEQ ID NO: 3302895 - RNA, 15 nt, Human
uacguacacauuuua

SEQ ID NO: 3302896 - RNA, 20 nt, Human
aauucuugcaaaguaucccu

SEQ ID NO: 3302897 - RNA, 14 nt, Human
aauucuugcaaagu

SEQ ID NO: 3302898 - RNA, 22 nt, Human
aauucuucuccacuuucuagcc

SEQ ID NO: 3302899 - RNA, 13 nt, Human
aauucuuaaauau

SEQ ID NO: 3302900 - RNA, 14 nt, Human
uacuauguaucaau

SEQ ID NO: 3302901 - RNA, 16 nt, Human
uacuauguaucaauga

SEQ ID NO: 3302902 - RNA, 16 nt, Human
uacuauaauuuaccug

SEQ ID NO: 3302903 - RNA, 13 nt, Human
uacguugugcauu

SEQ ID NO: 3302904 - RNA, 13 nt, Human
uacgugaguccug

SEQ ID NO: 3302905 - RNA, 21 nt, Human
uacucugugucagguggggca

SEQ ID NO: 3302906 - RNA, 21 nt, Human
aauuucuaaaucuccaaaaua

SEQ ID NO: 3302907 - RNA, 13 nt, Human
aauuucuaaaucu

SEQ ID NO: 3302908 - RNA, 17 nt, Human
aauuuagaaauauaauu

SEQ ID NO: 3302909 - RNA, 22 nt, Human
aauuguuuggggaugagaaagg

SEQ ID NO: 3302910 - RNA, 15 nt, Human
aauuuacauacucug

SEQ ID NO: 3302911 - RNA, 19 nt, Human
aauuuacauacucugcuua

SEQ ID NO: 3302912 - RNA, 13 nt, Human
aauuuaaaagucu

SEQ ID NO: 3302913 - RNA, 22 nt, Human
acagggcacaccgggcacucag

SEQ ID NO: 3302914 - RNA, 22 nt, Human
acagguuuuccugaagaauuga

SEQ ID NO: 3302915 - RNA, 12 nt, Human
acaggcugggcu

SEQ ID NO: 3302916 - RNA, 20 nt, Human
acagggcacaccgggcacuc

SEQ ID NO: 3302917 - RNA, 14 nt, Human
acaggcugggcuuc

SEQ ID NO: 3302918 - RNA, 17 nt, Human
acaggcugggcuucagu

SEQ ID NO: 3302919 - RNA, 17 nt, Human
acaguccucccaucuca

SEQ ID NO: 3302920 - RNA, 20 nt, Human
acaguccuuaccagcagagc

SEQ ID NO: 3302921 - RNA, 18 nt, Human
acaguccuuaccagcaga

SEQ ID NO: 3302922 - RNA, 15 nt, Human
acaguccucccaucu

SEQ ID NO: 3302923 - RNA, 14 nt, Human
acaguccucccauc

SEQ ID NO: 3302924 - RNA, 13 nt, Human
acaguccucccau

SEQ ID NO: 3302925 - RNA, 15 nt, Human
acagucccugccaau

SEQ ID NO: 3302926 - RNA, 15 nt, Human
acaguauuacuucug

SEQ ID NO: 3302927 - RNA, 16 nt, Human
acaguauuacuucugc

SEQ ID NO: 3302928 - RNA, 17 nt, Human
acaguauuacuucugcu

SEQ ID NO: 3302929 - RNA, 19 nt, Human
acaguauuacuucugcuac

SEQ ID NO: 3302930 - RNA, 13 nt, Human
acagucccugcca

SEQ ID NO: 3302931 - RNA, 12 nt, Human
acagucccugcc

SEQ ID NO: 3302932 - RNA, 15 nt, Human
acaguuaagagaaau

SEQ ID NO: 3302933 - RNA, 22 nt, Human
acaguccuuaccagcagagcac

SEQ ID NO: 3302934 - RNA, 21 nt, Human
acaguccuuaccagcagagca

SEQ ID NO: 3302935 - RNA, 22 nt, Human
uauucaggaagcucagggccug

SEQ ID NO: 3302936 - RNA, 18 nt, Human
uauucaggaagcucaggg

SEQ ID NO: 3302937 - RNA, 16 nt, Human
uauucaggaagcucag

SEQ ID NO: 3302938 - RNA, 16 nt, Human
uauuaccacagacaua

SEQ ID NO: 3302939 - RNA, 12 nt, Human
uauuagagaaga

SEQ ID NO: 3302940 - RNA, 17 nt, Human
uauguuuuaagaggcag

SEQ ID NO: 3302941 - RNA, 19 nt, Human
uauguuuuaagaggcaggg

SEQ ID NO: 3302942 - RNA, 22 nt, Human
uauuaaaaaucucaaauuucua

SEQ ID NO: 3302943 - RNA, 20 nt, Human
uauuaaaaaucucaaauuuc

SEQ ID NO: 3302944 - RNA, 18 nt, Human
uauuaaaaaucucaaauu

SEQ ID NO: 3302945 - RNA, 16 nt, Human
uauuaaaaaucucaaa

SEQ ID NO: 3302946 - RNA, 23 nt, Human
uauuaaaaaucucaaauuucuaa

SEQ ID NO: 3302947 - RNA, 16 nt, Human
acaguucucuccuucu

SEQ ID NO: 3302948 - RNA, 20 nt, Human
acaguuacucagaauucucu

SEQ ID NO: 3302949 - RNA, 13 nt, Human
acaguuacucaga

SEQ ID NO: 3302950 - RNA, 20 nt, Human
acaguucaauucucauuugu

SEQ ID NO: 3302951 - RNA, 15 nt, Human
uauucuuauuuaaug

SEQ ID NO: 3302952 - RNA, 16 nt, Human
uauucuguuggccagu

SEQ ID NO: 3302953 - RNA, 18 nt, Human
uauucucuccuguaccuc

SEQ ID NO: 3302954 - RNA, 24 nt, Human
uauucucuccuguaccucuugagc

SEQ ID NO: 3302955 - RNA, 20 nt, Human
uauucucuccuguaccucuu

SEQ ID NO: 3302956 - RNA, 17 nt, Human
acaguucucuccuucuu

SEQ ID NO: 3302957 - RNA, 23 nt, Human
uauuuaauuuuuuugagacagag

SEQ ID NO: 3302958 - RNA, 18 nt, Human
uauuuacuucuuauacau

SEQ ID NO: 3302959 - RNA, 14 nt, Human
uauuuauuuaaauu

SEQ ID NO: 3302960 - RNA, 13 nt, Human
uauuuauuuaaau

SEQ ID NO: 3302961 - RNA, 15 nt, Human
uauuuaaugaaagac

SEQ ID NO: 3302962 - RNA, 21 nt, Human
uauuuaaugaaagacuguaca

SEQ ID NO: 3302963 - RNA, 17 nt, Human
uauugucaaagugguga

SEQ ID NO: 3302964 - RNA, 13 nt, Human
uauugucaaagug

SEQ ID NO: 3302965 - RNA, 16 nt, Human
acagacccugcccugu

SEQ ID NO: 3302966 - RNA, 17 nt, Human
acagacccugcccugug

SEQ ID NO: 3302967 - RNA, 22 nt, Human
acagacacaggcccggcuccag

SEQ ID NO: 3302968 - RNA, 23 nt, Human
acagacacaggcccggcuccagg

SEQ ID NO: 3302969 - RNA, 11 nt, Human
acacuccuuca

SEQ ID NO: 3302970 - RNA, 18 nt, Human
acagacccugcccugugg

SEQ ID NO: 3302971 - RNA, 14 nt, Human
acagacuggaagca

SEQ ID NO: 3302972 - RNA, 18 nt, Human
uaucaaguauuauaccuu

SEQ ID NO: 3302973 - RNA, 21 nt, Human
uaucaaguauuauaccuuuuu

SEQ ID NO: 3302974 - RNA, 18 nt, Human
uaucacccagaagaaaau

SEQ ID NO: 3302975 - RNA, 19 nt, Human
uaucuagauacuguaucau

SEQ ID NO: 3302976 - RNA, 17 nt, Human
uaucucccccagcccca

SEQ ID NO: 3302977 - RNA, 18 nt, Human
uaucucccccagccccau

SEQ ID NO: 3302978 - RNA, 16 nt, Human
uaucucccccagcccc

SEQ ID NO: 3302979 - RNA, 16 nt, Human
uaucuagauacuguau

SEQ ID NO: 3302980 - RNA, 15 nt, Human
uaucuagauacugua

SEQ ID NO: 3302981 - RNA, 22 nt, Human
acagacuggaagcacagcuuca

SEQ ID NO: 3302982 - RNA, 20 nt, Human
acagagcccacgcccccacu

SEQ ID NO: 3302983 - RNA, 16 nt, Human
acagagcuacacaggg

SEQ ID NO: 3302984 - RNA, 21 nt, Human
acagagugagacucugucuca

SEQ ID NO: 3302985 - RNA, 10 nt, Human
uaugggagag

SEQ ID NO: 3302986 - RNA, 17 nt, Human
acagcuaacauggaagu

SEQ ID NO: 3302987 - RNA, 15 nt, Human
acagcuaacauggaa

SEQ ID NO: 3302988 - RNA, 14 nt, Human
acagcuaacaugga

SEQ ID NO: 3302989 - RNA, 19 nt, Human
uaugcucugcauguuacau

SEQ ID NO: 3302990 - RNA, 22 nt, Human
uauggcccuggccuagcauacg

SEQ ID NO: 3302991 - RNA, 18 nt, Human
uaugcucugcauguuaca

SEQ ID NO: 3302992 - RNA, 14 nt, Human
uaugcucugcaugu

SEQ ID NO: 3302993 - RNA, 13 nt, Human
uaugaggcauuug

SEQ ID NO: 3302994 - RNA, 23 nt, Human
uaugaggcauuuguuugaacuga

SEQ ID NO: 3302995 - RNA, 15 nt, Human
uaucuugaagacuuu

SEQ ID NO: 3302996 - RNA, 14 nt, Human
uaugaucacggcuc

SEQ ID NO: 3302997 - RNA, 21 nt, Human
uaugaucacggcucacugcag

SEQ ID NO: 3302998 - RNA, 23 nt, Human
uaugaucacggcucacugcagcc

SEQ ID NO: 3302999 - RNA, 20 nt, Human
acagaguuuucacucuuauu

SEQ ID NO: 3303000 - RNA, 18 nt, Human
acagaguuuucacucuua

SEQ ID NO: 3303001 - RNA, 22 nt, Human
acagaguuguuacauuuuuaag

SEQ ID NO: 3303002 - RNA, 14 nt, Human
uaucuugaagacuu

SEQ ID NO: 3303003 - RNA, 18 nt, Human
uauagccuaggugacaga

SEQ ID NO: 3303004 - RNA, 20 nt, Human
uauagccuaggugacagagu

SEQ ID NO: 3303005 - RNA, 19 nt, Human
acacucauugaccugaggc

SEQ ID NO: 3303006 - RNA, 23 nt, Human
acacucauugaccugaggcccuu

SEQ ID NO: 3303007 - RNA, 21 nt, Human
acacucauugaccugaggccc

SEQ ID NO: 3303008 - RNA, 21 nt, Human
uauaauuuaccugaagucuuu

SEQ ID NO: 3303009 - RNA, 14 nt, Human
uauacauaaacaag

SEQ ID NO: 3303010 - RNA, 13 nt, Human
uauacauaaacaa

SEQ ID NO: 3303011 - RNA, 14 nt, Human
uauacauuugauaa

SEQ ID NO: 3303012 - RNA, 20 nt, Human
uaguuccucauuagcauuuu

SEQ ID NO: 3303013 - RNA, 20 nt, Human
uagucacugagacagcccgg

SEQ ID NO: 3303014 - RNA, 21 nt, Human
uagucaggugccucaagagaa

SEQ ID NO: 3303015 - RNA, 23 nt, Human
acaagcugcacccucaggcaggu

SEQ ID NO: 3303016 - RNA, 22 nt, Human
acaagcugcacccucaggcagg

SEQ ID NO: 3303017 - RNA, 21 nt, Human
acaagcugcacccucaggcag

SEQ ID NO: 3303018 - RNA, 19 nt, Human
acaagcugcacccucaggc

SEQ ID NO: 3303019 - RNA, 20 nt, Human
acacaugcaaggucauuuuu

SEQ ID NO: 3303020 - RNA, 19 nt, Human
acacaugcaaggucauuuu

SEQ ID NO: 3303021 - RNA, 18 nt, Human
acacaugcaaggucauuu

SEQ ID NO: 3303022 - RNA, 11 nt, Human
acacccuguga

SEQ ID NO: 3303023 - RNA, 18 nt, Human
acacccugugauggggcc

SEQ ID NO: 3303024 - RNA, 12 nt, Human
acacccugugau

SEQ ID NO: 3303025 - RNA, 19 nt, Human
acacccagcccacuucugc

SEQ ID NO: 3303026 - RNA, 20 nt, Human
acacccagcccacuucugcc

SEQ ID NO: 3303027 - RNA, 21 nt, Human
acacccagcccacuucugcca

SEQ ID NO: 3303028 - RNA, 21 nt, Human
acacaugcaaggucauuuuuu

SEQ ID NO: 3303029 - RNA, 20 nt, Human
aagauauuuugcuuugugau

SEQ ID NO: 3303030 - RNA, 17 nt, Human
aagauauuuugcuuugu

SEQ ID NO: 3303031 - RNA, 19 nt, Human
aagaguaggaagacuuugg

SEQ ID NO: 3303032 - RNA, 15 nt, Human
aagauauuuugcuuu

SEQ ID NO: 3303033 - RNA, 18 nt, Human
aagaguaggaagacuuug

SEQ ID NO: 3303034 - RNA, 16 nt, Human
aagaguaggaagacuu

SEQ ID NO: 3303035 - RNA, 19 nt, Human
gugguguuuccuggcacug

SEQ ID NO: 3303036 - RNA, 18 nt, Human
gugguuauggagagggug

SEQ ID NO: 3303037 - RNA, 14 nt, Human
aagaguaggaagac

SEQ ID NO: 3303038 - RNA, 19 nt, Human
gugugguguuuccuggcac

SEQ ID NO: 3303039 - RNA, 19 nt, Human
gugucuugcaauggcagcc

SEQ ID NO: 3303040 - RNA, 21 nt, Human
gugucuugcaauggcagccuu

SEQ ID NO: 3303041 - RNA, 13 nt, Human
gugugagucacca

SEQ ID NO: 3303042 - RNA, 18 nt, Human
gugugagucaccaagccc

SEQ ID NO: 3303043 - RNA, 15 nt, Human
gugugguguuuccug

SEQ ID NO: 3303044 - RNA, 16 nt, Human
gugugguagagugugc

SEQ ID NO: 3303045 - RNA, 16 nt, Human
gugguguuuccuggca

SEQ ID NO: 3303046 - RNA, 15 nt, Human
gugguguuuccuggc

SEQ ID NO: 3303047 - RNA, 20 nt, Human
guggugguuuucuguucuuu

SEQ ID NO: 3303048 - RNA, 12 nt, Human
gugggagcugag

SEQ ID NO: 3303049 - RNA, 18 nt, Human
gugggauccuccaggugc

SEQ ID NO: 3303050 - RNA, 15 nt, Human
gugggauccuccagg

SEQ ID NO: 3303051 - RNA, 13 nt, Human
gugggauccucca

SEQ ID NO: 3303052 - RNA, 14 nt, Human
guggccucccaacu

SEQ ID NO: 3303053 - RNA, 13 nt, Human
guggccucccaac

SEQ ID NO: 3303054 - RNA, 16 nt, Human
aagagcccaggccucc

SEQ ID NO: 3303055 - RNA, 14 nt, Human
aagagcccaggccu

SEQ ID NO: 3303056 - RNA, 12 nt, Human
aagagcccaggc

SEQ ID NO: 3303057 - RNA, 16 nt, Human
aagagauugugguuuc

SEQ ID NO: 3303058 - RNA, 17 nt, Human
aagacucauucuucugu

SEQ ID NO: 3303059 - RNA, 20 nt, Human
aagacgcugugcugcccugc

SEQ ID NO: 3303060 - RNA, 23 nt, Human
aagacgcugugcugcccugccca

SEQ ID NO: 3303061 - RNA, 22 nt, Human
aagacgcugugcugcccugccc

SEQ ID NO: 3303062 - RNA, 21 nt, Human
aagacgcugugcugcccugcc

SEQ ID NO: 3303063 - RNA, 17 nt, Human
guggcagcugcggucca

SEQ ID NO: 3303064 - RNA, 20 nt, Human
guggcagcucaccucucccu

SEQ ID NO: 3303065 - RNA, 14 nt, Human
guggcaccagcagc

SEQ ID NO: 3303066 - RNA, 13 nt, Human
guggcaccagcag

SEQ ID NO: 3303067 - RNA, 14 nt, Human
guggcagcugcggu

SEQ ID NO: 3303068 - RNA, 22 nt, Human
guggcagcucaccucucccuug

SEQ ID NO: 3303069 - RNA, 23 nt, Human
guggauuuaacagaaauguacag

SEQ ID NO: 3303070 - RNA, 20 nt, Human
guggauuuaacagaaaugua

SEQ ID NO: 3303071 - RNA, 21 nt, Human
guggauuuaacagaaauguac

SEQ ID NO: 3303072 - RNA, 14 nt, Human
guggacacagcucu

SEQ ID NO: 3303073 - RNA, 15 nt, Human
guggacacagcucuu

SEQ ID NO: 3303074 - RNA, 23 nt, Human
guggacacagcucuucuccaggc

SEQ ID NO: 3303075 - RNA, 24 nt, Human
guggacacagcucuucuccaggcu

SEQ ID NO: 3303076 - RNA, 18 nt, Human
gugcugcccugcccaccu

SEQ ID NO: 3303077 - RNA, 20 nt, Human
gugcugcccugcccaccugg

SEQ ID NO: 3303078 - RNA, 19 nt, Human
gugcugcccugcccaccug

SEQ ID NO: 3303079 - RNA, 17 nt, Human
aagaagcccaggaaagg

SEQ ID NO: 3303080 - RNA, 16 nt, Human
aagaagcccaggaaag

SEQ ID NO: 3303081 - RNA, 15 nt, Human
aagaagcucucuccu

SEQ ID NO: 3303082 - RNA, 14 nt, Human
aagaagcucucucc

SEQ ID NO: 3303083 - RNA, 22 nt, Human
aagaaaaaggaugcacagaguu

SEQ ID NO: 3303084 - RNA, 20 nt, Human
aagaaaaaggaugcacagag

SEQ ID NO: 3303085 - RNA, 19 nt, Human
aagaaaaaggaugcacaga

SEQ ID NO: 3303086 - RNA, 14 nt, Human
aacuuggcgcugcc

SEQ ID NO: 3303087 - RNA, 22 nt, Human
aacuugucuuuggacccugagg

SEQ ID NO: 3303088 - RNA, 23 nt, Human
aacuugguucccauuugcuccuu

SEQ ID NO: 3303089 - RNA, 14 nt, Human
gugccucugggacu

SEQ ID NO: 3303090 - RNA, 15 nt, Human
gugccucugggacug

SEQ ID NO: 3303091 - RNA, 14 nt, Human
gugccaagcagagg

SEQ ID NO: 3303092 - RNA, 15 nt, Human
gugcauuuggugguu

SEQ ID NO: 3303093 - RNA, 22 nt, Human
gugcauuugaggucuguucuuu

SEQ ID NO: 3303094 - RNA, 21 nt, Human
gugcauuugaggucuguucuu

SEQ ID NO: 3303095 - RNA, 20 nt, Human
gugcauuugaggucuguucu

SEQ ID NO: 3303096 - RNA, 12 nt, Human
gugcacacacca

SEQ ID NO: 3303097 - RNA, 14 nt, Human
gugcacacaccaga

SEQ ID NO: 3303098 - RNA, 18 nt, Human
gugcacguacacacacau

SEQ ID NO: 3303099 - RNA, 17 nt, Human
gugcacacaccagagcc

SEQ ID NO: 3303100 - RNA, 23 nt, Human
gugcacaagcuccaagcucccag

SEQ ID NO: 3303101 - RNA, 19 nt, Human
gucccaccuuggcugcagg

SEQ ID NO: 3303102 - RNA, 17 nt, Human
gucccaccuuggcugca

SEQ ID NO: 3303103 - RNA, 18 nt, Human
gucccaccuuggcugcag

SEQ ID NO: 3303104 - RNA, 23 nt, Human
guccccuguuuguuucugaaagg

SEQ ID NO: 3303105 - RNA, 16 nt, Human
guccccgcacugggcu

SEQ ID NO: 3303106 - RNA, 15 nt, Human
guccccgcacugggc

SEQ ID NO: 3303107 - RNA, 13 nt, Human
gucccccugacaa

SEQ ID NO: 3303108 - RNA, 22 nt, Human
guccgaaagggacuuggaagcu

SEQ ID NO: 3303109 - RNA, 21 nt, Human
guccgaaagggacuuggaagc

SEQ ID NO: 3303110 - RNA, 13 nt, Human
gucccuuuuccuu

SEQ ID NO: 3303111 - RNA, 20 nt, Human
aacauacucccaucugugaa

SEQ ID NO: 3303112 - RNA, 16 nt, Human
aacauacucccaucug

SEQ ID NO: 3303113 - RNA, 18 nt, Human
aacauacucccaucugug

SEQ ID NO: 3303114 - RNA, 22 nt, Human
aacauguuuuucuucucccuca

SEQ ID NO: 3303115 - RNA, 13 nt, Human
guccuacccaccc

SEQ ID NO: 3303116 - RNA, 20 nt, Human
aacagacuggaagcacagcu

SEQ ID NO: 3303117 - RNA, 16 nt, Human
guccugcugcaguugc

SEQ ID NO: 3303118 - RNA, 13 nt, Human
guccugcugcagu

SEQ ID NO: 3303119 - RNA, 13 nt, Human
gucgcccagucug

SEQ ID NO: 3303120 - RNA, 14 nt, Human
gucgcccagucugg

SEQ ID NO: 3303121 - RNA, 14 nt, Human
gucgaggacaggga

SEQ ID NO: 3303122 - RNA, 20 nt, Human
gucuaccugaggggccucuu

SEQ ID NO: 3303123 - RNA, 23 nt, Human
gucgcccagucuggaaugcagug

SEQ ID NO: 3303124 - RNA, 23 nt, Human
aaccaucauugaaaucuuuuugc

SEQ ID NO: 3303125 - RNA, 13 nt, Human
aaccacaucuugc

SEQ ID NO: 3303126 - RNA, 19 nt, Human
gucucaaaaaaagaaaaag

SEQ ID NO: 3303127 - RNA, 22 nt, Human
gucucaaacucuugaccucagg

SEQ ID NO: 3303128 - RNA, 14 nt, Human
gucuaugggacuca

SEQ ID NO: 3303129 - RNA, 14 nt, Human
gugaagugaagaca

SEQ ID NO: 3303130 - RNA, 23 nt, Human
gugaagacaaugacuuacuguac

SEQ ID NO: 3303131 - RNA, 18 nt, Human
gugaccauguuuuguuua

SEQ ID NO: 3303132 - RNA, 21 nt, Human
gugaccagcaccaucucuccu

SEQ ID NO: 3303133 - RNA, 18 nt, Human
gugaccagcaccaucucu

SEQ ID NO: 3303134 - RNA, 17 nt, Human
gugaccaaugaugguca

SEQ ID NO: 3303135 - RNA, 16 nt, Human
gugacagaggcagccc

SEQ ID NO: 3303136 - RNA, 18 nt, Human
gugacagaggcagcccca

SEQ ID NO: 3303137 - RNA, 19 nt, Human
gugacagaggcagccccau

SEQ ID NO: 3303138 - RNA, 20 nt, Human
gugaguccuggcaugggaau

SEQ ID NO: 3303139 - RNA, 19 nt, Human
gugagucaccaagcccagu

SEQ ID NO: 3303140 - RNA, 19 nt, Human
gugaguacuacaguccucc

SEQ ID NO: 3303141 - RNA, 17 nt, Human
gugaguccuggcauggg

SEQ ID NO: 3303142 - RNA, 12 nt, Human
gugagagcuggg

SEQ ID NO: 3303143 - RNA, 12 nt, Human
gugaccccaggu

SEQ ID NO: 3303144 - RNA, 15 nt, Human
gugagcaauccugca

SEQ ID NO: 3303145 - RNA, 13 nt, Human
gugagagcugggu

SEQ ID NO: 3303146 - RNA, 16 nt, Human
gugagaggggaacaga

SEQ ID NO: 3303147 - RNA, 21 nt, Human
gugagcacuaaggugugcucu

SEQ ID NO: 3303148 - RNA, 17 nt, Human
gugaguacuacaguccu

SEQ ID NO: 3303149 - RNA, 18 nt, Human
gucuggaaugcaguggua

SEQ ID NO: 3303150 - RNA, 21 nt, Human
gucugacaggcaaugcuggcu

SEQ ID NO: 3303151 - RNA, 22 nt, Human
gucugacaggcaaugcuggcug

SEQ ID NO: 3303152 - RNA, 23 nt, Human
gucugacaggcaaugcuggcugu

SEQ ID NO: 3303153 - RNA, 18 nt, Human
gucucuuuaaugucacag

SEQ ID NO: 3303154 - RNA, 19 nt, Human
gucucuuuaaugucacagg

SEQ ID NO: 3303155 - RNA, 20 nt, Human
gucucuuuaaugucacaggc

SEQ ID NO: 3303156 - RNA, 14 nt, Human
gucugaaggcuggg

SEQ ID NO: 3303157 - RNA, 19 nt, Human
gucugaaggcuggguucug

SEQ ID NO: 3303158 - RNA, 22 nt, Human
gucucuuuaaugucacaggcag

SEQ ID NO: 3303159 - RNA, 17 nt, Human
gucucuugguccugcug

SEQ ID NO: 3303160 - RNA, 19 nt, Human
gucucuugguccugcugca

SEQ ID NO: 3303161 - RNA, 18 nt, Human
gucucuugguccugcugc

SEQ ID NO: 3303162 - RNA, 20 nt, Human
gucucuugguccugcugcag

SEQ ID NO: 3303163 - RNA, 13 nt, Human
gucucuugguccu

SEQ ID NO: 3303164 - RNA, 18 nt, Human
aaccugauugugucucuu

SEQ ID NO: 3303165 - RNA, 19 nt, Human
aaccugauugugucucuug

SEQ ID NO: 3303166 - RNA, 12 nt, Human
aaccugugucuc

SEQ ID NO: 3303167 - RNA, 16 nt, Human
gucuuuguacagacaa

SEQ ID NO: 3303168 - RNA, 15 nt, Human
gucuuuguacagaca

SEQ ID NO: 3303169 - RNA, 16 nt, Human
gucuucaguaagccgu

SEQ ID NO: 3303170 - RNA, 22 nt, Human
aacguggcugcuucaaggaucc

SEQ ID NO: 3303171 - RNA, 23 nt, Human
aacguggcugcuucaaggauccu

SEQ ID NO: 3303172 - RNA, 12 nt, Human
aaguuaaauaaa

SEQ ID NO: 3303173 - RNA, 14 nt, Human
aaguuaaauaaauc

SEQ ID NO: 3303174 - RNA, 18 nt, Human
uaaaccgccaaggcuggg

SEQ ID NO: 3303175 - RNA, 16 nt, Human
uaaaccgccaaggcug

SEQ ID NO: 3303176 - RNA, 19 nt, Human
uaaaggcuaccuuuguauu

SEQ ID NO: 3303177 - RNA, 21 nt, Human
uaaaggcuaccuuuguauucu

SEQ ID NO: 3303178 - RNA, 21 nt, Human
uaaaucuccaaaauaaaacuu

SEQ ID NO: 3303179 - RNA, 20 nt, Human
uaaaucuccaaaauaaaacu

SEQ ID NO: 3303180 - RNA, 18 nt, Human
uaaaucuccaaaauaaaa

SEQ ID NO: 3303181 - RNA, 22 nt, Human
uaaauuaacuuuuauaaacuuu

SEQ ID NO: 3303182 - RNA, 13 nt, Human
uaacaagccaccc

SEQ ID NO: 3303183 - RNA, 19 nt, Human
uaaaucuccaaaauaaaac

SEQ ID NO: 3303184 - RNA, 15 nt, Human
aauacaccacuacau

SEQ ID NO: 3303185 - RNA, 20 nt, Human
aauacaccacuacauucugu

SEQ ID NO: 3303186 - RNA, 18 nt, Human
aauacaccacuacauucu

SEQ ID NO: 3303187 - RNA, 16 nt, Human
aauacaccacuacauu

SEQ ID NO: 3303188 - RNA, 19 nt, Human
aauaacauguaauuaagua

SEQ ID NO: 3303189 - RNA, 12 nt, Human
aauaacauguaa

SEQ ID NO: 3303190 - RNA, 12 nt, Human
aauaaauuauuu

SEQ ID NO: 3303191 - RNA, 15 nt, Human
aauaacuaaaaggua

SEQ ID NO: 3303192 - RNA, 14 nt, Human
aauaaaguaauuau

SEQ ID NO: 3303193 - RNA, 19 nt, Human
uaaaguguauuuuuuuacu

SEQ ID NO: 3303194 - RNA, 15 nt, Human
uaaaguguauuuuuu

SEQ ID NO: 3303195 - RNA, 14 nt, Human
uaaaguguauuuuu

SEQ ID NO: 3303196 - RNA, 13 nt, Human
uaaagucaggggu

SEQ ID NO: 3303197 - RNA, 11 nt, Human
aagcucccagg

SEQ ID NO: 3303198 - RNA, 13 nt, Human
guguuuauuguca

SEQ ID NO: 3303199 - RNA, 21 nt, Human
aagcucuacugaggugcuaug

SEQ ID NO: 3303200 - RNA, 23 nt, Human
aagcucccaggcauuccccagga

SEQ ID NO: 3303201 - RNA, 22 nt, Human
aagcucccaggcauuccccagg

SEQ ID NO: 3303202 - RNA, 12 nt, Human
aagcucccaggc

SEQ ID NO: 3303203 - RNA, 13 nt, Human
aagcucugcuccu

SEQ ID NO: 3303204 - RNA, 18 nt, Human
aagcuguuacugucuuca

SEQ ID NO: 3303205 - RNA, 22 nt, Human
guugauagcacagacccugccc

SEQ ID NO: 3303206 - RNA, 23 nt, Human
guugauagcacagacccugcccu

SEQ ID NO: 3303207 - RNA, 14 nt, Human
guucucugaggaca

SEQ ID NO: 3303208 - RNA, 16 nt, Human
guucucugaggacacu

SEQ ID NO: 3303209 - RNA, 11 nt, Human
guucucugccc

SEQ ID NO: 3303210 - RNA, 12 nt, Human
guucucugcccu

SEQ ID NO: 3303211 - RNA, 17 nt, Human
guugggcuggugucacc

SEQ ID NO: 3303212 - RNA, 15 nt, Human
guugggcugguguca

SEQ ID NO: 3303213 - RNA, 16 nt, Human
guugcccaggcuggcg

SEQ ID NO: 3303214 - RNA, 15 nt, Human
guugcccaggcuggc

SEQ ID NO: 3303215 - RNA, 23 nt, Human
guuggcugggggccucagugcca

SEQ ID NO: 3303216 - RNA, 13 nt, Human
aaggcuaccuuug

SEQ ID NO: 3303217 - RNA, 14 nt, Human
guugcccaggcugg

SEQ ID NO: 3303218 - RNA, 19 nt, Human
aaggccccgcccaggcuua

SEQ ID NO: 3303219 - RNA, 16 nt, Human
aaggccccgcccaggc

SEQ ID NO: 3303220 - RNA, 14 nt, Human
aaggccccgcccag

SEQ ID NO: 3303221 - RNA, 22 nt, Human
aaggaugcacagaguuguuaca

SEQ ID NO: 3303222 - RNA, 24 nt, Human
aaggaugcacagaguuguuacauu

SEQ ID NO: 3303223 - RNA, 14 nt, Human
aaggaugcccaaag

SEQ ID NO: 3303224 - RNA, 15 nt, Human
aaggaaacccagcuc

SEQ ID NO: 3303225 - RNA, 17 nt, Human
aaggagauuuacaacug

SEQ ID NO: 3303226 - RNA, 18 nt, Human
aaggagauuuacaacugg

SEQ ID NO: 3303227 - RNA, 22 nt, Human
aaggauccugagccagauuuca

SEQ ID NO: 3303228 - RNA, 20 nt, Human
aaggauccugagccagauuu

SEQ ID NO: 3303229 - RNA, 12 nt, Human
aaggauccugag

SEQ ID NO: 3303230 - RNA, 11 nt, Human
aaggauccuga

SEQ ID NO: 3303231 - RNA, 18 nt, Human
aaggaggaagagaaaaaa

SEQ ID NO: 3303232 - RNA, 20 nt, Human
aaggaggaagagaaaaaaua

SEQ ID NO: 3303233 - RNA, 17 nt, Human
aaggguaucaggugcug

SEQ ID NO: 3303234 - RNA, 14 nt, Human
aaggggcaguggug

SEQ ID NO: 3303235 - RNA, 19 nt, Human
aaggguaucaggugcugcc

SEQ ID NO: 3303236 - RNA, 16 nt, Human
aaggguaucuggugac

SEQ ID NO: 3303237 - RNA, 15 nt, Human
aagggcccagagagg

SEQ ID NO: 3303238 - RNA, 13 nt, Human
aagggcccagaga

SEQ ID NO: 3303239 - RNA, 15 nt, Human
guuuuacugcagcuu

SEQ ID NO: 3303240 - RNA, 18 nt, Human
guuuuacugcagcuuugu

SEQ ID NO: 3303241 - RNA, 16 nt, Human
guuuuacugcagcuuu

SEQ ID NO: 3303242 - RNA, 14 nt, Human
guuuuaagaggcag

SEQ ID NO: 3303243 - RNA, 16 nt, Human
guuuuaagaggcaggg

SEQ ID NO: 3303244 - RNA, 16 nt, Human
guuugccucugccucu

SEQ ID NO: 3303245 - RNA, 17 nt, Human
guuugccucugccucug

SEQ ID NO: 3303246 - RNA, 13 nt, Human
guuugcuaaguga

SEQ ID NO: 3303247 - RNA, 22 nt, Human
guuucugccgcagcccugcaga

SEQ ID NO: 3303248 - RNA, 18 nt, Human
guuucugccgcagcccug

SEQ ID NO: 3303249 - RNA, 20 nt, Human
aaguacuucuccacccugcu

SEQ ID NO: 3303250 - RNA, 22 nt, Human
aaguacuucuccacccugcucu

SEQ ID NO: 3303251 - RNA, 15 nt, Human
aaguacuauguauca

SEQ ID NO: 3303252 - RNA, 21 nt, Human
aaguacuucuccacccugcuc

SEQ ID NO: 3303253 - RNA, 15 nt, Human
aaguacuggagaaaa

SEQ ID NO: 3303254 - RNA, 16 nt, Human
aaguacuauguaucaa

SEQ ID NO: 3303255 - RNA, 13 nt, Human
aagucacacagug

SEQ ID NO: 3303256 - RNA, 18 nt, Human
aaguauucuuauuuaaug

SEQ ID NO: 3303257 - RNA, 24 nt, Human
aagucacacaguauuacuucugcu

SEQ ID NO: 3303258 - RNA, 21 nt, Human
aagucaagugaaaaaggagga

SEQ ID NO: 3303259 - RNA, 16 nt, Human
guuuuugucuuaaaaa

SEQ ID NO: 3303260 - RNA, 18 nt, Human
guuuuucuaggccugggg

SEQ ID NO: 3303261 - RNA, 18 nt, Human
aagucuuagauguauaua

SEQ ID NO: 3303262 - RNA, 19 nt, Human
aagucuuagauguauauau

SEQ ID NO: 3303263 - RNA, 17 nt, Human
aagucuuagauguauau

SEQ ID NO: 3303264 - RNA, 15 nt, Human
uccucuccccagcaa

SEQ ID NO: 3303265 - RNA, 23 nt, Human
acugaguacguugugcauuuggu

SEQ ID NO: 3303266 - RNA, 22 nt, Human
acugaguacguugugcauuugg

SEQ ID NO: 3303267 - RNA, 21 nt, Human
acugaguacguugugcauuug

SEQ ID NO: 3303268 - RNA, 19 nt, Human
acugaguacguugugcauu

SEQ ID NO: 3303269 - RNA, 18 nt, Human
acugaguacguugugcau

SEQ ID NO: 3303270 - RNA, 13 nt, Human
acugcaaccuccg

SEQ ID NO: 3303271 - RNA, 14 nt, Human
acugcaaccuccgc

SEQ ID NO: 3303272 - RNA, 16 nt, Human
acugcaaccuccgccu

SEQ ID NO: 3303273 - RNA, 22 nt, Human
acugcaaccuccgccucuuggg

SEQ ID NO: 3303274 - RNA, 15 nt, Human
uccugcaggcagcca

SEQ ID NO: 3303275 - RNA, 21 nt, Human
uccugaugcuucuucagagac

SEQ ID NO: 3303276 - RNA, 17 nt, Human
uccugccucagccuccc

SEQ ID NO: 3303277 - RNA, 20 nt, Human
uccugccucgaacuggcugc

SEQ ID NO: 3303278 - RNA, 22 nt, Human
uccugcaggcagccaggccaca

SEQ ID NO: 3303279 - RNA, 19 nt, Human
uccugccucagccucccaa

SEQ ID NO: 3303280 - RNA, 20 nt, Human
uccugcaggcagccaggcca

SEQ ID NO: 3303281 - RNA, 19 nt, Human
uccugcaggcagccaggcc

SEQ ID NO: 3303282 - RNA, 17 nt, Human
uccugcaggcagccagg

SEQ ID NO: 3303283 - RNA, 16 nt, Human
uccugcaggcagccag

SEQ ID NO: 3303284 - RNA, 19 nt, Human
uccuguucccaugagauga

SEQ ID NO: 3303285 - RNA, 18 nt, Human
uccugugugugcgccuac

SEQ ID NO: 3303286 - RNA, 13 nt, Human
uccugugugugcg

SEQ ID NO: 3303287 - RNA, 14 nt, Human
uccugugugugcgc

SEQ ID NO: 3303288 - RNA, 23 nt, Human
uccugugucuugcaauggcagcc

SEQ ID NO: 3303289 - RNA, 24 nt, Human
uccugugucuugcaauggcagccu

SEQ ID NO: 3303290 - RNA, 19 nt, Human
acugcagccucaaccuccu

SEQ ID NO: 3303291 - RNA, 21 nt, Human
acugcagccucaaccuccugg

SEQ ID NO: 3303292 - RNA, 22 nt, Human
acugcagccucaaccuccuggg

SEQ ID NO: 3303293 - RNA, 13 nt, Human
acugcacuguuuu

SEQ ID NO: 3303294 - RNA, 23 nt, Human
acugcagccucaaccuccugggc

SEQ ID NO: 3303295 - RNA, 13 nt, Human
uccugcugcaguu

SEQ ID NO: 3303296 - RNA, 11 nt, Human
uccuucagugc

SEQ ID NO: 3303297 - RNA, 12 nt, Human
uccuucagugcc

SEQ ID NO: 3303298 - RNA, 22 nt, Human
uccuucagugccuuauggaaca

SEQ ID NO: 3303299 - RNA, 20 nt, Human
uccuucagugccuuauggaa

SEQ ID NO: 3303300 - RNA, 13 nt, Human
uccuucagugccu

SEQ ID NO: 3303301 - RNA, 22 nt, Human
acuggcugcaaaggguaucagg

SEQ ID NO: 3303302 - RNA, 23 nt, Human
acugcuuccagugaggcucugcc

SEQ ID NO: 3303303 - RNA, 22 nt, Human
acugcuuccagugaggcucugc

SEQ ID NO: 3303304 - RNA, 21 nt, Human
acugcuuccagugaggcucug

SEQ ID NO: 3303305 - RNA, 18 nt, Human
acugcuuccagugaggcu

SEQ ID NO: 3303306 - RNA, 17 nt, Human
acugcuuccagugaggc

SEQ ID NO: 3303307 - RNA, 22 nt, Human
acuggauuaaacuuaaucuaaa

SEQ ID NO: 3303308 - RNA, 19 nt, Human
acuggguacuuguggacac

SEQ ID NO: 3303309 - RNA, 20 nt, Human
acuggguacuuguggacaca

SEQ ID NO: 3303310 - RNA, 23 nt, Human
acuggguacuuguggacacagcu

SEQ ID NO: 3303311 - RNA, 18 nt, Human
acuggguacuuguggaca

SEQ ID NO: 3303312 - RNA, 12 nt, Human
ucgcuccugugu

SEQ ID NO: 3303313 - RNA, 13 nt, Human
ucgcuccuguguc

SEQ ID NO: 3303314 - RNA, 22 nt, Human
acugggcuuggggaccagagcu

SEQ ID NO: 3303315 - RNA, 14 nt, Human
acuguacaugaaaa

SEQ ID NO: 3303316 - RNA, 13 nt, Human
acuguacaugaaa

SEQ ID NO: 3303317 - RNA, 23 nt, Human
acuguacaugaaaacacauuuuu

SEQ ID NO: 3303318 - RNA, 13 nt, Human
acuguacaaagua

SEQ ID NO: 3303319 - RNA, 19 nt, Human
acuguaauuugugauacaa

SEQ ID NO: 3303320 - RNA, 14 nt, Human
acuguacaaaguag

SEQ ID NO: 3303321 - RNA, 15 nt, Human
acuguacaaaguaga

SEQ ID NO: 3303322 - RNA, 13 nt, Human
ucgaggacaggga

SEQ ID NO: 3303323 - RNA, 14 nt, Human
ucgagcaugccugg

SEQ ID NO: 3303324 - RNA, 14 nt, Human
ucgaggacagggag

SEQ ID NO: 3303325 - RNA, 17 nt, Human
ucgaggacagggaggug

SEQ ID NO: 3303326 - RNA, 13 nt, Human
ucgcgacaaugca

SEQ ID NO: 3303327 - RNA, 15 nt, Human
uccuuucaccacaug

SEQ ID NO: 3303328 - RNA, 23 nt, Human
uccuuuagcgcccaguugggugg

SEQ ID NO: 3303329 - RNA, 15 nt, Human
ucgaacuggcugcaa

SEQ ID NO: 3303330 - RNA, 14 nt, Human
ucgaacuggcugca

SEQ ID NO: 3303331 - RNA, 13 nt, Human
ucgaacuggcugc

SEQ ID NO: 3303332 - RNA, 14 nt, Human
acguuucuaaaggc

SEQ ID NO: 3303333 - RNA, 13 nt, Human
uccagccugggug

SEQ ID NO: 3303334 - RNA, 24 nt, Human
uccagccugggugacagagcaagu

SEQ ID NO: 3303335 - RNA, 14 nt, Human
uccagcucaccagc

SEQ ID NO: 3303336 - RNA, 12 nt, Human
acguuucuaaag

SEQ ID NO: 3303337 - RNA, 15 nt, Human
acuacaguccuccca

SEQ ID NO: 3303338 - RNA, 23 nt, Human
acuacaggugugagucaccaagc

SEQ ID NO: 3303339 - RNA, 17 nt, Human
acuaaccagcagaaaug

SEQ ID NO: 3303340 - RNA, 13 nt, Human
acuaaccacgcug

SEQ ID NO: 3303341 - RNA, 16 nt, Human
acuaaccagcagaaau

SEQ ID NO: 3303342 - RNA, 12 nt, Human
acuaaccacgcu

SEQ ID NO: 3303343 - RNA, 22 nt, Human
ucccagugccgagaaggaagcc

SEQ ID NO: 3303344 - RNA, 19 nt, Human
ucccagugccgagaaggaa

SEQ ID NO: 3303345 - RNA, 16 nt, Human
acuacaguccucccau

SEQ ID NO: 3303346 - RNA, 15 nt, Human
acuacaguuuguuag

SEQ ID NO: 3303347 - RNA, 22 nt, Human
uccccaccgcagacaggaccag

SEQ ID NO: 3303348 - RNA, 15 nt, Human
ucccauaugccuggg

SEQ ID NO: 3303349 - RNA, 13 nt, Human
ucccaucucacac

SEQ ID NO: 3303350 - RNA, 19 nt, Human
ucccaucucacacaugagc

SEQ ID NO: 3303351 - RNA, 14 nt, Human
ucccaucucacaca

SEQ ID NO: 3303352 - RNA, 16 nt, Human
ucccuauuagagaaga

SEQ ID NO: 3303353 - RNA, 18 nt, Human
ucccuauuagagaagaga

SEQ ID NO: 3303354 - RNA, 20 nt, Human
ucccgaguagcugggacuac

SEQ ID NO: 3303355 - RNA, 15 nt, Human
ucccgaauagcuggg

SEQ ID NO: 3303356 - RNA, 16 nt, Human
ucccgaauagcuggga

SEQ ID NO: 3303357 - RNA, 17 nt, Human
acuauagccuaggugac

SEQ ID NO: 3303358 - RNA, 21 nt, Human
acuauaauguaagcucuacug

SEQ ID NO: 3303359 - RNA, 23 nt, Human
acuauaauuuaccugaagucuuu

SEQ ID NO: 3303360 - RNA, 24 nt, Human
uccccaccgcagacaggaccaggg

SEQ ID NO: 3303361 - RNA, 23 nt, Human
uccccaggaggccagccuugacc

SEQ ID NO: 3303362 - RNA, 23 nt, Human
acuauguugcccaggcaggucuu

SEQ ID NO: 3303363 - RNA, 19 nt, Human
acuauguugcccaggcagg

SEQ ID NO: 3303364 - RNA, 20 nt, Human
acuauguugcccaggcaggu

SEQ ID NO: 3303365 - RNA, 17 nt, Human
acuauguugcccaggca

SEQ ID NO: 3303366 - RNA, 18 nt, Human
acuauguugcccaggcag

SEQ ID NO: 3303367 - RNA, 16 nt, Human
acucuuauugcccacg

SEQ ID NO: 3303368 - RNA, 20 nt, Human
uccucagaucuucugugggu

SEQ ID NO: 3303369 - RNA, 12 nt, Human
uccucuccccag

SEQ ID NO: 3303370 - RNA, 19 nt, Human
uccucccucccucuuuccc

SEQ ID NO: 3303371 - RNA, 17 nt, Human
uccucccucccucuuuc

SEQ ID NO: 3303372 - RNA, 15 nt, Human
uccucccucccucuu

SEQ ID NO: 3303373 - RNA, 18 nt, Human
uccucauacccaccccca

SEQ ID NO: 3303374 - RNA, 14 nt, Human
uccucauacccacc

SEQ ID NO: 3303375 - RNA, 17 nt, Human
acucgcgacaaugcaaa

SEQ ID NO: 3303376 - RNA, 23 nt, Human
acucgcgacaaugcaaaccauca

SEQ ID NO: 3303377 - RNA, 20 nt, Human
acucgcgacaaugcaaacca

SEQ ID NO: 3303378 - RNA, 19 nt, Human
uccuaggcauuugcugaau

SEQ ID NO: 3303379 - RNA, 18 nt, Human
acucgcgacaaugcaaac

SEQ ID NO: 3303380 - RNA, 17 nt, Human
acucuccucugcugcug

SEQ ID NO: 3303381 - RNA, 16 nt, Human
acucuccucugcugcu

SEQ ID NO: 3303382 - RNA, 19 nt, Human
acucuccucugcugcuggc

SEQ ID NO: 3303383 - RNA, 18 nt, Human
acucuccucugcugcugg

SEQ ID NO: 3303384 - RNA, 22 nt, Human
acucauugaccugaggcccuuc

SEQ ID NO: 3303385 - RNA, 20 nt, Human
ucccucagucuggcccuucc

SEQ ID NO: 3303386 - RNA, 21 nt, Human
ucccucagucuggcccuuccu

SEQ ID NO: 3303387 - RNA, 22 nt, Human
ucccucauccucauacccaccc

SEQ ID NO: 3303388 - RNA, 23 nt, Human
ucccugguggcagcucaccucuc

SEQ ID NO: 3303389 - RNA, 17 nt, Human
ucccuuacgugaguccu

SEQ ID NO: 3303390 - RNA, 22 nt, Human
ucccuuacgugaguccuggcau

SEQ ID NO: 3303391 - RNA, 18 nt, Human
ucccuuacgugaguccug

SEQ ID NO: 3303392 - RNA, 22 nt, Human
ucccuuuccaaaugcccagcuu

SEQ ID NO: 3303393 - RNA, 14 nt, Human
uccuaggcauuugc

SEQ ID NO: 3303394 - RNA, 21 nt, Human
ucccuuugacgccaucccagc

SEQ ID NO: 3303395 - RNA, 23 nt, Human
ucccuuugacgccaucccagccc

SEQ ID NO: 3303396 - RNA, 22 nt, Human
ucccuuugacgccaucccagcc

SEQ ID NO: 3303397 - RNA, 14 nt, Human
ucaggccagcugcu

SEQ ID NO: 3303398 - RNA, 11 nt, Human
ucaggccaggc

SEQ ID NO: 3303399 - RNA, 20 nt, Human
ucaggccagcugcuugggcu

SEQ ID NO: 3303400 - RNA, 15 nt, Human
ucaggccagcugcuu

SEQ ID NO: 3303401 - RNA, 13 nt, Human
ucagggucccugg

SEQ ID NO: 3303402 - RNA, 23 nt, Human
ucaggggugugcggccuuuggcu

SEQ ID NO: 3303403 - RNA, 14 nt, Human
ucagggucccuggu

SEQ ID NO: 3303404 - RNA, 13 nt, Human
ucagguaacaggc

SEQ ID NO: 3303405 - RNA, 15 nt, Human
ucagguaacaggcag

SEQ ID NO: 3303406 - RNA, 16 nt, Human
ucagguaacaggcaga

SEQ ID NO: 3303407 - RNA, 16 nt, Human
accccuucgcuccugu

SEQ ID NO: 3303408 - RNA, 19 nt, Human
accccuucgcuccuguguc

SEQ ID NO: 3303409 - RNA, 15 nt, Human
ucagcggggacagcu

SEQ ID NO: 3303410 - RNA, 16 nt, Human
ucagcggggacagcuc

SEQ ID NO: 3303411 - RNA, 17 nt, Human
ucagcggggacagcucc

SEQ ID NO: 3303412 - RNA, 20 nt, Human
ucaggaagcucagggccugg

SEQ ID NO: 3303413 - RNA, 19 nt, Human
ucaggaagcucagggccug

SEQ ID NO: 3303414 - RNA, 17 nt, Human
ucaggaagcucagggcc

SEQ ID NO: 3303415 - RNA, 16 nt, Human
ucaggaagcucagggc

SEQ ID NO: 3303416 - RNA, 20 nt, Human
ucaggccaaacucaccugcc

SEQ ID NO: 3303417 - RNA, 14 nt, Human
acccucuuagaaaa

SEQ ID NO: 3303418 - RNA, 13 nt, Human
acccugcccugug

SEQ ID NO: 3303419 - RNA, 12 nt, Human
acccugcccugu

SEQ ID NO: 3303420 - RNA, 11 nt, Human
acccugcccug

SEQ ID NO: 3303421 - RNA, 15 nt, Human
acccuugugguccca

SEQ ID NO: 3303422 - RNA, 19 nt, Human
acccuuguggucccacccc

SEQ ID NO: 3303423 - RNA, 17 nt, Human
acccuuguggucccacc

SEQ ID NO: 3303424 - RNA, 16 nt, Human
acccuuguggucccac

SEQ ID NO: 3303425 - RNA, 23 nt, Human
ucaggguuggccccugcccggcu

SEQ ID NO: 3303426 - RNA, 20 nt, Human
accccuucgcuccugugucu

SEQ ID NO: 3303427 - RNA, 15 nt, Human
acccagcucuggucc

SEQ ID NO: 3303428 - RNA, 13 nt, Human
acccagcucuggu

SEQ ID NO: 3303429 - RNA, 23 nt, Human
acccaggugcuaggaacacuccu

SEQ ID NO: 3303430 - RNA, 13 nt, Human
ucagaucuucugu

SEQ ID NO: 3303431 - RNA, 13 nt, Human
ucagaagacacug

SEQ ID NO: 3303432 - RNA, 15 nt, Human
acccccagccugcua

SEQ ID NO: 3303433 - RNA, 14 nt, Human
acccccagccugcu

SEQ ID NO: 3303434 - RNA, 12 nt, Human
ucagccugggca

SEQ ID NO: 3303435 - RNA, 10 nt, Human
ucagccuggg

SEQ ID NO: 3303436 - RNA, 17 nt, Human
ucacuguugcccaggcu

SEQ ID NO: 3303437 - RNA, 18 nt, Human
ucacuguugcccaggcug

SEQ ID NO: 3303438 - RNA, 21 nt, Human
accaguguuguggauuuaaca

SEQ ID NO: 3303439 - RNA, 18 nt, Human
accaguguuguggauuua

SEQ ID NO: 3303440 - RNA, 12 nt, Human
ucacugcagccu

SEQ ID NO: 3303441 - RNA, 16 nt, Human
ucacuguugcccaggc

SEQ ID NO: 3303442 - RNA, 13 nt, Human
ucacugagacagc

SEQ ID NO: 3303443 - RNA, 15 nt, Human
ucacugagacagccc

SEQ ID NO: 3303444 - RNA, 14 nt, Human
ucacugagacagcc

SEQ ID NO: 3303445 - RNA, 16 nt, Human
ucaccugccccucaac

SEQ ID NO: 3303446 - RNA, 23 nt, Human
accauuuugggguacccacugcu

SEQ ID NO: 3303447 - RNA, 22 nt, Human
accauuuugggguacccacugc

SEQ ID NO: 3303448 - RNA, 23 nt, Human
accaugauuaaccacuucagcug

SEQ ID NO: 3303449 - RNA, 22 nt, Human
accaugauuaaccacuucagcu

SEQ ID NO: 3303450 - RNA, 16 nt, Human
accauucuccaccugc

SEQ ID NO: 3303451 - RNA, 13 nt, Human
accauucuccacc

SEQ ID NO: 3303452 - RNA, 16 nt, Human
acccagaagaaaauag

SEQ ID NO: 3303453 - RNA, 16 nt, Human
acccagcccacuucug

SEQ ID NO: 3303454 - RNA, 17 nt, Human
acccagcccacuucugc

SEQ ID NO: 3303455 - RNA, 15 nt, Human
acccagcccacuucu

SEQ ID NO: 3303456 - RNA, 18 nt, Human
acccagcccacuucugcc

SEQ ID NO: 3303457 - RNA, 14 nt, Human
accacuucagcuga

SEQ ID NO: 3303458 - RNA, 13 nt, Human
accacuucagcug

SEQ ID NO: 3303459 - RNA, 20 nt, Human
accacucuaucaaguauuau

SEQ ID NO: 3303460 - RNA, 20 nt, Human
accacaucuugcucugcuga

SEQ ID NO: 3303461 - RNA, 21 nt, Human
accacaucuugcucugcugac

SEQ ID NO: 3303462 - RNA, 24 nt, Human
accacaucuugcucugcugacaga

SEQ ID NO: 3303463 - RNA, 14 nt, Human
accacaucuugcuc

SEQ ID NO: 3303464 - RNA, 22 nt, Human
accacagacauacuaaccagca

SEQ ID NO: 3303465 - RNA, 21 nt, Human
accacagacauacuaaccagc

SEQ ID NO: 3303466 - RNA, 22 nt, Human
accagacaccuugacagggcac

SEQ ID NO: 3303467 - RNA, 23 nt, Human
accagacaccuugacagggcaca

SEQ ID NO: 3303468 - RNA, 17 nt, Human
accagacaccuugacag

SEQ ID NO: 3303469 - RNA, 12 nt, Human
accacuuuuguu

SEQ ID NO: 3303470 - RNA, 19 nt, Human
accagagcccaccuuggcu

SEQ ID NO: 3303471 - RNA, 22 nt, Human
accagagcccaccuuggcucaa

SEQ ID NO: 3303472 - RNA, 17 nt, Human
accagagcccaccuugg

SEQ ID NO: 3303473 - RNA, 23 nt, Human
ucaccugaagacucauucuucug

SEQ ID NO: 3303474 - RNA, 16 nt, Human
ucaccugaagacucau

SEQ ID NO: 3303475 - RNA, 19 nt, Human
ucaccugaagacucauucu

SEQ ID NO: 3303476 - RNA, 19 nt, Human
ucaugacaaagacugagua

SEQ ID NO: 3303477 - RNA, 19 nt, Human
ucauccacugugccaugug

SEQ ID NO: 3303478 - RNA, 21 nt, Human
ucauccacugugccaugugcc

SEQ ID NO: 3303479 - RNA, 17 nt, Human
ucauguucuuaauucuu

SEQ ID NO: 3303480 - RNA, 11 nt, Human
ucauguucuua

SEQ ID NO: 3303481 - RNA, 13 nt, Human
ucaugucuggcua

SEQ ID NO: 3303482 - RNA, 19 nt, Human
ucauugaccugaggcccuu

SEQ ID NO: 3303483 - RNA, 21 nt, Human
ucauucuccuuguguuacuaa

SEQ ID NO: 3303484 - RNA, 22 nt, Human
ucauugaccugaggcccuucuc

SEQ ID NO: 3303485 - RNA, 17 nt, Human
accucggugccuuccuc

SEQ ID NO: 3303486 - RNA, 15 nt, Human
accucucccuuggau

SEQ ID NO: 3303487 - RNA, 14 nt, Human
accucucccuugga

SEQ ID NO: 3303488 - RNA, 13 nt, Human
accucucccuugg

SEQ ID NO: 3303489 - RNA, 19 nt, Human
accucucucacuccuugaa

SEQ ID NO: 3303490 - RNA, 14 nt, Human
accucucucacucc

SEQ ID NO: 3303491 - RNA, 23 nt, Human
accucucccuuggauuguccccg

SEQ ID NO: 3303492 - RNA, 12 nt, Human
accucugcacaa

SEQ ID NO: 3303493 - RNA, 10 nt, Human
acccuuuucu

SEQ ID NO: 3303494 - RNA, 20 nt, Human
ucauauuuacuucuuauaca

SEQ ID NO: 3303495 - RNA, 21 nt, Human
ucauauuuacuucuuauacau

SEQ ID NO: 3303496 - RNA, 16 nt, Human
ucauauuuacuucuua

SEQ ID NO: 3303497 - RNA, 17 nt, Human
accgcagacaggaccag

SEQ ID NO: 3303498 - RNA, 17 nt, Human
accgccaaggcuggggg

SEQ ID NO: 3303499 - RNA, 20 nt, Human
accgcagacaggaccaggga

SEQ ID NO: 3303500 - RNA, 18 nt, Human
ucauccacugugccaugu

SEQ ID NO: 3303501 - RNA, 20 nt, Human
accuccgccucuuggguuca

SEQ ID NO: 3303502 - RNA, 13 nt, Human
accuagccuuaga

SEQ ID NO: 3303503 - RNA, 22 nt, Human
uccagccccuggaugcagccuc

SEQ ID NO: 3303504 - RNA, 11 nt, Human
uccagccuggg

SEQ ID NO: 3303505 - RNA, 14 nt, Human
uccagccccuggau

SEQ ID NO: 3303506 - RNA, 15 nt, Human
uccagccccuggaug

SEQ ID NO: 3303507 - RNA, 21 nt, Human
uccagccccuggaugcagccu

SEQ ID NO: 3303508 - RNA, 19 nt, Human
uccagccccuggaugcagc

SEQ ID NO: 3303509 - RNA, 17 nt, Human
uccagccccuggaugca

SEQ ID NO: 3303510 - RNA, 16 nt, Human
uccagccccuggaugc

SEQ ID NO: 3303511 - RNA, 22 nt, Human
uccagaaguuugagaucagccu

SEQ ID NO: 3303512 - RNA, 23 nt, Human
accuuuguauucucuccuguacc

SEQ ID NO: 3303513 - RNA, 19 nt, Human
accuuuguauucucuccug

SEQ ID NO: 3303514 - RNA, 15 nt, Human
accuuuguauucucu

SEQ ID NO: 3303515 - RNA, 15 nt, Human
accuugacagggcac

SEQ ID NO: 3303516 - RNA, 14 nt, Human
accuugacagggca

SEQ ID NO: 3303517 - RNA, 15 nt, Human
accuugaaugaugcc

SEQ ID NO: 3303518 - RNA, 13 nt, Human
accuucuccuuca

SEQ ID NO: 3303519 - RNA, 12 nt, Human
accuucuccuuc

SEQ ID NO: 3303520 - RNA, 15 nt, Human
uccaccaucaagcca

SEQ ID NO: 3303521 - RNA, 18 nt, Human
accugcggugcuaucucc

SEQ ID NO: 3303522 - RNA, 22 nt, Human
accugaagucuuuguacagaca

SEQ ID NO: 3303523 - RNA, 15 nt, Human
accugaagucuuugu

SEQ ID NO: 3303524 - RNA, 23 nt, Human
accugcggugcuaucucccccag

SEQ ID NO: 3303525 - RNA, 22 nt, Human
accugcggugcuaucuccccca

SEQ ID NO: 3303526 - RNA, 19 nt, Human
accugcggugcuaucuccc

SEQ ID NO: 3303527 - RNA, 19 nt, Human
ucauuugagcagggcucag

SEQ ID NO: 3303528 - RNA, 14 nt, Human
accuggaauauaua

SEQ ID NO: 3303529 - RNA, 21 nt, Human
ucauuugagcagggcucagcg

SEQ ID NO: 3303530 - RNA, 13 nt, Human
ucauuuuuuuuaa

SEQ ID NO: 3303531 - RNA, 16 nt, Human
uccaagcucccaggca

SEQ ID NO: 3303532 - RNA, 15 nt, Human
uccaagcucccaggc

SEQ ID NO: 3303533 - RNA, 14 nt, Human
uccaagcucccagg

SEQ ID NO: 3303534 - RNA, 13 nt, Human
uccaagcucccag

SEQ ID NO: 3303535 - RNA, 12 nt, Human
uccaagcuccca

SEQ ID NO: 3303536 - RNA, 11 nt, Human
uccaagcuggu

SEQ ID NO: 3303537 - RNA, 14 nt, Human
ucucuugagagggu

SEQ ID NO: 3303538 - RNA, 15 nt, Human
ucucuccagccccug

SEQ ID NO: 3303539 - RNA, 17 nt, Human
ucucuccuguaccucuu

SEQ ID NO: 3303540 - RNA, 22 nt, Human
ucucuccuguaccucuugagcc

SEQ ID NO: 3303541 - RNA, 20 nt, Human
ucucuccuguaccucuugag

SEQ ID NO: 3303542 - RNA, 18 nt, Human
ucuccuucaccuuugucc

SEQ ID NO: 3303543 - RNA, 20 nt, Human
ucuccuucaccuuugucccc

SEQ ID NO: 3303544 - RNA, 14 nt, Human
ucucuccagccccu

SEQ ID NO: 3303545 - RNA, 13 nt, Human
ucucuccagcccc

SEQ ID NO: 3303546 - RNA, 18 nt, Human
agaaaaaggaugcacaga

SEQ ID NO: 3303547 - RNA, 21 nt, Human
ucucuuuaaugucacaggcag

SEQ ID NO: 3303548 - RNA, 15 nt, Human
ucucuugagccuggg

SEQ ID NO: 3303549 - RNA, 14 nt, Human
ucucuugagccugg

SEQ ID NO: 3303550 - RNA, 13 nt, Human
ucucuugagccug

SEQ ID NO: 3303551 - RNA, 22 nt, Human
ucucuuuaaugucacaggcagg

SEQ ID NO: 3303552 - RNA, 19 nt, Human
acuuugaccucugcagcaa

SEQ ID NO: 3303553 - RNA, 23 nt, Human
acuuugaccucugcagcaauaaa

SEQ ID NO: 3303554 - RNA, 12 nt, Human
acuuuaccuuuu

SEQ ID NO: 3303555 - RNA, 18 nt, Human
acuuuaccuuuuuuauac

SEQ ID NO: 3303556 - RNA, 22 nt, Human
acuuuaccuuuuuuauacauaa

SEQ ID NO: 3303557 - RNA, 19 nt, Human
acuuuaccuuuuuuauaca

SEQ ID NO: 3303558 - RNA, 12 nt, Human
acuuuggaaaga

SEQ ID NO: 3303559 - RNA, 14 nt, Human
acuuuggaaagacu

SEQ ID NO: 3303560 - RNA, 13 nt, Human
acuuuggaaagac

SEQ ID NO: 3303561 - RNA, 17 nt, Human
acuuuggaaagacuuuu

SEQ ID NO: 3303562 - RNA, 18 nt, Human
ucucccuuggauuguccc

SEQ ID NO: 3303563 - RNA, 11 nt, Human
ucucccuugga

SEQ ID NO: 3303564 - RNA, 14 nt, Human
ucuccucugcugcu

SEQ ID NO: 3303565 - RNA, 13 nt, Human
ucuccucugcugc

SEQ ID NO: 3303566 - RNA, 23 nt, Human
ucuccgaccagacaccuugacag

SEQ ID NO: 3303567 - RNA, 19 nt, Human
ucucccuuggauugucccc

SEQ ID NO: 3303568 - RNA, 12 nt, Human
ucuccucugcug

SEQ ID NO: 3303569 - RNA, 11 nt, Human
agaaauguguu

SEQ ID NO: 3303570 - RNA, 16 nt, Human
agaaauguacagcaag

SEQ ID NO: 3303571 - RNA, 17 nt, Human
agaaauguacagcaagg

SEQ ID NO: 3303572 - RNA, 23 nt, Human
ucugacccaugcugcccugugag

SEQ ID NO: 3303573 - RNA, 19 nt, Human
ucugacccugcuucaaaua

SEQ ID NO: 3303574 - RNA, 18 nt, Human
ucugauucccaagcucug

SEQ ID NO: 3303575 - RNA, 19 nt, Human
ucugauucccaagcucugc

SEQ ID NO: 3303576 - RNA, 20 nt, Human
ucugauucccaagcucugcu

SEQ ID NO: 3303577 - RNA, 22 nt, Human
ucugcacuccccugcugggugu

SEQ ID NO: 3303578 - RNA, 16 nt, Human
agaagcggcuggcagc

SEQ ID NO: 3303579 - RNA, 15 nt, Human
agaagcggcuggcag

SEQ ID NO: 3303580 - RNA, 18 nt, Human
ucuggagguacgaaaaga

SEQ ID NO: 3303581 - RNA, 23 nt, Human
ucugcuuuuuaaagaaugcucuu

SEQ ID NO: 3303582 - RNA, 15 nt, Human
ucuggcagcucagag

SEQ ID NO: 3303583 - RNA, 14 nt, Human
ucuggcagcucaga

SEQ ID NO: 3303584 - RNA, 23 nt, Human
ucugccgcagcccugcagagggc

SEQ ID NO: 3303585 - RNA, 14 nt, Human
ucugcccuccaaga

SEQ ID NO: 3303586 - RNA, 16 nt, Human
ucugcucacauaucug

SEQ ID NO: 3303587 - RNA, 17 nt, Human
agacuucaucccucugg

SEQ ID NO: 3303588 - RNA, 14 nt, Human
agacuucaucccuc

SEQ ID NO: 3303589 - RNA, 18 nt, Human
agagaaugaaagggccca

SEQ ID NO: 3303590 - RNA, 14 nt, Human
agacuuuggaaaga

SEQ ID NO: 3303591 - RNA, 12 nt, Human
agacuuuggaaa

SEQ ID NO: 3303592 - RNA, 14 nt, Human
agagaccaucccug

SEQ ID NO: 3303593 - RNA, 13 nt, Human
agagaccaucccu

SEQ ID NO: 3303594 - RNA, 15 nt, Human
agagaccaucccuga

SEQ ID NO: 3303595 - RNA, 15 nt, Human
ucuuuacuucaugga

SEQ ID NO: 3303596 - RNA, 17 nt, Human
agacuccugcaggcagc

SEQ ID NO: 3303597 - RNA, 16 nt, Human
agacuccugcaggcag

SEQ ID NO: 3303598 - RNA, 15 nt, Human
agacuccugcaggca

SEQ ID NO: 3303599 - RNA, 14 nt, Human
agacuccugcaggc

SEQ ID NO: 3303600 - RNA, 12 nt, Human
ucuuuccugagg

SEQ ID NO: 3303601 - RNA, 15 nt, Human
ucuuuccugaggcug

SEQ ID NO: 3303602 - RNA, 14 nt, Human
ucuuuccugaggcu

SEQ ID NO: 3303603 - RNA, 13 nt, Human
ucuuuccugaggc

SEQ ID NO: 3303604 - RNA, 20 nt, Human
agacuccugcaggcagccag

SEQ ID NO: 3303605 - RNA, 19 nt, Human
agacuccugcaggcagcca

SEQ ID NO: 3303606 - RNA, 18 nt, Human
agacuccugcaggcagcc

SEQ ID NO: 3303607 - RNA, 17 nt, Human
agacucuacagaggcca

SEQ ID NO: 3303608 - RNA, 21 nt, Human
agacucgcgacaaugcaaacc

SEQ ID NO: 3303609 - RNA, 19 nt, Human
agacucuacagaggccaug

SEQ ID NO: 3303610 - RNA, 15 nt, Human
agacucauucuucug

SEQ ID NO: 3303611 - RNA, 17 nt, Human
ucuugcaauggcagccu

SEQ ID NO: 3303612 - RNA, 13 nt, Human
ucuugcaauggca

SEQ ID NO: 3303613 - RNA, 16 nt, Human
ucuugcaauggcagcc

SEQ ID NO: 3303614 - RNA, 19 nt, Human
agacuaucuaaauguugaa

SEQ ID NO: 3303615 - RNA, 17 nt, Human
agacuaucuaaauguug

SEQ ID NO: 3303616 - RNA, 18 nt, Human
agacuaucuaaauguuga

SEQ ID NO: 3303617 - RNA, 15 nt, Human
agacuaucuaaaugu

SEQ ID NO: 3303618 - RNA, 18 nt, Human
agacucauucuucuguac

SEQ ID NO: 3303619 - RNA, 17 nt, Human
agacucauucuucugua

SEQ ID NO: 3303620 - RNA, 15 nt, Human
agacccuuguggucc

SEQ ID NO: 3303621 - RNA, 13 nt, Human
agacccuuguggu

SEQ ID NO: 3303622 - RNA, 23 nt, Human
agacccugcccugugggccccca

SEQ ID NO: 3303623 - RNA, 21 nt, Human
agacccugcccugugggcccc

SEQ ID NO: 3303624 - RNA, 19 nt, Human
agacccugcccugugggcc

SEQ ID NO: 3303625 - RNA, 16 nt, Human
agacccugcccugugg

SEQ ID NO: 3303626 - RNA, 23 nt, Human
agacccuuguggucccaccccac

SEQ ID NO: 3303627 - RNA, 22 nt, Human
agacccuuguggucccacccca

SEQ ID NO: 3303628 - RNA, 20 nt, Human
agacccuuguggucccaccc

SEQ ID NO: 3303629 - RNA, 19 nt, Human
agacccuuguggucccacc

SEQ ID NO: 3303630 - RNA, 12 nt, Human
agacccugcccu

SEQ ID NO: 3303631 - RNA, 14 nt, Human
agacccugcccugu

SEQ ID NO: 3303632 - RNA, 13 nt, Human
agacccugcccug

SEQ ID NO: 3303633 - RNA, 18 nt, Human
agaauuucccaaagcagu

SEQ ID NO: 3303634 - RNA, 17 nt, Human
agaauuucccaaagcag

SEQ ID NO: 3303635 - RNA, 23 nt, Human
agaauuucccaaagcagugcaug

SEQ ID NO: 3303636 - RNA, 21 nt, Human
ucugugaaaggaaagagggag

SEQ ID NO: 3303637 - RNA, 15 nt, Human
ucugugaaaggaaag

SEQ ID NO: 3303638 - RNA, 18 nt, Human
ucuguuggccagugugac

SEQ ID NO: 3303639 - RNA, 19 nt, Human
ucuguuggccagugugaca

SEQ ID NO: 3303640 - RNA, 20 nt, Human
ucuguuggccagugugacaa

SEQ ID NO: 3303641 - RNA, 11 nt, Human
ucuggggcugu

SEQ ID NO: 3303642 - RNA, 14 nt, Human
ucuggguucacugc

SEQ ID NO: 3303643 - RNA, 16 nt, Human
ucuggguucacugcaa

SEQ ID NO: 3303644 - RNA, 18 nt, Human
ucugguccauagagagca

SEQ ID NO: 3303645 - RNA, 20 nt, Human
ucugucauuugagcagggcu

SEQ ID NO: 3303646 - RNA, 23 nt, Human
ucugucauuugagcagggcucag

SEQ ID NO: 3303647 - RNA, 15 nt, Human
ucugucauuugagca

SEQ ID NO: 3303648 - RNA, 14 nt, Human
ucuuauugcccacg

SEQ ID NO: 3303649 - RNA, 18 nt, Human
ucuuauugcccacgcugg

SEQ ID NO: 3303650 - RNA, 22 nt, Human
ucuuauugcccacgcuggagug

SEQ ID NO: 3303651 - RNA, 14 nt, Human
ucuuaugggcuggg

SEQ ID NO: 3303652 - RNA, 13 nt, Human
ucuuaugggcugg

SEQ ID NO: 3303653 - RNA, 16 nt, Human
ucuuaugggcuggguu

SEQ ID NO: 3303654 - RNA, 15 nt, Human
ucuuaugggcugggu

SEQ ID NO: 3303655 - RNA, 22 nt, Human
ucuucccuacaguugaaaaaca

SEQ ID NO: 3303656 - RNA, 21 nt, Human
ucuuccaggcugggagagccu

SEQ ID NO: 3303657 - RNA, 22 nt, Human
ucuuccaggcugggagagccuu

SEQ ID NO: 3303658 - RNA, 16 nt, Human
agacagcugccuggga

SEQ ID NO: 3303659 - RNA, 23 nt, Human
agacaggcaagcaccuccugccu

SEQ ID NO: 3303660 - RNA, 22 nt, Human
agacaggcaagcaccuccugcc

SEQ ID NO: 3303661 - RNA, 15 nt, Human
agacaggaccaggga

SEQ ID NO: 3303662 - RNA, 21 nt, Human
agacaggguuuugccauguug

SEQ ID NO: 3303663 - RNA, 15 nt, Human
agacagucccugcca

SEQ ID NO: 3303664 - RNA, 17 nt, Human
agacagucccugccaau

SEQ ID NO: 3303665 - RNA, 16 nt, Human
agacagucccugccaa

SEQ ID NO: 3303666 - RNA, 14 nt, Human
agacagucccugcc

SEQ ID NO: 3303667 - RNA, 15 nt, Human
agagugagacucugu

SEQ ID NO: 3303668 - RNA, 16 nt, Human
agagugagacucuguc

SEQ ID NO: 3303669 - RNA, 20 nt, Human
agagucucacuguugcccag

SEQ ID NO: 3303670 - RNA, 14 nt, Human
ugaaugucagugug

SEQ ID NO: 3303671 - RNA, 15 nt, Human
ugaaugucaguguga

SEQ ID NO: 3303672 - RNA, 17 nt, Human
agauaaggguaucuggu

SEQ ID NO: 3303673 - RNA, 19 nt, Human
agauaaggguaucugguga

SEQ ID NO: 3303674 - RNA, 19 nt, Human
agagugagacucugucuca

SEQ ID NO: 3303675 - RNA, 22 nt, Human
agauauuuugcuuugugauuuu

SEQ ID NO: 3303676 - RNA, 19 nt, Human
agauacaggaaaagcugcu

SEQ ID NO: 3303677 - RNA, 14 nt, Human
agaucaaccccuuc

SEQ ID NO: 3303678 - RNA, 19 nt, Human
agaucaaccccuucgcucc

SEQ ID NO: 3303679 - RNA, 21 nt, Human
agaucaaccccuucgcuccug

SEQ ID NO: 3303680 - RNA, 20 nt, Human
agagggagggagggcuccag

SEQ ID NO: 3303681 - RNA, 21 nt, Human
agagggagggagggcuccaga

SEQ ID NO: 3303682 - RNA, 22 nt, Human
agagggagggagggcuccagac

SEQ ID NO: 3303683 - RNA, 11 nt, Human
ugaacuuugac

SEQ ID NO: 3303684 - RNA, 21 nt, Human
ucuuuggucuacacugugcug

SEQ ID NO: 3303685 - RNA, 14 nt, Human
ucuuuggucuacac

SEQ ID NO: 3303686 - RNA, 16 nt, Human
ugaacuuugaccucug

SEQ ID NO: 3303687 - RNA, 11 nt, Human
ugaagacaaug

SEQ ID NO: 3303688 - RNA, 17 nt, Human
ugaagacaaugacuuac

SEQ ID NO: 3303689 - RNA, 13 nt, Human
ugaagacaaugac

SEQ ID NO: 3303690 - RNA, 19 nt, Human
agagcugggugucaagagg

SEQ ID NO: 3303691 - RNA, 19 nt, Human
agaggaaagcaaaggagau

SEQ ID NO: 3303692 - RNA, 18 nt, Human
agaggaaagcaaaggaga

SEQ ID NO: 3303693 - RNA, 16 nt, Human
agaggaaagcaaagga

SEQ ID NO: 3303694 - RNA, 12 nt, Human
agaggaaagcaa

SEQ ID NO: 3303695 - RNA, 12 nt, Human
agaggaaaucac

SEQ ID NO: 3303696 - RNA, 11 nt, Human
agaggaaauca

SEQ ID NO: 3303697 - RNA, 18 nt, Human
agaggcaacugcauuggc

SEQ ID NO: 3303698 - RNA, 14 nt, Human
agauuucacucucc

SEQ ID NO: 3303699 - RNA, 13 nt, Human
agauuucacucuc

SEQ ID NO: 3303700 - RNA, 17 nt, Human
agauuugaacucuucaa

SEQ ID NO: 3303701 - RNA, 23 nt, Human
ugacuccagaauuucccaaagca

SEQ ID NO: 3303702 - RNA, 20 nt, Human
ugacuccagaauuucccaaa

SEQ ID NO: 3303703 - RNA, 19 nt, Human
ugacuccagaauuucccaa

SEQ ID NO: 3303704 - RNA, 17 nt, Human
ugacuccagaauuuccc

SEQ ID NO: 3303705 - RNA, 15 nt, Human
ugaccugaggcccuu

SEQ ID NO: 3303706 - RNA, 14 nt, Human
ugaccugaggcccu

SEQ ID NO: 3303707 - RNA, 16 nt, Human
agaugcuucucacugc

SEQ ID NO: 3303708 - RNA, 18 nt, Human
agaugcuucucacugcca

SEQ ID NO: 3303709 - RNA, 12 nt, Human
ugaccugaggcc

SEQ ID NO: 3303710 - RNA, 14 nt, Human
ugaccucugccuga

SEQ ID NO: 3303711 - RNA, 13 nt, Human
ugaccucugccug

SEQ ID NO: 3303712 - RNA, 19 nt, Human
ugagccuugaacuuugacc

SEQ ID NO: 3303713 - RNA, 18 nt, Human
ugagccuugaacuuugac

SEQ ID NO: 3303714 - RNA, 17 nt, Human
ugagccuugaacuuuga

SEQ ID NO: 3303715 - RNA, 15 nt, Human
ugagccuugaacuuu

SEQ ID NO: 3303716 - RNA, 14 nt, Human
ugagccugggaggu

SEQ ID NO: 3303717 - RNA, 16 nt, Human
ugagccuggcaagaau

SEQ ID NO: 3303718 - RNA, 11 nt, Human
ugagccuggca

SEQ ID NO: 3303719 - RNA, 22 nt, Human
ugagccugggaggucaaggcug

SEQ ID NO: 3303720 - RNA, 19 nt, Human
ugagccugggaggucaagg

SEQ ID NO: 3303721 - RNA, 14 nt, Human
ugagccuugaacuu

SEQ ID NO: 3303722 - RNA, 10 nt, Human
ugagccuggc

SEQ ID NO: 3303723 - RNA, 16 nt, Human
agcagagaccaucccu

SEQ ID NO: 3303724 - RNA, 15 nt, Human
agcagagaccauccc

SEQ ID NO: 3303725 - RNA, 22 nt, Human
agcagagaaugaaagggcccag

SEQ ID NO: 3303726 - RNA, 23 nt, Human
agcagagaaugaaagggcccaga

SEQ ID NO: 3303727 - RNA, 14 nt, Human
agcagagaauucuc

SEQ ID NO: 3303728 - RNA, 21 nt, Human
agcagagaauucucuuaucca

SEQ ID NO: 3303729 - RNA, 21 nt, Human
agcagagaaugaaagggccca

SEQ ID NO: 3303730 - RNA, 19 nt, Human
agcagaaaugccuuacccu

SEQ ID NO: 3303731 - RNA, 13 nt, Human
agcagaaaugccu

SEQ ID NO: 3303732 - RNA, 12 nt, Human
agcagaaaugcc

SEQ ID NO: 3303733 - RNA, 22 nt, Human
agcacuuugggaggccaaggug

SEQ ID NO: 3303734 - RNA, 23 nt, Human
agcacuuugggaggccaaggugg

SEQ ID NO: 3303735 - RNA, 22 nt, Human
agcaccuuagacagucccugcc

SEQ ID NO: 3303736 - RNA, 21 nt, Human
agcaccuuagacagucccugc

SEQ ID NO: 3303737 - RNA, 20 nt, Human
agcaccuuagacagucccug

SEQ ID NO: 3303738 - RNA, 19 nt, Human
agcaccuuagacagucccu

SEQ ID NO: 3303739 - RNA, 23 nt, Human
agcaccuuagacagucccugcca

SEQ ID NO: 3303740 - RNA, 13 nt, Human
agcacgauuucug

SEQ ID NO: 3303741 - RNA, 16 nt, Human
agcacgauuucuguuu

SEQ ID NO: 3303742 - RNA, 15 nt, Human
agcacgauuucuguu

SEQ ID NO: 3303743 - RNA, 14 nt, Human
agcacgauuucugu

SEQ ID NO: 3303744 - RNA, 22 nt, Human
agcaccaaaagcuuaccaaggg

SEQ ID NO: 3303745 - RNA, 14 nt, Human
agcacaugccucuc

SEQ ID NO: 3303746 - RNA, 13 nt, Human
agcacaugccucu

SEQ ID NO: 3303747 - RNA, 22 nt, Human
agcaagugagagcuggguguca

SEQ ID NO: 3303748 - RNA, 18 nt, Human
agcaagugagagcugggu

SEQ ID NO: 3303749 - RNA, 20 nt, Human
agcaagugagacccugucuc

SEQ ID NO: 3303750 - RNA, 16 nt, Human
agcaagugagacccug

SEQ ID NO: 3303751 - RNA, 13 nt, Human
agcaagugagagc

SEQ ID NO: 3303752 - RNA, 21 nt, Human
ugagccagauuucacucuccu

SEQ ID NO: 3303753 - RNA, 22 nt, Human
ugagccagauuucacucuccuu

SEQ ID NO: 3303754 - RNA, 17 nt, Human
ugagccagauuucacuc

SEQ ID NO: 3303755 - RNA, 24 nt, Human
ugagcaucaggccaggcccucugc

SEQ ID NO: 3303756 - RNA, 22 nt, Human
ugagcaucaggccaggcccucu

SEQ ID NO: 3303757 - RNA, 21 nt, Human
ugagcaucaggccaggcccuc

SEQ ID NO: 3303758 - RNA, 21 nt, Human
ugagccacugcaccgggccac

SEQ ID NO: 3303759 - RNA, 18 nt, Human
ugagccacugcaccgggc

SEQ ID NO: 3303760 - RNA, 23 nt, Human
ugagccacugcaccgggccacag

SEQ ID NO: 3303761 - RNA, 13 nt, Human
ugagccagauuuc

SEQ ID NO: 3303762 - RNA, 16 nt, Human
ugagccagauuucacu

SEQ ID NO: 3303763 - RNA, 14 nt, Human
ugagccagauuuca

SEQ ID NO: 3303764 - RNA, 20 nt, Human
ugagcacuaaggugugcucu

SEQ ID NO: 3303765 - RNA, 21 nt, Human
ugagcacuaaggugugcucug

SEQ ID NO: 3303766 - RNA, 22 nt, Human
ugagcacuaaggugugcucuga

SEQ ID NO: 3303767 - RNA, 23 nt, Human
ugagcacuaaggugugcucugau

SEQ ID NO: 3303768 - RNA, 15 nt, Human
ugagcaauccugcaa

SEQ ID NO: 3303769 - RNA, 21 nt, Human
ugaggaagccgcuggggccag

SEQ ID NO: 3303770 - RNA, 19 nt, Human
ugaggaagccgcuggggcc

SEQ ID NO: 3303771 - RNA, 18 nt, Human
ugaggaagccgcuggggc

SEQ ID NO: 3303772 - RNA, 17 nt, Human
ugaggaagccgcugggg

SEQ ID NO: 3303773 - RNA, 14 nt, Human
ugaggaagccgcug

SEQ ID NO: 3303774 - RNA, 22 nt, Human
ugaggaagcaaaagcaucuaug

SEQ ID NO: 3303775 - RNA, 15 nt, Human
ugaggaagcaaaagc

SEQ ID NO: 3303776 - RNA, 21 nt, Human
ugaggacacuaaccacgcugg

SEQ ID NO: 3303777 - RNA, 12 nt, Human
ugaggccagaga

SEQ ID NO: 3303778 - RNA, 23 nt, Human
ugaggcauuuguuugaacugaua

SEQ ID NO: 3303779 - RNA, 21 nt, Human
ugaggaauccagacccggcug

SEQ ID NO: 3303780 - RNA, 22 nt, Human
ugaggaauccagacccggcugc

SEQ ID NO: 3303781 - RNA, 13 nt, Human
ugaggcccagagg

SEQ ID NO: 3303782 - RNA, 12 nt, Human
ugaggcccagag

SEQ ID NO: 3303783 - RNA, 16 nt, Human
ugaggccagagacaca

SEQ ID NO: 3303784 - RNA, 14 nt, Human
ugaggccagagaca

SEQ ID NO: 3303785 - RNA, 20 nt, Human
ugaggccagagacacaagcc

SEQ ID NO: 3303786 - RNA, 20 nt, Human
ugaggcccagagggccugca

SEQ ID NO: 3303787 - RNA, 18 nt, Human
ugaggcccagagggccug

SEQ ID NO: 3303788 - RNA, 17 nt, Human
ugaggcccagagggccu

SEQ ID NO: 3303789 - RNA, 15 nt, Human
ugaggcccagagggc

SEQ ID NO: 3303790 - RNA, 22 nt, Human
ugaggcccagagggccugcaag

SEQ ID NO: 3303791 - RNA, 21 nt, Human
ugaggcccagagggccugcaa

SEQ ID NO: 3303792 - RNA, 23 nt, Human
ugaggcccagagggccugcaagg

SEQ ID NO: 3303793 - RNA, 13 nt, Human
ugaggucagagcc

SEQ ID NO: 3303794 - RNA, 14 nt, Human
ugaggucagagccu

SEQ ID NO: 3303795 - RNA, 16 nt, Human
ugaggucagagccugc

SEQ ID NO: 3303796 - RNA, 20 nt, Human
ugaggguugggcugguguca

SEQ ID NO: 3303797 - RNA, 20 nt, Human
agcagagaccaucccugaag

SEQ ID NO: 3303798 - RNA, 20 nt, Human
agcagagcaccuuagacagu

SEQ ID NO: 3303799 - RNA, 17 nt, Human
agcagagaccaucccug

SEQ ID NO: 3303800 - RNA, 19 nt, Human
agcagagaccaucccugaa

SEQ ID NO: 3303801 - RNA, 18 nt, Human
agcagagaccaucccuga

SEQ ID NO: 3303802 - RNA, 19 nt, Human
agcagauggagaccccuug

SEQ ID NO: 3303803 - RNA, 17 nt, Human
agcagaggaaggagagg

SEQ ID NO: 3303804 - RNA, 19 nt, Human
ugagggauacccaucccau

SEQ ID NO: 3303805 - RNA, 16 nt, Human
ugaggcccuucucucc

SEQ ID NO: 3303806 - RNA, 19 nt, Human
ugaggcccuucucuccagc

SEQ ID NO: 3303807 - RNA, 18 nt, Human
ugaggcccuucucuccag

SEQ ID NO: 3303808 - RNA, 24 nt, Human
ugaggcccuucucuccagccccug

SEQ ID NO: 3303809 - RNA, 23 nt, Human
ugaggcccuucucuccagccccu

SEQ ID NO: 3303810 - RNA, 22 nt, Human
ugaggcccuucucuccagcccc

SEQ ID NO: 3303811 - RNA, 20 nt, Human
ugaggcccuucucuccagcc

SEQ ID NO: 3303812 - RNA, 12 nt, Human
ugaggggccucu

SEQ ID NO: 3303813 - RNA, 13 nt, Human
ugaggggccucuu

SEQ ID NO: 3303814 - RNA, 22 nt, Human
auaagccaaaaaaugcuugcuu

SEQ ID NO: 3303815 - RNA, 21 nt, Human
auaagauucauauuuacuucu

SEQ ID NO: 3303816 - RNA, 18 nt, Human
auaauuuaccugaagucu

SEQ ID NO: 3303817 - RNA, 19 nt, Human
uuaggugugggggaagcac

SEQ ID NO: 3303818 - RNA, 21 nt, Human
uuaggugugacugaauuucuu

SEQ ID NO: 3303819 - RNA, 13 nt, Human
uuauaaacuuuac

SEQ ID NO: 3303820 - RNA, 14 nt, Human
uuaguagagacagg

SEQ ID NO: 3303821 - RNA, 13 nt, Human
uuaguagagacag

SEQ ID NO: 3303822 - RNA, 16 nt, Human
uuagaagucacacagu

SEQ ID NO: 3303823 - RNA, 14 nt, Human
auaagauucauauu

SEQ ID NO: 3303824 - RNA, 15 nt, Human
uuacugcagcuuugu

SEQ ID NO: 3303825 - RNA, 12 nt, Human
uuacuguacaug

SEQ ID NO: 3303826 - RNA, 23 nt, Human
uuacuguacaugaaaacacauuu

SEQ ID NO: 3303827 - RNA, 22 nt, Human
uuacuguacaugaaaacacauu

SEQ ID NO: 3303828 - RNA, 14 nt, Human
uuacuguacaugaa

SEQ ID NO: 3303829 - RNA, 13 nt, Human
uuacuguacauga

SEQ ID NO: 3303830 - RNA, 14 nt, Human
uuacaggugugaac

SEQ ID NO: 3303831 - RNA, 19 nt, Human
uuaccagcagagcaccuua

SEQ ID NO: 3303832 - RNA, 14 nt, Human
uuaccagcagagca

SEQ ID NO: 3303833 - RNA, 18 nt, Human
uuaacuuuuauaaacuuu

SEQ ID NO: 3303834 - RNA, 22 nt, Human
uuaacuuuuauaaacuuuaccu

SEQ ID NO: 3303835 - RNA, 23 nt, Human
uuaacuuuuauaaacuuuaccuu

SEQ ID NO: 3303836 - RNA, 15 nt, Human
uuaaucuaaauggaa

SEQ ID NO: 3303837 - RNA, 12 nt, Human
uuaacagaaaug

SEQ ID NO: 3303838 - RNA, 14 nt, Human
uuaacagaaaugua

SEQ ID NO: 3303839 - RNA, 13 nt, Human
uuaacagaaaugu

SEQ ID NO: 3303840 - RNA, 14 nt, Human
aguuucucuuuuca

SEQ ID NO: 3303841 - RNA, 21 nt, Human
aguuucuccaagcaggacaug

SEQ ID NO: 3303842 - RNA, 15 nt, Human
aguuucugccgcagc

SEQ ID NO: 3303843 - RNA, 19 nt, Human
aguuucugccgcagcccug

SEQ ID NO: 3303844 - RNA, 22 nt, Human
aguuuguuaguaugaggcauuu

SEQ ID NO: 3303845 - RNA, 19 nt, Human
uuaaaaaucucaaauuucu

SEQ ID NO: 3303846 - RNA, 20 nt, Human
uuaaaaaucucaaauuucua

SEQ ID NO: 3303847 - RNA, 17 nt, Human
uuaaaaaucucaaauuu

SEQ ID NO: 3303848 - RNA, 13 nt, Human
uuaugggcugggu

SEQ ID NO: 3303849 - RNA, 18 nt, Human
uuauggcuuuugugcauu

SEQ ID NO: 3303850 - RNA, 19 nt, Human
uuauggcuuuugugcauua

SEQ ID NO: 3303851 - RNA, 22 nt, Human
uuaugggcuggguucuacccag

SEQ ID NO: 3303852 - RNA, 11 nt, Human
uuaugacucca

SEQ ID NO: 3303853 - RNA, 21 nt, Human
uuaucacccagaagaaaauag

SEQ ID NO: 3303854 - RNA, 19 nt, Human
uuaucacccagaagaaaau

SEQ ID NO: 3303855 - RNA, 18 nt, Human
uuaucacccagaagaaaa

SEQ ID NO: 3303856 - RNA, 17 nt, Human
uuaucacccagaagaaa

SEQ ID NO: 3303857 - RNA, 13 nt, Human
auacguacacauu

SEQ ID NO: 3303858 - RNA, 16 nt, Human
auacguacacauuuua

SEQ ID NO: 3303859 - RNA, 15 nt, Human
auacguacacauuuu

SEQ ID NO: 3303860 - RNA, 14 nt, Human
auacguacacauuu

SEQ ID NO: 3303861 - RNA, 18 nt, Human
auaccacuuuuguucuug

SEQ ID NO: 3303862 - RNA, 17 nt, Human
auaccacuuuuguucuu

SEQ ID NO: 3303863 - RNA, 14 nt, Human
auaccuuuuuuaga

SEQ ID NO: 3303864 - RNA, 13 nt, Human
auacuaaccagca

SEQ ID NO: 3303865 - RNA, 20 nt, Human
auacuaaccagcagaaaugc

SEQ ID NO: 3303866 - RNA, 19 nt, Human
auacuaaccagcagaaaug

SEQ ID NO: 3303867 - RNA, 20 nt, Human
auacauaaacaagaccacgu

SEQ ID NO: 3303868 - RNA, 20 nt, Human
auacaguuacucagaauucu

SEQ ID NO: 3303869 - RNA, 23 nt, Human
auacagauagauauaugcucugc

SEQ ID NO: 3303870 - RNA, 22 nt, Human
auacaggaaaagcugcugacag

SEQ ID NO: 3303871 - RNA, 23 nt, Human
auacaggaaaagcugcugacagu

SEQ ID NO: 3303872 - RNA, 18 nt, Human
auacaguuacucagaauu

SEQ ID NO: 3303873 - RNA, 17 nt, Human
auacagaggcaacugca

SEQ ID NO: 3303874 - RNA, 16 nt, Human
auacagaggcaacugc

SEQ ID NO: 3303875 - RNA, 18 nt, Human
uuauaaacuuuaccuuuu

SEQ ID NO: 3303876 - RNA, 17 nt, Human
uuauaaacuuuaccuuu

SEQ ID NO: 3303877 - RNA, 11 nt, Human
auacucccauc

SEQ ID NO: 3303878 - RNA, 16 nt, Human
auacucugcuuagaau

SEQ ID NO: 3303879 - RNA, 14 nt, Human
auacucccaucugu

SEQ ID NO: 3303880 - RNA, 17 nt, Human
auacuccuccaagguua

SEQ ID NO: 3303881 - RNA, 12 nt, Human
uuauuaugcaug

SEQ ID NO: 3303882 - RNA, 13 nt, Human
uuauuaugcauga

SEQ ID NO: 3303883 - RNA, 23 nt, Human
auagacaauuuauuauggcacau

SEQ ID NO: 3303884 - RNA, 22 nt, Human
auagacaauuuauuauggcaca

SEQ ID NO: 3303885 - RNA, 16 nt, Human
auagacaauuuauuau

SEQ ID NO: 3303886 - RNA, 14 nt, Human
auagagagagacca

SEQ ID NO: 3303887 - RNA, 19 nt, Human
aguauucuuauuuaaugaa

SEQ ID NO: 3303888 - RNA, 14 nt, Human
agucaccaagccca

SEQ ID NO: 3303889 - RNA, 15 nt, Human
agucaccaagcccag

SEQ ID NO: 3303890 - RNA, 17 nt, Human
agucaccccggccaccu

SEQ ID NO: 3303891 - RNA, 19 nt, Human
ugucauuugagcagggcuc

SEQ ID NO: 3303892 - RNA, 16 nt, Human
ugucagguggggcagc

SEQ ID NO: 3303893 - RNA, 15 nt, Human
uguccaagaagccca

SEQ ID NO: 3303894 - RNA, 14 nt, Human
uguccaagaagccc

SEQ ID NO: 3303895 - RNA, 17 nt, Human
ugucagguggggcagcu

SEQ ID NO: 3303896 - RNA, 18 nt, Human
ugucagguggggcagcuu

SEQ ID NO: 3303897 - RNA, 20 nt, Human
ugucagguggggcagcuuga

SEQ ID NO: 3303898 - RNA, 20 nt, Human
ugucauuugagcagggcuca

SEQ ID NO: 3303899 - RNA, 21 nt, Human
ugucauuugagcagggcucag

SEQ ID NO: 3303900 - RNA, 22 nt, Human
ugucauuugagcagggcucagc

SEQ ID NO: 3303901 - RNA, 20 nt, Human
ugucccugcacuugcagacu

SEQ ID NO: 3303902 - RNA, 22 nt, Human
ugucccugcacuugcagacucu

SEQ ID NO: 3303903 - RNA, 23 nt, Human
ugucccugcacuugcagacucua

SEQ ID NO: 3303904 - RNA, 22 nt, Human
uguccaagaagcccaggaaagg

SEQ ID NO: 3303905 - RNA, 18 nt, Human
uguccaagaagcccagga

SEQ ID NO: 3303906 - RNA, 17 nt, Human
uguccaagaagcccagg

SEQ ID NO: 3303907 - RNA, 16 nt, Human
uguccaagaagcccag

SEQ ID NO: 3303908 - RNA, 21 nt, Human
agucucacuguugcccaggcu

SEQ ID NO: 3303909 - RNA, 23 nt, Human
agucucacuguugcccaggcugg

SEQ ID NO: 3303910 - RNA, 16 nt, Human
aguccucccaucucac

SEQ ID NO: 3303911 - RNA, 14 nt, Human
aguccucccaucuc

SEQ ID NO: 3303912 - RNA, 15 nt, Human
agucccaccuuggcu

SEQ ID NO: 3303913 - RNA, 16 nt, Human
agucccaccuuggcug

SEQ ID NO: 3303914 - RNA, 18 nt, Human
agucccaccuuggcugca

SEQ ID NO: 3303915 - RNA, 19 nt, Human
agucccaccuuggcugcag

SEQ ID NO: 3303916 - RNA, 14 nt, Human
ugucccugcacuug

SEQ ID NO: 3303917 - RNA, 23 nt, Human
ugucccuuacgugaguccuggca

SEQ ID NO: 3303918 - RNA, 19 nt, Human
ugucccuuacgugaguccu

SEQ ID NO: 3303919 - RNA, 14 nt, Human
agguugaagcacca

SEQ ID NO: 3303920 - RNA, 20 nt, Human
aggugugagucaccaagccc

SEQ ID NO: 3303921 - RNA, 16 nt, Human
aggugucccugcacuu

SEQ ID NO: 3303922 - RNA, 21 nt, Human
aggugugagucaccaagccca

SEQ ID NO: 3303923 - RNA, 22 nt, Human
aggugugagucaccaagcccag

SEQ ID NO: 3303924 - RNA, 12 nt, Human
aggugggaggau

SEQ ID NO: 3303925 - RNA, 20 nt, Human
agguuggcaaaaaggcagga

SEQ ID NO: 3303926 - RNA, 18 nt, Human
uguaauuaaguacuaugu

SEQ ID NO: 3303927 - RNA, 19 nt, Human
uguaauuaaguacuaugua

SEQ ID NO: 3303928 - RNA, 21 nt, Human
uguaauuaaguacuauguauc

SEQ ID NO: 3303929 - RNA, 17 nt, Human
uguaauuaaguacuaug

SEQ ID NO: 3303930 - RNA, 20 nt, Human
uguaauuuuuuuaucgucac

SEQ ID NO: 3303931 - RNA, 20 nt, Human
uguacauaaugcgugcauac

SEQ ID NO: 3303932 - RNA, 19 nt, Human
uguacauaaugcgugcaua

SEQ ID NO: 3303933 - RNA, 14 nt, Human
uguacaugaaaaca

SEQ ID NO: 3303934 - RNA, 16 nt, Human
uguacaugaaaacaca

SEQ ID NO: 3303935 - RNA, 20 nt, Human
uguacaugaaaacacauuuu

SEQ ID NO: 3303936 - RNA, 16 nt, Human
uguaggguuauaauaa

SEQ ID NO: 3303937 - RNA, 17 nt, Human
uguaggguuauaauaau

SEQ ID NO: 3303938 - RNA, 22 nt, Human
uguauauauuuccuauauuguu

SEQ ID NO: 3303939 - RNA, 18 nt, Human
uguauauauuuccuauau

SEQ ID NO: 3303940 - RNA, 20 nt, Human
aguacacuguuucaaacuuu

SEQ ID NO: 3303941 - RNA, 23 nt, Human
aguacacuguuucaaacuuuacu

SEQ ID NO: 3303942 - RNA, 21 nt, Human
aguacacuguuucaaacuuua

SEQ ID NO: 3303943 - RNA, 21 nt, Human
uguacauggaauaacauguaa

SEQ ID NO: 3303944 - RNA, 14 nt, Human
agugagcacuaagg

SEQ ID NO: 3303945 - RNA, 14 nt, Human
agugagagcugggu

SEQ ID NO: 3303946 - RNA, 18 nt, Human
ugugaugagaggaaauca

SEQ ID NO: 3303947 - RNA, 19 nt, Human
ugugaugagaggaaaucac

SEQ ID NO: 3303948 - RNA, 22 nt, Human
ugugaugaugaaaugaggucag

SEQ ID NO: 3303949 - RNA, 12 nt, Human
agugagcugguu

SEQ ID NO: 3303950 - RNA, 16 nt, Human
agugaacuugggccac

SEQ ID NO: 3303951 - RNA, 21 nt, Human
agugacugauggcuaauguac

SEQ ID NO: 3303952 - RNA, 17 nt, Human
agucucuugauucauaa

SEQ ID NO: 3303953 - RNA, 16 nt, Human
agucucuugauucaua

SEQ ID NO: 3303954 - RNA, 13 nt, Human
agucuuagaugua

SEQ ID NO: 3303955 - RNA, 14 nt, Human
agucuuagauguau

SEQ ID NO: 3303956 - RNA, 16 nt, Human
agucuuagauguauau

SEQ ID NO: 3303957 - RNA, 11 nt, Human
ugugaggaagc

SEQ ID NO: 3303958 - RNA, 16 nt, Human
ugugacugaucucucg

SEQ ID NO: 3303959 - RNA, 16 nt, Human
agugcaugcugucccu

SEQ ID NO: 3303960 - RNA, 14 nt, Human
agugcaugcugucc

SEQ ID NO: 3303961 - RNA, 17 nt, Human
agugcagugagccgaga

SEQ ID NO: 3303962 - RNA, 12 nt, Human
agugaggcucug

SEQ ID NO: 3303963 - RNA, 13 nt, Human
agugaggcucugc

SEQ ID NO: 3303964 - RNA, 16 nt, Human
agugaggaugaaaaaa

SEQ ID NO: 3303965 - RNA, 18 nt, Human
ugugcugagucugaaggc

SEQ ID NO: 3303966 - RNA, 19 nt, Human
ugugcugagucugaaggcu

SEQ ID NO: 3303967 - RNA, 19 nt, Human
ugugcucuggacaggcaug

SEQ ID NO: 3303968 - RNA, 20 nt, Human
ugugcugcccugcccaccug

SEQ ID NO: 3303969 - RNA, 19 nt, Human
ugugcugcccugcccaccu

SEQ ID NO: 3303970 - RNA, 18 nt, Human
ugugcugcccugcccacc

SEQ ID NO: 3303971 - RNA, 23 nt, Human
agugagcugguuuuuagcggaga

SEQ ID NO: 3303972 - RNA, 22 nt, Human
uguggauuuaacagaaauguac

SEQ ID NO: 3303973 - RNA, 20 nt, Human
uguggauuuaacagaaaugu

SEQ ID NO: 3303974 - RNA, 19 nt, Human
uguggauuuaacagaaaug

SEQ ID NO: 3303975 - RNA, 14 nt, Human
uguggaugauaaaa

SEQ ID NO: 3303976 - RNA, 23 nt, Human
uguugcccaggcuggcgugcagu

SEQ ID NO: 3303977 - RNA, 20 nt, Human
uguugcccaggcuggcgugc

SEQ ID NO: 3303978 - RNA, 16 nt, Human
aguguuguggauuuaa

SEQ ID NO: 3303979 - RNA, 13 nt, Human
aguuacucagaau

SEQ ID NO: 3303980 - RNA, 20 nt, Human
aguguuguggauuuaacaga

SEQ ID NO: 3303981 - RNA, 19 nt, Human
aguguuguggauuuaacag

SEQ ID NO: 3303982 - RNA, 22 nt, Human
agugugguguuuccuggcacug

SEQ ID NO: 3303983 - RNA, 13 nt, Human
uguuaugacucca

SEQ ID NO: 3303984 - RNA, 17 nt, Human
uguuaugacuccagaau

SEQ ID NO: 3303985 - RNA, 20 nt, Human
agugugacugaucucucgug

SEQ ID NO: 3303986 - RNA, 20 nt, Human
agugugccugaagucccaga

SEQ ID NO: 3303987 - RNA, 21 nt, Human
agugugccugaagucccagau

SEQ ID NO: 3303988 - RNA, 20 nt, Human
agugugguguuuccuggcac

SEQ ID NO: 3303989 - RNA, 22 nt, Human
ugugucucuugguccugcugca

SEQ ID NO: 3303990 - RNA, 12 nt, Human
ugugguuucauu

SEQ ID NO: 3303991 - RNA, 20 nt, Human
ugugucagguggggcagcuu

SEQ ID NO: 3303992 - RNA, 18 nt, Human
agugggggaucacagccu

SEQ ID NO: 3303993 - RNA, 22 nt, Human
agugggcccaaugcacuuuguu

SEQ ID NO: 3303994 - RNA, 22 nt, Human
uguguuaucacccagaagaaaa

SEQ ID NO: 3303995 - RNA, 21 nt, Human
ugggaggauugcuugagcuca

SEQ ID NO: 3303996 - RNA, 18 nt, Human
ugggaggauugcuugagc

SEQ ID NO: 3303997 - RNA, 22 nt, Human
ugggaggaucucuugagccugg

SEQ ID NO: 3303998 - RNA, 21 nt, Human
ugggagaaccaaaaagaggcu

SEQ ID NO: 3303999 - RNA, 13 nt, Human
ugggcagaaggaa

SEQ ID NO: 3304000 - RNA, 20 nt, Human
ugggcagaaggaagacuuca

SEQ ID NO: 3304001 - RNA, 16 nt, Human
ugggcagaaggaagac

SEQ ID NO: 3304002 - RNA, 21 nt, Human
ugggcaacccccagccugcua

SEQ ID NO: 3304003 - RNA, 15 nt, Human
agggacuuggaagcu

SEQ ID NO: 3304004 - RNA, 18 nt, Human
agggacuuggaagcuccg

SEQ ID NO: 3304005 - RNA, 19 nt, Human
agggacuuggaagcuccgc

SEQ ID NO: 3304006 - RNA, 20 nt, Human
agggacuuggaagcuccgcu

SEQ ID NO: 3304007 - RNA, 18 nt, Human
ugggacuacaggcaccca

SEQ ID NO: 3304008 - RNA, 16 nt, Human
ugggacuacaggcacc

SEQ ID NO: 3304009 - RNA, 16 nt, Human
ugggacuacaggugug

SEQ ID NO: 3304010 - RNA, 21 nt, Human
ugggcucccuucccaccucuc

SEQ ID NO: 3304011 - RNA, 14 nt, Human
ugggcucccuuccc

SEQ ID NO: 3304012 - RNA, 14 nt, Human
agggcccagagagg

SEQ ID NO: 3304013 - RNA, 15 nt, Human
agggcuccagacaca

SEQ ID NO: 3304014 - RNA, 20 nt, Human
agggcuccagacacaugucc

SEQ ID NO: 3304015 - RNA, 12 nt, Human
agggcccagaga

SEQ ID NO: 3304016 - RNA, 13 nt, Human
agggcccagagag

SEQ ID NO: 3304017 - RNA, 23 nt, Human
agggaguccgaaagggacuugga

SEQ ID NO: 3304018 - RNA, 20 nt, Human
agggagugacagaggcagcc

SEQ ID NO: 3304019 - RNA, 20 nt, Human
agggagugaguugauagcac

SEQ ID NO: 3304020 - RNA, 20 nt, Human
agggaguccgaaagggacuu

SEQ ID NO: 3304021 - RNA, 22 nt, Human
agggagggcuccagacacaugu

SEQ ID NO: 3304022 - RNA, 17 nt, Human
agggagggagggcucca

SEQ ID NO: 3304023 - RNA, 12 nt, Human
agggagggcucc

SEQ ID NO: 3304024 - RNA, 19 nt, Human
agggagggcuccagacaca

SEQ ID NO: 3304025 - RNA, 17 nt, Human
agggagggcuccagaca

SEQ ID NO: 3304026 - RNA, 14 nt, Human
uggcuaaauucaug

SEQ ID NO: 3304027 - RNA, 23 nt, Human
aggcuccaggagcagccacauuc

SEQ ID NO: 3304028 - RNA, 19 nt, Human
aggcuccaggagcagccac

SEQ ID NO: 3304029 - RNA, 18 nt, Human
aggcuccaggagcagcca

SEQ ID NO: 3304030 - RNA, 17 nt, Human
aggcuccaggagcagcc

SEQ ID NO: 3304031 - RNA, 17 nt, Human
uggcuaauguacugcau

SEQ ID NO: 3304032 - RNA, 19 nt, Human
uggcuaauguacugcauau

SEQ ID NO: 3304033 - RNA, 13 nt, Human
uggcucacgccug

SEQ ID NO: 3304034 - RNA, 23 nt, Human
uggcuguuggcugggggccucag

SEQ ID NO: 3304035 - RNA, 14 nt, Human
uggcuucacggaag

SEQ ID NO: 3304036 - RNA, 16 nt, Human
uggcuguuggcugggg

SEQ ID NO: 3304037 - RNA, 18 nt, Human
uggcuguuggcugggggc

SEQ ID NO: 3304038 - RNA, 23 nt, Human
uggcugcaaaggguaucaggugc

SEQ ID NO: 3304039 - RNA, 21 nt, Human
uggcuuuugugcauuaucuag

SEQ ID NO: 3304040 - RNA, 20 nt, Human
uggcuucacggaagagccuu

SEQ ID NO: 3304041 - RNA, 17 nt, Human
uggcuucacggaagagc

SEQ ID NO: 3304042 - RNA, 16 nt, Human
uggcuuuugugcauua

SEQ ID NO: 3304043 - RNA, 15 nt, Human
uggcuuuugugcauu

SEQ ID NO: 3304044 - RNA, 23 nt, Human
aggcuuagucacugagacagccc

SEQ ID NO: 3304045 - RNA, 22 nt, Human
aggcuuagucacugagacagcc

SEQ ID NO: 3304046 - RNA, 21 nt, Human
aggcuuagucacugagacagc

SEQ ID NO: 3304047 - RNA, 16 nt, Human
aggcugggagagccuu

SEQ ID NO: 3304048 - RNA, 19 nt, Human
aggcugggagagccuucca

SEQ ID NO: 3304049 - RNA, 22 nt, Human
aggcugggagagccuuccaggg

SEQ ID NO: 3304050 - RNA, 21 nt, Human
aggcugggagagccuuccagg

SEQ ID NO: 3304051 - RNA, 20 nt, Human
aggcugggagagccuuccag

SEQ ID NO: 3304052 - RNA, 13 nt, Human
aggcugggcuccc

SEQ ID NO: 3304053 - RNA, 18 nt, Human
aggcugggcucccuuccc

SEQ ID NO: 3304054 - RNA, 14 nt, Human
aggcugggcucccu

SEQ ID NO: 3304055 - RNA, 14 nt, Human
aggcugggcuucag

SEQ ID NO: 3304056 - RNA, 23 nt, Human
aggcugggcucccuucccaccuc

SEQ ID NO: 3304057 - RNA, 21 nt, Human
aggcugggcucccuucccacc

SEQ ID NO: 3304058 - RNA, 17 nt, Human
aggcugggggaagaagc

SEQ ID NO: 3304059 - RNA, 22 nt, Human
aggcugggcuucaguggcagcu

SEQ ID NO: 3304060 - RNA, 23 nt, Human
aggcugggcuucaguggcagcug

SEQ ID NO: 3304061 - RNA, 18 nt, Human
aggcugggcuucaguggc

SEQ ID NO: 3304062 - RNA, 19 nt, Human
aggcugggcuucaguggca

SEQ ID NO: 3304063 - RNA, 20 nt, Human
aggcugggcuucaguggcag

SEQ ID NO: 3304064 - RNA, 21 nt, Human
aggcugggcuucaguggcagc

SEQ ID NO: 3304065 - RNA, 14 nt, Human
aggcuggguucuga

SEQ ID NO: 3304066 - RNA, 22 nt, Human
aggcugggggaagaagcucucu

SEQ ID NO: 3304067 - RNA, 15 nt, Human
aggaggccagccuug

SEQ ID NO: 3304068 - RNA, 21 nt, Human
aggaguuugagaccaaccugg

SEQ ID NO: 3304069 - RNA, 10 nt, Human
ugcugcccug

SEQ ID NO: 3304070 - RNA, 18 nt, Human
uggaaguacuauaauuua

SEQ ID NO: 3304071 - RNA, 20 nt, Human
uggaaguacuauaauuuacc

SEQ ID NO: 3304072 - RNA, 13 nt, Human
uggaagcuccgcu

SEQ ID NO: 3304073 - RNA, 12 nt, Human
uggaacacucug

SEQ ID NO: 3304074 - RNA, 14 nt, Human
aggcaagcaccucc

SEQ ID NO: 3304075 - RNA, 19 nt, Human
aggcaacugcauuggcuuu

SEQ ID NO: 3304076 - RNA, 15 nt, Human
uggacaccggaaaca

SEQ ID NO: 3304077 - RNA, 22 nt, Human
aggauugcuacuguccuaccca

SEQ ID NO: 3304078 - RNA, 18 nt, Human
aggaugcuuguacauaau

SEQ ID NO: 3304079 - RNA, 18 nt, Human
aggauccugagccagauu

SEQ ID NO: 3304080 - RNA, 21 nt, Human
aggauccugagccagauuuca

SEQ ID NO: 3304081 - RNA, 16 nt, Human
aggaugcuuguacaua

SEQ ID NO: 3304082 - RNA, 15 nt, Human
aggaugcuuguacau

SEQ ID NO: 3304083 - RNA, 15 nt, Human
aggcaaugcuggcug

SEQ ID NO: 3304084 - RNA, 16 nt, Human
aggcaaugcuggcugu

SEQ ID NO: 3304085 - RNA, 24 nt, Human
uggacuuuguuaguuucuccaagc

SEQ ID NO: 3304086 - RNA, 22 nt, Human
uggacuuuguuaguuucuccaa

SEQ ID NO: 3304087 - RNA, 11 nt, Human
uggacuuuguu

SEQ ID NO: 3304088 - RNA, 21 nt, Human
aggcaggucuugaacuccugg

SEQ ID NO: 3304089 - RNA, 19 nt, Human
aggcagggucucacucugu

SEQ ID NO: 3304090 - RNA, 18 nt, Human
aggcagggucucacucug

SEQ ID NO: 3304091 - RNA, 20 nt, Human
aggcagggucucacucuguc

SEQ ID NO: 3304092 - RNA, 21 nt, Human
aggcagggucucacucugucg

SEQ ID NO: 3304093 - RNA, 22 nt, Human
aggcagggucucacucugucgc

SEQ ID NO: 3304094 - RNA, 14 nt, Human
aggcagguccaggg

SEQ ID NO: 3304095 - RNA, 22 nt, Human
aggcagccccauucugccugcc

SEQ ID NO: 3304096 - RNA, 19 nt, Human
aggcagccccauucugccu

SEQ ID NO: 3304097 - RNA, 20 nt, Human
aggcagccccauucugccug

SEQ ID NO: 3304098 - RNA, 21 nt, Human
aggcagccccauucugccugc

SEQ ID NO: 3304099 - RNA, 12 nt, Human
aggccuggccag

SEQ ID NO: 3304100 - RNA, 13 nt, Human
aggccuggccaga

SEQ ID NO: 3304101 - RNA, 13 nt, Human
aggccccugccac

SEQ ID NO: 3304102 - RNA, 15 nt, Human
aggccccugccaccc

SEQ ID NO: 3304103 - RNA, 20 nt, Human
aggcccagagggccugcaag

SEQ ID NO: 3304104 - RNA, 19 nt, Human
aggcccagagggccugcaa

SEQ ID NO: 3304105 - RNA, 17 nt, Human
aggccccugccacccug

SEQ ID NO: 3304106 - RNA, 18 nt, Human
aggccccugccacccugg

SEQ ID NO: 3304107 - RNA, 12 nt, Human
aggccccugcca

SEQ ID NO: 3304108 - RNA, 21 nt, Human
aggccccugccacccugggga

SEQ ID NO: 3304109 - RNA, 14 nt, Human
aggcccggcuccag

SEQ ID NO: 3304110 - RNA, 15 nt, Human
aggcccggcuccagg

SEQ ID NO: 3304111 - RNA, 16 nt, Human
aggcccggcuccaggc

SEQ ID NO: 3304112 - RNA, 16 nt, Human
aggcccagagggccug

SEQ ID NO: 3304113 - RNA, 15 nt, Human
aggcccagagggccu

SEQ ID NO: 3304114 - RNA, 17 nt, Human
aggccaugggccuccug

SEQ ID NO: 3304115 - RNA, 18 nt, Human
aggccaugggccuccugu

SEQ ID NO: 3304116 - RNA, 23 nt, Human
aggccagagacacaagccuucgg

SEQ ID NO: 3304117 - RNA, 13 nt, Human
uggcagcucagag

SEQ ID NO: 3304118 - RNA, 15 nt, Human
uggcagcucagagag

SEQ ID NO: 3304119 - RNA, 14 nt, Human
uggcagcucagaga

SEQ ID NO: 3304120 - RNA, 18 nt, Human
aggccagagacacaagcc

SEQ ID NO: 3304121 - RNA, 13 nt, Human
aggccagagacac

SEQ ID NO: 3304122 - RNA, 16 nt, Human
uggcagcucagagagg

SEQ ID NO: 3304123 - RNA, 12 nt, Human
aggccagagaca

SEQ ID NO: 3304124 - RNA, 17 nt, Human
uggcaccagcagccugg

SEQ ID NO: 3304125 - RNA, 16 nt, Human
uggcaccagcagccug

SEQ ID NO: 3304126 - RNA, 13 nt, Human
aggcuccaggagc

SEQ ID NO: 3304127 - RNA, 16 nt, Human
aggcuccaggagcagc

SEQ ID NO: 3304128 - RNA, 14 nt, Human
aggcuccaggagca

SEQ ID NO: 3304129 - RNA, 17 nt, Human
aggccuucucugaagga

SEQ ID NO: 3304130 - RNA, 18 nt, Human
aggccuucucugaaggac

SEQ ID NO: 3304131 - RNA, 18 nt, Human
uggccugagcugggauga

SEQ ID NO: 3304132 - RNA, 20 nt, Human
uggccucugcacuccccugc

SEQ ID NO: 3304133 - RNA, 18 nt, Human
uggccucugcacuccccu

SEQ ID NO: 3304134 - RNA, 19 nt, Human
uggccucugcacuccccug

SEQ ID NO: 3304135 - RNA, 22 nt, Human
uggcaugggaaugaaugucagu

SEQ ID NO: 3304136 - RNA, 19 nt, Human
uggcccacgcacuucggga

SEQ ID NO: 3304137 - RNA, 13 nt, Human
uggcccacgcacu

SEQ ID NO: 3304138 - RNA, 14 nt, Human
uggcccacugcauc

SEQ ID NO: 3304139 - RNA, 13 nt, Human
uggcccacugcau

SEQ ID NO: 3304140 - RNA, 23 nt, Human
aggaauccagacccggcugcgug

SEQ ID NO: 3304141 - RNA, 20 nt, Human
aggaauccagacccggcugc

SEQ ID NO: 3304142 - RNA, 16 nt, Human
aggaagcucagggccu

SEQ ID NO: 3304143 - RNA, 17 nt, Human
aggaagcucagggccug

SEQ ID NO: 3304144 - RNA, 22 nt, Human
aggaagcucagggccuggcuca

SEQ ID NO: 3304145 - RNA, 18 nt, Human
aggaagcucagggccugg

SEQ ID NO: 3304146 - RNA, 14 nt, Human
aggaagagaaaaaa

SEQ ID NO: 3304147 - RNA, 15 nt, Human
aggaagacuuuggaa

SEQ ID NO: 3304148 - RNA, 21 nt, Human
ugcugccauccagguucagcu

SEQ ID NO: 3304149 - RNA, 22 nt, Human
ugcugccauccagguucagcuu

SEQ ID NO: 3304150 - RNA, 12 nt, Human
ugcugccaucca

SEQ ID NO: 3304151 - RNA, 13 nt, Human
ugcugccauccag

SEQ ID NO: 3304152 - RNA, 14 nt, Human
ugcugccauccagg

SEQ ID NO: 3304153 - RNA, 15 nt, Human
ugcugccauccaggu

SEQ ID NO: 3304154 - RNA, 11 nt, Human
ugcugccaucc

SEQ ID NO: 3304155 - RNA, 22 nt, Human
aggaaaggcuccaggagcagcc

SEQ ID NO: 3304156 - RNA, 20 nt, Human
aggaaaggcuccaggagcag

SEQ ID NO: 3304157 - RNA, 18 nt, Human
aggaaaggcuccaggagc

SEQ ID NO: 3304158 - RNA, 16 nt, Human
aggaaaggcuccagga

SEQ ID NO: 3304159 - RNA, 19 nt, Human
aggaaagcaaaggagauug

SEQ ID NO: 3304160 - RNA, 16 nt, Human
ugcugacuguuuucuc

SEQ ID NO: 3304161 - RNA, 24 nt, Human
ugcugacuguuuucucuugagagg

SEQ ID NO: 3304162 - RNA, 21 nt, Human
ugcugacuguuuucucuugag

SEQ ID NO: 3304163 - RNA, 19 nt, Human
ugcucugaucauccacugu

SEQ ID NO: 3304164 - RNA, 22 nt, Human
ugcucugaucauccacugugcc

SEQ ID NO: 3304165 - RNA, 17 nt, Human
ugcucuggacaggcaug

SEQ ID NO: 3304166 - RNA, 15 nt, Human
ugcucugcauguuac

SEQ ID NO: 3304167 - RNA, 18 nt, Human
ugcucugcauguuacaua

SEQ ID NO: 3304168 - RNA, 17 nt, Human
ugcugacuguuuucucu

SEQ ID NO: 3304169 - RNA, 13 nt, Human
aggaaagaggcuc

SEQ ID NO: 3304170 - RNA, 12 nt, Human
aggaaagaggcu

SEQ ID NO: 3304171 - RNA, 17 nt, Human
aggaaagcaaaggagau

SEQ ID NO: 3304172 - RNA, 16 nt, Human
aggaaagaggcucugg

SEQ ID NO: 3304173 - RNA, 19 nt, Human
agcuuugaaaauucagugg

SEQ ID NO: 3304174 - RNA, 18 nt, Human
agcuuugaaaauucagug

SEQ ID NO: 3304175 - RNA, 16 nt, Human
agcuuugaaaauucag

SEQ ID NO: 3304176 - RNA, 12 nt, Human
agcuuugaaaau

SEQ ID NO: 3304177 - RNA, 16 nt, Human
aggaaaagcugcugac

SEQ ID NO: 3304178 - RNA, 15 nt, Human
aggaaacccagcucu

SEQ ID NO: 3304179 - RNA, 17 nt, Human
aggaaacccagcucugg

SEQ ID NO: 3304180 - RNA, 16 nt, Human
aggaaacccagcucug

SEQ ID NO: 3304181 - RNA, 20 nt, Human
aggaaacccagcucuggucc

SEQ ID NO: 3304182 - RNA, 18 nt, Human
aggaaacccagcucuggu

SEQ ID NO: 3304183 - RNA, 21 nt, Human
aggaaacccagcucuggucca

SEQ ID NO: 3304184 - RNA, 18 nt, Human
agcuuguaaauagcucag

SEQ ID NO: 3304185 - RNA, 19 nt, Human
agcuuguaaauagcucagg

SEQ ID NO: 3304186 - RNA, 20 nt, Human
agcuuguaaauagcucaggu

SEQ ID NO: 3304187 - RNA, 15 nt, Human
agcuuaucucagggg

SEQ ID NO: 3304188 - RNA, 14 nt, Human
agcuuaucucaggg

SEQ ID NO: 3304189 - RNA, 12 nt, Human
agcuuaucucag

SEQ ID NO: 3304190 - RNA, 20 nt, Human
ugcggacagccacggccagg

SEQ ID NO: 3304191 - RNA, 15 nt, Human
ugccuguucagcucc

SEQ ID NO: 3304192 - RNA, 16 nt, Human
ugccuguucagcucca

SEQ ID NO: 3304193 - RNA, 19 nt, Human
ugcgaaaggaugaaaguga

SEQ ID NO: 3304194 - RNA, 18 nt, Human
ugcggacagccacggcca

SEQ ID NO: 3304195 - RNA, 17 nt, Human
ugcggacagccacggcc

SEQ ID NO: 3304196 - RNA, 13 nt, Human
ugcgaaaggauga

SEQ ID NO: 3304197 - RNA, 19 nt, Human
agcugccugggaucccuca

SEQ ID NO: 3304198 - RNA, 13 nt, Human
agcugccugggau

SEQ ID NO: 3304199 - RNA, 21 nt, Human
agcugccugggaucccucauc

SEQ ID NO: 3304200 - RNA, 22 nt, Human
ugccucugacacacagcucugu

SEQ ID NO: 3304201 - RNA, 23 nt, Human
agcugggaugauuggagggggga

SEQ ID NO: 3304202 - RNA, 17 nt, Human
agcugggacuacaggug

SEQ ID NO: 3304203 - RNA, 19 nt, Human
agcugggacuacaggugug

SEQ ID NO: 3304204 - RNA, 14 nt, Human
agcugggcagguug

SEQ ID NO: 3304205 - RNA, 17 nt, Human
agcugcacccucaggca

SEQ ID NO: 3304206 - RNA, 13 nt, Human
agcugcacccuca

SEQ ID NO: 3304207 - RNA, 22 nt, Human
agcugcacccucaggcaggugg

SEQ ID NO: 3304208 - RNA, 20 nt, Human
agcugcacccucaggcaggu

SEQ ID NO: 3304209 - RNA, 19 nt, Human
agcugcacccucaggcagg

SEQ ID NO: 3304210 - RNA, 18 nt, Human
agcugcacccucaggcag

SEQ ID NO: 3304211 - RNA, 18 nt, Human
agcucuucuccaggcugu

SEQ ID NO: 3304212 - RNA, 17 nt, Human
agcucuucuccaggcug

SEQ ID NO: 3304213 - RNA, 12 nt, Human
agcucuguccug

SEQ ID NO: 3304214 - RNA, 12 nt, Human
agcucugcuccu

SEQ ID NO: 3304215 - RNA, 22 nt, Human
agcucugcuccucuccccagca

SEQ ID NO: 3304216 - RNA, 20 nt, Human
agcucugguccauagagagc

SEQ ID NO: 3304217 - RNA, 22 nt, Human
ugcccuccaagaccuucuccuu

SEQ ID NO: 3304218 - RNA, 20 nt, Human
ugcccuccaagaccuucucc

SEQ ID NO: 3304219 - RNA, 19 nt, Human
ugcccuccaagaccuucuc

SEQ ID NO: 3304220 - RNA, 13 nt, Human
agcugccaccugc

SEQ ID NO: 3304221 - RNA, 18 nt, Human
agcugcauacaguuugca

SEQ ID NO: 3304222 - RNA, 14 nt, Human
ugccucucucaggc

SEQ ID NO: 3304223 - RNA, 13 nt, Human
ugccucucucagg

SEQ ID NO: 3304224 - RNA, 14 nt, Human
ugccucccaucacc

SEQ ID NO: 3304225 - RNA, 13 nt, Human
ugccucccaucac

SEQ ID NO: 3304226 - RNA, 20 nt, Human
ugccucugacacacagcucu

SEQ ID NO: 3304227 - RNA, 21 nt, Human
ugccucugacacacagcucug

SEQ ID NO: 3304228 - RNA, 15 nt, Human
ugccucucucaggcc

SEQ ID NO: 3304229 - RNA, 14 nt, Human
ugcagugagccgag

SEQ ID NO: 3304230 - RNA, 17 nt, Human
ugcauaaguuaacuucc

SEQ ID NO: 3304231 - RNA, 15 nt, Human
agccucagcauccug

SEQ ID NO: 3304232 - RNA, 17 nt, Human
agccucaaccuccuggg

SEQ ID NO: 3304233 - RNA, 18 nt, Human
agccucaaccuccugggc

SEQ ID NO: 3304234 - RNA, 13 nt, Human
agccucagcaucc

SEQ ID NO: 3304235 - RNA, 14 nt, Human
agccucagcauccu

SEQ ID NO: 3304236 - RNA, 18 nt, Human
ugcagccucaaccuccug

SEQ ID NO: 3304237 - RNA, 19 nt, Human
ugcagccucaaccuccugg

SEQ ID NO: 3304238 - RNA, 23 nt, Human
agccugcaguuauuaacacuaac

SEQ ID NO: 3304239 - RNA, 19 nt, Human
agccugccucuucucuacu

SEQ ID NO: 3304240 - RNA, 16 nt, Human
agccugccucuucucu

SEQ ID NO: 3304241 - RNA, 13 nt, Human
ugcaugcuguccc

SEQ ID NO: 3304242 - RNA, 15 nt, Human
ugcaugcugucccuu

SEQ ID NO: 3304243 - RNA, 14 nt, Human
ugcaugcugucccu

SEQ ID NO: 3304244 - RNA, 21 nt, Human
ugcaugaggcuaguguggugu

SEQ ID NO: 3304245 - RNA, 22 nt, Human
ugcaugaaguaauaugcacaca

SEQ ID NO: 3304246 - RNA, 20 nt, Human
ugcaugaaguaauaugcaca

SEQ ID NO: 3304247 - RNA, 21 nt, Human
ugcauaccacuuuuguucuug

SEQ ID NO: 3304248 - RNA, 22 nt, Human
ugcauaccacuuuuguucuugg

SEQ ID NO: 3304249 - RNA, 15 nt, Human
agccucaaccuccug

SEQ ID NO: 3304250 - RNA, 15 nt, Human
agccuaggugacaga

SEQ ID NO: 3304251 - RNA, 17 nt, Human
agccuaggugacagagu

SEQ ID NO: 3304252 - RNA, 22 nt, Human
ugcagacucuacagaggccaug

SEQ ID NO: 3304253 - RNA, 19 nt, Human
ugcagacucuacagaggcc

SEQ ID NO: 3304254 - RNA, 20 nt, Human
ugcagacucuacagaggcca

SEQ ID NO: 3304255 - RNA, 18 nt, Human
ugcagacucuacagaggc

SEQ ID NO: 3304256 - RNA, 20 nt, Human
ugcacuuuguucuggcucuu

SEQ ID NO: 3304257 - RNA, 15 nt, Human
ugcacacaccagagc

SEQ ID NO: 3304258 - RNA, 16 nt, Human
ugcacaagcuccaagc

SEQ ID NO: 3304259 - RNA, 15 nt, Human
ugcacaagcuccaag

SEQ ID NO: 3304260 - RNA, 23 nt, Human
ugcacaagcuccaagcucccagg

SEQ ID NO: 3304261 - RNA, 22 nt, Human
ugcacaagcuccaagcucccag

SEQ ID NO: 3304262 - RNA, 20 nt, Human
ugcacaagcuccaagcuccc

SEQ ID NO: 3304263 - RNA, 18 nt, Human
ugcacaagcuccaagcuc

SEQ ID NO: 3304264 - RNA, 14 nt, Human
ugcaccacugcacu

SEQ ID NO: 3304265 - RNA, 19 nt, Human
ugcacguacacacacauac

SEQ ID NO: 3304266 - RNA, 13 nt, Human
ugcacuccccugc

SEQ ID NO: 3304267 - RNA, 12 nt, Human
ugcacuccccug

SEQ ID NO: 3304268 - RNA, 23 nt, Human
agcgugguggacaugcacagcua

SEQ ID NO: 3304269 - RNA, 16 nt, Human
agcgugagccacugca

SEQ ID NO: 3304270 - RNA, 15 nt, Human
agcgugcauaaguua

SEQ ID NO: 3304271 - RNA, 20 nt, Human
agcgugguggacaugcacag

SEQ ID NO: 3304272 - RNA, 13 nt, Human
agcgugagccacu

SEQ ID NO: 3304273 - RNA, 15 nt, Human
agcgugagccacugc

SEQ ID NO: 3304274 - RNA, 16 nt, Human
agcggggacagcuccu

SEQ ID NO: 3304275 - RNA, 17 nt, Human
agcggggacagcuccuu

SEQ ID NO: 3304276 - RNA, 15 nt, Human
agcggggacagcucc

SEQ ID NO: 3304277 - RNA, 20 nt, Human
ugccauauucuguuggccag

SEQ ID NO: 3304278 - RNA, 21 nt, Human
ugccauauucuguuggccagu

SEQ ID NO: 3304279 - RNA, 23 nt, Human
ugccagucaccccggccaccugc

SEQ ID NO: 3304280 - RNA, 22 nt, Human
ugccagucaccccggccaccug

SEQ ID NO: 3304281 - RNA, 16 nt, Human
ugccauauucuguugg

SEQ ID NO: 3304282 - RNA, 17 nt, Human
ugccauauucuguuggc

SEQ ID NO: 3304283 - RNA, 15 nt, Human
ugccauauucuguug

SEQ ID NO: 3304284 - RNA, 20 nt, Human
ugccagucaccccggccacc

SEQ ID NO: 3304285 - RNA, 18 nt, Human
ugccagucaccccggcca

SEQ ID NO: 3304286 - RNA, 16 nt, Human
ugccagucaccccggc

SEQ ID NO: 3304287 - RNA, 15 nt, Human
ugccagucaccccgg

SEQ ID NO: 3304288 - RNA, 14 nt, Human
agcgcccaguuggg

SEQ ID NO: 3304289 - RNA, 23 nt, Human
ugcauuugaaaauuuugauguuu

SEQ ID NO: 3304290 - RNA, 19 nt, Human
ugcauuugaaaauuuugau

SEQ ID NO: 3304291 - RNA, 16 nt, Human
ugccauguuggccagg

SEQ ID NO: 3304292 - RNA, 21 nt, Human
ugccauguuggccaggcuggu

SEQ ID NO: 3304293 - RNA, 20 nt, Human
ugccauguuggccaggcugg

SEQ ID NO: 3304294 - RNA, 17 nt, Human
ugccauguuggccaggc

SEQ ID NO: 3304295 - RNA, 17 nt, Human
agcucagggccuggcuc

SEQ ID NO: 3304296 - RNA, 18 nt, Human
ugccauguuggccaggcu

SEQ ID NO: 3304297 - RNA, 19 nt, Human
ugccauguuggccaggcug

SEQ ID NO: 3304298 - RNA, 16 nt, Human
agcucagggccuggcu

SEQ ID NO: 3304299 - RNA, 15 nt, Human
agcucagggccuggc

SEQ ID NO: 3304300 - RNA, 14 nt, Human
agcucagggccugg

SEQ ID NO: 3304301 - RNA, 12 nt, Human
ugcccaggcccc

SEQ ID NO: 3304302 - RNA, 20 nt, Human
ugcccaggccccugccaccc

SEQ ID NO: 3304303 - RNA, 22 nt, Human
ugcccaggccccugccacccug

SEQ ID NO: 3304304 - RNA, 16 nt, Human
ugcccaggcaggucuu

SEQ ID NO: 3304305 - RNA, 17 nt, Human
ugcccaggcaggucuug

SEQ ID NO: 3304306 - RNA, 20 nt, Human
ugcccaggcaggucuugaac

SEQ ID NO: 3304307 - RNA, 11 nt, Human
ugcccaggccc

SEQ ID NO: 3304308 - RNA, 14 nt, Human
ugcccacaggauca

SEQ ID NO: 3304309 - RNA, 15 nt, Human
ugcccaggcaggucu

SEQ ID NO: 3304310 - RNA, 17 nt, Human
auugaccugaggcccuu

SEQ ID NO: 3304311 - RNA, 12 nt, Human
auugaaaucuuu

SEQ ID NO: 3304312 - RNA, 20 nt, Human
auugaaaucuuuuugcuuug

SEQ ID NO: 3304313 - RNA, 18 nt, Human
auugaaaucuuuuugcuu

SEQ ID NO: 3304314 - RNA, 17 nt, Human
auugaaaucuuuuugcu

SEQ ID NO: 3304315 - RNA, 14 nt, Human
auucuuaaauaugu

SEQ ID NO: 3304316 - RNA, 17 nt, Human
auucucauuugucacac

SEQ ID NO: 3304317 - RNA, 11 nt, Human
auucugccugc

SEQ ID NO: 3304318 - RNA, 13 nt, Human
auucugccugccc

SEQ ID NO: 3304319 - RNA, 14 nt, Human
auucugccugccca

SEQ ID NO: 3304320 - RNA, 15 nt, Human
auucugccugcccag

SEQ ID NO: 3304321 - RNA, 16 nt, Human
auucugccugcccagg

SEQ ID NO: 3304322 - RNA, 17 nt, Human
auucugccugcccaggc

SEQ ID NO: 3304323 - RNA, 18 nt, Human
auucugccugcccaggcc

SEQ ID NO: 3304324 - RNA, 19 nt, Human
auucugccugcccaggccc

SEQ ID NO: 3304325 - RNA, 18 nt, Human
auucugcucacauaucug

SEQ ID NO: 3304326 - RNA, 20 nt, Human
auucugccugcccaggcccc

SEQ ID NO: 3304327 - RNA, 21 nt, Human
auucugccugcccaggccccu

SEQ ID NO: 3304328 - RNA, 19 nt, Human
auucugcucacauaucugu

SEQ ID NO: 3304329 - RNA, 20 nt, Human
auucugcucacauaucuguc

SEQ ID NO: 3304330 - RNA, 21 nt, Human
auucugcucacauaucuguca

SEQ ID NO: 3304331 - RNA, 22 nt, Human
auucugcucacauaucugucau

SEQ ID NO: 3304332 - RNA, 14 nt, Human
auucuguuggccag

SEQ ID NO: 3304333 - RNA, 19 nt, Human
auucuguuggccaguguga

SEQ ID NO: 3304334 - RNA, 13 nt, Human
auucaggaagcuc

SEQ ID NO: 3304335 - RNA, 11 nt, Human
auucagacagc

SEQ ID NO: 3304336 - RNA, 13 nt, Human
auucagacagcug

SEQ ID NO: 3304337 - RNA, 12 nt, Human
auucagacagcu

SEQ ID NO: 3304338 - RNA, 12 nt, Human
auucaggaagcu

SEQ ID NO: 3304339 - RNA, 18 nt, Human
auucagacagcugccugg

SEQ ID NO: 3304340 - RNA, 17 nt, Human
auucagacagcugccug

SEQ ID NO: 3304341 - RNA, 16 nt, Human
auucagacagcugccu

SEQ ID NO: 3304342 - RNA, 15 nt, Human
auucagacagcugcc

SEQ ID NO: 3304343 - RNA, 14 nt, Human
auucagacagcugc

SEQ ID NO: 3304344 - RNA, 18 nt, Human
auuaucuagauacuguau

SEQ ID NO: 3304345 - RNA, 14 nt, Human
auuaucuagauacu

SEQ ID NO: 3304346 - RNA, 19 nt, Human
auuuuuguagagccagggu

SEQ ID NO: 3304347 - RNA, 12 nt, Human
auuuuuguaauu

SEQ ID NO: 3304348 - RNA, 14 nt, Human
auuuuuuaaaugca

SEQ ID NO: 3304349 - RNA, 13 nt, Human
auuuuuuaaaugc

SEQ ID NO: 3304350 - RNA, 21 nt, Human
auuuuucuuagggaaggauac

SEQ ID NO: 3304351 - RNA, 22 nt, Human
auuuuucuuagggaaggauaca

SEQ ID NO: 3304352 - RNA, 19 nt, Human
auuuugugcccccauguaa

SEQ ID NO: 3304353 - RNA, 23 nt, Human
auuuugucauauaagauucauau

SEQ ID NO: 3304354 - RNA, 12 nt, Human
auuuugcuuugu

SEQ ID NO: 3304355 - RNA, 20 nt, Human
auuuugcuuugugauuuuug

SEQ ID NO: 3304356 - RNA, 18 nt, Human
auuuugcuuugugauuuu

SEQ ID NO: 3304357 - RNA, 14 nt, Human
auuuuggaaaauaa

SEQ ID NO: 3304358 - RNA, 19 nt, Human
auuuuggaaaauaaauuau

SEQ ID NO: 3304359 - RNA, 20 nt, Human
auuuuggaaaauaaauuauu

SEQ ID NO: 3304360 - RNA, 19 nt, Human
auuuucccuauuagagaag

SEQ ID NO: 3304361 - RNA, 16 nt, Human
auuuuccugccaggca

SEQ ID NO: 3304362 - RNA, 18 nt, Human
auuuugauccaagcuggu

SEQ ID NO: 3304363 - RNA, 19 nt, Human
auuuugauccaagcugguc

SEQ ID NO: 3304364 - RNA, 15 nt, Human
auuuugauguuuuaa

SEQ ID NO: 3304365 - RNA, 17 nt, Human
auuuugauguuuuaagg

SEQ ID NO: 3304366 - RNA, 20 nt, Human
auuuugcuaaaugugaauga

SEQ ID NO: 3304367 - RNA, 21 nt, Human
auuuugcugucccuuuuccuu

SEQ ID NO: 3304368 - RNA, 22 nt, Human
auuuuaaaaauacagauagaua

SEQ ID NO: 3304369 - RNA, 23 nt, Human
auuucuuccacaagagcccaggc

SEQ ID NO: 3304370 - RNA, 20 nt, Human
auuucuuccacaagagccca

SEQ ID NO: 3304371 - RNA, 16 nt, Human
auuucuuccacaagag

SEQ ID NO: 3304372 - RNA, 15 nt, Human
auuugaaaauuuuga

SEQ ID NO: 3304373 - RNA, 16 nt, Human
auuugaaaauuuugau

SEQ ID NO: 3304374 - RNA, 12 nt, Human
auuuauuuaaau

SEQ ID NO: 3304375 - RNA, 14 nt, Human
auuuauuuaaauuu

SEQ ID NO: 3304376 - RNA, 16 nt, Human
auuucccaaagcagug

SEQ ID NO: 3304377 - RNA, 19 nt, Human
auuucccaaagcagugcau

SEQ ID NO: 3304378 - RNA, 21 nt, Human
auugauuuccguuaaaauacc

SEQ ID NO: 3304379 - RNA, 16 nt, Human
auugucaaagugguga

SEQ ID NO: 3304380 - RNA, 23 nt, Human
auugucaaaguggugagaggcau

SEQ ID NO: 3304381 - RNA, 14 nt, Human
auugugggaagggg

SEQ ID NO: 3304382 - RNA, 13 nt, Human
auugugggaaggg

SEQ ID NO: 3304383 - RNA, 21 nt, Human
auuguuuggggaugagaaagg

SEQ ID NO: 3304384 - RNA, 13 nt, Human
auuuaaaagauac

SEQ ID NO: 3304385 - RNA, 16 nt, Human
auuuaaaagauacagu

SEQ ID NO: 3304386 - RNA, 14 nt, Human
auuuaaaagauaca

SEQ ID NO: 3304387 - RNA, 17 nt, Human
auuuaaaagauacaguu

SEQ ID NO: 3304388 - RNA, 18 nt, Human
aucuaauauguaacaagc

SEQ ID NO: 3304389 - RNA, 20 nt, Human
uugaguugauucagcucugc

SEQ ID NO: 3304390 - RNA, 20 nt, Human
uugagugaagcugggagaac

SEQ ID NO: 3304391 - RNA, 12 nt, Human
uugagacagagu

SEQ ID NO: 3304392 - RNA, 15 nt, Human
uugagaucagccugg

SEQ ID NO: 3304393 - RNA, 16 nt, Human
uugagaucagccuggg

SEQ ID NO: 3304394 - RNA, 17 nt, Human
auccucuguacagagcc

SEQ ID NO: 3304395 - RNA, 16 nt, Human
auccucuguacagagc

SEQ ID NO: 3304396 - RNA, 13 nt, Human
aucuaaauggaac

SEQ ID NO: 3304397 - RNA, 18 nt, Human
aucuaaauggaaccacuc

SEQ ID NO: 3304398 - RNA, 17 nt, Human
aucuaaauggaaccacu

SEQ ID NO: 3304399 - RNA, 21 nt, Human
uugauuaaauucuugcaaagu

SEQ ID NO: 3304400 - RNA, 14 nt, Human
uugauuaaauucuu

SEQ ID NO: 3304401 - RNA, 12 nt, Human
aucugaaaaugu

SEQ ID NO: 3304402 - RNA, 23 nt, Human
aucugaaaauguauguguaagua

SEQ ID NO: 3304403 - RNA, 13 nt, Human
uugauuaaauucu

SEQ ID NO: 3304404 - RNA, 23 nt, Human
uugauguuuuaaggaugcuugua

SEQ ID NO: 3304405 - RNA, 14 nt, Human
uugcaauggcagcc

SEQ ID NO: 3304406 - RNA, 16 nt, Human
uugcaauggcagccuu

SEQ ID NO: 3304407 - RNA, 17 nt, Human
uugcaauggcagccuug

SEQ ID NO: 3304408 - RNA, 19 nt, Human
uugcaauggcagccuuggc

SEQ ID NO: 3304409 - RNA, 16 nt, Human
uugcaccacugcacuc

SEQ ID NO: 3304410 - RNA, 15 nt, Human
uugcaccacugcacu

SEQ ID NO: 3304411 - RNA, 14 nt, Human
uugcaccacugcac

SEQ ID NO: 3304412 - RNA, 15 nt, Human
aucucuugagccugg

SEQ ID NO: 3304413 - RNA, 14 nt, Human
aucugaaaauguau

SEQ ID NO: 3304414 - RNA, 16 nt, Human
aucugaaaauguaugu

SEQ ID NO: 3304415 - RNA, 19 nt, Human
aucugaaaauguaugugua

SEQ ID NO: 3304416 - RNA, 20 nt, Human
aucugaaaauguauguguaa

SEQ ID NO: 3304417 - RNA, 22 nt, Human
aucugaaaauguauguguaagu

SEQ ID NO: 3304418 - RNA, 15 nt, Human
aucucccccagcccc

SEQ ID NO: 3304419 - RNA, 14 nt, Human
aucucccccagccc

SEQ ID NO: 3304420 - RNA, 17 nt, Human
aucucccccagccccau

SEQ ID NO: 3304421 - RNA, 16 nt, Human
aucucccccagcccca

SEQ ID NO: 3304422 - RNA, 13 nt, Human
aucuccaaaauaa

SEQ ID NO: 3304423 - RNA, 21 nt, Human
aucuccaaaauaaaacuuuuu

SEQ ID NO: 3304424 - RNA, 20 nt, Human
aucuccaaaauaaaacuuuu

SEQ ID NO: 3304425 - RNA, 17 nt, Human
aucuccaaaauaaaacu

SEQ ID NO: 3304426 - RNA, 14 nt, Human
aucuccaaaauaaa

SEQ ID NO: 3304427 - RNA, 16 nt, Human
aucucagggccugguc

SEQ ID NO: 3304428 - RNA, 14 nt, Human
aucucagggccugg

SEQ ID NO: 3304429 - RNA, 18 nt, Human
uuggggaccagagcugcc

SEQ ID NO: 3304430 - RNA, 14 nt, Human
augaaaugagguca

SEQ ID NO: 3304431 - RNA, 19 nt, Human
augaaagggcccagagagg

SEQ ID NO: 3304432 - RNA, 14 nt, Human
uugcuugaaagaaa

SEQ ID NO: 3304433 - RNA, 18 nt, Human
uuggccccugcccggcug

SEQ ID NO: 3304434 - RNA, 16 nt, Human
uuggagggugucccaa

SEQ ID NO: 3304435 - RNA, 23 nt, Human
uuggcuauuagagaucaaccccu

SEQ ID NO: 3304436 - RNA, 15 nt, Human
augaaagggcccaga

SEQ ID NO: 3304437 - RNA, 18 nt, Human
augaaagggcccagagag

SEQ ID NO: 3304438 - RNA, 17 nt, Human
aucuuugcagacaggca

SEQ ID NO: 3304439 - RNA, 22 nt, Human
aucuuuucauuuaggugaggaa

SEQ ID NO: 3304440 - RNA, 20 nt, Human
aucuuggucagauuugaacu

SEQ ID NO: 3304441 - RNA, 18 nt, Human
aucugugaaaggaaagag

SEQ ID NO: 3304442 - RNA, 22 nt, Human
aucugucauuugagcagggcuc

SEQ ID NO: 3304443 - RNA, 17 nt, Human
aucugugaaaggaaaga

SEQ ID NO: 3304444 - RNA, 10 nt, Human
aucuggugac

SEQ ID NO: 3304445 - RNA, 17 nt, Human
aucuggugacuuuccuc

SEQ ID NO: 3304446 - RNA, 16 nt, Human
aucuggugacuuuccu

SEQ ID NO: 3304447 - RNA, 21 nt, Human
auccaguaucuugaagacuuu

SEQ ID NO: 3304448 - RNA, 18 nt, Human
aucccauaugccugggca

SEQ ID NO: 3304449 - RNA, 12 nt, Human
aucccagcccca

SEQ ID NO: 3304450 - RNA, 20 nt, Human
aucccaaacccuucagugcc

SEQ ID NO: 3304451 - RNA, 19 nt, Human
aucccaaacccuucagugc

SEQ ID NO: 3304452 - RNA, 18 nt, Human
auccaagcuggucccacu

SEQ ID NO: 3304453 - RNA, 13 nt, Human
auccacccaccuc

SEQ ID NO: 3304454 - RNA, 15 nt, Human
auccacccaccucag

SEQ ID NO: 3304455 - RNA, 16 nt, Human
auccaguaucuugaag

SEQ ID NO: 3304456 - RNA, 15 nt, Human
auccaguaucuugaa

SEQ ID NO: 3304457 - RNA, 15 nt, Human
uucugccauauucug

SEQ ID NO: 3304458 - RNA, 22 nt, Human
uucugaacuuggcgcugccccu

SEQ ID NO: 3304459 - RNA, 19 nt, Human
uucugaacuuggcgcugcc

SEQ ID NO: 3304460 - RNA, 17 nt, Human
uucuggcucuuccaggc

SEQ ID NO: 3304461 - RNA, 16 nt, Human
uucuggcucuuccagg

SEQ ID NO: 3304462 - RNA, 21 nt, Human
uucugccugcccaggccccug

SEQ ID NO: 3304463 - RNA, 15 nt, Human
uucuggcucuuccag

SEQ ID NO: 3304464 - RNA, 17 nt, Human
uucugccugcccaggcc

SEQ ID NO: 3304465 - RNA, 18 nt, Human
uucugccugcccaggccc

SEQ ID NO: 3304466 - RNA, 17 nt, Human
uucucuaguuugauuaa

SEQ ID NO: 3304467 - RNA, 15 nt, Human
uucucuaguuugauu

SEQ ID NO: 3304468 - RNA, 19 nt, Human
aucaggugcugccauccag

SEQ ID NO: 3304469 - RNA, 21 nt, Human
uucuccuuguguuacuaaguu

SEQ ID NO: 3304470 - RNA, 14 nt, Human
auccuccucagauc

SEQ ID NO: 3304471 - RNA, 16 nt, Human
auccuccucagaucuu

SEQ ID NO: 3304472 - RNA, 16 nt, Human
auccuaggcauuugcu

SEQ ID NO: 3304473 - RNA, 12 nt, Human
auccuaagcuau

SEQ ID NO: 3304474 - RNA, 13 nt, Human
uucuucugcuuca

SEQ ID NO: 3304475 - RNA, 15 nt, Human
uucuucugcuucagc

SEQ ID NO: 3304476 - RNA, 14 nt, Human
uucuucucccucag

SEQ ID NO: 3304477 - RNA, 11 nt, Human
uucuucucccu

SEQ ID NO: 3304478 - RNA, 13 nt, Human
uucuucucccuca

SEQ ID NO: 3304479 - RNA, 17 nt, Human
aucccauaugccugggc

SEQ ID NO: 3304480 - RNA, 24 nt, Human
aucccauaugccugggcagaagga

SEQ ID NO: 3304481 - RNA, 14 nt, Human
aucccucauccuca

SEQ ID NO: 3304482 - RNA, 23 nt, Human
aucccucauccucauacccaccc

SEQ ID NO: 3304483 - RNA, 21 nt, Human
aucccucauccucauacccac

SEQ ID NO: 3304484 - RNA, 13 nt, Human
aucccucauccuc

SEQ ID NO: 3304485 - RNA, 20 nt, Human
uucuucugcuucagccuccc

SEQ ID NO: 3304486 - RNA, 21 nt, Human
aucaagaugugacauguuuua

SEQ ID NO: 3304487 - RNA, 18 nt, Human
aucacggcucacugcagc

SEQ ID NO: 3304488 - RNA, 13 nt, Human
aucacgccacugc

SEQ ID NO: 3304489 - RNA, 15 nt, Human
aucacggcucacugc

SEQ ID NO: 3304490 - RNA, 14 nt, Human
aucaaugaguaaca

SEQ ID NO: 3304491 - RNA, 16 nt, Human
uuccguuaaaauacca

SEQ ID NO: 3304492 - RNA, 14 nt, Human
uuccguuaaaauac

SEQ ID NO: 3304493 - RNA, 20 nt, Human
uucccucaccuuucccaucu

SEQ ID NO: 3304494 - RNA, 15 nt, Human
uucccuauuagagaa

SEQ ID NO: 3304495 - RNA, 17 nt, Human
uuccuaauccucuagga

SEQ ID NO: 3304496 - RNA, 14 nt, Human
uuccugaaccgaug

SEQ ID NO: 3304497 - RNA, 17 nt, Human
uuccucuuuccaucuac

SEQ ID NO: 3304498 - RNA, 22 nt, Human
uuccucuuuccaucuacccucc

SEQ ID NO: 3304499 - RNA, 11 nt, Human
uuccucuuucc

SEQ ID NO: 3304500 - RNA, 13 nt, Human
uuccucuuuccau

SEQ ID NO: 3304501 - RNA, 13 nt, Human
uucgcuccugugu

SEQ ID NO: 3304502 - RNA, 15 nt, Human
uucgcuccugugucu

SEQ ID NO: 3304503 - RNA, 19 nt, Human
uucgcuccugugucuugca

SEQ ID NO: 3304504 - RNA, 19 nt, Human
uucuaaaggcuaccuuugu

SEQ ID NO: 3304505 - RNA, 21 nt, Human
uucuaaaggcuaccuuuguau

SEQ ID NO: 3304506 - RNA, 20 nt, Human
uucuaaaggcuaccuuugua

SEQ ID NO: 3304507 - RNA, 19 nt, Human
uucuaaaucuccaaaauaa

SEQ ID NO: 3304508 - RNA, 21 nt, Human
uucuaaaucuccaaaauaaaa

SEQ ID NO: 3304509 - RNA, 16 nt, Human
uucuagcauggcugcc

SEQ ID NO: 3304510 - RNA, 14 nt, Human
aucaggccaggccc

SEQ ID NO: 3304511 - RNA, 12 nt, Human
aucagaauucuc

SEQ ID NO: 3304512 - RNA, 18 nt, Human
aucaggccaggcccucug

SEQ ID NO: 3304513 - RNA, 16 nt, Human
aucaggccaggcccuc

SEQ ID NO: 3304514 - RNA, 15 nt, Human
aucaggccaggcccu

SEQ ID NO: 3304515 - RNA, 13 nt, Human
aucagcacgauuu

SEQ ID NO: 3304516 - RNA, 11 nt, Human
aucagaauucu

SEQ ID NO: 3304517 - RNA, 16 nt, Human
uuucaaacuuuacuau

SEQ ID NO: 3304518 - RNA, 22 nt, Human
uuucaaacuuuacuauggcccu

SEQ ID NO: 3304519 - RNA, 15 nt, Human
uuucaaacuuuacua

SEQ ID NO: 3304520 - RNA, 13 nt, Human
augcuucucacug

SEQ ID NO: 3304521 - RNA, 22 nt, Human
augcugugcccuaaaguguauu

SEQ ID NO: 3304522 - RNA, 15 nt, Human
augggagagaagaga

SEQ ID NO: 3304523 - RNA, 19 nt, Human
augggagagaagagaaugc

SEQ ID NO: 3304524 - RNA, 18 nt, Human
uuuccaugaguccccugu

SEQ ID NO: 3304525 - RNA, 17 nt, Human
uuuccaugaguccccug

SEQ ID NO: 3304526 - RNA, 12 nt, Human
auggacuuuguu

SEQ ID NO: 3304527 - RNA, 11 nt, Human
auggacuuugu

SEQ ID NO: 3304528 - RNA, 19 nt, Human
auggacuaacuugucuuug

SEQ ID NO: 3304529 - RNA, 23 nt, Human
augcagugguaugaucacggcuc

SEQ ID NO: 3304530 - RNA, 13 nt, Human
augcagugcuucc

SEQ ID NO: 3304531 - RNA, 11 nt, Human
augcccagccc

SEQ ID NO: 3304532 - RNA, 14 nt, Human
augcccagccccuu

SEQ ID NO: 3304533 - RNA, 13 nt, Human
augcccagccccu

SEQ ID NO: 3304534 - RNA, 12 nt, Human
augcccagcccc

SEQ ID NO: 3304535 - RNA, 19 nt, Human
uuuaauuuuuuugagacag

SEQ ID NO: 3304536 - RNA, 18 nt, Human
augcagccucacaguccu

SEQ ID NO: 3304537 - RNA, 17 nt, Human
augcagccucacagucc

SEQ ID NO: 3304538 - RNA, 20 nt, Human
augaucuaggaagacuuugg

SEQ ID NO: 3304539 - RNA, 17 nt, Human
augaucuaggaagacuu

SEQ ID NO: 3304540 - RNA, 15 nt, Human
augaucuaggaagac

SEQ ID NO: 3304541 - RNA, 21 nt, Human
uuguuccacaaguuaaauaaa

SEQ ID NO: 3304542 - RNA, 20 nt, Human
uuguguuacuaaguuuuuau

SEQ ID NO: 3304543 - RNA, 15 nt, Human
uuguguuacuaaguu

SEQ ID NO: 3304544 - RNA, 13 nt, Human
uuguguuacuaag

SEQ ID NO: 3304545 - RNA, 20 nt, Human
uuguucuugguuuguaaauu

SEQ ID NO: 3304546 - RNA, 23 nt, Human
uuuaaaaauacagauagauauau

SEQ ID NO: 3304547 - RNA, 13 nt, Human
uuuaaagaaugcu

SEQ ID NO: 3304548 - RNA, 22 nt, Human
augcaccagcccuuagcaggga

SEQ ID NO: 3304549 - RNA, 14 nt, Human
augcaccagcccuu

SEQ ID NO: 3304550 - RNA, 13 nt, Human
augcaccuggaau

SEQ ID NO: 3304551 - RNA, 16 nt, Human
augcacuuuguucugg

SEQ ID NO: 3304552 - RNA, 17 nt, Human
augcacuuuguucuggc

SEQ ID NO: 3304553 - RNA, 20 nt, Human
augcacuuuguucuggcucu

SEQ ID NO: 3304554 - RNA, 19 nt, Human
augcacuuuguucuggcuc

SEQ ID NO: 3304555 - RNA, 20 nt, Human
augggcuggguucuacccag

SEQ ID NO: 3304556 - RNA, 17 nt, Human
augggccuccugugugu

SEQ ID NO: 3304557 - RNA, 18 nt, Human
augggccuccugugugug

SEQ ID NO: 3304558 - RNA, 15 nt, Human
augggggugcauuug

SEQ ID NO: 3304559 - RNA, 14 nt, Human
augggggugcauuu

SEQ ID NO: 3304560 - RNA, 24 nt, Human
auggggcugcaccggcuggccugg

SEQ ID NO: 3304561 - RNA, 12 nt, Human
auggggcugcac

SEQ ID NO: 3304562 - RNA, 15 nt, Human
augggauccuggagu

SEQ ID NO: 3304563 - RNA, 19 nt, Human
uuucugcagccacuauugu

SEQ ID NO: 3304564 - RNA, 19 nt, Human
uuucuggcuaugcauuuga

SEQ ID NO: 3304565 - RNA, 18 nt, Human
uuucuggcuaugcauuug

SEQ ID NO: 3304566 - RNA, 16 nt, Human
uuucuggcuaugcauu

SEQ ID NO: 3304567 - RNA, 15 nt, Human
uuucuggcuaugcau

SEQ ID NO: 3304568 - RNA, 14 nt, Human
augguuuucuugug

SEQ ID NO: 3304569 - RNA, 16 nt, Human
augguuuucaaaauaa

SEQ ID NO: 3304570 - RNA, 14 nt, Human
augguuuucaaaau

SEQ ID NO: 3304571 - RNA, 15 nt, Human
augguuuucaaaaua

SEQ ID NO: 3304572 - RNA, 20 nt, Human
auggugagggauacccaucc

SEQ ID NO: 3304573 - RNA, 15 nt, Human
augggugcuuggagg

SEQ ID NO: 3304574 - RNA, 15 nt, Human
auggugcaaugaccu

SEQ ID NO: 3304575 - RNA, 13 nt, Human
auggugcaaugac

SEQ ID NO: 3304576 - RNA, 12 nt, Human
auggugcaauga

SEQ ID NO: 3304577 - RNA, 17 nt, Human
auggugcaaugaccuuu

SEQ ID NO: 3304578 - RNA, 16 nt, Human
auggugcaaugaccuu

SEQ ID NO: 3304579 - RNA, 19 nt, Human
auggugcaaugaccuuuca

SEQ ID NO: 3304580 - RNA, 12 nt, Human
augguggcuggg

SEQ ID NO: 3304581 - RNA, 13 nt, Human
augguggcugggu

SEQ ID NO: 3304582 - RNA, 15 nt, Human
augguggcuggguug

SEQ ID NO: 3304583 - RNA, 17 nt, Human
augguggcuggguugga

SEQ ID NO: 3304584 - RNA, 12 nt, Human
uuugaccucugc

SEQ ID NO: 3304585 - RNA, 13 nt, Human
uuugccucugccu

SEQ ID NO: 3304586 - RNA, 15 nt, Human
uuugccguuauuaaa

SEQ ID NO: 3304587 - RNA, 22 nt, Human
uuugauucagacagcugccugg

SEQ ID NO: 3304588 - RNA, 22 nt, Human
uuugauguucuuucacccuuuu

SEQ ID NO: 3304589 - RNA, 13 nt, Human
uuugauuaaauuc

SEQ ID NO: 3304590 - RNA, 21 nt, Human
uuugauucagacagcugccug

SEQ ID NO: 3304591 - RNA, 18 nt, Human
uuugauucagacagcugc

SEQ ID NO: 3304592 - RNA, 21 nt, Human
uuugauuaaauucuugcaaag

SEQ ID NO: 3304593 - RNA, 18 nt, Human
uuugauuaaauucuugca

SEQ ID NO: 3304594 - RNA, 20 nt, Human
uuugacgccaucccagcccc

SEQ ID NO: 3304595 - RNA, 19 nt, Human
uuugacgccaucccagccc

SEQ ID NO: 3304596 - RNA, 16 nt, Human
uuugacgccaucccag

SEQ ID NO: 3304597 - RNA, 14 nt, Human
uuugacgccauccc

SEQ ID NO: 3304598 - RNA, 13 nt, Human
uuugacgccaucc

SEQ ID NO: 3304599 - RNA, 13 nt, Human
augucagugugac

SEQ ID NO: 3304600 - RNA, 12 nt, Human
augucaguguga

SEQ ID NO: 3304601 - RNA, 16 nt, Human
auguauguguaaguau

SEQ ID NO: 3304602 - RNA, 15 nt, Human
auguauguguaagua

SEQ ID NO: 3304603 - RNA, 15 nt, Human
augugaugagaggaa

SEQ ID NO: 3304604 - RNA, 16 nt, Human
augugaugagaggaaa

SEQ ID NO: 3304605 - RNA, 19 nt, Human
augugaugagaggaaauca

SEQ ID NO: 3304606 - RNA, 17 nt, Human
augugaugagaggaaau

SEQ ID NO: 3304607 - RNA, 23 nt, Human
augugcacaugcacgugugugca

SEQ ID NO: 3304608 - RNA, 15 nt, Human
aaaaaauauuuuccu

SEQ ID NO: 3304609 - RNA, 21 nt, Human
auagccaaggccaaaggaagc

SEQ ID NO: 3304610 - RNA, 15 nt, Human
auagccaaggccaaa

SEQ ID NO: 3304611 - RNA, 17 nt, Human
auaguaugguggcuggg

SEQ ID NO: 3304612 - RNA, 18 nt, Human
auaguaugguggcugggu

SEQ ID NO: 3304613 - RNA, 16 nt, Human
auaguaugguggcugg

SEQ ID NO: 3304614 - RNA, 19 nt, Human
auauuuacuucuuauacau

SEQ ID NO: 3304615 - RNA, 21 nt, Human
auaugcuuauacacuuacacu

SEQ ID NO: 3304616 - RNA, 22 nt, Human
auauuaccacagacauacuaac

SEQ ID NO: 3304617 - RNA, 19 nt, Human
auauuaccacagacauacu

SEQ ID NO: 3304618 - RNA, 15 nt, Human
auaauguaagcucua

SEQ ID NO: 3304619 - RNA, 18 nt, Human
auacaccacuacauucug

SEQ ID NO: 3304620 - RNA, 21 nt, Human
auacaccacuacauucuguua

SEQ ID NO: 3304621 - RNA, 20 nt, Human
auacaccacuacauucuguu

SEQ ID NO: 3304622 - RNA, 19 nt, Human
auacaccacuacauucugu

SEQ ID NO: 3304623 - RNA, 14 nt, Human
auaauguaagcucu

SEQ ID NO: 3304624 - RNA, 20 nt, Human
auaaugcgugcauaccacuu

SEQ ID NO: 3304625 - RNA, 21 nt, Human
auaaugcgugcauaccacuuu

SEQ ID NO: 3304626 - RNA, 17 nt, Human
auaccugucccccugac

SEQ ID NO: 3304627 - RNA, 18 nt, Human
auaccugucccccugaca

SEQ ID NO: 3304628 - RNA, 11 nt, Human
auacccacccc

SEQ ID NO: 3304629 - RNA, 12 nt, Human
auacccaccccc

SEQ ID NO: 3304630 - RNA, 11 nt, Human
auaaaacuuuu

SEQ ID NO: 3304631 - RNA, 15 nt, Human
auaaaacuuuuuaaa

SEQ ID NO: 3304632 - RNA, 24 nt, Human
auaaacuuuaccuuuuuuauacau

SEQ ID NO: 3304633 - RNA, 16 nt, Human
auaaacuuuaccuuuu

SEQ ID NO: 3304634 - RNA, 21 nt, Human
auaaacuuuaccuuuuuuaua

SEQ ID NO: 3304635 - RNA, 17 nt, Human
auaaaacuuuuuaaaau

SEQ ID NO: 3304636 - RNA, 13 nt, Human
auaaagcagcguu

SEQ ID NO: 3304637 - RNA, 20 nt, Human
auaaagcagcguuucuauga

SEQ ID NO: 3304638 - RNA, 19 nt, Human
auaaagcagcguuucuaug

SEQ ID NO: 3304639 - RNA, 18 nt, Human
auaaagcagcguuucuau

SEQ ID NO: 3304640 - RNA, 14 nt, Human
auaaagcagcguuu

SEQ ID NO: 3304641 - RNA, 20 nt, Human
aguucagguaacaggcagau

SEQ ID NO: 3304642 - RNA, 18 nt, Human
aguucagguaacaggcag

SEQ ID NO: 3304643 - RNA, 19 nt, Human
aguucagguaacaggcaga

SEQ ID NO: 3304644 - RNA, 22 nt, Human
aguucaucuugaauuguaagga

SEQ ID NO: 3304645 - RNA, 12 nt, Human
aguuaaauaaau

SEQ ID NO: 3304646 - RNA, 18 nt, Human
aguuacacuaaaagguga

SEQ ID NO: 3304647 - RNA, 16 nt, Human
aguuacagacaaagcg

SEQ ID NO: 3304648 - RNA, 14 nt, Human
aguuacagacaaag

SEQ ID NO: 3304649 - RNA, 14 nt, Human
aguugaagacagag

SEQ ID NO: 3304650 - RNA, 20 nt, Human
aguuguuugauucagacagc

SEQ ID NO: 3304651 - RNA, 23 nt, Human
aguggcuuaaaacaacacucaca

SEQ ID NO: 3304652 - RNA, 18 nt, Human
aguguauuuuuuuacuaa

SEQ ID NO: 3304653 - RNA, 17 nt, Human
aguguauuuuuuuacua

SEQ ID NO: 3304654 - RNA, 15 nt, Human
agugggagcugccug

SEQ ID NO: 3304655 - RNA, 14 nt, Human
agugggagcugccu

SEQ ID NO: 3304656 - RNA, 16 nt, Human
aguaugaggcauuugu

SEQ ID NO: 3304657 - RNA, 15 nt, Human
aguaugaggcauuug

SEQ ID NO: 3304658 - RNA, 15 nt, Human
aguaucucagggccu

SEQ ID NO: 3304659 - RNA, 15 nt, Human
aguaucuugaagacu

SEQ ID NO: 3304660 - RNA, 12 nt, Human
aguaucuugaag

SEQ ID NO: 3304661 - RNA, 11 nt, Human
aguaucuugaa

SEQ ID NO: 3304662 - RNA, 15 nt, Human
agucugaaggcuggg

SEQ ID NO: 3304663 - RNA, 13 nt, Human
agucugaaggcug

SEQ ID NO: 3304664 - RNA, 16 nt, Human
agucugaaggcugggu

SEQ ID NO: 3304665 - RNA, 12 nt, Human
agucugaaggcu

SEQ ID NO: 3304666 - RNA, 22 nt, Human
aguccuggcaugggaaugaaug

SEQ ID NO: 3304667 - RNA, 21 nt, Human
aguccuggcaugggaaugaau

SEQ ID NO: 3304668 - RNA, 20 nt, Human
aguccuggcaugggaaugaa

SEQ ID NO: 3304669 - RNA, 16 nt, Human
agugaagacaaugacu

SEQ ID NO: 3304670 - RNA, 14 nt, Human
agugaagacaauga

SEQ ID NO: 3304671 - RNA, 16 nt, Human
agucugauucccaagc

SEQ ID NO: 3304672 - RNA, 18 nt, Human
agucugauucccaagcuc

SEQ ID NO: 3304673 - RNA, 17 nt, Human
agucuggaaugcagugg

SEQ ID NO: 3304674 - RNA, 20 nt, Human
agugaacuugggccacugug

SEQ ID NO: 3304675 - RNA, 11 nt, Human
auguucuggga

SEQ ID NO: 3304676 - RNA, 12 nt, Human
auguucugggac

SEQ ID NO: 3304677 - RNA, 19 nt, Human
auguuugccucugccucug

SEQ ID NO: 3304678 - RNA, 22 nt, Human
auguuugccucugccucugaca

SEQ ID NO: 3304679 - RNA, 18 nt, Human
auguuugccucugccucu

SEQ ID NO: 3304680 - RNA, 15 nt, Human
auguaauuaaguacu

SEQ ID NO: 3304681 - RNA, 17 nt, Human
auguaauuaaguacuau

SEQ ID NO: 3304682 - RNA, 19 nt, Human
auggucaccaaaucagcug

SEQ ID NO: 3304683 - RNA, 14 nt, Human
augucuuuucuugc

SEQ ID NO: 3304684 - RNA, 22 nt, Human
augugaaacuggauuaaacuua

SEQ ID NO: 3304685 - RNA, 17 nt, Human
augcacagaguuguuac

SEQ ID NO: 3304686 - RNA, 17 nt, Human
augcacaaacagaggcc

SEQ ID NO: 3304687 - RNA, 16 nt, Human
augcacaaacagaggc

SEQ ID NO: 3304688 - RNA, 16 nt, Human
augcacagaguuguua

SEQ ID NO: 3304689 - RNA, 23 nt, Human
augcacacauuuuuuaaaugcac

SEQ ID NO: 3304690 - RNA, 19 nt, Human
augccucucucaggccaaa

SEQ ID NO: 3304691 - RNA, 17 nt, Human
augccucucucaggcca

SEQ ID NO: 3304692 - RNA, 16 nt, Human
augcaugaaguaauau

SEQ ID NO: 3304693 - RNA, 15 nt, Human
augcacaaacagagg

SEQ ID NO: 3304694 - RNA, 24 nt, Human
augauguuuuccaugaguccccug

SEQ ID NO: 3304695 - RNA, 17 nt, Human
augaugccaugaggaac

SEQ ID NO: 3304696 - RNA, 16 nt, Human
augaugccaugaggaa

SEQ ID NO: 3304697 - RNA, 12 nt, Human
augcuuguacau

SEQ ID NO: 3304698 - RNA, 14 nt, Human
augcuuguacauaa

SEQ ID NO: 3304699 - RNA, 13 nt, Human
augcuuguacaua

SEQ ID NO: 3304700 - RNA, 15 nt, Human
auggauuuccagcca

SEQ ID NO: 3304701 - RNA, 16 nt, Human
augcucuuuacuucau

SEQ ID NO: 3304702 - RNA, 11 nt, Human
augcugcccug

SEQ ID NO: 3304703 - RNA, 18 nt, Human
aucagccugcuccagcug

SEQ ID NO: 3304704 - RNA, 17 nt, Human
aucagccugcuccagcu

SEQ ID NO: 3304705 - RNA, 19 nt, Human
aucagccugcuccagcugu

SEQ ID NO: 3304706 - RNA, 14 nt, Human
aucaccgaaaacgu

SEQ ID NO: 3304707 - RNA, 19 nt, Human
aucaccgaaaacguggcug

SEQ ID NO: 3304708 - RNA, 20 nt, Human
aucagcacgauuucuguuua

SEQ ID NO: 3304709 - RNA, 19 nt, Human
aucagcacgauuucuguuu

SEQ ID NO: 3304710 - RNA, 23 nt, Human
aucagcacgauuucuguuuagau

SEQ ID NO: 3304711 - RNA, 13 nt, Human
aucacagccucug

SEQ ID NO: 3304712 - RNA, 21 nt, Human
aucacagccucugaaaaccaa

SEQ ID NO: 3304713 - RNA, 18 nt, Human
aucaccaacgucugugcc

SEQ ID NO: 3304714 - RNA, 23 nt, Human
aucacccgcuaagagggagggag

SEQ ID NO: 3304715 - RNA, 19 nt, Human
aucaccaacgucugugcca

SEQ ID NO: 3304716 - RNA, 20 nt, Human
auccucccaccucagccucc

SEQ ID NO: 3304717 - RNA, 18 nt, Human
auccucccaccucagccu

SEQ ID NO: 3304718 - RNA, 19 nt, Human
auccucccaccucagccuc

SEQ ID NO: 3304719 - RNA, 15 nt, Human
auccucccaccucag

SEQ ID NO: 3304720 - RNA, 23 nt, Human
auccuccaggugcacaagcucca

SEQ ID NO: 3304721 - RNA, 11 nt, Human
auccuccaggu

SEQ ID NO: 3304722 - RNA, 23 nt, Human
auccucauacccacccccaccca

SEQ ID NO: 3304723 - RNA, 15 nt, Human
auccccuguagagug

SEQ ID NO: 3304724 - RNA, 15 nt, Human
aucccauuuaaaaaa

SEQ ID NO: 3304725 - RNA, 14 nt, Human
aucccauuuaaaaa

SEQ ID NO: 3304726 - RNA, 23 nt, Human
augaccuuucaauaggaaaaacu

SEQ ID NO: 3304727 - RNA, 22 nt, Human
augaccuuucaauaggaaaaac

SEQ ID NO: 3304728 - RNA, 18 nt, Human
augaccuuucaauaggaa

SEQ ID NO: 3304729 - RNA, 21 nt, Human
augaccuuucaauaggaaaaa

SEQ ID NO: 3304730 - RNA, 13 nt, Human
augaaagacugua

SEQ ID NO: 3304731 - RNA, 16 nt, Human
augaaagacuguacaa

SEQ ID NO: 3304732 - RNA, 17 nt, Human
augaaagacuguacaaa

SEQ ID NO: 3304733 - RNA, 21 nt, Human
aucucccccagccccauccuc

SEQ ID NO: 3304734 - RNA, 22 nt, Human
aucugcuuuuuaaagaaugcuc

SEQ ID NO: 3304735 - RNA, 18 nt, Human
aucuugaagacuuuucuu

SEQ ID NO: 3304736 - RNA, 22 nt, Human
aucuucugaacuuggcgcugcc

SEQ ID NO: 3304737 - RNA, 23 nt, Human
aggcccuucucuccagccccugg

SEQ ID NO: 3304738 - RNA, 22 nt, Human
aggcccuucucuccagccccug

SEQ ID NO: 3304739 - RNA, 21 nt, Human
aggcccuucucuccagccccu

SEQ ID NO: 3304740 - RNA, 20 nt, Human
aggcccuucucuccagcccc

SEQ ID NO: 3304741 - RNA, 13 nt, Human
aggcuguauccca

SEQ ID NO: 3304742 - RNA, 18 nt, Human
aggcuguaucccaugagc

SEQ ID NO: 3304743 - RNA, 20 nt, Human
aggcugucaauuacaggaag

SEQ ID NO: 3304744 - RNA, 19 nt, Human
aggcugucaauuacaggaa

SEQ ID NO: 3304745 - RNA, 23 nt, Human
agggacagaggggguggccuccc

SEQ ID NO: 3304746 - RNA, 20 nt, Human
agggacagaggggguggccu

SEQ ID NO: 3304747 - RNA, 22 nt, Human
agggacagaggggguggccucc

SEQ ID NO: 3304748 - RNA, 21 nt, Human
aggcugucaauuacaggaagu

SEQ ID NO: 3304749 - RNA, 19 nt, Human
aggggccucuuaugggcug

SEQ ID NO: 3304750 - RNA, 20 nt, Human
aggggccucuuaugggcugg

SEQ ID NO: 3304751 - RNA, 19 nt, Human
aggguaucaggugcugcca

SEQ ID NO: 3304752 - RNA, 18 nt, Human
aggguaucaggugcugcc

SEQ ID NO: 3304753 - RNA, 21 nt, Human
aggguaucaggugcugccauc

SEQ ID NO: 3304754 - RNA, 11 nt, Human
agggucccugg

SEQ ID NO: 3304755 - RNA, 23 nt, Human
aggguuuugccauguuggccagg

SEQ ID NO: 3304756 - RNA, 23 nt, Human
aggucuguucuuuccaaaguaca

SEQ ID NO: 3304757 - RNA, 22 nt, Human
aggucuguucuuuccaaaguac

SEQ ID NO: 3304758 - RNA, 18 nt, Human
aggucuguucuuuccaaa

SEQ ID NO: 3304759 - RNA, 23 nt, Human
aggugcuaggaacacuccuucac

SEQ ID NO: 3304760 - RNA, 22 nt, Human
aggugcuaggaacacuccuuca

SEQ ID NO: 3304761 - RNA, 19 nt, Human
aggugcuaggaacacuccu

SEQ ID NO: 3304762 - RNA, 23 nt, Human
agguucccuuugacgccauccca

SEQ ID NO: 3304763 - RNA, 13 nt, Human
agguucccuuuga

SEQ ID NO: 3304764 - RNA, 22 nt, Human
agguucccuuugacgccauccc

SEQ ID NO: 3304765 - RNA, 14 nt, Human
agguucaaagauau

SEQ ID NO: 3304766 - RNA, 14 nt, Human
aggauuauuggaaa

SEQ ID NO: 3304767 - RNA, 15 nt, Human
aggauguucugggac

SEQ ID NO: 3304768 - RNA, 16 nt, Human
aggauguucugggaca

SEQ ID NO: 3304769 - RNA, 22 nt, Human
aggauguucuagcauggcugcc

SEQ ID NO: 3304770 - RNA, 23 nt, Human
aggaugcuuguacauaaugcgug

SEQ ID NO: 3304771 - RNA, 21 nt, Human
aggaugcuuguacauaaugcg

SEQ ID NO: 3304772 - RNA, 13 nt, Human
aggaccucaggug

SEQ ID NO: 3304773 - RNA, 17 nt, Human
aggaauccagacccggc

SEQ ID NO: 3304774 - RNA, 21 nt, Human
aggaaucaugugccaagcaga

SEQ ID NO: 3304775 - RNA, 21 nt, Human
agcugcgguccacccaggagc

SEQ ID NO: 3304776 - RNA, 21 nt, Human
agcugacuuuucuguccgagc

SEQ ID NO: 3304777 - RNA, 12 nt, Human
agcuccuucugu

SEQ ID NO: 3304778 - RNA, 23 nt, Human
agcuccgcuuucuacccagcgag

SEQ ID NO: 3304779 - RNA, 20 nt, Human
agcuccgcuuucuacccagc

SEQ ID NO: 3304780 - RNA, 21 nt, Human
agcuccgcuuucuacccagcg

SEQ ID NO: 3304781 - RNA, 23 nt, Human
agcugcgguccacccaggagccc

SEQ ID NO: 3304782 - RNA, 23 nt, Human
agaggacuuuucuuuguggcuuc

SEQ ID NO: 3304783 - RNA, 16 nt, Human
agaggagagaggaccc

SEQ ID NO: 3304784 - RNA, 15 nt, Human
agaggagagaggacc

SEQ ID NO: 3304785 - RNA, 16 nt, Human
agaggaaggagaggag

SEQ ID NO: 3304786 - RNA, 21 nt, Human
agaggaaaucaccgaaaacgu

SEQ ID NO: 3304787 - RNA, 11 nt, Human
agagugggagc

SEQ ID NO: 3304788 - RNA, 19 nt, Human
agaguggggauaugauuua

SEQ ID NO: 3304789 - RNA, 14 nt, Human
agagugugccugaa

SEQ ID NO: 3304790 - RNA, 19 nt, Human
agaggguggugaccucugc

SEQ ID NO: 3304791 - RNA, 20 nt, Human
agaggguggugaccucugcc

SEQ ID NO: 3304792 - RNA, 22 nt, Human
agaggguggugaccucugccug

SEQ ID NO: 3304793 - RNA, 12 nt, Human
agagggcacaga

SEQ ID NO: 3304794 - RNA, 14 nt, Human
agagcccaggccuc

SEQ ID NO: 3304795 - RNA, 13 nt, Human
agagcccaggccu

SEQ ID NO: 3304796 - RNA, 15 nt, Human
agagcccaggccucc

SEQ ID NO: 3304797 - RNA, 19 nt, Human
agauauaugcucugcaugu

SEQ ID NO: 3304798 - RNA, 14 nt, Human
agaucuucuguggg

SEQ ID NO: 3304799 - RNA, 19 nt, Human
agacuggaagcacagcuuc

SEQ ID NO: 3304800 - RNA, 17 nt, Human
agacuggaagcacagcu

SEQ ID NO: 3304801 - RNA, 16 nt, Human
agacuggaagcacagc

SEQ ID NO: 3304802 - RNA, 23 nt, Human
agagagcaagacgcugugcugcc

SEQ ID NO: 3304803 - RNA, 19 nt, Human
agagcccaccuuggcucaa

SEQ ID NO: 3304804 - RNA, 13 nt, Human
agagcccacgccc

SEQ ID NO: 3304805 - RNA, 16 nt, Human
agagcccacgccccca

SEQ ID NO: 3304806 - RNA, 13 nt, Human
agagcccaccuug

SEQ ID NO: 3304807 - RNA, 22 nt, Human
agagaggguggugaccucugcc

SEQ ID NO: 3304808 - RNA, 20 nt, Human
agagaggguggugaccucug

SEQ ID NO: 3304809 - RNA, 21 nt, Human
agagaggguggugaccucugc

SEQ ID NO: 3304810 - RNA, 23 nt, Human
agacagagucucacuguugccca

SEQ ID NO: 3304811 - RNA, 15 nt, Human
agacagcccgggcuc

SEQ ID NO: 3304812 - RNA, 14 nt, Human
agacagcccgggcu

SEQ ID NO: 3304813 - RNA, 15 nt, Human
agacagauacuccuc

SEQ ID NO: 3304814 - RNA, 21 nt, Human
agacagauacuccuccaaggu

SEQ ID NO: 3304815 - RNA, 12 nt, Human
agacagcucuua

SEQ ID NO: 3304816 - RNA, 11 nt, Human
agacagcucuu

SEQ ID NO: 3304817 - RNA, 21 nt, Human
agacgcugugcugcccugccc

SEQ ID NO: 3304818 - RNA, 22 nt, Human
agacgcugugcugcccugccca

SEQ ID NO: 3304819 - RNA, 20 nt, Human
agacgcugugcugcccugcc

SEQ ID NO: 3304820 - RNA, 18 nt, Human
agacgggggcagagaggg

SEQ ID NO: 3304821 - RNA, 13 nt, Human
agccgcuggggcc

SEQ ID NO: 3304822 - RNA, 21 nt, Human
agccgccaugcuccuggccca

SEQ ID NO: 3304823 - RNA, 22 nt, Human
agccucccacgacugcccggca

SEQ ID NO: 3304824 - RNA, 21 nt, Human
agccucccaaagugcugggau

SEQ ID NO: 3304825 - RNA, 20 nt, Human
agccucccaaagugcuggga

SEQ ID NO: 3304826 - RNA, 14 nt, Human
agccuccuccagcc

SEQ ID NO: 3304827 - RNA, 20 nt, Human
agccucccgaguagcuggga

SEQ ID NO: 3304828 - RNA, 18 nt, Human
agccucccgaguagcugg

SEQ ID NO: 3304829 - RNA, 19 nt, Human
agccucccgaguagcuggg

SEQ ID NO: 3304830 - RNA, 13 nt, Human
agccccauucugc

SEQ ID NO: 3304831 - RNA, 16 nt, Human
agccccauucugccug

SEQ ID NO: 3304832 - RNA, 21 nt, Human
agcccgggcucugccucccau

SEQ ID NO: 3304833 - RNA, 13 nt, Human
agccccagugccc

SEQ ID NO: 3304834 - RNA, 14 nt, Human
agccccagugccca

SEQ ID NO: 3304835 - RNA, 15 nt, Human
agccccagugcccac

SEQ ID NO: 3304836 - RNA, 20 nt, Human
agccagcaggcucucaggcc

SEQ ID NO: 3304837 - RNA, 17 nt, Human
agccagcaggcucucag

SEQ ID NO: 3304838 - RNA, 19 nt, Human
agccagcaggcucucaggc

SEQ ID NO: 3304839 - RNA, 18 nt, Human
agccagcaggcucucagg

SEQ ID NO: 3304840 - RNA, 19 nt, Human
agcacagacccugcccugu

SEQ ID NO: 3304841 - RNA, 18 nt, Human
agcacagacccugcccug

SEQ ID NO: 3304842 - RNA, 23 nt, Human
agcacacuugacaucaacugcau

SEQ ID NO: 3304843 - RNA, 17 nt, Human
agcacagacccugcccu

SEQ ID NO: 3304844 - RNA, 20 nt, Human
agcagugcaugcugucccuu

SEQ ID NO: 3304845 - RNA, 19 nt, Human
agcagugcaugcugucccu

SEQ ID NO: 3304846 - RNA, 18 nt, Human
agcagugcaugcuguccc

SEQ ID NO: 3304847 - RNA, 13 nt, Human
agcagcguuucua

SEQ ID NO: 3304848 - RNA, 23 nt, Human
agccaaagcuaggccuggccaga

SEQ ID NO: 3304849 - RNA, 23 nt, Human
agcaugccuggauggggcugcac

SEQ ID NO: 3304850 - RNA, 20 nt, Human
agcaugccuggauggggcug

SEQ ID NO: 3304851 - RNA, 23 nt, Human
agccaagugugguagagugugcc

SEQ ID NO: 3304852 - RNA, 18 nt, Human
agcauccuggcacccggc

SEQ ID NO: 3304853 - RNA, 22 nt, Human
agcauccuggcacccggccccu

SEQ ID NO: 3304854 - RNA, 23 nt, Human
agcauccuggcacccggccccug

SEQ ID NO: 3304855 - RNA, 15 nt, Human
acauuuauucugcuc

SEQ ID NO: 3304856 - RNA, 17 nt, Human
accagccaguaaauggg

SEQ ID NO: 3304857 - RNA, 13 nt, Human
accagcagaaaug

SEQ ID NO: 3304858 - RNA, 19 nt, Human
accagagcugccaccugcc

SEQ ID NO: 3304859 - RNA, 14 nt, Human
acauuuauucugcu

SEQ ID NO: 3304860 - RNA, 19 nt, Human
acaggguuuugccauguug

SEQ ID NO: 3304861 - RNA, 19 nt, Human
acaggcaaugcuggcuguu

SEQ ID NO: 3304862 - RNA, 23 nt, Human
acaggcaaugcuggcuguuggcu

SEQ ID NO: 3304863 - RNA, 21 nt, Human
acauaaugcgugcauaccacu

SEQ ID NO: 3304864 - RNA, 22 nt, Human
acauaaugcgugcauaccacuu

SEQ ID NO: 3304865 - RNA, 23 nt, Human
acauaaugcgugcauaccacuuu

SEQ ID NO: 3304866 - RNA, 19 nt, Human
acaugaucuucuuuauaau

SEQ ID NO: 3304867 - RNA, 17 nt, Human
acaucagcacgauuucu

SEQ ID NO: 3304868 - RNA, 15 nt, Human
acaucagcacgauuu

SEQ ID NO: 3304869 - RNA, 18 nt, Human
acaucagcacgauuucug

SEQ ID NO: 3304870 - RNA, 16 nt, Human
acaugugcacaugcac

SEQ ID NO: 3304871 - RNA, 18 nt, Human
acaugugcacaugcacgu

SEQ ID NO: 3304872 - RNA, 13 nt, Human
acccaccucagcc

SEQ ID NO: 3304873 - RNA, 14 nt, Human
acccaccucagccu

SEQ ID NO: 3304874 - RNA, 15 nt, Human
acccaccucagccuc

SEQ ID NO: 3304875 - RNA, 18 nt, Human
acccaagggccuggccug

SEQ ID NO: 3304876 - RNA, 22 nt, Human
acccaagggccuggccugagcu

SEQ ID NO: 3304877 - RNA, 19 nt, Human
acccaagggccuggccuga

SEQ ID NO: 3304878 - RNA, 20 nt, Human
accauauuaccacagacaua

SEQ ID NO: 3304879 - RNA, 11 nt, Human
acccccugaau

SEQ ID NO: 3304880 - RNA, 16 nt, Human
acccaccucagccucc

SEQ ID NO: 3304881 - RNA, 16 nt, Human
accauauuaccacaga

SEQ ID NO: 3304882 - RNA, 14 nt, Human
accauauuaccaca

SEQ ID NO: 3304883 - RNA, 20 nt, Human
accccucaacaccucugcac

SEQ ID NO: 3304884 - RNA, 16 nt, Human
accccuccaugugggc

SEQ ID NO: 3304885 - RNA, 19 nt, Human
accccuccaugugggcuag

SEQ ID NO: 3304886 - RNA, 19 nt, Human
acagagugagacucugucu

SEQ ID NO: 3304887 - RNA, 23 nt, Human
acagagucucacuguugcccagg

SEQ ID NO: 3304888 - RNA, 15 nt, Human
acagagugagacucu

SEQ ID NO: 3304889 - RNA, 19 nt, Human
acagaggcagccccauucu

SEQ ID NO: 3304890 - RNA, 23 nt, Human
acagaggccaugggccuccugug

SEQ ID NO: 3304891 - RNA, 13 nt, Human
acagacacaggcc

SEQ ID NO: 3304892 - RNA, 14 nt, Human
acagacacaggccc

SEQ ID NO: 3304893 - RNA, 14 nt, Human
acagaggcagcccc

SEQ ID NO: 3304894 - RNA, 15 nt, Human
acagaggcagcccca

SEQ ID NO: 3304895 - RNA, 15 nt, Human
acacuguacugcaau

SEQ ID NO: 3304896 - RNA, 11 nt, Human
acagacacagg

SEQ ID NO: 3304897 - RNA, 15 nt, Human
acacugcauguuugu

SEQ ID NO: 3304898 - RNA, 14 nt, Human
acacugcauguuug

SEQ ID NO: 3304899 - RNA, 18 nt, Human
acagccacggccaggcca

SEQ ID NO: 3304900 - RNA, 16 nt, Human
acagccacggccaggc

SEQ ID NO: 3304901 - RNA, 17 nt, Human
acagccacggccaggcc

SEQ ID NO: 3304902 - RNA, 15 nt, Human
acagccacggccagg

SEQ ID NO: 3304903 - RNA, 17 nt, Human
acagcucuguccuggga

SEQ ID NO: 3304904 - RNA, 16 nt, Human
acagcucuucuccagg

SEQ ID NO: 3304905 - RNA, 17 nt, Human
acagcucuucuccaggc

SEQ ID NO: 3304906 - RNA, 15 nt, Human
acaggaucagucuga

SEQ ID NO: 3304907 - RNA, 18 nt, Human
acaggcaaugcuggcugu

SEQ ID NO: 3304908 - RNA, 12 nt, Human
acaggcaagcac

SEQ ID NO: 3304909 - RNA, 14 nt, Human
acaggauuauugga

SEQ ID NO: 3304910 - RNA, 19 nt, Human
acacauuuuuuaaaugcac

SEQ ID NO: 3304911 - RNA, 15 nt, Human
acacgcgugcacaca

SEQ ID NO: 3304912 - RNA, 17 nt, Human
acacgcgugcacacacc

SEQ ID NO: 3304913 - RNA, 20 nt, Human
acacagcucuguccugggag

SEQ ID NO: 3304914 - RNA, 14 nt, Human
acacagcucugucc

SEQ ID NO: 3304915 - RNA, 19 nt, Human
acacagaggcugccucucc

SEQ ID NO: 3304916 - RNA, 11 nt, Human
acacagcucuu

SEQ ID NO: 3304917 - RNA, 22 nt, Human
acacauuuuauuuuauuaugca

SEQ ID NO: 3304918 - RNA, 21 nt, Human
acacauuuuauuuuauuaugc

SEQ ID NO: 3304919 - RNA, 22 nt, Human
acacauuuuuuaaaugcaccug

SEQ ID NO: 3304920 - RNA, 20 nt, Human
acacauuuuuuaaaugcacc

SEQ ID NO: 3304921 - RNA, 16 nt, Human
aauuuugugcccccau

SEQ ID NO: 3304922 - RNA, 20 nt, Human
acaaggcaaggcugucaauu

SEQ ID NO: 3304923 - RNA, 22 nt, Human
acaaaauguaggguuauaauaa

SEQ ID NO: 3304924 - RNA, 20 nt, Human
acaaaauguaggguuauaau

SEQ ID NO: 3304925 - RNA, 17 nt, Human
acaaggauugcuacugu

SEQ ID NO: 3304926 - RNA, 14 nt, Human
acaaggcaaggcug

SEQ ID NO: 3304927 - RNA, 12 nt, Human
acaaggcaaggc

SEQ ID NO: 3304928 - RNA, 15 nt, Human
agaaaauaccaagga

SEQ ID NO: 3304929 - RNA, 19 nt, Human
agaaaauaguggugugauu

SEQ ID NO: 3304930 - RNA, 14 nt, Human
acuuuucuuugugg

SEQ ID NO: 3304931 - RNA, 16 nt, Human
acuuuucuuucagcca

SEQ ID NO: 3304932 - RNA, 20 nt, Human
acuuuucauaaccuagccuu

SEQ ID NO: 3304933 - RNA, 17 nt, Human
acuuuguucuggcucuu

SEQ ID NO: 3304934 - RNA, 16 nt, Human
acuuuguucuggcucu

SEQ ID NO: 3304935 - RNA, 19 nt, Human
acuuuguucuggcucuucc

SEQ ID NO: 3304936 - RNA, 14 nt, Human
acuuuguucuggcu

SEQ ID NO: 3304937 - RNA, 13 nt, Human
acuuuuauaaacu

SEQ ID NO: 3304938 - RNA, 22 nt, Human
agaaaguacuucuccacccugc

SEQ ID NO: 3304939 - RNA, 23 nt, Human
agaaaguacuucuccacccugcu

SEQ ID NO: 3304940 - RNA, 16 nt, Human
acuugguuuuuaaaaa

SEQ ID NO: 3304941 - RNA, 15 nt, Human
acuugggccacugug

SEQ ID NO: 3304942 - RNA, 14 nt, Human
acuugggccacugu

SEQ ID NO: 3304943 - RNA, 18 nt, Human
acuucuuauacauuugau

SEQ ID NO: 3304944 - RNA, 23 nt, Human
acuucacauauugauuuccguua

SEQ ID NO: 3304945 - RNA, 20 nt, Human
acugugcugagucugaaggc

SEQ ID NO: 3304946 - RNA, 16 nt, Human
acugugaagagaacca

SEQ ID NO: 3304947 - RNA, 18 nt, Human
acugguuccauggccucu

SEQ ID NO: 3304948 - RNA, 16 nt, Human
acuggaagcacagcuu

SEQ ID NO: 3304949 - RNA, 19 nt, Human
acuggaagcacagcuucau

SEQ ID NO: 3304950 - RNA, 17 nt, Human
acuggaagcacagcuuc

SEQ ID NO: 3304951 - RNA, 15 nt, Human
acuggagaaaaugga

SEQ ID NO: 3304952 - RNA, 14 nt, Human
acuggagaaaaugg

SEQ ID NO: 3304953 - RNA, 21 nt, Human
acucuaucaaguauuauaccu

SEQ ID NO: 3304954 - RNA, 23 nt, Human
acucuaucaaguauuauaccuuu

SEQ ID NO: 3304955 - RNA, 19 nt, Human
acucugucgcccagucugg

SEQ ID NO: 3304956 - RNA, 17 nt, Human
acucuagggaaaaacca

SEQ ID NO: 3304957 - RNA, 15 nt, Human
acucuagggaaaaac

SEQ ID NO: 3304958 - RNA, 13 nt, Human
acucaaaagcugg

SEQ ID NO: 3304959 - RNA, 19 nt, Human
acucaguccauagcagaga

SEQ ID NO: 3304960 - RNA, 16 nt, Human
accugucccccugaca

SEQ ID NO: 3304961 - RNA, 15 nt, Human
accugucccccugac

SEQ ID NO: 3304962 - RNA, 12 nt, Human
accugucccccu

SEQ ID NO: 3304963 - RNA, 18 nt, Human
accuuggcugcagggagu

SEQ ID NO: 3304964 - RNA, 14 nt, Human
accuuggcugcagg

SEQ ID NO: 3304965 - RNA, 17 nt, Human
accuuggcugcagggag

SEQ ID NO: 3304966 - RNA, 13 nt, Human
accuuucccaucu

SEQ ID NO: 3304967 - RNA, 18 nt, Human
accuuucccaucuuccaa

SEQ ID NO: 3304968 - RNA, 15 nt, Human
accuuuaagagaaau

SEQ ID NO: 3304969 - RNA, 23 nt, Human
accucugccugaagucacacagu

SEQ ID NO: 3304970 - RNA, 21 nt, Human
accucugcagcaauaaagcag

SEQ ID NO: 3304971 - RNA, 20 nt, Human
accucugcagcaauaaagca

SEQ ID NO: 3304972 - RNA, 18 nt, Human
accucugcagcaauaaag

SEQ ID NO: 3304973 - RNA, 15 nt, Human
accucugcagcaaua

SEQ ID NO: 3304974 - RNA, 11 nt, Human
acgugaguccu

SEQ ID NO: 3304975 - RNA, 11 nt, Human
acgcugugcug

SEQ ID NO: 3304976 - RNA, 14 nt, Human
acgcugugcugccc

SEQ ID NO: 3304977 - RNA, 12 nt, Human
acgcugugcugc

SEQ ID NO: 3304978 - RNA, 13 nt, Human
acgucugacaggc

SEQ ID NO: 3304979 - RNA, 14 nt, Human
acgucugacaggca

SEQ ID NO: 3304980 - RNA, 17 nt, Human
aaaauaaaacuuuuuaa

SEQ ID NO: 3304981 - RNA, 16 nt, Human
aaaauaaaacuuuuua

SEQ ID NO: 3304982 - RNA, 22 nt, Human
aaaaucccuuaccucggugccu

SEQ ID NO: 3304983 - RNA, 15 nt, Human
aaaaagaaaggaggg

SEQ ID NO: 3304984 - RNA, 16 nt, Human
aaacacuguucucugc

SEQ ID NO: 3304985 - RNA, 22 nt, Human
aaaaucucaaauuucuaaaucu

SEQ ID NO: 3304986 - RNA, 19 nt, Human
aaaaucucaaauuucuaaa

SEQ ID NO: 3304987 - RNA, 14 nt, Human
aaagaguaggaaga

SEQ ID NO: 3304988 - RNA, 16 nt, Human
aaagauauuuugcuuu

SEQ ID NO: 3304989 - RNA, 12 nt, Human
aaagauauuuug

SEQ ID NO: 3304990 - RNA, 17 nt, Human
aaagauauuuugcuuug

SEQ ID NO: 3304991 - RNA, 18 nt, Human
aaaccaucauugaaaucu

SEQ ID NO: 3304992 - RNA, 13 nt, Human
aaacucuccucug

SEQ ID NO: 3304993 - RNA, 18 nt, Human
aaacucuccucugcugcu

SEQ ID NO: 3304994 - RNA, 16 nt, Human
aaaggcuccaggagca

SEQ ID NO: 3304995 - RNA, 15 nt, Human
aaaggcuccaggagc

SEQ ID NO: 3304996 - RNA, 19 nt, Human
aaaggcuccaggagcagcc

SEQ ID NO: 3304997 - RNA, 14 nt, Human
aaagugcugggauu

SEQ ID NO: 3304998 - RNA, 13 nt, Human
aaaguggaaaaau

SEQ ID NO: 3304999 - RNA, 16 nt, Human
aaauaaaacuuuuuaa

SEQ ID NO: 3305000 - RNA, 13 nt, Human
aaauaaaacuuuu

SEQ ID NO: 3305001 - RNA, 19 nt, Human
aaauaaaacuuuuuaaaau

SEQ ID NO: 3305002 - RNA, 18 nt, Human
aaaucugcuuuuuaaaga

SEQ ID NO: 3305003 - RNA, 19 nt, Human
aaauaguggugugauuugg

SEQ ID NO: 3305004 - RNA, 24 nt, Human
aaauagcucaggugucccugcacu

SEQ ID NO: 3305005 - RNA, 19 nt, Human
aacuuaaauaaugugaaac

SEQ ID NO: 3305006 - RNA, 14 nt, Human
aacugauaaagaug

SEQ ID NO: 3305007 - RNA, 18 nt, Human
aacuuaaucuaaauggaa

SEQ ID NO: 3305008 - RNA, 16 nt, Human
aacuuaaucuaaaugg

SEQ ID NO: 3305009 - RNA, 15 nt, Human
aacuuaaucuaaaug

SEQ ID NO: 3305010 - RNA, 21 nt, Human
aaauucuugcaaaguaucccu

SEQ ID NO: 3305011 - RNA, 18 nt, Human
aaauucuugcaaaguauc

SEQ ID NO: 3305012 - RNA, 23 nt, Human
aaaugccuuacccucauguucuu

SEQ ID NO: 3305013 - RNA, 15 nt, Human
aaccacuucagcuga

SEQ ID NO: 3305014 - RNA, 13 nt, Human
aaccacgcuggac

SEQ ID NO: 3305015 - RNA, 23 nt, Human
aaugcucuuuacuucauggacuu

SEQ ID NO: 3305016 - RNA, 15 nt, Human
aauguuugccucugc

SEQ ID NO: 3305017 - RNA, 15 nt, Human
aaugugaaaagaaaa

SEQ ID NO: 3305018 - RNA, 19 nt, Human
aaugcgugcauaccacuuu

SEQ ID NO: 3305019 - RNA, 18 nt, Human
aaugcgugcauaccacuu

SEQ ID NO: 3305020 - RNA, 23 nt, Human
aaugccuuacccucauguucuua

SEQ ID NO: 3305021 - RNA, 13 nt, Human
aauagacaauuua

SEQ ID NO: 3305022 - RNA, 14 nt, Human
aaucaccgaaaacg

SEQ ID NO: 3305023 - RNA, 22 nt, Human
aauacucuacccucuuagaaaa

SEQ ID NO: 3305024 - RNA, 20 nt, Human
aauacucuacccucuuagaa

SEQ ID NO: 3305025 - RNA, 16 nt, Human
aaugauuaauuaaaac

SEQ ID NO: 3305026 - RNA, 18 nt, Human
aaucucaaauuucuaaau

SEQ ID NO: 3305027 - RNA, 17 nt, Human
aaucucaaauuucuaaa

SEQ ID NO: 3305028 - RNA, 19 nt, Human
aauccagacccggcugcgu

SEQ ID NO: 3305029 - RNA, 17 nt, Human
aauccagacccggcugc

SEQ ID NO: 3305030 - RNA, 15 nt, Human
aaucucaaauuucua

SEQ ID NO: 3305031 - RNA, 16 nt, Human
aaucucaaauuucuaa

SEQ ID NO: 3305032 - RNA, 21 nt, Human
aaguagaagucuuagauguau

SEQ ID NO: 3305033 - RNA, 23 nt, Human
aaguaucccuacuguaauuugug

SEQ ID NO: 3305034 - RNA, 18 nt, Human
aaguaucccuacuguaau

SEQ ID NO: 3305035 - RNA, 17 nt, Human
aaguaucccuacuguaa

SEQ ID NO: 3305036 - RNA, 19 nt, Human
aaguagaagucuuagaugu

SEQ ID NO: 3305037 - RNA, 20 nt, Human
aaguagaagucuuagaugua

SEQ ID NO: 3305038 - RNA, 18 nt, Human
aaguccucuuuucugaga

SEQ ID NO: 3305039 - RNA, 22 nt, Human
aaguccucuuuucugagaggac

SEQ ID NO: 3305040 - RNA, 19 nt, Human
aaggucauuuuuuuuaaga

SEQ ID NO: 3305041 - RNA, 18 nt, Human
aaggucauuuuuuuuaag

SEQ ID NO: 3305042 - RNA, 21 nt, Human
aaguggaaaaauagccugccu

SEQ ID NO: 3305043 - RNA, 19 nt, Human
aaguggaaaaauagccugc

SEQ ID NO: 3305044 - RNA, 15 nt, Human
aaggauguucuagca

SEQ ID NO: 3305045 - RNA, 15 nt, Human
aaggauugcuacugu

SEQ ID NO: 3305046 - RNA, 13 nt, Human
aaggacacuagaa

SEQ ID NO: 3305047 - RNA, 15 nt, Human
aagcugggcagguug

SEQ ID NO: 3305048 - RNA, 18 nt, Human
aagcuggucccacucagu

SEQ ID NO: 3305049 - RNA, 21 nt, Human
aagcuggucccacucagucca

SEQ ID NO: 3305050 - RNA, 21 nt, Human
aagcgauucuucugcuucagc

SEQ ID NO: 3305051 - RNA, 17 nt, Human
aagcgauucuucugcuu

SEQ ID NO: 3305052 - RNA, 14 nt, Human
aagcagcguuucua

SEQ ID NO: 3305053 - RNA, 20 nt, Human
aagcagcguuucuaugacac

SEQ ID NO: 3305054 - RNA, 17 nt, Human
aagcagcguuucuauga

SEQ ID NO: 3305055 - RNA, 19 nt, Human
aagccagcaggcucucagg

SEQ ID NO: 3305056 - RNA, 22 nt, Human
aagcagcguuucuaugacacau

SEQ ID NO: 3305057 - RNA, 21 nt, Human
aagcagcguuucuaugacaca

SEQ ID NO: 3305058 - RNA, 23 nt, Human
aagccagcaggcucucaggccag

SEQ ID NO: 3305059 - RNA, 20 nt, Human
aagccagcaggcucucaggc

SEQ ID NO: 3305060 - RNA, 12 nt, Human
aagauaaaugug

SEQ ID NO: 3305061 - RNA, 13 nt, Human
aagauaaaugugc

SEQ ID NO: 3305062 - RNA, 23 nt, Human
aagauacaguuacucagaauucu

SEQ ID NO: 3305063 - RNA, 18 nt, Human
caaugcaaaccaucauug

SEQ ID NO: 3305064 - RNA, 17 nt, Human
caaugcaaaccaucauu

SEQ ID NO: 3305065 - RNA, 14 nt, Human
caaugcaaaccauc

SEQ ID NO: 3305066 - RNA, 23 nt, Human
caaugcacuuuguucuggcucuu

SEQ ID NO: 3305067 - RNA, 22 nt, Human
caaugcacuuuguucuggcucu

SEQ ID NO: 3305068 - RNA, 19 nt, Human
caaugcaaaccaucauuga

SEQ ID NO: 3305069 - RNA, 21 nt, Human
caauaggaaaaacugauuuuu

SEQ ID NO: 3305070 - RNA, 18 nt, Human
caauaggaaaaacugauu

SEQ ID NO: 3305071 - RNA, 20 nt, Human
caauaggaaaaacugauuuu

SEQ ID NO: 3305072 - RNA, 16 nt, Human
cacaaaaguuucucuu

SEQ ID NO: 3305073 - RNA, 18 nt, Human
cacaaaaguuucucuuuu

SEQ ID NO: 3305074 - RNA, 14 nt, Human
cacacaccagagcc

SEQ ID NO: 3305075 - RNA, 19 nt, Human
cacacagaggcugccucuc

SEQ ID NO: 3305076 - RNA, 12 nt, Human
cacacagcucug

SEQ ID NO: 3305077 - RNA, 15 nt, Human
cacaccagagcccac

SEQ ID NO: 3305078 - RNA, 12 nt, Human
cacaccagagcc

SEQ ID NO: 3305079 - RNA, 13 nt, Human
cacaccagagccc

SEQ ID NO: 3305080 - RNA, 21 nt, Human
cacagagaaaguacuucucca

SEQ ID NO: 3305081 - RNA, 17 nt, Human
cacagaguuguuacauu

SEQ ID NO: 3305082 - RNA, 16 nt, Human
cacagaguuguuacau

SEQ ID NO: 3305083 - RNA, 22 nt, Human
cacagacccugcccugugggcc

SEQ ID NO: 3305084 - RNA, 21 nt, Human
cacacuugacaucaacugcau

SEQ ID NO: 3305085 - RNA, 17 nt, Human
cacauacacacacacgc

SEQ ID NO: 3305086 - RNA, 19 nt, Human
cacagugagucgaggacag

SEQ ID NO: 3305087 - RNA, 20 nt, Human
cacagugagucgaggacagg

SEQ ID NO: 3305088 - RNA, 18 nt, Human
cacagugagucgaggaca

SEQ ID NO: 3305089 - RNA, 20 nt, Human
cacaggcccggcuccaggcu

SEQ ID NO: 3305090 - RNA, 23 nt, Human
cacaggcccggcuccaggcuccu

SEQ ID NO: 3305091 - RNA, 12 nt, Human
cacaggaucagu

SEQ ID NO: 3305092 - RNA, 15 nt, Human
cacaggaucagucug

SEQ ID NO: 3305093 - RNA, 16 nt, Human
cacaggaucagucuga

SEQ ID NO: 3305094 - RNA, 16 nt, Human
cacaggcccggcucca

SEQ ID NO: 3305095 - RNA, 17 nt, Human
cacaggcccggcuccag

SEQ ID NO: 3305096 - RNA, 18 nt, Human
cacaggcccggcuccagg

SEQ ID NO: 3305097 - RNA, 19 nt, Human
cacaggcccggcuccaggc

SEQ ID NO: 3305098 - RNA, 10 nt, Human
cacaggcagg

SEQ ID NO: 3305099 - RNA, 20 nt, Human
cacagaguuguuacauuuuu

SEQ ID NO: 3305100 - RNA, 18 nt, Human
cacagaugggugcuugga

SEQ ID NO: 3305101 - RNA, 14 nt, Human
cacagaugggugcu

SEQ ID NO: 3305102 - RNA, 20 nt, Human
cacagaugggugcuuggagg

SEQ ID NO: 3305103 - RNA, 19 nt, Human
caccacaugugcacaugca

SEQ ID NO: 3305104 - RNA, 15 nt, Human
caccacaugugcaca

SEQ ID NO: 3305105 - RNA, 18 nt, Human
caccacaugugcacaugc

SEQ ID NO: 3305106 - RNA, 16 nt, Human
caccacuacauucugu

SEQ ID NO: 3305107 - RNA, 18 nt, Human
caccacuacauucuguua

SEQ ID NO: 3305108 - RNA, 17 nt, Human
caccacuacauucuguu

SEQ ID NO: 3305109 - RNA, 20 nt, Human
caccacuacauucuguuaau

SEQ ID NO: 3305110 - RNA, 19 nt, Human
caccacuacauucuguuaa

SEQ ID NO: 3305111 - RNA, 15 nt, Human
caccaagcccaguua

SEQ ID NO: 3305112 - RNA, 13 nt, Human
caccacacccagc

SEQ ID NO: 3305113 - RNA, 15 nt, Human
caccacacccagccc

SEQ ID NO: 3305114 - RNA, 16 nt, Human
cacauuccugaugcuu

SEQ ID NO: 3305115 - RNA, 17 nt, Human
cacaugugcacaugcac

SEQ ID NO: 3305116 - RNA, 14 nt, Human
cacaugugcacaug

SEQ ID NO: 3305117 - RNA, 15 nt, Human
cacaugugcacaugc

SEQ ID NO: 3305118 - RNA, 12 nt, Human
cacauaucuguc

SEQ ID NO: 3305119 - RNA, 20 nt, Human
cacauauugauuuccguuaa

SEQ ID NO: 3305120 - RNA, 18 nt, Human
cacaucagcacgauuucu

SEQ ID NO: 3305121 - RNA, 18 nt, Human
cacaugccucucucaggc

SEQ ID NO: 3305122 - RNA, 17 nt, Human
cacaugccucucucagg

SEQ ID NO: 3305123 - RNA, 13 nt, Human
cacaugccucucu

SEQ ID NO: 3305124 - RNA, 19 nt, Human
cacaugccucucucaggcc

SEQ ID NO: 3305125 - RNA, 23 nt, Human
cacauguccaagaagcccaggaa

SEQ ID NO: 3305126 - RNA, 23 nt, Human
caacaggcugggcuucaguggca

SEQ ID NO: 3305127 - RNA, 24 nt, Human
caacaggcugggcuucaguggcag

SEQ ID NO: 3305128 - RNA, 22 nt, Human
caacaucuuggucagauuugaa

SEQ ID NO: 3305129 - RNA, 15 nt, Human
caacagguuuuccug

SEQ ID NO: 3305130 - RNA, 18 nt, Human
caacaggguuuuuuucca

SEQ ID NO: 3305131 - RNA, 19 nt, Human
caacagguuuuccugaaga

SEQ ID NO: 3305132 - RNA, 21 nt, Human
caaccccuucgcuccuguguc

SEQ ID NO: 3305133 - RNA, 18 nt, Human
caaccccuucgcuccugu

SEQ ID NO: 3305134 - RNA, 19 nt, Human
caaccccuucgcuccugug

SEQ ID NO: 3305135 - RNA, 16 nt, Human
caacugcauuggcuuu

SEQ ID NO: 3305136 - RNA, 20 nt, Human
caacucuccuccagagucag

SEQ ID NO: 3305137 - RNA, 19 nt, Human
caacucuccuccagaguca

SEQ ID NO: 3305138 - RNA, 15 nt, Human
caacccucaucacca

SEQ ID NO: 3305139 - RNA, 12 nt, Human
caacccucauca

SEQ ID NO: 3305140 - RNA, 17 nt, Human
caaccccuucgcuccug

SEQ ID NO: 3305141 - RNA, 18 nt, Human
caagcaccuccugccucg

SEQ ID NO: 3305142 - RNA, 16 nt, Human
caagcgugagccacug

SEQ ID NO: 3305143 - RNA, 21 nt, Human
caagccaccaacauacuccca

SEQ ID NO: 3305144 - RNA, 17 nt, Human
caagcgugagccacugc

SEQ ID NO: 3305145 - RNA, 22 nt, Human
caaggauccugagccagauuuc

SEQ ID NO: 3305146 - RNA, 21 nt, Human
caaggaugaucuaggaagacu

SEQ ID NO: 3305147 - RNA, 15 nt, Human
caaggauugcuacug

SEQ ID NO: 3305148 - RNA, 16 nt, Human
caagggccuggccuga

SEQ ID NO: 3305149 - RNA, 19 nt, Human
caagggccuggccugagcu

SEQ ID NO: 3305150 - RNA, 12 nt, Human
caaggugggagg

SEQ ID NO: 3305151 - RNA, 23 nt, Human
caaggugggaggauugcuugagc

SEQ ID NO: 3305152 - RNA, 22 nt, Human
caagugugguagagugugccug

SEQ ID NO: 3305153 - RNA, 22 nt, Human
caagugauucuccugccucagc

SEQ ID NO: 3305154 - RNA, 21 nt, Human
caagugauucuccugccucag

SEQ ID NO: 3305155 - RNA, 16 nt, Human
caagugauucuccugc

SEQ ID NO: 3305156 - RNA, 17 nt, Human
caagugauucuccugcc

SEQ ID NO: 3305157 - RNA, 22 nt, Human
caaauucugcuugcuugcuuuu

SEQ ID NO: 3305158 - RNA, 16 nt, Human
caaaucagcugcuacu

SEQ ID NO: 3305159 - RNA, 13 nt, Human
caaaucagcugcu

SEQ ID NO: 3305160 - RNA, 21 nt, Human
caaaggaugcccaaagaugca

SEQ ID NO: 3305161 - RNA, 18 nt, Human
auuuuuuuacuaauagac

SEQ ID NO: 3305162 - RNA, 16 nt, Human
caaagcuuguuaagau

SEQ ID NO: 3305163 - RNA, 16 nt, Human
caaagcuaggccuggc

SEQ ID NO: 3305164 - RNA, 17 nt, Human
caaagcuaggccuggcc

SEQ ID NO: 3305165 - RNA, 20 nt, Human
caaagccaaagcuaggccug

SEQ ID NO: 3305166 - RNA, 21 nt, Human
caaagccaaagcuaggccugg

SEQ ID NO: 3305167 - RNA, 15 nt, Human
caaagcuaggccugg

SEQ ID NO: 3305168 - RNA, 22 nt, Human
cacccccacccaagggccuggc

SEQ ID NO: 3305169 - RNA, 17 nt, Human
caccccggccaccugcg

SEQ ID NO: 3305170 - RNA, 16 nt, Human
caccccggccaccugc

SEQ ID NO: 3305171 - RNA, 15 nt, Human
caccccggccaccug

SEQ ID NO: 3305172 - RNA, 14 nt, Human
caccccggccaccu

SEQ ID NO: 3305173 - RNA, 13 nt, Human
caccccagcccca

SEQ ID NO: 3305174 - RNA, 12 nt, Human
caccccagcccc

SEQ ID NO: 3305175 - RNA, 12 nt, Human
cacccaccucag

SEQ ID NO: 3305176 - RNA, 13 nt, Human
cacccaccucagc

SEQ ID NO: 3305177 - RNA, 14 nt, Human
cacccaccucagcc

SEQ ID NO: 3305178 - RNA, 16 nt, Human
cacccaccucagccuc

SEQ ID NO: 3305179 - RNA, 20 nt, Human
cacccaccaucaugucuggc

SEQ ID NO: 3305180 - RNA, 22 nt, Human
cacccaccaucaugucuggcua

SEQ ID NO: 3305181 - RNA, 23 nt, Human
cacccaagggccuggccugagcu

SEQ ID NO: 3305182 - RNA, 21 nt, Human
cacccaagggccuggccugag

SEQ ID NO: 3305183 - RNA, 20 nt, Human
cacccaagggccuggccuga

SEQ ID NO: 3305184 - RNA, 19 nt, Human
cacccaagggccuggccug

SEQ ID NO: 3305185 - RNA, 18 nt, Human
cacccaagggccuggccu

SEQ ID NO: 3305186 - RNA, 17 nt, Human
cacccaagggccuggcc

SEQ ID NO: 3305187 - RNA, 16 nt, Human
cacccaagggccuggc

SEQ ID NO: 3305188 - RNA, 16 nt, Human
cuaaauucaugcugcu

SEQ ID NO: 3305189 - RNA, 12 nt, Human
cuaaccacgcug

SEQ ID NO: 3305190 - RNA, 23 nt, Human
cuaagagggagggagggcuccag

SEQ ID NO: 3305191 - RNA, 13 nt, Human
cuaagagggaggg

SEQ ID NO: 3305192 - RNA, 22 nt, Human
cuaagagggagggagggcucca

SEQ ID NO: 3305193 - RNA, 15 nt, Human
cuaagagggagggag

SEQ ID NO: 3305194 - RNA, 23 nt, Human
cgggaggauguucugggacacag

SEQ ID NO: 3305195 - RNA, 21 nt, Human
cgggaggauguucugggacac

SEQ ID NO: 3305196 - RNA, 22 nt, Human
cuaaaugaaaaucgugacaaca

SEQ ID NO: 3305197 - RNA, 20 nt, Human
cuaaaucuccaaaauaaaac

SEQ ID NO: 3305198 - RNA, 21 nt, Human
cuaaaucuccaaaauaaaacu

SEQ ID NO: 3305199 - RNA, 22 nt, Human
cuaagcuauucaguaauaacuc

SEQ ID NO: 3305200 - RNA, 17 nt, Human
cuaauagacaauuuauu

SEQ ID NO: 3305201 - RNA, 23 nt, Human
cuaauagacaauuuauuauggca

SEQ ID NO: 3305202 - RNA, 19 nt, Human
cuaauagacaauuuauuau

SEQ ID NO: 3305203 - RNA, 21 nt, Human
cuacacacugcauguuuguga

SEQ ID NO: 3305204 - RNA, 21 nt, Human
cuacacaggggaaaagaggag

SEQ ID NO: 3305205 - RNA, 12 nt, Human
cuaaugggacac

SEQ ID NO: 3305206 - RNA, 13 nt, Human
cuaaugggacacu

SEQ ID NO: 3305207 - RNA, 16 nt, Human
cuacaggugugaguca

SEQ ID NO: 3305208 - RNA, 14 nt, Human
cuacaggugugagu

SEQ ID NO: 3305209 - RNA, 18 nt, Human
cuacauggaguauauguc

SEQ ID NO: 3305210 - RNA, 20 nt, Human
cuacauggaguauaugucaa

SEQ ID NO: 3305211 - RNA, 15 nt, Human
cuacaggcacccacc

SEQ ID NO: 3305212 - RNA, 17 nt, Human
cuacaggcacccaccau

SEQ ID NO: 3305213 - RNA, 14 nt, Human
cuacaggagugagc

SEQ ID NO: 3305214 - RNA, 15 nt, Human
cuacaggagugagca

SEQ ID NO: 3305215 - RNA, 16 nt, Human
cuacaggagugagcac

SEQ ID NO: 3305216 - RNA, 23 nt, Human
cuacagcuugaccgugaggccag

SEQ ID NO: 3305217 - RNA, 22 nt, Human
cuacagcuugaccgugaggcca

SEQ ID NO: 3305218 - RNA, 19 nt, Human
cuacagcuugaccgugagg

SEQ ID NO: 3305219 - RNA, 22 nt, Human
cuacagaggccaugggccuccu

SEQ ID NO: 3305220 - RNA, 18 nt, Human
cuacagaggccaugggcc

SEQ ID NO: 3305221 - RNA, 20 nt, Human
cuacagaggccaugggccuc

SEQ ID NO: 3305222 - RNA, 17 nt, Human
cuacagaggccaugggc

SEQ ID NO: 3305223 - RNA, 17 nt, Human
cuacacugugcugaguc

SEQ ID NO: 3305224 - RNA, 14 nt, Human
cuacacugugcuga

SEQ ID NO: 3305225 - RNA, 13 nt, Human
cuacacugugcug

SEQ ID NO: 3305226 - RNA, 17 nt, Human
cuacccucuuagaaaaa

SEQ ID NO: 3305227 - RNA, 18 nt, Human
cuacccagcgagcccugg

SEQ ID NO: 3305228 - RNA, 13 nt, Human
cuacccaggugcu

SEQ ID NO: 3305229 - RNA, 12 nt, Human
cuacccaggugc

SEQ ID NO: 3305230 - RNA, 15 nt, Human
cuacccagcgagccc

SEQ ID NO: 3305231 - RNA, 17 nt, Human
cuacccagcgagcccug

SEQ ID NO: 3305232 - RNA, 18 nt, Human
cuaccauccccuguagag

SEQ ID NO: 3305233 - RNA, 14 nt, Human
cuacauucuguuaa

SEQ ID NO: 3305234 - RNA, 13 nt, Human
cuacauucuguua

SEQ ID NO: 3305235 - RNA, 22 nt, Human
cuacauuauaaaugucucuuua

SEQ ID NO: 3305236 - RNA, 17 nt, Human
cuauucaguaauaacuc

SEQ ID NO: 3305237 - RNA, 13 nt, Human
cuauguaucaaug

SEQ ID NO: 3305238 - RNA, 23 nt, Human
cuauucaguaauaacucuacccu

SEQ ID NO: 3305239 - RNA, 21 nt, Human
cuaugcauuugaaaauuuuga

SEQ ID NO: 3305240 - RNA, 17 nt, Human
cuaggaagacuuuggaa

SEQ ID NO: 3305241 - RNA, 15 nt, Human
cuaggaagacuuugg

SEQ ID NO: 3305242 - RNA, 20 nt, Human
cuaggaacacuccuucacag

SEQ ID NO: 3305243 - RNA, 19 nt, Human
cuauagccuaggugacaga

SEQ ID NO: 3305244 - RNA, 18 nt, Human
cuauagccuaggugacag

SEQ ID NO: 3305245 - RNA, 20 nt, Human
cuauagccuaggugacagag

SEQ ID NO: 3305246 - RNA, 21 nt, Human
cuauagccuaggugacagagu

SEQ ID NO: 3305247 - RNA, 16 nt, Human
cuauugcugcuugagg

SEQ ID NO: 3305248 - RNA, 18 nt, Human
cuauuguuagucucuuga

SEQ ID NO: 3305249 - RNA, 14 nt, Human
cucaacucuccucc

SEQ ID NO: 3305250 - RNA, 13 nt, Human
cucaaauuucuaa

SEQ ID NO: 3305251 - RNA, 17 nt, Human
cucaaauuucuaaaucu

SEQ ID NO: 3305252 - RNA, 15 nt, Human
cucaaauuucuaaau

SEQ ID NO: 3305253 - RNA, 14 nt, Human
cucaaauuucuaaa

SEQ ID NO: 3305254 - RNA, 18 nt, Human
cucaacucuccuccagag

SEQ ID NO: 3305255 - RNA, 16 nt, Human
cucaacucuccuccag

SEQ ID NO: 3305256 - RNA, 23 nt, Human
cucacacggacacucaaaagcug

SEQ ID NO: 3305257 - RNA, 14 nt, Human
cuacugaggugcua

SEQ ID NO: 3305258 - RNA, 12 nt, Human
cuacucuguguc

SEQ ID NO: 3305259 - RNA, 19 nt, Human
cuacuguccuacccacccu

SEQ ID NO: 3305260 - RNA, 21 nt, Human
cuacuguaauuugugauacaa

SEQ ID NO: 3305261 - RNA, 15 nt, Human
cuacucgaguuacag

SEQ ID NO: 3305262 - RNA, 19 nt, Human
cuacucgaguuacagacaa

SEQ ID NO: 3305263 - RNA, 16 nt, Human
cuacucgaguuacaga

SEQ ID NO: 3305264 - RNA, 21 nt, Human
cuagagugaacuugggccacu

SEQ ID NO: 3305265 - RNA, 15 nt, Human
cuagagguucaaaga

SEQ ID NO: 3305266 - RNA, 17 nt, Human
cuagagguucaaagaua

SEQ ID NO: 3305267 - RNA, 21 nt, Human
cuagagguucaaagauauuuu

SEQ ID NO: 3305268 - RNA, 18 nt, Human
cuagagguucaaagauau

SEQ ID NO: 3305269 - RNA, 20 nt, Human
cuacuguccuacccacccuc

SEQ ID NO: 3305270 - RNA, 22 nt, Human
cuagccuuagaagucacacagu

SEQ ID NO: 3305271 - RNA, 23 nt, Human
cuagccuuagaagucacacagua

SEQ ID NO: 3305272 - RNA, 21 nt, Human
cuagccuuagaagucacacag

SEQ ID NO: 3305273 - RNA, 22 nt, Human
cuagccugugccucugggacug

SEQ ID NO: 3305274 - RNA, 21 nt, Human
cuagccugugccucugggacu

SEQ ID NO: 3305275 - RNA, 19 nt, Human
cuagccugugccucuggga

SEQ ID NO: 3305276 - RNA, 16 nt, Human
cuagauacuguaucau

SEQ ID NO: 3305277 - RNA, 13 nt, Human
cuagauacuguau

SEQ ID NO: 3305278 - RNA, 24 nt, Human
cuagauacuguaucaugacaaaga

SEQ ID NO: 3305279 - RNA, 14 nt, Human
cuccagcucaccag

SEQ ID NO: 3305280 - RNA, 15 nt, Human
cuccagcucaccagc

SEQ ID NO: 3305281 - RNA, 16 nt, Human
cuccagcucaccagcc

SEQ ID NO: 3305282 - RNA, 18 nt, Human
cuccagcucaccagcccc

SEQ ID NO: 3305283 - RNA, 11 nt, Human
cuccagccccu

SEQ ID NO: 3305284 - RNA, 14 nt, Human
cuccagccccugga

SEQ ID NO: 3305285 - RNA, 13 nt, Human
cuccagccccugg

SEQ ID NO: 3305286 - RNA, 16 nt, Human
cuccagagucagaagu

SEQ ID NO: 3305287 - RNA, 18 nt, Human
cucauuugucacacacuu

SEQ ID NO: 3305288 - RNA, 21 nt, Human
cucauuugucacacacuuugg

SEQ ID NO: 3305289 - RNA, 17 nt, Human
cuccaagcucccaggca

SEQ ID NO: 3305290 - RNA, 18 nt, Human
cuccaaaauaaaacuuuu

SEQ ID NO: 3305291 - RNA, 21 nt, Human
cucauugaccugaggcccuuc

SEQ ID NO: 3305292 - RNA, 19 nt, Human
cucauugaccugaggcccu

SEQ ID NO: 3305293 - RNA, 17 nt, Human
cucauugaccugaggcc

SEQ ID NO: 3305294 - RNA, 22 nt, Human
cucauucuccuuguguuacuaa

SEQ ID NO: 3305295 - RNA, 18 nt, Human
cucauucuccuuguguua

SEQ ID NO: 3305296 - RNA, 23 nt, Human
cuccccugcuggguguggcgcag

SEQ ID NO: 3305297 - RNA, 21 nt, Human
cuccccugcuggguguggcgc

SEQ ID NO: 3305298 - RNA, 14 nt, Human
cuccccugcugggu

SEQ ID NO: 3305299 - RNA, 20 nt, Human
cucccgaauagcugggacua

SEQ ID NO: 3305300 - RNA, 23 nt, Human
cucccgaauagcugggacuacag

SEQ ID NO: 3305301 - RNA, 19 nt, Human
cucccgaauagcugggacu

SEQ ID NO: 3305302 - RNA, 15 nt, Human
cucccuucauccuuc

SEQ ID NO: 3305303 - RNA, 14 nt, Human
cucccaucacccgc

SEQ ID NO: 3305304 - RNA, 16 nt, Human
cucccaucacuucccu

SEQ ID NO: 3305305 - RNA, 15 nt, Human
cucccacaaaggaga

SEQ ID NO: 3305306 - RNA, 15 nt, Human
cucccaacucacccc

SEQ ID NO: 3305307 - RNA, 14 nt, Human
cucccaacucaccc

SEQ ID NO: 3305308 - RNA, 16 nt, Human
cucccaaagugcuggg

SEQ ID NO: 3305309 - RNA, 23 nt, Human
cucccaaagugcugggauuacag

SEQ ID NO: 3305310 - RNA, 18 nt, Human
cucagggucccugguggc

SEQ ID NO: 3305311 - RNA, 24 nt, Human
cucagggucccugguggcagcuca

SEQ ID NO: 3305312 - RNA, 22 nt, Human
cucagggucccugguggcagcu

SEQ ID NO: 3305313 - RNA, 21 nt, Human
cucagggucccugguggcagc

SEQ ID NO: 3305314 - RNA, 20 nt, Human
cucagggucccugguggcag

SEQ ID NO: 3305315 - RNA, 21 nt, Human
cucagguggggucacucuggc

SEQ ID NO: 3305316 - RNA, 20 nt, Human
cucagguggggucacucugg

SEQ ID NO: 3305317 - RNA, 19 nt, Human
cucagguggggucacucug

SEQ ID NO: 3305318 - RNA, 22 nt, Human
cucaggugauccacccaccuca

SEQ ID NO: 3305319 - RNA, 23 nt, Human
cucaggugauccacccaccucag

SEQ ID NO: 3305320 - RNA, 20 nt, Human
cucagggccuggcucaggug

SEQ ID NO: 3305321 - RNA, 19 nt, Human
cucagggccuggcucaggu

SEQ ID NO: 3305322 - RNA, 18 nt, Human
cucagggccuggcucagg

SEQ ID NO: 3305323 - RNA, 15 nt, Human
cucaggcagguggga

SEQ ID NO: 3305324 - RNA, 18 nt, Human
cucaggcaggugggaugg

SEQ ID NO: 3305325 - RNA, 16 nt, Human
cucagaucuucugugg

SEQ ID NO: 3305326 - RNA, 18 nt, Human
cucagagagggugggagu

SEQ ID NO: 3305327 - RNA, 19 nt, Human
cucagagagggugggagug

SEQ ID NO: 3305328 - RNA, 23 nt, Human
cucagagagggugggagugggcc

SEQ ID NO: 3305329 - RNA, 16 nt, Human
cucacuguugcccagg

SEQ ID NO: 3305330 - RNA, 17 nt, Human
cucacuguugcccaggc

SEQ ID NO: 3305331 - RNA, 18 nt, Human
cucacuguugcccaggcu

SEQ ID NO: 3305332 - RNA, 14 nt, Human
cucacuguugccca

SEQ ID NO: 3305333 - RNA, 15 nt, Human
cucacuguugcccag

SEQ ID NO: 3305334 - RNA, 15 nt, Human
cucacugcagccuca

SEQ ID NO: 3305335 - RNA, 16 nt, Human
cucacugcagccucaa

SEQ ID NO: 3305336 - RNA, 14 nt, Human
cucacugcagccuc

SEQ ID NO: 3305337 - RNA, 13 nt, Human
cucagcauccugg

SEQ ID NO: 3305338 - RNA, 21 nt, Human
cucagcauccuggcacccggc

SEQ ID NO: 3305339 - RNA, 22 nt, Human
cucagcauccuggcacccggcc

SEQ ID NO: 3305340 - RNA, 20 nt, Human
cucagcaaaagaugcuucuc

SEQ ID NO: 3305341 - RNA, 19 nt, Human
cucagcaaaagaugcuucu

SEQ ID NO: 3305342 - RNA, 16 nt, Human
cucagcaggggagggu

SEQ ID NO: 3305343 - RNA, 13 nt, Human
cucagcggggaca

SEQ ID NO: 3305344 - RNA, 23 nt, Human
cucagcggggacagcuccuucug

SEQ ID NO: 3305345 - RNA, 14 nt, Human
cucagcggggacag

SEQ ID NO: 3305346 - RNA, 15 nt, Human
cucagcggggacagc

SEQ ID NO: 3305347 - RNA, 16 nt, Human
cucagcggggacagcu

SEQ ID NO: 3305348 - RNA, 18 nt, Human
cucagcggggacagcucc

SEQ ID NO: 3305349 - RNA, 19 nt, Human
cucagcggggacagcuccu

SEQ ID NO: 3305350 - RNA, 20 nt, Human
cucagcggggacagcuccuu

SEQ ID NO: 3305351 - RNA, 21 nt, Human
cucagcggggacagcuccuuc

SEQ ID NO: 3305352 - RNA, 14 nt, Human
ccugcccggcugcg

SEQ ID NO: 3305353 - RNA, 16 nt, Human
ccugcccggcugcgga

SEQ ID NO: 3305354 - RNA, 22 nt, Human
ccugccagggacagagggggug

SEQ ID NO: 3305355 - RNA, 12 nt, Human
ccugccaggcau

SEQ ID NO: 3305356 - RNA, 22 nt, Human
ccugcccuuaccugccaggaag

SEQ ID NO: 3305357 - RNA, 21 nt, Human
ccugcccuuaccugccaggaa

SEQ ID NO: 3305358 - RNA, 19 nt, Human
ccugcccuuaccugccagg

SEQ ID NO: 3305359 - RNA, 15 nt, Human
ccugcccugugggcc

SEQ ID NO: 3305360 - RNA, 13 nt, Human
ccugccucagccu

SEQ ID NO: 3305361 - RNA, 12 nt, Human
ccugccucagcc

SEQ ID NO: 3305362 - RNA, 11 nt, Human
ccugccucagc

SEQ ID NO: 3305363 - RNA, 14 nt, Human
ccugccuguugggc

SEQ ID NO: 3305364 - RNA, 11 nt, Human
ccugcccugug

SEQ ID NO: 3305365 - RNA, 14 nt, Human
ccugcccugugggc

SEQ ID NO: 3305366 - RNA, 12 nt, Human
ccugcccugugg

SEQ ID NO: 3305367 - RNA, 22 nt, Human
ccugccuguugggccaggagcc

SEQ ID NO: 3305368 - RNA, 18 nt, Human
ccugaaagcccugagcuu

SEQ ID NO: 3305369 - RNA, 21 nt, Human
ccugaagacucauucuucugu

SEQ ID NO: 3305370 - RNA, 14 nt, Human
ccugaaagcccuga

SEQ ID NO: 3305371 - RNA, 13 nt, Human
ccugaaagcccug

SEQ ID NO: 3305372 - RNA, 14 nt, Human
ccugaaggccccgc

SEQ ID NO: 3305373 - RNA, 19 nt, Human
ccugaaggccccgcccagg

SEQ ID NO: 3305374 - RNA, 18 nt, Human
ccugaaggccccgcccag

SEQ ID NO: 3305375 - RNA, 21 nt, Human
ccugaaggccccgcccaggcu

SEQ ID NO: 3305376 - RNA, 20 nt, Human
ccugaaggccccgcccaggc

SEQ ID NO: 3305377 - RNA, 22 nt, Human
ccugaaggccccgcccaggcuu

SEQ ID NO: 3305378 - RNA, 15 nt, Human
ccugagcugggauga

SEQ ID NO: 3305379 - RNA, 14 nt, Human
ccugaggcccagag

SEQ ID NO: 3305380 - RNA, 15 nt, Human
ccugaggcugggcuc

SEQ ID NO: 3305381 - RNA, 14 nt, Human
ccugaggcugggcu

SEQ ID NO: 3305382 - RNA, 13 nt, Human
ccugaggcugggc

SEQ ID NO: 3305383 - RNA, 17 nt, Human
ccugaggcccagagggc

SEQ ID NO: 3305384 - RNA, 16 nt, Human
ccugaggcccagaggg

SEQ ID NO: 3305385 - RNA, 15 nt, Human
ccugaggcccagagg

SEQ ID NO: 3305386 - RNA, 12 nt, Human
ccugagcuggga

SEQ ID NO: 3305387 - RNA, 22 nt, Human
ccugaagucuuuguacagacaa

SEQ ID NO: 3305388 - RNA, 20 nt, Human
ccugaagucacacagugagu

SEQ ID NO: 3305389 - RNA, 19 nt, Human
ccugaagucacacagugag

SEQ ID NO: 3305390 - RNA, 18 nt, Human
ccugagccagauuucacu

SEQ ID NO: 3305391 - RNA, 16 nt, Human
ccugagccagauuuca

SEQ ID NO: 3305392 - RNA, 12 nt, Human
ccugagccagau

SEQ ID NO: 3305393 - RNA, 15 nt, Human
ccugagccagauuuc

SEQ ID NO: 3305394 - RNA, 19 nt, Human
ccugccaauggacuaacuu

SEQ ID NO: 3305395 - RNA, 16 nt, Human
ccugccacccugggga

SEQ ID NO: 3305396 - RNA, 22 nt, Human
ccugccacccuggggagaaagu

SEQ ID NO: 3305397 - RNA, 14 nt, Human
ccugccacccuggg

SEQ ID NO: 3305398 - RNA, 12 nt, Human
ccugccacccug

SEQ ID NO: 3305399 - RNA, 13 nt, Human
ccugccacccugg

SEQ ID NO: 3305400 - RNA, 17 nt, Human
ccugcuaauuccccaga

SEQ ID NO: 3305401 - RNA, 21 nt, Human
ccugcuaauuccccagauugc

SEQ ID NO: 3305402 - RNA, 20 nt, Human
ccugccuguugggccaggag

SEQ ID NO: 3305403 - RNA, 19 nt, Human
ccugccuguugggccagga

SEQ ID NO: 3305404 - RNA, 18 nt, Human
ccugccuguugggccagg

SEQ ID NO: 3305405 - RNA, 19 nt, Human
ccuggcacccggccccugc

SEQ ID NO: 3305406 - RNA, 20 nt, Human
ccuggcacccggccccugcu

SEQ ID NO: 3305407 - RNA, 18 nt, Human
ccuggcacccggccccug

SEQ ID NO: 3305408 - RNA, 22 nt, Human
ccuggcacuauaauguaagcuc

SEQ ID NO: 3305409 - RNA, 12 nt, Human
ccuggcacugcu

SEQ ID NO: 3305410 - RNA, 14 nt, Human
ccuggcccacugca

SEQ ID NO: 3305411 - RNA, 13 nt, Human
ccuggcccacugc

SEQ ID NO: 3305412 - RNA, 21 nt, Human
ccuggccagaugcaccagccc

SEQ ID NO: 3305413 - RNA, 23 nt, Human
ccuggccagaugcaccagcccuu

SEQ ID NO: 3305414 - RNA, 20 nt, Human
ccuggccagaugcaccagcc

SEQ ID NO: 3305415 - RNA, 23 nt, Human
ccuggcaugggaaugaaugucag

SEQ ID NO: 3305416 - RNA, 13 nt, Human
ccuggcaugggaa

SEQ ID NO: 3305417 - RNA, 16 nt, Human
ccuggcacugcuucca

SEQ ID NO: 3305418 - RNA, 13 nt, Human
ccuggcacugcuu

SEQ ID NO: 3305419 - RNA, 16 nt, Human
ccuggcccacugcauc

SEQ ID NO: 3305420 - RNA, 16 nt, Human
ccugggagugagcugg

SEQ ID NO: 3305421 - RNA, 22 nt, Human
ccugggaggucaaggcugcagu

SEQ ID NO: 3305422 - RNA, 16 nt, Human
ccugggcagaaggaag

SEQ ID NO: 3305423 - RNA, 18 nt, Human
ccugggagugagcugguu

SEQ ID NO: 3305424 - RNA, 15 nt, Human
ccugggcagaaggaa

SEQ ID NO: 3305425 - RNA, 18 nt, Human
ccugggggcugggcagag

SEQ ID NO: 3305426 - RNA, 21 nt, Human
ccugggggcugggcagaggaa

SEQ ID NO: 3305427 - RNA, 20 nt, Human
ccugggggcugggcagagga

SEQ ID NO: 3305428 - RNA, 19 nt, Human
ccugggggcugggcagagg

SEQ ID NO: 3305429 - RNA, 13 nt, Human
ccugguggcagug

SEQ ID NO: 3305430 - RNA, 14 nt, Human
ccugguggcagugg

SEQ ID NO: 3305431 - RNA, 10 nt, Human
ccuguaccuc

SEQ ID NO: 3305432 - RNA, 16 nt, Human
ccuguagagugggagc

SEQ ID NO: 3305433 - RNA, 15 nt, Human
ccuguagagugggag

SEQ ID NO: 3305434 - RNA, 13 nt, Human
ccuguagcccuaa

SEQ ID NO: 3305435 - RNA, 15 nt, Human
ccugucccccugaca

SEQ ID NO: 3305436 - RNA, 14 nt, Human
ccugucccccugac

SEQ ID NO: 3305437 - RNA, 13 nt, Human
ccugucccccuga

SEQ ID NO: 3305438 - RNA, 12 nt, Human
ccugucccccug

SEQ ID NO: 3305439 - RNA, 14 nt, Human
ccugguggcagcug

SEQ ID NO: 3305440 - RNA, 22 nt, Human
ccugguggcagcucaccucucc

SEQ ID NO: 3305441 - RNA, 21 nt, Human
ccugguggcagcucaccucuc

SEQ ID NO: 3305442 - RNA, 19 nt, Human
ccugguggcagcucaccuc

SEQ ID NO: 3305443 - RNA, 15 nt, Human
ccugguggcagcugc

SEQ ID NO: 3305444 - RNA, 16 nt, Human
ccugguggcagcugcg

SEQ ID NO: 3305445 - RNA, 17 nt, Human
ccugguggcagcugcgg

SEQ ID NO: 3305446 - RNA, 18 nt, Human
ccugguggcagcugcggu

SEQ ID NO: 3305447 - RNA, 13 nt, Human
ccuuccaggggug

SEQ ID NO: 3305448 - RNA, 22 nt, Human
ccuuccaggggugggacacccu

SEQ ID NO: 3305449 - RNA, 17 nt, Human
ccuuccauggacuuugu

SEQ ID NO: 3305450 - RNA, 16 nt, Human
ccuucucuccagcccc

SEQ ID NO: 3305451 - RNA, 15 nt, Human
ccuucucuccagccc

SEQ ID NO: 3305452 - RNA, 13 nt, Human
ccuucucuccagc

SEQ ID NO: 3305453 - RNA, 12 nt, Human
ccuucucuccag

SEQ ID NO: 3305454 - RNA, 19 nt, Human
ccugugccucugggacugg

SEQ ID NO: 3305455 - RNA, 20 nt, Human
ccugugccucugggacugga

SEQ ID NO: 3305456 - RNA, 20 nt, Human
ccugugggcccccaaaugga

SEQ ID NO: 3305457 - RNA, 20 nt, Human
ccuguggaugauaaaacaca

SEQ ID NO: 3305458 - RNA, 15 nt, Human
ccuuggauugucccc

SEQ ID NO: 3305459 - RNA, 22 nt, Human
ccuuggcucaaguccucuuuuc

SEQ ID NO: 3305460 - RNA, 18 nt, Human
ccuugacagggcacaccg

SEQ ID NO: 3305461 - RNA, 21 nt, Human
ccuugacagggcacaccgggc

SEQ ID NO: 3305462 - RNA, 18 nt, Human
ccuucucuccagccccug

SEQ ID NO: 3305463 - RNA, 17 nt, Human
ccuucucuccagccccu

SEQ ID NO: 3305464 - RNA, 14 nt, Human
ccuuggcugcaggg

SEQ ID NO: 3305465 - RNA, 16 nt, Human
ccuuggcugcagggag

SEQ ID NO: 3305466 - RNA, 14 nt, Human
ccuuggggagcagg

SEQ ID NO: 3305467 - RNA, 20 nt, Human
ccuuggugucgggcaugaca

SEQ ID NO: 3305468 - RNA, 19 nt, Human
ccuuggugucgggcaugac

SEQ ID NO: 3305469 - RNA, 19 nt, Human
ccuucucuccagccccugg

SEQ ID NO: 3305470 - RNA, 14 nt, Human
ccuuuguccccacc

SEQ ID NO: 3305471 - RNA, 18 nt, Human
ccuuuguccccaccgcag

SEQ ID NO: 3305472 - RNA, 16 nt, Human
ccuuuguccccaccgc

SEQ ID NO: 3305473 - RNA, 24 nt, Human
ccuuuguauucucuccuguaccuc

SEQ ID NO: 3305474 - RNA, 23 nt, Human
ccuuuguauucucuccuguaccu

SEQ ID NO: 3305475 - RNA, 22 nt, Human
ccuuuguauucucuccuguacc

SEQ ID NO: 3305476 - RNA, 14 nt, Human
ccuuugugaggaag

SEQ ID NO: 3305477 - RNA, 23 nt, Human
ccuuuguccccaccgcagacagg

SEQ ID NO: 3305478 - RNA, 22 nt, Human
ccuuuguccccaccgcagacag

SEQ ID NO: 3305479 - RNA, 23 nt, Human
ccuuugugaggaagccgcugggg

SEQ ID NO: 3305480 - RNA, 17 nt, Human
ccuuugugaggaagccg

SEQ ID NO: 3305481 - RNA, 16 nt, Human
ccuuugugaggaagcc

SEQ ID NO: 3305482 - RNA, 15 nt, Human
ccuuugugaggaagc

SEQ ID NO: 3305483 - RNA, 19 nt, Human
ccuuuuuuauacauaaaca

SEQ ID NO: 3305484 - RNA, 15 nt, Human
ccuuuuuuggcugcu

SEQ ID NO: 3305485 - RNA, 21 nt, Human
cgaacauguuuuucuucuccc

SEQ ID NO: 3305486 - RNA, 23 nt, Human
cgaaagggacuuggaagcuccgc

SEQ ID NO: 3305487 - RNA, 22 nt, Human
ccuuuuuuggcugcugaaggcu

SEQ ID NO: 3305488 - RNA, 20 nt, Human
ccuuuuuuggcugcugaagg

SEQ ID NO: 3305489 - RNA, 18 nt, Human
ccuuuuuuggcugcugaa

SEQ ID NO: 3305490 - RNA, 17 nt, Human
ccuuuuuuggcugcuga

SEQ ID NO: 3305491 - RNA, 15 nt, Human
cgaauagcugggacu

SEQ ID NO: 3305492 - RNA, 16 nt, Human
cgaauagcugggacua

SEQ ID NO: 3305493 - RNA, 11 nt, Human
cgaauauugcu

SEQ ID NO: 3305494 - RNA, 14 nt, Human
cgaauauugcugau

SEQ ID NO: 3305495 - RNA, 12 nt, Human
cgaauauugcug

SEQ ID NO: 3305496 - RNA, 17 nt, Human
cgaauauugcugauggu

SEQ ID NO: 3305497 - RNA, 15 nt, Human
cgaauauugcugaug

SEQ ID NO: 3305498 - RNA, 16 nt, Human
cgggaagggggcuggg

SEQ ID NO: 3305499 - RNA, 20 nt, Human
cgggaagggggcugggacau

SEQ ID NO: 3305500 - RNA, 19 nt, Human
cgggaagggggcugggaca

SEQ ID NO: 3305501 - RNA, 13 nt, Human
cggcuggccuggc

SEQ ID NO: 3305502 - RNA, 23 nt, Human
cggcuggcagcccaccccucaac

SEQ ID NO: 3305503 - RNA, 12 nt, Human
cggccaggccag

SEQ ID NO: 3305504 - RNA, 20 nt, Human
cggccaggccagagggagug

SEQ ID NO: 3305505 - RNA, 11 nt, Human
cggccaggcca

SEQ ID NO: 3305506 - RNA, 14 nt, Human
cggcuggcagccca

SEQ ID NO: 3305507 - RNA, 19 nt, Human
cgcgguggcucacgccugu

SEQ ID NO: 3305508 - RNA, 14 nt, Human
cgcgacaaugcaaa

SEQ ID NO: 3305509 - RNA, 24 nt, Human
cgcuacccgggaagggggcuggga

SEQ ID NO: 3305510 - RNA, 21 nt, Human
cgcuacccgggaagggggcug

SEQ ID NO: 3305511 - RNA, 18 nt, Human
cgcuacccgggaaggggg

SEQ ID NO: 3305512 - RNA, 17 nt, Human
cgcuacccgggaagggg

SEQ ID NO: 3305513 - RNA, 19 nt, Human
cgcagcccugcagagggca

SEQ ID NO: 3305514 - RNA, 18 nt, Human
cgcagcccugcagagggc

SEQ ID NO: 3305515 - RNA, 13 nt, Human
cgcccagucugga

SEQ ID NO: 3305516 - RNA, 19 nt, Human
cgcccagucuggaaugcag

SEQ ID NO: 3305517 - RNA, 21 nt, Human
cgcccagucuggaaugcagug

SEQ ID NO: 3305518 - RNA, 12 nt, Human
cgcccagucugg

SEQ ID NO: 3305519 - RNA, 18 nt, Human
cgcugugcugcccugccc

SEQ ID NO: 3305520 - RNA, 19 nt, Human
cgcugugcugcccugccca

SEQ ID NO: 3305521 - RNA, 23 nt, Human
cgcugugcugcccugcccaccug

SEQ ID NO: 3305522 - RNA, 21 nt, Human
cgcugugcugcccugcccacc

SEQ ID NO: 3305523 - RNA, 11 nt, Human
cgcugugcugc

SEQ ID NO: 3305524 - RNA, 13 nt, Human
cgcugugcugccc

SEQ ID NO: 3305525 - RNA, 15 nt, Human
cggagaaaggaaggg

SEQ ID NO: 3305526 - RNA, 21 nt, Human
cggacagccacggccaggcca

SEQ ID NO: 3305527 - RNA, 22 nt, Human
cggacagccacggccaggccag

SEQ ID NO: 3305528 - RNA, 14 nt, Human
cgcuuucuacccag

SEQ ID NO: 3305529 - RNA, 16 nt, Human
cgcuuucuacccagcg

SEQ ID NO: 3305530 - RNA, 16 nt, Human
cggaauaguuggcuag

SEQ ID NO: 3305531 - RNA, 17 nt, Human
cggaauaguuggcuagg

SEQ ID NO: 3305532 - RNA, 14 nt, Human
cggaauaguuggcu

SEQ ID NO: 3305533 - RNA, 20 nt, Human
cggacagccacggccaggcc

SEQ ID NO: 3305534 - RNA, 17 nt, Human
cgcacugggcuugggga

SEQ ID NO: 3305535 - RNA, 17 nt, Human
cgcagcccugcagaggg

SEQ ID NO: 3305536 - RNA, 15 nt, Human
cgcagcccugcagag

SEQ ID NO: 3305537 - RNA, 20 nt, Human
cgcagcauauucaggaagcu

SEQ ID NO: 3305538 - RNA, 19 nt, Human
cgcagcauauucaggaagc

SEQ ID NO: 3305539 - RNA, 13 nt, Human
cgcacugggcuug

SEQ ID NO: 3305540 - RNA, 18 nt, Human
cgagcccugguggcagug

SEQ ID NO: 3305541 - RNA, 14 nt, Human
cgaggacagggagg

SEQ ID NO: 3305542 - RNA, 19 nt, Human
cgagcccugguggcagugg

SEQ ID NO: 3305543 - RNA, 16 nt, Human
cgaggacagggaggug

SEQ ID NO: 3305544 - RNA, 22 nt, Human
ccagacacauguccaagaagcc

SEQ ID NO: 3305545 - RNA, 20 nt, Human
ccagacacauguccaagaag

SEQ ID NO: 3305546 - RNA, 17 nt, Human
ccagacacauguccaag

SEQ ID NO: 3305547 - RNA, 14 nt, Human
ccagacccggcugc

SEQ ID NO: 3305548 - RNA, 15 nt, Human
ccagacccggcugcg

SEQ ID NO: 3305549 - RNA, 23 nt, Human
ccacuggugacaugucuuuucuu

SEQ ID NO: 3305550 - RNA, 15 nt, Human
ccacugugaagagaa

SEQ ID NO: 3305551 - RNA, 14 nt, Human
ccacugugaagaga

SEQ ID NO: 3305552 - RNA, 22 nt, Human
ccacugcuuuuggucuguguga

SEQ ID NO: 3305553 - RNA, 20 nt, Human
ccacugcuuuuggucugugu

SEQ ID NO: 3305554 - RNA, 11 nt, Human
ccacugcucug

SEQ ID NO: 3305555 - RNA, 12 nt, Human
ccacugcucugg

SEQ ID NO: 3305556 - RNA, 13 nt, Human
ccacugcucuggu

SEQ ID NO: 3305557 - RNA, 15 nt, Human
ccacugcucugguua

SEQ ID NO: 3305558 - RNA, 23 nt, Human
ccacugcaucguuucaucuucca

SEQ ID NO: 3305559 - RNA, 21 nt, Human
ccacugcaucguuucaucuuc

SEQ ID NO: 3305560 - RNA, 22 nt, Human
ccacuuuuguucuugguuugua

SEQ ID NO: 3305561 - RNA, 19 nt, Human
ccacugugccaugugccag

SEQ ID NO: 3305562 - RNA, 15 nt, Human
ccacugugccaugug

SEQ ID NO: 3305563 - RNA, 16 nt, Human
ccacugugccaugugc

SEQ ID NO: 3305564 - RNA, 22 nt, Human
ccagaagaaaauagugguguga

SEQ ID NO: 3305565 - RNA, 15 nt, Human
ccaccugccagggac

SEQ ID NO: 3305566 - RNA, 12 nt, Human
ccaccugccagg

SEQ ID NO: 3305567 - RNA, 14 nt, Human
ccaccugccaggga

SEQ ID NO: 3305568 - RNA, 13 nt, Human
ccaccugccaggg

SEQ ID NO: 3305569 - RNA, 20 nt, Human
ccaccuggccucugcacucc

SEQ ID NO: 3305570 - RNA, 18 nt, Human
ccaccuggccucugcacu

SEQ ID NO: 3305571 - RNA, 13 nt, Human
ccaccuggccucu

SEQ ID NO: 3305572 - RNA, 20 nt, Human
ccaccucucucacuccuuga

SEQ ID NO: 3305573 - RNA, 19 nt, Human
ccaccucucucacuccuug

SEQ ID NO: 3305574 - RNA, 16 nt, Human
ccaccucucucacucc

SEQ ID NO: 3305575 - RNA, 14 nt, Human
ccaccucucucacu

SEQ ID NO: 3305576 - RNA, 11 nt, Human
ccacccugcuc

SEQ ID NO: 3305577 - RNA, 12 nt, Human
ccacccugcucu

SEQ ID NO: 3305578 - RNA, 14 nt, Human
ccacccuccuuuca

SEQ ID NO: 3305579 - RNA, 18 nt, Human
ccacccugaaagcccuga

SEQ ID NO: 3305580 - RNA, 19 nt, Human
ccaccccucaacaccucug

SEQ ID NO: 3305581 - RNA, 19 nt, Human
ccacccccacccaagggcc

SEQ ID NO: 3305582 - RNA, 22 nt, Human
ccagccuugaccauucuccacc

SEQ ID NO: 3305583 - RNA, 23 nt, Human
ccagccuugaccauucuccaccu

SEQ ID NO: 3305584 - RNA, 13 nt, Human
ccagccuggguga

SEQ ID NO: 3305585 - RNA, 16 nt, Human
ccagcccacuucugcc

SEQ ID NO: 3305586 - RNA, 17 nt, Human
ccagcccacuucugcca

SEQ ID NO: 3305587 - RNA, 23 nt, Human
ccagcaggcucucaggccagcug

SEQ ID NO: 3305588 - RNA, 21 nt, Human
ccagcaggcucucaggccagc

SEQ ID NO: 3305589 - RNA, 20 nt, Human
ccagcaggcucucaggccag

SEQ ID NO: 3305590 - RNA, 19 nt, Human
ccagcaggcucucaggcca

SEQ ID NO: 3305591 - RNA, 19 nt, Human
ccagccgccaugcuccugg

SEQ ID NO: 3305592 - RNA, 17 nt, Human
ccagccgagauagccaa

SEQ ID NO: 3305593 - RNA, 22 nt, Human
ccagccgagauagccaaggcca

SEQ ID NO: 3305594 - RNA, 20 nt, Human
ccagccgagauagccaaggc

SEQ ID NO: 3305595 - RNA, 17 nt, Human
ccagcaagugagagcug

SEQ ID NO: 3305596 - RNA, 18 nt, Human
ccagcaagugagagcugg

SEQ ID NO: 3305597 - RNA, 19 nt, Human
ccagcaagugagagcuggg

SEQ ID NO: 3305598 - RNA, 16 nt, Human
ccagcaagugagagcu

SEQ ID NO: 3305599 - RNA, 18 nt, Human
ccagcaccaucucuccuc

SEQ ID NO: 3305600 - RNA, 17 nt, Human
ccagcaccaucucuccu

SEQ ID NO: 3305601 - RNA, 16 nt, Human
ccagcaggcucucagg

SEQ ID NO: 3305602 - RNA, 18 nt, Human
ccagcaggcucucaggcc

SEQ ID NO: 3305603 - RNA, 17 nt, Human
ccagcaggcucucaggc

SEQ ID NO: 3305604 - RNA, 14 nt, Human
ccagauugcaacag

SEQ ID NO: 3305605 - RNA, 16 nt, Human
ccagauugcaacaggc

SEQ ID NO: 3305606 - RNA, 14 nt, Human
ccagagcccaccuu

SEQ ID NO: 3305607 - RNA, 23 nt, Human
ccagauugcaacaggcugggcuu

SEQ ID NO: 3305608 - RNA, 22 nt, Human
ccagauugcaacaggcugggcu

SEQ ID NO: 3305609 - RNA, 15 nt, Human
ccagauuucacucuc

SEQ ID NO: 3305610 - RNA, 19 nt, Human
ccagauuucacucuccuug

SEQ ID NO: 3305611 - RNA, 18 nt, Human
ccagauuucacucuccuu

SEQ ID NO: 3305612 - RNA, 16 nt, Human
ccaucauugaaaucuu

SEQ ID NO: 3305613 - RNA, 14 nt, Human
ccaucauugaaauc

SEQ ID NO: 3305614 - RNA, 13 nt, Human
ccaucuacccucc

SEQ ID NO: 3305615 - RNA, 15 nt, Human
ccaucucuccuccuu

SEQ ID NO: 3305616 - RNA, 21 nt, Human
ccaucucacacaugagcauca

SEQ ID NO: 3305617 - RNA, 20 nt, Human
ccaucucacacaugagcauc

SEQ ID NO: 3305618 - RNA, 18 nt, Human
ccaucucacacaugagca

SEQ ID NO: 3305619 - RNA, 17 nt, Human
ccaucucacacaugagc

SEQ ID NO: 3305620 - RNA, 15 nt, Human
ccaucucacacauga

SEQ ID NO: 3305621 - RNA, 14 nt, Human
ccaucucacacaug

SEQ ID NO: 3305622 - RNA, 12 nt, Human
ccaucaugucug

SEQ ID NO: 3305623 - RNA, 13 nt, Human
ccaucaugucugg

SEQ ID NO: 3305624 - RNA, 12 nt, Human
ccaucauugaaa

SEQ ID NO: 3305625 - RNA, 14 nt, Human
ccaucaagccacca

SEQ ID NO: 3305626 - RNA, 13 nt, Human
ccaucaagccacc

SEQ ID NO: 3305627 - RNA, 16 nt, Human
ccaucaagccaccaac

SEQ ID NO: 3305628 - RNA, 15 nt, Human
ccauaugccugggca

SEQ ID NO: 3305629 - RNA, 12 nt, Human
ccaucaagccac

SEQ ID NO: 3305630 - RNA, 13 nt, Human
ccauaugccuggg

SEQ ID NO: 3305631 - RNA, 14 nt, Human
ccagugugacaagg

SEQ ID NO: 3305632 - RNA, 23 nt, Human
ccagugugacaaggauugcuacu

SEQ ID NO: 3305633 - RNA, 21 nt, Human
ccaggugcuaggaacacuccu

SEQ ID NO: 3305634 - RNA, 24 nt, Human
ccaggugcacaagcuccaagcucc

SEQ ID NO: 3305635 - RNA, 16 nt, Human
ccagguuucuaugugu

SEQ ID NO: 3305636 - RNA, 13 nt, Human
ccagguuuaagcu

SEQ ID NO: 3305637 - RNA, 20 nt, Human
ccaguaaaugggggugcauu

SEQ ID NO: 3305638 - RNA, 22 nt, Human
ccaguaaaugggggugcauuug

SEQ ID NO: 3305639 - RNA, 21 nt, Human
ccaguaaaugggggugcauuu

SEQ ID NO: 3305640 - RNA, 14 nt, Human
ccaggccccugcca

SEQ ID NO: 3305641 - RNA, 13 nt, Human
ccaggccccugcc

SEQ ID NO: 3305642 - RNA, 15 nt, Human
ccaggccccugccac

SEQ ID NO: 3305643 - RNA, 16 nt, Human
ccaggccccugccacc

SEQ ID NO: 3305644 - RNA, 14 nt, Human
ccaggcccucugcc

SEQ ID NO: 3305645 - RNA, 13 nt, Human
ccaggcccucugc

SEQ ID NO: 3305646 - RNA, 14 nt, Human
ccaggaggccagcc

SEQ ID NO: 3305647 - RNA, 18 nt, Human
ccaggaggccagccuuga

SEQ ID NO: 3305648 - RNA, 15 nt, Human
ccaggaggccagccu

SEQ ID NO: 3305649 - RNA, 20 nt, Human
ccaggaggccagccuugacc

SEQ ID NO: 3305650 - RNA, 21 nt, Human
ccaggccacaagacccuugug

SEQ ID NO: 3305651 - RNA, 21 nt, Human
ccaggcuuagucacugagaca

SEQ ID NO: 3305652 - RNA, 23 nt, Human
ccaggcuuagucacugagacagc

SEQ ID NO: 3305653 - RNA, 22 nt, Human
ccaggcuuagucacugagacag

SEQ ID NO: 3305654 - RNA, 23 nt, Human
ccaggcugggagagccuuccagg

SEQ ID NO: 3305655 - RNA, 15 nt, Human
ccaggcccucugccc

SEQ ID NO: 3305656 - RNA, 21 nt, Human
cccacgcuggagugcagugag

SEQ ID NO: 3305657 - RNA, 19 nt, Human
cccacgcccccacugguga

SEQ ID NO: 3305658 - RNA, 17 nt, Human
cccacgcccccacuggu

SEQ ID NO: 3305659 - RNA, 15 nt, Human
cccacgcccccacug

SEQ ID NO: 3305660 - RNA, 15 nt, Human
cccaccuuggcucaa

SEQ ID NO: 3305661 - RNA, 22 nt, Human
cccaccuuggcucaaguccucu

SEQ ID NO: 3305662 - RNA, 14 nt, Human
cccaccuuggcugc

SEQ ID NO: 3305663 - RNA, 15 nt, Human
cccaccuuggcugca

SEQ ID NO: 3305664 - RNA, 12 nt, Human
cccaccucagcc

SEQ ID NO: 3305665 - RNA, 14 nt, Human
cccaccucagccuc

SEQ ID NO: 3305666 - RNA, 15 nt, Human
cccaccucagccucc

SEQ ID NO: 3305667 - RNA, 12 nt, Human
cccaccuuggcu

SEQ ID NO: 3305668 - RNA, 21 nt, Human
cccaccucagccucccaaagu

SEQ ID NO: 3305669 - RNA, 13 nt, Human
cccaccucucuca

SEQ ID NO: 3305670 - RNA, 17 nt, Human
cccaccucucucacucc

SEQ ID NO: 3305671 - RNA, 14 nt, Human
cccaccucucucac

SEQ ID NO: 3305672 - RNA, 21 nt, Human
ccauuuuguauuuuacuaaua

SEQ ID NO: 3305673 - RNA, 20 nt, Human
ccauuuugcugucccuuuuc

SEQ ID NO: 3305674 - RNA, 14 nt, Human
cccaagggccuggc

SEQ ID NO: 3305675 - RNA, 12 nt, Human
cccaagggccug

SEQ ID NO: 3305676 - RNA, 17 nt, Human
cccacaggaucagucug

SEQ ID NO: 3305677 - RNA, 13 nt, Human
cccacaggaucag

SEQ ID NO: 3305678 - RNA, 16 nt, Human
cccaagggccuggccu

SEQ ID NO: 3305679 - RNA, 18 nt, Human
ccauguuuuguuuacggu

SEQ ID NO: 3305680 - RNA, 15 nt, Human
ccauucugccugccc

SEQ ID NO: 3305681 - RNA, 13 nt, Human
ccauuugcuccuu

SEQ ID NO: 3305682 - RNA, 22 nt, Human
cccgaauagcugggacuacagg

SEQ ID NO: 3305683 - RNA, 20 nt, Human
ccccuuccauggacuuuguu

SEQ ID NO: 3305684 - RNA, 13 nt, Human
ccccuuccaugga

SEQ ID NO: 3305685 - RNA, 20 nt, Human
cccgcccaggcuuagucacu

SEQ ID NO: 3305686 - RNA, 23 nt, Human
cccgcuaagagggagggagggcu

SEQ ID NO: 3305687 - RNA, 22 nt, Human
cccgcuaagagggagggagggc

SEQ ID NO: 3305688 - RNA, 15 nt, Human
ccccuggaugcagcc

SEQ ID NO: 3305689 - RNA, 19 nt, Human
ccccuggaugcagccucac

SEQ ID NO: 3305690 - RNA, 18 nt, Human
ccccuggaugcagccuca

SEQ ID NO: 3305691 - RNA, 17 nt, Human
ccccugcuggguguggc

SEQ ID NO: 3305692 - RNA, 14 nt, Human
ccccugcugggugu

SEQ ID NO: 3305693 - RNA, 11 nt, Human
ccccugcuggu

SEQ ID NO: 3305694 - RNA, 13 nt, Human
ccccugcugguuc

SEQ ID NO: 3305695 - RNA, 15 nt, Human
ccccugcugguucag

SEQ ID NO: 3305696 - RNA, 20 nt, Human
ccccugcugguucaggguug

SEQ ID NO: 3305697 - RNA, 17 nt, Human
ccccugcccggcugcgg

SEQ ID NO: 3305698 - RNA, 19 nt, Human
ccccugcccggcugcggaa

SEQ ID NO: 3305699 - RNA, 12 nt, Human
ccccuccaugug

SEQ ID NO: 3305700 - RNA, 22 nt, Human
ccccucagggucccugguggca

SEQ ID NO: 3305701 - RNA, 17 nt, Human
cccccugacaacacuca

SEQ ID NO: 3305702 - RNA, 19 nt, Human
cccccugacaacacucauu

SEQ ID NO: 3305703 - RNA, 12 nt, Human
cccccagccugc

SEQ ID NO: 3305704 - RNA, 23 nt, Human
ccccucaacucuccuccagaguc

SEQ ID NO: 3305705 - RNA, 16 nt, Human
ccccucaacaccucug

SEQ ID NO: 3305706 - RNA, 15 nt, Human
ccccucaacaccucu

SEQ ID NO: 3305707 - RNA, 14 nt, Human
ccccagugcccaca

SEQ ID NO: 3305708 - RNA, 15 nt, Human
ccccagugcccacag

SEQ ID NO: 3305709 - RNA, 16 nt, Human
ccccagugcccacagg

SEQ ID NO: 3305710 - RNA, 20 nt, Human
ccccagugcccacaggauca

SEQ ID NO: 3305711 - RNA, 22 nt, Human
ccccaggugguuauggagaggg

SEQ ID NO: 3305712 - RNA, 13 nt, Human
cccccacugguga

SEQ ID NO: 3305713 - RNA, 11 nt, Human
cccccacuggu

SEQ ID NO: 3305714 - RNA, 15 nt, Human
cccccacuggugaca

SEQ ID NO: 3305715 - RNA, 24 nt, Human
cccccacccaagggccuggccuga

SEQ ID NO: 3305716 - RNA, 13 nt, Human
cccccacccaagg

SEQ ID NO: 3305717 - RNA, 14 nt, Human
ccccauccucugua

SEQ ID NO: 3305718 - RNA, 22 nt, Human
cccaugagccucagcauccugg

SEQ ID NO: 3305719 - RNA, 14 nt, Human
cccaugagccucag

SEQ ID NO: 3305720 - RNA, 18 nt, Human
cccaugcugcccugugag

SEQ ID NO: 3305721 - RNA, 14 nt, Human
cccaguugggugga

SEQ ID NO: 3305722 - RNA, 19 nt, Human
cccaucucuacaaaaagca

SEQ ID NO: 3305723 - RNA, 14 nt, Human
ccccacuggugaca

SEQ ID NO: 3305724 - RNA, 19 nt, Human
ccccaccgcagacaggacc

SEQ ID NO: 3305725 - RNA, 15 nt, Human
ccccaccgcagacag

SEQ ID NO: 3305726 - RNA, 21 nt, Human
ccccacccaagggccuggccu

SEQ ID NO: 3305727 - RNA, 13 nt, Human
ccgggcucugccu

SEQ ID NO: 3305728 - RNA, 18 nt, Human
ccgggcucugccucccau

SEQ ID NO: 3305729 - RNA, 15 nt, Human
ccgggcucugccucc

SEQ ID NO: 3305730 - RNA, 14 nt, Human
ccgggcucugccuc

SEQ ID NO: 3305731 - RNA, 18 nt, Human
ccgugaggccagagacac

SEQ ID NO: 3305732 - RNA, 15 nt, Human
ccggcuccaggcucc

SEQ ID NO: 3305733 - RNA, 16 nt, Human
ccggcuccaggcuccu

SEQ ID NO: 3305734 - RNA, 21 nt, Human
ccggcuccaggcuccuuuagc

SEQ ID NO: 3305735 - RNA, 20 nt, Human
ccgggcacucagaagacacu

SEQ ID NO: 3305736 - RNA, 22 nt, Human
ccgggcacucagaagacacuga

SEQ ID NO: 3305737 - RNA, 13 nt, Human
ccgggccacagag

SEQ ID NO: 3305738 - RNA, 11 nt, Human
ccgcuggggcc

SEQ ID NO: 3305739 - RNA, 21 nt, Human
ccgagauugcaccacugcacu

SEQ ID NO: 3305740 - RNA, 19 nt, Human
ccgagauugcaccacugca

SEQ ID NO: 3305741 - RNA, 15 nt, Human
ccgagauugcaccac

SEQ ID NO: 3305742 - RNA, 19 nt, Human
ccgagcuuugaaaauucag

SEQ ID NO: 3305743 - RNA, 14 nt, Human
ccgaguagcuggga

SEQ ID NO: 3305744 - RNA, 19 nt, Human
ccgcacugggcuuggggac

SEQ ID NO: 3305745 - RNA, 23 nt, Human
ccgcacugggcuuggggaccaga

SEQ ID NO: 3305746 - RNA, 18 nt, Human
ccuacaggagugagcacu

SEQ ID NO: 3305747 - RNA, 12 nt, Human
ccguuauuaaaa

SEQ ID NO: 3305748 - RNA, 16 nt, Human
ccgugaggccagagac

SEQ ID NO: 3305749 - RNA, 23 nt, Human
ccuaggcauuugcugaauacaga

SEQ ID NO: 3305750 - RNA, 18 nt, Human
ccuaggugacagagugag

SEQ ID NO: 3305751 - RNA, 17 nt, Human
cccucuuucccucccuu

SEQ ID NO: 3305752 - RNA, 20 nt, Human
cccucuuucccucccuuccu

SEQ ID NO: 3305753 - RNA, 12 nt, Human
cccucuuucccu

SEQ ID NO: 3305754 - RNA, 19 nt, Human
cccucugcccacucccugc

SEQ ID NO: 3305755 - RNA, 18 nt, Human
cccucugcccacucccug

SEQ ID NO: 3305756 - RNA, 15 nt, Human
cccucugcccacucc

SEQ ID NO: 3305757 - RNA, 11 nt, Human
cccucugccca

SEQ ID NO: 3305758 - RNA, 23 nt, Human
cccucccucuuucccucccuucc

SEQ ID NO: 3305759 - RNA, 14 nt, Human
cccugguggcagug

SEQ ID NO: 3305760 - RNA, 21 nt, Human
cccuguagagugggagcugag

SEQ ID NO: 3305761 - RNA, 13 nt, Human
cccugguggcagu

SEQ ID NO: 3305762 - RNA, 21 nt, Human
cccugguggcagcucaccucu

SEQ ID NO: 3305763 - RNA, 21 nt, Human
cccuggugaccagcaccaucu

SEQ ID NO: 3305764 - RNA, 20 nt, Human
cccugguggcagcucaccuc

SEQ ID NO: 3305765 - RNA, 14 nt, Human
cccuguucuggcag

SEQ ID NO: 3305766 - RNA, 13 nt, Human
cccuguucuggca

SEQ ID NO: 3305767 - RNA, 16 nt, Human
cccuguuuguuucuga

SEQ ID NO: 3305768 - RNA, 19 nt, Human
cccuguuuguuucugaaag

SEQ ID NO: 3305769 - RNA, 19 nt, Human
cccuuaccucggugccuuc

SEQ ID NO: 3305770 - RNA, 17 nt, Human
cccuuaccugccaggaa

SEQ ID NO: 3305771 - RNA, 23 nt, Human
cccuuaccugccaggaagccagc

SEQ ID NO: 3305772 - RNA, 20 nt, Human
cccuuaccugccaggaagcc

SEQ ID NO: 3305773 - RNA, 22 nt, Human
cccuugccgucuaccugagggg

SEQ ID NO: 3305774 - RNA, 23 nt, Human
cccuuagcagggaaacagcuaau

SEQ ID NO: 3305775 - RNA, 14 nt, Human
cccuuagcagggaa

SEQ ID NO: 3305776 - RNA, 17 nt, Human
cccuuacgugaguccug

SEQ ID NO: 3305777 - RNA, 15 nt, Human
cccuuacgugagucc

SEQ ID NO: 3305778 - RNA, 12 nt, Human
cccuuccaugga

SEQ ID NO: 3305779 - RNA, 20 nt, Human
cccugcagagggcacagaaa

SEQ ID NO: 3305780 - RNA, 12 nt, Human
cccugaggccca

SEQ ID NO: 3305781 - RNA, 21 nt, Human
cccugcccugugggcccccaa

SEQ ID NO: 3305782 - RNA, 11 nt, Human
cccugccuccu

SEQ ID NO: 3305783 - RNA, 22 nt, Human
cccugcucuccgaccagacacc

SEQ ID NO: 3305784 - RNA, 21 nt, Human
cccugcucuccgaccagacac

SEQ ID NO: 3305785 - RNA, 24 nt, Human
cuggccuggccccucagggucccu

SEQ ID NO: 3305786 - RNA, 19 nt, Human
cuggccuggccccucaggg

SEQ ID NO: 3305787 - RNA, 16 nt, Human
cuggccucugcacucc

SEQ ID NO: 3305788 - RNA, 21 nt, Human
cuggccucugcacuccccugc

SEQ ID NO: 3305789 - RNA, 20 nt, Human
cuggccucugcacuccccug

SEQ ID NO: 3305790 - RNA, 18 nt, Human
cuggccucugcacucccc

SEQ ID NO: 3305791 - RNA, 14 nt, Human
cuggcgugcagugg

SEQ ID NO: 3305792 - RNA, 15 nt, Human
cuggcgugcaguggu

SEQ ID NO: 3305793 - RNA, 22 nt, Human
cuggcucuuccaggcugggaga

SEQ ID NO: 3305794 - RNA, 21 nt, Human
cuggcucuuccaggcugggag

SEQ ID NO: 3305795 - RNA, 24 nt, Human
cuggcucuuccaggcugggagagc

SEQ ID NO: 3305796 - RNA, 20 nt, Human
cuggcucuuccaggcuggga

SEQ ID NO: 3305797 - RNA, 15 nt, Human
cuggcccacugcauc

SEQ ID NO: 3305798 - RNA, 14 nt, Human
cuggccagaugcac

SEQ ID NO: 3305799 - RNA, 20 nt, Human
cuggagugcagugagccgag

SEQ ID NO: 3305800 - RNA, 20 nt, Human
cuggcacccggccccugcug

SEQ ID NO: 3305801 - RNA, 21 nt, Human
cuggcacccggccccugcugg

SEQ ID NO: 3305802 - RNA, 19 nt, Human
cuggcacccggccccugcu

SEQ ID NO: 3305803 - RNA, 18 nt, Human
cuggcacugcuuccagug

SEQ ID NO: 3305804 - RNA, 23 nt, Human
cuggcacugcuuccagugaggcu

SEQ ID NO: 3305805 - RNA, 20 nt, Human
cuggcacugcuuccagugag

SEQ ID NO: 3305806 - RNA, 19 nt, Human
cuggcacugcuuccaguga

SEQ ID NO: 3305807 - RNA, 14 nt, Human
cuggagugcaguga

SEQ ID NO: 3305808 - RNA, 15 nt, Human
cuggagugcagugag

SEQ ID NO: 3305809 - RNA, 16 nt, Human
cuggagugcagugagc

SEQ ID NO: 3305810 - RNA, 17 nt, Human
cuggagugcagugagcc

SEQ ID NO: 3305811 - RNA, 22 nt, Human
cuggagguacgaaaagagggga

SEQ ID NO: 3305812 - RNA, 17 nt, Human
cuggagguacgaaaaga

SEQ ID NO: 3305813 - RNA, 23 nt, Human
cuggacaggcauguucucugagg

SEQ ID NO: 3305814 - RNA, 14 nt, Human
cuggacaggcaugu

SEQ ID NO: 3305815 - RNA, 17 nt, Human
cuggacaggcauguucu

SEQ ID NO: 3305816 - RNA, 16 nt, Human
cuggaccuugaacugg

SEQ ID NO: 3305817 - RNA, 15 nt, Human
cuggacccuguggau

SEQ ID NO: 3305818 - RNA, 21 nt, Human
cuggaccuugaacuggguacu

SEQ ID NO: 3305819 - RNA, 17 nt, Human
cuggaccuugaacuggg

SEQ ID NO: 3305820 - RNA, 20 nt, Human
cuggaccuugaacuggguac

SEQ ID NO: 3305821 - RNA, 13 nt, Human
cugcugguucagg

SEQ ID NO: 3305822 - RNA, 15 nt, Human
cugcugguucagggu

SEQ ID NO: 3305823 - RNA, 23 nt, Human
cugcugguucaggguuggccccu

SEQ ID NO: 3305824 - RNA, 15 nt, Human
cugcuuccagugagg

SEQ ID NO: 3305825 - RNA, 18 nt, Human
cugcuuccagugaggcuc

SEQ ID NO: 3305826 - RNA, 16 nt, Human
cugcuuccagugaggc

SEQ ID NO: 3305827 - RNA, 23 nt, Human
cugcuuccagugaggcucugccc

SEQ ID NO: 3305828 - RNA, 21 nt, Human
cugcuuccagugaggcucugc

SEQ ID NO: 3305829 - RNA, 20 nt, Human
cugcuuccagugaggcucug

SEQ ID NO: 3305830 - RNA, 19 nt, Human
cugcuuccagugaggcucu

SEQ ID NO: 3305831 - RNA, 15 nt, Human
cugcugcuggcuggu

SEQ ID NO: 3305832 - RNA, 14 nt, Human
cugcugcuggcugg

SEQ ID NO: 3305833 - RNA, 11 nt, Human
cugcugaaggc

SEQ ID NO: 3305834 - RNA, 15 nt, Human
cugcugcaguugcca

SEQ ID NO: 3305835 - RNA, 19 nt, Human
cugcgaccacaagaaggau

SEQ ID NO: 3305836 - RNA, 15 nt, Human
cugcuccagcuguuc

SEQ ID NO: 3305837 - RNA, 20 nt, Human
cugcuccagcuguucagcug

SEQ ID NO: 3305838 - RNA, 19 nt, Human
cugcuccagcuguucagcu

SEQ ID NO: 3305839 - RNA, 19 nt, Human
cugcucuccgaccagacac

SEQ ID NO: 3305840 - RNA, 15 nt, Human
cugccgcagcccugc

SEQ ID NO: 3305841 - RNA, 14 nt, Human
cugccgcagcccug

SEQ ID NO: 3305842 - RNA, 18 nt, Human
cugccgcagcccugcaga

SEQ ID NO: 3305843 - RNA, 17 nt, Human
cugccgcagcccugcag

SEQ ID NO: 3305844 - RNA, 17 nt, Human
cucccuucccaccucuc

SEQ ID NO: 3305845 - RNA, 16 nt, Human
cucccuucccaccucu

SEQ ID NO: 3305846 - RNA, 15 nt, Human
cucccuucccaccuc

SEQ ID NO: 3305847 - RNA, 14 nt, Human
cucccuucccaccu

SEQ ID NO: 3305848 - RNA, 12 nt, Human
cugcccuccaag

SEQ ID NO: 3305849 - RNA, 19 nt, Human
cugccucccaucacccgcu

SEQ ID NO: 3305850 - RNA, 16 nt, Human
cugccucccaucaccc

SEQ ID NO: 3305851 - RNA, 14 nt, Human
cugccucccaucac

SEQ ID NO: 3305852 - RNA, 12 nt, Human
cugccucccauc

SEQ ID NO: 3305853 - RNA, 11 nt, Human
cugccucccau

SEQ ID NO: 3305854 - RNA, 22 nt, Human
cugccucugacacacagcucug

SEQ ID NO: 3305855 - RNA, 23 nt, Human
cugccucugacacacagcucugu

SEQ ID NO: 3305856 - RNA, 20 nt, Human
cugccugcccaggccccugc

SEQ ID NO: 3305857 - RNA, 21 nt, Human
cugccugggaucccucauccu

SEQ ID NO: 3305858 - RNA, 15 nt, Human
cugccugaagucaca

SEQ ID NO: 3305859 - RNA, 15 nt, Human
cugccugcccaggcc

SEQ ID NO: 3305860 - RNA, 16 nt, Human
cugccugcccaggccc

SEQ ID NO: 3305861 - RNA, 17 nt, Human
cugccugcccaggcccc

SEQ ID NO: 3305862 - RNA, 14 nt, Human
cugccucuucucua

SEQ ID NO: 3305863 - RNA, 15 nt, Human
cugccucuucucuac

SEQ ID NO: 3305864 - RNA, 16 nt, Human
cugguuccauggccuc

SEQ ID NO: 3305865 - RNA, 19 nt, Human
cuguaauccuagcacuuug

SEQ ID NO: 3305866 - RNA, 20 nt, Human
cuguaauccuagcacuuugg

SEQ ID NO: 3305867 - RNA, 15 nt, Human
cuguacaaaguagaa

SEQ ID NO: 3305868 - RNA, 22 nt, Human
cuguaauuugugauacaaugcu

SEQ ID NO: 3305869 - RNA, 13 nt, Human
cuguacaaaguag

SEQ ID NO: 3305870 - RNA, 23 nt, Human
cugguggcagcucaccucucccu

SEQ ID NO: 3305871 - RNA, 21 nt, Human
cugguggcagcucaccucucc

SEQ ID NO: 3305872 - RNA, 13 nt, Human
cugguggcagcug

SEQ ID NO: 3305873 - RNA, 19 nt, Human
cugggggcugggcagagga

SEQ ID NO: 3305874 - RNA, 18 nt, Human
cugggggcugggcagagg

SEQ ID NO: 3305875 - RNA, 15 nt, Human
cugggggaagaagcu

SEQ ID NO: 3305876 - RNA, 13 nt, Human
cugggggaagaag

SEQ ID NO: 3305877 - RNA, 23 nt, Human
cugggcuucaguggcagcugcuu

SEQ ID NO: 3305878 - RNA, 24 nt, Human
cugggcuucaguggcagcugcuuu

SEQ ID NO: 3305879 - RNA, 17 nt, Human
cuggguucuacccaggu

SEQ ID NO: 3305880 - RNA, 16 nt, Human
cuggguucuacccagg

SEQ ID NO: 3305881 - RNA, 15 nt, Human
cuggguucuacccag

SEQ ID NO: 3305882 - RNA, 14 nt, Human
cuggguucuaccca

SEQ ID NO: 3305883 - RNA, 20 nt, Human
cuggguaacuagggaagaua

SEQ ID NO: 3305884 - RNA, 22 nt, Human
cuggguaacuagggaagauaau

SEQ ID NO: 3305885 - RNA, 14 nt, Human
cuguccuacccacc

SEQ ID NO: 3305886 - RNA, 15 nt, Human
cuguccgagcuuuga

SEQ ID NO: 3305887 - RNA, 23 nt, Human
cugucucaaaaaaacacaaaagu

SEQ ID NO: 3305888 - RNA, 16 nt, Human
cugucucaaaaaaaga

SEQ ID NO: 3305889 - RNA, 18 nt, Human
cugucucaaaaaaagaaa

SEQ ID NO: 3305890 - RNA, 20 nt, Human
cugucccuuacgugaguccu

SEQ ID NO: 3305891 - RNA, 14 nt, Human
cuguccgagcuuug

SEQ ID NO: 3305892 - RNA, 22 nt, Human
cuguccccgcacugggcuuggg

SEQ ID NO: 3305893 - RNA, 19 nt, Human
cuguccccgcacugggcuu

SEQ ID NO: 3305894 - RNA, 18 nt, Human
cuguccccgcacugggcu

SEQ ID NO: 3305895 - RNA, 17 nt, Human
cuguccccgcacugggc

SEQ ID NO: 3305896 - RNA, 23 nt, Human
cuguaucccaugagccucagcau

SEQ ID NO: 3305897 - RNA, 22 nt, Human
cuguaucccaugagccucagca

SEQ ID NO: 3305898 - RNA, 13 nt, Human
cuguacagagccc

SEQ ID NO: 3305899 - RNA, 18 nt, Human
cugucuccauguuugaug

SEQ ID NO: 3305900 - RNA, 23 nt, Human
cugugaguacuacaguccuccca

SEQ ID NO: 3305901 - RNA, 21 nt, Human
cugugaguacuacaguccucc

SEQ ID NO: 3305902 - RNA, 20 nt, Human
cugugaguacuacaguccuc

SEQ ID NO: 3305903 - RNA, 17 nt, Human
cugugauggggcccugc

SEQ ID NO: 3305904 - RNA, 18 nt, Human
cugugauggggcccugcc

SEQ ID NO: 3305905 - RNA, 19 nt, Human
cugugauggggcccugccu

SEQ ID NO: 3305906 - RNA, 14 nt, Human
cugugccauuuugu

SEQ ID NO: 3305907 - RNA, 16 nt, Human
cugugccaugugccag

SEQ ID NO: 3305908 - RNA, 18 nt, Human
cugugccaugugccaggu

SEQ ID NO: 3305909 - RNA, 22 nt, Human
cugugcugcccugcccaccugg

SEQ ID NO: 3305910 - RNA, 17 nt, Human
cugugccucugggacug

SEQ ID NO: 3305911 - RNA, 21 nt, Human
cugugcugcccugcccaccug

SEQ ID NO: 3305912 - RNA, 14 nt, Human
cugugccucuggga

SEQ ID NO: 3305913 - RNA, 16 nt, Human
cugugccucugggacu

SEQ ID NO: 3305914 - RNA, 14 nt, Human
cugugggcccccaa

SEQ ID NO: 3305915 - RNA, 17 nt, Human
cuguggaugauaaaaca

SEQ ID NO: 3305916 - RNA, 18 nt, Human
cugugugugcgccuacag

SEQ ID NO: 3305917 - RNA, 20 nt, Human
cugugugugcgccuacagga

SEQ ID NO: 3305918 - RNA, 21 nt, Human
cugugucuugcaauggcagcc

SEQ ID NO: 3305919 - RNA, 20 nt, Human
cugugucuugcaauggcagc

SEQ ID NO: 3305920 - RNA, 22 nt, Human
cugugucuugcaauggcagccu

SEQ ID NO: 3305921 - RNA, 21 nt, Human
cuguucagcugguugagguuu

SEQ ID NO: 3305922 - RNA, 19 nt, Human
cuguucagcugguugaggu

SEQ ID NO: 3305923 - RNA, 18 nt, Human
cuguucagcugguugagg

SEQ ID NO: 3305924 - RNA, 20 nt, Human
cuguucucugcccuccaaga

SEQ ID NO: 3305925 - RNA, 19 nt, Human
cuguucucugcccuccaag

SEQ ID NO: 3305926 - RNA, 18 nt, Human
cuguucucugcccuccaa

SEQ ID NO: 3305927 - RNA, 17 nt, Human
cuguucucugcccucca

SEQ ID NO: 3305928 - RNA, 16 nt, Human
cuguucucugcccucc

SEQ ID NO: 3305929 - RNA, 15 nt, Human
cuguucucugcccuc

SEQ ID NO: 3305930 - RNA, 14 nt, Human
cuguucucugcccu

SEQ ID NO: 3305931 - RNA, 13 nt, Human
cuguucucugccc

SEQ ID NO: 3305932 - RNA, 13 nt, Human
cuugaacuccugg

SEQ ID NO: 3305933 - RNA, 21 nt, Human
cuugaacuuugaccucugcag

SEQ ID NO: 3305934 - RNA, 17 nt, Human
cuugaacuuugaccucu

SEQ ID NO: 3305935 - RNA, 13 nt, Human
cuugaccucaggu

SEQ ID NO: 3305936 - RNA, 21 nt, Human
cuugaccgugaggccagagac

SEQ ID NO: 3305937 - RNA, 20 nt, Human
cuugaccgugaggccagaga

SEQ ID NO: 3305938 - RNA, 18 nt, Human
cuugaccgugaggccaga

SEQ ID NO: 3305939 - RNA, 23 nt, Human
cuugaccauucuccaccugccag

SEQ ID NO: 3305940 - RNA, 22 nt, Human
cuugaccauucuccaccugcca

SEQ ID NO: 3305941 - RNA, 17 nt, Human
cuugaccgugaggccag

SEQ ID NO: 3305942 - RNA, 21 nt, Human
cuugaccauucuccaccugcc

SEQ ID NO: 3305943 - RNA, 16 nt, Human
cuugagccugggaggu

SEQ ID NO: 3305944 - RNA, 18 nt, Human
cuugagccuugaacuuug

SEQ ID NO: 3305945 - RNA, 17 nt, Human
cuugagccuugaacuuu

SEQ ID NO: 3305946 - RNA, 15 nt, Human
cuugagccuugaacu

SEQ ID NO: 3305947 - RNA, 13 nt, Human
cuugagcucagga

SEQ ID NO: 3305948 - RNA, 21 nt, Human
cuugaggguugggcugguguc

SEQ ID NO: 3305949 - RNA, 21 nt, Human
cuugaguugauucagcucugc

SEQ ID NO: 3305950 - RNA, 17 nt, Human
cuugaggguugggcugg

SEQ ID NO: 3305951 - RNA, 19 nt, Human
cuugaggguugggcuggug

SEQ ID NO: 3305952 - RNA, 20 nt, Human
cuugaggguugggcuggugu

SEQ ID NO: 3305953 - RNA, 13 nt, Human
cuucuguggguuu

SEQ ID NO: 3305954 - RNA, 21 nt, Human
cuucuguggguuucuaaagcu

SEQ ID NO: 3305955 - RNA, 14 nt, Human
cuucuguggguuuc

SEQ ID NO: 3305956 - RNA, 23 nt, Human
cuugaaaacacuguucucugccc

SEQ ID NO: 3305957 - RNA, 14 nt, Human
cuugaaaacacugu

SEQ ID NO: 3305958 - RNA, 21 nt, Human
cuucuguccuacucuguguca

SEQ ID NO: 3305959 - RNA, 16 nt, Human
cuucuguccuacucug

SEQ ID NO: 3305960 - RNA, 17 nt, Human
cuucuguccuacucugu

SEQ ID NO: 3305961 - RNA, 18 nt, Human
cuucuguccuacucugug

SEQ ID NO: 3305962 - RNA, 19 nt, Human
cuucuguccuacucugugu

SEQ ID NO: 3305963 - RNA, 21 nt, Human
cuucuguacgucugacaggca

SEQ ID NO: 3305964 - RNA, 14 nt, Human
cuucuguacgucug

SEQ ID NO: 3305965 - RNA, 15 nt, Human
cuucuguacgucuga

SEQ ID NO: 3305966 - RNA, 18 nt, Human
cuucuguacgucugacag

SEQ ID NO: 3305967 - RNA, 20 nt, Human
cuucuguacgucugacaggc

SEQ ID NO: 3305968 - RNA, 20 nt, Human
cuucuccacuuucuagccag

SEQ ID NO: 3305969 - RNA, 11 nt, Human
cuucuccacuu

SEQ ID NO: 3305970 - RNA, 12 nt, Human
cuucuccaggcu

SEQ ID NO: 3305971 - RNA, 13 nt, Human
cuucuccaggcug

SEQ ID NO: 3305972 - RNA, 12 nt, Human
cuucucuccagc

SEQ ID NO: 3305973 - RNA, 19 nt, Human
cuucucuccagccccugga

SEQ ID NO: 3305974 - RNA, 17 nt, Human
cuucucuccagccccug

SEQ ID NO: 3305975 - RNA, 15 nt, Human
cuucucuccagcccc

SEQ ID NO: 3305976 - RNA, 13 nt, Human
cuucucuccagcc

SEQ ID NO: 3305977 - RNA, 13 nt, Human
cuucucugaagga

SEQ ID NO: 3305978 - RNA, 20 nt, Human
cuucugccauuucugagauc

SEQ ID NO: 3305979 - RNA, 13 nt, Human
cuuagauguauau

SEQ ID NO: 3305980 - RNA, 16 nt, Human
cuuagucacugagaca

SEQ ID NO: 3305981 - RNA, 16 nt, Human
cuguucuggcagaguu

SEQ ID NO: 3305982 - RNA, 14 nt, Human
cuuagucacugaga

SEQ ID NO: 3305983 - RNA, 19 nt, Human
cuuagucacugagacagcc

SEQ ID NO: 3305984 - RNA, 18 nt, Human
cuuagucacugagacagc

SEQ ID NO: 3305985 - RNA, 15 nt, Human
cuuauacauuugaua

SEQ ID NO: 3305986 - RNA, 18 nt, Human
cuuauuuaaugaaagacu

SEQ ID NO: 3305987 - RNA, 15 nt, Human
cuuauuuaaugaaag

SEQ ID NO: 3305988 - RNA, 17 nt, Human
cuuauuuaaugaaagac

SEQ ID NO: 3305989 - RNA, 10 nt, Human
cuucaaggau

SEQ ID NO: 3305990 - RNA, 15 nt, Human
cuucaaggauccuga

SEQ ID NO: 3305991 - RNA, 13 nt, Human
cuucaaggauccu

SEQ ID NO: 3305992 - RNA, 23 nt, Human
cuucacagaugggugcuuggagg

SEQ ID NO: 3305993 - RNA, 14 nt, Human
cuuccaggcuggga

SEQ ID NO: 3305994 - RNA, 12 nt, Human
cuuccaggcugg

SEQ ID NO: 3305995 - RNA, 16 nt, Human
cuuccacaagagccca

SEQ ID NO: 3305996 - RNA, 17 nt, Human
cuuccacaagagcccag

SEQ ID NO: 3305997 - RNA, 21 nt, Human
cuuccacaagagcccaggccu

SEQ ID NO: 3305998 - RNA, 19 nt, Human
cuuccacaagagcccaggc

SEQ ID NO: 3305999 - RNA, 20 nt, Human
cuucauucaacccaccugcg

SEQ ID NO: 3306000 - RNA, 15 nt, Human
cuucaguaagccgug

SEQ ID NO: 3306001 - RNA, 14 nt, Human
cuucagugccuuau

SEQ ID NO: 3306002 - RNA, 22 nt, Human
cuucagugccuuauggaacacu

SEQ ID NO: 3306003 - RNA, 18 nt, Human
cuucagugccuuauggaa

SEQ ID NO: 3306004 - RNA, 13 nt, Human
cuucaguggcagc

SEQ ID NO: 3306005 - RNA, 14 nt, Human
cuucaguggcagcu

SEQ ID NO: 3306006 - RNA, 15 nt, Human
cuucaguggcagcug

SEQ ID NO: 3306007 - RNA, 16 nt, Human
cuucaguggcagcugc

SEQ ID NO: 3306008 - RNA, 23 nt, Human
cuucaguaagccgugauuuucau

SEQ ID NO: 3306009 - RNA, 16 nt, Human
cuucaguaagccguga

SEQ ID NO: 3306010 - RNA, 17 nt, Human
cuuccaggggugggaca

SEQ ID NO: 3306011 - RNA, 15 nt, Human
cuuccagggguggga

SEQ ID NO: 3306012 - RNA, 14 nt, Human
cuuccagggguggg

SEQ ID NO: 3306013 - RNA, 19 nt, Human
cuuccaggcugggagagcc

SEQ ID NO: 3306014 - RNA, 16 nt, Human
cuuccaggcugggaga

SEQ ID NO: 3306015 - RNA, 15 nt, Human
cuuccaggcugggag

SEQ ID NO: 3306016 - RNA, 17 nt, Human
gaaagcccugagcuuuc

SEQ ID NO: 3306017 - RNA, 22 nt, Human
gaaagcccugagcuuucugcua

SEQ ID NO: 3306018 - RNA, 21 nt, Human
gaaagcccugagcuuucugcu

SEQ ID NO: 3306019 - RNA, 19 nt, Human
gaaagacuuuuccaacccu

SEQ ID NO: 3306020 - RNA, 17 nt, Human
gaaagacuguacaaagu

SEQ ID NO: 3306021 - RNA, 15 nt, Human
gaaagaguaggaaga

SEQ ID NO: 3306022 - RNA, 23 nt, Human
gaaacccagcucugguccauaga

SEQ ID NO: 3306023 - RNA, 14 nt, Human
gaaacccagcucug

SEQ ID NO: 3306024 - RNA, 13 nt, Human
gaaacccagcucu

SEQ ID NO: 3306025 - RNA, 19 nt, Human
gaaacccagcucuggucca

SEQ ID NO: 3306026 - RNA, 18 nt, Human
gaaacccagcucuggucc

SEQ ID NO: 3306027 - RNA, 16 nt, Human
gaaacccagcucuggu

SEQ ID NO: 3306028 - RNA, 15 nt, Human
gaaacccagcucugg

SEQ ID NO: 3306029 - RNA, 18 nt, Human
gaaaaucagccugcucca

SEQ ID NO: 3306030 - RNA, 22 nt, Human
gaaaaucagccugcuccagcug

SEQ ID NO: 3306031 - RNA, 20 nt, Human
gaaaaucagccugcuccagc

SEQ ID NO: 3306032 - RNA, 24 nt, Human
gaaaacacuguucucugcccucca

SEQ ID NO: 3306033 - RNA, 22 nt, Human
gaaaacacuguucucugcccuc

SEQ ID NO: 3306034 - RNA, 19 nt, Human
gaaaagcugcugacagugu

SEQ ID NO: 3306035 - RNA, 19 nt, Human
gaaaacguggcugcuucaa

SEQ ID NO: 3306036 - RNA, 22 nt, Human
gaaaacguggcugcuucaagga

SEQ ID NO: 3306037 - RNA, 20 nt, Human
gaaaacguggcugcuucaag

SEQ ID NO: 3306038 - RNA, 18 nt, Human
cuuuguuaguuucuccaa

SEQ ID NO: 3306039 - RNA, 12 nt, Human
cuuuuguucuug

SEQ ID NO: 3306040 - RNA, 11 nt, Human
cuuuuguucuu

SEQ ID NO: 3306041 - RNA, 16 nt, Human
cuuuuuuggcugcuga

SEQ ID NO: 3306042 - RNA, 15 nt, Human
gaaaaaggaggaaga

SEQ ID NO: 3306043 - RNA, 12 nt, Human
gaaaaaggagga

SEQ ID NO: 3306044 - RNA, 19 nt, Human
gaaaacacauuuuucuuag

SEQ ID NO: 3306045 - RNA, 18 nt, Human
gaaaacacauuuuucuua

SEQ ID NO: 3306046 - RNA, 14 nt, Human
gaaaacacauuuuu

SEQ ID NO: 3306047 - RNA, 17 nt, Human
cuuuuuuggcugcugaa

SEQ ID NO: 3306048 - RNA, 22 nt, Human
cuuuuuuggcugcugaaggcuc

SEQ ID NO: 3306049 - RNA, 20 nt, Human
cuuuuuuggcugcugaaggc

SEQ ID NO: 3306050 - RNA, 20 nt, Human
cuuucuggcuaugcauuuga

SEQ ID NO: 3306051 - RNA, 19 nt, Human
cuuucuggcuaugcauuug

SEQ ID NO: 3306052 - RNA, 18 nt, Human
cuuucuggcuaugcauuu

SEQ ID NO: 3306053 - RNA, 17 nt, Human
cuuucuggcuaugcauu

SEQ ID NO: 3306054 - RNA, 15 nt, Human
cuuuccugaggcugg

SEQ ID NO: 3306055 - RNA, 13 nt, Human
cuuuccugaggcu

SEQ ID NO: 3306056 - RNA, 16 nt, Human
cuuuccucuuuggucu

SEQ ID NO: 3306057 - RNA, 12 nt, Human
cuuuccugaggc

SEQ ID NO: 3306058 - RNA, 11 nt, Human
cuuucccuccc

SEQ ID NO: 3306059 - RNA, 13 nt, Human
cuuucccucccuu

SEQ ID NO: 3306060 - RNA, 14 nt, Human
cuuucccucccuuc

SEQ ID NO: 3306061 - RNA, 16 nt, Human
cuuucccucccuuccu

SEQ ID NO: 3306062 - RNA, 15 nt, Human
cuuuccaggaaggcu

SEQ ID NO: 3306063 - RNA, 15 nt, Human
cuuuccaucuacccu

SEQ ID NO: 3306064 - RNA, 20 nt, Human
cuuugcagacaggcaagcac

SEQ ID NO: 3306065 - RNA, 16 nt, Human
cuuugcagacaggcaa

SEQ ID NO: 3306066 - RNA, 13 nt, Human
cuuugaccucugc

SEQ ID NO: 3306067 - RNA, 15 nt, Human
cuuugaccucugcag

SEQ ID NO: 3306068 - RNA, 14 nt, Human
cuuugaccucugca

SEQ ID NO: 3306069 - RNA, 24 nt, Human
cuuugaccucugcagcaauaaagc

SEQ ID NO: 3306070 - RNA, 20 nt, Human
cuuugaccucugcagcaaua

SEQ ID NO: 3306071 - RNA, 18 nt, Human
cuuugaccucugcagcaa

SEQ ID NO: 3306072 - RNA, 17 nt, Human
cuuugaccucugcagca

SEQ ID NO: 3306073 - RNA, 15 nt, Human
cuuugugaggaagcc

SEQ ID NO: 3306074 - RNA, 19 nt, Human
cuuugugauuuuuguaauu

SEQ ID NO: 3306075 - RNA, 14 nt, Human
cuuuguccccaccg

SEQ ID NO: 3306076 - RNA, 19 nt, Human
cuuuggcuauuagagauca

SEQ ID NO: 3306077 - RNA, 23 nt, Human
cuuggggggcugaggugggagga

SEQ ID NO: 3306078 - RNA, 16 nt, Human
cuuguaaauagcucag

SEQ ID NO: 3306079 - RNA, 22 nt, Human
cuuggggggcugaggugggagg

SEQ ID NO: 3306080 - RNA, 17 nt, Human
cuuguaaauagcucagg

SEQ ID NO: 3306081 - RNA, 18 nt, Human
cuuguaaauagcucaggu

SEQ ID NO: 3306082 - RNA, 12 nt, Human
cuuguacauaau

SEQ ID NO: 3306083 - RNA, 15 nt, Human
cuuguacauaaugcg

SEQ ID NO: 3306084 - RNA, 21 nt, Human
cuuguacauaaugcgugcaua

SEQ ID NO: 3306085 - RNA, 19 nt, Human
cuuguacauaaugcgugca

SEQ ID NO: 3306086 - RNA, 22 nt, Human
cuuguacauaaugcgugcauac

SEQ ID NO: 3306087 - RNA, 14 nt, Human
cuuuagcgcccagu

SEQ ID NO: 3306088 - RNA, 13 nt, Human
cuuuauaauucua

SEQ ID NO: 3306089 - RNA, 19 nt, Human
cuuuauaauucuacuuuga

SEQ ID NO: 3306090 - RNA, 15 nt, Human
cuuuaugcacaaaau

SEQ ID NO: 3306091 - RNA, 13 nt, Human
cuuuacuauggcc

SEQ ID NO: 3306092 - RNA, 22 nt, Human
cuuuaccuuuuuuauacauaaa

SEQ ID NO: 3306093 - RNA, 23 nt, Human
gauguuuuccaugaguccccugu

SEQ ID NO: 3306094 - RNA, 22 nt, Human
gauuacaagcgugagccacugc

SEQ ID NO: 3306095 - RNA, 15 nt, Human
gauuaaacuuaaucu

SEQ ID NO: 3306096 - RNA, 23 nt, Human
gauuacaagcgugagccacugca

SEQ ID NO: 3306097 - RNA, 21 nt, Human
gauuacaagcgugagccacug

SEQ ID NO: 3306098 - RNA, 14 nt, Human
gauggugcaaugac

SEQ ID NO: 3306099 - RNA, 12 nt, Human
gauggugcaaug

SEQ ID NO: 3306100 - RNA, 16 nt, Human
gauggugcaaugaccu

SEQ ID NO: 3306101 - RNA, 15 nt, Human
gauggugcaaugacc

SEQ ID NO: 3306102 - RNA, 20 nt, Human
gaugcccaaagaugcagccg

SEQ ID NO: 3306103 - RNA, 19 nt, Human
gaugcccaaagaugcagcc

SEQ ID NO: 3306104 - RNA, 19 nt, Human
gaugggugcuuggaggaag

SEQ ID NO: 3306105 - RNA, 13 nt, Human
gauggggcugcac

SEQ ID NO: 3306106 - RNA, 15 nt, Human
gauggggcugcaccg

SEQ ID NO: 3306107 - RNA, 20 nt, Human
gaugggcaacccccagccug

SEQ ID NO: 3306108 - RNA, 21 nt, Human
gaugggcaacccccagccugc

SEQ ID NO: 3306109 - RNA, 24 nt, Human
gauggggcccugccuccuuuguga

SEQ ID NO: 3306110 - RNA, 18 nt, Human
gauuuccguuaaaauacc

SEQ ID NO: 3306111 - RNA, 22 nt, Human
gauuuccguuaaaauaccagcc

SEQ ID NO: 3306112 - RNA, 15 nt, Human
gauuuaacagaaaug

SEQ ID NO: 3306113 - RNA, 12 nt, Human
gauuuaaaucag

SEQ ID NO: 3306114 - RNA, 14 nt, Human
gauuuaacagaaau

SEQ ID NO: 3306115 - RNA, 13 nt, Human
gauuuaacagaaa

SEQ ID NO: 3306116 - RNA, 19 nt, Human
gauuuugauccaagcuggu

SEQ ID NO: 3306117 - RNA, 21 nt, Human
gauuuugaaauuuuuauuaaa

SEQ ID NO: 3306118 - RNA, 12 nt, Human
gcaaaccaucau

SEQ ID NO: 3306119 - RNA, 22 nt, Human
gcacugcuuccagugaggcucu

SEQ ID NO: 3306120 - RNA, 23 nt, Human
gcacugcuuccagugaggcucug

SEQ ID NO: 3306121 - RNA, 16 nt, Human
gcacgauuucuguuua

SEQ ID NO: 3306122 - RNA, 18 nt, Human
gcagaaggaagacuucau

SEQ ID NO: 3306123 - RNA, 13 nt, Human
gcagacaggcaag

SEQ ID NO: 3306124 - RNA, 12 nt, Human
gcagacaggcaa

SEQ ID NO: 3306125 - RNA, 18 nt, Human
gcagacaggaccagggau

SEQ ID NO: 3306126 - RNA, 22 nt, Human
gcacagaguuguuacauuuuua

SEQ ID NO: 3306127 - RNA, 21 nt, Human
gcacagaguuguuacauuuuu

SEQ ID NO: 3306128 - RNA, 19 nt, Human
gcacagaguuguuacauuu

SEQ ID NO: 3306129 - RNA, 18 nt, Human
gcacagaguuguuacauu

SEQ ID NO: 3306130 - RNA, 16 nt, Human
gcacagaguuguuaca

SEQ ID NO: 3306131 - RNA, 19 nt, Human
gcaccuuagacagucccug

SEQ ID NO: 3306132 - RNA, 15 nt, Human
gcacgauuucuguuu

SEQ ID NO: 3306133 - RNA, 13 nt, Human
gcacgauuucugu

SEQ ID NO: 3306134 - RNA, 21 nt, Human
gcaccuuagacagucccugcc

SEQ ID NO: 3306135 - RNA, 20 nt, Human
gcaccuuagacagucccugc

SEQ ID NO: 3306136 - RNA, 12 nt, Human
gcaccauaacuu

SEQ ID NO: 3306137 - RNA, 16 nt, Human
gcacaaacagaggccg

SEQ ID NO: 3306138 - RNA, 15 nt, Human
gcacaaacagaggcc

SEQ ID NO: 3306139 - RNA, 14 nt, Human
gcacaaacagaggc

SEQ ID NO: 3306140 - RNA, 15 nt, Human
gcaauggcagccuug

SEQ ID NO: 3306141 - RNA, 14 nt, Human
gcaacucaucuuag

SEQ ID NO: 3306142 - RNA, 14 nt, Human
gcaaugugauaaaa

SEQ ID NO: 3306143 - RNA, 23 nt, Human
gcacagaaaauggaagacagcuc

SEQ ID NO: 3306144 - RNA, 22 nt, Human
gcacagaaaauggaagacagcu

SEQ ID NO: 3306145 - RNA, 21 nt, Human
gcacagaaaauggaagacagc

SEQ ID NO: 3306146 - RNA, 17 nt, Human
gcacagacccugcccug

SEQ ID NO: 3306147 - RNA, 16 nt, Human
gcacagacccugcccu

SEQ ID NO: 3306148 - RNA, 15 nt, Human
gcacagacccugccc

SEQ ID NO: 3306149 - RNA, 14 nt, Human
gcacagacccugcc

SEQ ID NO: 3306150 - RNA, 21 nt, Human
gcacagacccugcccuguggg

SEQ ID NO: 3306151 - RNA, 20 nt, Human
gcacagacccugcccugugg

SEQ ID NO: 3306152 - RNA, 19 nt, Human
gcacagacccugcccugug

SEQ ID NO: 3306153 - RNA, 18 nt, Human
gcacagacccugcccugu

SEQ ID NO: 3306154 - RNA, 22 nt, Human
gcacagacccugcccugugggc

SEQ ID NO: 3306155 - RNA, 15 nt, Human
gcacagaguuguuac

SEQ ID NO: 3306156 - RNA, 20 nt, Human
gcacaccgggcacucagaag

SEQ ID NO: 3306157 - RNA, 20 nt, Human
gcacagaaaauggaagacag

SEQ ID NO: 3306158 - RNA, 17 nt, Human
gcacaagcuccaagcuc

SEQ ID NO: 3306159 - RNA, 15 nt, Human
gcacaagcuccaagc

SEQ ID NO: 3306160 - RNA, 18 nt, Human
gcacaagcuccaagcucc

SEQ ID NO: 3306161 - RNA, 16 nt, Human
gaggccuucucugaag

SEQ ID NO: 3306162 - RNA, 14 nt, Human
gaggccuucucuga

SEQ ID NO: 3306163 - RNA, 18 nt, Human
gaggccuucucugaagga

SEQ ID NO: 3306164 - RNA, 19 nt, Human
gaggccuucucugaaggac

SEQ ID NO: 3306165 - RNA, 14 nt, Human
gaggcugccucucc

SEQ ID NO: 3306166 - RNA, 16 nt, Human
gaggcugggcucccuu

SEQ ID NO: 3306167 - RNA, 14 nt, Human
gaggcccuucucuc

SEQ ID NO: 3306168 - RNA, 20 nt, Human
gaggcccuucucuccagccc

SEQ ID NO: 3306169 - RNA, 15 nt, Human
gaggcccuucucucc

SEQ ID NO: 3306170 - RNA, 21 nt, Human
gaggcccuucucuccagcccc

SEQ ID NO: 3306171 - RNA, 16 nt, Human
gaggcccagagggccu

SEQ ID NO: 3306172 - RNA, 15 nt, Human
gaggcccagagggcc

SEQ ID NO: 3306173 - RNA, 19 nt, Human
gaggcccagagggccugca

SEQ ID NO: 3306174 - RNA, 14 nt, Human
gaggcccagagggc

SEQ ID NO: 3306175 - RNA, 13 nt, Human
gaggcccagaggg

SEQ ID NO: 3306176 - RNA, 11 nt, Human
gaggcccagag

SEQ ID NO: 3306177 - RNA, 20 nt, Human
gaggcagccccauucugccu

SEQ ID NO: 3306178 - RNA, 9 nt, Human
gaggcaggg

SEQ ID NO: 3306179 - RNA, 19 nt, Human
gaggcagccccauucugcc

SEQ ID NO: 3306180 - RNA, 18 nt, Human
gaggcagccccauucugc

SEQ ID NO: 3306181 - RNA, 14 nt, Human
gaggccaugggccu

SEQ ID NO: 3306182 - RNA, 17 nt, Human
gaggccaugggccuccu

SEQ ID NO: 3306183 - RNA, 18 nt, Human
gaggccaugggccuccug

SEQ ID NO: 3306184 - RNA, 20 nt, Human
gaggccaugggccuccugug

SEQ ID NO: 3306185 - RNA, 21 nt, Human
gaggccaugggccuccugugu

SEQ ID NO: 3306186 - RNA, 23 nt, Human
gaggccaugggccuccugugugu

SEQ ID NO: 3306187 - RNA, 20 nt, Human
gaggauugcuugagcucagg

SEQ ID NO: 3306188 - RNA, 16 nt, Human
gaggauugcuugagcu

SEQ ID NO: 3306189 - RNA, 22 nt, Human
gaggaucucuugagccugggag

SEQ ID NO: 3306190 - RNA, 19 nt, Human
gaggaucucuugagccugg

SEQ ID NO: 3306191 - RNA, 16 nt, Human
gaggaucucuugagcc

SEQ ID NO: 3306192 - RNA, 13 nt, Human
gaggaucucuuga

SEQ ID NO: 3306193 - RNA, 14 nt, Human
gaggguugggcugg

SEQ ID NO: 3306194 - RNA, 15 nt, Human
gaggguugggcuggu

SEQ ID NO: 3306195 - RNA, 24 nt, Human
gagguaaggaauaccugucccccu

SEQ ID NO: 3306196 - RNA, 21 nt, Human
gagguaaggaauaccuguccc

SEQ ID NO: 3306197 - RNA, 12 nt, Human
gaggucagagcc

SEQ ID NO: 3306198 - RNA, 13 nt, Human
gaggucagagccu

SEQ ID NO: 3306199 - RNA, 17 nt, Human
gaggucaaggcugcagu

SEQ ID NO: 3306200 - RNA, 12 nt, Human
gaggguggaaua

SEQ ID NO: 3306201 - RNA, 21 nt, Human
gagggugaagugaagacaaug

SEQ ID NO: 3306202 - RNA, 14 nt, Human
gaggguggugaccu

SEQ ID NO: 3306203 - RNA, 15 nt, Human
gagggugggaguggg

SEQ ID NO: 3306204 - RNA, 21 nt, Human
gaggguggugaccucugccug

SEQ ID NO: 3306205 - RNA, 22 nt, Human
gagggugucccaaaaagaaagg

SEQ ID NO: 3306206 - RNA, 13 nt, Human
gagggucugagga

SEQ ID NO: 3306207 - RNA, 14 nt, Human
gagggucugaggaa

SEQ ID NO: 3306208 - RNA, 17 nt, Human
gaggggguggccuccca

SEQ ID NO: 3306209 - RNA, 15 nt, Human
gaggggguggccucc

SEQ ID NO: 3306210 - RNA, 13 nt, Human
gaggguaaggcug

SEQ ID NO: 3306211 - RNA, 21 nt, Human
gagggagugacagaggcagcc

SEQ ID NO: 3306212 - RNA, 22 nt, Human
gagggagugacagaggcagccc

SEQ ID NO: 3306213 - RNA, 18 nt, Human
gagggagugacagaggca

SEQ ID NO: 3306214 - RNA, 16 nt, Human
gagggagugacagagg

SEQ ID NO: 3306215 - RNA, 16 nt, Human
gagggagggcuccaga

SEQ ID NO: 3306216 - RNA, 20 nt, Human
gagggagggcuccagacaca

SEQ ID NO: 3306217 - RNA, 19 nt, Human
gagggagggcuccagacac

SEQ ID NO: 3306218 - RNA, 20 nt, Human
gaggcugggcucccuuccca

SEQ ID NO: 3306219 - RNA, 17 nt, Human
gagugaagcugggagaa

SEQ ID NO: 3306220 - RNA, 14 nt, Human
gagugacagaggca

SEQ ID NO: 3306221 - RNA, 15 nt, Human
gagugacagaggcag

SEQ ID NO: 3306222 - RNA, 16 nt, Human
gagugacagaggcagc

SEQ ID NO: 3306223 - RNA, 14 nt, Human
gagucugaaggcug

SEQ ID NO: 3306224 - RNA, 13 nt, Human
gagucugaaggcu

SEQ ID NO: 3306225 - RNA, 12 nt, Human
gagucugaaggc

SEQ ID NO: 3306226 - RNA, 11 nt, Human
gaguauauguc

SEQ ID NO: 3306227 - RNA, 19 nt, Human
gaguaggaagacuuuggaa

SEQ ID NO: 3306228 - RNA, 18 nt, Human
gaguaggaagacuuugga

SEQ ID NO: 3306229 - RNA, 15 nt, Human
gagucgaggacaggg

SEQ ID NO: 3306230 - RNA, 19 nt, Human
gaguccgaaagggacuugg

SEQ ID NO: 3306231 - RNA, 14 nt, Human
gagucgaggacagg

SEQ ID NO: 3306232 - RNA, 19 nt, Human
gaguagcugggacuacagg

SEQ ID NO: 3306233 - RNA, 22 nt, Human
gaguagcugggacuacaggcac

SEQ ID NO: 3306234 - RNA, 12 nt, Human
gaguaggaagac

SEQ ID NO: 3306235 - RNA, 17 nt, Human
gaguaggaagacuuugg

SEQ ID NO: 3306236 - RNA, 13 nt, Human
gaguaggaagacu

SEQ ID NO: 3306237 - RNA, 23 nt, Human
gaguacuacaguccucccaucuc

SEQ ID NO: 3306238 - RNA, 21 nt, Human
gaguacuacaguccucccauc

SEQ ID NO: 3306239 - RNA, 20 nt, Human
gaguacuacaguccucccau

SEQ ID NO: 3306240 - RNA, 17 nt, Human
gaggucagagccugcag

SEQ ID NO: 3306241 - RNA, 20 nt, Human
gaggucagagccugcaguua

SEQ ID NO: 3306242 - RNA, 16 nt, Human
gagguuucaaaccucc

SEQ ID NO: 3306243 - RNA, 17 nt, Human
gagguugggaggccauu

SEQ ID NO: 3306244 - RNA, 15 nt, Human
gagguugggaggcca

SEQ ID NO: 3306245 - RNA, 19 nt, Human
gauacaggaaaagcugcug

SEQ ID NO: 3306246 - RNA, 21 nt, Human
gauacaggaaaagcugcugac

SEQ ID NO: 3306247 - RNA, 20 nt, Human
gauacaggaaaagcugcuga

SEQ ID NO: 3306248 - RNA, 22 nt, Human
gauaagaaccuuuugagugccu

SEQ ID NO: 3306249 - RNA, 15 nt, Human
gauagcacagacccu

SEQ ID NO: 3306250 - RNA, 14 nt, Human
gauagccaaggcca

SEQ ID NO: 3306251 - RNA, 22 nt, Human
gauagccaaggccaaaggaagc

SEQ ID NO: 3306252 - RNA, 12 nt, Human
gaucacggcuca

SEQ ID NO: 3306253 - RNA, 18 nt, Human
gaucacggcucacugcag

SEQ ID NO: 3306254 - RNA, 15 nt, Human
gaucacggcucacug

SEQ ID NO: 3306255 - RNA, 16 nt, Human
gaucacggcucacugc

SEQ ID NO: 3306256 - RNA, 20 nt, Human
gagugugccugaagucccag

SEQ ID NO: 3306257 - RNA, 17 nt, Human
gagugugccugaagucc

SEQ ID NO: 3306258 - RNA, 12 nt, Human
gaguuacagaca

SEQ ID NO: 3306259 - RNA, 13 nt, Human
gagugggugaaua

SEQ ID NO: 3306260 - RNA, 23 nt, Human
gagugggggaucacagccucuga

SEQ ID NO: 3306261 - RNA, 14 nt, Human
gaguugaagacaga

SEQ ID NO: 3306262 - RNA, 21 nt, Human
gaguugaagacagagcuacac

SEQ ID NO: 3306263 - RNA, 17 nt, Human
gaguugaagacagagcu

SEQ ID NO: 3306264 - RNA, 15 nt, Human
gaguugaagacagag

SEQ ID NO: 3306265 - RNA, 20 nt, Human
gaguucauacccuguuacca

SEQ ID NO: 3306266 - RNA, 14 nt, Human
gaguucaucuugaa

SEQ ID NO: 3306267 - RNA, 19 nt, Human
gaguucaucuugaauugua

SEQ ID NO: 3306268 - RNA, 15 nt, Human
gaguuacagacaaag

SEQ ID NO: 3306269 - RNA, 13 nt, Human
gaguuacagacaa

SEQ ID NO: 3306270 - RNA, 23 nt, Human
gacauacuaaccagcagaaaugc

SEQ ID NO: 3306271 - RNA, 14 nt, Human
gacaugaucuucuu

SEQ ID NO: 3306272 - RNA, 14 nt, Human
gacaugggaaaggg

SEQ ID NO: 3306273 - RNA, 14 nt, Human
gacaggaccaggga

SEQ ID NO: 3306274 - RNA, 23 nt, Human
gacaggaccagggauuuccauga

SEQ ID NO: 3306275 - RNA, 15 nt, Human
gacaggaccagggau

SEQ ID NO: 3306276 - RNA, 16 nt, Human
gacagggaggugaccc

SEQ ID NO: 3306277 - RNA, 23 nt, Human
gacagggcacaccgggcacucag

SEQ ID NO: 3306278 - RNA, 14 nt, Human
gacaguuaagagaa

SEQ ID NO: 3306279 - RNA, 13 nt, Human
gacagccacggcc

SEQ ID NO: 3306280 - RNA, 13 nt, Human
gacagagggggug

SEQ ID NO: 3306281 - RNA, 20 nt, Human
gacagagugagacucugucu

SEQ ID NO: 3306282 - RNA, 22 nt, Human
gacagagugagacucugucuca

SEQ ID NO: 3306283 - RNA, 14 nt, Human
gacagccacggcca

SEQ ID NO: 3306284 - RNA, 17 nt, Human
gacagccacggccaggc

SEQ ID NO: 3306285 - RNA, 18 nt, Human
gacagccacggccaggcc

SEQ ID NO: 3306286 - RNA, 19 nt, Human
gacagccacggccaggcca

SEQ ID NO: 3306287 - RNA, 18 nt, Human
gacagcugccugggaucc

SEQ ID NO: 3306288 - RNA, 20 nt, Human
gacagccacggccaggccag

SEQ ID NO: 3306289 - RNA, 21 nt, Human
gacagccacggccaggccaga

SEQ ID NO: 3306290 - RNA, 17 nt, Human
gacagcugccugggauc

SEQ ID NO: 3306291 - RNA, 16 nt, Human
gacagcugccugggau

SEQ ID NO: 3306292 - RNA, 17 nt, Human
gacagaggcagccccau

SEQ ID NO: 3306293 - RNA, 15 nt, Human
gacagaggggguggc

SEQ ID NO: 3306294 - RNA, 19 nt, Human
gacagaggggguggccucc

SEQ ID NO: 3306295 - RNA, 18 nt, Human
gacagaggggguggccuc

SEQ ID NO: 3306296 - RNA, 23 nt, Human
gacagaggggguggccucccaac

SEQ ID NO: 3306297 - RNA, 19 nt, Human
gacagagugagacucuguc

SEQ ID NO: 3306298 - RNA, 22 nt, Human
gacagaggggguggccucccaa

SEQ ID NO: 3306299 - RNA, 21 nt, Human
gacagaggggguggccuccca

SEQ ID NO: 3306300 - RNA, 12 nt, Human
gacagaggcagc

SEQ ID NO: 3306301 - RNA, 14 nt, Human
gacagaggcagccc

SEQ ID NO: 3306302 - RNA, 16 nt, Human
gacagaggcagcccca

SEQ ID NO: 3306303 - RNA, 21 nt, Human
gacagagcaagugagacccug

SEQ ID NO: 3306304 - RNA, 13 nt, Human
gaccccuccaugu

SEQ ID NO: 3306305 - RNA, 23 nt, Human
gacccugaggcccagagggccug

SEQ ID NO: 3306306 - RNA, 14 nt, Human
gaccccuccaugug

SEQ ID NO: 3306307 - RNA, 18 nt, Human
gaccccuccaugugggcu

SEQ ID NO: 3306308 - RNA, 21 nt, Human
gaccccuccaugugggcuagu

SEQ ID NO: 3306309 - RNA, 22 nt, Human
gacccugaggcccagagggccu

SEQ ID NO: 3306310 - RNA, 12 nt, Human
gacccugucuca

SEQ ID NO: 3306311 - RNA, 20 nt, Human
gacccuuguggucccacccc

SEQ ID NO: 3306312 - RNA, 19 nt, Human
gacccuuguggucccaccc

SEQ ID NO: 3306313 - RNA, 21 nt, Human
gacccuuguggucccacccca

SEQ ID NO: 3306314 - RNA, 15 nt, Human
gacccuugugguccc

SEQ ID NO: 3306315 - RNA, 17 nt, Human
gaccgugaggccagaga

SEQ ID NO: 3306316 - RNA, 16 nt, Human
gaccgugaggccagag

SEQ ID NO: 3306317 - RNA, 18 nt, Human
gaccgugaggccagagac

SEQ ID NO: 3306318 - RNA, 15 nt, Human
gaccgugaggccaga

SEQ ID NO: 3306319 - RNA, 14 nt, Human
gaccacguuucuaa

SEQ ID NO: 3306320 - RNA, 24 nt, Human
gaccagacaccuugacagggcaca

SEQ ID NO: 3306321 - RNA, 11 nt, Human
gaccagagcug

SEQ ID NO: 3306322 - RNA, 18 nt, Human
gacaugggaaaggggaag

SEQ ID NO: 3306323 - RNA, 20 nt, Human
gaccauucuccaccugccag

SEQ ID NO: 3306324 - RNA, 19 nt, Human
gaccauucuccaccugcca

SEQ ID NO: 3306325 - RNA, 17 nt, Human
gaccauucuccaccugc

SEQ ID NO: 3306326 - RNA, 22 nt, Human
gaccauucuccaccugccaggg

SEQ ID NO: 3306327 - RNA, 21 nt, Human
gaccauucuccaccugccagg

SEQ ID NO: 3306328 - RNA, 18 nt, Human
gaccagagcugccaccug

SEQ ID NO: 3306329 - RNA, 17 nt, Human
gaccagagcugccaccu

SEQ ID NO: 3306330 - RNA, 15 nt, Human
gaccagagcugccac

SEQ ID NO: 3306331 - RNA, 14 nt, Human
gaccagagcugcca

SEQ ID NO: 3306332 - RNA, 13 nt, Human
gaccagagcugcc

SEQ ID NO: 3306333 - RNA, 14 nt, Human
gaauugaagcagga

SEQ ID NO: 3306334 - RNA, 18 nt, Human
gaauccagacccggcugc

SEQ ID NO: 3306335 - RNA, 20 nt, Human
gaauccagacccggcugcgu

SEQ ID NO: 3306336 - RNA, 21 nt, Human
gaaugaaagggcccagagagg

SEQ ID NO: 3306337 - RNA, 20 nt, Human
gaaugcacaaacagaggccg

SEQ ID NO: 3306338 - RNA, 21 nt, Human
gaaugcacaaacagaggccgc

SEQ ID NO: 3306339 - RNA, 19 nt, Human
gacacaggcccggcuccag

SEQ ID NO: 3306340 - RNA, 16 nt, Human
gacacaagccuucggc

SEQ ID NO: 3306341 - RNA, 14 nt, Human
gacacaugcaaggu

SEQ ID NO: 3306342 - RNA, 20 nt, Human
gacacaggcccggcuccagg

SEQ ID NO: 3306343 - RNA, 21 nt, Human
gacacaggcccggcuccaggc

SEQ ID NO: 3306344 - RNA, 23 nt, Human
gacacauguccaagaagcccagg

SEQ ID NO: 3306345 - RNA, 20 nt, Human
gacacauguccaagaagccc

SEQ ID NO: 3306346 - RNA, 15 nt, Human
gacacauguccaaga

SEQ ID NO: 3306347 - RNA, 19 nt, Human
gacacaugcaaggucauuu

SEQ ID NO: 3306348 - RNA, 18 nt, Human
gacaaggauugcuacugu

SEQ ID NO: 3306349 - RNA, 21 nt, Human
gacaaggaugaucuaggaaga

SEQ ID NO: 3306350 - RNA, 19 nt, Human
gacaaggauugcuacuguc

SEQ ID NO: 3306351 - RNA, 20 nt, Human
gacaaugugaaaagaaaaau

SEQ ID NO: 3306352 - RNA, 19 nt, Human
gacaaugugaaaagaaaaa

SEQ ID NO: 3306353 - RNA, 22 nt, Human
gacaaugcaaaccaucauugaa

SEQ ID NO: 3306354 - RNA, 18 nt, Human
gacaaugugaaaagaaaa

SEQ ID NO: 3306355 - RNA, 12 nt, Human
gacaaugugaaa

SEQ ID NO: 3306356 - RNA, 23 nt, Human
gacaacacucauugaccugaggc

SEQ ID NO: 3306357 - RNA, 22 nt, Human
gacaacacucauugaccugagg

SEQ ID NO: 3306358 - RNA, 22 nt, Human
gaauuucuuuugccguuauuaa

SEQ ID NO: 3306359 - RNA, 22 nt, Human
gagaaugcacaaacagaggccg

SEQ ID NO: 3306360 - RNA, 23 nt, Human
gagaaugcacaaacagaggccgc

SEQ ID NO: 3306361 - RNA, 22 nt, Human
gagacaggguuuugccauguug

SEQ ID NO: 3306362 - RNA, 12 nt, Human
gagaccaucccu

SEQ ID NO: 3306363 - RNA, 14 nt, Human
gagaccaucccuga

SEQ ID NO: 3306364 - RNA, 21 nt, Human
gagaccaucccugaaggcccc

SEQ ID NO: 3306365 - RNA, 18 nt, Human
gagaccaucccugaaggc

SEQ ID NO: 3306366 - RNA, 18 nt, Human
gagacuccugcaggcagc

SEQ ID NO: 3306367 - RNA, 19 nt, Human
gagacuccugcaggcagcc

SEQ ID NO: 3306368 - RNA, 21 nt, Human
gagacuccugcaggcagccag

SEQ ID NO: 3306369 - RNA, 20 nt, Human
gagacuccugcaggcagcca

SEQ ID NO: 3306370 - RNA, 18 nt, Human
gagacucgcgacaaugca

SEQ ID NO: 3306371 - RNA, 21 nt, Human
gagacucgcgacaaugcaaac

SEQ ID NO: 3306372 - RNA, 20 nt, Human
gagacucgcgacaaugcaaa

SEQ ID NO: 3306373 - RNA, 19 nt, Human
gagaggggaacagacugga

SEQ ID NO: 3306374 - RNA, 18 nt, Human
gagaggggaacagacugg

SEQ ID NO: 3306375 - RNA, 13 nt, Human
gagaggggcacag

SEQ ID NO: 3306376 - RNA, 16 nt, Human
gagagggugggagugg

SEQ ID NO: 3306377 - RNA, 14 nt, Human
gagagggugggagu

SEQ ID NO: 3306378 - RNA, 19 nt, Human
gagaucacgccacugcacu

SEQ ID NO: 3306379 - RNA, 18 nt, Human
gagaucacgccacugcac

SEQ ID NO: 3306380 - RNA, 14 nt, Human
gagauagccaaggc

SEQ ID NO: 3306381 - RNA, 23 nt, Human
gagaucaaccccuucgcuccugu

SEQ ID NO: 3306382 - RNA, 16 nt, Human
gagauagccaaggcca

SEQ ID NO: 3306383 - RNA, 23 nt, Human
gagcaagacgcugugcugcccug

SEQ ID NO: 3306384 - RNA, 20 nt, Human
gagcaccuuagacagucccu

SEQ ID NO: 3306385 - RNA, 21 nt, Human
gagcacuaaggugugcucuga

SEQ ID NO: 3306386 - RNA, 19 nt, Human
gagcaccuuagacaguccc

SEQ ID NO: 3306387 - RNA, 15 nt, Human
gagcacuaaggugug

SEQ ID NO: 3306388 - RNA, 22 nt, Human
gagcaccuuagacagucccugc

SEQ ID NO: 3306389 - RNA, 21 nt, Human
gagcaccuuagacagucccug

SEQ ID NO: 3306390 - RNA, 16 nt, Human
gagcagagaauucucu

SEQ ID NO: 3306391 - RNA, 12 nt, Human
gagcagagacca

SEQ ID NO: 3306392 - RNA, 20 nt, Human
gagccagauuucacucuccu

SEQ ID NO: 3306393 - RNA, 19 nt, Human
gagccaauuuaaagaaaac

SEQ ID NO: 3306394 - RNA, 18 nt, Human
gagcccugguggcagugg

SEQ ID NO: 3306395 - RNA, 14 nt, Human
gagccagggucuca

SEQ ID NO: 3306396 - RNA, 23 nt, Human
gagccagauuucacucuccuugg

SEQ ID NO: 3306397 - RNA, 19 nt, Human
gagccagggucucacuaug

SEQ ID NO: 3306398 - RNA, 14 nt, Human
gagaaaugagcuug

SEQ ID NO: 3306399 - RNA, 16 nt, Human
gagaaagguugaagca

SEQ ID NO: 3306400 - RNA, 14 nt, Human
gagaagagaaugca

SEQ ID NO: 3306401 - RNA, 16 nt, Human
gagaagcagaggaagg

SEQ ID NO: 3306402 - RNA, 16 nt, Human
gagaagagaaugcaca

SEQ ID NO: 3306403 - RNA, 19 nt, Human
gacuuaagcacacuugaca

SEQ ID NO: 3306404 - RNA, 23 nt, Human
gacugaguacguugugcauuugg

SEQ ID NO: 3306405 - RNA, 13 nt, Human
gacugcccggcag

SEQ ID NO: 3306406 - RNA, 15 nt, Human
gacugcccggcaggg

SEQ ID NO: 3306407 - RNA, 18 nt, Human
gacugaguacguugugca

SEQ ID NO: 3306408 - RNA, 22 nt, Human
gacugaguacguugugcauuug

SEQ ID NO: 3306409 - RNA, 21 nt, Human
gacugaguacguugugcauuu

SEQ ID NO: 3306410 - RNA, 17 nt, Human
gacucgcgacaaugcaa

SEQ ID NO: 3306411 - RNA, 14 nt, Human
gacuggaagcacag

SEQ ID NO: 3306412 - RNA, 15 nt, Human
gacuggaagcacagc

SEQ ID NO: 3306413 - RNA, 16 nt, Human
gacuggaagcacagcu

SEQ ID NO: 3306414 - RNA, 18 nt, Human
gacuggaagcacagcuuc

SEQ ID NO: 3306415 - RNA, 13 nt, Human
gacucgcgacaau

SEQ ID NO: 3306416 - RNA, 21 nt, Human
gacuccugcaggcagccaggc

SEQ ID NO: 3306417 - RNA, 13 nt, Human
gacuccugcaggc

SEQ ID NO: 3306418 - RNA, 12 nt, Human
gacuccugcagg

SEQ ID NO: 3306419 - RNA, 13 nt, Human
gacuacaggugug

SEQ ID NO: 3306420 - RNA, 18 nt, Human
gacuacaggugugaguca

SEQ ID NO: 3306421 - RNA, 21 nt, Human
gacuacaggugugagucacca

SEQ ID NO: 3306422 - RNA, 14 nt, Human
gacucauucuucug

SEQ ID NO: 3306423 - RNA, 15 nt, Human
gacucauucuucugu

SEQ ID NO: 3306424 - RNA, 19 nt, Human
gccgagauagccaaggcca

SEQ ID NO: 3306425 - RNA, 14 nt, Human
gccucaaccuccug

SEQ ID NO: 3306426 - RNA, 16 nt, Human
gccucaaccuccuggg

SEQ ID NO: 3306427 - RNA, 19 nt, Human
gccucaagugauucuccug

SEQ ID NO: 3306428 - RNA, 20 nt, Human
gccucaagugauucuccugc

SEQ ID NO: 3306429 - RNA, 21 nt, Human
gccucaagugauucuccugcc

SEQ ID NO: 3306430 - RNA, 12 nt, Human
gccucagugcca

SEQ ID NO: 3306431 - RNA, 14 nt, Human
gccucagugccacu

SEQ ID NO: 3306432 - RNA, 23 nt, Human
gccucagccucccaaagugcugg

SEQ ID NO: 3306433 - RNA, 22 nt, Human
gccucagccucccaaagugcug

SEQ ID NO: 3306434 - RNA, 21 nt, Human
gccucacaguccuuaccagca

SEQ ID NO: 3306435 - RNA, 21 nt, Human
gccucccgaauagcugggacu

SEQ ID NO: 3306436 - RNA, 14 nt, Human
gccucccacgacug

SEQ ID NO: 3306437 - RNA, 21 nt, Human
gccucccacgacugcccggca

SEQ ID NO: 3306438 - RNA, 23 nt, Human
gccucccaacucaccccagcccc

SEQ ID NO: 3306439 - RNA, 22 nt, Human
gccucccaacucaccccagccc

SEQ ID NO: 3306440 - RNA, 15 nt, Human
gccucagugccacua

SEQ ID NO: 3306441 - RNA, 21 nt, Human
gccucccaacucaccccagcc

SEQ ID NO: 3306442 - RNA, 23 nt, Human
gccucccgaauagcugggacuac

SEQ ID NO: 3306443 - RNA, 15 nt, Human
gccucccgaguagcu

SEQ ID NO: 3306444 - RNA, 15 nt, Human
gccugcuccagcugu

SEQ ID NO: 3306445 - RNA, 13 nt, Human
gccugcuccagcu

SEQ ID NO: 3306446 - RNA, 18 nt, Human
gccugcuccagcuguuca

SEQ ID NO: 3306447 - RNA, 16 nt, Human
gccugcuccagcuguu

SEQ ID NO: 3306448 - RNA, 18 nt, Human
gccugaagucacacagug

SEQ ID NO: 3306449 - RNA, 22 nt, Human
gccugaagucacacagugaguc

SEQ ID NO: 3306450 - RNA, 18 nt, Human
gccucugccucugacaca

SEQ ID NO: 3306451 - RNA, 20 nt, Human
gccugggggcugggcagagg

SEQ ID NO: 3306452 - RNA, 17 nt, Human
gccugggcagaaggaag

SEQ ID NO: 3306453 - RNA, 16 nt, Human
gccugggcagaaggaa

SEQ ID NO: 3306454 - RNA, 11 nt, Human
gccugggcaga

SEQ ID NO: 3306455 - RNA, 14 nt, Human
gccuggauggggcu

SEQ ID NO: 3306456 - RNA, 15 nt, Human
gccuggauggggcug

SEQ ID NO: 3306457 - RNA, 15 nt, Human
gccugggcagaagga

SEQ ID NO: 3306458 - RNA, 14 nt, Human
gccuggccagaugc

SEQ ID NO: 3306459 - RNA, 15 nt, Human
gccuggccagaugca

SEQ ID NO: 3306460 - RNA, 22 nt, Human
gccuggccagaugcaccagccc

SEQ ID NO: 3306461 - RNA, 14 nt, Human
gcccugguggcagu

SEQ ID NO: 3306462 - RNA, 17 nt, Human
gcccugguggcaguggg

SEQ ID NO: 3306463 - RNA, 18 nt, Human
gcccugguggcaguggga

SEQ ID NO: 3306464 - RNA, 19 nt, Human
gcccugguggcagugggag

SEQ ID NO: 3306465 - RNA, 20 nt, Human
gcccugguggcagugggagc

SEQ ID NO: 3306466 - RNA, 21 nt, Human
gcccugguggcagugggagcu

SEQ ID NO: 3306467 - RNA, 22 nt, Human
gcccugguggcagugggagcug

SEQ ID NO: 3306468 - RNA, 23 nt, Human
gcccugguggcagugggagcugc

SEQ ID NO: 3306469 - RNA, 16 nt, Human
gccgagaucacgccac

SEQ ID NO: 3306470 - RNA, 18 nt, Human
gccgagaucacgccacug

SEQ ID NO: 3306471 - RNA, 17 nt, Human
gccgagauugcaccacu

SEQ ID NO: 3306472 - RNA, 18 nt, Human
gccgagauugcaccacug

SEQ ID NO: 3306473 - RNA, 22 nt, Human
gcccuucucuccagccccugga

SEQ ID NO: 3306474 - RNA, 21 nt, Human
gcccuucucuccagccccugg

SEQ ID NO: 3306475 - RNA, 19 nt, Human
gcccuucucuccagccccu

SEQ ID NO: 3306476 - RNA, 18 nt, Human
gcccuucucuccagcccc

SEQ ID NO: 3306477 - RNA, 15 nt, Human
gcccggcuccaggcu

SEQ ID NO: 3306478 - RNA, 16 nt, Human
gcccggcuccaggcuc

SEQ ID NO: 3306479 - RNA, 13 nt, Human
gccccugccaccc

SEQ ID NO: 3306480 - RNA, 14 nt, Human
gccccugccacccu

SEQ ID NO: 3306481 - RNA, 15 nt, Human
gccccugccacccug

SEQ ID NO: 3306482 - RNA, 17 nt, Human
gccccuguucuggcaga

SEQ ID NO: 3306483 - RNA, 21 nt, Human
gccccuguucuggcagaguug

SEQ ID NO: 3306484 - RNA, 15 nt, Human
gcagacucuacagag

SEQ ID NO: 3306485 - RNA, 17 nt, Human
gcccggcuccaggcucc

SEQ ID NO: 3306486 - RNA, 18 nt, Human
gcccggcuccaggcuccu

SEQ ID NO: 3306487 - RNA, 14 nt, Human
gcccugagcuuucu

SEQ ID NO: 3306488 - RNA, 16 nt, Human
gcccugagcuuucugc

SEQ ID NO: 3306489 - RNA, 12 nt, Human
gcccucugccca

SEQ ID NO: 3306490 - RNA, 19 nt, Human
gcucuccgaccagacaccu

SEQ ID NO: 3306491 - RNA, 13 nt, Human
gcucuccgaccag

SEQ ID NO: 3306492 - RNA, 17 nt, Human
gcucuccgaccagacac

SEQ ID NO: 3306493 - RNA, 16 nt, Human
gcucgagcaugccugg

SEQ ID NO: 3306494 - RNA, 15 nt, Human
gcucccuucccaccu

SEQ ID NO: 3306495 - RNA, 18 nt, Human
gcucccuucccaccucuc

SEQ ID NO: 3306496 - RNA, 16 nt, Human
gcucccuucccaccuc

SEQ ID NO: 3306497 - RNA, 15 nt, Human
gcuccuucuguccua

SEQ ID NO: 3306498 - RNA, 21 nt, Human
gcuccuucuguccuacucugu

SEQ ID NO: 3306499 - RNA, 14 nt, Human
gcucugcccuuggu

SEQ ID NO: 3306500 - RNA, 13 nt, Human
gcucugcccuugg

SEQ ID NO: 3306501 - RNA, 11 nt, Human
gcucugccucc

SEQ ID NO: 3306502 - RNA, 23 nt, Human
gcucugcccuugguuaggcauug

SEQ ID NO: 3306503 - RNA, 13 nt, Human
gcucugcuccucu

SEQ ID NO: 3306504 - RNA, 14 nt, Human
gcucugcuccucuc

SEQ ID NO: 3306505 - RNA, 22 nt, Human
gcucugccucccaucacccgcu

SEQ ID NO: 3306506 - RNA, 15 nt, Human
gcucugccucccauc

SEQ ID NO: 3306507 - RNA, 14 nt, Human
gcucugccucccau

SEQ ID NO: 3306508 - RNA, 13 nt, Human
gcucugccuccca

SEQ ID NO: 3306509 - RNA, 14 nt, Human
gcucuggacaggca

SEQ ID NO: 3306510 - RNA, 15 nt, Human
gcucuggacaggcau

SEQ ID NO: 3306511 - RNA, 16 nt, Human
gcucuggacaggcaug

SEQ ID NO: 3306512 - RNA, 21 nt, Human
gcucuggacaggcauguucuc

SEQ ID NO: 3306513 - RNA, 22 nt, Human
gcucuggacaggcauguucucu

SEQ ID NO: 3306514 - RNA, 19 nt, Human
gcucugcuccucuccccag

SEQ ID NO: 3306515 - RNA, 21 nt, Human
gcucugcuccucuccccagca

SEQ ID NO: 3306516 - RNA, 13 nt, Human
gcucugcugacag

SEQ ID NO: 3306517 - RNA, 14 nt, Human
gcucugcugacaga

SEQ ID NO: 3306518 - RNA, 18 nt, Human
gcucugcugacagacaca

SEQ ID NO: 3306519 - RNA, 19 nt, Human
gcucugcugacagacacag

SEQ ID NO: 3306520 - RNA, 20 nt, Human
gcucugcugacagacacagg

SEQ ID NO: 3306521 - RNA, 23 nt, Human
gcucugcugacagacacaggccc

SEQ ID NO: 3306522 - RNA, 23 nt, Human
gcugagugggggaucacagccuc

SEQ ID NO: 3306523 - RNA, 22 nt, Human
gcugagugggggaucacagccu

SEQ ID NO: 3306524 - RNA, 16 nt, Human
gcugauggugcaauga

SEQ ID NO: 3306525 - RNA, 15 nt, Human
gcugauggugcaaug

SEQ ID NO: 3306526 - RNA, 15 nt, Human
gcugagucugaaggc

SEQ ID NO: 3306527 - RNA, 18 nt, Human
gcugagucugaaggcugg

SEQ ID NO: 3306528 - RNA, 16 nt, Human
gcugagucugaaggcu

SEQ ID NO: 3306529 - RNA, 19 nt, Human
gcugagucugaaggcuggg

SEQ ID NO: 3306530 - RNA, 17 nt, Human
gcugcaguugccaguca

SEQ ID NO: 3306531 - RNA, 21 nt, Human
gcugcaguugccagucacccc

SEQ ID NO: 3306532 - RNA, 20 nt, Human
gcugcaguugccagucaccc

SEQ ID NO: 3306533 - RNA, 18 nt, Human
gcugcaguugccagucac

SEQ ID NO: 3306534 - RNA, 21 nt, Human
gcugauggugcaaugaccuuu

SEQ ID NO: 3306535 - RNA, 18 nt, Human
gcugauggugcaaugacc

SEQ ID NO: 3306536 - RNA, 21 nt, Human
gcugacagacacaggcccggc

SEQ ID NO: 3306537 - RNA, 20 nt, Human
gcugacagacacaggcccgg

SEQ ID NO: 3306538 - RNA, 22 nt, Human
gcucuuccaggcugggagagcc

SEQ ID NO: 3306539 - RNA, 12 nt, Human
gcucuucuccag

SEQ ID NO: 3306540 - RNA, 18 nt, Human
gcucuuccaggcugggag

SEQ ID NO: 3306541 - RNA, 19 nt, Human
gcucuuccaggcugggaga

SEQ ID NO: 3306542 - RNA, 14 nt, Human
gcucuucuccaggc

SEQ ID NO: 3306543 - RNA, 16 nt, Human
gcucuucuccaggcug

SEQ ID NO: 3306544 - RNA, 23 nt, Human
gcuaagagggagggagggcucca

SEQ ID NO: 3306545 - RNA, 15 nt, Human
gcuacccgggaaggg

SEQ ID NO: 3306546 - RNA, 14 nt, Human
gcuacccgggaagg

SEQ ID NO: 3306547 - RNA, 20 nt, Human
gcuaccuuuguauucucucc

SEQ ID NO: 3306548 - RNA, 21 nt, Human
gcuacccgggaagggggcugg

SEQ ID NO: 3306549 - RNA, 18 nt, Human
gcuagagguucaaagaua

SEQ ID NO: 3306550 - RNA, 21 nt, Human
gcuagagguucaaagauauuu

SEQ ID NO: 3306551 - RNA, 19 nt, Human
gcuagagguucaaagauau

SEQ ID NO: 3306552 - RNA, 15 nt, Human
gcuaucucccccagc

SEQ ID NO: 3306553 - RNA, 23 nt, Human
gcuaucucccccagccccauccu

SEQ ID NO: 3306554 - RNA, 22 nt, Human
gcuaucucccccagccccaucc

SEQ ID NO: 3306555 - RNA, 21 nt, Human
gcuaucucccccagccccauc

SEQ ID NO: 3306556 - RNA, 20 nt, Human
gcuaucucccccagccccau

SEQ ID NO: 3306557 - RNA, 19 nt, Human
gcuaucucccccagcccca

SEQ ID NO: 3306558 - RNA, 22 nt, Human
gcuagcagcagggagggcuucu

SEQ ID NO: 3306559 - RNA, 18 nt, Human
gcuaucucccccagcccc

SEQ ID NO: 3306560 - RNA, 17 nt, Human
gcuaucucccccagccc

SEQ ID NO: 3306561 - RNA, 16 nt, Human
gcuaucucccccagcc

SEQ ID NO: 3306562 - RNA, 16 nt, Human
gcuaaaugugaaugau

SEQ ID NO: 3306563 - RNA, 13 nt, Human
gcuaaaugugaau

SEQ ID NO: 3306564 - RNA, 22 nt, Human
gcuaagagggagggagggcucc

SEQ ID NO: 3306565 - RNA, 21 nt, Human
gcuaagagggagggagggcuc

SEQ ID NO: 3306566 - RNA, 16 nt, Human
gcgugagccacugcac

SEQ ID NO: 3306567 - RNA, 18 nt, Human
gcgugagccacugcaccg

SEQ ID NO: 3306568 - RNA, 23 nt, Human
gcgugagccacugcaccgggcca

SEQ ID NO: 3306569 - RNA, 18 nt, Human
gcgguccacccaggagcc

SEQ ID NO: 3306570 - RNA, 19 nt, Human
gcgguccacccaggagccc

SEQ ID NO: 3306571 - RNA, 12 nt, Human
gcggggacagcu

SEQ ID NO: 3306572 - RNA, 15 nt, Human
gcgggcuuccuccug

SEQ ID NO: 3306573 - RNA, 13 nt, Human
gcggggacagcuc

SEQ ID NO: 3306574 - RNA, 16 nt, Human
gcgguccacccaggag

SEQ ID NO: 3306575 - RNA, 18 nt, Human
gcucaccagccccagugc

SEQ ID NO: 3306576 - RNA, 19 nt, Human
gcucaccagccccagugcc

SEQ ID NO: 3306577 - RNA, 20 nt, Human
gcucaccagccccagugccc

SEQ ID NO: 3306578 - RNA, 23 nt, Human
gcucaccagccccagugcccaca

SEQ ID NO: 3306579 - RNA, 23 nt, Human
gcucagcaaaagaugcuucucac

SEQ ID NO: 3306580 - RNA, 22 nt, Human
gcucagcaaaagaugcuucuca

SEQ ID NO: 3306581 - RNA, 20 nt, Human
gcucagcaaaagaugcuucu

SEQ ID NO: 3306582 - RNA, 17 nt, Human
gcucagcaaaagaugcu

SEQ ID NO: 3306583 - RNA, 20 nt, Human
gcucagcggggacagcuccu

SEQ ID NO: 3306584 - RNA, 19 nt, Human
gcucagcggggacagcucc

SEQ ID NO: 3306585 - RNA, 15 nt, Human
gcucagcggggacag

SEQ ID NO: 3306586 - RNA, 21 nt, Human
gcucagcggggacagcuccuu

SEQ ID NO: 3306587 - RNA, 18 nt, Human
gcucaggugucccugcac

SEQ ID NO: 3306588 - RNA, 17 nt, Human
gcucaggugucccugca

SEQ ID NO: 3306589 - RNA, 19 nt, Human
gcucaggugucccugcacu

SEQ ID NO: 3306590 - RNA, 13 nt, Human
gcuccaagcuccc

SEQ ID NO: 3306591 - RNA, 15 nt, Human
gcuccaagcucccag

SEQ ID NO: 3306592 - RNA, 14 nt, Human
gcuccaagcuccca

SEQ ID NO: 3306593 - RNA, 21 nt, Human
gcuccagcucaccagccccag

SEQ ID NO: 3306594 - RNA, 21 nt, Human
gcuccaagcucccaggcauuc

SEQ ID NO: 3306595 - RNA, 19 nt, Human
gcuccaagcucccaggcau

SEQ ID NO: 3306596 - RNA, 18 nt, Human
gcuccaagcucccaggca

SEQ ID NO: 3306597 - RNA, 17 nt, Human
gcuccaagcucccaggc

SEQ ID NO: 3306598 - RNA, 16 nt, Human
gcuccaagcucccagg

SEQ ID NO: 3306599 - RNA, 13 nt, Human
gcuccaggcuccu

SEQ ID NO: 3306600 - RNA, 11 nt, Human
gcuccagcugu

SEQ ID NO: 3306601 - RNA, 16 nt, Human
gcuccaggcuccuuua

SEQ ID NO: 3306602 - RNA, 23 nt, Human
gcuccaggcuccuuuagcgccca

SEQ ID NO: 3306603 - RNA, 15 nt, Human
ggcuaugcauuugaa

SEQ ID NO: 3306604 - RNA, 16 nt, Human
ggcuaguugggcuucc

SEQ ID NO: 3306605 - RNA, 14 nt, Human
ggcuaugcauuuga

SEQ ID NO: 3306606 - RNA, 15 nt, Human
ggcuaguugggcuuc

SEQ ID NO: 3306607 - RNA, 23 nt, Human
ggcuagugugguguuuccuggca

SEQ ID NO: 3306608 - RNA, 22 nt, Human
ggcuaggaccccuccauguggg

SEQ ID NO: 3306609 - RNA, 16 nt, Human
ggcuaggaccccucca

SEQ ID NO: 3306610 - RNA, 16 nt, Human
ggcuagagguucaaag

SEQ ID NO: 3306611 - RNA, 17 nt, Human
ggcuagagguucaaaga

SEQ ID NO: 3306612 - RNA, 22 nt, Human
ggcuagagguucaaagauauuu

SEQ ID NO: 3306613 - RNA, 15 nt, Human
ggcucaaguccucuu

SEQ ID NO: 3306614 - RNA, 21 nt, Human
ggcucaaguccucuuuucuga

SEQ ID NO: 3306615 - RNA, 12 nt, Human
ggcuccaggagc

SEQ ID NO: 3306616 - RNA, 19 nt, Human
ggcuccaggagcagccaca

SEQ ID NO: 3306617 - RNA, 16 nt, Human
ggcuccaggcuccuuu

SEQ ID NO: 3306618 - RNA, 11 nt, Human
ggcuccaggcu

SEQ ID NO: 3306619 - RNA, 15 nt, Human
ggcuccaggcuccuu

SEQ ID NO: 3306620 - RNA, 18 nt, Human
ggcuccaggagcagccac

SEQ ID NO: 3306621 - RNA, 19 nt, Human
ggccuggccugagcuggga

SEQ ID NO: 3306622 - RNA, 14 nt, Human
ggccugggggcugg

SEQ ID NO: 3306623 - RNA, 20 nt, Human
ggccugggggcugggcagag

SEQ ID NO: 3306624 - RNA, 23 nt, Human
ggcgcugccccuggcagccccug

SEQ ID NO: 3306625 - RNA, 21 nt, Human
ggcgcugccccuggcagcccc

SEQ ID NO: 3306626 - RNA, 19 nt, Human
ggcgcugccccuggcagcc

SEQ ID NO: 3306627 - RNA, 18 nt, Human
ggcgcugccccuggcagc

SEQ ID NO: 3306628 - RNA, 23 nt, Human
ggccuagcauacguacacauuuu

SEQ ID NO: 3306629 - RNA, 17 nt, Human
ggccucuuaugggcugg

SEQ ID NO: 3306630 - RNA, 18 nt, Human
ggccucuuaugggcuggg

SEQ ID NO: 3306631 - RNA, 15 nt, Human
ggccucugcacuccc

SEQ ID NO: 3306632 - RNA, 14 nt, Human
ggccucugcacucc

SEQ ID NO: 3306633 - RNA, 13 nt, Human
ggccucugcacuc

SEQ ID NO: 3306634 - RNA, 11 nt, Human
ggcccagagag

SEQ ID NO: 3306635 - RNA, 17 nt, Human
ggcccucugcccacucc

SEQ ID NO: 3306636 - RNA, 16 nt, Human
ggcccucugcccacuc

SEQ ID NO: 3306637 - RNA, 15 nt, Human
ggcccucugcccacu

SEQ ID NO: 3306638 - RNA, 13 nt, Human
ggcccucugccca

SEQ ID NO: 3306639 - RNA, 20 nt, Human
ggcccucugcccacucccug

SEQ ID NO: 3306640 - RNA, 19 nt, Human
ggcccucugcccacucccu

SEQ ID NO: 3306641 - RNA, 21 nt, Human
ggcccucugcccacucccugc

SEQ ID NO: 3306642 - RNA, 15 nt, Human
ggcccugccuccuuu

SEQ ID NO: 3306643 - RNA, 14 nt, Human
ggcccugccuccuu

SEQ ID NO: 3306644 - RNA, 13 nt, Human
ggcccugccuccu

SEQ ID NO: 3306645 - RNA, 19 nt, Human
ggauuacaagcgugagcca

SEQ ID NO: 3306646 - RNA, 15 nt, Human
ggaugcuuguacaua

SEQ ID NO: 3306647 - RNA, 19 nt, Human
ggaugcagccucacagucc

SEQ ID NO: 3306648 - RNA, 21 nt, Human
ggaugccugguggcagcugcg

SEQ ID NO: 3306649 - RNA, 17 nt, Human
ggaugcagccucacagu

SEQ ID NO: 3306650 - RNA, 16 nt, Human
ggaugcagccucacag

SEQ ID NO: 3306651 - RNA, 21 nt, Human
ggaugauuggaggggggaggu

SEQ ID NO: 3306652 - RNA, 23 nt, Human
ggaugcacagaguuguuacauuu

SEQ ID NO: 3306653 - RNA, 13 nt, Human
ggauccuccaggu

SEQ ID NO: 3306654 - RNA, 12 nt, Human
ggauccuccagg

SEQ ID NO: 3306655 - RNA, 18 nt, Human
ggauacaaaagcauguga

SEQ ID NO: 3306656 - RNA, 14 nt, Human
ggagugcagugagc

SEQ ID NO: 3306657 - RNA, 12 nt, Human
ggagugcaguga

SEQ ID NO: 3306658 - RNA, 23 nt, Human
ggagugaguugauagcacagacc

SEQ ID NO: 3306659 - RNA, 17 nt, Human
ggaucccucauccucau

SEQ ID NO: 3306660 - RNA, 13 nt, Human
ggaucccucaucc

SEQ ID NO: 3306661 - RNA, 22 nt, Human
ggaucccucauccucauaccca

SEQ ID NO: 3306662 - RNA, 23 nt, Human
ggauuacaagcgugagccacugc

SEQ ID NO: 3306663 - RNA, 16 nt, Human
ggauucuuauggacaa

SEQ ID NO: 3306664 - RNA, 16 nt, Human
ggcaacccccagccug

SEQ ID NO: 3306665 - RNA, 17 nt, Human
ggcaacccccagccugc

SEQ ID NO: 3306666 - RNA, 17 nt, Human
ggauugcuacuguccua

SEQ ID NO: 3306667 - RNA, 20 nt, Human
ggcacccaccaucaugucug

SEQ ID NO: 3306668 - RNA, 23 nt, Human
ggcacccaccaucaugucuggcu

SEQ ID NO: 3306669 - RNA, 20 nt, Human
ggcacccggccccugcuggu

SEQ ID NO: 3306670 - RNA, 22 nt, Human
ggcacccggccccugcugguuc

SEQ ID NO: 3306671 - RNA, 14 nt, Human
ggcaaugcuggcug

SEQ ID NO: 3306672 - RNA, 15 nt, Human
ggcaaugcuggcugu

SEQ ID NO: 3306673 - RNA, 23 nt, Human
ggcaaugcuggcuguuggcuggg

SEQ ID NO: 3306674 - RNA, 18 nt, Human
ggcaacccccagccugcu

SEQ ID NO: 3306675 - RNA, 16 nt, Human
ggccaugggccuccug

SEQ ID NO: 3306676 - RNA, 20 nt, Human
ggccagccuugaccauucuc

SEQ ID NO: 3306677 - RNA, 17 nt, Human
ggccagcugcuugggcu

SEQ ID NO: 3306678 - RNA, 22 nt, Human
ggccagccuugaccauucucca

SEQ ID NO: 3306679 - RNA, 18 nt, Human
ggccaggcccucugccca

SEQ ID NO: 3306680 - RNA, 23 nt, Human
ggccagcugcuugggcuucaucc

SEQ ID NO: 3306681 - RNA, 18 nt, Human
ggcaugggaaugaauguc

SEQ ID NO: 3306682 - RNA, 17 nt, Human
ggcauuccccaggaggc

SEQ ID NO: 3306683 - RNA, 22 nt, Human
ggcaugggaaugaaugucagug

SEQ ID NO: 3306684 - RNA, 16 nt, Human
ggcauuccccaggagg

SEQ ID NO: 3306685 - RNA, 19 nt, Human
ggcauuccccaggaggcca

SEQ ID NO: 3306686 - RNA, 18 nt, Human
ggcauuccccaggaggcc

SEQ ID NO: 3306687 - RNA, 19 nt, Human
ggcagggucucacucuguc

SEQ ID NO: 3306688 - RNA, 20 nt, Human
ggcagggucucacucugucg

SEQ ID NO: 3306689 - RNA, 13 nt, Human
ggcagugggagcu

SEQ ID NO: 3306690 - RNA, 14 nt, Human
ggcagugggagcug

SEQ ID NO: 3306691 - RNA, 16 nt, Human
ggcagugggagcugcc

SEQ ID NO: 3306692 - RNA, 18 nt, Human
ggcaugacacgaauauug

SEQ ID NO: 3306693 - RNA, 15 nt, Human
ggcaugaagacagau

SEQ ID NO: 3306694 - RNA, 14 nt, Human
ggcagcucaccucu

SEQ ID NO: 3306695 - RNA, 12 nt, Human
ggcagcucaccu

SEQ ID NO: 3306696 - RNA, 22 nt, Human
ggcagcugcuuuugucuauggg

SEQ ID NO: 3306697 - RNA, 18 nt, Human
ggcagggucucacucugu

SEQ ID NO: 3306698 - RNA, 21 nt, Human
ggcagcucagagaggguggga

SEQ ID NO: 3306699 - RNA, 13 nt, Human
ggcagcucagaga

SEQ ID NO: 3306700 - RNA, 18 nt, Human
ggagaagcggcuggcagc

SEQ ID NO: 3306701 - RNA, 17 nt, Human
ggagaagcggcuggcag

SEQ ID NO: 3306702 - RNA, 13 nt, Human
ggaccagagcugc

SEQ ID NO: 3306703 - RNA, 23 nt, Human
ggaccucaggugagaagcagagg

SEQ ID NO: 3306704 - RNA, 20 nt, Human
ggaccucaggccugggggcu

SEQ ID NO: 3306705 - RNA, 19 nt, Human
ggaccucaggugagaagca

SEQ ID NO: 3306706 - RNA, 15 nt, Human
ggaccuugaacuggg

SEQ ID NO: 3306707 - RNA, 17 nt, Human
ggaccuugaacugggua

SEQ ID NO: 3306708 - RNA, 17 nt, Human
ggacgcuacccgggaag

SEQ ID NO: 3306709 - RNA, 20 nt, Human
ggacgcuacccgggaagggg

SEQ ID NO: 3306710 - RNA, 19 nt, Human
ggacgcuacccgggaaggg

SEQ ID NO: 3306711 - RNA, 17 nt, Human
ggacacucaaaagcugg

SEQ ID NO: 3306712 - RNA, 20 nt, Human
ggacagaggggguggccucc

SEQ ID NO: 3306713 - RNA, 15 nt, Human
ggacagccacggcca

SEQ ID NO: 3306714 - RNA, 19 nt, Human
ggacagccacggccaggcc

SEQ ID NO: 3306715 - RNA, 20 nt, Human
ggacagccacggccaggcca

SEQ ID NO: 3306716 - RNA, 21 nt, Human
ggacagccacggccaggccag

SEQ ID NO: 3306717 - RNA, 14 nt, Human
ggacauggacaagg

SEQ ID NO: 3306718 - RNA, 20 nt, Human
ggacauugcggacagccacg

SEQ ID NO: 3306719 - RNA, 14 nt, Human
ggaaugauuaauua

SEQ ID NO: 3306720 - RNA, 18 nt, Human
ggaaguacuggagaaaau

SEQ ID NO: 3306721 - RNA, 16 nt, Human
ggaaguacuggagaaa

SEQ ID NO: 3306722 - RNA, 12 nt, Human
ggaaguacugga

SEQ ID NO: 3306723 - RNA, 23 nt, Human
ggaaggggagauaaggguaucug

SEQ ID NO: 3306724 - RNA, 12 nt, Human
ggaaugcagugg

SEQ ID NO: 3306725 - RNA, 24 nt, Human
ggaaugauuaauuaaaacacaaca

SEQ ID NO: 3306726 - RNA, 19 nt, Human
ggaauguuugccucugccu

SEQ ID NO: 3306727 - RNA, 22 nt, Human
ggacacuaaccacgcuggaccu

SEQ ID NO: 3306728 - RNA, 15 nt, Human
gcuuugugauuuuug

SEQ ID NO: 3306729 - RNA, 18 nt, Human
gcuugaggguugggcugg

SEQ ID NO: 3306730 - RNA, 20 nt, Human
gcuugaggguugggcuggug

SEQ ID NO: 3306731 - RNA, 21 nt, Human
gcuuuguuuguugucagcuga

SEQ ID NO: 3306732 - RNA, 18 nt, Human
ggaaaacaugcuacacac

SEQ ID NO: 3306733 - RNA, 18 nt, Human
ggaaaagcugcugacagu

SEQ ID NO: 3306734 - RNA, 20 nt, Human
ggaaaagcugcugacagugu

SEQ ID NO: 3306735 - RNA, 14 nt, Human
ggaaaagcugcuga

SEQ ID NO: 3306736 - RNA, 14 nt, Human
ggaaaucaccgaaa

SEQ ID NO: 3306737 - RNA, 21 nt, Human
ggaaaucaccgaaaacguggc

SEQ ID NO: 3306738 - RNA, 16 nt, Human
ggaacaggaaacugau

SEQ ID NO: 3306739 - RNA, 23 nt, Human
ggaaaaucagccugcuccagcug

SEQ ID NO: 3306740 - RNA, 19 nt, Human
ggaaaaucagccugcucca

SEQ ID NO: 3306741 - RNA, 14 nt, Human
ggaaaggcuccagg

SEQ ID NO: 3306742 - RNA, 13 nt, Human
ggaaaggcuccag

SEQ ID NO: 3306743 - RNA, 12 nt, Human
ggaaaggcucca

SEQ ID NO: 3306744 - RNA, 21 nt, Human
ggaaaggcuccaggagcagcc

SEQ ID NO: 3306745 - RNA, 20 nt, Human
ggaaaggcuccaggagcagc

SEQ ID NO: 3306746 - RNA, 19 nt, Human
ggaaaggcuccaggagcag

SEQ ID NO: 3306747 - RNA, 17 nt, Human
ggaaaggcuccaggagc

SEQ ID NO: 3306748 - RNA, 22 nt, Human
ggaaaggcuccaggagcagcca

SEQ ID NO: 3306749 - RNA, 19 nt, Human
gcugccaaugggagcucau

SEQ ID NO: 3306750 - RNA, 16 nt, Human
gcugccaaugggagcu

SEQ ID NO: 3306751 - RNA, 15 nt, Human
gcugccaaugggagc

SEQ ID NO: 3306752 - RNA, 13 nt, Human
gcuguucagcugg

SEQ ID NO: 3306753 - RNA, 14 nt, Human
gcuguucagcuggu

SEQ ID NO: 3306754 - RNA, 20 nt, Human
gcuuagucacugagacagcc

SEQ ID NO: 3306755 - RNA, 19 nt, Human
gcuuagucacugagacagc

SEQ ID NO: 3306756 - RNA, 21 nt, Human
gcuuagucacugagacagccc

SEQ ID NO: 3306757 - RNA, 17 nt, Human
gcuuagucacugagaca

SEQ ID NO: 3306758 - RNA, 15 nt, Human
gcuuagucacugaga

SEQ ID NO: 3306759 - RNA, 16 nt, Human
gcuugaggguugggcu

SEQ ID NO: 3306760 - RNA, 15 nt, Human
gcuuccagugaggcu

SEQ ID NO: 3306761 - RNA, 17 nt, Human
gcuucauuuccuguguc

SEQ ID NO: 3306762 - RNA, 16 nt, Human
gcuuccagugaggcuc

SEQ ID NO: 3306763 - RNA, 16 nt, Human
gcuucaguggcagcug

SEQ ID NO: 3306764 - RNA, 15 nt, Human
gcuucaguggcagcu

SEQ ID NO: 3306765 - RNA, 19 nt, Human
gcuuaucucaggggugugc

SEQ ID NO: 3306766 - RNA, 13 nt, Human
gcuuaucucaggg

SEQ ID NO: 3306767 - RNA, 12 nt, Human
gcuuauacacuu

SEQ ID NO: 3306768 - RNA, 13 nt, Human
gcuucauuuccug

SEQ ID NO: 3306769 - RNA, 16 nt, Human
gcuucauuuccugugu

SEQ ID NO: 3306770 - RNA, 15 nt, Human
gcuucauccuccuca

SEQ ID NO: 3306771 - RNA, 12 nt, Human
gcuucauccucc

SEQ ID NO: 3306772 - RNA, 17 nt, Human
gcuucaguggcagcugc

SEQ ID NO: 3306773 - RNA, 18 nt, Human
gcuucaguggcagcugcu

SEQ ID NO: 3306774 - RNA, 16 nt, Human
guacccacugcucugg

SEQ ID NO: 3306775 - RNA, 22 nt, Human
guaccucuugagccuugaacuu

SEQ ID NO: 3306776 - RNA, 21 nt, Human
guaccucuugagccuugaacu

SEQ ID NO: 3306777 - RNA, 13 nt, Human
guaccucuugagc

SEQ ID NO: 3306778 - RNA, 14 nt, Human
guacgucugacagg

SEQ ID NO: 3306779 - RNA, 15 nt, Human
guacgucugacaggc

SEQ ID NO: 3306780 - RNA, 17 nt, Human
guacgucugacaggcaa

SEQ ID NO: 3306781 - RNA, 14 nt, Human
guacguugugcauu

SEQ ID NO: 3306782 - RNA, 16 nt, Human
guacguugugcauuug

SEQ ID NO: 3306783 - RNA, 15 nt, Human
guacguugugcauuu

SEQ ID NO: 3306784 - RNA, 14 nt, Human
guacuucuccaccc

SEQ ID NO: 3306785 - RNA, 15 nt, Human
guacuucuccacccu

SEQ ID NO: 3306786 - RNA, 15 nt, Human
guacuaaggaaucuu

SEQ ID NO: 3306787 - RNA, 23 nt, Human
guacuaaggaaucuuucugcuuu

SEQ ID NO: 3306788 - RNA, 17 nt, Human
guacguugugcauuugg

SEQ ID NO: 3306789 - RNA, 16 nt, Human
guagagcggagaaagg

SEQ ID NO: 3306790 - RNA, 18 nt, Human
guagagccagggucucac

SEQ ID NO: 3306791 - RNA, 21 nt, Human
guacuuguggacacagcucuu

SEQ ID NO: 3306792 - RNA, 16 nt, Human
guacuuguggacacag

SEQ ID NO: 3306793 - RNA, 20 nt, Human
guacuuguggacacagcucu

SEQ ID NO: 3306794 - RNA, 16 nt, Human
guacuucuccacccug

SEQ ID NO: 3306795 - RNA, 17 nt, Human
guacuucuccacccugc

SEQ ID NO: 3306796 - RNA, 18 nt, Human
guacuucuccacccugcu

SEQ ID NO: 3306797 - RNA, 19 nt, Human
guacuucuccacccugcuc

SEQ ID NO: 3306798 - RNA, 20 nt, Human
guacuucuccacccugcucu

SEQ ID NO: 3306799 - RNA, 21 nt, Human
guacuucuccacccugcucuc

SEQ ID NO: 3306800 - RNA, 18 nt, Human
guacacuguuucaaacuu

SEQ ID NO: 3306801 - RNA, 14 nt, Human
guaauuaaguacua

SEQ ID NO: 3306802 - RNA, 17 nt, Human
guaauuaaguacuaugu

SEQ ID NO: 3306803 - RNA, 20 nt, Human
guaauuaaguacuauguauc

SEQ ID NO: 3306804 - RNA, 21 nt, Human
guaauuaaguacuauguauca

SEQ ID NO: 3306805 - RNA, 21 nt, Human
guacacuguuucaaacuuuac

SEQ ID NO: 3306806 - RNA, 20 nt, Human
guacacuguuucaaacuuua

SEQ ID NO: 3306807 - RNA, 19 nt, Human
guacacuguuucaaacuuu

SEQ ID NO: 3306808 - RNA, 16 nt, Human
guacagacaacaaacc

SEQ ID NO: 3306809 - RNA, 20 nt, Human
guacagcaaggagauuuaca

SEQ ID NO: 3306810 - RNA, 22 nt, Human
guacagagcccacgcccccacu

SEQ ID NO: 3306811 - RNA, 18 nt, Human
guacagagcccacgcccc

SEQ ID NO: 3306812 - RNA, 12 nt, Human
guacagagccca

SEQ ID NO: 3306813 - RNA, 15 nt, Human
guacccacugcucug

SEQ ID NO: 3306814 - RNA, 20 nt, Human
guacauaaugcgugcauacc

SEQ ID NO: 3306815 - RNA, 14 nt, Human
gguugggcuggugu

SEQ ID NO: 3306816 - RNA, 13 nt, Human
gguuggugggggc

SEQ ID NO: 3306817 - RNA, 13 nt, Human
gguuuaagcuguu

SEQ ID NO: 3306818 - RNA, 13 nt, Human
gguggccucccaa

SEQ ID NO: 3306819 - RNA, 21 nt, Human
gguucaagcgauucuucugcu

SEQ ID NO: 3306820 - RNA, 17 nt, Human
gguggccucccaacuca

SEQ ID NO: 3306821 - RNA, 20 nt, Human
gguucacugcaaccuccgcc

SEQ ID NO: 3306822 - RNA, 22 nt, Human
gguucaagcgauucuucugcuu

SEQ ID NO: 3306823 - RNA, 23 nt, Human
gguucaagcgauucuucugcuuc

SEQ ID NO: 3306824 - RNA, 14 nt, Human
gguugaagcaccaa

SEQ ID NO: 3306825 - RNA, 15 nt, Human
gguuuucuguucuuu

SEQ ID NO: 3306826 - RNA, 13 nt, Human
gguuuucuguucu

SEQ ID NO: 3306827 - RNA, 12 nt, Human
gguuuucuguuc

SEQ ID NO: 3306828 - RNA, 23 nt, Human
gguuuugccauguuggccaggcu

SEQ ID NO: 3306829 - RNA, 15 nt, Human
guaaauuaacuuuua

SEQ ID NO: 3306830 - RNA, 22 nt, Human
guaaauuaacuuuuauaaacuu

SEQ ID NO: 3306831 - RNA, 21 nt, Human
guaaauuaacuuuuauaaacu

SEQ ID NO: 3306832 - RNA, 17 nt, Human
guaaauuaacuuuuaua

SEQ ID NO: 3306833 - RNA, 16 nt, Human
guaaauuaacuuuuau

SEQ ID NO: 3306834 - RNA, 18 nt, Human
guaaaugggggugcauuu

SEQ ID NO: 3306835 - RNA, 20 nt, Human
guaaaugggggugcauuuga

SEQ ID NO: 3306836 - RNA, 19 nt, Human
guaaaugggggugcauuug

SEQ ID NO: 3306837 - RNA, 22 nt, Human
guaaguauucuuauuuaaugaa

SEQ ID NO: 3306838 - RNA, 18 nt, Human
guaaggaauaccuguccc

SEQ ID NO: 3306839 - RNA, 13 nt, Human
guaaggaaugauu

SEQ ID NO: 3306840 - RNA, 23 nt, Human
guaaggaauaccugucccccuga

SEQ ID NO: 3306841 - RNA, 21 nt, Human
guaaggaauaccugucccccu

SEQ ID NO: 3306842 - RNA, 20 nt, Human
guaaggaauaccuguccccc

SEQ ID NO: 3306843 - RNA, 23 nt, Human
guaaauuaacuuuuauaaacuuu

SEQ ID NO: 3306844 - RNA, 17 nt, Human
ggggaucacagccucug

SEQ ID NO: 3306845 - RNA, 11 nt, Human
ggggagaaagu

SEQ ID NO: 3306846 - RNA, 21 nt, Human
gggcuuggggaccagagcugc

SEQ ID NO: 3306847 - RNA, 13 nt, Human
ggggaguggccac

SEQ ID NO: 3306848 - RNA, 20 nt, Human
gggcuuggggaccagagcug

SEQ ID NO: 3306849 - RNA, 20 nt, Human
gggcuucauccuccucagau

SEQ ID NO: 3306850 - RNA, 15 nt, Human
gggcuucaguggcag

SEQ ID NO: 3306851 - RNA, 16 nt, Human
gggcuucaguggcagc

SEQ ID NO: 3306852 - RNA, 17 nt, Human
gggcuucaguggcagcu

SEQ ID NO: 3306853 - RNA, 18 nt, Human
gggcuucaguggcagcug

SEQ ID NO: 3306854 - RNA, 19 nt, Human
gggcuucaguggcagcugc

SEQ ID NO: 3306855 - RNA, 20 nt, Human
gggcuucaguggcagcugcu

SEQ ID NO: 3306856 - RNA, 19 nt, Human
gggcuucauccuccucaga

SEQ ID NO: 3306857 - RNA, 23 nt, Human
gggguucccuuuuuuggcugcug

SEQ ID NO: 3306858 - RNA, 19 nt, Human
ggguacuuguggacacagc

SEQ ID NO: 3306859 - RNA, 22 nt, Human
ggguacuuguggacacagcucu

SEQ ID NO: 3306860 - RNA, 23 nt, Human
ggguacuuguggacacagcucuu

SEQ ID NO: 3306861 - RNA, 23 nt, Human
ggguagagcggagaaaggaaggg

SEQ ID NO: 3306862 - RNA, 13 nt, Human
ggguacccacugc

SEQ ID NO: 3306863 - RNA, 15 nt, Human
ggguacccacugcuc

SEQ ID NO: 3306864 - RNA, 18 nt, Human
ggguacccacugcucugg

SEQ ID NO: 3306865 - RNA, 23 nt, Human
ggggcugcaccggcuggccuggc

SEQ ID NO: 3306866 - RNA, 17 nt, Human
ggggcugggcagaggaa

SEQ ID NO: 3306867 - RNA, 16 nt, Human
ggggcugggcagagga

SEQ ID NO: 3306868 - RNA, 13 nt, Human
ggggcugggacau

SEQ ID NO: 3306869 - RNA, 16 nt, Human
gggcgcgguggcucac

SEQ ID NO: 3306870 - RNA, 13 nt, Human
gggcucccuuccc

SEQ ID NO: 3306871 - RNA, 23 nt, Human
gggcucccuucccaccucucuca

SEQ ID NO: 3306872 - RNA, 18 nt, Human
gggcucccuucccaccuc

SEQ ID NO: 3306873 - RNA, 17 nt, Human
gggcucccuucccaccu

SEQ ID NO: 3306874 - RNA, 14 nt, Human
gggcucccuuccca

SEQ ID NO: 3306875 - RNA, 19 nt, Human
gggccuggccugagcuggg

SEQ ID NO: 3306876 - RNA, 12 nt, Human
gggccuggcuca

SEQ ID NO: 3306877 - RNA, 16 nt, Human
gggccuggcucaggug

SEQ ID NO: 3306878 - RNA, 14 nt, Human
gggccuggcucagg

SEQ ID NO: 3306879 - RNA, 18 nt, Human
gggccuggucguuuucaa

SEQ ID NO: 3306880 - RNA, 13 nt, Human
gggcucugccucc

SEQ ID NO: 3306881 - RNA, 20 nt, Human
gggcucugccucccaucacc

SEQ ID NO: 3306882 - RNA, 17 nt, Human
gggcucugccucccauc

SEQ ID NO: 3306883 - RNA, 16 nt, Human
gggcucugccucccau

SEQ ID NO: 3306884 - RNA, 15 nt, Human
gggcucugccuccca

SEQ ID NO: 3306885 - RNA, 14 nt, Human
gggcugcaccggcu

SEQ ID NO: 3306886 - RNA, 16 nt, Human
gggcugaggugggagg

SEQ ID NO: 3306887 - RNA, 14 nt, Human
gggcuucaguggca

SEQ ID NO: 3306888 - RNA, 15 nt, Human
ggugcgaucuggguu

SEQ ID NO: 3306889 - RNA, 22 nt, Human
ggugcuaucucccccagcccca

SEQ ID NO: 3306890 - RNA, 21 nt, Human
ggugcuaucucccccagcccc

SEQ ID NO: 3306891 - RNA, 23 nt, Human
ggugcuaucucccccagccccau

SEQ ID NO: 3306892 - RNA, 15 nt, Human
gguggcagcugcggu

SEQ ID NO: 3306893 - RNA, 23 nt, Human
gguggcagcugcgguccacccag

SEQ ID NO: 3306894 - RNA, 11 nt, Human
gguggcagcug

SEQ ID NO: 3306895 - RNA, 13 nt, Human
gguggcagcucac

SEQ ID NO: 3306896 - RNA, 12 nt, Human
gguggcagcugc

SEQ ID NO: 3306897 - RNA, 13 nt, Human
gguggcagcugcg

SEQ ID NO: 3306898 - RNA, 16 nt, Human
ggugaccucugccuga

SEQ ID NO: 3306899 - RNA, 14 nt, Human
ggugaccucugccu

SEQ ID NO: 3306900 - RNA, 15 nt, Human
ggucugacccacugc

SEQ ID NO: 3306901 - RNA, 16 nt, Human
ggucugacccacugcu

SEQ ID NO: 3306902 - RNA, 21 nt, Human
ggucucacuauguugcccagg

SEQ ID NO: 3306903 - RNA, 12 nt, Human
ggucucacucug

SEQ ID NO: 3306904 - RNA, 19 nt, Human
ggucugaggaauccagacc

SEQ ID NO: 3306905 - RNA, 16 nt, Human
ggugaacuugguuccc

SEQ ID NO: 3306906 - RNA, 18 nt, Human
ggugaagugaagacaaug

SEQ ID NO: 3306907 - RNA, 22 nt, Human
ggucccugguggcagcucaccu

SEQ ID NO: 3306908 - RNA, 22 nt, Human
ggucucacuauguugcccaggc

SEQ ID NO: 3306909 - RNA, 14 nt, Human
ggucccugguggca

SEQ ID NO: 3306910 - RNA, 21 nt, Human
gguacuuguggacacagcucu

SEQ ID NO: 3306911 - RNA, 20 nt, Human
gguacuuguggacacagcuc

SEQ ID NO: 3306912 - RNA, 22 nt, Human
gguacuuguggacacagcucuu

SEQ ID NO: 3306913 - RNA, 17 nt, Human
gguacccacugcucugg

SEQ ID NO: 3306914 - RNA, 16 nt, Human
gguacccacugcucug

SEQ ID NO: 3306915 - RNA, 15 nt, Human
ggguugggcuggugu

SEQ ID NO: 3306916 - RNA, 23 nt, Human
ggguucccuuuuuuggcugcuga

SEQ ID NO: 3306917 - RNA, 22 nt, Human
ggguucuacccaggugcuagga

SEQ ID NO: 3306918 - RNA, 17 nt, Human
ggguucuacccaggugc

SEQ ID NO: 3306919 - RNA, 16 nt, Human
ggguuggccccugccc

SEQ ID NO: 3306920 - RNA, 19 nt, Human
ggguuggccccugcccggc

SEQ ID NO: 3306921 - RNA, 12 nt, Human
ggucacucuggc

SEQ ID NO: 3306922 - RNA, 12 nt, Human
ggucagagccug

SEQ ID NO: 3306923 - RNA, 22 nt, Human
ggucacucuggcagcucagaga

SEQ ID NO: 3306924 - RNA, 20 nt, Human
ggucacucuggcagcucaga

SEQ ID NO: 3306925 - RNA, 16 nt, Human
ggucacucuggcagcu

SEQ ID NO: 3306926 - RNA, 13 nt, Human
ggucagagccugc

SEQ ID NO: 3306927 - RNA, 14 nt, Human
ggucagagccugca

SEQ ID NO: 3306928 - RNA, 15 nt, Human
ggucagagccugcag

SEQ ID NO: 3306929 - RNA, 16 nt, Human
ggucagagccugcagu

SEQ ID NO: 3306930 - RNA, 13 nt, Human
ggucccccuucca

SEQ ID NO: 3306931 - RNA, 23 nt, Human
ggucccccuuccauggacuuugu

SEQ ID NO: 3306932 - RNA, 18 nt, Human
ggucccccuuccauggac

SEQ ID NO: 3306933 - RNA, 22 nt, Human
ggucccacucaguccauagcag

SEQ ID NO: 3306934 - RNA, 12 nt, Human
ggucccacucag

SEQ ID NO: 3306935 - RNA, 14 nt, Human
ggucccacucaguc

SEQ ID NO: 3306936 - RNA, 11 nt, Human
ggucagagccu

SEQ ID NO: 3306937 - RNA, 22 nt, Human
ggucccaccccacacacgccag

SEQ ID NO: 3306938 - RNA, 17 nt, Human
gucccagauacuugggg

SEQ ID NO: 3306939 - RNA, 15 nt, Human
gucccacucagucca

SEQ ID NO: 3306940 - RNA, 14 nt, Human
gucccacucagucc

SEQ ID NO: 3306941 - RNA, 14 nt, Human
guccacccaggagc

SEQ ID NO: 3306942 - RNA, 13 nt, Human
guccacccaggag

SEQ ID NO: 3306943 - RNA, 15 nt, Human
guccacccaggagcc

SEQ ID NO: 3306944 - RNA, 16 nt, Human
guccacccaggagccc

SEQ ID NO: 3306945 - RNA, 21 nt, Human
gucauauaagauucauauuua

SEQ ID NO: 3306946 - RNA, 13 nt, Human
guagagugggagc

SEQ ID NO: 3306947 - RNA, 15 nt, Human
guagagugggagcug

SEQ ID NO: 3306948 - RNA, 13 nt, Human
guauuacuucugc

SEQ ID NO: 3306949 - RNA, 14 nt, Human
guauuacuucugcu

SEQ ID NO: 3306950 - RNA, 15 nt, Human
guauuacuucugcua

SEQ ID NO: 3306951 - RNA, 14 nt, Human
guauuauaccuuuu

SEQ ID NO: 3306952 - RNA, 15 nt, Human
gucaauuacaggaag

SEQ ID NO: 3306953 - RNA, 13 nt, Human
gucaauuacagga

SEQ ID NO: 3306954 - RNA, 20 nt, Human
gucaccugaagacucauucu

SEQ ID NO: 3306955 - RNA, 13 nt, Human
gucaccccggcca

SEQ ID NO: 3306956 - RNA, 18 nt, Human
gucaagagggucugagga

SEQ ID NO: 3306957 - RNA, 19 nt, Human
gucaagagggucugaggaa

SEQ ID NO: 3306958 - RNA, 18 nt, Human
gucaagugaaaaaggagg

SEQ ID NO: 3306959 - RNA, 16 nt, Human
gucaagugaaaaagga

SEQ ID NO: 3306960 - RNA, 19 nt, Human
gucaagugaaaaaggagga

SEQ ID NO: 3306961 - RNA, 12 nt, Human
gucccagugccg

SEQ ID NO: 3306962 - RNA, 13 nt, Human
guccuacucugug

SEQ ID NO: 3306963 - RNA, 17 nt, Human
gucccugguggcagcuc

SEQ ID NO: 3306964 - RNA, 16 nt, Human
gucccugguggcagcu

SEQ ID NO: 3306965 - RNA, 15 nt, Human
guccuacucuguguc

SEQ ID NO: 3306966 - RNA, 23 nt, Human
guccuacucugugucaggugggg

SEQ ID NO: 3306967 - RNA, 23 nt, Human
guccuagaaauuccccacccuga

SEQ ID NO: 3306968 - RNA, 15 nt, Human
guccugggagugagc

SEQ ID NO: 3306969 - RNA, 16 nt, Human
guccugggagugagcu

SEQ ID NO: 3306970 - RNA, 17 nt, Human
guccuggcaugggaaug

SEQ ID NO: 3306971 - RNA, 12 nt, Human
guccucccaucu

SEQ ID NO: 3306972 - RNA, 14 nt, Human
guccucccaucuca

SEQ ID NO: 3306973 - RNA, 13 nt, Human
guccucccaucuc

SEQ ID NO: 3306974 - RNA, 23 nt, Human
guccucccaucucacacaugagc

SEQ ID NO: 3306975 - RNA, 19 nt, Human
guccugggagugagcuggu

SEQ ID NO: 3306976 - RNA, 17 nt, Human
guccugggagugagcug

SEQ ID NO: 3306977 - RNA, 18 nt, Human
guccugggagugagcugg

SEQ ID NO: 3306978 - RNA, 15 nt, Human
gucuacacugugcug

SEQ ID NO: 3306979 - RNA, 15 nt, Human
guccuuaccagcaga

SEQ ID NO: 3306980 - RNA, 17 nt, Human
guccuuaccagcagagc

SEQ ID NO: 3306981 - RNA, 16 nt, Human
guccuuaccagcagag

SEQ ID NO: 3306982 - RNA, 20 nt, Human
gucucacuauguugcccagg

SEQ ID NO: 3306983 - RNA, 21 nt, Human
gucucacuauguugcccaggc

SEQ ID NO: 3306984 - RNA, 13 nt, Human
gucucacuguugc

SEQ ID NO: 3306985 - RNA, 23 nt, Human
gucucacuauguugcccaggcag

SEQ ID NO: 3306986 - RNA, 16 nt, Human
gucucacuguugccca

SEQ ID NO: 3306987 - RNA, 17 nt, Human
gucucacuguugcccag

SEQ ID NO: 3306988 - RNA, 18 nt, Human
gucucacuguugcccagg

SEQ ID NO: 3306989 - RNA, 19 nt, Human
gucucacuguugcccaggc

SEQ ID NO: 3306990 - RNA, 20 nt, Human
gucucacuguugcccaggcu

SEQ ID NO: 3306991 - RNA, 21 nt, Human
gucucacuguugcccaggcug

SEQ ID NO: 3306992 - RNA, 22 nt, Human
gucucacuguugcccaggcugg

SEQ ID NO: 3306993 - RNA, 23 nt, Human
gucucacuguugcccaggcuggc

SEQ ID NO: 3306994 - RNA, 17 nt, Human
gucugauucccaagcuc

SEQ ID NO: 3306995 - RNA, 18 nt, Human
gucugauucccaagcucu

SEQ ID NO: 3306996 - RNA, 19 nt, Human
gucugauucccaagcucug

SEQ ID NO: 3306997 - RNA, 21 nt, Human
gucugaggaauccagacccgg

SEQ ID NO: 3306998 - RNA, 20 nt, Human
gucugauucccaagcucugc

SEQ ID NO: 3306999 - RNA, 21 nt, Human
gucugauucccaagcucugcu

SEQ ID NO: 3307000 - RNA, 13 nt, Human
gucugacccacug

SEQ ID NO: 3307001 - RNA, 14 nt, Human
gucugacccacugc

SEQ ID NO: 3307002 - RNA, 15 nt, Human
gucugacccacugcu

SEQ ID NO: 3307003 - RNA, 18 nt, Human
gucugaggaauccagacc

SEQ ID NO: 3307004 - RNA, 19 nt, Human
gucugaggaauccagaccc

SEQ ID NO: 3307005 - RNA, 11 nt, Human
gugaggccaga

SEQ ID NO: 3307006 - RNA, 15 nt, Human
gugauccacccaccu

SEQ ID NO: 3307007 - RNA, 18 nt, Human
gugauccacccaccucag

SEQ ID NO: 3307008 - RNA, 20 nt, Human
gugauccacccaccucagcc

SEQ ID NO: 3307009 - RNA, 20 nt, Human
gugauccucccaccucagcc

SEQ ID NO: 3307010 - RNA, 22 nt, Human
gugauccucccaccucagccuc

SEQ ID NO: 3307011 - RNA, 14 nt, Human
gugauccucccacc

SEQ ID NO: 3307012 - RNA, 15 nt, Human
gugauccucccaccu

SEQ ID NO: 3307013 - RNA, 18 nt, Human
gugauccucccaccucag

SEQ ID NO: 3307014 - RNA, 12 nt, Human
gugauuuucauu

SEQ ID NO: 3307015 - RNA, 23 nt, Human
gugauucuccugccucagccucc

SEQ ID NO: 3307016 - RNA, 14 nt, Human
gugauucuccugcc

SEQ ID NO: 3307017 - RNA, 16 nt, Human
gugauucuccugccuc

SEQ ID NO: 3307018 - RNA, 17 nt, Human
gugauucuccugccuca

SEQ ID NO: 3307019 - RNA, 18 nt, Human
gugauucuccugccucag

SEQ ID NO: 3307020 - RNA, 19 nt, Human
gugauucuccugccucagc

SEQ ID NO: 3307021 - RNA, 20 nt, Human
gugauucuccugccucagcc

SEQ ID NO: 3307022 - RNA, 22 nt, Human
gugauucuccugccucagccuc

SEQ ID NO: 3307023 - RNA, 19 nt, Human
gugcauaaguuaacuucca

SEQ ID NO: 3307024 - RNA, 20 nt, Human
gugccagguuuuuggucuga

SEQ ID NO: 3307025 - RNA, 22 nt, Human
gugccagguuuuuggucugacc

SEQ ID NO: 3307026 - RNA, 14 nt, Human
gugcauaccacuuu

SEQ ID NO: 3307027 - RNA, 13 nt, Human
gugcauaccacuu

SEQ ID NO: 3307028 - RNA, 20 nt, Human
gugcccacaggaucagucug

SEQ ID NO: 3307029 - RNA, 15 nt, Human
gugacugaauuucuu

SEQ ID NO: 3307030 - RNA, 18 nt, Human
gugacugaauuucuuuug

SEQ ID NO: 3307031 - RNA, 16 nt, Human
gugacugaauuucuuu

SEQ ID NO: 3307032 - RNA, 15 nt, Human
gugaccucugccuga

SEQ ID NO: 3307033 - RNA, 16 nt, Human
gugacaacacuugugu

SEQ ID NO: 3307034 - RNA, 11 nt, Human
gugaggaagcc

SEQ ID NO: 3307035 - RNA, 19 nt, Human
gugaggaagccgcuggggc

SEQ ID NO: 3307036 - RNA, 16 nt, Human
gugaggaagccgcugg

SEQ ID NO: 3307037 - RNA, 17 nt, Human
gugacugaucucucgug

SEQ ID NO: 3307038 - RNA, 13 nt, Human
gugagccacugca

SEQ ID NO: 3307039 - RNA, 19 nt, Human
gugaaaggaaagagggagg

SEQ ID NO: 3307040 - RNA, 12 nt, Human
gugaaacuggau

SEQ ID NO: 3307041 - RNA, 23 nt, Human
gugaaaagaaaaaugagccuggc

SEQ ID NO: 3307042 - RNA, 14 nt, Human
gugaaaagaaaaau

SEQ ID NO: 3307043 - RNA, 15 nt, Human
gugcucuggacaggc

SEQ ID NO: 3307044 - RNA, 16 nt, Human
gugcucuggacaggca

SEQ ID NO: 3307045 - RNA, 21 nt, Human
gugccuuggggacaagagcag

SEQ ID NO: 3307046 - RNA, 19 nt, Human
gugcugaaugguuuucaaa

SEQ ID NO: 3307047 - RNA, 20 nt, Human
gugcugaaugguuuucaaaa

SEQ ID NO: 3307048 - RNA, 23 nt, Human
gugcugaaugguuuucaaaauaa

SEQ ID NO: 3307049 - RNA, 17 nt, Human
gugcucuggacaggcau

SEQ ID NO: 3307050 - RNA, 18 nt, Human
gugcucuggacaggcaug

SEQ ID NO: 3307051 - RNA, 14 nt, Human
gugcucuggacagg

SEQ ID NO: 3307052 - RNA, 15 nt, Human
gugcugccauccagg

SEQ ID NO: 3307053 - RNA, 18 nt, Human
gugcugccauccagguuc

SEQ ID NO: 3307054 - RNA, 19 nt, Human
gugcugccauccagguuca

SEQ ID NO: 3307055 - RNA, 20 nt, Human
gugcugcauuuaaaagauac

SEQ ID NO: 3307056 - RNA, 19 nt, Human
gugcugcauuuaaaagaua

SEQ ID NO: 3307057 - RNA, 12 nt, Human
gugcugcauuua

SEQ ID NO: 3307058 - RNA, 12 nt, Human
gugcugagucug

SEQ ID NO: 3307059 - RNA, 19 nt, Human
gugcugagucugaaggcug

SEQ ID NO: 3307060 - RNA, 18 nt, Human
gugcugagucugaaggcu

SEQ ID NO: 3307061 - RNA, 17 nt, Human
gugcugagucugaaggc

SEQ ID NO: 3307062 - RNA, 16 nt, Human
gugcugagucugaagg

SEQ ID NO: 3307063 - RNA, 12 nt, Human
gugcuuggagga

SEQ ID NO: 3307064 - RNA, 15 nt, Human
gugcuuggaggaagg

SEQ ID NO: 3307065 - RNA, 13 nt, Human
gugcuuggaggaa

SEQ ID NO: 3307066 - RNA, 11 nt, Human
gugcugcccug

SEQ ID NO: 3307067 - RNA, 22 nt, Human
gugcugccauccagguucagcu

SEQ ID NO: 3307068 - RNA, 18 nt, Human
guggaaaaauagccugcc

SEQ ID NO: 3307069 - RNA, 19 nt, Human
guggcagugggagcugccu

SEQ ID NO: 3307070 - RNA, 21 nt, Human
guggcagugggagcugccugu

SEQ ID NO: 3307071 - RNA, 19 nt, Human
guggcagcugcgguccacc

SEQ ID NO: 3307072 - RNA, 21 nt, Human
guggcagcugcgguccaccca

SEQ ID NO: 3307073 - RNA, 22 nt, Human
guggcagcugcgguccacccag

SEQ ID NO: 3307074 - RNA, 23 nt, Human
guggcagcugcgguccacccagg

SEQ ID NO: 3307075 - RNA, 12 nt, Human
guggcagcugcu

SEQ ID NO: 3307076 - RNA, 13 nt, Human
guggcagcugcuu

SEQ ID NO: 3307077 - RNA, 19 nt, Human
guggcagcugcuuuugucu

SEQ ID NO: 3307078 - RNA, 16 nt, Human
guggcagugggagcug

SEQ ID NO: 3307079 - RNA, 17 nt, Human
guggcagugggagcugc

SEQ ID NO: 3307080 - RNA, 15 nt, Human
guggcagugggagcu

SEQ ID NO: 3307081 - RNA, 20 nt, Human
guggagaagcggcuggcagc

SEQ ID NO: 3307082 - RNA, 16 nt, Human
guggaugccugguggc

SEQ ID NO: 3307083 - RNA, 18 nt, Human
guggaugccugguggcag

SEQ ID NO: 3307084 - RNA, 17 nt, Human
guggaguucaucuugaa

SEQ ID NO: 3307085 - RNA, 17 nt, Human
ugcugggcuugucugua

SEQ ID NO: 3307086 - RNA, 13 nt, Human
ugcuggguguggc

SEQ ID NO: 3307087 - RNA, 14 nt, Human
ugcugcauuuaaaa

SEQ ID NO: 3307088 - RNA, 23 nt, Human
ugcugcauuuaaaagauacaguu

SEQ ID NO: 3307089 - RNA, 19 nt, Human
ugcugcauuuaaaagauac

SEQ ID NO: 3307090 - RNA, 18 nt, Human
ugcugcauuuaaaagaua

SEQ ID NO: 3307091 - RNA, 17 nt, Human
ugcugcauuuaaaagau

SEQ ID NO: 3307092 - RNA, 12 nt, Human
ugcugcuugagg

SEQ ID NO: 3307093 - RNA, 20 nt, Human
ugcugggauuacagguguga

SEQ ID NO: 3307094 - RNA, 19 nt, Human
ugcugcuugaggcaacuca

SEQ ID NO: 3307095 - RNA, 22 nt, Human
ugcuaggaacacuccuucacag

SEQ ID NO: 3307096 - RNA, 20 nt, Human
ugcuaggaacacuccuucac

SEQ ID NO: 3307097 - RNA, 21 nt, Human
ugcuaggaacacuccuucaca

SEQ ID NO: 3307098 - RNA, 17 nt, Human
ugcucacauaucuguca

SEQ ID NO: 3307099 - RNA, 23 nt, Human
ugcucuccgaccagacaccuuga

SEQ ID NO: 3307100 - RNA, 21 nt, Human
ugcuacuguccuacccacccu

SEQ ID NO: 3307101 - RNA, 22 nt, Human
ugcuacuguccuacccacccuc

SEQ ID NO: 3307102 - RNA, 22 nt, Human
ugccaggaagccagcaggcucu

SEQ ID NO: 3307103 - RNA, 20 nt, Human
ugccaggaagccagcaggcu

SEQ ID NO: 3307104 - RNA, 14 nt, Human
ugccaggcauggug

SEQ ID NO: 3307105 - RNA, 10 nt, Human
ugccaggcau

SEQ ID NO: 3307106 - RNA, 19 nt, Human
ugccaggaagccagcaggc

SEQ ID NO: 3307107 - RNA, 20 nt, Human
ugccacccuggggagaaagu

SEQ ID NO: 3307108 - RNA, 21 nt, Human
ugcauuuggugguuucagaaa

SEQ ID NO: 3307109 - RNA, 23 nt, Human
ugcauuuggugguuucagaaaug

SEQ ID NO: 3307110 - RNA, 15 nt, Human
ugcaguugccaguca

SEQ ID NO: 3307111 - RNA, 16 nt, Human
ugcaguugccagucac

SEQ ID NO: 3307112 - RNA, 19 nt, Human
ugcaucaagaugugacaug

SEQ ID NO: 3307113 - RNA, 13 nt, Human
ugcagggaguccg

SEQ ID NO: 3307114 - RNA, 20 nt, Human
ugcaguggugcgaucugggu

SEQ ID NO: 3307115 - RNA, 21 nt, Human
ugcaguggugcgaucuggguu

SEQ ID NO: 3307116 - RNA, 21 nt, Human
ugcaguuacacuaaaagguga

SEQ ID NO: 3307117 - RNA, 14 nt, Human
ugcccugcccaccu

SEQ ID NO: 3307118 - RNA, 15 nt, Human
ugcccugcccaccug

SEQ ID NO: 3307119 - RNA, 20 nt, Human
ugcccugcccaccuggccuc

SEQ ID NO: 3307120 - RNA, 16 nt, Human
ugcccugcccaccugg

SEQ ID NO: 3307121 - RNA, 15 nt, Human
ugccucaagagaagg

SEQ ID NO: 3307122 - RNA, 14 nt, Human
ugccucaagagaag

SEQ ID NO: 3307123 - RNA, 16 nt, Human
ugccccuggcagcccc

SEQ ID NO: 3307124 - RNA, 12 nt, Human
ugcccggcugcg

SEQ ID NO: 3307125 - RNA, 14 nt, Human
ugcccggcugcgga

SEQ ID NO: 3307126 - RNA, 13 nt, Human
ugcccaggcuggc

SEQ ID NO: 3307127 - RNA, 20 nt, Human
ugcccaggcuggcgugcagu

SEQ ID NO: 3307128 - RNA, 18 nt, Human
ugcccaggcuggcgugca

SEQ ID NO: 3307129 - RNA, 19 nt, Human
ugcccaggcuggcgugcag

SEQ ID NO: 3307130 - RNA, 11 nt, Human
uggcugcuuca

SEQ ID NO: 3307131 - RNA, 15 nt, Human
uggcugggggccuca

SEQ ID NO: 3307132 - RNA, 15 nt, Human
uggcugcuucaagga

SEQ ID NO: 3307133 - RNA, 23 nt, Human
uggccucccaacucaccccagcc

SEQ ID NO: 3307134 - RNA, 23 nt, Human
uggcgcagcauauucaggaagcu

SEQ ID NO: 3307135 - RNA, 22 nt, Human
uggcgcagcauauucaggaagc

SEQ ID NO: 3307136 - RNA, 16 nt, Human
uggcgcugccccuggc

SEQ ID NO: 3307137 - RNA, 23 nt, Human
uggcgcugccccuggcagccccu

SEQ ID NO: 3307138 - RNA, 15 nt, Human
uggcgcugccccugg

SEQ ID NO: 3307139 - RNA, 14 nt, Human
uggccccugcccgg

SEQ ID NO: 3307140 - RNA, 15 nt, Human
uggccccugcccggc

SEQ ID NO: 3307141 - RNA, 16 nt, Human
uggccccugcccggcu

SEQ ID NO: 3307142 - RNA, 13 nt, Human
uggccaggcuggu

SEQ ID NO: 3307143 - RNA, 19 nt, Human
uggccagaugcaccagccc

SEQ ID NO: 3307144 - RNA, 15 nt, Human
uggccagaugcacca

SEQ ID NO: 3307145 - RNA, 17 nt, Human
uggccagaugcaccagc

SEQ ID NO: 3307146 - RNA, 18 nt, Human
uggccagaugcaccagcc

SEQ ID NO: 3307147 - RNA, 19 nt, Human
uggcagaguugaagacaga

SEQ ID NO: 3307148 - RNA, 17 nt, Human
uggcagaguugaagaca

SEQ ID NO: 3307149 - RNA, 21 nt, Human
uggcagaguggauucuugaac

SEQ ID NO: 3307150 - RNA, 15 nt, Human
uggcagaguugaaga

SEQ ID NO: 3307151 - RNA, 20 nt, Human
uggaggaaggaaacccagcu

SEQ ID NO: 3307152 - RNA, 23 nt, Human
uggaggaaggaaacccagcucug

SEQ ID NO: 3307153 - RNA, 21 nt, Human
uggaggaaggaaacccagcuc

SEQ ID NO: 3307154 - RNA, 12 nt, Human
uggcaaaaaggc

SEQ ID NO: 3307155 - RNA, 16 nt, Human
uggcaaaaaggcagga

SEQ ID NO: 3307156 - RNA, 15 nt, Human
uggcacuauaaugua

SEQ ID NO: 3307157 - RNA, 16 nt, Human
uggcacuauaauguaa

SEQ ID NO: 3307158 - RNA, 23 nt, Human
uggacaggcauguucucugagga

SEQ ID NO: 3307159 - RNA, 14 nt, Human
uggucccccuucca

SEQ ID NO: 3307160 - RNA, 13 nt, Human
uggucccacucag

SEQ ID NO: 3307161 - RNA, 18 nt, Human
ugguaugaucacggcuca

SEQ ID NO: 3307162 - RNA, 23 nt, Human
uggucccccuuccauggacuuug

SEQ ID NO: 3307163 - RNA, 18 nt, Human
uggucccccuuccaugga

SEQ ID NO: 3307164 - RNA, 16 nt, Human
uggucccccuuccaug

SEQ ID NO: 3307165 - RNA, 15 nt, Human
uggucccccuuccau

SEQ ID NO: 3307166 - RNA, 23 nt, Human
ugguccugcugcaguugccaguc

SEQ ID NO: 3307167 - RNA, 15 nt, Human
ugguccugcugcagu

SEQ ID NO: 3307168 - RNA, 13 nt, Human
ugguccugcugca

SEQ ID NO: 3307169 - RNA, 19 nt, Human
ugguccuaaucuucugaac

SEQ ID NO: 3307170 - RNA, 17 nt, Human
ugguccuaaucuucuga

SEQ ID NO: 3307171 - RNA, 14 nt, Human
uggucggaaaacau

SEQ ID NO: 3307172 - RNA, 17 nt, Human
uggucggaaaacaugcu

SEQ ID NO: 3307173 - RNA, 18 nt, Human
uggucuacacugugcuga

SEQ ID NO: 3307174 - RNA, 17 nt, Human
uggucuacacugugcug

SEQ ID NO: 3307175 - RNA, 16 nt, Human
uggucuacacugugcu

SEQ ID NO: 3307176 - RNA, 15 nt, Human
uggucuacacugugc

SEQ ID NO: 3307177 - RNA, 13 nt, Human
uggugaccucugc

SEQ ID NO: 3307178 - RNA, 14 nt, Human
uggugaccucugcc

SEQ ID NO: 3307179 - RNA, 20 nt, Human
uggugcaaugaccuuucaau

SEQ ID NO: 3307180 - RNA, 21 nt, Human
uggugcaaugaccuuucaaua

SEQ ID NO: 3307181 - RNA, 14 nt, Human
uggugagaggcauc

SEQ ID NO: 3307182 - RNA, 15 nt, Human
uggugaccucugccu

SEQ ID NO: 3307183 - RNA, 16 nt, Human
uggugaccucugccug

SEQ ID NO: 3307184 - RNA, 17 nt, Human
uggugaccucugccuga

SEQ ID NO: 3307185 - RNA, 22 nt, Human
uggugaccucugccugaaguca

SEQ ID NO: 3307186 - RNA, 19 nt, Human
uggugacuuuccucuuugg

SEQ ID NO: 3307187 - RNA, 16 nt, Human
ugggggaguggccaca

SEQ ID NO: 3307188 - RNA, 16 nt, Human
uggguaacuagggaag

SEQ ID NO: 3307189 - RNA, 17 nt, Human
uggguacuuguggacac

SEQ ID NO: 3307190 - RNA, 18 nt, Human
uggguacuuguggacaca

SEQ ID NO: 3307191 - RNA, 22 nt, Human
ugggcuucauccuccucagauc

SEQ ID NO: 3307192 - RNA, 15 nt, Human
uggggaugagaaagg

SEQ ID NO: 3307193 - RNA, 23 nt, Human
uggggaugagaaagguugaagca

SEQ ID NO: 3307194 - RNA, 20 nt, Human
uggggccaguuggucccccu

SEQ ID NO: 3307195 - RNA, 16 nt, Human
ugggagugggcccaau

SEQ ID NO: 3307196 - RNA, 14 nt, Human
ugggagugggccca

SEQ ID NO: 3307197 - RNA, 16 nt, Human
uggcugggggccucag

SEQ ID NO: 3307198 - RNA, 17 nt, Human
uggcugggggccucagu

SEQ ID NO: 3307199 - RNA, 13 nt, Human
ugggauccuccag

SEQ ID NO: 3307200 - RNA, 12 nt, Human
ugggauccucca

SEQ ID NO: 3307201 - RNA, 22 nt, Human
ugggauuacaagcgugagccac

SEQ ID NO: 3307202 - RNA, 18 nt, Human
ugggcagagcagagacca

SEQ ID NO: 3307203 - RNA, 22 nt, Human
ugggcagagcagagaccauccc

SEQ ID NO: 3307204 - RNA, 23 nt, Human
ugggcagagcagagaccaucccu

SEQ ID NO: 3307205 - RNA, 14 nt, Human
ugggccuggcuccc

SEQ ID NO: 3307206 - RNA, 18 nt, Human
ugaaagcccugagcuuuc

SEQ ID NO: 3307207 - RNA, 18 nt, Human
ugaaagggcccagagagg

SEQ ID NO: 3307208 - RNA, 13 nt, Human
ugaaagggcccag

SEQ ID NO: 3307209 - RNA, 23 nt, Human
ugaaagggaguauuacaaaaaca

SEQ ID NO: 3307210 - RNA, 14 nt, Human
ugaaacauuuuguc

SEQ ID NO: 3307211 - RNA, 13 nt, Human
ugaaaauuuugau

SEQ ID NO: 3307212 - RNA, 12 nt, Human
ugaaaauuuuga

SEQ ID NO: 3307213 - RNA, 21 nt, Human
ugaaaauuuugauguuuuaag

SEQ ID NO: 3307214 - RNA, 19 nt, Human
ugaaaauuuugauguuuua

SEQ ID NO: 3307215 - RNA, 22 nt, Human
ugaaccacaucuugcucugcug

SEQ ID NO: 3307216 - RNA, 22 nt, Human
ugaaccaagaacuuuccaggaa

SEQ ID NO: 3307217 - RNA, 23 nt, Human
ugaaccacaucuugcucugcuga

SEQ ID NO: 3307218 - RNA, 17 nt, Human
ugaaccaccacacccag

SEQ ID NO: 3307219 - RNA, 20 nt, Human
ugaaccaccacacccagccc

SEQ ID NO: 3307220 - RNA, 16 nt, Human
ugaacuccuggccuca

SEQ ID NO: 3307221 - RNA, 23 nt, Human
ucuuucacccuuuucuguuugcu

SEQ ID NO: 3307222 - RNA, 21 nt, Human
ucuuguguguuuauugucaaa

SEQ ID NO: 3307223 - RNA, 16 nt, Human
ucuuguguguuuauug

SEQ ID NO: 3307224 - RNA, 23 nt, Human
ucuugcaauggcagccuuggcaa

SEQ ID NO: 3307225 - RNA, 20 nt, Human
ucuccucugcugcuggcugg

SEQ ID NO: 3307226 - RNA, 16 nt, Human
ucucccuucauccuuc

SEQ ID NO: 3307227 - RNA, 17 nt, Human
ucuuuggacacucacac

SEQ ID NO: 3307228 - RNA, 21 nt, Human
ucuuucagccaagaauucuua

SEQ ID NO: 3307229 - RNA, 20 nt, Human
ucuuucagccaagaauucuu

SEQ ID NO: 3307230 - RNA, 19 nt, Human
ucuuucagccaagaauucu

SEQ ID NO: 3307231 - RNA, 16 nt, Human
ucuuucagccaagaau

SEQ ID NO: 3307232 - RNA, 14 nt, Human
ucuuuccaaaguac

SEQ ID NO: 3307233 - RNA, 13 nt, Human
ucuuuccaaagua

SEQ ID NO: 3307234 - RNA, 17 nt, Human
ugaaggccccgcccagg

SEQ ID NO: 3307235 - RNA, 17 nt, Human
ugaacuccuggccucaa

SEQ ID NO: 3307236 - RNA, 16 nt, Human
ugaaggccccgcccag

SEQ ID NO: 3307237 - RNA, 15 nt, Human
ugaaggccccgccca

SEQ ID NO: 3307238 - RNA, 22 nt, Human
ugaaggacauugcggacagcca

SEQ ID NO: 3307239 - RNA, 19 nt, Human
ugaaggacauugcggacag

SEQ ID NO: 3307240 - RNA, 20 nt, Human
ugaaggacauugcggacagc

SEQ ID NO: 3307241 - RNA, 19 nt, Human
ugaccagcaccaucucucc

SEQ ID NO: 3307242 - RNA, 15 nt, Human
ugacaugucuuuucu

SEQ ID NO: 3307243 - RNA, 13 nt, Human
ugacaugucuuuu

SEQ ID NO: 3307244 - RNA, 16 nt, Human
ugaccauucuccaccu

SEQ ID NO: 3307245 - RNA, 18 nt, Human
ugaccauucuccaccugc

SEQ ID NO: 3307246 - RNA, 17 nt, Human
ugaccauucuccaccug

SEQ ID NO: 3307247 - RNA, 20 nt, Human
ugaccgugaggccagagaca

SEQ ID NO: 3307248 - RNA, 16 nt, Human
ugaccgugaggccaga

SEQ ID NO: 3307249 - RNA, 14 nt, Human
ugaccgugaggcca

SEQ ID NO: 3307250 - RNA, 13 nt, Human
ugaccgugaggcc

SEQ ID NO: 3307251 - RNA, 14 nt, Human
ugaccauucuccac

SEQ ID NO: 3307252 - RNA, 19 nt, Human
ugacagagugagacucugu

SEQ ID NO: 3307253 - RNA, 18 nt, Human
ugacagaggcagccccau

SEQ ID NO: 3307254 - RNA, 23 nt, Human
ugacagaggcagccccauucugc

SEQ ID NO: 3307255 - RNA, 14 nt, Human
ugacagagugagac

SEQ ID NO: 3307256 - RNA, 17 nt, Human
ugacagagugagacucu

SEQ ID NO: 3307257 - RNA, 13 nt, Human
ugacagaggcagc

SEQ ID NO: 3307258 - RNA, 20 nt, Human
ugacagacacaggcccggcu

SEQ ID NO: 3307259 - RNA, 23 nt, Human
ugacagacacaggcccggcucca

SEQ ID NO: 3307260 - RNA, 14 nt, Human
ugacagaggcagcc

SEQ ID NO: 3307261 - RNA, 15 nt, Human
ugacagaggcagccc

SEQ ID NO: 3307262 - RNA, 16 nt, Human
ugacagaggcagcccc

SEQ ID NO: 3307263 - RNA, 17 nt, Human
ugacagaggcagcccca

SEQ ID NO: 3307264 - RNA, 20 nt, Human
ugauguucuuucacccuuuu

SEQ ID NO: 3307265 - RNA, 20 nt, Human
ugauucaacagguuuuccug

SEQ ID NO: 3307266 - RNA, 16 nt, Human
ugauucagacagcugc

SEQ ID NO: 3307267 - RNA, 15 nt, Human
ugauucagacagcug

SEQ ID NO: 3307268 - RNA, 14 nt, Human
ugauucagacagcu

SEQ ID NO: 3307269 - RNA, 13 nt, Human
ugauucagacagc

SEQ ID NO: 3307270 - RNA, 21 nt, Human
ugauuggaggggggagguggg

SEQ ID NO: 3307271 - RNA, 13 nt, Human
ugauuggaggggg

SEQ ID NO: 3307272 - RNA, 16 nt, Human
ugauugugucucuugg

SEQ ID NO: 3307273 - RNA, 20 nt, Human
ugauucuccugccucagccu

SEQ ID NO: 3307274 - RNA, 21 nt, Human
ugauucuccugccucagccuc

SEQ ID NO: 3307275 - RNA, 23 nt, Human
ugauucagacagcugccugggau

SEQ ID NO: 3307276 - RNA, 21 nt, Human
ugauucagacagcugccuggg

SEQ ID NO: 3307277 - RNA, 20 nt, Human
ugauucagacagcugccugg

SEQ ID NO: 3307278 - RNA, 19 nt, Human
ugauucagacagcugccug

SEQ ID NO: 3307279 - RNA, 18 nt, Human
ugauucagacagcugccu

SEQ ID NO: 3307280 - RNA, 16 nt, Human
ugauguguuaucucuu

SEQ ID NO: 3307281 - RNA, 17 nt, Human
ugaugcuucuucagaga

SEQ ID NO: 3307282 - RNA, 16 nt, Human
ugaugcuucuucagag

SEQ ID NO: 3307283 - RNA, 16 nt, Human
ugaucuuugcagacag

SEQ ID NO: 3307284 - RNA, 20 nt, Human
ugaucuucuuuauaauucua

SEQ ID NO: 3307285 - RNA, 17 nt, Human
ugauccacccaccucag

SEQ ID NO: 3307286 - RNA, 18 nt, Human
ugauccacccaccucagc

SEQ ID NO: 3307287 - RNA, 13 nt, Human
ugauagcacagac

SEQ ID NO: 3307288 - RNA, 13 nt, Human
ugauccaagcugg

SEQ ID NO: 3307289 - RNA, 14 nt, Human
ugauccaagcuggu

SEQ ID NO: 3307290 - RNA, 15 nt, Human
ugauccaagcugguc

SEQ ID NO: 3307291 - RNA, 16 nt, Human
ugauccacccaccuca

SEQ ID NO: 3307292 - RNA, 14 nt, Human
ugaggcucugcccu

SEQ ID NO: 3307293 - RNA, 13 nt, Human
ugaggcucugccc

SEQ ID NO: 3307294 - RNA, 17 nt, Human
ugagggaacagagaggu

SEQ ID NO: 3307295 - RNA, 13 nt, Human
ugaggugggagga

SEQ ID NO: 3307296 - RNA, 12 nt, Human
ugaggugggagg

SEQ ID NO: 3307297 - RNA, 13 nt, Human
ugagcugggauga

SEQ ID NO: 3307298 - RNA, 12 nt, Human
ugaggcauuugu

SEQ ID NO: 3307299 - RNA, 20 nt, Human
ugaggcauuuguuugaacug

SEQ ID NO: 3307300 - RNA, 19 nt, Human
ugaggcauuuguuugaacu

SEQ ID NO: 3307301 - RNA, 17 nt, Human
ugaggcuaguguggugu

SEQ ID NO: 3307302 - RNA, 21 nt, Human
ugaggcauuuguuugaacuga

SEQ ID NO: 3307303 - RNA, 23 nt, Human
ugaggcuagugugguguuuccug

SEQ ID NO: 3307304 - RNA, 20 nt, Human
ugaguugauagcacagaccc

SEQ ID NO: 3307305 - RNA, 16 nt, Human
ugaguugauagcacag

SEQ ID NO: 3307306 - RNA, 19 nt, Human
ugaguccagaaguuugaga

SEQ ID NO: 3307307 - RNA, 13 nt, Human
ugaguccagaagu

SEQ ID NO: 3307308 - RNA, 18 nt, Human
ugagucgaggacagggag

SEQ ID NO: 3307309 - RNA, 19 nt, Human
ugagucgaggacagggagg

SEQ ID NO: 3307310 - RNA, 18 nt, Human
ugagucugaaggcugggu

SEQ ID NO: 3307311 - RNA, 17 nt, Human
ugagucugaaggcuggg

SEQ ID NO: 3307312 - RNA, 15 nt, Human
ugagucugaaggcug

SEQ ID NO: 3307313 - RNA, 13 nt, Human
ugagucugaaggc

SEQ ID NO: 3307314 - RNA, 22 nt, Human
ugagacucgcgacaaugcaaac

SEQ ID NO: 3307315 - RNA, 21 nt, Human
ugagacucgcgacaaugcaaa

SEQ ID NO: 3307316 - RNA, 20 nt, Human
ugagacucgcgacaaugcaa

SEQ ID NO: 3307317 - RNA, 12 nt, Human
ugagcagggcuc

SEQ ID NO: 3307318 - RNA, 13 nt, Human
ugagcagggcuca

SEQ ID NO: 3307319 - RNA, 14 nt, Human
ugagcagggcucag

SEQ ID NO: 3307320 - RNA, 15 nt, Human
ugagcagggcucagc

SEQ ID NO: 3307321 - RNA, 14 nt, Human
ugagaucagccugg

SEQ ID NO: 3307322 - RNA, 15 nt, Human
ugagaucaaaacggu

SEQ ID NO: 3307323 - RNA, 19 nt, Human
ugagacucgcgacaaugca

SEQ ID NO: 3307324 - RNA, 20 nt, Human
ugaccucaggugauccaccc

SEQ ID NO: 3307325 - RNA, 21 nt, Human
ugaccucaggugauccaccca

SEQ ID NO: 3307326 - RNA, 20 nt, Human
ugagcaucaggccaggcccu

SEQ ID NO: 3307327 - RNA, 19 nt, Human
ugagcaucaggccaggccc

SEQ ID NO: 3307328 - RNA, 18 nt, Human
ugagcaucaggccaggcc

SEQ ID NO: 3307329 - RNA, 19 nt, Human
ugagcagggcucagcgggg

SEQ ID NO: 3307330 - RNA, 16 nt, Human
ugagcagggcucagcg

SEQ ID NO: 3307331 - RNA, 17 nt, Human
ugagcagggcucagcgg

SEQ ID NO: 3307332 - RNA, 16 nt, Human
ugagcaucaggccagg

SEQ ID NO: 3307333 - RNA, 15 nt, Human
ugagccucagcaucc

SEQ ID NO: 3307334 - RNA, 22 nt, Human
ugagccucagcauccuggcacc

SEQ ID NO: 3307335 - RNA, 18 nt, Human
ugagccucagcauccugg

SEQ ID NO: 3307336 - RNA, 21 nt, Human
ugagccucagcauccuggcac

SEQ ID NO: 3307337 - RNA, 19 nt, Human
ugagccgagaucacgccac

SEQ ID NO: 3307338 - RNA, 21 nt, Human
ugagccgagaucacgccacug

SEQ ID NO: 3307339 - RNA, 17 nt, Human
ugagccucagcauccug

SEQ ID NO: 3307340 - RNA, 16 nt, Human
uccaaaguacacuguu

SEQ ID NO: 3307341 - RNA, 14 nt, Human
uccaaaguacacug

SEQ ID NO: 3307342 - RNA, 19 nt, Human
uccacuuucuagccagagg

SEQ ID NO: 3307343 - RNA, 21 nt, Human
uccacuuucuagccagaggag

SEQ ID NO: 3307344 - RNA, 20 nt, Human
uccacuuucuagccagagga

SEQ ID NO: 3307345 - RNA, 20 nt, Human
uccaggggugggacacccug

SEQ ID NO: 3307346 - RNA, 19 nt, Human
uccaggggugggacacccu

SEQ ID NO: 3307347 - RNA, 15 nt, Human
uccaggagcagccac

SEQ ID NO: 3307348 - RNA, 14 nt, Human
uccaggagcagcca

SEQ ID NO: 3307349 - RNA, 13 nt, Human
uccaggagcagcc

SEQ ID NO: 3307350 - RNA, 12 nt, Human
uccaggagcagc

SEQ ID NO: 3307351 - RNA, 14 nt, Human
uccauagagagcaa

SEQ ID NO: 3307352 - RNA, 18 nt, Human
uccagguuuaagcuguua

SEQ ID NO: 3307353 - RNA, 20 nt, Human
uccagguuuaagcuguuacu

SEQ ID NO: 3307354 - RNA, 14 nt, Human
uccccaggaggcca

SEQ ID NO: 3307355 - RNA, 21 nt, Human
ucccccagccccauccucugu

SEQ ID NO: 3307356 - RNA, 20 nt, Human
ucccccagccccauccucug

SEQ ID NO: 3307357 - RNA, 16 nt, Human
uccccaggaggccagc

SEQ ID NO: 3307358 - RNA, 15 nt, Human
uccccaggaggccag

SEQ ID NO: 3307359 - RNA, 17 nt, Human
ucccccagccccauccu

SEQ ID NO: 3307360 - RNA, 13 nt, Human
uccccaggaggcc

SEQ ID NO: 3307361 - RNA, 19 nt, Human
uccccagauugcaacaggc

SEQ ID NO: 3307362 - RNA, 20 nt, Human
uccccagauugcaacaggcu

SEQ ID NO: 3307363 - RNA, 22 nt, Human
uccccagauugcaacaggcugg

SEQ ID NO: 3307364 - RNA, 23 nt, Human
uccccagauugcaacaggcuggg

SEQ ID NO: 3307365 - RNA, 20 nt, Human
uccccagcaagugagagcug

SEQ ID NO: 3307366 - RNA, 21 nt, Human
uccccagcaagugagagcugg

SEQ ID NO: 3307367 - RNA, 22 nt, Human
uccccagcaagugagagcuggg

SEQ ID NO: 3307368 - RNA, 13 nt, Human
uccccagauugca

SEQ ID NO: 3307369 - RNA, 18 nt, Human
uccccagauugcaacagg

SEQ ID NO: 3307370 - RNA, 20 nt, Human
ucccaugagccucagcaucc

SEQ ID NO: 3307371 - RNA, 17 nt, Human
ucccaugagccucagca

SEQ ID NO: 3307372 - RNA, 24 nt, Human
ucccaggcauuccccaggaggcca

SEQ ID NO: 3307373 - RNA, 23 nt, Human
ucccaggcauuccccaggaggcc

SEQ ID NO: 3307374 - RNA, 23 nt, Human
ucccagcugugcucuggacaggc

SEQ ID NO: 3307375 - RNA, 21 nt, Human
ucccagcugugcucuggacag

SEQ ID NO: 3307376 - RNA, 22 nt, Human
ucccagcugugcucuggacagg

SEQ ID NO: 3307377 - RNA, 15 nt, Human
ucccaucuuccaagg

SEQ ID NO: 3307378 - RNA, 21 nt, Human
ucccaucugugaaaggaaaga

SEQ ID NO: 3307379 - RNA, 18 nt, Human
ucccaugagccucagcau

SEQ ID NO: 3307380 - RNA, 19 nt, Human
ucccaugagccucagcauc

SEQ ID NO: 3307381 - RNA, 22 nt, Human
ucccaccucucucacuccuuga

SEQ ID NO: 3307382 - RNA, 20 nt, Human
uccaugugggcuaguugggc

SEQ ID NO: 3307383 - RNA, 16 nt, Human
ucccaccuuggcugca

SEQ ID NO: 3307384 - RNA, 17 nt, Human
ucccaccuuggcugcag

SEQ ID NO: 3307385 - RNA, 20 nt, Human
ucccagcugugcucuggaca

SEQ ID NO: 3307386 - RNA, 13 nt, Human
ucccaccuuggcu

SEQ ID NO: 3307387 - RNA, 19 nt, Human
ucagucugauucccaagcu

SEQ ID NO: 3307388 - RNA, 21 nt, Human
ucagucugauucccaagcucu

SEQ ID NO: 3307389 - RNA, 22 nt, Human
ucagucugauucccaagcucug

SEQ ID NO: 3307390 - RNA, 20 nt, Human
ucagguggggcagcuugagg

SEQ ID NO: 3307391 - RNA, 16 nt, Human
ucaggugauccaccca

SEQ ID NO: 3307392 - RNA, 23 nt, Human
ucaggugagaagcagaggaagga

SEQ ID NO: 3307393 - RNA, 23 nt, Human
ucaggugauccacccaccucagc

SEQ ID NO: 3307394 - RNA, 17 nt, Human
ucagguggggcagcuug

SEQ ID NO: 3307395 - RNA, 18 nt, Human
ucagguggggcagcuuga

SEQ ID NO: 3307396 - RNA, 19 nt, Human
ucagguggggcagcuugag

SEQ ID NO: 3307397 - RNA, 23 nt, Human
ucagcuccagcucaccagcccca

SEQ ID NO: 3307398 - RNA, 24 nt, Human
ucagcuccagcucaccagccccag

SEQ ID NO: 3307399 - RNA, 22 nt, Human
ucagcuccagcucaccagcccc

SEQ ID NO: 3307400 - RNA, 23 nt, Human
ucagcucugcaagaauugaagca

SEQ ID NO: 3307401 - RNA, 23 nt, Human
ucaggaagcucagggccuggcuc

SEQ ID NO: 3307402 - RNA, 21 nt, Human
ucaggccugggggcugggcag

SEQ ID NO: 3307403 - RNA, 20 nt, Human
ucaguguacauggaauaaca

SEQ ID NO: 3307404 - RNA, 11 nt, Human
ucaguguacau

SEQ ID NO: 3307405 - RNA, 14 nt, Human
ucaucauccuaagc

SEQ ID NO: 3307406 - RNA, 14 nt, Human
ucauccacugugcc

SEQ ID NO: 3307407 - RNA, 17 nt, Human
ucauccacugugccaug

SEQ ID NO: 3307408 - RNA, 19 nt, Human
ucaucuugaauuguaagga

SEQ ID NO: 3307409 - RNA, 13 nt, Human
uccaaaguacacu

SEQ ID NO: 3307410 - RNA, 19 nt, Human
ucuaugggacucaaugcac

SEQ ID NO: 3307411 - RNA, 12 nt, Human
ucuaugggacuc

SEQ ID NO: 3307412 - RNA, 13 nt, Human
ucuaugggacuca

SEQ ID NO: 3307413 - RNA, 16 nt, Human
ucucauacucaccuca

SEQ ID NO: 3307414 - RNA, 18 nt, Human
ucucauacucaccucacc

SEQ ID NO: 3307415 - RNA, 13 nt, Human
ucuccacccugcu

SEQ ID NO: 3307416 - RNA, 12 nt, Human
ucuccacccugc

SEQ ID NO: 3307417 - RNA, 17 nt, Human
ucuccacccugcucucc

SEQ ID NO: 3307418 - RNA, 14 nt, Human
ucuccacccugcuc

SEQ ID NO: 3307419 - RNA, 16 nt, Human
ucuccacccugcucuc

SEQ ID NO: 3307420 - RNA, 22 nt, Human
ucuccaccugccagggacagag

SEQ ID NO: 3307421 - RNA, 19 nt, Human
ucuccaccugccagggaca

SEQ ID NO: 3307422 - RNA, 17 nt, Human
ucuccaccugccaggga

SEQ ID NO: 3307423 - RNA, 16 nt, Human
ucuccaccugccaggg

SEQ ID NO: 3307424 - RNA, 15 nt, Human
ucuccaccugccagg

SEQ ID NO: 3307425 - RNA, 14 nt, Human
ucuccaccugccag

SEQ ID NO: 3307426 - RNA, 12 nt, Human
ucucccccagcc

SEQ ID NO: 3307427 - RNA, 18 nt, Human
ucucccucagucuggccc

SEQ ID NO: 3307428 - RNA, 23 nt, Human
ucucccucagucuggcccuuccu

SEQ ID NO: 3307429 - RNA, 15 nt, Human
ucuccagccccugga

SEQ ID NO: 3307430 - RNA, 14 nt, Human
ucuccagccccugg

SEQ ID NO: 3307431 - RNA, 13 nt, Human
ucuccagccccug

SEQ ID NO: 3307432 - RNA, 12 nt, Human
ucuccagccccu

SEQ ID NO: 3307433 - RNA, 18 nt, Human
ucuccagccccuggaugc

SEQ ID NO: 3307434 - RNA, 16 nt, Human
ucuccagccccuggau

SEQ ID NO: 3307435 - RNA, 22 nt, Human
ucuccagccccuggaugcagcc

SEQ ID NO: 3307436 - RNA, 14 nt, Human
ucuaugacacaugc

SEQ ID NO: 3307437 - RNA, 17 nt, Human
ucuaugacacaugcaag

SEQ ID NO: 3307438 - RNA, 16 nt, Human
ucuaggaagacuuugg

SEQ ID NO: 3307439 - RNA, 15 nt, Human
ucuaggaagacuuug

SEQ ID NO: 3307440 - RNA, 19 nt, Human
ucuaggaagacuuuggaaa

SEQ ID NO: 3307441 - RNA, 12 nt, Human
ucuaggaagacu

SEQ ID NO: 3307442 - RNA, 22 nt, Human
ucuaucaaguauuauaccuuuu

SEQ ID NO: 3307443 - RNA, 21 nt, Human
ucuacacugugcugagucuga

SEQ ID NO: 3307444 - RNA, 15 nt, Human
ucuacagaggccaug

SEQ ID NO: 3307445 - RNA, 14 nt, Human
ucuaccuuccugca

SEQ ID NO: 3307446 - RNA, 13 nt, Human
ucgugacaacacu

SEQ ID NO: 3307447 - RNA, 20 nt, Human
ucuaaaggcuaccuuuguau

SEQ ID NO: 3307448 - RNA, 19 nt, Human
ucuaaaggcuaccuuugua

SEQ ID NO: 3307449 - RNA, 17 nt, Human
ucuaaaggcuaccuuug

SEQ ID NO: 3307450 - RNA, 18 nt, Human
ucuaaaggcuaccuuugu

SEQ ID NO: 3307451 - RNA, 14 nt, Human
uccugccaggcaug

SEQ ID NO: 3307452 - RNA, 13 nt, Human
uccugccaggcau

SEQ ID NO: 3307453 - RNA, 21 nt, Human
uccugagccagauuucacucu

SEQ ID NO: 3307454 - RNA, 11 nt, Human
uccuguagccc

SEQ ID NO: 3307455 - RNA, 13 nt, Human
uccuguagcccua

SEQ ID NO: 3307456 - RNA, 22 nt, Human
uccuguaccucuugagccuuga

SEQ ID NO: 3307457 - RNA, 23 nt, Human
uccuggcacccggccccugcugg

SEQ ID NO: 3307458 - RNA, 22 nt, Human
uccuggcacccggccccugcug

SEQ ID NO: 3307459 - RNA, 16 nt, Human
uccuggcacugcuucc

SEQ ID NO: 3307460 - RNA, 13 nt, Human
uccuggcacugcu

SEQ ID NO: 3307461 - RNA, 12 nt, Human
uccuggccucaa

SEQ ID NO: 3307462 - RNA, 20 nt, Human
uccugcccuuaccugccagg

SEQ ID NO: 3307463 - RNA, 17 nt, Human
uccugcccuuaccugcc

SEQ ID NO: 3307464 - RNA, 14 nt, Human
uccuggaguucugg

SEQ ID NO: 3307465 - RNA, 23 nt, Human
uccuauauuguuuucaguguaca

SEQ ID NO: 3307466 - RNA, 21 nt, Human
uccuauauuguuuucagugua

SEQ ID NO: 3307467 - RNA, 12 nt, Human
uccucccaccuc

SEQ ID NO: 3307468 - RNA, 17 nt, Human
uccucauuagcauuuug

SEQ ID NO: 3307469 - RNA, 18 nt, Human
uccucauuagcauuuugc

SEQ ID NO: 3307470 - RNA, 15 nt, Human
ucccuuccucuuucc

SEQ ID NO: 3307471 - RNA, 16 nt, Human
ucccuuccucuuucca

SEQ ID NO: 3307472 - RNA, 15 nt, Human
ucccccuuccaugga

SEQ ID NO: 3307473 - RNA, 16 nt, Human
uccgcuuucuacccag

SEQ ID NO: 3307474 - RNA, 18 nt, Human
uccgcuuucuacccagcg

SEQ ID NO: 3307475 - RNA, 18 nt, Human
uccuaagcuauucaguaa

SEQ ID NO: 3307476 - RNA, 20 nt, Human
uccuaagcuauucaguaaua

SEQ ID NO: 3307477 - RNA, 21 nt, Human
uccuaagcuauucaguaauaa

SEQ ID NO: 3307478 - RNA, 14 nt, Human
uccgccucuugggu

SEQ ID NO: 3307479 - RNA, 23 nt, Human
uaggugacagagugagacucugu

SEQ ID NO: 3307480 - RNA, 18 nt, Human
uaggccuggccagaugca

SEQ ID NO: 3307481 - RNA, 15 nt, Human
uaggccuggccagau

SEQ ID NO: 3307482 - RNA, 11 nt, Human
uagggaaaaac

SEQ ID NO: 3307483 - RNA, 19 nt, Human
uagggaaaaaccagcgugu

SEQ ID NO: 3307484 - RNA, 21 nt, Human
uagggaaaaaccagcguguga

SEQ ID NO: 3307485 - RNA, 20 nt, Human
uagggaaaaaccagcgugug

SEQ ID NO: 3307486 - RNA, 20 nt, Human
uauaugcucugcauguuaca

SEQ ID NO: 3307487 - RNA, 21 nt, Human
uauaugcucugcauguuacau

SEQ ID NO: 3307488 - RNA, 18 nt, Human
uauaaacuuuaccuuuuu

SEQ ID NO: 3307489 - RNA, 16 nt, Human
uaucuaaauguugaaa

SEQ ID NO: 3307490 - RNA, 19 nt, Human
uauauguuuuaagaggcag

SEQ ID NO: 3307491 - RNA, 21 nt, Human
uaucuaauauguaacaagcca

SEQ ID NO: 3307492 - RNA, 12 nt, Human
uaugacacaugc

SEQ ID NO: 3307493 - RNA, 22 nt, Human
uaugacacaugcaaggucauuu

SEQ ID NO: 3307494 - RNA, 20 nt, Human
uaucugucauuugagcaggg

SEQ ID NO: 3307495 - RNA, 21 nt, Human
uaucugucauuugagcagggc

SEQ ID NO: 3307496 - RNA, 23 nt, Human
uaucugucauuugagcagggcuc

SEQ ID NO: 3307497 - RNA, 23 nt, Human
uaugacuccagaauuucccaaag

SEQ ID NO: 3307498 - RNA, 17 nt, Human
uaugacuccagaauuuc

SEQ ID NO: 3307499 - RNA, 16 nt, Human
uaugacuccagaauuu

SEQ ID NO: 3307500 - RNA, 18 nt, Human
uaugcaaucaaaucugcu

SEQ ID NO: 3307501 - RNA, 14 nt, Human
uaugcacacauuuu

SEQ ID NO: 3307502 - RNA, 13 nt, Human
uaugcacacauuu

SEQ ID NO: 3307503 - RNA, 22 nt, Human
uaugcuuauacacuuacacuuu

SEQ ID NO: 3307504 - RNA, 13 nt, Human
uaugcaugaagua

SEQ ID NO: 3307505 - RNA, 17 nt, Human
uauggacaaugacccag

SEQ ID NO: 3307506 - RNA, 19 nt, Human
uauggaacacucugagacu

SEQ ID NO: 3307507 - RNA, 18 nt, Human
uauggaacacucugagac

SEQ ID NO: 3307508 - RNA, 17 nt, Human
uauggaacacucugaga

SEQ ID NO: 3307509 - RNA, 16 nt, Human
uauggaacacucugag

SEQ ID NO: 3307510 - RNA, 13 nt, Human
uauggaacacucu

SEQ ID NO: 3307511 - RNA, 15 nt, Human
ucacacacuuuggcu

SEQ ID NO: 3307512 - RNA, 23 nt, Human
ucacacaugagcaucaggccagg

SEQ ID NO: 3307513 - RNA, 22 nt, Human
ucacacaugagcaucaggccag

SEQ ID NO: 3307514 - RNA, 14 nt, Human
ucacauuuauucug

SEQ ID NO: 3307515 - RNA, 21 nt, Human
ucaccaaaucagcugcuacua

SEQ ID NO: 3307516 - RNA, 18 nt, Human
ucaccaacgucugugcca

SEQ ID NO: 3307517 - RNA, 17 nt, Human
ucaccaacgucugugcc

SEQ ID NO: 3307518 - RNA, 18 nt, Human
ucacccgcuaagagggag

SEQ ID NO: 3307519 - RNA, 16 nt, Human
ucaccacaugugcaca

SEQ ID NO: 3307520 - RNA, 13 nt, Human
ucaccaagcccag

SEQ ID NO: 3307521 - RNA, 23 nt, Human
ucaccgaaaacguggcugcuuca

SEQ ID NO: 3307522 - RNA, 22 nt, Human
ucaccgaaaacguggcugcuuc

SEQ ID NO: 3307523 - RNA, 21 nt, Human
ucaccgaaaacguggcugcuu

SEQ ID NO: 3307524 - RNA, 20 nt, Human
ucaccgaaaacguggcugcu

SEQ ID NO: 3307525 - RNA, 19 nt, Human
ucaccgaaaacguggcugc

SEQ ID NO: 3307526 - RNA, 15 nt, Human
ucaccgaaaacgugg

SEQ ID NO: 3307527 - RNA, 19 nt, Human
ucacccgcuaagagggagg

SEQ ID NO: 3307528 - RNA, 14 nt, Human
ucaccgaaaacgug

SEQ ID NO: 3307529 - RNA, 12 nt, Human
ucacccuuuucu

SEQ ID NO: 3307530 - RNA, 23 nt, Human
ucaaagagguuuuaaaaaaaucc

SEQ ID NO: 3307531 - RNA, 12 nt, Human
ucaaagagguuu

SEQ ID NO: 3307532 - RNA, 20 nt, Human
ucaacucuccuccagaguca

SEQ ID NO: 3307533 - RNA, 16 nt, Human
ucaaccuccugggcua

SEQ ID NO: 3307534 - RNA, 14 nt, Human
ucaaccuccugggc

SEQ ID NO: 3307535 - RNA, 15 nt, Human
ucaaccuccugggcu

SEQ ID NO: 3307536 - RNA, 18 nt, Human
ucaaccccuucgcuccug

SEQ ID NO: 3307537 - RNA, 19 nt, Human
ucaaccccuucgcuccugu

SEQ ID NO: 3307538 - RNA, 17 nt, Human
ucaagcgauucuucugc

SEQ ID NO: 3307539 - RNA, 20 nt, Human
ucaagccaccaacauacucc

SEQ ID NO: 3307540 - RNA, 12 nt, Human
ucaagccaccaa

SEQ ID NO: 3307541 - RNA, 18 nt, Human
ucaagcgauucuucugcu

SEQ ID NO: 3307542 - RNA, 19 nt, Human
ucaagcgauucuucugcuu

SEQ ID NO: 3307543 - RNA, 16 nt, Human
ucaaggauccugagcc

SEQ ID NO: 3307544 - RNA, 15 nt, Human
ucaaggauccugagc

SEQ ID NO: 3307545 - RNA, 14 nt, Human
ucaaggauccugag

SEQ ID NO: 3307546 - RNA, 13 nt, Human
ucaaggauccuga

SEQ ID NO: 3307547 - RNA, 22 nt, Human
uauguucuuaguggauguucug

SEQ ID NO: 3307548 - RNA, 21 nt, Human
uauguugcccaggcaggucuu

SEQ ID NO: 3307549 - RNA, 15 nt, Human
uauuaaaugcccagc

SEQ ID NO: 3307550 - RNA, 19 nt, Human
uauuaaaugcccagccccu

SEQ ID NO: 3307551 - RNA, 17 nt, Human
uauuaaaugcccagccc

SEQ ID NO: 3307552 - RNA, 16 nt, Human
uauuaagaaagacuau

SEQ ID NO: 3307553 - RNA, 14 nt, Human
uauuauaccuuuuu

SEQ ID NO: 3307554 - RNA, 13 nt, Human
uauuauaccuuuu

SEQ ID NO: 3307555 - RNA, 12 nt, Human
uauuauaccuuu

SEQ ID NO: 3307556 - RNA, 14 nt, Human
uauuaaggaagaca

SEQ ID NO: 3307557 - RNA, 22 nt, Human
uauuuauuaaaugcccagcccc

SEQ ID NO: 3307558 - RNA, 17 nt, Human
uauuuaugggauccugg

SEQ ID NO: 3307559 - RNA, 20 nt, Human
uauugauaugcuuauacacu

SEQ ID NO: 3307560 - RNA, 22 nt, Human
uauugcugauggugcaaugacc

SEQ ID NO: 3307561 - RNA, 23 nt, Human
uauugcugauggugcaaugaccu

SEQ ID NO: 3307562 - RNA, 13 nt, Human
uauugcccacgcu

SEQ ID NO: 3307563 - RNA, 14 nt, Human
uauugcccacgcug

SEQ ID NO: 3307564 - RNA, 15 nt, Human
uauugcccacgcugg

SEQ ID NO: 3307565 - RNA, 17 nt, Human
uuaguagagacaggguu

SEQ ID NO: 3307566 - RNA, 16 nt, Human
uuaguaugaggcauuu

SEQ ID NO: 3307567 - RNA, 18 nt, Human
uuaguaugaggcauuugu

SEQ ID NO: 3307568 - RNA, 14 nt, Human
uuagcggagacgga

SEQ ID NO: 3307569 - RNA, 22 nt, Human
uuagauaauacaccacuacauu

SEQ ID NO: 3307570 - RNA, 14 nt, Human
uuagaguugauacu

SEQ ID NO: 3307571 - RNA, 16 nt, Human
uuacuaauagacaauu

SEQ ID NO: 3307572 - RNA, 14 nt, Human
uuacuaaguuuuua

SEQ ID NO: 3307573 - RNA, 13 nt, Human
uuacuaaguuuuu

SEQ ID NO: 3307574 - RNA, 18 nt, Human
uuacuuagguguggggga

SEQ ID NO: 3307575 - RNA, 11 nt, Human
uuacuucugcu

SEQ ID NO: 3307576 - RNA, 12 nt, Human
uuacuucugcua

SEQ ID NO: 3307577 - RNA, 23 nt, Human
uuacuucuuauacauuugauaaa

SEQ ID NO: 3307578 - RNA, 21 nt, Human
uuacuuaaaccgccaaggcug

SEQ ID NO: 3307579 - RNA, 17 nt, Human
uuacuuuaaaaggagcc

SEQ ID NO: 3307580 - RNA, 18 nt, Human
uuacuuuaaaaggagcca

SEQ ID NO: 3307581 - RNA, 14 nt, Human
uuacuuuguguuca

SEQ ID NO: 3307582 - RNA, 15 nt, Human
uuagacagucccugc

SEQ ID NO: 3307583 - RNA, 14 nt, Human
uuagacagucccug

SEQ ID NO: 3307584 - RNA, 18 nt, Human
uuagacagucccugccaa

SEQ ID NO: 3307585 - RNA, 17 nt, Human
uuagacagucccugcca

SEQ ID NO: 3307586 - RNA, 16 nt, Human
uuagacagucccugcc

SEQ ID NO: 3307587 - RNA, 14 nt, Human
uuaacuuuuauaaa

SEQ ID NO: 3307588 - RNA, 17 nt, Human
uuaacuuuuauaaacuu

SEQ ID NO: 3307589 - RNA, 16 nt, Human
uuaacuuuuauaaacu

SEQ ID NO: 3307590 - RNA, 16 nt, Human
uuaacuucacauauug

SEQ ID NO: 3307591 - RNA, 15 nt, Human
uuaacuuuuauaaac

SEQ ID NO: 3307592 - RNA, 17 nt, Human
uuaaccacuucagcuga

SEQ ID NO: 3307593 - RNA, 18 nt, Human
uuaauauugauaugcuua

SEQ ID NO: 3307594 - RNA, 22 nt, Human
uuaauauugauaugcuuauaca

SEQ ID NO: 3307595 - RNA, 17 nt, Human
uuaagcuguuacugucu

SEQ ID NO: 3307596 - RNA, 21 nt, Human
uuacaagcgugagccacugca

SEQ ID NO: 3307597 - RNA, 20 nt, Human
uuacaagcgugagccacugc

SEQ ID NO: 3307598 - RNA, 16 nt, Human
uguuuagauaauacac

SEQ ID NO: 3307599 - RNA, 15 nt, Human
uguuucaaacuuuac

SEQ ID NO: 3307600 - RNA, 19 nt, Human
uguuuggggaugagaaagg

SEQ ID NO: 3307601 - RNA, 23 nt, Human
uguuuccuggcacugcuuccagu

SEQ ID NO: 3307602 - RNA, 13 nt, Human
uguuugugauuga

SEQ ID NO: 3307603 - RNA, 20 nt, Human
uguuuuaagaggcagggucu

SEQ ID NO: 3307604 - RNA, 21 nt, Human
uuaaaauaccagccaguaaau

SEQ ID NO: 3307605 - RNA, 17 nt, Human
uuaaaagauacaguuac

SEQ ID NO: 3307606 - RNA, 14 nt, Human
uuaaaagauacagu

SEQ ID NO: 3307607 - RNA, 22 nt, Human
uguuuuaagaggcagggucuca

SEQ ID NO: 3307608 - RNA, 18 nt, Human
uguuuuaaggaugcuugu

SEQ ID NO: 3307609 - RNA, 20 nt, Human
uucgggaggucgaggcagga

SEQ ID NO: 3307610 - RNA, 13 nt, Human
uucuaaagcugcc

SEQ ID NO: 3307611 - RNA, 14 nt, Human
uuccuggcacugcu

SEQ ID NO: 3307612 - RNA, 17 nt, Human
uuccugccaggcauggu

SEQ ID NO: 3307613 - RNA, 15 nt, Human
uuccugaugcuucuu

SEQ ID NO: 3307614 - RNA, 19 nt, Human
uuccugaugcuucuucaga

SEQ ID NO: 3307615 - RNA, 18 nt, Human
uuccugaugcuucuucag

SEQ ID NO: 3307616 - RNA, 13 nt, Human
uuccucauuagca

SEQ ID NO: 3307617 - RNA, 22 nt, Human
uucccuuugacgccaucccagc

SEQ ID NO: 3307618 - RNA, 21 nt, Human
uucccuuugacgccaucccag

SEQ ID NO: 3307619 - RNA, 20 nt, Human
uucccuuugacgccauccca

SEQ ID NO: 3307620 - RNA, 15 nt, Human
uucauuuccuguguc

SEQ ID NO: 3307621 - RNA, 16 nt, Human
uucauuuccugugucu

SEQ ID NO: 3307622 - RNA, 21 nt, Human
uucaucuugaauuguaaggaa

SEQ ID NO: 3307623 - RNA, 17 nt, Human
uucaucuugaauuguaa

SEQ ID NO: 3307624 - RNA, 13 nt, Human
uucaggaagcuca

SEQ ID NO: 3307625 - RNA, 11 nt, Human
uucaggaagcu

SEQ ID NO: 3307626 - RNA, 15 nt, Human
uuccaaauucugcuu

SEQ ID NO: 3307627 - RNA, 16 nt, Human
uuccccaggaggccag

SEQ ID NO: 3307628 - RNA, 15 nt, Human
uuccccaggaggcca

SEQ ID NO: 3307629 - RNA, 16 nt, Human
uucccauuugcuccuu

SEQ ID NO: 3307630 - RNA, 11 nt, Human
uucccucccuu

SEQ ID NO: 3307631 - RNA, 17 nt, Human
uucccucccuuccucuu

SEQ ID NO: 3307632 - RNA, 20 nt, Human
uucccucccuuccucuuucc

SEQ ID NO: 3307633 - RNA, 21 nt, Human
uuccccaggaggccagccuug

SEQ ID NO: 3307634 - RNA, 20 nt, Human
uuccccaggaggccagccuu

SEQ ID NO: 3307635 - RNA, 19 nt, Human
uuccccaggaggccagccu

SEQ ID NO: 3307636 - RNA, 18 nt, Human
uuccccaggaggccagcc

SEQ ID NO: 3307637 - RNA, 17 nt, Human
uuccccaggaggccagc

SEQ ID NO: 3307638 - RNA, 21 nt, Human
uucagacagcugccugggauc

SEQ ID NO: 3307639 - RNA, 19 nt, Human
uucagagacuccugcaggc

SEQ ID NO: 3307640 - RNA, 13 nt, Human
uucacucuccuug

SEQ ID NO: 3307641 - RNA, 22 nt, Human
uucagcuuguaaauagcucagg

SEQ ID NO: 3307642 - RNA, 18 nt, Human
uucaauaggaaaaacuga

SEQ ID NO: 3307643 - RNA, 15 nt, Human
uucaauaggaaaaac

SEQ ID NO: 3307644 - RNA, 13 nt, Human
uucaauaggaaaa

SEQ ID NO: 3307645 - RNA, 18 nt, Human
uucacggaagagccuugc

SEQ ID NO: 3307646 - RNA, 15 nt, Human
uucacgugguccuaa

SEQ ID NO: 3307647 - RNA, 18 nt, Human
uuauugucaaagugguga

SEQ ID NO: 3307648 - RNA, 17 nt, Human
uuauugucaaaguggug

SEQ ID NO: 3307649 - RNA, 17 nt, Human
uuauuuuaauucaguug

SEQ ID NO: 3307650 - RNA, 14 nt, Human
uuauggcacaucag

SEQ ID NO: 3307651 - RNA, 22 nt, Human
uuaugcaugaaguaauaugcac

SEQ ID NO: 3307652 - RNA, 16 nt, Human
uuaugcaugaaguaau

SEQ ID NO: 3307653 - RNA, 17 nt, Human
uuaucuagauacuguau

SEQ ID NO: 3307654 - RNA, 14 nt, Human
uuaguuccuugagu

SEQ ID NO: 3307655 - RNA, 16 nt, Human
uuaguuccucauuagc

SEQ ID NO: 3307656 - RNA, 14 nt, Human
uuaucuagauacug

SEQ ID NO: 3307657 - RNA, 16 nt, Human
uuaucuagauacugua

SEQ ID NO: 3307658 - RNA, 15 nt, Human
uuauugcccacgcug

SEQ ID NO: 3307659 - RNA, 11 nt, Human
uuauucugcuc

SEQ ID NO: 3307660 - RNA, 23 nt, Human
uuauuaaaaaucucaaauuucua

SEQ ID NO: 3307661 - RNA, 13 nt, Human
uuuaacagaaaug

SEQ ID NO: 3307662 - RNA, 13 nt, Human
uuuaaaagauaca

SEQ ID NO: 3307663 - RNA, 24 nt, Human
uugucuuuggacccugaggcccag

SEQ ID NO: 3307664 - RNA, 20 nt, Human
uugucuuuggacccugaggc

SEQ ID NO: 3307665 - RNA, 15 nt, Human
uugucuuuggacccu

SEQ ID NO: 3307666 - RNA, 20 nt, Human
uuguuuggggaugagaaagg

SEQ ID NO: 3307667 - RNA, 15 nt, Human
uuuaacagaaaugua

SEQ ID NO: 3307668 - RNA, 14 nt, Human
uuuaacagaaaugu

SEQ ID NO: 3307669 - RNA, 20 nt, Human
uuuauacauaaacaagacca

SEQ ID NO: 3307670 - RNA, 12 nt, Human
uuuauacauaaa

SEQ ID NO: 3307671 - RNA, 18 nt, Human
uuuauaaacuuuaccuuu

SEQ ID NO: 3307672 - RNA, 19 nt, Human
uuuagacccuauugcugcu

SEQ ID NO: 3307673 - RNA, 22 nt, Human
uuuagacccuauugcugcuuga

SEQ ID NO: 3307674 - RNA, 16 nt, Human
uuucagccaagaauuc

SEQ ID NO: 3307675 - RNA, 17 nt, Human
uuucagccaagaauucu

SEQ ID NO: 3307676 - RNA, 22 nt, Human
uuucuacccagcgagcccuggu

SEQ ID NO: 3307677 - RNA, 15 nt, Human
uuucuacccagcgag

SEQ ID NO: 3307678 - RNA, 18 nt, Human
uuucuacccagcgagccc

SEQ ID NO: 3307679 - RNA, 14 nt, Human
uuucugaaauaaca

SEQ ID NO: 3307680 - RNA, 23 nt, Human
uuuccuggcacugcuuccaguga

SEQ ID NO: 3307681 - RNA, 19 nt, Human
uuuccuggcacugcuucca

SEQ ID NO: 3307682 - RNA, 19 nt, Human
uuucuaaaucuccaaaaua

SEQ ID NO: 3307683 - RNA, 17 nt, Human
uuugagaucagccuggg

SEQ ID NO: 3307684 - RNA, 16 nt, Human
uuugagaucagccugg

SEQ ID NO: 3307685 - RNA, 19 nt, Human
uuucuuguguguuuauugu

SEQ ID NO: 3307686 - RNA, 13 nt, Human
uuuggacccugag

SEQ ID NO: 3307687 - RNA, 19 nt, Human
uuuggacccugaggcccag

SEQ ID NO: 3307688 - RNA, 15 nt, Human
uuuggacccugaggc

SEQ ID NO: 3307689 - RNA, 14 nt, Human
uuugcuugaaagaa

SEQ ID NO: 3307690 - RNA, 16 nt, Human
uuugcuugaaagaaaa

SEQ ID NO: 3307691 - RNA, 20 nt, Human
uugucuaugggacucaaugc

SEQ ID NO: 3307692 - RNA, 22 nt, Human
uugucuuaaaaaguggaaaaau

SEQ ID NO: 3307693 - RNA, 20 nt, Human
uuguauuuuacuaauaaaau

SEQ ID NO: 3307694 - RNA, 14 nt, Human
uugucuaugggacu

SEQ ID NO: 3307695 - RNA, 22 nt, Human
uugucaaaguggugagaggcau

SEQ ID NO: 3307696 - RNA, 13 nt, Human
uugguccugcugc

SEQ ID NO: 3307697 - RNA, 20 nt, Human
uuggucugacccacugcuuu

SEQ ID NO: 3307698 - RNA, 23 nt, Human
uuggcuucacggaagagccuugc

SEQ ID NO: 3307699 - RNA, 21 nt, Human
uuggacccugaggcccagagg

SEQ ID NO: 3307700 - RNA, 19 nt, Human
uuggacccugaggcccaga

SEQ ID NO: 3307701 - RNA, 18 nt, Human
uuggacccugaggcccag

SEQ ID NO: 3307702 - RNA, 15 nt, Human
uuggacccugaggcc

SEQ ID NO: 3307703 - RNA, 15 nt, Human
uuggauuguccccga

SEQ ID NO: 3307704 - RNA, 14 nt, Human
uuggauuguccccg

SEQ ID NO: 3307705 - RNA, 19 nt, Human
uuggaagcuccgcuuucua

SEQ ID NO: 3307706 - RNA, 16 nt, Human
uugcugcuugaggcaa

SEQ ID NO: 3307707 - RNA, 14 nt, Human
uugcugcuugaggc

SEQ ID NO: 3307708 - RNA, 16 nt, Human
uugcugucccuuuucc

SEQ ID NO: 3307709 - RNA, 18 nt, Human
uugcugucccuuuuccuu

SEQ ID NO: 3307710 - RNA, 20 nt, Human
uugccauguuggccaggcug

SEQ ID NO: 3307711 - RNA, 21 nt, Human
uugccauguuggccaggcugg

SEQ ID NO: 3307712 - RNA, 16 nt, Human
uugaaugaugccauga

SEQ ID NO: 3307713 - RNA, 12 nt, Human
uugaaugaugcc

SEQ ID NO: 3307714 - RNA, 13 nt, Human
uugaacuuugacc

SEQ ID NO: 3307715 - RNA, 18 nt, Human
uugaacuuugaccucugc

SEQ ID NO: 3307716 - RNA, 17 nt, Human
uugaacuuugaccucug

SEQ ID NO: 3307717 - RNA, 21 nt, Human
uucuuuccugaggcugggcuc

SEQ ID NO: 3307718 - RNA, 15 nt, Human
uugaacuuugaccuc

SEQ ID NO: 3307719 - RNA, 17 nt, Human
uucuuagggaaggauac

SEQ ID NO: 3307720 - RNA, 13 nt, Human
uucuucagagacu

SEQ ID NO: 3307721 - RNA, 20 nt, Human
uucuggcagaguugaagaca

SEQ ID NO: 3307722 - RNA, 23 nt, Human
uugauauccucuuugagugaagc

SEQ ID NO: 3307723 - RNA, 16 nt, Human
uugauaugcuuauaca

SEQ ID NO: 3307724 - RNA, 21 nt, Human
uugauucagacagcugccugg

SEQ ID NO: 3307725 - RNA, 17 nt, Human
uugauucagacagcugc

SEQ ID NO: 3307726 - RNA, 23 nt, Human
uugauucagacagcugccuggga

SEQ ID NO: 3307727 - RNA, 16 nt, Human
uugauucagcucugca

SEQ ID NO: 3307728 - RNA, 19 nt, Human
uugagccuugaacuuugac

SEQ ID NO: 3307729 - RNA, 14 nt, Human
uugagccugggagg

SEQ ID NO: 3307730 - RNA, 14 nt, Human
uugagccuugaacu

SEQ ID NO: 3307731 - RNA, 16 nt, Human
uugagccuugaacuuu

SEQ ID NO: 3307732 - RNA, 15 nt, Human
uugagccuugaacuu

SEQ ID NO: 3307733 - RNA, 22 nt, Human
uugcagacaggcaagcaccucc

SEQ ID NO: 3307734 - RNA, 17 nt, Human
uugauucauaaugacuu

SEQ ID NO: 3307735 - RNA, 13 nt, Human
uugauucauaaug

SEQ ID NO: 3307736 - RNA, 23 nt, Human
uugcagacaggcaagcaccuccu

SEQ ID NO: 3307737 - RNA, 16 nt, Human
uugccauguuggccag

SEQ ID NO: 3307738 - RNA, 17 nt, Human
uugccauguuggccagg

SEQ ID NO: 3307739 - RNA, 18 nt, Human
uugccauguuggccaggc

SEQ ID NO: 3307740 - RNA, 19 nt, Human
uugccauguuggccaggcu

SEQ ID NO: 3307741 - RNA, 15 nt, Human
cuggaugcagccuca

SEQ ID NO: 3307742 - RNA, 18 nt, Human
cuggaugcagccucacag

SEQ ID NO: 3307743 - RNA, 17 nt, Human
cuggaugcagccucaca

SEQ ID NO: 3307744 - RNA, 16 nt, Human
cuggaugcagccucac

SEQ ID NO: 3307745 - RNA, 13 nt, Human
cugcuucaaggau

SEQ ID NO: 3307746 - RNA, 19 nt, Human
cugcuucaaggauccugag

SEQ ID NO: 3307747 - RNA, 16 nt, Human
cugcuucaaggauccu

SEQ ID NO: 3307748 - RNA, 14 nt, Human
cugcuucaaggauc

SEQ ID NO: 3307749 - RNA, 23 nt, Human
cugcuucagccucccgaguagcu

SEQ ID NO: 3307750 - RNA, 14 nt, Human
cugcuuccagugag

SEQ ID NO: 3307751 - RNA, 21 nt, Human
cuggagaaaauggacguguua

SEQ ID NO: 3307752 - RNA, 14 nt, Human
cuggagaaaaugga

SEQ ID NO: 3307753 - RNA, 13 nt, Human
cuggcagccccug

SEQ ID NO: 3307754 - RNA, 22 nt, Human
cuggcagaguugaagacagagc

SEQ ID NO: 3307755 - RNA, 23 nt, Human
cuggcagccccuguucuggcaga

SEQ ID NO: 3307756 - RNA, 19 nt, Human
cuggcagaguugaagacag

SEQ ID NO: 3307757 - RNA, 21 nt, Human
cuggcagaguugaagacagag

SEQ ID NO: 3307758 - RNA, 20 nt, Human
cuggcagaguugaagacaga

SEQ ID NO: 3307759 - RNA, 13 nt, Human
cuggcucuuccag

SEQ ID NO: 3307760 - RNA, 15 nt, Human
cuggcucuuccaggc

SEQ ID NO: 3307761 - RNA, 14 nt, Human
cuggcucuuccagg

SEQ ID NO: 3307762 - RNA, 16 nt, Human
cugggacuacaggcac

SEQ ID NO: 3307763 - RNA, 17 nt, Human
cugggacuacaggcacc

SEQ ID NO: 3307764 - RNA, 21 nt, Human
cugggacuacaggcacccacc

SEQ ID NO: 3307765 - RNA, 17 nt, Human
cugggacuacaggugug

SEQ ID NO: 3307766 - RNA, 15 nt, Human
cuggcagcucagaga

SEQ ID NO: 3307767 - RNA, 16 nt, Human
cuggcagcucagagag

SEQ ID NO: 3307768 - RNA, 19 nt, Human
cuggcagcucagagagggu

SEQ ID NO: 3307769 - RNA, 17 nt, Human
cuggcagcucagagagg

SEQ ID NO: 3307770 - RNA, 19 nt, Human
cugccucgaacuggcugca

SEQ ID NO: 3307771 - RNA, 20 nt, Human
cugccucgaacuggcugcaa

SEQ ID NO: 3307772 - RNA, 14 nt, Human
cugccucgaacugg

SEQ ID NO: 3307773 - RNA, 23 nt, Human
cugccuccuuugugaggaagccg

SEQ ID NO: 3307774 - RNA, 21 nt, Human
cugccuccuuugugaggaagc

SEQ ID NO: 3307775 - RNA, 17 nt, Human
cugccuccuuugugagg

SEQ ID NO: 3307776 - RNA, 14 nt, Human
cugccuccuuugug

SEQ ID NO: 3307777 - RNA, 17 nt, Human
cugcuaucaaagagguu

SEQ ID NO: 3307778 - RNA, 18 nt, Human
cugcugaaggcucgagca

SEQ ID NO: 3307779 - RNA, 23 nt, Human
cugcugaaggcucgagcaugccu

SEQ ID NO: 3307780 - RNA, 24 nt, Human
cugcugaaggcucgagcaugccug

SEQ ID NO: 3307781 - RNA, 20 nt, Human
cugccuguucagcuccagcu

SEQ ID NO: 3307782 - RNA, 23 nt, Human
cugccuguucagcuccagcucac

SEQ ID NO: 3307783 - RNA, 23 nt, Human
cugcccuuaccugccaggaagcc

SEQ ID NO: 3307784 - RNA, 22 nt, Human
cugcccuuaccugccaggaagc

SEQ ID NO: 3307785 - RNA, 11 nt, Human
cugcccugugg

SEQ ID NO: 3307786 - RNA, 12 nt, Human
cugcccuguggg

SEQ ID NO: 3307787 - RNA, 17 nt, Human
cugcccuuaccugccag

SEQ ID NO: 3307788 - RNA, 19 nt, Human
cugcccuuaccugccagga

SEQ ID NO: 3307789 - RNA, 13 nt, Human
cugcccugugagu

SEQ ID NO: 3307790 - RNA, 24 nt, Human
cugcccugugaguacuacaguccu

SEQ ID NO: 3307791 - RNA, 18 nt, Human
cuggucuuauuuguaaag

SEQ ID NO: 3307792 - RNA, 22 nt, Human
cuggugacaugucuuuucuugc

SEQ ID NO: 3307793 - RNA, 15 nt, Human
cuguagagugggagc

SEQ ID NO: 3307794 - RNA, 22 nt, Human
cugucuaaugaaaccugugucu

SEQ ID NO: 3307795 - RNA, 20 nt, Human
cuguccugggagugagcugg

SEQ ID NO: 3307796 - RNA, 13 nt, Human
cuguccugggagu

SEQ ID NO: 3307797 - RNA, 14 nt, Human
cuguccugggagug

SEQ ID NO: 3307798 - RNA, 14 nt, Human
cugucauuugagca

SEQ ID NO: 3307799 - RNA, 17 nt, Human
cugugcucuggacaggc

SEQ ID NO: 3307800 - RNA, 15 nt, Human
cugugcucuggacag

SEQ ID NO: 3307801 - RNA, 12 nt, Human
cuguucagcugg

SEQ ID NO: 3307802 - RNA, 16 nt, Human
cuguucagcuccagcu

SEQ ID NO: 3307803 - RNA, 18 nt, Human
cuguucagcuccagcuca

SEQ ID NO: 3307804 - RNA, 19 nt, Human
cuguucagcuccagcucac

SEQ ID NO: 3307805 - RNA, 22 nt, Human
cuguucagcuccagcucaccag

SEQ ID NO: 3307806 - RNA, 14 nt, Human
cuguucagcuccag

SEQ ID NO: 3307807 - RNA, 15 nt, Human
cuguucagcuccagc

SEQ ID NO: 3307808 - RNA, 13 nt, Human
cuguuacugucuu

SEQ ID NO: 3307809 - RNA, 17 nt, Human
cuguuacugucuucagu

SEQ ID NO: 3307810 - RNA, 18 nt, Human
cugugcucuggacaggca

SEQ ID NO: 3307811 - RNA, 22 nt, Human
cugugucagguggggcagcuug

SEQ ID NO: 3307812 - RNA, 18 nt, Human
cuguugcccaggcuggcg

SEQ ID NO: 3307813 - RNA, 12 nt, Human
cuguuggccagu

SEQ ID NO: 3307814 - RNA, 19 nt, Human
cuuaaauaaugugaaacug

SEQ ID NO: 3307815 - RNA, 16 nt, Human
cuuaaauaaugugaaa

SEQ ID NO: 3307816 - RNA, 14 nt, Human
cuuaaauaauguga

SEQ ID NO: 3307817 - RNA, 13 nt, Human
cuuaaauaaugug

SEQ ID NO: 3307818 - RNA, 14 nt, Human
cuuccucccucccu

SEQ ID NO: 3307819 - RNA, 12 nt, Human
cuuccucccucc

SEQ ID NO: 3307820 - RNA, 13 nt, Human
cuuccucccuccc

SEQ ID NO: 3307821 - RNA, 19 nt, Human
cuucugaacuuggcgcugc

SEQ ID NO: 3307822 - RNA, 22 nt, Human
cuucugaacuuggcgcugcccc

SEQ ID NO: 3307823 - RNA, 15 nt, Human
cuucugacccaugcu

SEQ ID NO: 3307824 - RNA, 13 nt, Human
cuucuuauacauu

SEQ ID NO: 3307825 - RNA, 16 nt, Human
cuucuuauacauuuga

SEQ ID NO: 3307826 - RNA, 17 nt, Human
cuucugacccaugcugc

SEQ ID NO: 3307827 - RNA, 16 nt, Human
cuucugacccaugcug

SEQ ID NO: 3307828 - RNA, 18 nt, Human
cuucugacccaugcugcc

SEQ ID NO: 3307829 - RNA, 20 nt, Human
cuuggugucgggcaugacac

SEQ ID NO: 3307830 - RNA, 22 nt, Human
cuugguccugcugcaguugcca

SEQ ID NO: 3307831 - RNA, 16 nt, Human
cuugguucccauuugc

SEQ ID NO: 3307832 - RNA, 20 nt, Human
cuugguucccauuugcuccu

SEQ ID NO: 3307833 - RNA, 13 nt, Human
cuugucuguagau

SEQ ID NO: 3307834 - RNA, 20 nt, Human
cuugucuuuggacccugagg

SEQ ID NO: 3307835 - RNA, 19 nt, Human
cuugucuuuggacccugag

SEQ ID NO: 3307836 - RNA, 15 nt, Human
cuugguccugcugca

SEQ ID NO: 3307837 - RNA, 20 nt, Human
cuugguccugcugcaguugc

SEQ ID NO: 3307838 - RNA, 18 nt, Human
cuugguccugcugcaguu

SEQ ID NO: 3307839 - RNA, 17 nt, Human
cuugguccugcugcagu

SEQ ID NO: 3307840 - RNA, 16 nt, Human
cuugguccugcugcag

SEQ ID NO: 3307841 - RNA, 17 nt, Human
cuuucaauaggaaaaac

SEQ ID NO: 3307842 - RNA, 22 nt, Human
cuugucuuuggacccugaggcc

SEQ ID NO: 3307843 - RNA, 21 nt, Human
cuugucuuuggacccugaggc

SEQ ID NO: 3307844 - RNA, 22 nt, Human
cuuuaaugucacaggcaggucc

SEQ ID NO: 3307845 - RNA, 15 nt, Human
cuuucaauaggaaaa

SEQ ID NO: 3307846 - RNA, 14 nt, Human
cuuucaauaggaaa

SEQ ID NO: 3307847 - RNA, 17 nt, Human
cuuuaaugucacaggca

SEQ ID NO: 3307848 - RNA, 18 nt, Human
cuuuaaugucacaggcag

SEQ ID NO: 3307849 - RNA, 19 nt, Human
cuuuaaugucacaggcagg

SEQ ID NO: 3307850 - RNA, 20 nt, Human
cuuuaaugucacaggcaggu

SEQ ID NO: 3307851 - RNA, 12 nt, Human
cuugauucauaa

SEQ ID NO: 3307852 - RNA, 19 nt, Human
cuugauucauaaugacuua

SEQ ID NO: 3307853 - RNA, 18 nt, Human
cuugccgucuaccugagg

SEQ ID NO: 3307854 - RNA, 15 nt, Human
cuuggauuguccccg

SEQ ID NO: 3307855 - RNA, 20 nt, Human
cuuggauuguccccgacccu

SEQ ID NO: 3307856 - RNA, 18 nt, Human
cuuggauuguccccgacc

SEQ ID NO: 3307857 - RNA, 14 nt, Human
cuuggauugucccc

SEQ ID NO: 3307858 - RNA, 22 nt, Human
cuuggcgcugccccuggcagcc

SEQ ID NO: 3307859 - RNA, 21 nt, Human
cuuggcgcugccccuggcagc

SEQ ID NO: 3307860 - RNA, 23 nt, Human
cuuggcgcugccccuggcagccc

SEQ ID NO: 3307861 - RNA, 20 nt, Human
cuuggcgcugccccuggcag

SEQ ID NO: 3307862 - RNA, 18 nt, Human
cuuuugccguuauuaaaa

SEQ ID NO: 3307863 - RNA, 16 nt, Human
cuuuugccguuauuaa

SEQ ID NO: 3307864 - RNA, 15 nt, Human
cuuuuggucugugug

SEQ ID NO: 3307865 - RNA, 16 nt, Human
cuuuuggucuguguga

SEQ ID NO: 3307866 - RNA, 18 nt, Human
cuuuugugcauuaucuag

SEQ ID NO: 3307867 - RNA, 14 nt, Human
cuuuugugcauuau

SEQ ID NO: 3307868 - RNA, 21 nt, Human
cuuuuuuuuuuuuuuugacaa

SEQ ID NO: 3307869 - RNA, 19 nt, Human
gaaaaaauauuuuccugcc

SEQ ID NO: 3307870 - RNA, 14 nt, Human
gaaaauuuuaaaaa

SEQ ID NO: 3307871 - RNA, 18 nt, Human
gaaaauuuugauguuuua

SEQ ID NO: 3307872 - RNA, 21 nt, Human
gaacaaggcaaggcugucaau

SEQ ID NO: 3307873 - RNA, 18 nt, Human
gaacaaggcaaggcuguc

SEQ ID NO: 3307874 - RNA, 17 nt, Human
gaacaaggcaaggcugu

SEQ ID NO: 3307875 - RNA, 15 nt, Human
gaacaaggcaaggcu

SEQ ID NO: 3307876 - RNA, 14 nt, Human
gaacaaggcaaggc

SEQ ID NO: 3307877 - RNA, 17 nt, Human
gaaaucaccgaaaacgu

SEQ ID NO: 3307878 - RNA, 18 nt, Human
gaaauuuuuauuaaauua

SEQ ID NO: 3307879 - RNA, 19 nt, Human
gaaauuuuuauuaaauuau

SEQ ID NO: 3307880 - RNA, 21 nt, Human
gaaaguacuucuccacccugc

SEQ ID NO: 3307881 - RNA, 18 nt, Human
gaaagacuaucuaaaugu

SEQ ID NO: 3307882 - RNA, 16 nt, Human
gaaaggcuccaggagc

SEQ ID NO: 3307883 - RNA, 19 nt, Human
gaaaggcuccaggagcagc

SEQ ID NO: 3307884 - RNA, 18 nt, Human
gaaaggcuccaggagcag

SEQ ID NO: 3307885 - RNA, 17 nt, Human
gaaaggcuccaggagca

SEQ ID NO: 3307886 - RNA, 14 nt, Human
gagauuggaaggaa

SEQ ID NO: 3307887 - RNA, 21 nt, Human
gagauugcaccacugcacucc

SEQ ID NO: 3307888 - RNA, 16 nt, Human
gagagccuuccagggg

SEQ ID NO: 3307889 - RNA, 15 nt, Human
gagagccuuccaggg

SEQ ID NO: 3307890 - RNA, 14 nt, Human
gagagccuuccagg

SEQ ID NO: 3307891 - RNA, 13 nt, Human
gagacuccugcag

SEQ ID NO: 3307892 - RNA, 13 nt, Human
gagagcugggugu

SEQ ID NO: 3307893 - RNA, 21 nt, Human
gagagcuagcagcagggaggg

SEQ ID NO: 3307894 - RNA, 15 nt, Human
gagagcuagcagcag

SEQ ID NO: 3307895 - RNA, 20 nt, Human
gagagccuuccagggguggg

SEQ ID NO: 3307896 - RNA, 18 nt, Human
gagagccuuccaggggug

SEQ ID NO: 3307897 - RNA, 12 nt, Human
gagaggaaauca

SEQ ID NO: 3307898 - RNA, 20 nt, Human
gagagcugggugucaagagg

SEQ ID NO: 3307899 - RNA, 15 nt, Human
gagaggacccccuga

SEQ ID NO: 3307900 - RNA, 15 nt, Human
gagaaugaaagggcc

SEQ ID NO: 3307901 - RNA, 23 nt, Human
gagaaugaaagggcccagagagg

SEQ ID NO: 3307902 - RNA, 21 nt, Human
gagacccugucucaaaaaaag

SEQ ID NO: 3307903 - RNA, 18 nt, Human
gagacgggggcagagagg

SEQ ID NO: 3307904 - RNA, 16 nt, Human
gagacggagucccacc

SEQ ID NO: 3307905 - RNA, 19 nt, Human
gagacggagucccaccuug

SEQ ID NO: 3307906 - RNA, 14 nt, Human
gagacggaguccca

SEQ ID NO: 3307907 - RNA, 19 nt, Human
gacuuuuccaacccucauc

SEQ ID NO: 3307908 - RNA, 14 nt, Human
gacuuuuccaaccc

SEQ ID NO: 3307909 - RNA, 14 nt, Human
gagggccugcaagg

SEQ ID NO: 3307910 - RNA, 21 nt, Human
gagggccugcaagggagugag

SEQ ID NO: 3307911 - RNA, 17 nt, Human
gagggccugcaagggag

SEQ ID NO: 3307912 - RNA, 21 nt, Human
gaggcauuuguuugaacugau

SEQ ID NO: 3307913 - RNA, 21 nt, Human
gaggcaugugaugagaggaaa

SEQ ID NO: 3307914 - RNA, 20 nt, Human
gaggcaugugaugagaggaa

SEQ ID NO: 3307915 - RNA, 22 nt, Human
gaggcaugugaugagaggaaau

SEQ ID NO: 3307916 - RNA, 19 nt, Human
gaggcauuuguuugaacug

SEQ ID NO: 3307917 - RNA, 23 nt, Human
gaggacagggaggugaccccagg

SEQ ID NO: 3307918 - RNA, 20 nt, Human
gaggacuuuucuuuguggcu

SEQ ID NO: 3307919 - RNA, 23 nt, Human
gaggacuuuucuuuguggcuucc

SEQ ID NO: 3307920 - RNA, 16 nt, Human
gaggacuuuucuuugu

SEQ ID NO: 3307921 - RNA, 12 nt, Human
gaggagagagga

SEQ ID NO: 3307922 - RNA, 15 nt, Human
gaggagagaggaccc

SEQ ID NO: 3307923 - RNA, 14 nt, Human
gaggagagaggacc

SEQ ID NO: 3307924 - RNA, 18 nt, Human
gaggcagggucucacucu

SEQ ID NO: 3307925 - RNA, 19 nt, Human
gaggcagggucucacucug

SEQ ID NO: 3307926 - RNA, 20 nt, Human
gaggcagggucucacucugu

SEQ ID NO: 3307927 - RNA, 13 nt, Human
gagcccugguggc

SEQ ID NO: 3307928 - RNA, 21 nt, Human
gagcagggcucagcggggaca

SEQ ID NO: 3307929 - RNA, 14 nt, Human
gagcaucaggccag

SEQ ID NO: 3307930 - RNA, 13 nt, Human
gagcaucaggcca

SEQ ID NO: 3307931 - RNA, 16 nt, Human
gagcaucaggccaggc

SEQ ID NO: 3307932 - RNA, 15 nt, Human
gagcaucaggccagg

SEQ ID NO: 3307933 - RNA, 13 nt, Human
gagcaugccugga

SEQ ID NO: 3307934 - RNA, 17 nt, Human
gagccccgaggccuucu

SEQ ID NO: 3307935 - RNA, 13 nt, Human
gagccccgaggcc

SEQ ID NO: 3307936 - RNA, 14 nt, Human
gagccccgaggccu

SEQ ID NO: 3307937 - RNA, 14 nt, Human
gaaugauuaauuaa

SEQ ID NO: 3307938 - RNA, 14 nt, Human
gaaugaugccauga

SEQ ID NO: 3307939 - RNA, 20 nt, Human
gaaugaugauccuaggcauu

SEQ ID NO: 3307940 - RNA, 18 nt, Human
gaaugcacaaacagaggc

SEQ ID NO: 3307941 - RNA, 15 nt, Human
gaauguuugccucug

SEQ ID NO: 3307942 - RNA, 19 nt, Human
gaaugcacaaacagaggcc

SEQ ID NO: 3307943 - RNA, 16 nt, Human
gaauguuugccucugc

SEQ ID NO: 3307944 - RNA, 17 nt, Human
gaauguuugccucugcc

SEQ ID NO: 3307945 - RNA, 18 nt, Human
gaauguuugccucugccu

SEQ ID NO: 3307946 - RNA, 19 nt, Human
gaauguuugccucugccuc

SEQ ID NO: 3307947 - RNA, 17 nt, Human
gacacagcucuucucca

SEQ ID NO: 3307948 - RNA, 21 nt, Human
gacacagcucuucuccaggcu

SEQ ID NO: 3307949 - RNA, 12 nt, Human
gacacagcucuu

SEQ ID NO: 3307950 - RNA, 19 nt, Human
gacacagcucuucuccagg

SEQ ID NO: 3307951 - RNA, 20 nt, Human
gacacagcucuucuccaggc

SEQ ID NO: 3307952 - RNA, 23 nt, Human
gaauauugcugauggugcaauga

SEQ ID NO: 3307953 - RNA, 22 nt, Human
gaauauugcugauggugcaaug

SEQ ID NO: 3307954 - RNA, 24 nt, Human
gaauauugcugauggugcaaugac

SEQ ID NO: 3307955 - RNA, 20 nt, Human
gaauauugcugauggugcaa

SEQ ID NO: 3307956 - RNA, 15 nt, Human
gaauauauaaccagu

SEQ ID NO: 3307957 - RNA, 11 nt, Human
gaauauugcug

SEQ ID NO: 3307958 - RNA, 13 nt, Human
gaauauugcugau

SEQ ID NO: 3307959 - RNA, 12 nt, Human
gaauauugcuga

SEQ ID NO: 3307960 - RNA, 23 nt, Human
gacgcuacccgggaagggggcug

SEQ ID NO: 3307961 - RNA, 19 nt, Human
gacgcuacccgggaagggg

SEQ ID NO: 3307962 - RNA, 22 nt, Human
gacgcuacccgggaagggggcu

SEQ ID NO: 3307963 - RNA, 15 nt, Human
gacgcugugcugccc

SEQ ID NO: 3307964 - RNA, 18 nt, Human
gacgcugugcugcccugc

SEQ ID NO: 3307965 - RNA, 17 nt, Human
gacgcugugcugcccug

SEQ ID NO: 3307966 - RNA, 16 nt, Human
gacgcugugcugcccu

SEQ ID NO: 3307967 - RNA, 21 nt, Human
gacgccaucccagccccaaug

SEQ ID NO: 3307968 - RNA, 19 nt, Human
gacgccaucccagccccaa

SEQ ID NO: 3307969 - RNA, 13 nt, Human
gacgccaucccag

SEQ ID NO: 3307970 - RNA, 12 nt, Human
gacgccauccca

SEQ ID NO: 3307971 - RNA, 22 nt, Human
gaccucugcagcaauaaagcag

SEQ ID NO: 3307972 - RNA, 18 nt, Human
gaccucugcagcaauaaa

SEQ ID NO: 3307973 - RNA, 16 nt, Human
gaccucugcagcaaua

SEQ ID NO: 3307974 - RNA, 13 nt, Human
gaccucaggccug

SEQ ID NO: 3307975 - RNA, 14 nt, Human
gaccucaggccugg

SEQ ID NO: 3307976 - RNA, 19 nt, Human
gaccucaggugauccaccc

SEQ ID NO: 3307977 - RNA, 21 nt, Human
gaccucaggugagaagcagag

SEQ ID NO: 3307978 - RNA, 20 nt, Human
gaccucaggugauccaccca

SEQ ID NO: 3307979 - RNA, 21 nt, Human
gaccucaggugauccacccac

SEQ ID NO: 3307980 - RNA, 19 nt, Human
gaccucaggccugggggcu

SEQ ID NO: 3307981 - RNA, 19 nt, Human
gaccucaggugagaagcag

SEQ ID NO: 3307982 - RNA, 18 nt, Human
gaccucaggugagaagca

SEQ ID NO: 3307983 - RNA, 16 nt, Human
gacagcuccuucuguc

SEQ ID NO: 3307984 - RNA, 16 nt, Human
gacagcccgggcucug

SEQ ID NO: 3307985 - RNA, 17 nt, Human
gacagcuccuucugucc

SEQ ID NO: 3307986 - RNA, 18 nt, Human
gacagcuccuucuguccu

SEQ ID NO: 3307987 - RNA, 14 nt, Human
gacagcccgggcuc

SEQ ID NO: 3307988 - RNA, 19 nt, Human
gacagcuccuucuguccua

SEQ ID NO: 3307989 - RNA, 10 nt, Human
gacagcucuu

SEQ ID NO: 3307990 - RNA, 12 nt, Human
gacagucccugc

SEQ ID NO: 3307991 - RNA, 11 nt, Human
gacagcucuua

SEQ ID NO: 3307992 - RNA, 20 nt, Human
gacagucccugccaauggac

SEQ ID NO: 3307993 - RNA, 16 nt, Human
gacagucccugccaau

SEQ ID NO: 3307994 - RNA, 15 nt, Human
gacagucccugccaa

SEQ ID NO: 3307995 - RNA, 14 nt, Human
gacagucccugcca

SEQ ID NO: 3307996 - RNA, 17 nt, Human
gacauugcggacagcca

SEQ ID NO: 3307997 - RNA, 23 nt, Human
gacauugcggacagccacggcca

SEQ ID NO: 3307998 - RNA, 14 nt, Human
gcauacguacacau

SEQ ID NO: 3307999 - RNA, 15 nt, Human
gcauacguacacauu

SEQ ID NO: 3308000 - RNA, 17 nt, Human
gcauacguacacauuuu

SEQ ID NO: 3308001 - RNA, 16 nt, Human
gcauacguacacauuu

SEQ ID NO: 3308002 - RNA, 17 nt, Human
gcauccaguaucuugaa

SEQ ID NO: 3308003 - RNA, 14 nt, Human
gcauccaguaucuu

SEQ ID NO: 3308004 - RNA, 18 nt, Human
gcauccaguaucuugaag

SEQ ID NO: 3308005 - RNA, 13 nt, Human
gcauccuggcacc

SEQ ID NO: 3308006 - RNA, 21 nt, Human
gcauggcugccaaugggagcu

SEQ ID NO: 3308007 - RNA, 19 nt, Human
gcaugugaugagaggaaau

SEQ ID NO: 3308008 - RNA, 18 nt, Human
gcaugugaugagaggaaa

SEQ ID NO: 3308009 - RNA, 21 nt, Human
gcaugugaugagaggaaauca

SEQ ID NO: 3308010 - RNA, 15 nt, Human
gcauugugggaaggg

SEQ ID NO: 3308011 - RNA, 13 nt, Human
gcauugugggaag

SEQ ID NO: 3308012 - RNA, 15 nt, Human
gcauuuacuuugugu

SEQ ID NO: 3308013 - RNA, 22 nt, Human
gcauuuaaaagauacaguuacu

SEQ ID NO: 3308014 - RNA, 18 nt, Human
gcauuuaaaagauacagu

SEQ ID NO: 3308015 - RNA, 15 nt, Human
gcauuuaaaagauac

SEQ ID NO: 3308016 - RNA, 16 nt, Human
gcauugugggaagggg

SEQ ID NO: 3308017 - RNA, 17 nt, Human
gcauuuaaaagauacag

SEQ ID NO: 3308018 - RNA, 16 nt, Human
gcauuuaaaagauaca

SEQ ID NO: 3308019 - RNA, 16 nt, Human
gcagccaggccacaag

SEQ ID NO: 3308020 - RNA, 17 nt, Human
gcacucagaagacacug

SEQ ID NO: 3308021 - RNA, 20 nt, Human
gcacucagaagacacugaug

SEQ ID NO: 3308022 - RNA, 18 nt, Human
gcaagugagagcugggug

SEQ ID NO: 3308023 - RNA, 22 nt, Human
gcacuuuguucuggcucuucca

SEQ ID NO: 3308024 - RNA, 14 nt, Human
gcacuccagccugg

SEQ ID NO: 3308025 - RNA, 14 nt, Human
gcacuccccugcug

SEQ ID NO: 3308026 - RNA, 13 nt, Human
gcacuccccugcu

SEQ ID NO: 3308027 - RNA, 19 nt, Human
gcacuuuguucuggcucuu

SEQ ID NO: 3308028 - RNA, 18 nt, Human
gcacuuuguucuggcucu

SEQ ID NO: 3308029 - RNA, 15 nt, Human
gcacuccccugcugg

SEQ ID NO: 3308030 - RNA, 12 nt, Human
gcacuccccugc

SEQ ID NO: 3308031 - RNA, 16 nt, Human
gcacuuuguucuggcu

SEQ ID NO: 3308032 - RNA, 21 nt, Human
gcagaggaaagcaaaggagau

SEQ ID NO: 3308033 - RNA, 20 nt, Human
gcagaggaaagcaaaggaga

SEQ ID NO: 3308034 - RNA, 18 nt, Human
gcagaggaaagcaaagga

SEQ ID NO: 3308035 - RNA, 14 nt, Human
gcagaggaaagcaa

SEQ ID NO: 3308036 - RNA, 13 nt, Human
gcagaggaaagca

SEQ ID NO: 3308037 - RNA, 23 nt, Human
gcagcauauucaggaagcucagg

SEQ ID NO: 3308038 - RNA, 19 nt, Human
gcagcauauucaggaagcu

SEQ ID NO: 3308039 - RNA, 18 nt, Human
gcagcauauucaggaagc

SEQ ID NO: 3308040 - RNA, 17 nt, Human
gcagcauauucaggaag

SEQ ID NO: 3308041 - RNA, 14 nt, Human
gcagagggcacaga

SEQ ID NO: 3308042 - RNA, 16 nt, Human
gauacaguuacucaga

SEQ ID NO: 3308043 - RNA, 23 nt, Human
gauacaguuacucagaauucucu

SEQ ID NO: 3308044 - RNA, 19 nt, Human
gauacaguuacucagaauu

SEQ ID NO: 3308045 - RNA, 23 nt, Human
gauacaggaaaagcugcugacag

SEQ ID NO: 3308046 - RNA, 17 nt, Human
gauacuguaucaugaca

SEQ ID NO: 3308047 - RNA, 21 nt, Human
gauacuguaucaugacaaaga

SEQ ID NO: 3308048 - RNA, 12 nt, Human
gauccaagcugg

SEQ ID NO: 3308049 - RNA, 16 nt, Human
gauccaagcugguccc

SEQ ID NO: 3308050 - RNA, 17 nt, Human
gauccaagcugguccca

SEQ ID NO: 3308051 - RNA, 19 nt, Human
gauccaagcuggucccacu

SEQ ID NO: 3308052 - RNA, 22 nt, Human
gauccacccaccucagccuccc

SEQ ID NO: 3308053 - RNA, 20 nt, Human
gauccacccaccucagccuc

SEQ ID NO: 3308054 - RNA, 21 nt, Human
gauccacccaccucagccucc

SEQ ID NO: 3308055 - RNA, 21 nt, Human
gauccaagcuggucccacuca

SEQ ID NO: 3308056 - RNA, 18 nt, Human
gauccacccaccucagcc

SEQ ID NO: 3308057 - RNA, 19 nt, Human
gauccacccaccucagccu

SEQ ID NO: 3308058 - RNA, 23 nt, Human
gaucaaaagguuaauaaaguaau

SEQ ID NO: 3308059 - RNA, 20 nt, Human
gaucaaaagguuaauaaagu

SEQ ID NO: 3308060 - RNA, 17 nt, Human
gauauuuuuuucuuuuc

SEQ ID NO: 3308061 - RNA, 13 nt, Human
gaugauccuaggc

SEQ ID NO: 3308062 - RNA, 22 nt, Human
gaugauuggaggggggaggugg

SEQ ID NO: 3308063 - RNA, 20 nt, Human
gaugcuucuucagagacucc

SEQ ID NO: 3308064 - RNA, 17 nt, Human
gaugcuucuucagagac

SEQ ID NO: 3308065 - RNA, 23 nt, Human
gaugcuucucacugccaugccag

SEQ ID NO: 3308066 - RNA, 21 nt, Human
gaugcuucuucagagacuccu

SEQ ID NO: 3308067 - RNA, 15 nt, Human
gaucucuaacuucac

SEQ ID NO: 3308068 - RNA, 19 nt, Human
gaucucuugagccugggag

SEQ ID NO: 3308069 - RNA, 18 nt, Human
gaucucuugagccuggga

SEQ ID NO: 3308070 - RNA, 12 nt, Human
gauucuucugcu

SEQ ID NO: 3308071 - RNA, 13 nt, Human
gauucuucugcuu

SEQ ID NO: 3308072 - RNA, 15 nt, Human
gauucuucugcuuca

SEQ ID NO: 3308073 - RNA, 18 nt, Human
gauuuaacagaaauguac

SEQ ID NO: 3308074 - RNA, 17 nt, Human
gauuuaacagaaaugua

SEQ ID NO: 3308075 - RNA, 16 nt, Human
gauuuaacagaaaugu

SEQ ID NO: 3308076 - RNA, 11 nt, Human
gauuucacucu

SEQ ID NO: 3308077 - RNA, 18 nt, Human
gauuuuuuuuuccuucag

SEQ ID NO: 3308078 - RNA, 17 nt, Human
gauuuuuuuuuccuuca

SEQ ID NO: 3308079 - RNA, 12 nt, Human
gauuucacucuc

SEQ ID NO: 3308080 - RNA, 16 nt, Human
gauuuuuuuuuccuuc

SEQ ID NO: 3308081 - RNA, 17 nt, Human
gcaaaagaugcuucuca

SEQ ID NO: 3308082 - RNA, 22 nt, Human
gcaaaagaugcuucucacugcc

SEQ ID NO: 3308083 - RNA, 14 nt, Human
gcaaaaaggcagga

SEQ ID NO: 3308084 - RNA, 21 nt, Human
gauuuuuuuuuccuucagugc

SEQ ID NO: 3308085 - RNA, 16 nt, Human
gcaagugagagcuggg

SEQ ID NO: 3308086 - RNA, 15 nt, Human
gcaagugagagcugg

SEQ ID NO: 3308087 - RNA, 20 nt, Human
gcaaccuccgccucuugggu

SEQ ID NO: 3308088 - RNA, 14 nt, Human
gcaacccccagccu

SEQ ID NO: 3308089 - RNA, 15 nt, Human
gcaacccccagccug

SEQ ID NO: 3308090 - RNA, 16 nt, Human
gcaacccccagccugc

SEQ ID NO: 3308091 - RNA, 19 nt, Human
gcaaccuccgccucuuggg

SEQ ID NO: 3308092 - RNA, 13 nt, Human
gcaaccaccacca

SEQ ID NO: 3308093 - RNA, 18 nt, Human
gcaaccaccaccaaccac

SEQ ID NO: 3308094 - RNA, 16 nt, Human
gcaaccaccaccaacc

SEQ ID NO: 3308095 - RNA, 16 nt, Human
gcaacaggcugggcuu

SEQ ID NO: 3308096 - RNA, 19 nt, Human
gcaacaggcugggcuucag

SEQ ID NO: 3308097 - RNA, 14 nt, Human
gcaacaggcugggc

SEQ ID NO: 3308098 - RNA, 15 nt, Human
gcaacaggcugggcu

SEQ ID NO: 3308099 - RNA, 13 nt, Human
gcaacaggcuggg

SEQ ID NO: 3308100 - RNA, 15 nt, Human
ggaguggccacagaa

SEQ ID NO: 3308101 - RNA, 22 nt, Human
ggagugggcccaaugcacuuug

SEQ ID NO: 3308102 - RNA, 12 nt, Human
ggagugggccca

SEQ ID NO: 3308103 - RNA, 16 nt, Human
ggaguggccacagaaa

SEQ ID NO: 3308104 - RNA, 12 nt, Human
ggauuuaacaga

SEQ ID NO: 3308105 - RNA, 20 nt, Human
ggauuguccccgacccuugc

SEQ ID NO: 3308106 - RNA, 16 nt, Human
ggauuguccccgaccc

SEQ ID NO: 3308107 - RNA, 17 nt, Human
ggauuuaacagaaaugu

SEQ ID NO: 3308108 - RNA, 16 nt, Human
ggauuuaacagaaaug

SEQ ID NO: 3308109 - RNA, 22 nt, Human
ggauuuaacagaaauguacagc

SEQ ID NO: 3308110 - RNA, 14 nt, Human
ggaugaaaaaauaa

SEQ ID NO: 3308111 - RNA, 13 nt, Human
ggauuguccccga

SEQ ID NO: 3308112 - RNA, 23 nt, Human
ggauccugagccagauuucacuc

SEQ ID NO: 3308113 - RNA, 20 nt, Human
ggauccugagccagauuuca

SEQ ID NO: 3308114 - RNA, 19 nt, Human
ggauccugagccagauuuc

SEQ ID NO: 3308115 - RNA, 18 nt, Human
ggauccugagccagauuu

SEQ ID NO: 3308116 - RNA, 16 nt, Human
ggauccugagccagau

SEQ ID NO: 3308117 - RNA, 15 nt, Human
ggauccugagccaga

SEQ ID NO: 3308118 - RNA, 16 nt, Human
ggaguucaucuugaau

SEQ ID NO: 3308119 - RNA, 13 nt, Human
ggaggggggaggu

SEQ ID NO: 3308120 - RNA, 23 nt, Human
ggaggugggauccuccaggugca

SEQ ID NO: 3308121 - RNA, 22 nt, Human
ggaggugggauccuccaggugc

SEQ ID NO: 3308122 - RNA, 21 nt, Human
ggagggugacgggggugaacu

SEQ ID NO: 3308123 - RNA, 15 nt, Human
ggcaaaaaggcagga

SEQ ID NO: 3308124 - RNA, 18 nt, Human
ggcacaccgggcacucag

SEQ ID NO: 3308125 - RNA, 18 nt, Human
ggcacaucagcacgauuu

SEQ ID NO: 3308126 - RNA, 16 nt, Human
ggcacugcuuccagug

SEQ ID NO: 3308127 - RNA, 18 nt, Human
ggcaggaggaucacuuga

SEQ ID NO: 3308128 - RNA, 16 nt, Human
ggcagccccauucugc

SEQ ID NO: 3308129 - RNA, 20 nt, Human
ggcagccccauucugccugc

SEQ ID NO: 3308130 - RNA, 21 nt, Human
ggcagccccauucugccugcc

SEQ ID NO: 3308131 - RNA, 22 nt, Human
ggcagccccauucugccugccc

SEQ ID NO: 3308132 - RNA, 13 nt, Human
ggcagccaggcca

SEQ ID NO: 3308133 - RNA, 20 nt, Human
ggcacugcuuccagugaggc

SEQ ID NO: 3308134 - RNA, 14 nt, Human
ggcauuugcugaau

SEQ ID NO: 3308135 - RNA, 19 nt, Human
ggccaaaggaagcacaugc

SEQ ID NO: 3308136 - RNA, 16 nt, Human
ggccaaaggaagcaca

SEQ ID NO: 3308137 - RNA, 14 nt, Human
ggccaaaggaagca

SEQ ID NO: 3308138 - RNA, 13 nt, Human
ggccaaaggaagc

SEQ ID NO: 3308139 - RNA, 17 nt, Human
ggcauuuguuugaacug

SEQ ID NO: 3308140 - RNA, 17 nt, Human
ggccagagggagugaca

SEQ ID NO: 3308141 - RNA, 19 nt, Human
ggccagagggagugacaga

SEQ ID NO: 3308142 - RNA, 18 nt, Human
ggccagagacacaagccu

SEQ ID NO: 3308143 - RNA, 17 nt, Human
ggccagagacacaagcc

SEQ ID NO: 3308144 - RNA, 15 nt, Human
ggcucacugcagccu

SEQ ID NO: 3308145 - RNA, 13 nt, Human
ggcucacugcagc

SEQ ID NO: 3308146 - RNA, 14 nt, Human
ggcucacugcagcc

SEQ ID NO: 3308147 - RNA, 13 nt, Human
ggcucccuuccca

SEQ ID NO: 3308148 - RNA, 18 nt, Human
ggcucuuccaggcuggga

SEQ ID NO: 3308149 - RNA, 17 nt, Human
ggcucuuccaggcuggg

SEQ ID NO: 3308150 - RNA, 15 nt, Human
ggcucuuccaggcug

SEQ ID NO: 3308151 - RNA, 14 nt, Human
ggcucuuccaggcu

SEQ ID NO: 3308152 - RNA, 13 nt, Human
aaaaaaacacaaa

SEQ ID NO: 3308153 - RNA, 22 nt, Human
aaaaaacugcugacuguuuucu

SEQ ID NO: 3308154 - RNA, 14 nt, Human
ggcuggguuggagg

SEQ ID NO: 3308155 - RNA, 22 nt, Human
ggcuggguucuacccaggugcu

SEQ ID NO: 3308156 - RNA, 12 nt, Human
aaaaaggcagga

SEQ ID NO: 3308157 - RNA, 21 nt, Human
aaaaaggaugcacagaguugu

SEQ ID NO: 3308158 - RNA, 14 nt, Human
aaaaaggaggaaga

SEQ ID NO: 3308159 - RNA, 13 nt, Human
ggcuggccuggcc

SEQ ID NO: 3308160 - RNA, 14 nt, Human
ggcuggccuggccc

SEQ ID NO: 3308161 - RNA, 16 nt, Human
ggccugcaagggagug

SEQ ID NO: 3308162 - RNA, 12 nt, Human
ggccuggccaga

SEQ ID NO: 3308163 - RNA, 15 nt, Human
ggccuggccagaugc

SEQ ID NO: 3308164 - RNA, 20 nt, Human
ggcuaagugauccucccacc

SEQ ID NO: 3308165 - RNA, 16 nt, Human
ggcuaauguacugcau

SEQ ID NO: 3308166 - RNA, 13 nt, Human
ggcuaccuuugua

SEQ ID NO: 3308167 - RNA, 14 nt, Human
ggcuaccuuuguau

SEQ ID NO: 3308168 - RNA, 23 nt, Human
ggccucccaacucaccccagccc

SEQ ID NO: 3308169 - RNA, 22 nt, Human
ggccucccaacucaccccagcc

SEQ ID NO: 3308170 - RNA, 20 nt, Human
ggccucccaacucaccccag

SEQ ID NO: 3308171 - RNA, 13 nt, Human
ggccucagugcca

SEQ ID NO: 3308172 - RNA, 17 nt, Human
ggccucccaacucaccc

SEQ ID NO: 3308173 - RNA, 19 nt, Human
ggccucccaacucacccca

SEQ ID NO: 3308174 - RNA, 18 nt, Human
ggccucccaacucacccc

SEQ ID NO: 3308175 - RNA, 15 nt, Human
ggccagaugcaccag

SEQ ID NO: 3308176 - RNA, 16 nt, Human
ggccagaugcaccagc

SEQ ID NO: 3308177 - RNA, 17 nt, Human
gggcuggguucuaccca

SEQ ID NO: 3308178 - RNA, 21 nt, Human
gggcugcaccggcuggccugg

SEQ ID NO: 3308179 - RNA, 20 nt, Human
gggcugcaccggcuggccug

SEQ ID NO: 3308180 - RNA, 15 nt, Human
gggcugggcagagga

SEQ ID NO: 3308181 - RNA, 12 nt, Human
gggcugggcaga

SEQ ID NO: 3308182 - RNA, 19 nt, Human
gggcugcaccggcuggccu

SEQ ID NO: 3308183 - RNA, 17 nt, Human
gggcugcaccggcuggc

SEQ ID NO: 3308184 - RNA, 13 nt, Human
gggcuccagacac

SEQ ID NO: 3308185 - RNA, 10 nt, Human
gggcuccaga

SEQ ID NO: 3308186 - RNA, 21 nt, Human
gggcucagcggggacagcucc

SEQ ID NO: 3308187 - RNA, 22 nt, Human
gggcucagcaaaagaugcuucu

SEQ ID NO: 3308188 - RNA, 18 nt, Human
gggcucagcaaaagaugc

SEQ ID NO: 3308189 - RNA, 15 nt, Human
gggcuaguugggcuu

SEQ ID NO: 3308190 - RNA, 17 nt, Human
gggcucagcggggacag

SEQ ID NO: 3308191 - RNA, 19 nt, Human
gggcucagcggggacagcu

SEQ ID NO: 3308192 - RNA, 14 nt, Human
gggccaggagccuc

SEQ ID NO: 3308193 - RNA, 13 nt, Human
gggccaggagccu

SEQ ID NO: 3308194 - RNA, 12 nt, Human
gggccaggagcc

SEQ ID NO: 3308195 - RNA, 21 nt, Human
gggcggugagaggggaacaga

SEQ ID NO: 3308196 - RNA, 18 nt, Human
gggccucuuaugggcugg

SEQ ID NO: 3308197 - RNA, 22 nt, Human
gggccucgguguggagaagcgg

SEQ ID NO: 3308198 - RNA, 13 nt, Human
gggccucagugcc

SEQ ID NO: 3308199 - RNA, 14 nt, Human
gggccucagugcca

SEQ ID NO: 3308200 - RNA, 16 nt, Human
aaaauauuuuccugcc

SEQ ID NO: 3308201 - RNA, 13 nt, Human
aaaauaccaagga

SEQ ID NO: 3308202 - RNA, 22 nt, Human
aaaaggagccaauuuaaagaaa

SEQ ID NO: 3308203 - RNA, 13 nt, Human
aaaaggaugcaca

SEQ ID NO: 3308204 - RNA, 22 nt, Human
aaaaggaugcacagaguuguua

SEQ ID NO: 3308205 - RNA, 19 nt, Human
aaaaggaugcacagaguug

SEQ ID NO: 3308206 - RNA, 15 nt, Human
aaaaggaugcacaga

SEQ ID NO: 3308207 - RNA, 14 nt, Human
aaaaggaugcacag

SEQ ID NO: 3308208 - RNA, 19 nt, Human
aaaagguaugcaaucaaau

SEQ ID NO: 3308209 - RNA, 11 nt, Human
aaaaggcagga

SEQ ID NO: 3308210 - RNA, 17 nt, Human
aaaagguuaauaaagua

SEQ ID NO: 3308211 - RNA, 16 nt, Human
aaaagguuaauaaagu

SEQ ID NO: 3308212 - RNA, 20 nt, Human
gggucacucuggcagcucag

SEQ ID NO: 3308213 - RNA, 14 nt, Human
gggucacucuggca

SEQ ID NO: 3308214 - RNA, 19 nt, Human
aaacauuuugucauauaag

SEQ ID NO: 3308215 - RNA, 22 nt, Human
aaaccugugucucugagaguag

SEQ ID NO: 3308216 - RNA, 11 nt, Human
gggggcuggga

SEQ ID NO: 3308217 - RNA, 17 nt, Human
gggggaucacagccucu

SEQ ID NO: 3308218 - RNA, 21 nt, Human
ggggucacucuggcagcucag

SEQ ID NO: 3308219 - RNA, 13 nt, Human
ggggguggccucc

SEQ ID NO: 3308220 - RNA, 15 nt, Human
gggggcugggcagag

SEQ ID NO: 3308221 - RNA, 13 nt, Human
ggggaccagagcu

SEQ ID NO: 3308222 - RNA, 12 nt, Human
ggggaccagagc

SEQ ID NO: 3308223 - RNA, 18 nt, Human
aaaauguauguguaagua

SEQ ID NO: 3308224 - RNA, 14 nt, Human
ggggaccagagcug

SEQ ID NO: 3308225 - RNA, 19 nt, Human
ggggccaguuggucccccu

SEQ ID NO: 3308226 - RNA, 20 nt, Human
gguaaggaauaccugucccc

SEQ ID NO: 3308227 - RNA, 20 nt, Human
gguaggguaagugagagagg

SEQ ID NO: 3308228 - RNA, 14 nt, Human
gguaucaggugcug

SEQ ID NO: 3308229 - RNA, 18 nt, Human
aaacuuuacuauggcccu

SEQ ID NO: 3308230 - RNA, 22 nt, Human
aaacuugauguguuaucucuua

SEQ ID NO: 3308231 - RNA, 19 nt, Human
gguaucaggugcugccauc

SEQ ID NO: 3308232 - RNA, 12 nt, Human
ggguggugaccu

SEQ ID NO: 3308233 - RNA, 20 nt, Human
ggguuuugccauguuggcca

SEQ ID NO: 3308234 - RNA, 23 nt, Human
ggguuuugccauguuggccaggc

SEQ ID NO: 3308235 - RNA, 18 nt, Human
gguaacuagggaagauaa

SEQ ID NO: 3308236 - RNA, 21 nt, Human
aaacguggcugcuucaaggau

SEQ ID NO: 3308237 - RNA, 20 nt, Human
aaacguggcugcuucaagga

SEQ ID NO: 3308238 - RNA, 19 nt, Human
aaacuguuaauaguucagg

SEQ ID NO: 3308239 - RNA, 14 nt, Human
ggguggccucccaa

SEQ ID NO: 3308240 - RNA, 18 nt, Human
gggugggacacccuguga

SEQ ID NO: 3308241 - RNA, 15 nt, Human
gggugggacacccug

SEQ ID NO: 3308242 - RNA, 19 nt, Human
aaacuuaaucuaaauggaa

SEQ ID NO: 3308243 - RNA, 21 nt, Human
ggugcugccauccagguucag

SEQ ID NO: 3308244 - RNA, 20 nt, Human
gguggcaccagcagccugga

SEQ ID NO: 3308245 - RNA, 14 nt, Human
gguggcaccagcag

SEQ ID NO: 3308246 - RNA, 14 nt, Human
aaagcuaggccugg

SEQ ID NO: 3308247 - RNA, 16 nt, Human
aaagcuaggccuggcc

SEQ ID NO: 3308248 - RNA, 13 nt, Human
aaagcagugcaug

SEQ ID NO: 3308249 - RNA, 13 nt, Human
aaagcugccagcc

SEQ ID NO: 3308250 - RNA, 12 nt, Human
aaagcugccagc

SEQ ID NO: 3308251 - RNA, 20 nt, Human
aaagggcccagagagggugg

SEQ ID NO: 3308252 - RNA, 19 nt, Human
gguggggaccucaggccug

SEQ ID NO: 3308253 - RNA, 16 nt, Human
ggugggacacccugug

SEQ ID NO: 3308254 - RNA, 13 nt, Human
ggugggacacccu

SEQ ID NO: 3308255 - RNA, 17 nt, Human
ggugggacacccuguga

SEQ ID NO: 3308256 - RNA, 18 nt, Human
gguggcuggguuggaggg

SEQ ID NO: 3308257 - RNA, 12 nt, Human
gguggcuggguu

SEQ ID NO: 3308258 - RNA, 20 nt, Human
gguuuguaaauuaacuuuua

SEQ ID NO: 3308259 - RNA, 15 nt, Human
gguuucagaaaugug

SEQ ID NO: 3308260 - RNA, 16 nt, Human
gguuucuaaagcugcc

SEQ ID NO: 3308261 - RNA, 22 nt, Human
gguuucuaaagcugccagccga

SEQ ID NO: 3308262 - RNA, 18 nt, Human
aaaguaucccuacuguaa

SEQ ID NO: 3308263 - RNA, 21 nt, Human
aaaguguauuuuuuuacuaau

SEQ ID NO: 3308264 - RNA, 14 nt, Human
aaaguguauuuuuu

SEQ ID NO: 3308265 - RNA, 21 nt, Human
aaaguaucccuacuguaauuu

SEQ ID NO: 3308266 - RNA, 20 nt, Human
aaaguagaagucuuagaugu

SEQ ID NO: 3308267 - RNA, 22 nt, Human
aaaguagaagucuuagauguau

SEQ ID NO: 3308268 - RNA, 18 nt, Human
aaaguacacuguuucaaa

SEQ ID NO: 3308269 - RNA, 23 nt, Human
aaaguacuucuccacccugcucu

SEQ ID NO: 3308270 - RNA, 19 nt, Human
aaaguacacuguuucaaac

SEQ ID NO: 3308271 - RNA, 12 nt, Human
gguguggagaag

SEQ ID NO: 3308272 - RNA, 23 nt, Human
gguguggagaagcggcuggcagc

SEQ ID NO: 3308273 - RNA, 14 nt, Human
gguguggagaagcg

SEQ ID NO: 3308274 - RNA, 13 nt, Human
ggugggggccucg

SEQ ID NO: 3308275 - RNA, 13 nt, Human
ggugugggggaag

SEQ ID NO: 3308276 - RNA, 11 nt, Human
gguguggggga

SEQ ID NO: 3308277 - RNA, 22 nt, Human
gguucccuuugacgccauccca

SEQ ID NO: 3308278 - RNA, 23 nt, Human
gguucccuuugacgccaucccag

SEQ ID NO: 3308279 - RNA, 22 nt, Human
gguucccuuuuuuggcugcuga

SEQ ID NO: 3308280 - RNA, 19 nt, Human
gguguuuccuggcacugcu

SEQ ID NO: 3308281 - RNA, 17 nt, Human
gguguuuccuggcacug

SEQ ID NO: 3308282 - RNA, 17 nt, Human
gguucccauuugcuccu

SEQ ID NO: 3308283 - RNA, 23 nt, Human
guaauccuagcacuuugggaggc

SEQ ID NO: 3308284 - RNA, 20 nt, Human
guaauuugugauacaaugcu

SEQ ID NO: 3308285 - RNA, 17 nt, Human
guaauuugugauacaau

SEQ ID NO: 3308286 - RNA, 15 nt, Human
guaauuugugauaca

SEQ ID NO: 3308287 - RNA, 21 nt, Human
guaauuuuuuuaucgucacug

SEQ ID NO: 3308288 - RNA, 19 nt, Human
guaacaggaaaauuuuaaa

SEQ ID NO: 3308289 - RNA, 16 nt, Human
guaacaagccacccca

SEQ ID NO: 3308290 - RNA, 22 nt, Human
aaauaaugugaaacuggauuaa

SEQ ID NO: 3308291 - RNA, 14 nt, Human
aaauaaugugaaac

SEQ ID NO: 3308292 - RNA, 22 nt, Human
aaaguguauuuuuuuacuaaua

SEQ ID NO: 3308293 - RNA, 18 nt, Human
aaaucagccugcuccagc

SEQ ID NO: 3308294 - RNA, 23 nt, Human
aaaucagccugcuccagcuguuc

SEQ ID NO: 3308295 - RNA, 21 nt, Human
aaaucagccugcuccagcugu

SEQ ID NO: 3308296 - RNA, 19 nt, Human
aaaucagccugcuccagcu

SEQ ID NO: 3308297 - RNA, 12 nt, Human
aaauaucugaaa

SEQ ID NO: 3308298 - RNA, 14 nt, Human
aaauaucugaaaau

SEQ ID NO: 3308299 - RNA, 17 nt, Human
aaauaucugaaaaugua

SEQ ID NO: 3308300 - RNA, 18 nt, Human
aaauaucugaaaauguau

SEQ ID NO: 3308301 - RNA, 19 nt, Human
aaauaucugaaaauguaug

SEQ ID NO: 3308302 - RNA, 21 nt, Human
aaauaucugaaaauguaugug

SEQ ID NO: 3308303 - RNA, 22 nt, Human
aaauaucugaaaauguaugugu

SEQ ID NO: 3308304 - RNA, 23 nt, Human
aaauaucugaaaauguaugugua

SEQ ID NO: 3308305 - RNA, 18 nt, Human
aaauaccagccaguaaau

SEQ ID NO: 3308306 - RNA, 21 nt, Human
aaauaccagccaguaaauggg

SEQ ID NO: 3308307 - RNA, 20 nt, Human
aaauaccagccaguaaaugg

SEQ ID NO: 3308308 - RNA, 16 nt, Human
guacacacacauacac

SEQ ID NO: 3308309 - RNA, 19 nt, Human
aaauaccagccaguaaaug

SEQ ID NO: 3308310 - RNA, 15 nt, Human
aaauauaggaacuua

SEQ ID NO: 3308311 - RNA, 20 nt, Human
gcucagggccuggcucaggu

SEQ ID NO: 3308312 - RNA, 17 nt, Human
gcucagggccuggcuca

SEQ ID NO: 3308313 - RNA, 13 nt, Human
gcucaggaguuug

SEQ ID NO: 3308314 - RNA, 19 nt, Human
gcucagggccuggcucagg

SEQ ID NO: 3308315 - RNA, 18 nt, Human
gcucagggccuggcucag

SEQ ID NO: 3308316 - RNA, 22 nt, Human
gcucagagagggugggaguggg

SEQ ID NO: 3308317 - RNA, 20 nt, Human
gcuaggaccccuccaugugg

SEQ ID NO: 3308318 - RNA, 22 nt, Human
gcuagugugguguuuccuggca

SEQ ID NO: 3308319 - RNA, 14 nt, Human
gcuaguugggcuuc

SEQ ID NO: 3308320 - RNA, 16 nt, Human
gcuaguugggcuuccu

SEQ ID NO: 3308321 - RNA, 18 nt, Human
gcuaagugauccucccac

SEQ ID NO: 3308322 - RNA, 22 nt, Human
gcuaagugauccucccaccuca

SEQ ID NO: 3308323 - RNA, 16 nt, Human
gcggccuuuggcuuca

SEQ ID NO: 3308324 - RNA, 15 nt, Human
gcggcuggcagccca

SEQ ID NO: 3308325 - RNA, 21 nt, Human
gcgcagcauauucaggaagcu

SEQ ID NO: 3308326 - RNA, 20 nt, Human
gcgcagcauauucaggaagc

SEQ ID NO: 3308327 - RNA, 23 nt, Human
gcgauucuucugcuucagccucc

SEQ ID NO: 3308328 - RNA, 23 nt, Human
gccuugaccauucuccaccugcc

SEQ ID NO: 3308329 - RNA, 22 nt, Human
gcgauucuucugcuucagccuc

SEQ ID NO: 3308330 - RNA, 17 nt, Human
gcgauucuucugcuuca

SEQ ID NO: 3308331 - RNA, 22 nt, Human
gccuugaccauucuccaccugc

SEQ ID NO: 3308332 - RNA, 21 nt, Human
gccuugaccauucuccaccug

SEQ ID NO: 3308333 - RNA, 23 nt, Human
gccuugaacuuugaccucugcag

SEQ ID NO: 3308334 - RNA, 15 nt, Human
gccuucucugaagga

SEQ ID NO: 3308335 - RNA, 16 nt, Human
gccuucucugaaggac

SEQ ID NO: 3308336 - RNA, 15 nt, Human
gccuguucagcucca

SEQ ID NO: 3308337 - RNA, 14 nt, Human
gccuguucagcucc

SEQ ID NO: 3308338 - RNA, 16 nt, Human
gccuguucagcuccag

SEQ ID NO: 3308339 - RNA, 14 nt, Human
gccuugaacuuuga

SEQ ID NO: 3308340 - RNA, 21 nt, Human
gccugggaucccucauccuca

SEQ ID NO: 3308341 - RNA, 23 nt, Human
gccugggaucccucauccucaua

SEQ ID NO: 3308342 - RNA, 19 nt, Human
gccugugccucugggacug

SEQ ID NO: 3308343 - RNA, 18 nt, Human
gcccaggccccugccacc

SEQ ID NO: 3308344 - RNA, 20 nt, Human
gcccaggccccugccacccu

SEQ ID NO: 3308345 - RNA, 21 nt, Human
gcccaggccccugccacccug

SEQ ID NO: 3308346 - RNA, 11 nt, Human
gcccaggcccc

SEQ ID NO: 3308347 - RNA, 12 nt, Human
gcccaggccccu

SEQ ID NO: 3308348 - RNA, 16 nt, Human
gcccaggcaggucuug

SEQ ID NO: 3308349 - RNA, 11 nt, Human
gcccaggcagg

SEQ ID NO: 3308350 - RNA, 18 nt, Human
gcauuuacuuuguguuca

SEQ ID NO: 3308351 - RNA, 21 nt, Human
gcccacgcccccacuggugac

SEQ ID NO: 3308352 - RNA, 17 nt, Human
gcccacgcccccacugg

SEQ ID NO: 3308353 - RNA, 16 nt, Human
gcccacgcccccacug

SEQ ID NO: 3308354 - RNA, 15 nt, Human
gcccacgcccccacu

SEQ ID NO: 3308355 - RNA, 13 nt, Human
gcccacuucugcc

SEQ ID NO: 3308356 - RNA, 23 nt, Human
gcccaggaaaggcuccaggagca

SEQ ID NO: 3308357 - RNA, 22 nt, Human
gcccaggaaaggcuccaggagc

SEQ ID NO: 3308358 - RNA, 21 nt, Human
gcccaggaaaggcuccaggag

SEQ ID NO: 3308359 - RNA, 24 nt, Human
gcccaggaaaggcuccaggagcag

SEQ ID NO: 3308360 - RNA, 23 nt, Human
gcccacgcuggagugcagugagc

SEQ ID NO: 3308361 - RNA, 19 nt, Human
gcccacgcuggagugcagu

SEQ ID NO: 3308362 - RNA, 21 nt, Human
gcccacgcuggagugcaguga

SEQ ID NO: 3308363 - RNA, 19 nt, Human
gccccaaaacucuccucug

SEQ ID NO: 3308364 - RNA, 21 nt, Human
gccccaaaacucuccucugcu

SEQ ID NO: 3308365 - RNA, 20 nt, Human
gccccaaaacucuccucugc

SEQ ID NO: 3308366 - RNA, 12 nt, Human
gcccccacuggu

SEQ ID NO: 3308367 - RNA, 12 nt, Human
gccccugcuggu

SEQ ID NO: 3308368 - RNA, 15 nt, Human
gccccugcugguuca

SEQ ID NO: 3308369 - RNA, 16 nt, Human
gccccugcugguucag

SEQ ID NO: 3308370 - RNA, 15 nt, Human
gccccuggcagcccc

SEQ ID NO: 3308371 - RNA, 12 nt, Human
gccccuggcagc

SEQ ID NO: 3308372 - RNA, 14 nt, Human
gccucugggacugg

SEQ ID NO: 3308373 - RNA, 16 nt, Human
gccucgaacuggcugc

SEQ ID NO: 3308374 - RNA, 13 nt, Human
gccucgaacuggc

SEQ ID NO: 3308375 - RNA, 22 nt, Human
gccuccuuugugaggaagccgc

SEQ ID NO: 3308376 - RNA, 12 nt, Human
gccuagcauacg

SEQ ID NO: 3308377 - RNA, 17 nt, Human
gccuacaggagugagca

SEQ ID NO: 3308378 - RNA, 16 nt, Human
gccccuggcagccccu

SEQ ID NO: 3308379 - RNA, 14 nt, Human
gcccugcccaccug

SEQ ID NO: 3308380 - RNA, 23 nt, Human
gcccuuaccugccaggaagccag

SEQ ID NO: 3308381 - RNA, 22 nt, Human
gcccuuaccugccaggaagcca

SEQ ID NO: 3308382 - RNA, 21 nt, Human
gcccuuaccugccaggaagcc

SEQ ID NO: 3308383 - RNA, 17 nt, Human
gcccugugggcccccaa

SEQ ID NO: 3308384 - RNA, 16 nt, Human
gcccugugggccccca

SEQ ID NO: 3308385 - RNA, 16 nt, Human
gccuacaggagugagc

SEQ ID NO: 3308386 - RNA, 23 nt, Human
ggaaaucaccgaaaacguggcug

SEQ ID NO: 3308387 - RNA, 21 nt, Human
ggaagccagcaggcucucagg

SEQ ID NO: 3308388 - RNA, 23 nt, Human
ggaagccagcaggcucucaggcc

SEQ ID NO: 3308389 - RNA, 22 nt, Human
ggaagccagcaggcucucaggc

SEQ ID NO: 3308390 - RNA, 15 nt, Human
ggaagccgcuggggc

SEQ ID NO: 3308391 - RNA, 18 nt, Human
ggaagccgcuggggccag

SEQ ID NO: 3308392 - RNA, 13 nt, Human
ggacauggacaag

SEQ ID NO: 3308393 - RNA, 23 nt, Human
ggacacccugugauggggcccug

SEQ ID NO: 3308394 - RNA, 13 nt, Human
ggacacccuguga

SEQ ID NO: 3308395 - RNA, 23 nt, Human
ggacaggcauguucucugaggac

SEQ ID NO: 3308396 - RNA, 17 nt, Human
ggacagggaggugaccc

SEQ ID NO: 3308397 - RNA, 12 nt, Human
ggacacccugug

SEQ ID NO: 3308398 - RNA, 13 nt, Human
ggacacagcucuu

SEQ ID NO: 3308399 - RNA, 21 nt, Human
ggacacagcucuucuccaggc

SEQ ID NO: 3308400 - RNA, 12 nt, Human
ggacacagcucu

SEQ ID NO: 3308401 - RNA, 19 nt, Human
ggaaugaaugucaguguga

SEQ ID NO: 3308402 - RNA, 16 nt, Human
ggaauauauaaccagu

SEQ ID NO: 3308403 - RNA, 19 nt, Human
ggaauaccugucccccuga

SEQ ID NO: 3308404 - RNA, 16 nt, Human
ggaauaccuguccccc

SEQ ID NO: 3308405 - RNA, 15 nt, Human
ggaagcucagggccu

SEQ ID NO: 3308406 - RNA, 15 nt, Human
ggaauaccugucccc

SEQ ID NO: 3308407 - RNA, 21 nt, Human
ggaagcucagggccuggcuca

SEQ ID NO: 3308408 - RNA, 17 nt, Human
ggaagcucagggccugg

SEQ ID NO: 3308409 - RNA, 16 nt, Human
ggaagcucagggccug

SEQ ID NO: 3308410 - RNA, 19 nt, Human
gcuugggcuucauccuccu

SEQ ID NO: 3308411 - RNA, 22 nt, Human
gcuuggggaccagagcugccac

SEQ ID NO: 3308412 - RNA, 21 nt, Human
gcuuggggaccagagcugcca

SEQ ID NO: 3308413 - RNA, 20 nt, Human
gcuuggggaccagagcugcc

SEQ ID NO: 3308414 - RNA, 18 nt, Human
gcuuggggaccagagcug

SEQ ID NO: 3308415 - RNA, 17 nt, Human
gcuuggggaccagagcu

SEQ ID NO: 3308416 - RNA, 13 nt, Human
gcuuucuacccag

SEQ ID NO: 3308417 - RNA, 19 nt, Human
gcuuucuacccagcgagcc

SEQ ID NO: 3308418 - RNA, 22 nt, Human
gcuuucuacccagcgagcccug

SEQ ID NO: 3308419 - RNA, 16 nt, Human
gcuuggggaccagagc

SEQ ID NO: 3308420 - RNA, 23 nt, Human
gcuugggcuucauccuccucaga

SEQ ID NO: 3308421 - RNA, 19 nt, Human
gcuugaccgugaggccaga

SEQ ID NO: 3308422 - RNA, 18 nt, Human
gcuugaccgugaggccag

SEQ ID NO: 3308423 - RNA, 17 nt, Human
gcuugaccgugaggcca

SEQ ID NO: 3308424 - RNA, 16 nt, Human
gcuugaccgugaggcc

SEQ ID NO: 3308425 - RNA, 21 nt, Human
gcuucuucagagacuccugca

SEQ ID NO: 3308426 - RNA, 19 nt, Human
gcuucuucagagacuccug

SEQ ID NO: 3308427 - RNA, 14 nt, Human
gcuuaacuucacau

SEQ ID NO: 3308428 - RNA, 17 nt, Human
gcuuaacuucacauauu

SEQ ID NO: 3308429 - RNA, 16 nt, Human
gcuucuucagagacuc

SEQ ID NO: 3308430 - RNA, 16 nt, Human
gcuuaacuucacauau

SEQ ID NO: 3308431 - RNA, 20 nt, Human
ggaaacagcuaaugggacac

SEQ ID NO: 3308432 - RNA, 15 nt, Human
ggaaacccagcucug

SEQ ID NO: 3308433 - RNA, 15 nt, Human
gcuuuuuaauauuga

SEQ ID NO: 3308434 - RNA, 12 nt, Human
gcuuuugugcau

SEQ ID NO: 3308435 - RNA, 19 nt, Human
gcuuuugugcauuaucuag

SEQ ID NO: 3308436 - RNA, 13 nt, Human
gcuuuugugcauu

SEQ ID NO: 3308437 - RNA, 14 nt, Human
ggaaagaggcucug

SEQ ID NO: 3308438 - RNA, 20 nt, Human
ggaaagacuuuuccaacccu

SEQ ID NO: 3308439 - RNA, 17 nt, Human
ggaaagaguaggaagac

SEQ ID NO: 3308440 - RNA, 16 nt, Human
ggaaagaguaggaaga

SEQ ID NO: 3308441 - RNA, 19 nt, Human
ggaaagcaaaggagauugg

SEQ ID NO: 3308442 - RNA, 23 nt, Human
gcugcaaaggguaucaggugcug

SEQ ID NO: 3308443 - RNA, 13 nt, Human
gcugcaccggcug

SEQ ID NO: 3308444 - RNA, 19 nt, Human
gcugcacccucaggcaggu

SEQ ID NO: 3308445 - RNA, 18 nt, Human
gcugcacccucaggcagg

SEQ ID NO: 3308446 - RNA, 16 nt, Human
gcugcacccucaggca

SEQ ID NO: 3308447 - RNA, 20 nt, Human
gcugccugggaucccucauc

SEQ ID NO: 3308448 - RNA, 16 nt, Human
gcugccucucccauca

SEQ ID NO: 3308449 - RNA, 21 nt, Human
gcugccugggaucccucaucc

SEQ ID NO: 3308450 - RNA, 12 nt, Human
gcugccuguuca

SEQ ID NO: 3308451 - RNA, 13 nt, Human
gcugccuguucag

SEQ ID NO: 3308452 - RNA, 17 nt, Human
gcugccuguucagcucc

SEQ ID NO: 3308453 - RNA, 19 nt, Human
gcugccccuggcagccccu

SEQ ID NO: 3308454 - RNA, 18 nt, Human
gcugccccuggcagcccc

SEQ ID NO: 3308455 - RNA, 20 nt, Human
gcugccccuggcagccccug

SEQ ID NO: 3308456 - RNA, 17 nt, Human
gcugccccuggcagccc

SEQ ID NO: 3308457 - RNA, 14 nt, Human
gcugaggugggagg

SEQ ID NO: 3308458 - RNA, 23 nt, Human
gcugagggugagugggugaauaa

SEQ ID NO: 3308459 - RNA, 18 nt, Human
gcugagggugagugggug

SEQ ID NO: 3308460 - RNA, 21 nt, Human
gcuggguucuacccaggugcu

SEQ ID NO: 3308461 - RNA, 20 nt, Human
gcuggguucuacccaggugc

SEQ ID NO: 3308462 - RNA, 17 nt, Human
gcuggguucuacccagg

SEQ ID NO: 3308463 - RNA, 18 nt, Human
gcuggguucuacccaggu

SEQ ID NO: 3308464 - RNA, 22 nt, Human
gcugggguggggaccucaggcc

SEQ ID NO: 3308465 - RNA, 14 nt, Human
gcugggcagguugg

SEQ ID NO: 3308466 - RNA, 17 nt, Human
gcuggcuguuggcuggg

SEQ ID NO: 3308467 - RNA, 20 nt, Human
gcuggcuguuggcugggggc

SEQ ID NO: 3308468 - RNA, 23 nt, Human
gcuggcuguuggcugggggccuc

SEQ ID NO: 3308469 - RNA, 19 nt, Human
gcugggguggggaccucag

SEQ ID NO: 3308470 - RNA, 17 nt, Human
gcugggguggggaccuc

SEQ ID NO: 3308471 - RNA, 14 nt, Human
gcuggcgugcagug

SEQ ID NO: 3308472 - RNA, 15 nt, Human
gcuggcgugcagugg

SEQ ID NO: 3308473 - RNA, 18 nt, Human
gcuggcgugcaguggugc

SEQ ID NO: 3308474 - RNA, 18 nt, Human
gcuggcuguuggcugggg

SEQ ID NO: 3308475 - RNA, 19 nt, Human
gcuggcuguuggcuggggg

SEQ ID NO: 3308476 - RNA, 17 nt, Human
gcuguaucccaugagcc

SEQ ID NO: 3308477 - RNA, 13 nt, Human
gcugugcucugga

SEQ ID NO: 3308478 - RNA, 14 nt, Human
gcugugcugcccug

SEQ ID NO: 3308479 - RNA, 15 nt, Human
gcugugcucuggaca

SEQ ID NO: 3308480 - RNA, 16 nt, Human
gcugugcucuggacag

SEQ ID NO: 3308481 - RNA, 14 nt, Human
gcuguuggcugggg

SEQ ID NO: 3308482 - RNA, 16 nt, Human
gcuguuggcugggggc

SEQ ID NO: 3308483 - RNA, 20 nt, Human
gcuguuggcugggggccuca

SEQ ID NO: 3308484 - RNA, 15 nt, Human
gcuguuggcuggggg

SEQ ID NO: 3308485 - RNA, 16 nt, Human
gcugugcugcccugcc

SEQ ID NO: 3308486 - RNA, 15 nt, Human
gcugugcugcccugc

SEQ ID NO: 3308487 - RNA, 16 nt, Human
cuccucugcugcuggc

SEQ ID NO: 3308488 - RNA, 15 nt, Human
cuccucugcugcugg

SEQ ID NO: 3308489 - RNA, 18 nt, Human
cuccucugcugcuggcug

SEQ ID NO: 3308490 - RNA, 16 nt, Human
cuccuggcccacugca

SEQ ID NO: 3308491 - RNA, 22 nt, Human
cucccccagccccauccucugu

SEQ ID NO: 3308492 - RNA, 20 nt, Human
cucccccagccccauccucu

SEQ ID NO: 3308493 - RNA, 15 nt, Human
cucccccagccccau

SEQ ID NO: 3308494 - RNA, 15 nt, Human
cucgaacuggcugca

SEQ ID NO: 3308495 - RNA, 13 nt, Human
cucgaacuggcug

SEQ ID NO: 3308496 - RNA, 14 nt, Human
cucgaacuggcugc

SEQ ID NO: 3308497 - RNA, 19 nt, Human
cuccacuuucuagccagag

SEQ ID NO: 3308498 - RNA, 16 nt, Human
cuccacuuucuagcca

SEQ ID NO: 3308499 - RNA, 16 nt, Human
cuccaagcucccaggc

SEQ ID NO: 3308500 - RNA, 15 nt, Human
cuccaagcucccagg

SEQ ID NO: 3308501 - RNA, 14 nt, Human
cuccaagcucccag

SEQ ID NO: 3308502 - RNA, 13 nt, Human
cuccaagcuccca

SEQ ID NO: 3308503 - RNA, 21 nt, Human
cuccaagaccuucuccuucac

SEQ ID NO: 3308504 - RNA, 22 nt, Human
cuccaagaccuucuccuucacc

SEQ ID NO: 3308505 - RNA, 24 nt, Human
cuccaagcaggacauggacaagga

SEQ ID NO: 3308506 - RNA, 22 nt, Human
cuccaagcaggacauggacaag

SEQ ID NO: 3308507 - RNA, 14 nt, Human
cuccaagcaggaca

SEQ ID NO: 3308508 - RNA, 13 nt, Human
cuccaagcaggac

SEQ ID NO: 3308509 - RNA, 21 nt, Human
cugagaggacuuuucuuugug

SEQ ID NO: 3308510 - RNA, 22 nt, Human
cugagaggacuuuucuuugugg

SEQ ID NO: 3308511 - RNA, 17 nt, Human
cugagaguagagucacu

SEQ ID NO: 3308512 - RNA, 22 nt, Human
cugagacucgcgacaaugcaaa

SEQ ID NO: 3308513 - RNA, 20 nt, Human
cugacccaugcugcccugug

SEQ ID NO: 3308514 - RNA, 22 nt, Human
cugacccaugcugcccugugag

SEQ ID NO: 3308515 - RNA, 21 nt, Human
cugacccaugcugcccuguga

SEQ ID NO: 3308516 - RNA, 20 nt, Human
cugagacucgcgacaaugca

SEQ ID NO: 3308517 - RNA, 21 nt, Human
cugagacucgcgacaaugcaa

SEQ ID NO: 3308518 - RNA, 22 nt, Human
cugagacagcccgggcucugcc

SEQ ID NO: 3308519 - RNA, 23 nt, Human
cugagacagcccgggcucugccu

SEQ ID NO: 3308520 - RNA, 20 nt, Human
cugaguacguugugcauuug

SEQ ID NO: 3308521 - RNA, 19 nt, Human
cugaguacguugugcauuu

SEQ ID NO: 3308522 - RNA, 17 nt, Human
cugaguacguugugcau

SEQ ID NO: 3308523 - RNA, 18 nt, Human
cugaguacguugugcauu

SEQ ID NO: 3308524 - RNA, 21 nt, Human
cugaguacguugugcauuugg

SEQ ID NO: 3308525 - RNA, 23 nt, Human
cugaggacacuaaccacgcugga

SEQ ID NO: 3308526 - RNA, 20 nt, Human
cugaggacacuaaccacgcu

SEQ ID NO: 3308527 - RNA, 17 nt, Human
cugaggaauccagaccc

SEQ ID NO: 3308528 - RNA, 20 nt, Human
cugaggaauccagacccggc

SEQ ID NO: 3308529 - RNA, 14 nt, Human
cugaggaauccaga

SEQ ID NO: 3308530 - RNA, 15 nt, Human
cugagcuuucugcua

SEQ ID NO: 3308531 - RNA, 14 nt, Human
cugagcuuucugcu

SEQ ID NO: 3308532 - RNA, 21 nt, Human
cugagaucaaaacgguuuuac

SEQ ID NO: 3308533 - RNA, 13 nt, Human
cucuuauugccca

SEQ ID NO: 3308534 - RNA, 14 nt, Human
cucuuauugcccac

SEQ ID NO: 3308535 - RNA, 15 nt, Human
cucuuauugcccacg

SEQ ID NO: 3308536 - RNA, 19 nt, Human
cucuuauugcccacgcugg

SEQ ID NO: 3308537 - RNA, 20 nt, Human
cucuuauugcccacgcugga

SEQ ID NO: 3308538 - RNA, 14 nt, Human
cucuucaaucucuu

SEQ ID NO: 3308539 - RNA, 19 nt, Human
cucuucagaucucuaacuu

SEQ ID NO: 3308540 - RNA, 18 nt, Human
cucuucagaucucuaacu

SEQ ID NO: 3308541 - RNA, 13 nt, Human
cucugcugacaga

SEQ ID NO: 3308542 - RNA, 14 nt, Human
cucugcugacagac

SEQ ID NO: 3308543 - RNA, 16 nt, Human
cucugcugacagacac

SEQ ID NO: 3308544 - RNA, 14 nt, Human
cucugguccauaga

SEQ ID NO: 3308545 - RNA, 18 nt, Human
cucugcacuccccugcug

SEQ ID NO: 3308546 - RNA, 20 nt, Human
cucugcacuccccugcuggg

SEQ ID NO: 3308547 - RNA, 21 nt, Human
cucugcacuccccugcugggu

SEQ ID NO: 3308548 - RNA, 13 nt, Human
cucugcuccucuc

SEQ ID NO: 3308549 - RNA, 18 nt, Human
cucugcuccucuccccag

SEQ ID NO: 3308550 - RNA, 23 nt, Human
cugacaacacucauugaccugag

SEQ ID NO: 3308551 - RNA, 22 nt, Human
cugacaacacucauugaccuga

SEQ ID NO: 3308552 - RNA, 21 nt, Human
cugaaggccccgcccaggcuu

SEQ ID NO: 3308553 - RNA, 19 nt, Human
cugaaggccccgcccaggc

SEQ ID NO: 3308554 - RNA, 18 nt, Human
cugaaggccccgcccagg

SEQ ID NO: 3308555 - RNA, 23 nt, Human
cugaaggacauugcggacagcca

SEQ ID NO: 3308556 - RNA, 21 nt, Human
cugaaggacauugcggacagc

SEQ ID NO: 3308557 - RNA, 16 nt, Human
cucuugagccugggag

SEQ ID NO: 3308558 - RNA, 18 nt, Human
cucuugagccuugaacuu

SEQ ID NO: 3308559 - RNA, 17 nt, Human
cucuugagccuugaacu

SEQ ID NO: 3308560 - RNA, 16 nt, Human
cucuugagccuugaac

SEQ ID NO: 3308561 - RNA, 22 nt, Human
cuagaagauuuugaaauuuuua

SEQ ID NO: 3308562 - RNA, 20 nt, Human
cuagcauacguacacauuuu

SEQ ID NO: 3308563 - RNA, 23 nt, Human
cuagcauacguacacauuuuauu

SEQ ID NO: 3308564 - RNA, 21 nt, Human
cuagcauacguacacauuuua

SEQ ID NO: 3308565 - RNA, 17 nt, Human
cuaccuuuguauucucu

SEQ ID NO: 3308566 - RNA, 18 nt, Human
cuacauacaauuccaaac

SEQ ID NO: 3308567 - RNA, 22 nt, Human
cuacaguugaaaaacagcugag

SEQ ID NO: 3308568 - RNA, 18 nt, Human
cuacaguccucccaucuc

SEQ ID NO: 3308569 - RNA, 20 nt, Human
cuacaguccucccaucucac

SEQ ID NO: 3308570 - RNA, 21 nt, Human
cuacaguugaaaaacagcuga

SEQ ID NO: 3308571 - RNA, 19 nt, Human
cuacaguugaaaaacagcu

SEQ ID NO: 3308572 - RNA, 19 nt, Human
cuacaguccucccaucuca

SEQ ID NO: 3308573 - RNA, 23 nt, Human
cuaaguuuuuauggcuuuugugc

SEQ ID NO: 3308574 - RNA, 23 nt, Human
cuaagugauccucccaccucagc

SEQ ID NO: 3308575 - RNA, 21 nt, Human
cuaagugguacuaacuuuccu

SEQ ID NO: 3308576 - RNA, 20 nt, Human
cuaaguuuuuauggcuuuug

SEQ ID NO: 3308577 - RNA, 18 nt, Human
cucaaaagcugggcaggu

SEQ ID NO: 3308578 - RNA, 17 nt, Human
cuaucucccccagcccc

SEQ ID NO: 3308579 - RNA, 16 nt, Human
cuaucucccccagccc

SEQ ID NO: 3308580 - RNA, 20 nt, Human
cucaaacucuugaccucagg

SEQ ID NO: 3308581 - RNA, 13 nt, Human
cucaaugcacuga

SEQ ID NO: 3308582 - RNA, 15 nt, Human
cucaaugcacugaca

SEQ ID NO: 3308583 - RNA, 23 nt, Human
cuaguuguuugauucagacagcu

SEQ ID NO: 3308584 - RNA, 22 nt, Human
cuaguuguuugauucagacagc

SEQ ID NO: 3308585 - RNA, 13 nt, Human
cuaguuugauuaa

SEQ ID NO: 3308586 - RNA, 15 nt, Human
cuagccagaggagag

SEQ ID NO: 3308587 - RNA, 13 nt, Human
cuagccagaggag

SEQ ID NO: 3308588 - RNA, 12 nt, Human
cuagccagagga

SEQ ID NO: 3308589 - RNA, 22 nt, Human
cuaguuugauuaaauucuugca

SEQ ID NO: 3308590 - RNA, 21 nt, Human
cuaguuugauuaaauucuugc

SEQ ID NO: 3308591 - RNA, 14 nt, Human
cuaucucccccagc

SEQ ID NO: 3308592 - RNA, 15 nt, Human
cuaucucccccagcc

SEQ ID NO: 3308593 - RNA, 14 nt, Human
cuaucuaaauguug

SEQ ID NO: 3308594 - RNA, 14 nt, Human
cgccuacaggagug

SEQ ID NO: 3308595 - RNA, 22 nt, Human
cgcaggauucuuccucccuccc

SEQ ID NO: 3308596 - RNA, 16 nt, Human
cgaguagcugggacua

SEQ ID NO: 3308597 - RNA, 14 nt, Human
cgauagugguggug

SEQ ID NO: 3308598 - RNA, 16 nt, Human
ccuugccgucuaccug

SEQ ID NO: 3308599 - RNA, 14 nt, Human
ccuuuaagagaaau

SEQ ID NO: 3308600 - RNA, 18 nt, Human
ccuuucaauaggaaaaac

SEQ ID NO: 3308601 - RNA, 21 nt, Human
ccuuucaauaggaaaaacuga

SEQ ID NO: 3308602 - RNA, 17 nt, Human
ccuuuugagugccuuac

SEQ ID NO: 3308603 - RNA, 15 nt, Human
ccuuuugagugccuu

SEQ ID NO: 3308604 - RNA, 17 nt, Human
cgacugcccggcagggu

SEQ ID NO: 3308605 - RNA, 20 nt, Human
cgacccuugccgucuaccug

SEQ ID NO: 3308606 - RNA, 19 nt, Human
cgacccuugccgucuaccu

SEQ ID NO: 3308607 - RNA, 13 nt, Human
cgacaaugcaaac

SEQ ID NO: 3308608 - RNA, 12 nt, Human
cgacaaugcaaa

SEQ ID NO: 3308609 - RNA, 12 nt, Human
cgggccacagag

SEQ ID NO: 3308610 - RNA, 14 nt, Human
cgggccacagagaa

SEQ ID NO: 3308611 - RNA, 13 nt, Human
cggcuccaggcuc

SEQ ID NO: 3308612 - RNA, 14 nt, Human
cggcuccaggcucc

SEQ ID NO: 3308613 - RNA, 15 nt, Human
cggcuccaggcuccu

SEQ ID NO: 3308614 - RNA, 16 nt, Human
cggcuccaggcuccuu

SEQ ID NO: 3308615 - RNA, 12 nt, Human
cggcuccaggcu

SEQ ID NO: 3308616 - RNA, 14 nt, Human
cggagucccaccuu

SEQ ID NO: 3308617 - RNA, 16 nt, Human
cggcucacugcagccu

SEQ ID NO: 3308618 - RNA, 18 nt, Human
cggagucccaccuuggcu

SEQ ID NO: 3308619 - RNA, 20 nt, Human
cggagucccaccuuggcugc

SEQ ID NO: 3308620 - RNA, 15 nt, Human
cggcucacugcagcc

SEQ ID NO: 3308621 - RNA, 14 nt, Human
cggcucacugcagc

SEQ ID NO: 3308622 - RNA, 15 nt, Human
cggggacagcuccuu

SEQ ID NO: 3308623 - RNA, 13 nt, Human
cgguguggagaag

SEQ ID NO: 3308624 - RNA, 18 nt, Human
cgguguggagaagcggcu

SEQ ID NO: 3308625 - RNA, 14 nt, Human
cggggacagcuccu

SEQ ID NO: 3308626 - RNA, 17 nt, Human
cgggcucugccucccau

SEQ ID NO: 3308627 - RNA, 13 nt, Human
cgggcucugccuc

SEQ ID NO: 3308628 - RNA, 15 nt, Human
cgggcucagcaaaag

SEQ ID NO: 3308629 - RNA, 16 nt, Human
cgggcucugccuccca

SEQ ID NO: 3308630 - RNA, 14 nt, Human
cgggcucugccucc

SEQ ID NO: 3308631 - RNA, 11 nt, Human
cgggcucagca

SEQ ID NO: 3308632 - RNA, 16 nt, Human
cggagucccaccuugg

SEQ ID NO: 3308633 - RNA, 16 nt, Human
cgugaggccagagaca

SEQ ID NO: 3308634 - RNA, 17 nt, Human
cgugaguccuggcaugg

SEQ ID NO: 3308635 - RNA, 16 nt, Human
cgugaguccuggcaug

SEQ ID NO: 3308636 - RNA, 17 nt, Human
cgugaggccagagacac

SEQ ID NO: 3308637 - RNA, 20 nt, Human
cguguaaccauggacccaau

SEQ ID NO: 3308638 - RNA, 16 nt, Human
cgguuuuacugcagcu

SEQ ID NO: 3308639 - RNA, 20 nt, Human
ccugguggcagugggagcug

SEQ ID NO: 3308640 - RNA, 21 nt, Human
ccugguggcagugggagcugc

SEQ ID NO: 3308641 - RNA, 22 nt, Human
ccugucuaaugaaaccuguguc

SEQ ID NO: 3308642 - RNA, 15 nt, Human
ccugucuaaugaaac

SEQ ID NO: 3308643 - RNA, 22 nt, Human
ccuggccucugcacuccccugc

SEQ ID NO: 3308644 - RNA, 21 nt, Human
ccuggccucugcacuccccug

SEQ ID NO: 3308645 - RNA, 20 nt, Human
ccuggccucugcacuccccu

SEQ ID NO: 3308646 - RNA, 16 nt, Human
ccuggccucugcacuc

SEQ ID NO: 3308647 - RNA, 22 nt, Human
ccuggccuagcauacguacaca

SEQ ID NO: 3308648 - RNA, 11 nt, Human
ccucuuucccu

SEQ ID NO: 3308649 - RNA, 18 nt, Human
ccugcacuugcagacucu

SEQ ID NO: 3308650 - RNA, 14 nt, Human
ccugcagagggcac

SEQ ID NO: 3308651 - RNA, 16 nt, Human
ccugcacuugcagacu

SEQ ID NO: 3308652 - RNA, 17 nt, Human
ccugcacuugcagacuc

SEQ ID NO: 3308653 - RNA, 13 nt, Human
ccucuuucccucc

SEQ ID NO: 3308654 - RNA, 20 nt, Human
ccugcugcaguugccaguca

SEQ ID NO: 3308655 - RNA, 16 nt, Human
ccugcugcaguugcca

SEQ ID NO: 3308656 - RNA, 19 nt, Human
ccugccucgaacuggcugc

SEQ ID NO: 3308657 - RNA, 21 nt, Human
ccugccucgaacuggcugcaa

SEQ ID NO: 3308658 - RNA, 23 nt, Human
ccugccucgaacuggcugcaaag

SEQ ID NO: 3308659 - RNA, 19 nt, Human
ccugcugcaguugccaguc

SEQ ID NO: 3308660 - RNA, 17 nt, Human
ccugcugcaguugccag

SEQ ID NO: 3308661 - RNA, 13 nt, Human
ccugcccaccugg

SEQ ID NO: 3308662 - RNA, 20 nt, Human
ccugcccaccuggccucugc

SEQ ID NO: 3308663 - RNA, 14 nt, Human
ccugcccaccuggc

SEQ ID NO: 3308664 - RNA, 12 nt, Human
ccugcccaccug

SEQ ID NO: 3308665 - RNA, 19 nt, Human
ccugcccaccuggccucug

SEQ ID NO: 3308666 - RNA, 13 nt, Human
ccugcccaggccc

SEQ ID NO: 3308667 - RNA, 16 nt, Human
ccucccaucucacaca

SEQ ID NO: 3308668 - RNA, 13 nt, Human
ccucccaucucac

SEQ ID NO: 3308669 - RNA, 15 nt, Human
ccucccaccucagcc

SEQ ID NO: 3308670 - RNA, 14 nt, Human
ccggccccugcugg

SEQ ID NO: 3308671 - RNA, 14 nt, Human
cccuucgcuccugu

SEQ ID NO: 3308672 - RNA, 15 nt, Human
cccuucgcuccugug

SEQ ID NO: 3308673 - RNA, 19 nt, Human
cccuucucuccagccccug

SEQ ID NO: 3308674 - RNA, 21 nt, Human
cccuucucuccagccccugga

SEQ ID NO: 3308675 - RNA, 23 nt, Human
ccgcagcccugcagagggcacag

SEQ ID NO: 3308676 - RNA, 22 nt, Human
cccuucucuccagccccuggau

SEQ ID NO: 3308677 - RNA, 13 nt, Human
ccggccccugcug

SEQ ID NO: 3308678 - RNA, 13 nt, Human
cccugucuaauga

SEQ ID NO: 3308679 - RNA, 16 nt, Human
cccugucuaaugaaac

SEQ ID NO: 3308680 - RNA, 23 nt, Human
cccugucucaaaaaaagaaaaag

SEQ ID NO: 3308681 - RNA, 20 nt, Human
cccugucucaaaaaaagaaa

SEQ ID NO: 3308682 - RNA, 13 nt, Human
cccuucgcuccug

SEQ ID NO: 3308683 - RNA, 19 nt, Human
cccugugauggggcccugc

SEQ ID NO: 3308684 - RNA, 18 nt, Human
cccugugauggggcccug

SEQ ID NO: 3308685 - RNA, 17 nt, Human
cccugugauggggcccu

SEQ ID NO: 3308686 - RNA, 19 nt, Human
ccccuucgcuccugugucu

SEQ ID NO: 3308687 - RNA, 14 nt, Human
ccccuucgcuccug

SEQ ID NO: 3308688 - RNA, 15 nt, Human
ccccuucgcuccugu

SEQ ID NO: 3308689 - RNA, 17 nt, Human
ccccuucgcuccugugu

SEQ ID NO: 3308690 - RNA, 15 nt, Human
ccccauucugccugc

SEQ ID NO: 3308691 - RNA, 13 nt, Human
ccccauucugccu

SEQ ID NO: 3308692 - RNA, 14 nt, Human
ccccauucugccug

SEQ ID NO: 3308693 - RNA, 20 nt, Human
cccucaacucuccuccagag

SEQ ID NO: 3308694 - RNA, 17 nt, Human
ccccuucugacccaugc

SEQ ID NO: 3308695 - RNA, 16 nt, Human
ccccuucugacccaug

SEQ ID NO: 3308696 - RNA, 12 nt, Human
cccggcugcgga

SEQ ID NO: 3308697 - RNA, 14 nt, Human
cccagcccacuucu

SEQ ID NO: 3308698 - RNA, 23 nt, Human
cccaggaaaggcuccaggagcag

SEQ ID NO: 3308699 - RNA, 22 nt, Human
cccaggaaaggcuccaggagca

SEQ ID NO: 3308700 - RNA, 21 nt, Human
cccaggaaaggcuccaggagc

SEQ ID NO: 3308701 - RNA, 21 nt, Human
cccagcugugcucuggacagg

SEQ ID NO: 3308702 - RNA, 23 nt, Human
cccagcugugcucuggacaggca

SEQ ID NO: 3308703 - RNA, 19 nt, Human
cccaggaaaggcuccagga

SEQ ID NO: 3308704 - RNA, 21 nt, Human
cccaggcuggcgugcaguggu

SEQ ID NO: 3308705 - RNA, 15 nt, Human
cccaggcuuagucac

SEQ ID NO: 3308706 - RNA, 21 nt, Human
ccccagauugcaacaggcugg

SEQ ID NO: 3308707 - RNA, 22 nt, Human
ccccagauugcaacaggcuggg

SEQ ID NO: 3308708 - RNA, 23 nt, Human
ccccagauugcaacaggcugggc

SEQ ID NO: 3308709 - RNA, 17 nt, Human
ccccagcaagugagagc

SEQ ID NO: 3308710 - RNA, 19 nt, Human
ccccagcaagugagagcug

SEQ ID NO: 3308711 - RNA, 20 nt, Human
ccccagcaagugagagcugg

SEQ ID NO: 3308712 - RNA, 17 nt, Human
ccccauccucuguacag

SEQ ID NO: 3308713 - RNA, 22 nt, Human
ccccauccucuguacagagccc

SEQ ID NO: 3308714 - RNA, 21 nt, Human
ccccauccucuguacagagcc

SEQ ID NO: 3308715 - RNA, 19 nt, Human
ccccauccucuguacagag

SEQ ID NO: 3308716 - RNA, 20 nt, Human
cccauucugccugcccaggc

SEQ ID NO: 3308717 - RNA, 21 nt, Human
cccauucugccugcccaggcc

SEQ ID NO: 3308718 - RNA, 22 nt, Human
cccauucugccugcccaggccc

SEQ ID NO: 3308719 - RNA, 14 nt, Human
ccaugggccuccug

SEQ ID NO: 3308720 - RNA, 15 nt, Human
ccaugggccuccugu

SEQ ID NO: 3308721 - RNA, 20 nt, Human
ccaucccaaacccuucagug

SEQ ID NO: 3308722 - RNA, 23 nt, Human
ccaucccaaacccuucagugcca

SEQ ID NO: 3308723 - RNA, 12 nt, Human
ccaucccagccc

SEQ ID NO: 3308724 - RNA, 14 nt, Human
ccaugagccucagc

SEQ ID NO: 3308725 - RNA, 18 nt, Human
ccaugagccucagcaucc

SEQ ID NO: 3308726 - RNA, 19 nt, Human
ccaugagccucagcauccu

SEQ ID NO: 3308727 - RNA, 13 nt, Human
ccaugaguccccu

SEQ ID NO: 3308728 - RNA, 13 nt, Human
ccaugggccuccu

SEQ ID NO: 3308729 - RNA, 16 nt, Human
ccaugaguccccuguu

SEQ ID NO: 3308730 - RNA, 15 nt, Human
ccaugaguccccugu

SEQ ID NO: 3308731 - RNA, 14 nt, Human
ccaugaguccccug

SEQ ID NO: 3308732 - RNA, 16 nt, Human
ccauccccuguagagu

SEQ ID NO: 3308733 - RNA, 20 nt, Human
ccaucccugaaggccccgcc

SEQ ID NO: 3308734 - RNA, 13 nt, Human
ccaugagccucag

SEQ ID NO: 3308735 - RNA, 19 nt, Human
ccagcagagcaccuuagac

SEQ ID NO: 3308736 - RNA, 23 nt, Human
ccagcagagcaccuuagacaguc

SEQ ID NO: 3308737 - RNA, 16 nt, Human
ccagcuuaucucaggg

SEQ ID NO: 3308738 - RNA, 20 nt, Human
ccaggaaaggcuccaggagc

SEQ ID NO: 3308739 - RNA, 21 nt, Human
ccaggaaaggcuccaggagca

SEQ ID NO: 3308740 - RNA, 23 nt, Human
ccaggaaaggcuccaggagcagc

SEQ ID NO: 3308741 - RNA, 22 nt, Human
ccaggaaaggcuccaggagcag

SEQ ID NO: 3308742 - RNA, 14 nt, Human
ccagcagccuggac

SEQ ID NO: 3308743 - RNA, 15 nt, Human
ccagcagccuggacc

SEQ ID NO: 3308744 - RNA, 18 nt, Human
ccagccccuggaugcagc

SEQ ID NO: 3308745 - RNA, 19 nt, Human
ccagcagccuggacccugu

SEQ ID NO: 3308746 - RNA, 10 nt, Human
ccagccccuu

SEQ ID NO: 3308747 - RNA, 21 nt, Human
ccagccccuggaugcagccuc

SEQ ID NO: 3308748 - RNA, 14 nt, Human
ccaggcugggagag

SEQ ID NO: 3308749 - RNA, 13 nt, Human
ccaggcugggaga

SEQ ID NO: 3308750 - RNA, 21 nt, Human
ccaggcugggagagccuucca

SEQ ID NO: 3308751 - RNA, 18 nt, Human
ccaggcugggagagccuu

SEQ ID NO: 3308752 - RNA, 17 nt, Human
ccaggcugggagagccu

SEQ ID NO: 3308753 - RNA, 15 nt, Human
ccaggcugggagagc

SEQ ID NO: 3308754 - RNA, 22 nt, Human
ccaggcugggagagccuuccag

SEQ ID NO: 3308755 - RNA, 19 nt, Human
ccaggcuggcgugcagugg

SEQ ID NO: 3308756 - RNA, 19 nt, Human
ccagucaccccggccaccu

SEQ ID NO: 3308757 - RNA, 21 nt, Human
ccagucaccccggccaccugc

SEQ ID NO: 3308758 - RNA, 20 nt, Human
ccagucaccccggccaccug

SEQ ID NO: 3308759 - RNA, 12 nt, Human
ccagucaccccg

SEQ ID NO: 3308760 - RNA, 14 nt, Human
ccaacucaccccag

SEQ ID NO: 3308761 - RNA, 23 nt, Human
ccaaauggaaaugggcagagcag

SEQ ID NO: 3308762 - RNA, 18 nt, Human
ccaacucaccccagcccc

SEQ ID NO: 3308763 - RNA, 17 nt, Human
ccaacucaccccagccc

SEQ ID NO: 3308764 - RNA, 16 nt, Human
ccaacucaccccagcc

SEQ ID NO: 3308765 - RNA, 17 nt, Human
ccaauauuuaccagacc

SEQ ID NO: 3308766 - RNA, 15 nt, Human
ccaaugauggucacc

SEQ ID NO: 3308767 - RNA, 14 nt, Human
ccaaugcacuuugu

SEQ ID NO: 3308768 - RNA, 18 nt, Human
ccaagcucugcuccucuc

SEQ ID NO: 3308769 - RNA, 12 nt, Human
ccaagcucugcu

SEQ ID NO: 3308770 - RNA, 17 nt, Human
ccaagcucugcuccucu

SEQ ID NO: 3308771 - RNA, 14 nt, Human
ccaaugggagcuca

SEQ ID NO: 3308772 - RNA, 17 nt, Human
ccaaugggagcucaugg

SEQ ID NO: 3308773 - RNA, 20 nt, Human
ccaaaacucuccucugcugc

SEQ ID NO: 3308774 - RNA, 21 nt, Human
ccaaaacucuccucugcugcu

SEQ ID NO: 3308775 - RNA, 14 nt, Human
ccaccaucaagcca

SEQ ID NO: 3308776 - RNA, 13 nt, Human
ccaccaucaagcc

SEQ ID NO: 3308777 - RNA, 17 nt, Human
ccaccacacccagccca

SEQ ID NO: 3308778 - RNA, 13 nt, Human
ccacgcccccacu

SEQ ID NO: 3308779 - RNA, 19 nt, Human
ccacgcccccacuggugac

SEQ ID NO: 3308780 - RNA, 18 nt, Human
ccacgcccccacugguga

SEQ ID NO: 3308781 - RNA, 17 nt, Human
ccacgcccccacuggug

SEQ ID NO: 3308782 - RNA, 16 nt, Human
ccacgcccccacuggu

SEQ ID NO: 3308783 - RNA, 19 nt, Human
ccaccgcagacaggaccag

SEQ ID NO: 3308784 - RNA, 22 nt, Human
ccaccgcagacaggaccaggga

SEQ ID NO: 3308785 - RNA, 21 nt, Human
ccaccuuugaagaaguaagga

SEQ ID NO: 3308786 - RNA, 17 nt, Human
ccacucccugcaaccug

SEQ ID NO: 3308787 - RNA, 21 nt, Human
caguggugguuuucuguucuu

SEQ ID NO: 3308788 - RNA, 20 nt, Human
caguggugguuuucuguucu

SEQ ID NO: 3308789 - RNA, 19 nt, Human
caguggugguuuucuguuc

SEQ ID NO: 3308790 - RNA, 22 nt, Human
cauauucaggaagcucagggcc

SEQ ID NO: 3308791 - RNA, 17 nt, Human
cauauucuguuggccag

SEQ ID NO: 3308792 - RNA, 22 nt, Human
cauccuggcacccggccccugc

SEQ ID NO: 3308793 - RNA, 21 nt, Human
cauccccuguagagugggagc

SEQ ID NO: 3308794 - RNA, 12 nt, Human
caucacuucccu

SEQ ID NO: 3308795 - RNA, 14 nt, Human
caucacuucccuac

SEQ ID NO: 3308796 - RNA, 15 nt, Human
cauccuggcacccgg

SEQ ID NO: 3308797 - RNA, 13 nt, Human
caugauguuuucc

SEQ ID NO: 3308798 - RNA, 23 nt, Human
caugcuacacacugcauguuugu

SEQ ID NO: 3308799 - RNA, 20 nt, Human
caugcuacacacugcauguu

SEQ ID NO: 3308800 - RNA, 14 nt, Human
caugcuacacacug

SEQ ID NO: 3308801 - RNA, 20 nt, Human
caugcuccuggcccacugca

SEQ ID NO: 3308802 - RNA, 16 nt, Human
caugggaaugaauguc

SEQ ID NO: 3308803 - RNA, 15 nt, Human
caugggaaugaaugu

SEQ ID NO: 3308804 - RNA, 14 nt, Human
caugggaaugaaug

SEQ ID NO: 3308805 - RNA, 13 nt, Human
cauucuccaccug

SEQ ID NO: 3308806 - RNA, 16 nt, Human
cauucuccaccugcca

SEQ ID NO: 3308807 - RNA, 14 nt, Human
cauucuccaccugc

SEQ ID NO: 3308808 - RNA, 19 nt, Human
cauguuggccaggcugguc

SEQ ID NO: 3308809 - RNA, 16 nt, Human
cauguuggccaggcug

SEQ ID NO: 3308810 - RNA, 14 nt, Human
cauguuggccaggc

SEQ ID NO: 3308811 - RNA, 15 nt, Human
cauguuggccaggcu

SEQ ID NO: 3308812 - RNA, 13 nt, Human
cauguuggccagg

SEQ ID NO: 3308813 - RNA, 23 nt, Human
cagaggggguggccucccaacuc

SEQ ID NO: 3308814 - RNA, 22 nt, Human
cagaggggguggccucccaacu

SEQ ID NO: 3308815 - RNA, 19 nt, Human
cagauucuuuccugaggcu

SEQ ID NO: 3308816 - RNA, 18 nt, Human
cagauucuuuccugaggc

SEQ ID NO: 3308817 - RNA, 17 nt, Human
cagauucuuuccugagg

SEQ ID NO: 3308818 - RNA, 15 nt, Human
cagauucuuuccuga

SEQ ID NO: 3308819 - RNA, 22 nt, Human
cagauucuuuccugaggcuggg

SEQ ID NO: 3308820 - RNA, 20 nt, Human
cagauucuuuccugaggcug

SEQ ID NO: 3308821 - RNA, 19 nt, Human
cagcacgauuucuguuuag

SEQ ID NO: 3308822 - RNA, 18 nt, Human
cagcacgauuucuguuua

SEQ ID NO: 3308823 - RNA, 16 nt, Human
cagcacgauuucuguu

SEQ ID NO: 3308824 - RNA, 20 nt, Human
cagcaucauggagguuugaa

SEQ ID NO: 3308825 - RNA, 17 nt, Human
cagccucugaaaaccaa

SEQ ID NO: 3308826 - RNA, 19 nt, Human
cagccgagauagccaaggc

SEQ ID NO: 3308827 - RNA, 18 nt, Human
cagcggggacagcuccuu

SEQ ID NO: 3308828 - RNA, 19 nt, Human
cagcggggacagcuccuuc

SEQ ID NO: 3308829 - RNA, 21 nt, Human
cagcggggacagcuccuucug

SEQ ID NO: 3308830 - RNA, 19 nt, Human
cagccugcuaauuccccag

SEQ ID NO: 3308831 - RNA, 12 nt, Human
cagccugcucca

SEQ ID NO: 3308832 - RNA, 19 nt, Human
cagcugagggugagugggu

SEQ ID NO: 3308833 - RNA, 12 nt, Human
cagcugccuggg

SEQ ID NO: 3308834 - RNA, 14 nt, Human
cagcugccugggau

SEQ ID NO: 3308835 - RNA, 13 nt, Human
cagcugccuggga

SEQ ID NO: 3308836 - RNA, 19 nt, Human
cagcugugcucuggacagg

SEQ ID NO: 3308837 - RNA, 20 nt, Human
cagcugugcucuggacaggc

SEQ ID NO: 3308838 - RNA, 24 nt, Human
cagcugugcucuggacaggcaugu

SEQ ID NO: 3308839 - RNA, 19 nt, Human
cagcuguucagcugguuga

SEQ ID NO: 3308840 - RNA, 18 nt, Human
caggaaaagcugcugaca

SEQ ID NO: 3308841 - RNA, 15 nt, Human
caggaaaagcugcug

SEQ ID NO: 3308842 - RNA, 16 nt, Human
caggaaaagcugcuga

SEQ ID NO: 3308843 - RNA, 21 nt, Human
caggugcacaagcuccaagcu

SEQ ID NO: 3308844 - RNA, 21 nt, Human
cagguuggugggggccucggu

SEQ ID NO: 3308845 - RNA, 12 nt, Human
cagguuuuccug

SEQ ID NO: 3308846 - RNA, 16 nt, Human
cagguuuuccugaaga

SEQ ID NO: 3308847 - RNA, 15 nt, Human
caggugcacaagcuc

SEQ ID NO: 3308848 - RNA, 22 nt, Human
caggugauccacccaccucagc

SEQ ID NO: 3308849 - RNA, 23 nt, Human
caggugauccacccaccucagcc

SEQ ID NO: 3308850 - RNA, 20 nt, Human
caggugcacaagcuccaagc

SEQ ID NO: 3308851 - RNA, 19 nt, Human
caggugcacaagcuccaag

SEQ ID NO: 3308852 - RNA, 18 nt, Human
caggugcacaagcuccaa

SEQ ID NO: 3308853 - RNA, 17 nt, Human
caggugcacaagcucca

SEQ ID NO: 3308854 - RNA, 21 nt, Human
caggugauccacccaccucag

SEQ ID NO: 3308855 - RNA, 20 nt, Human
caggugauccacccaccuca

SEQ ID NO: 3308856 - RNA, 14 nt, Human
cagugcaugcuguc

SEQ ID NO: 3308857 - RNA, 13 nt, Human
cagugcaugcugu

SEQ ID NO: 3308858 - RNA, 15 nt, Human
cagucuggaaugcag

SEQ ID NO: 3308859 - RNA, 17 nt, Human
cagucuggaaugcagug

SEQ ID NO: 3308860 - RNA, 13 nt, Human
cagugcccacagg

SEQ ID NO: 3308861 - RNA, 15 nt, Human
cagugcccacaggau

SEQ ID NO: 3308862 - RNA, 17 nt, Human
cagugcaugcugucccu

SEQ ID NO: 3308863 - RNA, 16 nt, Human
cagugcaugcuguccc

SEQ ID NO: 3308864 - RNA, 17 nt, Human
cagugcccacaggauca

SEQ ID NO: 3308865 - RNA, 20 nt, Human
cagugggagcugccuguuca

SEQ ID NO: 3308866 - RNA, 23 nt, Human
cagugggagcugccuguucagcu

SEQ ID NO: 3308867 - RNA, 20 nt, Human
caguggugcgaucuggguuc

SEQ ID NO: 3308868 - RNA, 21 nt, Human
caguggugcgaucuggguuca

SEQ ID NO: 3308869 - RNA, 18 nt, Human
caguggugguuuucuguu

SEQ ID NO: 3308870 - RNA, 20 nt, Human
caggggaaaaucagccugcu

SEQ ID NO: 3308871 - RNA, 17 nt, Human
caggggaaaaucagccu

SEQ ID NO: 3308872 - RNA, 19 nt, Human
caggggaaaaucagccugc

SEQ ID NO: 3308873 - RNA, 21 nt, Human
cagggcucagcggggacagcu

SEQ ID NO: 3308874 - RNA, 23 nt, Human
cagggcucagcggggacagcucc

SEQ ID NO: 3308875 - RNA, 20 nt, Human
cagggcucagcggggacagc

SEQ ID NO: 3308876 - RNA, 21 nt, Human
caggcugggcuucaguggcag

SEQ ID NO: 3308877 - RNA, 22 nt, Human
caggcugggcuucaguggcagc

SEQ ID NO: 3308878 - RNA, 19 nt, Human
caggcugggcuucaguggc

SEQ ID NO: 3308879 - RNA, 20 nt, Human
caggcugggcuucaguggca

SEQ ID NO: 3308880 - RNA, 14 nt, Human
caggcugggagagc

SEQ ID NO: 3308881 - RNA, 12 nt, Human
caggcugggaga

SEQ ID NO: 3308882 - RNA, 21 nt, Human
caggccagcugcuugggcuuc

SEQ ID NO: 3308883 - RNA, 19 nt, Human
caggccagcugcuugggcu

SEQ ID NO: 3308884 - RNA, 17 nt, Human
caggccagcugcuuggg

SEQ ID NO: 3308885 - RNA, 18 nt, Human
caggccaggcccucugcc

SEQ ID NO: 3308886 - RNA, 17 nt, Human
caggccaggcccucugc

SEQ ID NO: 3308887 - RNA, 19 nt, Human
caggccaggcccucugccc

SEQ ID NO: 3308888 - RNA, 18 nt, Human
caggcagauacaggaaaa

SEQ ID NO: 3308889 - RNA, 13 nt, Human
caggccagaggga

SEQ ID NO: 3308890 - RNA, 15 nt, Human
caggccagagggagu

SEQ ID NO: 3308891 - RNA, 16 nt, Human
cacaagacccuugugg

SEQ ID NO: 3308892 - RNA, 14 nt, Human
cacaagacccuugu

SEQ ID NO: 3308893 - RNA, 14 nt, Human
cacaagccuucggc

SEQ ID NO: 3308894 - RNA, 22 nt, Human
caaugcuggcuguuggcugggg

SEQ ID NO: 3308895 - RNA, 23 nt, Human
caaugcuggcuguuggcuggggg

SEQ ID NO: 3308896 - RNA, 22 nt, Human
caaugcugugcccuaaagugua

SEQ ID NO: 3308897 - RNA, 22 nt, Human
cacagcuaacauggaaguacua

SEQ ID NO: 3308898 - RNA, 20 nt, Human
cacagcucuguccugggagu

SEQ ID NO: 3308899 - RNA, 23 nt, Human
cacagcucuguccugggagugag

SEQ ID NO: 3308900 - RNA, 19 nt, Human
cacagcucuguccugggag

SEQ ID NO: 3308901 - RNA, 18 nt, Human
cacagacccugcccugug

SEQ ID NO: 3308902 - RNA, 16 nt, Human
cacagcuaacauggaa

SEQ ID NO: 3308903 - RNA, 15 nt, Human
cacagcuaacaugga

SEQ ID NO: 3308904 - RNA, 19 nt, Human
cacagacccugcccugugg

SEQ ID NO: 3308905 - RNA, 21 nt, Human
cacagacccugcccugugggc

SEQ ID NO: 3308906 - RNA, 20 nt, Human
cacagacccugcccuguggg

SEQ ID NO: 3308907 - RNA, 16 nt, Human
cacaguauuacuucug

SEQ ID NO: 3308908 - RNA, 18 nt, Human
cacaguauuacuucugcu

SEQ ID NO: 3308909 - RNA, 16 nt, Human
cacaucuugcucugcu

SEQ ID NO: 3308910 - RNA, 17 nt, Human
cacaucuugcucugcug

SEQ ID NO: 3308911 - RNA, 22 nt, Human
cacaucagcacgauuucuguuu

SEQ ID NO: 3308912 - RNA, 21 nt, Human
cacaucagcacgauuucuguu

SEQ ID NO: 3308913 - RNA, 20 nt, Human
cacaucagcacgauuucugu

SEQ ID NO: 3308914 - RNA, 19 nt, Human
cacaucagcacgauuucug

SEQ ID NO: 3308915 - RNA, 18 nt, Human
cacaucuugcucugcuga

SEQ ID NO: 3308916 - RNA, 21 nt, Human
cacauuuuauuuuauuaugca

SEQ ID NO: 3308917 - RNA, 15 nt, Human
cacauuuuauuuuau

SEQ ID NO: 3308918 - RNA, 17 nt, Human
caccaacauacucccau

SEQ ID NO: 3308919 - RNA, 21 nt, Human
caccaacauacucccaucugu

SEQ ID NO: 3308920 - RNA, 20 nt, Human
caccaacauacucccaucug

SEQ ID NO: 3308921 - RNA, 21 nt, Human
cacauuuuuuaaaugcaccug

SEQ ID NO: 3308922 - RNA, 17 nt, Human
cacauuuuuuaaaugca

SEQ ID NO: 3308923 - RNA, 14 nt, Human
cacauuuuucuuag

SEQ ID NO: 3308924 - RNA, 13 nt, Human
cacauuuuucuua

SEQ ID NO: 3308925 - RNA, 24 nt, Human
cacccaggagccccgaggccuucu

SEQ ID NO: 3308926 - RNA, 19 nt, Human
cacccagcccacuucugcc

SEQ ID NO: 3308927 - RNA, 20 nt, Human
cacccaggagccccgaggcc

SEQ ID NO: 3308928 - RNA, 23 nt, Human
cacccaggagccccgaggccuuc

SEQ ID NO: 3308929 - RNA, 21 nt, Human
caccagcccuuagcagggaaa

SEQ ID NO: 3308930 - RNA, 15 nt, Human
caccagcagccugga

SEQ ID NO: 3308931 - RNA, 12 nt, Human
caccagcagccu

SEQ ID NO: 3308932 - RNA, 14 nt, Human
caccagcagccugg

SEQ ID NO: 3308933 - RNA, 23 nt, Human
caccaacauacucccaucuguga

SEQ ID NO: 3308934 - RNA, 16 nt, Human
cacccagcccacuucu

SEQ ID NO: 3308935 - RNA, 17 nt, Human
cacccagcccacuucug

SEQ ID NO: 3308936 - RNA, 13 nt, Human
caccugccaggga

SEQ ID NO: 3308937 - RNA, 16 nt, Human
caccugccagggacag

SEQ ID NO: 3308938 - RNA, 14 nt, Human
caccugccagggac

SEQ ID NO: 3308939 - RNA, 14 nt, Human
caccuuugaagaag

SEQ ID NO: 3308940 - RNA, 15 nt, Human
caccuuuguccccac

SEQ ID NO: 3308941 - RNA, 14 nt, Human
caccuuugucccca

SEQ ID NO: 3308942 - RNA, 13 nt, Human
caccuuggcucaa

SEQ ID NO: 3308943 - RNA, 19 nt, Human
caccuugacagggcacacc

SEQ ID NO: 3308944 - RNA, 17 nt, Human
caccugccagggacaga

SEQ ID NO: 3308945 - RNA, 18 nt, Human
caccuugacagggcacac

SEQ ID NO: 3308946 - RNA, 20 nt, Human
cacggagggugacgggggug

SEQ ID NO: 3308947 - RNA, 14 nt, Human
cacggccaggccag

SEQ ID NO: 3308948 - RNA, 15 nt, Human
cacggccaggccaga

SEQ ID NO: 3308949 - RNA, 16 nt, Human
cacggccaggccagag

SEQ ID NO: 3308950 - RNA, 13 nt, Human
cacggccaggcca

SEQ ID NO: 3308951 - RNA, 23 nt, Human
cacuacggaauaguuggcuagga

SEQ ID NO: 3308952 - RNA, 18 nt, Human
cacucuuauugcccacgc

SEQ ID NO: 3308953 - RNA, 17 nt, Human
cacucuuauugcccacg

SEQ ID NO: 3308954 - RNA, 19 nt, Human
cacuguuucaaacuuuacu

SEQ ID NO: 3308955 - RNA, 17 nt, Human
cacuggugacaugucuu

SEQ ID NO: 3308956 - RNA, 14 nt, Human
cacuguugcccagg

SEQ ID NO: 3308957 - RNA, 15 nt, Human
cacuguugcccaggc

SEQ ID NO: 3308958 - RNA, 16 nt, Human
cacuguugcccaggcu

SEQ ID NO: 3308959 - RNA, 20 nt, Human
cacugggcuuggggaccaga

SEQ ID NO: 3308960 - RNA, 22 nt, Human
cacugggcuuggggaccagagc

SEQ ID NO: 3308961 - RNA, 23 nt, Human
cacugggcuuggggaccagagcu

SEQ ID NO: 3308962 - RNA, 21 nt, Human
cagaaguuucugccgcagccc

SEQ ID NO: 3308963 - RNA, 20 nt, Human
cagaaguuucugccgcagcc

SEQ ID NO: 3308964 - RNA, 22 nt, Human
cagaaguuucugccgcagcccu

SEQ ID NO: 3308965 - RNA, 23 nt, Human
cagaaguuugagaucagccuggg

SEQ ID NO: 3308966 - RNA, 19 nt, Human
cagaaguuucugccgcagc

SEQ ID NO: 3308967 - RNA, 17 nt, Human
cagaaauguguuaucac

SEQ ID NO: 3308968 - RNA, 14 nt, Human
caacccccagccug

SEQ ID NO: 3308969 - RNA, 15 nt, Human
caacccccagccugc

SEQ ID NO: 3308970 - RNA, 16 nt, Human
caacccccagccugcu

SEQ ID NO: 3308971 - RNA, 17 nt, Human
caacccccagccugcua

SEQ ID NO: 3308972 - RNA, 15 nt, Human
caacucaccccagcc

SEQ ID NO: 3308973 - RNA, 13 nt, Human
caacucaccccag

SEQ ID NO: 3308974 - RNA, 16 nt, Human
caacucaccccagccc

SEQ ID NO: 3308975 - RNA, 22 nt, Human
caagacccuuguggucccaccc

SEQ ID NO: 3308976 - RNA, 19 nt, Human
caagacccuugugguccca

SEQ ID NO: 3308977 - RNA, 18 nt, Human
caagacccuugugguccc

SEQ ID NO: 3308978 - RNA, 18 nt, Human
caaccacugcgaccacaa

SEQ ID NO: 3308979 - RNA, 20 nt, Human
caacaccucugcacaagcug

SEQ ID NO: 3308980 - RNA, 22 nt, Human
caacaccucugcacaagcugca

SEQ ID NO: 3308981 - RNA, 20 nt, Human
caacaccuuguuucccucuc

SEQ ID NO: 3308982 - RNA, 17 nt, Human
caaaucagcugcuacua

SEQ ID NO: 3308983 - RNA, 13 nt, Human
caaagaugcagcc

SEQ ID NO: 3308984 - RNA, 21 nt, Human
caaaguacacuguuucaaacu

SEQ ID NO: 3308985 - RNA, 20 nt, Human
caaaguacacuguuucaaac

SEQ ID NO: 3308986 - RNA, 16 nt, Human
caaaguacacuguuuc

SEQ ID NO: 3308987 - RNA, 23 nt, Human
caacaaaccuguuucugcagcca

SEQ ID NO: 3308988 - RNA, 12 nt, Human
auuuuuuuuucc

SEQ ID NO: 3308989 - RNA, 16 nt, Human
auuuuuuuuuccuuca

SEQ ID NO: 3308990 - RNA, 13 nt, Human
auuuuuuuuuccu

SEQ ID NO: 3308991 - RNA, 13 nt, Human
auuuuuaagugcu

SEQ ID NO: 3308992 - RNA, 15 nt, Human
caaaagcugggcagg

SEQ ID NO: 3308993 - RNA, 16 nt, Human
auuuguuugaacugau

SEQ ID NO: 3308994 - RNA, 14 nt, Human
auuuguuugaacug

SEQ ID NO: 3308995 - RNA, 13 nt, Human
auuuguuugaacu

SEQ ID NO: 3308996 - RNA, 20 nt, Human
auuaaauucuugcaaaguau

SEQ ID NO: 3308997 - RNA, 18 nt, Human
auuaaauucuugcaaagu

SEQ ID NO: 3308998 - RNA, 14 nt, Human
auuaaauucuugca

SEQ ID NO: 3308999 - RNA, 20 nt, Human
auucauauuuacuucuuaua

SEQ ID NO: 3309000 - RNA, 18 nt, Human
auucauauuuacuucuua

SEQ ID NO: 3309001 - RNA, 19 nt, Human
auucauauuuacuucuuau

SEQ ID NO: 3309002 - RNA, 13 nt, Human
auucuuuccugag

SEQ ID NO: 3309003 - RNA, 22 nt, Human
auucuuuccugaggcugggcuc

SEQ ID NO: 3309004 - RNA, 17 nt, Human
auucuuuccugaggcug

SEQ ID NO: 3309005 - RNA, 16 nt, Human
auucucuccuguaccu

SEQ ID NO: 3309006 - RNA, 21 nt, Human
auuccugaugcuucuucagag

SEQ ID NO: 3309007 - RNA, 21 nt, Human
auucucuccuguaccucuuga

SEQ ID NO: 3309008 - RNA, 19 nt, Human
auucucuccuguaccucuu

SEQ ID NO: 3309009 - RNA, 17 nt, Human
auugauaugcuuauaca

SEQ ID NO: 3309010 - RNA, 16 nt, Human
auuguaaggaaugauu

SEQ ID NO: 3309011 - RNA, 15 nt, Human
auuguaaggaaugau

SEQ ID NO: 3309012 - RNA, 19 nt, Human
auuguucuuaguuugcagu

SEQ ID NO: 3309013 - RNA, 21 nt, Human
auuuaaugaaagacuguacaa

SEQ ID NO: 3309014 - RNA, 14 nt, Human
auuuaaugaaagac

SEQ ID NO: 3309015 - RNA, 12 nt, Human
auuucuguuuag

SEQ ID NO: 3309016 - RNA, 16 nt, Human
auuucuguuuagauaa

SEQ ID NO: 3309017 - RNA, 14 nt, Human
auuucuguuuagau

SEQ ID NO: 3309018 - RNA, 16 nt, Human
gucaauuacaggaagu

SEQ ID NO: 3309019 - RNA, 22 nt, Human
gucaauuacaggaaguacugga

SEQ ID NO: 3309020 - RNA, 22 nt, Human
gucaccaaaucagcugcuacua

SEQ ID NO: 3309021 - RNA, 12 nt, Human
gucaccaagccc

SEQ ID NO: 3309022 - RNA, 15 nt, Human
gucaccaagcccagu

SEQ ID NO: 3309023 - RNA, 23 nt, Human
gucacucuggcagcucagagagg

SEQ ID NO: 3309024 - RNA, 16 nt, Human
gucacugagacagccc

SEQ ID NO: 3309025 - RNA, 15 nt, Human
gucacugagacagcc

SEQ ID NO: 3309026 - RNA, 14 nt, Human
gucacugagacagc

SEQ ID NO: 3309027 - RNA, 22 nt, Human
gucacucuggcagcucagagag

SEQ ID NO: 3309028 - RNA, 23 nt, Human
gucacugagacagcccgggcucu

SEQ ID NO: 3309029 - RNA, 21 nt, Human
gucacugagacagcccgggcu

SEQ ID NO: 3309030 - RNA, 18 nt, Human
gucacugagacagcccgg

SEQ ID NO: 3309031 - RNA, 17 nt, Human
gucacugagacagcccg

SEQ ID NO: 3309032 - RNA, 10 nt, Human
gucacugcuu

SEQ ID NO: 3309033 - RNA, 21 nt, Human
gucagaaguuucugccgcagc

SEQ ID NO: 3309034 - RNA, 21 nt, Human
gucacugcuuaacuucacaua

SEQ ID NO: 3309035 - RNA, 15 nt, Human
gucacugcuuaacuu

SEQ ID NO: 3309036 - RNA, 16 nt, Human
gucagguggggcagcu

SEQ ID NO: 3309037 - RNA, 17 nt, Human
gucagguggggcagcuu

SEQ ID NO: 3309038 - RNA, 18 nt, Human
gucagguggggcagcuug

SEQ ID NO: 3309039 - RNA, 22 nt, Human
gucagguggggcagcuugaggg

SEQ ID NO: 3309040 - RNA, 12 nt, Human
aaauuucuaaau

SEQ ID NO: 3309041 - RNA, 15 nt, Human
aaauuucuaaaucuc

SEQ ID NO: 3309042 - RNA, 13 nt, Human
aaauuucuaaauc

SEQ ID NO: 3309043 - RNA, 18 nt, Human
guauucucuccuguaccu

SEQ ID NO: 3309044 - RNA, 24 nt, Human
aaaugucuaguuguaacaccauga

SEQ ID NO: 3309045 - RNA, 21 nt, Human
aaaugucucuuuaaugucaca

SEQ ID NO: 3309046 - RNA, 15 nt, Human
gucccaccccacaca

SEQ ID NO: 3309047 - RNA, 17 nt, Human
guccccaccgcagacag

SEQ ID NO: 3309048 - RNA, 18 nt, Human
guccccaccgcagacagg

SEQ ID NO: 3309049 - RNA, 22 nt, Human
guccccaccgcagacaggacca

SEQ ID NO: 3309050 - RNA, 22 nt, Human
guccccuguuuguuucugaaag

SEQ ID NO: 3309051 - RNA, 18 nt, Human
guccccuguuuguuucug

SEQ ID NO: 3309052 - RNA, 19 nt, Human
gucccuuacgugaguccug

SEQ ID NO: 3309053 - RNA, 18 nt, Human
gucccuuacgugaguccu

SEQ ID NO: 3309054 - RNA, 18 nt, Human
gucccugguggcagcuca

SEQ ID NO: 3309055 - RNA, 19 nt, Human
gucccugguggcagcucac

SEQ ID NO: 3309056 - RNA, 19 nt, Human
aaauuucuaaaucuccaaa

SEQ ID NO: 3309057 - RNA, 19 nt, Human
aacacaaacgggcucagca

SEQ ID NO: 3309058 - RNA, 16 nt, Human
aacacuguucucugcc

SEQ ID NO: 3309059 - RNA, 18 nt, Human
aacacuguucucugcccu

SEQ ID NO: 3309060 - RNA, 17 nt, Human
aacacuguucucugccc

SEQ ID NO: 3309061 - RNA, 17 nt, Human
gucauuugagcagggcu

SEQ ID NO: 3309062 - RNA, 19 nt, Human
aacacuguucucugcccuc

SEQ ID NO: 3309063 - RNA, 21 nt, Human
aacacucacauuuauucugcu

SEQ ID NO: 3309064 - RNA, 18 nt, Human
aacaguccauugaaaggg

SEQ ID NO: 3309065 - RNA, 21 nt, Human
guccggucccugucccagugc

SEQ ID NO: 3309066 - RNA, 23 nt, Human
aacauguaauuaaguacuaugua

SEQ ID NO: 3309067 - RNA, 14 nt, Human
guccucuuuucuga

SEQ ID NO: 3309068 - RNA, 16 nt, Human
guccuggcaugggaau

SEQ ID NO: 3309069 - RNA, 17 nt, Human
guccugcugcaguugcc

SEQ ID NO: 3309070 - RNA, 19 nt, Human
guccugcugcaguugccag

SEQ ID NO: 3309071 - RNA, 12 nt, Human
gucgaggcagga

SEQ ID NO: 3309072 - RNA, 16 nt, Human
gucgaggacagggagg

SEQ ID NO: 3309073 - RNA, 15 nt, Human
gucuaugggacucaa

SEQ ID NO: 3309074 - RNA, 22 nt, Human
gucuaugggacucaaugcacug

SEQ ID NO: 3309075 - RNA, 16 nt, Human
gucuaccugaggggcc

SEQ ID NO: 3309076 - RNA, 15 nt, Human
gucuaccugaggggc

SEQ ID NO: 3309077 - RNA, 13 nt, Human
gucuaccugaggg

SEQ ID NO: 3309078 - RNA, 14 nt, Human
gucuaccugagggg

SEQ ID NO: 3309079 - RNA, 23 nt, Human
gugaauaauacaguaucucaggg

SEQ ID NO: 3309080 - RNA, 14 nt, Human
gugacaugucuuuu

SEQ ID NO: 3309081 - RNA, 23 nt, Human
gugacagaggcagccccauucug

SEQ ID NO: 3309082 - RNA, 20 nt, Human
gugacagagugagacucugu

SEQ ID NO: 3309083 - RNA, 22 nt, Human
gugacagagugagacucugucu

SEQ ID NO: 3309084 - RNA, 22 nt, Human
gugagacccugucucaaaaaaa

SEQ ID NO: 3309085 - RNA, 14 nt, Human
gugagacucugucu

SEQ ID NO: 3309086 - RNA, 16 nt, Human
gugagacucugucuca

SEQ ID NO: 3309087 - RNA, 19 nt, Human
gugacaugucuuuucuugc

SEQ ID NO: 3309088 - RNA, 16 nt, Human
aacugcauuggcuuug

SEQ ID NO: 3309089 - RNA, 22 nt, Human
aacugauuuuuuuuuccuucag

SEQ ID NO: 3309090 - RNA, 21 nt, Human
aacugauuuuuuuuuccuuca

SEQ ID NO: 3309091 - RNA, 20 nt, Human
aacugauuuuuuuuuccuuc

SEQ ID NO: 3309092 - RNA, 23 nt, Human
aacucuccucugcugcuggcugg

SEQ ID NO: 3309093 - RNA, 22 nt, Human
aacucuccucugcugcuggcug

SEQ ID NO: 3309094 - RNA, 18 nt, Human
gugaggcucugcccuugg

SEQ ID NO: 3309095 - RNA, 17 nt, Human
gugagucaccaagccca

SEQ ID NO: 3309096 - RNA, 23 nt, Human
gugaguacuacaguccucccauc

SEQ ID NO: 3309097 - RNA, 17 nt, Human
aacucuccucugcugcu

SEQ ID NO: 3309098 - RNA, 21 nt, Human
gugaguacuacaguccuccca

SEQ ID NO: 3309099 - RNA, 21 nt, Human
aacucuccucugcugcuggcu

SEQ ID NO: 3309100 - RNA, 19 nt, Human
aacucuccucugcugcugg

SEQ ID NO: 3309101 - RNA, 18 nt, Human
gugagacucugucucaaa

SEQ ID NO: 3309102 - RNA, 13 nt, Human
gugaggcucugcc

SEQ ID NO: 3309103 - RNA, 12 nt, Human
gugaggcucugc

SEQ ID NO: 3309104 - RNA, 17 nt, Human
gugaggcucugcccuug

SEQ ID NO: 3309105 - RNA, 16 nt, Human
gugaggcucugcccuu

SEQ ID NO: 3309106 - RNA, 15 nt, Human
gugaggcucugcccu

SEQ ID NO: 3309107 - RNA, 14 nt, Human
gugaggcucugccc

SEQ ID NO: 3309108 - RNA, 21 nt, Human
gucuuaaaaaguggaaaaaua

SEQ ID NO: 3309109 - RNA, 15 nt, Human
gucuggaaugcagug

SEQ ID NO: 3309110 - RNA, 16 nt, Human
gucuggaaugcagugg

SEQ ID NO: 3309111 - RNA, 14 nt, Human
gucucaaaaaaaca

SEQ ID NO: 3309112 - RNA, 17 nt, Human
gucucaaaaaaagaaaa

SEQ ID NO: 3309113 - RNA, 23 nt, Human
gucucuuuaaugucacaggcagg

SEQ ID NO: 3309114 - RNA, 20 nt, Human
gucugacaggcaaugcuggc

SEQ ID NO: 3309115 - RNA, 15 nt, Human
gucugacaggcaaug

SEQ ID NO: 3309116 - RNA, 18 nt, Human
gucugacaggcaaugcug

SEQ ID NO: 3309117 - RNA, 12 nt, Human
gucugacaggca

SEQ ID NO: 3309118 - RNA, 13 nt, Human
gucugacaggcaa

SEQ ID NO: 3309119 - RNA, 14 nt, Human
gucugacaggcaau

SEQ ID NO: 3309120 - RNA, 13 nt, Human
aacguggcugcuu

SEQ ID NO: 3309121 - RNA, 12 nt, Human
aacguggcugcu

SEQ ID NO: 3309122 - RNA, 17 nt, Human
aacuagggaagauaaua

SEQ ID NO: 3309123 - RNA, 13 nt, Human
aacgucugugcca

SEQ ID NO: 3309124 - RNA, 13 nt, Human
aacuucacauauu

SEQ ID NO: 3309125 - RNA, 14 nt, Human
aacuucacauauug

SEQ ID NO: 3309126 - RNA, 22 nt, Human
aacuucaccauauuaccacaga

SEQ ID NO: 3309127 - RNA, 22 nt, Human
aacuucacauauugauuuccgu

SEQ ID NO: 3309128 - RNA, 23 nt, Human
gugauccucccaccucagccucc

SEQ ID NO: 3309129 - RNA, 21 nt, Human
gugcacaugcacgugugugca

SEQ ID NO: 3309130 - RNA, 21 nt, Human
gugcacaagcuccaagcuccc

SEQ ID NO: 3309131 - RNA, 16 nt, Human
gugcacaagcuccaag

SEQ ID NO: 3309132 - RNA, 13 nt, Human
gugcacaagcucc

SEQ ID NO: 3309133 - RNA, 18 nt, Human
gugcaaugaccuuucaau

SEQ ID NO: 3309134 - RNA, 23 nt, Human
gugccaaaaacaacaacaaaaug

SEQ ID NO: 3309135 - RNA, 21 nt, Human
gugcauuuggugguuucagaa

SEQ ID NO: 3309136 - RNA, 19 nt, Human
gugcauuugaggucuguuc

SEQ ID NO: 3309137 - RNA, 17 nt, Human
gugcauuugaggucugu

SEQ ID NO: 3309138 - RNA, 16 nt, Human
aagaaaauaccaagga

SEQ ID NO: 3309139 - RNA, 15 nt, Human
aagaaaauaguggug

SEQ ID NO: 3309140 - RNA, 22 nt, Human
aagaaaauaguggugugauuug

SEQ ID NO: 3309141 - RNA, 21 nt, Human
aagaaaauaguggugugauuu

SEQ ID NO: 3309142 - RNA, 18 nt, Human
aagaaaaaugagccuggc

SEQ ID NO: 3309143 - RNA, 17 nt, Human
aagaaaaaugagccugg

SEQ ID NO: 3309144 - RNA, 19 nt, Human
aagaaaaaauauuuucccu

SEQ ID NO: 3309145 - RNA, 13 nt, Human
aagaaaaagaaaa

SEQ ID NO: 3309146 - RNA, 23 nt, Human
aacuuuaccuuuuuuauacauaa

SEQ ID NO: 3309147 - RNA, 22 nt, Human
aacuuuaccuuuuuuauacaua

SEQ ID NO: 3309148 - RNA, 21 nt, Human
aacuuuaccuuuuuuauacau

SEQ ID NO: 3309149 - RNA, 18 nt, Human
gugcuaucucccccagcc

SEQ ID NO: 3309150 - RNA, 15 nt, Human
gugcuaucuccccca

SEQ ID NO: 3309151 - RNA, 15 nt, Human
gugcugcccugccca

SEQ ID NO: 3309152 - RNA, 14 nt, Human
gugcugcccugccc

SEQ ID NO: 3309153 - RNA, 13 nt, Human
gugcugcccugcc

SEQ ID NO: 3309154 - RNA, 12 nt, Human
gugcugcccugc

SEQ ID NO: 3309155 - RNA, 13 nt, Human
gugcucuggacag

SEQ ID NO: 3309156 - RNA, 16 nt, Human
gugcucugaucaucca

SEQ ID NO: 3309157 - RNA, 17 nt, Human
guuucaaacuuuacuau

SEQ ID NO: 3309158 - RNA, 16 nt, Human
aaggaaacccagcucu

SEQ ID NO: 3309159 - RNA, 20 nt, Human
guuguuugauucagacagcu

SEQ ID NO: 3309160 - RNA, 23 nt, Human
guuguuugauucagacagcugcc

SEQ ID NO: 3309161 - RNA, 22 nt, Human
aaggaaacccagcucuggucca

SEQ ID NO: 3309162 - RNA, 17 nt, Human
aaggaaacccagcucug

SEQ ID NO: 3309163 - RNA, 21 nt, Human
guuuaagugacugauggcuaa

SEQ ID NO: 3309164 - RNA, 13 nt, Human
aaggggagaguaa

SEQ ID NO: 3309165 - RNA, 23 nt, Human
aagggggcugggacaugggaaag

SEQ ID NO: 3309166 - RNA, 12 nt, Human
aagggggcuggg

SEQ ID NO: 3309167 - RNA, 20 nt, Human
aaggcugucaauuacaggaa

SEQ ID NO: 3309168 - RNA, 22 nt, Human
aaggcugggggaagaagcucuc

SEQ ID NO: 3309169 - RNA, 19 nt, Human
aaggcugggggaagaagcu

SEQ ID NO: 3309170 - RNA, 14 nt, Human
aaggcugggggaag

SEQ ID NO: 3309171 - RNA, 16 nt, Human
aaggcugggggaagaa

SEQ ID NO: 3309172 - RNA, 13 nt, Human
guuucagaaaugu

SEQ ID NO: 3309173 - RNA, 11 nt, Human
guuucagaaau

SEQ ID NO: 3309174 - RNA, 23 nt, Human
aaguauucuuauuuaaugaaaga

SEQ ID NO: 3309175 - RNA, 21 nt, Human
aaguauucuuauuuaaugaaa

SEQ ID NO: 3309176 - RNA, 19 nt, Human
aaguauucuuauuuaauga

SEQ ID NO: 3309177 - RNA, 19 nt, Human
aaguauuauaccuuuuuua

SEQ ID NO: 3309178 - RNA, 16 nt, Human
aaguauuauaccuuuu

SEQ ID NO: 3309179 - RNA, 19 nt, Human
aaguacuucuccacccugc

SEQ ID NO: 3309180 - RNA, 18 nt, Human
aaguacuucuccacccug

SEQ ID NO: 3309181 - RNA, 15 nt, Human
aaguauuauaccuuu

SEQ ID NO: 3309182 - RNA, 14 nt, Human
aaguacuauaauuu

SEQ ID NO: 3309183 - RNA, 17 nt, Human
aaguacuauaauuuacc

SEQ ID NO: 3309184 - RNA, 13 nt, Human
aaguacuauguau

SEQ ID NO: 3309185 - RNA, 12 nt, Human
guuuucuguucu

SEQ ID NO: 3309186 - RNA, 14 nt, Human
guuuucuguucuuu

SEQ ID NO: 3309187 - RNA, 16 nt, Human
guuuucuguucuuucu

SEQ ID NO: 3309188 - RNA, 15 nt, Human
guuuucuguucuuuc

SEQ ID NO: 3309189 - RNA, 22 nt, Human
guuuuaaggaugcuuguacaua

SEQ ID NO: 3309190 - RNA, 18 nt, Human
guuuuaaggaugcuugua

SEQ ID NO: 3309191 - RNA, 17 nt, Human
aaguaauaugcacacau

SEQ ID NO: 3309192 - RNA, 20 nt, Human
aaguaauaugcacacauuuu

SEQ ID NO: 3309193 - RNA, 18 nt, Human
aaguaauaugcacacauu

SEQ ID NO: 3309194 - RNA, 23 nt, Human
uaaaaaucucaaauuucuaaauc

SEQ ID NO: 3309195 - RNA, 15 nt, Human
uaaaaaugagguacu

SEQ ID NO: 3309196 - RNA, 13 nt, Human
uaaaacccaagug

SEQ ID NO: 3309197 - RNA, 15 nt, Human
uaaaacuuuuuaaaa

SEQ ID NO: 3309198 - RNA, 12 nt, Human
uaaaacuuuuua

SEQ ID NO: 3309199 - RNA, 19 nt, Human
uaaaaggugaccaaugaug

SEQ ID NO: 3309200 - RNA, 13 nt, Human
uaaaagucuugug

SEQ ID NO: 3309201 - RNA, 23 nt, Human
aagugauccucccaccucagccu

SEQ ID NO: 3309202 - RNA, 20 nt, Human
aagugauucuccugccucag

SEQ ID NO: 3309203 - RNA, 13 nt, Human
aagugauccuccc

SEQ ID NO: 3309204 - RNA, 19 nt, Human
aagugauccucccaccuca

SEQ ID NO: 3309205 - RNA, 20 nt, Human
aagugauccucccaccucag

SEQ ID NO: 3309206 - RNA, 13 nt, Human
aagugugguagag

SEQ ID NO: 3309207 - RNA, 23 nt, Human
aaguguauuuuuuuacuaauaga

SEQ ID NO: 3309208 - RNA, 20 nt, Human
aaguuugagaucagccuggg

SEQ ID NO: 3309209 - RNA, 21 nt, Human
aaguuucugccgcagcccugc

SEQ ID NO: 3309210 - RNA, 19 nt, Human
aaguuucugccgcagcccu

SEQ ID NO: 3309211 - RNA, 23 nt, Human
aagaucaaaagguuaauaaagua

SEQ ID NO: 3309212 - RNA, 20 nt, Human
aagaucaaaagguuaauaaa

SEQ ID NO: 3309213 - RNA, 19 nt, Human
gugucagguggggcagcuu

SEQ ID NO: 3309214 - RNA, 23 nt, Human
gugugaaccaccacacccagccc

SEQ ID NO: 3309215 - RNA, 22 nt, Human
gugucaccugaagacucauucu

SEQ ID NO: 3309216 - RNA, 14 nt, Human
gugucagguggggc

SEQ ID NO: 3309217 - RNA, 18 nt, Human
gugucagguggggcagcu

SEQ ID NO: 3309218 - RNA, 14 nt, Human
gugucaccugaaga

SEQ ID NO: 3309219 - RNA, 23 nt, Human
gugcugcccugcccaccuggccu

SEQ ID NO: 3309220 - RNA, 21 nt, Human
gugcugcccugcccaccuggc

SEQ ID NO: 3309221 - RNA, 15 nt, Human
gugguuucagaaaug

SEQ ID NO: 3309222 - RNA, 22 nt, Human
aagauauuuugcuuugugauuu

SEQ ID NO: 3309223 - RNA, 22 nt, Human
aagagggucugaggaauccaga

SEQ ID NO: 3309224 - RNA, 21 nt, Human
aagagggagggagggcuccag

SEQ ID NO: 3309225 - RNA, 14 nt, Human
aagaggcagggucu

SEQ ID NO: 3309226 - RNA, 11 nt, Human
aagaggcaggg

SEQ ID NO: 3309227 - RNA, 12 nt, Human
aagcaugugaga

SEQ ID NO: 3309228 - RNA, 17 nt, Human
aagccaaagcuaggccu

SEQ ID NO: 3309229 - RNA, 18 nt, Human
aagccaaagcuaggccug

SEQ ID NO: 3309230 - RNA, 17 nt, Human
aagcaccuccugccucg

SEQ ID NO: 3309231 - RNA, 21 nt, Human
aagcacaugccucucucaggc

SEQ ID NO: 3309232 - RNA, 13 nt, Human
aagcaccuccugc

SEQ ID NO: 3309233 - RNA, 14 nt, Human
aagcaccuccugcc

SEQ ID NO: 3309234 - RNA, 15 nt, Human
aagcaccuccugccu

SEQ ID NO: 3309235 - RNA, 16 nt, Human
aagcaccuccugccuc

SEQ ID NO: 3309236 - RNA, 16 nt, Human
aagcacacuugacauc

SEQ ID NO: 3309237 - RNA, 20 nt, Human
aagcacaugccucucucagg

SEQ ID NO: 3309238 - RNA, 19 nt, Human
aagcacaugccucucucag

SEQ ID NO: 3309239 - RNA, 16 nt, Human
aagcacaugccucucu

SEQ ID NO: 3309240 - RNA, 15 nt, Human
aagcacaugccucuc

SEQ ID NO: 3309241 - RNA, 14 nt, Human
aagcacaugccucu

SEQ ID NO: 3309242 - RNA, 19 nt, Human
guuagagguucccuuugac

SEQ ID NO: 3309243 - RNA, 21 nt, Human
aagccgugauuuucauugcug

SEQ ID NO: 3309244 - RNA, 17 nt, Human
guucagguaacaggcag

SEQ ID NO: 3309245 - RNA, 18 nt, Human
guucagguaacaggcaga

SEQ ID NO: 3309246 - RNA, 20 nt, Human
guucaggguuggccccugcc

SEQ ID NO: 3309247 - RNA, 21 nt, Human
guucaggguuggccccugccc

SEQ ID NO: 3309248 - RNA, 22 nt, Human
guucaggguuggccccugcccg

SEQ ID NO: 3309249 - RNA, 18 nt, Human
guucagcuccagcucacc

SEQ ID NO: 3309250 - RNA, 23 nt, Human
guucagcuuguaaauagcucagg

SEQ ID NO: 3309251 - RNA, 22 nt, Human
aagcuaggccuggccagaugca

SEQ ID NO: 3309252 - RNA, 16 nt, Human
aagccucccacgacug

SEQ ID NO: 3309253 - RNA, 15 nt, Human
aagccuccuccagcc

SEQ ID NO: 3309254 - RNA, 22 nt, Human
guucccuuuuuuggcugcugaa

SEQ ID NO: 3309255 - RNA, 21 nt, Human
guucccuuuuuuggcugcuga

SEQ ID NO: 3309256 - RNA, 22 nt, Human
guucccuuugacgccaucccag

SEQ ID NO: 3309257 - RNA, 17 nt, Human
aagcucugcuccucucc

SEQ ID NO: 3309258 - RNA, 19 nt, Human
guugauagcacagacccug

SEQ ID NO: 3309259 - RNA, 14 nt, Human
guugauagcacaga

SEQ ID NO: 3309260 - RNA, 15 nt, Human
guucuugguuuguaa

SEQ ID NO: 3309261 - RNA, 14 nt, Human
guucuugguuugua

SEQ ID NO: 3309262 - RNA, 17 nt, Human
guucuuaauucuuagcu

SEQ ID NO: 3309263 - RNA, 14 nt, Human
guucuuaauucuua

SEQ ID NO: 3309264 - RNA, 18 nt, Human
guucucugcccuccaaga

SEQ ID NO: 3309265 - RNA, 17 nt, Human
guucucugcccuccaag

SEQ ID NO: 3309266 - RNA, 13 nt, Human
guucuuaauucuu

SEQ ID NO: 3309267 - RNA, 12 nt, Human
guucucugagga

SEQ ID NO: 3309268 - RNA, 15 nt, Human
guucucucuucucca

SEQ ID NO: 3309269 - RNA, 15 nt, Human
guucucugcccucca

SEQ ID NO: 3309270 - RNA, 13 nt, Human
guucucugcccuc

SEQ ID NO: 3309271 - RNA, 13 nt, Human
guucucuccuucu

SEQ ID NO: 3309272 - RNA, 19 nt, Human
guucuagcauggcugccaa

SEQ ID NO: 3309273 - RNA, 15 nt, Human
uaugcuuauacacuu

SEQ ID NO: 3309274 - RNA, 17 nt, Human
uauggcuuuugugcauu

SEQ ID NO: 3309275 - RNA, 16 nt, Human
uauggcuuuugugcau

SEQ ID NO: 3309276 - RNA, 21 nt, Human
uauggcuuuugugcauuaucu

SEQ ID NO: 3309277 - RNA, 18 nt, Human
uauggcuuuugugcauua

SEQ ID NO: 3309278 - RNA, 11 nt, Human
uaugcauuuga

SEQ ID NO: 3309279 - RNA, 24 nt, Human
uaugcauuugaaaauuuugauguu

SEQ ID NO: 3309280 - RNA, 23 nt, Human
uaugcauuugaaaauuuugaugu

SEQ ID NO: 3309281 - RNA, 17 nt, Human
uaugccugggcagaagg

SEQ ID NO: 3309282 - RNA, 17 nt, Human
acagcaaggagauuuac

SEQ ID NO: 3309283 - RNA, 14 nt, Human
acagagcccacgcc

SEQ ID NO: 3309284 - RNA, 15 nt, Human
acagagcccacgccc

SEQ ID NO: 3309285 - RNA, 19 nt, Human
acagagcccacgcccccac

SEQ ID NO: 3309286 - RNA, 18 nt, Human
acagagcccacgccccca

SEQ ID NO: 3309287 - RNA, 16 nt, Human
acagcccgggcucugc

SEQ ID NO: 3309288 - RNA, 17 nt, Human
acagcccgggcucugcc

SEQ ID NO: 3309289 - RNA, 21 nt, Human
acagcaaggagauuuacaacu

SEQ ID NO: 3309290 - RNA, 16 nt, Human
acagcaaggagauuua

SEQ ID NO: 3309291 - RNA, 19 nt, Human
acagcccgggcucugccuc

SEQ ID NO: 3309292 - RNA, 18 nt, Human
acagcccgggcucugccu

SEQ ID NO: 3309293 - RNA, 15 nt, Human
acagacccugcccug

SEQ ID NO: 3309294 - RNA, 14 nt, Human
acagacccugcccu

SEQ ID NO: 3309295 - RNA, 13 nt, Human
acagacccugccc

SEQ ID NO: 3309296 - RNA, 17 nt, Human
acagaaauguacagcaa

SEQ ID NO: 3309297 - RNA, 16 nt, Human
acagaaauguacagca

SEQ ID NO: 3309298 - RNA, 14 nt, Human
acagaaauguacag

SEQ ID NO: 3309299 - RNA, 17 nt, Human
acagaaaauucuucucc

SEQ ID NO: 3309300 - RNA, 13 nt, Human
acagaaauguaca

SEQ ID NO: 3309301 - RNA, 20 nt, Human
acagaaaauggaagacagcu

SEQ ID NO: 3309302 - RNA, 11 nt, Human
acagagaaagu

SEQ ID NO: 3309303 - RNA, 18 nt, Human
acagagaaaguacuucuc

SEQ ID NO: 3309304 - RNA, 15 nt, Human
uaucucagggccugg

SEQ ID NO: 3309305 - RNA, 13 nt, Human
uaucucccccagc

SEQ ID NO: 3309306 - RNA, 14 nt, Human
uaucucccccagcc

SEQ ID NO: 3309307 - RNA, 23 nt, Human
acaggcugggcuucaguggcagc

SEQ ID NO: 3309308 - RNA, 21 nt, Human
acaggcugggcuucaguggca

SEQ ID NO: 3309309 - RNA, 22 nt, Human
acaggcugggcuucaguggcag

SEQ ID NO: 3309310 - RNA, 12 nt, Human
acagggcacacc

SEQ ID NO: 3309311 - RNA, 13 nt, Human
uauuacuucugcu

SEQ ID NO: 3309312 - RNA, 14 nt, Human
uauuacuucugcua

SEQ ID NO: 3309313 - RNA, 20 nt, Human
uauucaguaauaacucuacc

SEQ ID NO: 3309314 - RNA, 14 nt, Human
uauucaggaagcuc

SEQ ID NO: 3309315 - RNA, 13 nt, Human
acaggaaguacug

SEQ ID NO: 3309316 - RNA, 17 nt, Human
acaggaaaagcugcuga

SEQ ID NO: 3309317 - RNA, 15 nt, Human
acaggaaaagcugcu

SEQ ID NO: 3309318 - RNA, 16 nt, Human
acaggaaaagcugcug

SEQ ID NO: 3309319 - RNA, 13 nt, Human
acagcuaacaugg

SEQ ID NO: 3309320 - RNA, 14 nt, Human
acaggcauguucuc

SEQ ID NO: 3309321 - RNA, 14 nt, Human
acaggcagguccag

SEQ ID NO: 3309322 - RNA, 16 nt, Human
acaggcagguccaggg

SEQ ID NO: 3309323 - RNA, 16 nt, Human
acaggagugagcacua

SEQ ID NO: 3309324 - RNA, 14 nt, Human
acaggaucagucug

SEQ ID NO: 3309325 - RNA, 13 nt, Human
acaggcaggucca

SEQ ID NO: 3309326 - RNA, 23 nt, Human
acaggaccagggauuuccaugau

SEQ ID NO: 3309327 - RNA, 20 nt, Human
uauguggaguucaucuugaa

SEQ ID NO: 3309328 - RNA, 15 nt, Human
acaggcauguucucu

SEQ ID NO: 3309329 - RNA, 18 nt, Human
acaggcauguucucugag

SEQ ID NO: 3309330 - RNA, 19 nt, Human
acaggcauguucucugagg

SEQ ID NO: 3309331 - RNA, 20 nt, Human
acaggcauguucucugagga

SEQ ID NO: 3309332 - RNA, 22 nt, Human
acaggcauguucucugaggaca

SEQ ID NO: 3309333 - RNA, 15 nt, Human
uagccagaggagaga

SEQ ID NO: 3309334 - RNA, 11 nt, Human
uagccagagga

SEQ ID NO: 3309335 - RNA, 19 nt, Human
acaagacccuugugguccc

SEQ ID NO: 3309336 - RNA, 19 nt, Human
acaagaccacguuucuaaa

SEQ ID NO: 3309337 - RNA, 21 nt, Human
acaacacucauugaccugagg

SEQ ID NO: 3309338 - RNA, 23 nt, Human
acaacacucauugaccugaggcc

SEQ ID NO: 3309339 - RNA, 19 nt, Human
uagcauggcugccaauggg

SEQ ID NO: 3309340 - RNA, 16 nt, Human
uagcauuuugcuaaau

SEQ ID NO: 3309341 - RNA, 14 nt, Human
uagccaaggccaaa

SEQ ID NO: 3309342 - RNA, 22 nt, Human
uagcauuuugcuaaaugugaau

SEQ ID NO: 3309343 - RNA, 21 nt, Human
uagccaaggccaaaggaagca

SEQ ID NO: 3309344 - RNA, 15 nt, Human
uagauauaugcucug

SEQ ID NO: 3309345 - RNA, 19 nt, Human
uagauauaugcucugcaug

SEQ ID NO: 3309346 - RNA, 22 nt, Human
acaaaggaugcccaaagaugca

SEQ ID NO: 3309347 - RNA, 22 nt, Human
acaaaagcaugugagacugguu

SEQ ID NO: 3309348 - RNA, 11 nt, Human
acaaaagcaug

SEQ ID NO: 3309349 - RNA, 14 nt, Human
uaggcauuguggga

SEQ ID NO: 3309350 - RNA, 20 nt, Human
uaggcauuugcugaauacag

SEQ ID NO: 3309351 - RNA, 16 nt, Human
uaggcauuugcugaau

SEQ ID NO: 3309352 - RNA, 21 nt, Human
uagggaaggauacaaaagcau

SEQ ID NO: 3309353 - RNA, 12 nt, Human
acaaugacuuac

SEQ ID NO: 3309354 - RNA, 18 nt, Human
acaaugacuuacuguaca

SEQ ID NO: 3309355 - RNA, 17 nt, Human
acaaugacuuacuguac

SEQ ID NO: 3309356 - RNA, 18 nt, Human
acaagaccacguuucuaa

SEQ ID NO: 3309357 - RNA, 21 nt, Human
acacaugagcaucaggccagg

SEQ ID NO: 3309358 - RNA, 20 nt, Human
acacauuuuauuuuauuaug

SEQ ID NO: 3309359 - RNA, 19 nt, Human
acacauuuuauuuuauuau

SEQ ID NO: 3309360 - RNA, 14 nt, Human
acacauuuuauuuu

SEQ ID NO: 3309361 - RNA, 13 nt, Human
acacauuuuauuu

SEQ ID NO: 3309362 - RNA, 20 nt, Human
uaguuccaccaucaagccac

SEQ ID NO: 3309363 - RNA, 18 nt, Human
uaguucagguaacaggca

SEQ ID NO: 3309364 - RNA, 21 nt, Human
acaccucugcacaagcugcac

SEQ ID NO: 3309365 - RNA, 19 nt, Human
acaccucugcacaagcugc

SEQ ID NO: 3309366 - RNA, 16 nt, Human
acaccgggcacucaga

SEQ ID NO: 3309367 - RNA, 19 nt, Human
acacccugugauggggccc

SEQ ID NO: 3309368 - RNA, 20 nt, Human
acacuaaccacgcuggaccu

SEQ ID NO: 3309369 - RNA, 20 nt, Human
acacucacauuuauucugcu

SEQ ID NO: 3309370 - RNA, 15 nt, Human
acacucaaaagcugg

SEQ ID NO: 3309371 - RNA, 21 nt, Human
acaaugcugugcccuaaagug

SEQ ID NO: 3309372 - RNA, 24 nt, Human
acaaugcugugcccuaaaguguau

SEQ ID NO: 3309373 - RNA, 23 nt, Human
acaaugcugugcccuaaagugua

SEQ ID NO: 3309374 - RNA, 22 nt, Human
acaaugcugugcccuaaagugu

SEQ ID NO: 3309375 - RNA, 17 nt, Human
acaaugugaaaagaaaa

SEQ ID NO: 3309376 - RNA, 19 nt, Human
acaaugugaaaagaaaaau

SEQ ID NO: 3309377 - RNA, 14 nt, Human
acacacacauacac

SEQ ID NO: 3309378 - RNA, 21 nt, Human
acacacugcauguuugugauu

SEQ ID NO: 3309379 - RNA, 14 nt, Human
acacaccagagccc

SEQ ID NO: 3309380 - RNA, 15 nt, Human
acacaccagagccca

SEQ ID NO: 3309381 - RNA, 20 nt, Human
acacaccagagcccaccuug

SEQ ID NO: 3309382 - RNA, 21 nt, Human
acacacgcgugcacacaccag

SEQ ID NO: 3309383 - RNA, 17 nt, Human
acacacagcucuguccu

SEQ ID NO: 3309384 - RNA, 13 nt, Human
acacacagcucug

SEQ ID NO: 3309385 - RNA, 14 nt, Human
acacacagcucugu

SEQ ID NO: 3309386 - RNA, 13 nt, Human
acacagugagucg

SEQ ID NO: 3309387 - RNA, 19 nt, Human
acacaguauuacuucugcu

SEQ ID NO: 3309388 - RNA, 18 nt, Human
acacaguauuacuucugc

SEQ ID NO: 3309389 - RNA, 16 nt, Human
acacaguauuacuucu

SEQ ID NO: 3309390 - RNA, 12 nt, Human
aauuccccagau

SEQ ID NO: 3309391 - RNA, 14 nt, Human
aauuccccacccug

SEQ ID NO: 3309392 - RNA, 16 nt, Human
uaccugccaggaagcc

SEQ ID NO: 3309393 - RNA, 23 nt, Human
uaccugccaggaagccagcaggc

SEQ ID NO: 3309394 - RNA, 20 nt, Human
uaccugccaggaagccagca

SEQ ID NO: 3309395 - RNA, 18 nt, Human
uaccugccaggaagccag

SEQ ID NO: 3309396 - RNA, 10 nt, Human
uaccuguccc

SEQ ID NO: 3309397 - RNA, 17 nt, Human
uaccugucccccugaca

SEQ ID NO: 3309398 - RNA, 16 nt, Human
uaccugucccccugac

SEQ ID NO: 3309399 - RNA, 14 nt, Human
uaccugucccccug

SEQ ID NO: 3309400 - RNA, 13 nt, Human
uaccugucccccu

SEQ ID NO: 3309401 - RNA, 11 nt, Human
aauuacaggaa

SEQ ID NO: 3309402 - RNA, 15 nt, Human
aauuagccaagugug

SEQ ID NO: 3309403 - RNA, 18 nt, Human
uacuguacaugaaaacac

SEQ ID NO: 3309404 - RNA, 22 nt, Human
uacuguacaugaaaacacauuu

SEQ ID NO: 3309405 - RNA, 21 nt, Human
uacuguacaugaaaacacauu

SEQ ID NO: 3309406 - RNA, 18 nt, Human
uacuguaauuugugauac

SEQ ID NO: 3309407 - RNA, 20 nt, Human
uacuguaauuugugauacaa

SEQ ID NO: 3309408 - RNA, 19 nt, Human
uacuguaauuugugauaca

SEQ ID NO: 3309409 - RNA, 12 nt, Human
uacucuguguca

SEQ ID NO: 3309410 - RNA, 16 nt, Human
uacuggagaaaaugga

SEQ ID NO: 3309411 - RNA, 13 nt, Human
uacuacuccugua

SEQ ID NO: 3309412 - RNA, 17 nt, Human
uacuacuccuguaggaa

SEQ ID NO: 3309413 - RNA, 23 nt, Human
uacuauggcccuggccuagcaua

SEQ ID NO: 3309414 - RNA, 12 nt, Human
uacuauguauca

SEQ ID NO: 3309415 - RNA, 13 nt, Human
uacuauguaucaa

SEQ ID NO: 3309416 - RNA, 22 nt, Human
uacucuccuggaaauauuaaga

SEQ ID NO: 3309417 - RNA, 23 nt, Human
uacucuccuggaaauauuaagaa

SEQ ID NO: 3309418 - RNA, 18 nt, Human
uacgggaggguaaggcug

SEQ ID NO: 3309419 - RNA, 12 nt, Human
uacguacacauu

SEQ ID NO: 3309420 - RNA, 16 nt, Human
uacguugugcauuugg

SEQ ID NO: 3309421 - RNA, 15 nt, Human
uacguugugcauuug

SEQ ID NO: 3309422 - RNA, 13 nt, Human
uacguacacauuu

SEQ ID NO: 3309423 - RNA, 14 nt, Human
uacguugugcauuu

SEQ ID NO: 3309424 - RNA, 22 nt, Human
uacgccaggggaaaaucagccu

SEQ ID NO: 3309425 - RNA, 12 nt, Human
aaugcccagccc

SEQ ID NO: 3309426 - RNA, 11 nt, Human
aaugcccagcc

SEQ ID NO: 3309427 - RNA, 21 nt, Human
aauggacguguuaugacucca

SEQ ID NO: 3309428 - RNA, 20 nt, Human
aauggacuaacuugucuuug

SEQ ID NO: 3309429 - RNA, 23 nt, Human
aauggacguguuaugacuccaga

SEQ ID NO: 3309430 - RNA, 21 nt, Human
aauggaaaugggcagagcaga

SEQ ID NO: 3309431 - RNA, 20 nt, Human
aauggaaaugggcagagcag

SEQ ID NO: 3309432 - RNA, 16 nt, Human
uacaaugcugugcccu

SEQ ID NO: 3309433 - RNA, 21 nt, Human
aaugcacuuuguucuggcucu

SEQ ID NO: 3309434 - RNA, 17 nt, Human
aaugaccuuucaauagg

SEQ ID NO: 3309435 - RNA, 16 nt, Human
aaugaccuuucaauag

SEQ ID NO: 3309436 - RNA, 18 nt, Human
aaugaccuuucaauagga

SEQ ID NO: 3309437 - RNA, 21 nt, Human
uacaaugcugugcccuaaagu

SEQ ID NO: 3309438 - RNA, 20 nt, Human
aaugcacuuuguucuggcuc

SEQ ID NO: 3309439 - RNA, 22 nt, Human
aaugcacuuuguucuggcucuu

SEQ ID NO: 3309440 - RNA, 15 nt, Human
uacacuaaaagguga

SEQ ID NO: 3309441 - RNA, 19 nt, Human
uacacauuuuauuuuauua

SEQ ID NO: 3309442 - RNA, 22 nt, Human
uacacauuuuauuuuauuaugc

SEQ ID NO: 3309443 - RNA, 21 nt, Human
uacacauuuuauuuuauuaug

SEQ ID NO: 3309444 - RNA, 18 nt, Human
uacagaggccaugggccu

SEQ ID NO: 3309445 - RNA, 19 nt, Human
uacagacaaagcguggugg

SEQ ID NO: 3309446 - RNA, 22 nt, Human
uacagacaacaaaccuguuucu

SEQ ID NO: 3309447 - RNA, 12 nt, Human
aauggcagccuu

SEQ ID NO: 3309448 - RNA, 16 nt, Human
aauggcagccuuggca

SEQ ID NO: 3309449 - RNA, 21 nt, Human
aauguucucucuucuccaccu

SEQ ID NO: 3309450 - RNA, 12 nt, Human
uacauucuguua

SEQ ID NO: 3309451 - RNA, 13 nt, Human
uacauucuguuaa

SEQ ID NO: 3309452 - RNA, 16 nt, Human
uacaggugugagucac

SEQ ID NO: 3309453 - RNA, 23 nt, Human
uacauaaugcgugcauaccacuu

SEQ ID NO: 3309454 - RNA, 21 nt, Human
uacauaaugcgugcauaccac

SEQ ID NO: 3309455 - RNA, 24 nt, Human
uacauaaugcgugcauaccacuuu

SEQ ID NO: 3309456 - RNA, 19 nt, Human
aaugugaaaagaaaaauga

SEQ ID NO: 3309457 - RNA, 14 nt, Human
aaugugaaacugga

SEQ ID NO: 3309458 - RNA, 15 nt, Human
aaugugaaacuggau

SEQ ID NO: 3309459 - RNA, 19 nt, Human
aauguauguguaaguauuc

SEQ ID NO: 3309460 - RNA, 17 nt, Human
aaugugaaaagaaaaau

SEQ ID NO: 3309461 - RNA, 20 nt, Human
aauguauguguaaguauucu

SEQ ID NO: 3309462 - RNA, 13 nt, Human
aaugaaugucagu

SEQ ID NO: 3309463 - RNA, 15 nt, Human
aaugaccuuucaaua

SEQ ID NO: 3309464 - RNA, 22 nt, Human
aaugaaugucagugugacugau

SEQ ID NO: 3309465 - RNA, 17 nt, Human
aaugaaacauuuuguca

SEQ ID NO: 3309466 - RNA, 16 nt, Human
aaugaaagacuguaca

SEQ ID NO: 3309467 - RNA, 17 nt, Human
aaugaaagacuguacaa

SEQ ID NO: 3309468 - RNA, 17 nt, Human
aaugaaaccugugucuc

SEQ ID NO: 3309469 - RNA, 13 nt, Human
uaauguacugcau

SEQ ID NO: 3309470 - RNA, 18 nt, Human
uaaugucacaggcagguc

SEQ ID NO: 3309471 - RNA, 22 nt, Human
uaauagacaauuuauuauggca

SEQ ID NO: 3309472 - RNA, 18 nt, Human
uaauagacaauuuauuau

SEQ ID NO: 3309473 - RNA, 14 nt, Human
uaauacaccacuac

SEQ ID NO: 3309474 - RNA, 16 nt, Human
uaauacaccacuacau

SEQ ID NO: 3309475 - RNA, 16 nt, Human
uaauagacaauuuauu

SEQ ID NO: 3309476 - RNA, 14 nt, Human
uaauagacaauuua

SEQ ID NO: 3309477 - RNA, 19 nt, Human
uaauacaccacuacauucu

SEQ ID NO: 3309478 - RNA, 18 nt, Human
uaauacaccacuacauuc

SEQ ID NO: 3309479 - RNA, 17 nt, Human
uaaugaaugaaacauuu

SEQ ID NO: 3309480 - RNA, 15 nt, Human
aaucauuagguguga

SEQ ID NO: 3309481 - RNA, 23 nt, Human
aaucauuaggugugacugaauuu

SEQ ID NO: 3309482 - RNA, 17 nt, Human
aaucauuaggugugacu

SEQ ID NO: 3309483 - RNA, 19 nt, Human
uaaguauucuuauuuaaug

SEQ ID NO: 3309484 - RNA, 20 nt, Human
uaaguauucuuauuuaauga

SEQ ID NO: 3309485 - RNA, 17 nt, Human
uaaguacuauguaucaa

SEQ ID NO: 3309486 - RNA, 13 nt, Human
uaaguacuaugua

SEQ ID NO: 3309487 - RNA, 16 nt, Human
uaaguacuauguauca

SEQ ID NO: 3309488 - RNA, 18 nt, Human
uaagcacacuugacauca

SEQ ID NO: 3309489 - RNA, 22 nt, Human
uaagcuguuacugucuucagua

SEQ ID NO: 3309490 - RNA, 15 nt, Human
aauaugcacacauuu

SEQ ID NO: 3309491 - RNA, 22 nt, Human
aauaugcacacauuuuuuaaau

SEQ ID NO: 3309492 - RNA, 17 nt, Human
aauaugcacacauuuuu

SEQ ID NO: 3309493 - RNA, 16 nt, Human
aauaugcacacauuuu

SEQ ID NO: 3309494 - RNA, 15 nt, Human
uaagagaaaugagcu

SEQ ID NO: 3309495 - RNA, 16 nt, Human
uaacuuucugaaauaa

SEQ ID NO: 3309496 - RNA, 13 nt, Human
uaacuucacauau

SEQ ID NO: 3309497 - RNA, 21 nt, Human
uaacuucacauauugauuucc

SEQ ID NO: 3309498 - RNA, 17 nt, Human
uaacuuccaauuuacau

SEQ ID NO: 3309499 - RNA, 14 nt, Human
uaacuucaccauau

SEQ ID NO: 3309500 - RNA, 16 nt, Human
aauaguggugugauuu

SEQ ID NO: 3309501 - RNA, 22 nt, Human
aauaguggugugauuuggggau

SEQ ID NO: 3309502 - RNA, 21 nt, Human
aauaguucagguaacaggcag

SEQ ID NO: 3309503 - RNA, 13 nt, Human
aauaguuggcuag

SEQ ID NO: 3309504 - RNA, 16 nt, Human
uaacauggaaguacua

SEQ ID NO: 3309505 - RNA, 18 nt, Human
uaacauggacaugaucuu

SEQ ID NO: 3309506 - RNA, 23 nt, Human
uaacauggacaugaucuucuuua

SEQ ID NO: 3309507 - RNA, 16 nt, Human
uccagugaggcucugc

SEQ ID NO: 3309508 - RNA, 15 nt, Human
uccagugaggcucug

SEQ ID NO: 3309509 - RNA, 23 nt, Human
uccagugaggcucugcccuuggu

SEQ ID NO: 3309510 - RNA, 22 nt, Human
uccagugaggcucugcccuugg

SEQ ID NO: 3309511 - RNA, 18 nt, Human
uccaguaucuugaagacu

SEQ ID NO: 3309512 - RNA, 16 nt, Human
uccaguaucuugaaga

SEQ ID NO: 3309513 - RNA, 15 nt, Human
uccaguaucuugaag

SEQ ID NO: 3309514 - RNA, 14 nt, Human
uccaguaucuugaa

SEQ ID NO: 3309515 - RNA, 18 nt, Human
acggcuuuuacuuaaacc

SEQ ID NO: 3309516 - RNA, 16 nt, Human
acggcucacugcagcc

SEQ ID NO: 3309517 - RNA, 15 nt, Human
acggcucacugcagc

SEQ ID NO: 3309518 - RNA, 17 nt, Human
acggcucacugcagccu

SEQ ID NO: 3309519 - RNA, 18 nt, Human
acggcucacugcagccuc

SEQ ID NO: 3309520 - RNA, 12 nt, Human
acggccaggcca

SEQ ID NO: 3309521 - RNA, 13 nt, Human
acgcuggaccuug

SEQ ID NO: 3309522 - RNA, 23 nt, Human
acggagucccaccuuggcugcag

SEQ ID NO: 3309523 - RNA, 21 nt, Human
acggagucccaccuuggcugc

SEQ ID NO: 3309524 - RNA, 17 nt, Human
acgcuggagugcaguga

SEQ ID NO: 3309525 - RNA, 20 nt, Human
acgcuggaccuugaacuggg

SEQ ID NO: 3309526 - RNA, 23 nt, Human
acgcuggaccuugaacuggguac

SEQ ID NO: 3309527 - RNA, 15 nt, Human
acgcuggagugcagu

SEQ ID NO: 3309528 - RNA, 16 nt, Human
acgcuggagugcagug

SEQ ID NO: 3309529 - RNA, 18 nt, Human
acgcuacccgggaagggg

SEQ ID NO: 3309530 - RNA, 21 nt, Human
acgcuacccgggaagggggcu

SEQ ID NO: 3309531 - RNA, 14 nt, Human
acgaauauugcuga

SEQ ID NO: 3309532 - RNA, 21 nt, Human
acgaauauugcugauggugca

SEQ ID NO: 3309533 - RNA, 13 nt, Human
accuuuuuuauac

SEQ ID NO: 3309534 - RNA, 20 nt, Human
accuugaacuggguacuugu

SEQ ID NO: 3309535 - RNA, 18 nt, Human
accuuuguccccaccgca

SEQ ID NO: 3309536 - RNA, 17 nt, Human
accuuuguccccaccgc

SEQ ID NO: 3309537 - RNA, 18 nt, Human
acgaauauugcugauggu

SEQ ID NO: 3309538 - RNA, 15 nt, Human
acgaauauugcugau

SEQ ID NO: 3309539 - RNA, 23 nt, Human
uccaggcugggagagccuuccag

SEQ ID NO: 3309540 - RNA, 22 nt, Human
accuuuuuuauacauaaacaag

SEQ ID NO: 3309541 - RNA, 10 nt, Human
uccaggcucc

SEQ ID NO: 3309542 - RNA, 12 nt, Human
uccaggcuccuu

SEQ ID NO: 3309543 - RNA, 21 nt, Human
uccaggcugggagagccuucc

SEQ ID NO: 3309544 - RNA, 20 nt, Human
uccaggcugggagagccuuc

SEQ ID NO: 3309545 - RNA, 22 nt, Human
uccaggagcagccacauuccug

SEQ ID NO: 3309546 - RNA, 13 nt, Human
uccagacacaugu

SEQ ID NO: 3309547 - RNA, 15 nt, Human
uccagaauuucccaa

SEQ ID NO: 3309548 - RNA, 14 nt, Human
uccagaauuuccca

SEQ ID NO: 3309549 - RNA, 17 nt, Human
acgguuuuacugcagcu

SEQ ID NO: 3309550 - RNA, 21 nt, Human
acguggcugcuucaaggaucc

SEQ ID NO: 3309551 - RNA, 19 nt, Human
acguggcugcuucaaggau

SEQ ID NO: 3309552 - RNA, 18 nt, Human
acguggcugcuucaagga

SEQ ID NO: 3309553 - RNA, 17 nt, Human
acguggcugcuucaagg

SEQ ID NO: 3309554 - RNA, 13 nt, Human
acguugugcauuu

SEQ ID NO: 3309555 - RNA, 15 nt, Human
acguugugcauuugg

SEQ ID NO: 3309556 - RNA, 14 nt, Human
acguugugcauuug

SEQ ID NO: 3309557 - RNA, 16 nt, Human
acguuucuaaaggcua

SEQ ID NO: 3309558 - RNA, 15 nt, Human
acguuucuaaaggcu

SEQ ID NO: 3309559 - RNA, 22 nt, Human
acguuucuaaaggcuaccuuug

SEQ ID NO: 3309560 - RNA, 18 nt, Human
ucccagauacuugggggg

SEQ ID NO: 3309561 - RNA, 12 nt, Human
ucccagccccaa

SEQ ID NO: 3309562 - RNA, 16 nt, Human
ucccagauacuugggg

SEQ ID NO: 3309563 - RNA, 18 nt, Human
acuauagccuaggugaca

SEQ ID NO: 3309564 - RNA, 20 nt, Human
acuauagccuaggugacaga

SEQ ID NO: 3309565 - RNA, 22 nt, Human
acuauagccuaggugacagagu

SEQ ID NO: 3309566 - RNA, 16 nt, Human
acuaucuaaauguuga

SEQ ID NO: 3309567 - RNA, 21 nt, Human
acuaucuaaauguugaaagau

SEQ ID NO: 3309568 - RNA, 14 nt, Human
acuauguugcccag

SEQ ID NO: 3309569 - RNA, 22 nt, Human
acuauggcccuggccuagcaua

SEQ ID NO: 3309570 - RNA, 15 nt, Human
acuauguugcccagg

SEQ ID NO: 3309571 - RNA, 16 nt, Human
acuauguugcccaggc

SEQ ID NO: 3309572 - RNA, 16 nt, Human
acucaaugcacugaca

SEQ ID NO: 3309573 - RNA, 16 nt, Human
ucccccagccccaucc

SEQ ID NO: 3309574 - RNA, 15 nt, Human
ucccccagccccauc

SEQ ID NO: 3309575 - RNA, 13 nt, Human
ucccccagcccca

SEQ ID NO: 3309576 - RNA, 11 nt, Human
ucccccagccc

SEQ ID NO: 3309577 - RNA, 21 nt, Human
uccccaggaggccagccuuga

SEQ ID NO: 3309578 - RNA, 20 nt, Human
uccccaggaggccagccuug

SEQ ID NO: 3309579 - RNA, 17 nt, Human
uccccaggaggccagcc

SEQ ID NO: 3309580 - RNA, 12 nt, Human
uccccacccuga

SEQ ID NO: 3309581 - RNA, 18 nt, Human
uccccaggaggccagccu

SEQ ID NO: 3309582 - RNA, 16 nt, Human
uccccaccgcagacag

SEQ ID NO: 3309583 - RNA, 15 nt, Human
uccccaccgcagaca

SEQ ID NO: 3309584 - RNA, 23 nt, Human
uccccacccugaaagcccugagc

SEQ ID NO: 3309585 - RNA, 13 nt, Human
acucaccccagcc

SEQ ID NO: 3309586 - RNA, 16 nt, Human
acucaccccagcccca

SEQ ID NO: 3309587 - RNA, 15 nt, Human
acucaccccagcccc

SEQ ID NO: 3309588 - RNA, 14 nt, Human
acucaccccagccc

SEQ ID NO: 3309589 - RNA, 14 nt, Human
acuccugcaggcag

SEQ ID NO: 3309590 - RNA, 12 nt, Human
acuccugcaggc

SEQ ID NO: 3309591 - RNA, 22 nt, Human
acuccugcaggcagccaggcca

SEQ ID NO: 3309592 - RNA, 16 nt, Human
acuccugcaggcagcc

SEQ ID NO: 3309593 - RNA, 15 nt, Human
acuccugcaggcagc

SEQ ID NO: 3309594 - RNA, 11 nt, Human
acuccuggccu

SEQ ID NO: 3309595 - RNA, 17 nt, Human
ucccugguggcagcuca

SEQ ID NO: 3309596 - RNA, 16 nt, Human
ucccugguggcagcuc

SEQ ID NO: 3309597 - RNA, 21 nt, Human
ucccugguggcagcucaccuc

SEQ ID NO: 3309598 - RNA, 20 nt, Human
ucccugguggcagcucaccu

SEQ ID NO: 3309599 - RNA, 19 nt, Human
ucccugguggcagcucacc

SEQ ID NO: 3309600 - RNA, 18 nt, Human
ucccugguggcagcucac

SEQ ID NO: 3309601 - RNA, 18 nt, Human
ucccuuugacgccauccc

SEQ ID NO: 3309602 - RNA, 16 nt, Human
ucccuuugacgccauc

SEQ ID NO: 3309603 - RNA, 20 nt, Human
ucccuuggauuguccccgac

SEQ ID NO: 3309604 - RNA, 19 nt, Human
ucccuuggauuguccccga

SEQ ID NO: 3309605 - RNA, 22 nt, Human
ucccugguggcagcucaccucu

SEQ ID NO: 3309606 - RNA, 19 nt, Human
ucccuuuuuuggcugcuga

SEQ ID NO: 3309607 - RNA, 17 nt, Human
ucccuuuuuuggcugcu

SEQ ID NO: 3309608 - RNA, 19 nt, Human
ucccuuugacgccauccca

SEQ ID NO: 3309609 - RNA, 22 nt, Human
ucccuuuuuuggcugcugaagg

SEQ ID NO: 3309610 - RNA, 20 nt, Human
ucccuuuuuuggcugcugaa

SEQ ID NO: 3309611 - RNA, 23 nt, Human
ucccuuuuuuggcugcugaaggc

SEQ ID NO: 3309612 - RNA, 12 nt, Human
acuccuggccuc

SEQ ID NO: 3309613 - RNA, 13 nt, Human
uccuaggcauuug

SEQ ID NO: 3309614 - RNA, 13 nt, Human
acuccuggccuca

SEQ ID NO: 3309615 - RNA, 14 nt, Human
acuccuggccucaa

SEQ ID NO: 3309616 - RNA, 15 nt, Human
uccuacucuguguca

SEQ ID NO: 3309617 - RNA, 12 nt, Human
uccuacucugug

SEQ ID NO: 3309618 - RNA, 13 nt, Human
uccuacucugugu

SEQ ID NO: 3309619 - RNA, 14 nt, Human
uccuacucuguguc

SEQ ID NO: 3309620 - RNA, 15 nt, Human
acucuggcagcucag

SEQ ID NO: 3309621 - RNA, 13 nt, Human
acucuggcagcuc

SEQ ID NO: 3309622 - RNA, 22 nt, Human
acucugagacucgcgacaaugc

SEQ ID NO: 3309623 - RNA, 11 nt, Human
acucugagacu

SEQ ID NO: 3309624 - RNA, 23 nt, Human
acucuccuuggugucgggcauga

SEQ ID NO: 3309625 - RNA, 16 nt, Human
acucuccuuggugucg

SEQ ID NO: 3309626 - RNA, 12 nt, Human
acucuccucugc

SEQ ID NO: 3309627 - RNA, 14 nt, Human
acucuccucugcug

SEQ ID NO: 3309628 - RNA, 13 nt, Human
acucuccucugcu

SEQ ID NO: 3309629 - RNA, 21 nt, Human
acucuccucugcugcuggcug

SEQ ID NO: 3309630 - RNA, 15 nt, Human
acucuccuugguguc

SEQ ID NO: 3309631 - RNA, 18 nt, Human
acucuccuggaaauauua

SEQ ID NO: 3309632 - RNA, 17 nt, Human
acucuccuccagaguca

SEQ ID NO: 3309633 - RNA, 14 nt, Human
acucuccuccagag

SEQ ID NO: 3309634 - RNA, 24 nt, Human
acuccuugaaaacacuguucucug

SEQ ID NO: 3309635 - RNA, 23 nt, Human
acuccuugaaaacacuguucucu

SEQ ID NO: 3309636 - RNA, 14 nt, Human
acucuugaccucag

SEQ ID NO: 3309637 - RNA, 15 nt, Human
acucuugaccucagg

SEQ ID NO: 3309638 - RNA, 16 nt, Human
acucuugaccucaggu

SEQ ID NO: 3309639 - RNA, 23 nt, Human
uccucauacccacccccacccaa

SEQ ID NO: 3309640 - RNA, 22 nt, Human
uccucauaguaugguggcuggg

SEQ ID NO: 3309641 - RNA, 22 nt, Human
uccucauacccacccccaccca

SEQ ID NO: 3309642 - RNA, 23 nt, Human
acugagacagcccgggcucugcc

SEQ ID NO: 3309643 - RNA, 22 nt, Human
acugagacagcccgggcucugc

SEQ ID NO: 3309644 - RNA, 21 nt, Human
acugagacagcccgggcucug

SEQ ID NO: 3309645 - RNA, 18 nt, Human
acugagacagcccgggcu

SEQ ID NO: 3309646 - RNA, 15 nt, Human
acugagacagcccgg

SEQ ID NO: 3309647 - RNA, 22 nt, Human
uccucuuuggucuacacugugc

SEQ ID NO: 3309648 - RNA, 19 nt, Human
uccucuuuccaucuacccu

SEQ ID NO: 3309649 - RNA, 21 nt, Human
uccucuuuggucuacacugug

SEQ ID NO: 3309650 - RNA, 19 nt, Human
uccucuuuggucuacacug

SEQ ID NO: 3309651 - RNA, 11 nt, Human
uccucccuccc

SEQ ID NO: 3309652 - RNA, 14 nt, Human
uccucccucccucu

SEQ ID NO: 3309653 - RNA, 11 nt, Human
uccucuuucca

SEQ ID NO: 3309654 - RNA, 12 nt, Human
uccucuuuccau

SEQ ID NO: 3309655 - RNA, 19 nt, Human
uccugaugcuucuucagag

SEQ ID NO: 3309656 - RNA, 20 nt, Human
uccugaugcuucuucagaga

SEQ ID NO: 3309657 - RNA, 21 nt, Human
acugcacuauagccuagguga

SEQ ID NO: 3309658 - RNA, 14 nt, Human
acugcacuccagcc

SEQ ID NO: 3309659 - RNA, 17 nt, Human
acugcacuccagccugg

SEQ ID NO: 3309660 - RNA, 18 nt, Human
acugcacuccagccuggg

SEQ ID NO: 3309661 - RNA, 20 nt, Human
acugcacuccagccugggug

SEQ ID NO: 3309662 - RNA, 19 nt, Human
acugcacuccagccugggu

SEQ ID NO: 3309663 - RNA, 21 nt, Human
acugauaaagaugagugagca

SEQ ID NO: 3309664 - RNA, 13 nt, Human
acugauaaagaug

SEQ ID NO: 3309665 - RNA, 14 nt, Human
acugcaccgggcca

SEQ ID NO: 3309666 - RNA, 16 nt, Human
acugcaccgggccaca

SEQ ID NO: 3309667 - RNA, 20 nt, Human
acugcacuauagccuaggug

SEQ ID NO: 3309668 - RNA, 15 nt, Human
uccuggaaauauuaa

SEQ ID NO: 3309669 - RNA, 12 nt, Human
uccugggaguga

SEQ ID NO: 3309670 - RNA, 14 nt, Human
uccugggagugagc

SEQ ID NO: 3309671 - RNA, 17 nt, Human
uccugggagugagcugg

SEQ ID NO: 3309672 - RNA, 21 nt, Human
uccugccucgaacuggcugca

SEQ ID NO: 3309673 - RNA, 14 nt, Human
uccugcaggcagcc

SEQ ID NO: 3309674 - RNA, 13 nt, Human
uccugcaggcagc

SEQ ID NO: 3309675 - RNA, 12 nt, Human
uccugcaggcag

SEQ ID NO: 3309676 - RNA, 21 nt, Human
uccugcugcaguugccaguca

SEQ ID NO: 3309677 - RNA, 21 nt, Human
acaugcuacacacugcauguu

SEQ ID NO: 3309678 - RNA, 15 nt, Human
acaugcuacacacug

SEQ ID NO: 3309679 - RNA, 15 nt, Human
acauguaauuaagua

SEQ ID NO: 3309680 - RNA, 17 nt, Human
acauguaauuaaguacu

SEQ ID NO: 3309681 - RNA, 19 nt, Human
acauguaauuaaguacuau

SEQ ID NO: 3309682 - RNA, 21 nt, Human
acauguaauuaaguacuaugu

SEQ ID NO: 3309683 - RNA, 22 nt, Human
acauguaauuaaguacuaugua

SEQ ID NO: 3309684 - RNA, 14 nt, Human
acauuccugaugcu

SEQ ID NO: 3309685 - RNA, 15 nt, Human
acauguccaagaagc

SEQ ID NO: 3309686 - RNA, 23 nt, Human
acauguaauuaaguacuauguau

SEQ ID NO: 3309687 - RNA, 13 nt, Human
ucaaauuucuaaa

SEQ ID NO: 3309688 - RNA, 20 nt, Human
ucaacugcaucaagauguga

SEQ ID NO: 3309689 - RNA, 14 nt, Human
ucaaccagcagaug

SEQ ID NO: 3309690 - RNA, 22 nt, Human
ucaaguccucuuuucugagagg

SEQ ID NO: 3309691 - RNA, 20 nt, Human
acauuuuauuuuauuaugca

SEQ ID NO: 3309692 - RNA, 19 nt, Human
acauuuuauuuuauuaugc

SEQ ID NO: 3309693 - RNA, 14 nt, Human
acauuuuauuuuau

SEQ ID NO: 3309694 - RNA, 18 nt, Human
acauuuuauuuuauuaug

SEQ ID NO: 3309695 - RNA, 17 nt, Human
acauuuuuuaaaugcac

SEQ ID NO: 3309696 - RNA, 16 nt, Human
acauuuuuuaaaugca

SEQ ID NO: 3309697 - RNA, 14 nt, Human
acauuuuuuaaaug

SEQ ID NO: 3309698 - RNA, 19 nt, Human
acauuuuuaagugcugcau

SEQ ID NO: 3309699 - RNA, 23 nt, Human
acauuuuuaagugcugcauuuaa

SEQ ID NO: 3309700 - RNA, 22 nt, Human
acauuuuuaagugcugcauuua

SEQ ID NO: 3309701 - RNA, 21 nt, Human
acauuuuuaagugcugcauuu

SEQ ID NO: 3309702 - RNA, 10 nt, Human
ucacuugagu

SEQ ID NO: 3309703 - RNA, 17 nt, Human
accaguguuguggauuu

SEQ ID NO: 3309704 - RNA, 15 nt, Human
accaguguuguggau

SEQ ID NO: 3309705 - RNA, 23 nt, Human
ucacuguugcccaggcuggcgug

SEQ ID NO: 3309706 - RNA, 19 nt, Human
ucacuguugcccaggcugg

SEQ ID NO: 3309707 - RNA, 15 nt, Human
ucacugcagccucaa

SEQ ID NO: 3309708 - RNA, 13 nt, Human
ucacugcagccuc

SEQ ID NO: 3309709 - RNA, 16 nt, Human
ucacugagacagcccg

SEQ ID NO: 3309710 - RNA, 14 nt, Human
ucacugcagccuca

SEQ ID NO: 3309711 - RNA, 22 nt, Human
ucacugagacagcccgggcucu

SEQ ID NO: 3309712 - RNA, 21 nt, Human
ucacugagacagcccgggcuc

SEQ ID NO: 3309713 - RNA, 17 nt, Human
ucacugagacagcccgg

SEQ ID NO: 3309714 - RNA, 22 nt, Human
accagcgugugacuacuccccc

SEQ ID NO: 3309715 - RNA, 15 nt, Human
accacuacauucugu

SEQ ID NO: 3309716 - RNA, 16 nt, Human
accacuacauucuguu

SEQ ID NO: 3309717 - RNA, 17 nt, Human
accacuacauucuguua

SEQ ID NO: 3309718 - RNA, 13 nt, Human
ucacagccucuga

SEQ ID NO: 3309719 - RNA, 20 nt, Human
ucacaguucucuccuucuuc

SEQ ID NO: 3309720 - RNA, 16 nt, Human
ucacaguucucuccuu

SEQ ID NO: 3309721 - RNA, 20 nt, Human
ucacagaugggugcuuggag

SEQ ID NO: 3309722 - RNA, 17 nt, Human
ucacaaaggaugcccaa

SEQ ID NO: 3309723 - RNA, 17 nt, Human
accacaucuugcucugc

SEQ ID NO: 3309724 - RNA, 18 nt, Human
accacaucuugcucugcu

SEQ ID NO: 3309725 - RNA, 19 nt, Human
accacaucuugcucugcug

SEQ ID NO: 3309726 - RNA, 15 nt, Human
accaccacacccagc

SEQ ID NO: 3309727 - RNA, 20 nt, Human
accaccacacccagcccacu

SEQ ID NO: 3309728 - RNA, 18 nt, Human
accacaugugcacaugca

SEQ ID NO: 3309729 - RNA, 16 nt, Human
accacaucuugcucug

SEQ ID NO: 3309730 - RNA, 23 nt, Human
ucauccacugugccaugugccag

SEQ ID NO: 3309731 - RNA, 16 nt, Human
accgcagacaggacca

SEQ ID NO: 3309732 - RNA, 12 nt, Human
accgcagacagg

SEQ ID NO: 3309733 - RNA, 20 nt, Human
accucccacaaaggagagcu

SEQ ID NO: 3309734 - RNA, 14 nt, Human
ucauaaccuagccu

SEQ ID NO: 3309735 - RNA, 15 nt, Human
ucauaguaugguggc

SEQ ID NO: 3309736 - RNA, 18 nt, Human
ucauaguaugguggcugg

SEQ ID NO: 3309737 - RNA, 19 nt, Human
ucauaguaugguggcuggg

SEQ ID NO: 3309738 - RNA, 18 nt, Human
ucauauaagauucauauu

SEQ ID NO: 3309739 - RNA, 21 nt, Human
ucauaguaugguggcuggguu

SEQ ID NO: 3309740 - RNA, 22 nt, Human
ucauauuuacuucuuauacauu

SEQ ID NO: 3309741 - RNA, 15 nt, Human
ucauauuuacuucuu

SEQ ID NO: 3309742 - RNA, 23 nt, Human
ucauauuuacuucuuauacauuu

SEQ ID NO: 3309743 - RNA, 12 nt, Human
ucagugccacua

SEQ ID NO: 3309744 - RNA, 16 nt, Human
ucagugccaaaaacaa

SEQ ID NO: 3309745 - RNA, 19 nt, Human
accgaaaacguggcugcuu

SEQ ID NO: 3309746 - RNA, 17 nt, Human
accgaaaacguggcugc

SEQ ID NO: 3309747 - RNA, 10 nt, Human
ucagugccuu

SEQ ID NO: 3309748 - RNA, 9 nt, Human
ucagugccu

SEQ ID NO: 3309749 - RNA, 15 nt, Human
ucagugccuuaugga

SEQ ID NO: 3309750 - RNA, 14 nt, Human
ucagugccuuaugg

SEQ ID NO: 3309751 - RNA, 12 nt, Human
ucagugccuuau

SEQ ID NO: 3309752 - RNA, 11 nt, Human
ucagugccuua

SEQ ID NO: 3309753 - RNA, 16 nt, Human
ucaguggcagcugcuu

SEQ ID NO: 3309754 - RNA, 12 nt, Human
ucaguggcagcu

SEQ ID NO: 3309755 - RNA, 11 nt, Human
ucaguggcagc

SEQ ID NO: 3309756 - RNA, 16 nt, Human
ucagugccuuauggaa

SEQ ID NO: 3309757 - RNA, 13 nt, Human
acccgggaagggg

SEQ ID NO: 3309758 - RNA, 12 nt, Human
acccgggaaggg

SEQ ID NO: 3309759 - RNA, 22 nt, Human
acccggccccugcugguucagg

SEQ ID NO: 3309760 - RNA, 17 nt, Human
acccggccccugcuggu

SEQ ID NO: 3309761 - RNA, 20 nt, Human
acccggccccugcugguuca

SEQ ID NO: 3309762 - RNA, 23 nt, Human
ucagguaacaggcagauacagga

SEQ ID NO: 3309763 - RNA, 21 nt, Human
ucagguaacaggcagauacag

SEQ ID NO: 3309764 - RNA, 22 nt, Human
ucagguaacaggcagauacagg

SEQ ID NO: 3309765 - RNA, 14 nt, Human
acccggccccugcu

SEQ ID NO: 3309766 - RNA, 15 nt, Human
acccggccccugcug

SEQ ID NO: 3309767 - RNA, 16 nt, Human
acccggccccugcugg

SEQ ID NO: 3309768 - RNA, 20 nt, Human
ucaggccaggcccucugccc

SEQ ID NO: 3309769 - RNA, 22 nt, Human
ucaggccaggcccucugcccac

SEQ ID NO: 3309770 - RNA, 21 nt, Human
ucaggccaggcccucugccca

SEQ ID NO: 3309771 - RNA, 20 nt, Human
ucagcuuguaaauagcucag

SEQ ID NO: 3309772 - RNA, 14 nt, Human
ucagcuccagcuca

SEQ ID NO: 3309773 - RNA, 21 nt, Human
ucagcuuguaaauagcucagg

SEQ ID NO: 3309774 - RNA, 22 nt, Human
ucagcuuguaaauagcucaggu

SEQ ID NO: 3309775 - RNA, 23 nt, Human
ucaggccaggcccucugcccacu

SEQ ID NO: 3309776 - RNA, 16 nt, Human
ucaggguuggccccug

SEQ ID NO: 3309777 - RNA, 19 nt, Human
ucagggucccugguggcag

SEQ ID NO: 3309778 - RNA, 18 nt, Human
ucagggucccugguggca

SEQ ID NO: 3309779 - RNA, 22 nt, Human
acccugcccugugggcccccaa

SEQ ID NO: 3309780 - RNA, 17 nt, Human
acccugcccugugggcc

SEQ ID NO: 3309781 - RNA, 14 nt, Human
acccugcccugugg

SEQ ID NO: 3309782 - RNA, 15 nt, Human
acccugcccuguggg

SEQ ID NO: 3309783 - RNA, 16 nt, Human
acccugaggcccagag

SEQ ID NO: 3309784 - RNA, 15 nt, Human
acccugaggcccaga

SEQ ID NO: 3309785 - RNA, 15 nt, Human
accgaaaacguggcu

SEQ ID NO: 3309786 - RNA, 17 nt, Human
acccuugccgucuaccu

SEQ ID NO: 3309787 - RNA, 23 nt, Human
acccuuguggucccaccccacac

SEQ ID NO: 3309788 - RNA, 20 nt, Human
acccuuguggucccacccca

SEQ ID NO: 3309789 - RNA, 18 nt, Human
acccugaaagcccugagc

SEQ ID NO: 3309790 - RNA, 16 nt, Human
acccugaaagcccuga

SEQ ID NO: 3309791 - RNA, 14 nt, Human
acccugaggcccag

SEQ ID NO: 3309792 - RNA, 13 nt, Human
acccugaggccca

SEQ ID NO: 3309793 - RNA, 15 nt, Human
ucagcaaaagaugcu

SEQ ID NO: 3309794 - RNA, 12 nt, Human
ucagauuugaac

SEQ ID NO: 3309795 - RNA, 21 nt, Human
ucagauuugaacucuucaauc

SEQ ID NO: 3309796 - RNA, 17 nt, Human
accccacacacgccaga

SEQ ID NO: 3309797 - RNA, 22 nt, Human
accccagccccaaaacucuccu

SEQ ID NO: 3309798 - RNA, 13 nt, Human
accccagccccaa

SEQ ID NO: 3309799 - RNA, 19 nt, Human
acccaggagccccgaggcc

SEQ ID NO: 3309800 - RNA, 23 nt, Human
acccaggagccccgaggccuucu

SEQ ID NO: 3309801 - RNA, 18 nt, Human
accccaucucuacaaaaa

SEQ ID NO: 3309802 - RNA, 18 nt, Human
ucagcggggacagcuccu

SEQ ID NO: 3309803 - RNA, 19 nt, Human
ucagcggggacagcuccuu

SEQ ID NO: 3309804 - RNA, 20 nt, Human
ucagcggggacagcuccuuc

SEQ ID NO: 3309805 - RNA, 21 nt, Human
ucagcggggacagcuccuucu

SEQ ID NO: 3309806 - RNA, 23 nt, Human
ucagcggggacagcuccuucugu

SEQ ID NO: 3309807 - RNA, 12 nt, Human
ucagcuccagcu

SEQ ID NO: 3309808 - RNA, 23 nt, Human
agaaguuucugccgcagcccugc

SEQ ID NO: 3309809 - RNA, 22 nt, Human
agaaguuucugccgcagcccug

SEQ ID NO: 3309810 - RNA, 21 nt, Human
agaaguuucugccgcagcccu

SEQ ID NO: 3309811 - RNA, 22 nt, Human
ucugugaaaggaaagagggagg

SEQ ID NO: 3309812 - RNA, 12 nt, Human
ucuguuggccag

SEQ ID NO: 3309813 - RNA, 17 nt, Human
ucuguuggccaguguga

SEQ ID NO: 3309814 - RNA, 13 nt, Human
ucuguucuuucca

SEQ ID NO: 3309815 - RNA, 22 nt, Human
ucuguucuuuccaaaguacacu

SEQ ID NO: 3309816 - RNA, 12 nt, Human
agacacaggccc

SEQ ID NO: 3309817 - RNA, 13 nt, Human
agacacaggcccg

SEQ ID NO: 3309818 - RNA, 17 nt, Human
agacaccuugacagggc

SEQ ID NO: 3309819 - RNA, 18 nt, Human
agacaccuugacagggca

SEQ ID NO: 3309820 - RNA, 16 nt, Human
agacacauguccaaga

SEQ ID NO: 3309821 - RNA, 16 nt, Human
agacaggaccagggau

SEQ ID NO: 3309822 - RNA, 15 nt, Human
ucugacacacagcuc

SEQ ID NO: 3309823 - RNA, 13 nt, Human
ucugacacacagc

SEQ ID NO: 3309824 - RNA, 14 nt, Human
ucugacacacagcu

SEQ ID NO: 3309825 - RNA, 12 nt, Human
ucugacacacag

SEQ ID NO: 3309826 - RNA, 21 nt, Human
ucugaaggacauugcggacag

SEQ ID NO: 3309827 - RNA, 13 nt, Human
ucugcacuccccu

SEQ ID NO: 3309828 - RNA, 17 nt, Human
ucugcagcaauaaagca

SEQ ID NO: 3309829 - RNA, 16 nt, Human
ucugcacuccccugcu

SEQ ID NO: 3309830 - RNA, 15 nt, Human
ucugcacuccccugc

SEQ ID NO: 3309831 - RNA, 14 nt, Human
ucugcacuccccug

SEQ ID NO: 3309832 - RNA, 15 nt, Human
agaaauguacagcaa

SEQ ID NO: 3309833 - RNA, 14 nt, Human
agaaauguacagca

SEQ ID NO: 3309834 - RNA, 21 nt, Human
ucugagacucgcgacaaugca

SEQ ID NO: 3309835 - RNA, 17 nt, Human
ucugaucauccacugug

SEQ ID NO: 3309836 - RNA, 21 nt, Human
ucugaucauccacugugccau

SEQ ID NO: 3309837 - RNA, 17 nt, Human
ucugcccacucccugca

SEQ ID NO: 3309838 - RNA, 16 nt, Human
ucugcccacucccugc

SEQ ID NO: 3309839 - RNA, 22 nt, Human
agaagcccaggaaaggcuccag

SEQ ID NO: 3309840 - RNA, 21 nt, Human
agaagcccaggaaaggcucca

SEQ ID NO: 3309841 - RNA, 20 nt, Human
agaagcccaggaaaggcucc

SEQ ID NO: 3309842 - RNA, 18 nt, Human
agaagcccaggaaaggcu

SEQ ID NO: 3309843 - RNA, 16 nt, Human
agaagcccaggaaagg

SEQ ID NO: 3309844 - RNA, 12 nt, Human
agaagcccagga

SEQ ID NO: 3309845 - RNA, 18 nt, Human
agaagauuuugaaauuuu

SEQ ID NO: 3309846 - RNA, 15 nt, Human
ucugccgcagcccug

SEQ ID NO: 3309847 - RNA, 14 nt, Human
ucugccgcagcccu

SEQ ID NO: 3309848 - RNA, 19 nt, Human
ucugcccuccaagaccuuc

SEQ ID NO: 3309849 - RNA, 18 nt, Human
ucugcccuccaagaccuu

SEQ ID NO: 3309850 - RNA, 21 nt, Human
ucugcccacucccugcaaccu

SEQ ID NO: 3309851 - RNA, 18 nt, Human
ucugcccacucccugcaa

SEQ ID NO: 3309852 - RNA, 21 nt, Human
ucugccugcccaggccccugc

SEQ ID NO: 3309853 - RNA, 22 nt, Human
ucugccugcccaggccccugcc

SEQ ID NO: 3309854 - RNA, 22 nt, Human
ucugccgcagcccugcagaggg

SEQ ID NO: 3309855 - RNA, 23 nt, Human
ucugcccuugguuaggcauugug

SEQ ID NO: 3309856 - RNA, 17 nt, Human
ucugcucacauaucugu

SEQ ID NO: 3309857 - RNA, 19 nt, Human
ucugcucacauaucuguca

SEQ ID NO: 3309858 - RNA, 20 nt, Human
ucugcucacauaucugucau

SEQ ID NO: 3309859 - RNA, 13 nt, Human
ucugcuucagccu

SEQ ID NO: 3309860 - RNA, 14 nt, Human
ucugcuucagccuc

SEQ ID NO: 3309861 - RNA, 15 nt, Human
ucugcuucagccucc

SEQ ID NO: 3309862 - RNA, 22 nt, Human
ucuaguuguuugauucagacag

SEQ ID NO: 3309863 - RNA, 23 nt, Human
ucuaguuguuugauucagacagc

SEQ ID NO: 3309864 - RNA, 21 nt, Human
ucuaguuugauuaaauucuug

SEQ ID NO: 3309865 - RNA, 18 nt, Human
ucuagcauggcugccaau

SEQ ID NO: 3309866 - RNA, 23 nt, Human
ucuaugggacucaaugcacugac

SEQ ID NO: 3309867 - RNA, 17 nt, Human
ucucacuauguugccca

SEQ ID NO: 3309868 - RNA, 19 nt, Human
ucucacuauguugcccagg

SEQ ID NO: 3309869 - RNA, 16 nt, Human
ucucacuauguugccc

SEQ ID NO: 3309870 - RNA, 20 nt, Human
acuuaaauaaugugaaacug

SEQ ID NO: 3309871 - RNA, 13 nt, Human
acuuaagcacacu

SEQ ID NO: 3309872 - RNA, 19 nt, Human
acuuaaucuaaauggaacc

SEQ ID NO: 3309873 - RNA, 17 nt, Human
acuuaaucuaaauggaa

SEQ ID NO: 3309874 - RNA, 16 nt, Human
acuuacacuuuaugca

SEQ ID NO: 3309875 - RNA, 22 nt, Human
acuuaaucuaaauggaaccacu

SEQ ID NO: 3309876 - RNA, 15 nt, Human
acuuagguguggggg

SEQ ID NO: 3309877 - RNA, 22 nt, Human
acuuacuguacaugaaaacaca

SEQ ID NO: 3309878 - RNA, 17 nt, Human
acuuacacuuuaugcac

SEQ ID NO: 3309879 - RNA, 16 nt, Human
acuuacuguacaugaa

SEQ ID NO: 3309880 - RNA, 21 nt, Human
acuuacuguacaugaaaacac

SEQ ID NO: 3309881 - RNA, 18 nt, Human
uccugggagugagcuggu

SEQ ID NO: 3309882 - RNA, 21 nt, Human
ucuacagaggccaugggccuc

SEQ ID NO: 3309883 - RNA, 19 nt, Human
ucuacccagcgagcccugg

SEQ ID NO: 3309884 - RNA, 16 nt, Human
ucuacagaggccaugg

SEQ ID NO: 3309885 - RNA, 15 nt, Human
acuguucucugcccu

SEQ ID NO: 3309886 - RNA, 18 nt, Human
acuguucucugcccucca

SEQ ID NO: 3309887 - RNA, 17 nt, Human
acuguucucugcccucc

SEQ ID NO: 3309888 - RNA, 16 nt, Human
acuguucucugcccuc

SEQ ID NO: 3309889 - RNA, 21 nt, Human
ucuacccuggcacuauaaugu

SEQ ID NO: 3309890 - RNA, 20 nt, Human
ucuacccagcgagcccuggu

SEQ ID NO: 3309891 - RNA, 19 nt, Human
ucuacccuggcacuauaau

SEQ ID NO: 3309892 - RNA, 14 nt, Human
ucuacccuggcacu

SEQ ID NO: 3309893 - RNA, 21 nt, Human
acuugucuuuggacccugagg

SEQ ID NO: 3309894 - RNA, 18 nt, Human
acuugucuuuggacccug

SEQ ID NO: 3309895 - RNA, 20 nt, Human
acuugucuuuggacccugag

SEQ ID NO: 3309896 - RNA, 19 nt, Human
acuuguggacacagcucuu

SEQ ID NO: 3309897 - RNA, 22 nt, Human
acuuguggacacagcucuucuc

SEQ ID NO: 3309898 - RNA, 18 nt, Human
acuuguggacacagcucu

SEQ ID NO: 3309899 - RNA, 20 nt, Human
ucucacuauguugcccaggc

SEQ ID NO: 3309900 - RNA, 21 nt, Human
ucucacuauguugcccaggca

SEQ ID NO: 3309901 - RNA, 22 nt, Human
ucucacuauguugcccaggcag

SEQ ID NO: 3309902 - RNA, 23 nt, Human
ucucacuauguugcccaggcagg

SEQ ID NO: 3309903 - RNA, 19 nt, Human
acuugcagacucuacagag

SEQ ID NO: 3309904 - RNA, 22 nt, Human
acuugcagacucuacagaggcc

SEQ ID NO: 3309905 - RNA, 23 nt, Human
acuugcagacucuacagaggcca

SEQ ID NO: 3309906 - RNA, 14 nt, Human
ucucauuugucaca

SEQ ID NO: 3309907 - RNA, 16 nt, Human
ucucauuugucacaca

SEQ ID NO: 3309908 - RNA, 16 nt, Human
ucuccaagcaggacau

SEQ ID NO: 3309909 - RNA, 15 nt, Human
ucuccaagcaggaca

SEQ ID NO: 3309910 - RNA, 21 nt, Human
ucucaggccagcugcuugggc

SEQ ID NO: 3309911 - RNA, 18 nt, Human
ucucaggccagcugcuug

SEQ ID NO: 3309912 - RNA, 17 nt, Human
ucucaggccagcugcuu

SEQ ID NO: 3309913 - RNA, 10 nt, Human
ucucaggcca

SEQ ID NO: 3309914 - RNA, 12 nt, Human
ucucaggccaaa

SEQ ID NO: 3309915 - RNA, 13 nt, Human
ucucaggccagcu

SEQ ID NO: 3309916 - RNA, 12 nt, Human
ucucaggccagc

SEQ ID NO: 3309917 - RNA, 13 nt, Human
acuuugaccucug

SEQ ID NO: 3309918 - RNA, 12 nt, Human
acuuugaccucu

SEQ ID NO: 3309919 - RNA, 18 nt, Human
acuuuguguucaccuugu

SEQ ID NO: 3309920 - RNA, 20 nt, Human
acuuuguuaguuucuccaag

SEQ ID NO: 3309921 - RNA, 21 nt, Human
acuuuguuaguuucuccaagc

SEQ ID NO: 3309922 - RNA, 13 nt, Human
acuuuuguucuug

SEQ ID NO: 3309923 - RNA, 12 nt, Human
acuuuuguucuu

SEQ ID NO: 3309924 - RNA, 23 nt, Human
acuuuuguucuugguuuguaaau

SEQ ID NO: 3309925 - RNA, 15 nt, Human
acuuuuguucuuggu

SEQ ID NO: 3309926 - RNA, 17 nt, Human
agaaaaaauauuuuccc

SEQ ID NO: 3309927 - RNA, 15 nt, Human
ucuccuucaccuuug

SEQ ID NO: 3309928 - RNA, 14 nt, Human
ucuccuucaccuuu

SEQ ID NO: 3309929 - RNA, 16 nt, Human
ucuccuucaccuuugu

SEQ ID NO: 3309930 - RNA, 21 nt, Human
ucuccuuguguuacuaaguuu

SEQ ID NO: 3309931 - RNA, 13 nt, Human
ucuccuuguguua

SEQ ID NO: 3309932 - RNA, 15 nt, Human
ucuccuccagaguca

SEQ ID NO: 3309933 - RNA, 16 nt, Human
ucuccucugcugcugg

SEQ ID NO: 3309934 - RNA, 15 nt, Human
ucuccucugcugcug

SEQ ID NO: 3309935 - RNA, 18 nt, Human
ucuccucugcugcuggcu

SEQ ID NO: 3309936 - RNA, 17 nt, Human
ucuccucugcugcuggc

SEQ ID NO: 3309937 - RNA, 14 nt, Human
acuuucugaaauaa

SEQ ID NO: 3309938 - RNA, 20 nt, Human
acuuucugaaauaacauggc

SEQ ID NO: 3309939 - RNA, 19 nt, Human
ucuccaagcaggacaugga

SEQ ID NO: 3309940 - RNA, 18 nt, Human
ucuccaagcaggacaugg

SEQ ID NO: 3309941 - RNA, 23 nt, Human
ucuccccagcaagugagagcugg

SEQ ID NO: 3309942 - RNA, 21 nt, Human
ucucccuuggauuguccccga

SEQ ID NO: 3309943 - RNA, 17 nt, Human
ucuccgaccagacaccu

SEQ ID NO: 3309944 - RNA, 21 nt, Human
ugaaccaccacacccagccca

SEQ ID NO: 3309945 - RNA, 22 nt, Human
ugaaccaccacacccagcccac

SEQ ID NO: 3309946 - RNA, 21 nt, Human
ugaagacaaugacuuacugua

SEQ ID NO: 3309947 - RNA, 23 nt, Human
ugaagacaaugacuuacuguaca

SEQ ID NO: 3309948 - RNA, 22 nt, Human
ugaagacaaugacuuacuguac

SEQ ID NO: 3309949 - RNA, 19 nt, Human
ugaaauuuuuauuaaauua

SEQ ID NO: 3309950 - RNA, 20 nt, Human
ugaaauuuuuauuaaauuau

SEQ ID NO: 3309951 - RNA, 16 nt, Human
ugaaauaacauggccu

SEQ ID NO: 3309952 - RNA, 17 nt, Human
ugaaauaacauggccuu

SEQ ID NO: 3309953 - RNA, 13 nt, Human
ugaagucacacag

SEQ ID NO: 3309954 - RNA, 12 nt, Human
ugaauaauacag

SEQ ID NO: 3309955 - RNA, 13 nt, Human
ugaauaauacagu

SEQ ID NO: 3309956 - RNA, 15 nt, Human
ugaaguaauaugcac

SEQ ID NO: 3309957 - RNA, 22 nt, Human
ugaaguaauaugcacacauuuu

SEQ ID NO: 3309958 - RNA, 21 nt, Human
ugaaguaauaugcacacauuu

SEQ ID NO: 3309959 - RNA, 20 nt, Human
ugaaguaauaugcacacauu

SEQ ID NO: 3309960 - RNA, 16 nt, Human
ugaaguaauaugcaca

SEQ ID NO: 3309961 - RNA, 21 nt, Human
agaggcagccccauucugccu

SEQ ID NO: 3309962 - RNA, 22 nt, Human
agaggcagccccauucugccug

SEQ ID NO: 3309963 - RNA, 21 nt, Human
agaggcagggucucacucugu

SEQ ID NO: 3309964 - RNA, 23 nt, Human
agaggcagccccauucugccugc

SEQ ID NO: 3309965 - RNA, 19 nt, Human
agagguucaaagauauuuu

SEQ ID NO: 3309966 - RNA, 16 nt, Human
agagguucaaagauau

SEQ ID NO: 3309967 - RNA, 15 nt, Human
agagggagguaagga

SEQ ID NO: 3309968 - RNA, 15 nt, Human
agagggagugacaga

SEQ ID NO: 3309969 - RNA, 20 nt, Human
agagggagugacagaggcag

SEQ ID NO: 3309970 - RNA, 13 nt, Human
agagguucaaaga

SEQ ID NO: 3309971 - RNA, 22 nt, Human
agaggcugccucucccaucacu

SEQ ID NO: 3309972 - RNA, 20 nt, Human
ucuuuguacagacaacaaac

SEQ ID NO: 3309973 - RNA, 15 nt, Human
ucuuuguacagacaa

SEQ ID NO: 3309974 - RNA, 14 nt, Human
ucuuuguacagaca

SEQ ID NO: 3309975 - RNA, 15 nt, Human
agacuuuggaaagac

SEQ ID NO: 3309976 - RNA, 15 nt, Human
agacuuuggaaagag

SEQ ID NO: 3309977 - RNA, 17 nt, Human
agacuuuggaaagacuu

SEQ ID NO: 3309978 - RNA, 20 nt, Human
agacugguuccauggccucu

SEQ ID NO: 3309979 - RNA, 15 nt, Human
agagacacaagccuu

SEQ ID NO: 3309980 - RNA, 19 nt, Human
agagacacaagccuucggc

SEQ ID NO: 3309981 - RNA, 16 nt, Human
agagacacaagccuuc

SEQ ID NO: 3309982 - RNA, 19 nt, Human
agacuuuggaaagaguagg

SEQ ID NO: 3309983 - RNA, 15 nt, Human
agacuuuuccaaccc

SEQ ID NO: 3309984 - RNA, 23 nt, Human
ucuuucccucccuuccucuuucc

SEQ ID NO: 3309985 - RNA, 18 nt, Human
ucuuuaaugucacaggca

SEQ ID NO: 3309986 - RNA, 15 nt, Human
ucuuuaaugucacag

SEQ ID NO: 3309987 - RNA, 20 nt, Human
agacaggcaagcaccuccug

SEQ ID NO: 3309988 - RNA, 13 nt, Human
agacuccugcagg

SEQ ID NO: 3309989 - RNA, 22 nt, Human
ugaaagacuguacaaaguagaa

SEQ ID NO: 3309990 - RNA, 18 nt, Human
ugaaagacuguacaaagu

SEQ ID NO: 3309991 - RNA, 19 nt, Human
ugaaagacuguacaaagua

SEQ ID NO: 3309992 - RNA, 16 nt, Human
ugaaagacuguacaaa

SEQ ID NO: 3309993 - RNA, 22 nt, Human
ugaaagaaaauaccaaggaaca

SEQ ID NO: 3309994 - RNA, 23 nt, Human
agagaccaucccugaaggccccg

SEQ ID NO: 3309995 - RNA, 22 nt, Human
agagaccaucccugaaggcccc

SEQ ID NO: 3309996 - RNA, 21 nt, Human
agagaccaucccugaaggccc

SEQ ID NO: 3309997 - RNA, 19 nt, Human
agagaccaucccugaaggc

SEQ ID NO: 3309998 - RNA, 18 nt, Human
agagaccaucccugaagg

SEQ ID NO: 3309999 - RNA, 11 nt, Human
agagacuccug

SEQ ID NO: 3310000 - RNA, 23 nt, Human
agagacuccugcaggcagccagg

SEQ ID NO: 3310001 - RNA, 12 nt, Human
agagacuccugc

SEQ ID NO: 3310002 - RNA, 14 nt, Human
agagacuccugcag

SEQ ID NO: 3310003 - RNA, 13 nt, Human
agagacuccugca

SEQ ID NO: 3310004 - RNA, 18 nt, Human
ugaaacuggauuaaacuu

SEQ ID NO: 3310005 - RNA, 17 nt, Human
ugaaacuggauuaaacu

SEQ ID NO: 3310006 - RNA, 19 nt, Human
ugaaaacacauuuuucuua

SEQ ID NO: 3310007 - RNA, 17 nt, Human
ugaaaacacauuuuucu

SEQ ID NO: 3310008 - RNA, 15 nt, Human
ugaaaacacauuuuu

SEQ ID NO: 3310009 - RNA, 13 nt, Human
ugaaaacacauuu

SEQ ID NO: 3310010 - RNA, 12 nt, Human
ugaaaacacauu

SEQ ID NO: 3310011 - RNA, 14 nt, Human
ugaaaacacauuuu

SEQ ID NO: 3310012 - RNA, 17 nt, Human
agauuucacucuccuug

SEQ ID NO: 3310013 - RNA, 19 nt, Human
agauuucacucuccuuggu

SEQ ID NO: 3310014 - RNA, 13 nt, Human
agauucauauuua

SEQ ID NO: 3310015 - RNA, 16 nt, Human
agauucauauuuacuu

SEQ ID NO: 3310016 - RNA, 19 nt, Human
ugacuuacuguacaugaaa

SEQ ID NO: 3310017 - RNA, 20 nt, Human
ugacuuacuguacaugaaaa

SEQ ID NO: 3310018 - RNA, 12 nt, Human
ugaccuuucaau

SEQ ID NO: 3310019 - RNA, 21 nt, Human
ugacuguuuucucuugagagg

SEQ ID NO: 3310020 - RNA, 15 nt, Human
ugaccuuuaagagaa

SEQ ID NO: 3310021 - RNA, 22 nt, Human
ugacagagugagacucugucuc

SEQ ID NO: 3310022 - RNA, 19 nt, Human
ugacacgaauauugcugau

SEQ ID NO: 3310023 - RNA, 16 nt, Human
ugacacgaauauugcu

SEQ ID NO: 3310024 - RNA, 13 nt, Human
ugacauguuuuau

SEQ ID NO: 3310025 - RNA, 17 nt, Human
ugacaggcaaugcuggc

SEQ ID NO: 3310026 - RNA, 19 nt, Human
ugacaggcaaugcuggcug

SEQ ID NO: 3310027 - RNA, 21 nt, Human
ugacagggcacaccgggcacu

SEQ ID NO: 3310028 - RNA, 22 nt, Human
ugacagggcacaccgggcacuc

SEQ ID NO: 3310029 - RNA, 20 nt, Human
ugagacucugucucaaaaaa

SEQ ID NO: 3310030 - RNA, 22 nt, Human
ugagacagcccgggcucugccu

SEQ ID NO: 3310031 - RNA, 20 nt, Human
ugagacagcccgggcucugc

SEQ ID NO: 3310032 - RNA, 19 nt, Human
ugagacagcccgggcucug

SEQ ID NO: 3310033 - RNA, 18 nt, Human
ugagacagcccgggcucu

SEQ ID NO: 3310034 - RNA, 17 nt, Human
ugagacagcccgggcuc

SEQ ID NO: 3310035 - RNA, 20 nt, Human
ugagaagcagaggaaggaga

SEQ ID NO: 3310036 - RNA, 11 nt, Human
ugagacagagu

SEQ ID NO: 3310037 - RNA, 21 nt, Human
ugagacagaguuuucacucuu

SEQ ID NO: 3310038 - RNA, 13 nt, Human
ugagacagcccgg

SEQ ID NO: 3310039 - RNA, 23 nt, Human
ugagaggacuuuucuuuguggcu

SEQ ID NO: 3310040 - RNA, 17 nt, Human
ugagaggaaaucaccga

SEQ ID NO: 3310041 - RNA, 14 nt, Human
ugagaggaaaucac

SEQ ID NO: 3310042 - RNA, 13 nt, Human
ugagaggaaauca

SEQ ID NO: 3310043 - RNA, 12 nt, Human
ugagaggaaauc

SEQ ID NO: 3310044 - RNA, 11 nt, Human
ugagaggaaau

SEQ ID NO: 3310045 - RNA, 14 nt, Human
ugagagcugggugu

SEQ ID NO: 3310046 - RNA, 10 nt, Human
ugagaggaaa

SEQ ID NO: 3310047 - RNA, 15 nt, Human
agcaagugagagcug

SEQ ID NO: 3310048 - RNA, 16 nt, Human
agcaagugagagcugg

SEQ ID NO: 3310049 - RNA, 14 nt, Human
agcaagugagagcu

SEQ ID NO: 3310050 - RNA, 14 nt, Human
agcaaggagauuua

SEQ ID NO: 3310051 - RNA, 19 nt, Human
agcaaggagauuuacaacu

SEQ ID NO: 3310052 - RNA, 17 nt, Human
agcaaggagauuuacaa

SEQ ID NO: 3310053 - RNA, 20 nt, Human
ugagccagauuucacucucc

SEQ ID NO: 3310054 - RNA, 14 nt, Human
ugagccacugcacc

SEQ ID NO: 3310055 - RNA, 19 nt, Human
ugagccagauuucacucuc

SEQ ID NO: 3310056 - RNA, 18 nt, Human
ugagccagauuucacucu

SEQ ID NO: 3310057 - RNA, 12 nt, Human
ugagccacugca

SEQ ID NO: 3310058 - RNA, 13 nt, Human
ugagccacugcac

SEQ ID NO: 3310059 - RNA, 17 nt, Human
agcaagugagagcuggg

SEQ ID NO: 3310060 - RNA, 16 nt, Human
agcacagcuucauuuc

SEQ ID NO: 3310061 - RNA, 21 nt, Human
agcacagcuucauuuccugug

SEQ ID NO: 3310062 - RNA, 16 nt, Human
agcacaugccucucuc

SEQ ID NO: 3310063 - RNA, 18 nt, Human
agcacaugccucucucag

SEQ ID NO: 3310064 - RNA, 22 nt, Human
agcacaugccucucucaggcca

SEQ ID NO: 3310065 - RNA, 21 nt, Human
agcacaugccucucucaggcc

SEQ ID NO: 3310066 - RNA, 20 nt, Human
agcacaugccucucucaggc

SEQ ID NO: 3310067 - RNA, 19 nt, Human
agcacaugccucucucagg

SEQ ID NO: 3310068 - RNA, 23 nt, Human
agcacaugccucucucaggccaa

SEQ ID NO: 3310069 - RNA, 16 nt, Human
agcaccaucucuccuc

SEQ ID NO: 3310070 - RNA, 13 nt, Human
agcaccuccugcc

SEQ ID NO: 3310071 - RNA, 14 nt, Human
agcaccuccugccu

SEQ ID NO: 3310072 - RNA, 16 nt, Human
agcaccuccugccucg

SEQ ID NO: 3310073 - RNA, 24 nt, Human
auguggaguucaucuugaauugua

SEQ ID NO: 3310074 - RNA, 20 nt, Human
auguggaguucaucuugaau

SEQ ID NO: 3310075 - RNA, 20 nt, Human
auggggcccugccuccuuug

SEQ ID NO: 3310076 - RNA, 22 nt, Human
augugccagguuuuuggucuga

SEQ ID NO: 3310077 - RNA, 21 nt, Human
augugccagguuuuuggucug

SEQ ID NO: 3310078 - RNA, 16 nt, Human
auguugcccaggcagg

SEQ ID NO: 3310079 - RNA, 17 nt, Human
auguugcccaggcaggu

SEQ ID NO: 3310080 - RNA, 12 nt, Human
auguugcccagg

SEQ ID NO: 3310081 - RNA, 20 nt, Human
auguugcccaggcaggucuu

SEQ ID NO: 3310082 - RNA, 20 nt, Human
uuuucauuuaggugaggaag

SEQ ID NO: 3310083 - RNA, 14 nt, Human
uuuucaguguacau

SEQ ID NO: 3310084 - RNA, 11 nt, Human
uuuuauuuuau

SEQ ID NO: 3310085 - RNA, 13 nt, Human
uuuuauuaugcau

SEQ ID NO: 3310086 - RNA, 19 nt, Human
auuaaaaaucucaaauuuc

SEQ ID NO: 3310087 - RNA, 15 nt, Human
auuaaaaaucucaaa

SEQ ID NO: 3310088 - RNA, 23 nt, Human
auuaaaacacaacaucuuuuucu

SEQ ID NO: 3310089 - RNA, 20 nt, Human
auuaaaaaucucaaauuucu

SEQ ID NO: 3310090 - RNA, 14 nt, Human
auuaaguacuaugu

SEQ ID NO: 3310091 - RNA, 19 nt, Human
uuuuuguagagccaggguc

SEQ ID NO: 3310092 - RNA, 20 nt, Human
uuuuuguagagccagggucu

SEQ ID NO: 3310093 - RNA, 22 nt, Human
uuuuuauggcuuuugugcauua

SEQ ID NO: 3310094 - RNA, 21 nt, Human
uuuuuauggcuuuugugcauu

SEQ ID NO: 3310095 - RNA, 20 nt, Human
uuuuuauggcuuuugugcau

SEQ ID NO: 3310096 - RNA, 15 nt, Human
uuuuguuccacaagu

SEQ ID NO: 3310097 - RNA, 20 nt, Human
uuuugugcauuaucuagaua

SEQ ID NO: 3310098 - RNA, 17 nt, Human
uuuugugcauuaucuag

SEQ ID NO: 3310099 - RNA, 12 nt, Human
uuuuuauggcuu

SEQ ID NO: 3310100 - RNA, 20 nt, Human
uuuuuaucgucacugcuuaa

SEQ ID NO: 3310101 - RNA, 22 nt, Human
uuuuuagacagagucucacugu

SEQ ID NO: 3310102 - RNA, 11 nt, Human
uuuuuacuaau

SEQ ID NO: 3310103 - RNA, 17 nt, Human
uuuugauccaagcuggu

SEQ ID NO: 3310104 - RNA, 17 nt, Human
uuuugagugccuuacac

SEQ ID NO: 3310105 - RNA, 23 nt, Human
uuuugccauguuggccaggcugg

SEQ ID NO: 3310106 - RNA, 20 nt, Human
auucuccaccugccagggac

SEQ ID NO: 3310107 - RNA, 19 nt, Human
auucuccaccugccaggga

SEQ ID NO: 3310108 - RNA, 20 nt, Human
auucuccugccucagccucc

SEQ ID NO: 3310109 - RNA, 19 nt, Human
auucuccugccucagccuc

SEQ ID NO: 3310110 - RNA, 15 nt, Human
auucuccugccucag

SEQ ID NO: 3310111 - RNA, 17 nt, Human
auucuccugccucagcc

SEQ ID NO: 3310112 - RNA, 16 nt, Human
auucuccuuguguuac

SEQ ID NO: 3310113 - RNA, 11 nt, Human
auucuccugcc

SEQ ID NO: 3310114 - RNA, 14 nt, Human
auucuccugccuca

SEQ ID NO: 3310115 - RNA, 13 nt, Human
auucuccugccuc

SEQ ID NO: 3310116 - RNA, 21 nt, Human
auucuccaccugccagggaca

SEQ ID NO: 3310117 - RNA, 18 nt, Human
auucuccaccugccaggg

SEQ ID NO: 3310118 - RNA, 16 nt, Human
auucccaagcucugcu

SEQ ID NO: 3310119 - RNA, 14 nt, Human
auucccaagcucug

SEQ ID NO: 3310120 - RNA, 15 nt, Human
auucccaagcucugc

SEQ ID NO: 3310121 - RNA, 15 nt, Human
auucaguaauaacuc

SEQ ID NO: 3310122 - RNA, 19 nt, Human
auucaguaauaacucuacc

SEQ ID NO: 3310123 - RNA, 19 nt, Human
auucaggaagcucagggcc

SEQ ID NO: 3310124 - RNA, 17 nt, Human
auucaggaagcucaggg

SEQ ID NO: 3310125 - RNA, 19 nt, Human
auucagacagcugccuggg

SEQ ID NO: 3310126 - RNA, 14 nt, Human
auucaggaagcuca

SEQ ID NO: 3310127 - RNA, 18 nt, Human
auugacaggauuauugga

SEQ ID NO: 3310128 - RNA, 15 nt, Human
auugaaaaaccauuu

SEQ ID NO: 3310129 - RNA, 13 nt, Human
auucuucuccacu

SEQ ID NO: 3310130 - RNA, 13 nt, Human
auucuuccucccu

SEQ ID NO: 3310131 - RNA, 22 nt, Human
auucuuccucccucccucuuuc

SEQ ID NO: 3310132 - RNA, 13 nt, Human
auucuuauuuaau

SEQ ID NO: 3310133 - RNA, 14 nt, Human
auucuuauuuaaug

SEQ ID NO: 3310134 - RNA, 18 nt, Human
auucuuauuuaaugaaag

SEQ ID NO: 3310135 - RNA, 21 nt, Human
auucuguuggccagugugaca

SEQ ID NO: 3310136 - RNA, 20 nt, Human
auuguccccgacccuugccg

SEQ ID NO: 3310137 - RNA, 19 nt, Human
auuguccccgacccuugcc

SEQ ID NO: 3310138 - RNA, 17 nt, Human
auuguccccgacccuug

SEQ ID NO: 3310139 - RNA, 14 nt, Human
auugugucucuugg

SEQ ID NO: 3310140 - RNA, 14 nt, Human
auuuaaaaaaaauc

SEQ ID NO: 3310141 - RNA, 16 nt, Human
auuuccguuaaaauac

SEQ ID NO: 3310142 - RNA, 15 nt, Human
auuuccguuaaaaua

SEQ ID NO: 3310143 - RNA, 14 nt, Human
auuugaaaauuuug

SEQ ID NO: 3310144 - RNA, 17 nt, Human
auuuccagccaaagccu

SEQ ID NO: 3310145 - RNA, 13 nt, Human
auuuauucugcuc

SEQ ID NO: 3310146 - RNA, 22 nt, Human
auuuauuaaaugcccagccccu

SEQ ID NO: 3310147 - RNA, 14 nt, Human
auuuaacagaaaug

SEQ ID NO: 3310148 - RNA, 12 nt, Human
auuuaacagaaa

SEQ ID NO: 3310149 - RNA, 14 nt, Human
auuuacuucuuaua

SEQ ID NO: 3310150 - RNA, 16 nt, Human
auuuacuucuuauaca

SEQ ID NO: 3310151 - RNA, 15 nt, Human
auuuagaaauauaau

SEQ ID NO: 3310152 - RNA, 14 nt, Human
auuuauucugcuca

SEQ ID NO: 3310153 - RNA, 14 nt, Human
auuugugauacaau

SEQ ID NO: 3310154 - RNA, 21 nt, Human
auuuuacuuuaaaaggagcca

SEQ ID NO: 3310155 - RNA, 15 nt, Human
auuuuaauucaguug

SEQ ID NO: 3310156 - RNA, 15 nt, Human
aucacgccacugcac

SEQ ID NO: 3310157 - RNA, 17 nt, Human
aucacgccacugcacua

SEQ ID NO: 3310158 - RNA, 14 nt, Human
aucacgccacugca

SEQ ID NO: 3310159 - RNA, 21 nt, Human
aucaacugcaucaagauguga

SEQ ID NO: 3310160 - RNA, 20 nt, Human
uucccuuuuuuggcugcuga

SEQ ID NO: 3310161 - RNA, 22 nt, Human
uuccuggcacugcuuccaguga

SEQ ID NO: 3310162 - RNA, 20 nt, Human
uuccuggcacugcuuccagu

SEQ ID NO: 3310163 - RNA, 19 nt, Human
uuccuggcacugcuuccag

SEQ ID NO: 3310164 - RNA, 22 nt, Human
uuccucuuuuuauuuaguuccu

SEQ ID NO: 3310165 - RNA, 16 nt, Human
uuccagugaggcucug

SEQ ID NO: 3310166 - RNA, 15 nt, Human
uuccagugaggcucu

SEQ ID NO: 3310167 - RNA, 16 nt, Human
auauuaagaaagacua

SEQ ID NO: 3310168 - RNA, 15 nt, Human
auauuaagaaagacu

SEQ ID NO: 3310169 - RNA, 17 nt, Human
auauuaagaaagacuau

SEQ ID NO: 3310170 - RNA, 17 nt, Human
auauuaccacagacaua

SEQ ID NO: 3310171 - RNA, 13 nt, Human
auauuguuuucag

SEQ ID NO: 3310172 - RNA, 21 nt, Human
auauugcugauggugcaauga

SEQ ID NO: 3310173 - RNA, 22 nt, Human
auauugcugauggugcaaugac

SEQ ID NO: 3310174 - RNA, 15 nt, Human
auauugauaugcuua

SEQ ID NO: 3310175 - RNA, 21 nt, Human
auauguggaguucaucuugaa

SEQ ID NO: 3310176 - RNA, 20 nt, Human
auauguggaguucaucuuga

SEQ ID NO: 3310177 - RNA, 22 nt, Human
uuccaauuuacauacucugcuu

SEQ ID NO: 3310178 - RNA, 17 nt, Human
uuccagguuuaagcugu

SEQ ID NO: 3310179 - RNA, 18 nt, Human
uuccagguuuaagcuguu

SEQ ID NO: 3310180 - RNA, 17 nt, Human
uuccaggcugggagagc

SEQ ID NO: 3310181 - RNA, 15 nt, Human
uuccaggcugggaga

SEQ ID NO: 3310182 - RNA, 13 nt, Human
uuccaggcuggga

SEQ ID NO: 3310183 - RNA, 21 nt, Human
uuccacaagagcccaggccuc

SEQ ID NO: 3310184 - RNA, 21 nt, Human
auauauguuuuaagaggcagg

SEQ ID NO: 3310185 - RNA, 22 nt, Human
auauauguuuuaagaggcaggg

SEQ ID NO: 3310186 - RNA, 17 nt, Human
uucagguaacaggcaga

SEQ ID NO: 3310187 - RNA, 14 nt, Human
uucaguaagccgug

SEQ ID NO: 3310188 - RNA, 13 nt, Human
uucagaaaugugu

SEQ ID NO: 3310189 - RNA, 16 nt, Human
uucagaaauguguuau

SEQ ID NO: 3310190 - RNA, 14 nt, Human
uucaggguuggccc

SEQ ID NO: 3310191 - RNA, 16 nt, Human
uucaggguuggccccu

SEQ ID NO: 3310192 - RNA, 17 nt, Human
uucaggguuggccccug

SEQ ID NO: 3310193 - RNA, 19 nt, Human
uucaggguuggccccugcc

SEQ ID NO: 3310194 - RNA, 22 nt, Human
uucaggguuggccccugcccgg

SEQ ID NO: 3310195 - RNA, 15 nt, Human
uucagguaacaggca

SEQ ID NO: 3310196 - RNA, 16 nt, Human
uucagguaacaggcag

SEQ ID NO: 3310197 - RNA, 11 nt, Human
aucccagcccc

SEQ ID NO: 3310198 - RNA, 13 nt, Human
aucccaugagccu

SEQ ID NO: 3310199 - RNA, 16 nt, Human
aucccaugagccucag

SEQ ID NO: 3310200 - RNA, 17 nt, Human
aucccaugagccucagc

SEQ ID NO: 3310201 - RNA, 22 nt, Human
aucccugaaggccccgcccagg

SEQ ID NO: 3310202 - RNA, 17 nt, Human
aucccugaaggccccgc

SEQ ID NO: 3310203 - RNA, 17 nt, Human
auccagguucagcuugu

SEQ ID NO: 3310204 - RNA, 14 nt, Human
auccaguaucuuga

SEQ ID NO: 3310205 - RNA, 15 nt, Human
uucugccugcccagg

SEQ ID NO: 3310206 - RNA, 16 nt, Human
uucugccugcccaggc

SEQ ID NO: 3310207 - RNA, 21 nt, Human
uucuguuggccagugugacaa

SEQ ID NO: 3310208 - RNA, 18 nt, Human
uucuguuuagauaauaca

SEQ ID NO: 3310209 - RNA, 13 nt, Human
uucuguuuagaua

SEQ ID NO: 3310210 - RNA, 12 nt, Human
uucuuucuggcu

SEQ ID NO: 3310211 - RNA, 20 nt, Human
uucuuucuggcuaugcauuu

SEQ ID NO: 3310212 - RNA, 17 nt, Human
uucuuucuggcuaugca

SEQ ID NO: 3310213 - RNA, 22 nt, Human
uucuucuccacuuucuagccag

SEQ ID NO: 3310214 - RNA, 13 nt, Human
uucuugcaaagua

SEQ ID NO: 3310215 - RNA, 15 nt, Human
aucaggugcugccau

SEQ ID NO: 3310216 - RNA, 17 nt, Human
aucaggugcugccaucc

SEQ ID NO: 3310217 - RNA, 14 nt, Human
aucaggugcugcca

SEQ ID NO: 3310218 - RNA, 19 nt, Human
aucagucugauucccaagc

SEQ ID NO: 3310219 - RNA, 16 nt, Human
aucauuaggugugacu

SEQ ID NO: 3310220 - RNA, 21 nt, Human
aucauccacugugccaugugc

SEQ ID NO: 3310221 - RNA, 22 nt, Human
aucauuaaagccugaguuugcu

SEQ ID NO: 3310222 - RNA, 15 nt, Human
aucauaaaacuugau

SEQ ID NO: 3310223 - RNA, 23 nt, Human
aucauaguggcuuaaaacaacac

SEQ ID NO: 3310224 - RNA, 21 nt, Human
uucucuaguuugauuaaauuc

SEQ ID NO: 3310225 - RNA, 20 nt, Human
uucucuaguuugauuaaauu

SEQ ID NO: 3310226 - RNA, 19 nt, Human
uucugcagccacuauuguu

SEQ ID NO: 3310227 - RNA, 12 nt, Human
aucauugaaauc

SEQ ID NO: 3310228 - RNA, 15 nt, Human
aucuaaauguugaaa

SEQ ID NO: 3310229 - RNA, 19 nt, Human
aucuaaauggaaccacucu

SEQ ID NO: 3310230 - RNA, 14 nt, Human
aucgugacaacacu

SEQ ID NO: 3310231 - RNA, 15 nt, Human
aucgugacaacacuu

SEQ ID NO: 3310232 - RNA, 18 nt, Human
aucgucacugcuuaacuu

SEQ ID NO: 3310233 - RNA, 14 nt, Human
aucgucacugcuua

SEQ ID NO: 3310234 - RNA, 12 nt, Human
uugauaaaguaa

SEQ ID NO: 3310235 - RNA, 16 nt, Human
uugaggucuguucuuu

SEQ ID NO: 3310236 - RNA, 15 nt, Human
uugaggucuguucuu

SEQ ID NO: 3310237 - RNA, 24 nt, Human
uugaccauucuccaccugccaggg

SEQ ID NO: 3310238 - RNA, 19 nt, Human
uugacagggcacaccgggc

SEQ ID NO: 3310239 - RNA, 19 nt, Human
uugaccauucuccaccugc

SEQ ID NO: 3310240 - RNA, 18 nt, Human
uugaccauucuccaccug

SEQ ID NO: 3310241 - RNA, 17 nt, Human
uugaccauucuccaccu

SEQ ID NO: 3310242 - RNA, 21 nt, Human
auccugagccagauuucacuc

SEQ ID NO: 3310243 - RNA, 17 nt, Human
auccugagccagauuuc

SEQ ID NO: 3310244 - RNA, 15 nt, Human
auccugagccagauu

SEQ ID NO: 3310245 - RNA, 14 nt, Human
auccugagccagau

SEQ ID NO: 3310246 - RNA, 11 nt, Human
auccugagcca

SEQ ID NO: 3310247 - RNA, 13 nt, Human
auccugagccaga

SEQ ID NO: 3310248 - RNA, 12 nt, Human
auccugagccag

SEQ ID NO: 3310249 - RNA, 17 nt, Human
auccucuuugagugaag

SEQ ID NO: 3310250 - RNA, 20 nt, Human
auccucuguacagagcccac

SEQ ID NO: 3310251 - RNA, 18 nt, Human
auccucuguacagagccc

SEQ ID NO: 3310252 - RNA, 20 nt, Human
uucuuuugccguuauuaaaa

SEQ ID NO: 3310253 - RNA, 22 nt, Human
auccuggcacccggccccugcu

SEQ ID NO: 3310254 - RNA, 23 nt, Human
auccuggcacccggccccugcug

SEQ ID NO: 3310255 - RNA, 15 nt, Human
auccuggaguucugg

SEQ ID NO: 3310256 - RNA, 17 nt, Human
auccuggcacccggccc

SEQ ID NO: 3310257 - RNA, 19 nt, Human
auccuggcacccggccccu

SEQ ID NO: 3310258 - RNA, 20 nt, Human
auccuggcacccggccccug

SEQ ID NO: 3310259 - RNA, 21 nt, Human
auccuggcacccggccccugc

SEQ ID NO: 3310260 - RNA, 14 nt, Human
uuuaccuuuuuuau

SEQ ID NO: 3310261 - RNA, 20 nt, Human
uuuaccuuuuuuauacauaa

SEQ ID NO: 3310262 - RNA, 19 nt, Human
uuuaccuuuuuuauacaua

SEQ ID NO: 3310263 - RNA, 17 nt, Human
augcuacacacugcaug

SEQ ID NO: 3310264 - RNA, 22 nt, Human
uuuaccugaagucuuuguacag

SEQ ID NO: 3310265 - RNA, 18 nt, Human
augcuacacacugcaugu

SEQ ID NO: 3310266 - RNA, 21 nt, Human
uuuaccuuuuuuauacauaaa

SEQ ID NO: 3310267 - RNA, 17 nt, Human
uuuacuaauagacaauu

SEQ ID NO: 3310268 - RNA, 14 nt, Human
uuuacuaauagaca

SEQ ID NO: 3310269 - RNA, 18 nt, Human
uuuacuaauagacaauuu

SEQ ID NO: 3310270 - RNA, 19 nt, Human
uuuauuaaaugcccagccc

SEQ ID NO: 3310271 - RNA, 13 nt, Human
uuuagauaauaca

SEQ ID NO: 3310272 - RNA, 18 nt, Human
uuuagaguugauacuaca

SEQ ID NO: 3310273 - RNA, 15 nt, Human
uuuagauaauacacc

SEQ ID NO: 3310274 - RNA, 22 nt, Human
augcuggcuguuggcugggggc

SEQ ID NO: 3310275 - RNA, 19 nt, Human
augcugugcccuaaagugu

SEQ ID NO: 3310276 - RNA, 21 nt, Human
auggaaguacuauaauuuacc

SEQ ID NO: 3310277 - RNA, 17 nt, Human
auggaacacucugagac

SEQ ID NO: 3310278 - RNA, 18 nt, Human
auggaacacucugagacu

SEQ ID NO: 3310279 - RNA, 14 nt, Human
auggaauaacaugu

SEQ ID NO: 3310280 - RNA, 15 nt, Human
auggaauaacaugua

SEQ ID NO: 3310281 - RNA, 24 nt, Human
uuucacucuuauugcccacgcugg

SEQ ID NO: 3310282 - RNA, 15 nt, Human
uuucacucuccuugg

SEQ ID NO: 3310283 - RNA, 14 nt, Human
uuucacucuccuug

SEQ ID NO: 3310284 - RNA, 19 nt, Human
uuuccagguuuaagcuguu

SEQ ID NO: 3310285 - RNA, 23 nt, Human
augggcuggguucuacccaggug

SEQ ID NO: 3310286 - RNA, 13 nt, Human
auggggcccugcc

SEQ ID NO: 3310287 - RNA, 14 nt, Human
auggggcccugccu

SEQ ID NO: 3310288 - RNA, 13 nt, Human
uuucuuuguggcu

SEQ ID NO: 3310289 - RNA, 16 nt, Human
uuucugccgcagcccu

SEQ ID NO: 3310290 - RNA, 14 nt, Human
uuucugccgcagcc

SEQ ID NO: 3310291 - RNA, 21 nt, Human
uuucugcagccacuauuguua

SEQ ID NO: 3310292 - RNA, 21 nt, Human
uuucuaugacacaugcaaggu

SEQ ID NO: 3310293 - RNA, 15 nt, Human
uuucuaugacacaug

SEQ ID NO: 3310294 - RNA, 13 nt, Human
augggagcucaug

SEQ ID NO: 3310295 - RNA, 18 nt, Human
augggcaacccccagccu

SEQ ID NO: 3310296 - RNA, 19 nt, Human
augggcaacccccagccug

SEQ ID NO: 3310297 - RNA, 21 nt, Human
augggcaacccccagccugcu

SEQ ID NO: 3310298 - RNA, 15 nt, Human
augggccuccugugu

SEQ ID NO: 3310299 - RNA, 15 nt, Human
augggcagagcagag

SEQ ID NO: 3310300 - RNA, 14 nt, Human
augggcagagcaga

SEQ ID NO: 3310301 - RNA, 13 nt, Human
augggcagagcag

SEQ ID NO: 3310302 - RNA, 19 nt, Human
auggacaugaucuucuuua

SEQ ID NO: 3310303 - RNA, 21 nt, Human
auggacccaauauuuaccaga

SEQ ID NO: 3310304 - RNA, 18 nt, Human
auggccucuucagaucuc

SEQ ID NO: 3310305 - RNA, 11 nt, Human
uuuccuucagu

SEQ ID NO: 3310306 - RNA, 15 nt, Human
uuuccuucagugccu

SEQ ID NO: 3310307 - RNA, 12 nt, Human
uuuccuucagug

SEQ ID NO: 3310308 - RNA, 12 nt, Human
uuuccugugucu

SEQ ID NO: 3310309 - RNA, 23 nt, Human
uuuccuucauucaacccaccugc

SEQ ID NO: 3310310 - RNA, 21 nt, Human
uuuccuucagugccuuaugga

SEQ ID NO: 3310311 - RNA, 18 nt, Human
uuuccuucagugccuuau

SEQ ID NO: 3310312 - RNA, 22 nt, Human
uuuccuucagugccuuauggaa

SEQ ID NO: 3310313 - RNA, 21 nt, Human
uuuccuucauucaacccaccu

SEQ ID NO: 3310314 - RNA, 22 nt, Human
uuucgcaggauucuuccucccu

SEQ ID NO: 3310315 - RNA, 18 nt, Human
uuucgcaggauucuuccu

SEQ ID NO: 3310316 - RNA, 18 nt, Human
augaucacggcucacugc

SEQ ID NO: 3310317 - RNA, 19 nt, Human
augaucacggcucacugca

SEQ ID NO: 3310318 - RNA, 15 nt, Human
augaucacggcucac

SEQ ID NO: 3310319 - RNA, 23 nt, Human
augaucacggcucacugcagccu

SEQ ID NO: 3310320 - RNA, 16 nt, Human
augauccuaggcauuu

SEQ ID NO: 3310321 - RNA, 14 nt, Human
augaucuucuuuau

SEQ ID NO: 3310322 - RNA, 19 nt, Human
augcaccuggaauauauaa

SEQ ID NO: 3310323 - RNA, 22 nt, Human
augcaaaccaucauugaaaucu

SEQ ID NO: 3310324 - RNA, 21 nt, Human
augcaaaccaucauugaaauc

SEQ ID NO: 3310325 - RNA, 20 nt, Human
augcaaaccaucauugaaau

SEQ ID NO: 3310326 - RNA, 19 nt, Human
augcaaaccaucauugaaa

SEQ ID NO: 3310327 - RNA, 18 nt, Human
augcaaaccaucauugaa

SEQ ID NO: 3310328 - RNA, 16 nt, Human
augcaaaccaucauug

SEQ ID NO: 3310329 - RNA, 15 nt, Human
augaucuucuuuaua

SEQ ID NO: 3310330 - RNA, 22 nt, Human
augcaaggucauuuuuuuuaag

SEQ ID NO: 3310331 - RNA, 14 nt, Human
augcaccuggaaua

SEQ ID NO: 3310332 - RNA, 16 nt, Human
augcaccuggaauaua

SEQ ID NO: 3310333 - RNA, 16 nt, Human
augcaaggucauuuuu

SEQ ID NO: 3310334 - RNA, 14 nt, Human
augcaaggucauuu

SEQ ID NO: 3310335 - RNA, 16 nt, Human
uuguccccgacccuug

SEQ ID NO: 3310336 - RNA, 18 nt, Human
uugucacacacuuuggcu

SEQ ID NO: 3310337 - RNA, 15 nt, Human
augauaaaacacaaa

SEQ ID NO: 3310338 - RNA, 23 nt, Human
augaguccccuguuuguuucuga

SEQ ID NO: 3310339 - RNA, 22 nt, Human
augaggucagagccugcaguua

SEQ ID NO: 3310340 - RNA, 17 nt, Human
augagccucagcauccu

SEQ ID NO: 3310341 - RNA, 18 nt, Human
augagccucagcauccug

SEQ ID NO: 3310342 - RNA, 13 nt, Human
augagaggaaauc

SEQ ID NO: 3310343 - RNA, 12 nt, Human
augagaggaaau

SEQ ID NO: 3310344 - RNA, 16 nt, Human
augagaggaaaucacc

SEQ ID NO: 3310345 - RNA, 15 nt, Human
augagaggaaaucac

SEQ ID NO: 3310346 - RNA, 14 nt, Human
augagaggaaauca

SEQ ID NO: 3310347 - RNA, 15 nt, Human
augagcaucaggcca

SEQ ID NO: 3310348 - RNA, 17 nt, Human
augagcaucaggccagg

SEQ ID NO: 3310349 - RNA, 16 nt, Human
augagcaucaggccag

SEQ ID NO: 3310350 - RNA, 21 nt, Human
augagcaucaggccaggcccu

SEQ ID NO: 3310351 - RNA, 20 nt, Human
augagcaucaggccaggccc

SEQ ID NO: 3310352 - RNA, 19 nt, Human
augagcaucaggccaggcc

SEQ ID NO: 3310353 - RNA, 18 nt, Human
augagcaucaggccaggc

SEQ ID NO: 3310354 - RNA, 22 nt, Human
augagcaucaggccaggcccuc

SEQ ID NO: 3310355 - RNA, 12 nt, Human
augagccucagc

SEQ ID NO: 3310356 - RNA, 15 nt, Human
augagccucagcauc

SEQ ID NO: 3310357 - RNA, 16 nt, Human
augagccucagcaucc

SEQ ID NO: 3310358 - RNA, 19 nt, Human
uugcugaauacagaggcaa

SEQ ID NO: 3310359 - RNA, 20 nt, Human
uugcuaagugaggaugaaaa

SEQ ID NO: 3310360 - RNA, 18 nt, Human
uugcugauggugcaauga

SEQ ID NO: 3310361 - RNA, 17 nt, Human
uugcugauggugcaaug

SEQ ID NO: 3310362 - RNA, 17 nt, Human
uuggaaagaguaggaag

SEQ ID NO: 3310363 - RNA, 20 nt, Human
augaaagacuguacaaagua

SEQ ID NO: 3310364 - RNA, 19 nt, Human
augaaagacuguacaaagu

SEQ ID NO: 3310365 - RNA, 18 nt, Human
uuggaaagaguaggaaga

SEQ ID NO: 3310366 - RNA, 21 nt, Human
uuggcuagagguucaaagaua

SEQ ID NO: 3310367 - RNA, 22 nt, Human
uuggcuaggaccccuccaugug

SEQ ID NO: 3310368 - RNA, 22 nt, Human
uuggcuagagguucaaagauau

SEQ ID NO: 3310369 - RNA, 13 nt, Human
uuggcugcaggga

SEQ ID NO: 3310370 - RNA, 14 nt, Human
uuggcugcagggag

SEQ ID NO: 3310371 - RNA, 15 nt, Human
uuggcugcugaaggc

SEQ ID NO: 3310372 - RNA, 11 nt, Human
uuggcugcuga

SEQ ID NO: 3310373 - RNA, 20 nt, Human
uuguaaggaaugauuaauua

SEQ ID NO: 3310374 - RNA, 20 nt, Human
augacacgaauauugcugau

SEQ ID NO: 3310375 - RNA, 19 nt, Human
augacacgaauauugcuga

SEQ ID NO: 3310376 - RNA, 20 nt, Human
augaaccacaucuugcucug

SEQ ID NO: 3310377 - RNA, 13 nt, Human
augaaccacaucu

SEQ ID NO: 3310378 - RNA, 17 nt, Human
uugggguacccacugcu

SEQ ID NO: 3310379 - RNA, 19 nt, Human
uuggggaagaacgaagcca

SEQ ID NO: 3310380 - RNA, 22 nt, Human
uugggguacccacugcucuggu

SEQ ID NO: 3310381 - RNA, 19 nt, Human
uugguuaggcauuguggga

SEQ ID NO: 3310382 - RNA, 14 nt, Human
uuguaaggaaugau

SEQ ID NO: 3310383 - RNA, 13 nt, Human
uggcuguuggcug

SEQ ID NO: 3310384 - RNA, 14 nt, Human
uggcugugucuccc

SEQ ID NO: 3310385 - RNA, 15 nt, Human
uggcuguuggcuggg

SEQ ID NO: 3310386 - RNA, 17 nt, Human
uggcuuaaaacaacacu

SEQ ID NO: 3310387 - RNA, 23 nt, Human
uggcuucacggaagagccuugcg

SEQ ID NO: 3310388 - RNA, 22 nt, Human
uggcuucacggaagagccuugc

SEQ ID NO: 3310389 - RNA, 16 nt, Human
ugggaaaggggaaguu

SEQ ID NO: 3310390 - RNA, 14 nt, Human
aggcugggagagcc

SEQ ID NO: 3310391 - RNA, 22 nt, Human
uggcuagagguucaaagauauu

SEQ ID NO: 3310392 - RNA, 18 nt, Human
aggcuggcgugcaguggu

SEQ ID NO: 3310393 - RNA, 20 nt, Human
aggcuggcgugcaguggugc

SEQ ID NO: 3310394 - RNA, 22 nt, Human
uggcuauuagagaucaaccccu

SEQ ID NO: 3310395 - RNA, 19 nt, Human
uggcuaugcauuugaaaau

SEQ ID NO: 3310396 - RNA, 14 nt, Human
uggcuaugcauuug

SEQ ID NO: 3310397 - RNA, 17 nt, Human
uggcuaugcauuugaaa

SEQ ID NO: 3310398 - RNA, 15 nt, Human
uggcuaugcauuuga

SEQ ID NO: 3310399 - RNA, 15 nt, Human
uggcugcagggaguc

SEQ ID NO: 3310400 - RNA, 13 nt, Human
uggcugcagggag

SEQ ID NO: 3310401 - RNA, 14 nt, Human
uggcugcagggagu

SEQ ID NO: 3310402 - RNA, 20 nt, Human
uggcugccaaugggagcuca

SEQ ID NO: 3310403 - RNA, 18 nt, Human
uggcugccaaugggagcu

SEQ ID NO: 3310404 - RNA, 18 nt, Human
uggcucaaguccucuuuu

SEQ ID NO: 3310405 - RNA, 19 nt, Human
uggcucuuccaggcuggga

SEQ ID NO: 3310406 - RNA, 21 nt, Human
uggcucuuccaggcugggaga

SEQ ID NO: 3310407 - RNA, 20 nt, Human
uggcucuuccaggcugggag

SEQ ID NO: 3310408 - RNA, 12 nt, Human
uggcugcaaagg

SEQ ID NO: 3310409 - RNA, 21 nt, Human
aggcucucaggccagcugcuu

SEQ ID NO: 3310410 - RNA, 11 nt, Human
aggcucugccc

SEQ ID NO: 3310411 - RNA, 12 nt, Human
aggcucugcccu

SEQ ID NO: 3310412 - RNA, 13 nt, Human
aggcucugcccuu

SEQ ID NO: 3310413 - RNA, 15 nt, Human
aggcucugcccuugg

SEQ ID NO: 3310414 - RNA, 14 nt, Human
aggcucugcccuug

SEQ ID NO: 3310415 - RNA, 20 nt, Human
aggcucucaggccagcugcu

SEQ ID NO: 3310416 - RNA, 19 nt, Human
aggcucucaggccagcugc

SEQ ID NO: 3310417 - RNA, 18 nt, Human
aggcucucaggccagcug

SEQ ID NO: 3310418 - RNA, 16 nt, Human
aggcucucaggccagc

SEQ ID NO: 3310419 - RNA, 15 nt, Human
aggcucucaggccag

SEQ ID NO: 3310420 - RNA, 14 nt, Human
aggcucucaggcca

SEQ ID NO: 3310421 - RNA, 12 nt, Human
aggcucucaggc

SEQ ID NO: 3310422 - RNA, 11 nt, Human
aggcucucagg

SEQ ID NO: 3310423 - RNA, 19 nt, Human
aggcuccuuuagcgcccag

SEQ ID NO: 3310424 - RNA, 12 nt, Human
aggcucgagcau

SEQ ID NO: 3310425 - RNA, 19 nt, Human
aggcucgagcaugccugga

SEQ ID NO: 3310426 - RNA, 18 nt, Human
aggcucgagcaugccugg

SEQ ID NO: 3310427 - RNA, 17 nt, Human
aggcucgagcaugccug

SEQ ID NO: 3310428 - RNA, 15 nt, Human
aggcucgagcaugcc

SEQ ID NO: 3310429 - RNA, 21 nt, Human
aggcucgagcaugccuggaug

SEQ ID NO: 3310430 - RNA, 13 nt, Human
aggcuggcgugca

SEQ ID NO: 3310431 - RNA, 17 nt, Human
aggcuggcgugcagugg

SEQ ID NO: 3310432 - RNA, 16 nt, Human
aggcucugcccuuggu

SEQ ID NO: 3310433 - RNA, 20 nt, Human
uggccccugcccggcugcgg

SEQ ID NO: 3310434 - RNA, 21 nt, Human
uggccccugcccggcugcgga

SEQ ID NO: 3310435 - RNA, 22 nt, Human
aggccuggccagaugcaccagc

SEQ ID NO: 3310436 - RNA, 23 nt, Human
aggccuggccagaugcaccagcc

SEQ ID NO: 3310437 - RNA, 23 nt, Human
aggccugggggcugggcagagga

SEQ ID NO: 3310438 - RNA, 15 nt, Human
aggccuggccagaug

SEQ ID NO: 3310439 - RNA, 16 nt, Human
aggccuggccagaugc

SEQ ID NO: 3310440 - RNA, 17 nt, Human
aggccuggccagaugca

SEQ ID NO: 3310441 - RNA, 21 nt, Human
aggccuggccagaugcaccag

SEQ ID NO: 3310442 - RNA, 13 nt, Human
uggccucugcacu

SEQ ID NO: 3310443 - RNA, 17 nt, Human
uggccucugcacucccc

SEQ ID NO: 3310444 - RNA, 15 nt, Human
uggccucugcacucc

SEQ ID NO: 3310445 - RNA, 14 nt, Human
uggccucugcacuc

SEQ ID NO: 3310446 - RNA, 14 nt, Human
aggcccucugccca

SEQ ID NO: 3310447 - RNA, 13 nt, Human
aggcccucugccc

SEQ ID NO: 3310448 - RNA, 15 nt, Human
uggccaggcuggucu

SEQ ID NO: 3310449 - RNA, 17 nt, Human
uggccaggcuggucuca

SEQ ID NO: 3310450 - RNA, 15 nt, Human
uggcaugggaaugaa

SEQ ID NO: 3310451 - RNA, 12 nt, Human
uggcaugggaau

SEQ ID NO: 3310452 - RNA, 20 nt, Human
uggaccuugaacuggguacu

SEQ ID NO: 3310453 - RNA, 18 nt, Human
aggcauuuguuugaacug

SEQ ID NO: 3310454 - RNA, 16 nt, Human
aggccaaacucaccug

SEQ ID NO: 3310455 - RNA, 18 nt, Human
aggccaaggugggaggau

SEQ ID NO: 3310456 - RNA, 20 nt, Human
aggccaaaggaagcacaugc

SEQ ID NO: 3310457 - RNA, 23 nt, Human
aggccaaaggaagcacaugccuc

SEQ ID NO: 3310458 - RNA, 20 nt, Human
aggccaaacucaccugcccc

SEQ ID NO: 3310459 - RNA, 14 nt, Human
aggccaaaggaagc

SEQ ID NO: 3310460 - RNA, 14 nt, Human
uggaguauauguca

SEQ ID NO: 3310461 - RNA, 15 nt, Human
aggccacaagacccu

SEQ ID NO: 3310462 - RNA, 15 nt, Human
uggaugccugguggc

SEQ ID NO: 3310463 - RNA, 20 nt, Human
uggaguucaucuugaauugu

SEQ ID NO: 3310464 - RNA, 17 nt, Human
uggaguucaucuugaau

SEQ ID NO: 3310465 - RNA, 16 nt, Human
uggaguucaucuugaa

SEQ ID NO: 3310466 - RNA, 18 nt, Human
uggaugccugguggcagc

SEQ ID NO: 3310467 - RNA, 19 nt, Human
uggaugccugguggcagcu

SEQ ID NO: 3310468 - RNA, 12 nt, Human
uggcagccccug

SEQ ID NO: 3310469 - RNA, 20 nt, Human
aggccacaagacccuugugg

SEQ ID NO: 3310470 - RNA, 12 nt, Human
uggauguucuga

SEQ ID NO: 3310471 - RNA, 18 nt, Human
uggcaccagcagccugga

SEQ ID NO: 3310472 - RNA, 20 nt, Human
uggcacaucagcacgauuuc

SEQ ID NO: 3310473 - RNA, 22 nt, Human
uggcagaguugaagacagagcu

SEQ ID NO: 3310474 - RNA, 15 nt, Human
uggcacccggccccu

SEQ ID NO: 3310475 - RNA, 21 nt, Human
uggcagaguugaagacagagc

SEQ ID NO: 3310476 - RNA, 15 nt, Human
ugcugcccugugagu

SEQ ID NO: 3310477 - RNA, 14 nt, Human
ugcugcccugugag

SEQ ID NO: 3310478 - RNA, 13 nt, Human
ugcugcccuguga

SEQ ID NO: 3310479 - RNA, 12 nt, Human
ugcugcccugug

SEQ ID NO: 3310480 - RNA, 16 nt, Human
ugcuggcugguuagag

SEQ ID NO: 3310481 - RNA, 18 nt, Human
ugcuguaacuuucugaaa

SEQ ID NO: 3310482 - RNA, 23 nt, Human
aggacacuaaccacgcuggaccu

SEQ ID NO: 3310483 - RNA, 19 nt, Human
aggacacuaaccacgcugg

SEQ ID NO: 3310484 - RNA, 22 nt, Human
aggacagggaggugaccccagg

SEQ ID NO: 3310485 - RNA, 13 nt, Human
ugcuuauacacuu

SEQ ID NO: 3310486 - RNA, 12 nt, Human
ugcuucaaggau

SEQ ID NO: 3310487 - RNA, 13 nt, Human
ugcuucagccucc

SEQ ID NO: 3310488 - RNA, 14 nt, Human
ugcuucagccuccc

SEQ ID NO: 3310489 - RNA, 19 nt, Human
ugcuucaaggauccugagc

SEQ ID NO: 3310490 - RNA, 18 nt, Human
ugcuucaaggauccugag

SEQ ID NO: 3310491 - RNA, 16 nt, Human
ugcuucaaggauccug

SEQ ID NO: 3310492 - RNA, 15 nt, Human
aggaaggagaggaga

SEQ ID NO: 3310493 - RNA, 19 nt, Human
aggaaggaaacccagcucu

SEQ ID NO: 3310494 - RNA, 13 nt, Human
aggaagccagcag

SEQ ID NO: 3310495 - RNA, 17 nt, Human
aggaagccagcaggcuc

SEQ ID NO: 3310496 - RNA, 18 nt, Human
aggaaggaaacccagcuc

SEQ ID NO: 3310497 - RNA, 22 nt, Human
aggaagcacaugccucucucag

SEQ ID NO: 3310498 - RNA, 15 nt, Human
aggaagccagcaggc

SEQ ID NO: 3310499 - RNA, 14 nt, Human
aggaagccagcagg

SEQ ID NO: 3310500 - RNA, 24 nt, Human
aggaagcacaugccucucucaggc

SEQ ID NO: 3310501 - RNA, 23 nt, Human
aggaagcacaugccucucucagg

SEQ ID NO: 3310502 - RNA, 14 nt, Human
aggaagacuuugga

SEQ ID NO: 3310503 - RNA, 13 nt, Human
aggaagacuuugg

SEQ ID NO: 3310504 - RNA, 19 nt, Human
aggaagacuucaucccucu

SEQ ID NO: 3310505 - RNA, 13 nt, Human
aggaagacuucau

SEQ ID NO: 3310506 - RNA, 22 nt, Human
ugcugagucugaaggcuggguu

SEQ ID NO: 3310507 - RNA, 21 nt, Human
ugcugagucugaaggcugggu

SEQ ID NO: 3310508 - RNA, 18 nt, Human
ugcugagucugaaggcug

SEQ ID NO: 3310509 - RNA, 17 nt, Human
ugcugagucugaaggcu

SEQ ID NO: 3310510 - RNA, 16 nt, Human
ugcugagucugaaggc

SEQ ID NO: 3310511 - RNA, 16 nt, Human
agcugggacuacaggc

SEQ ID NO: 3310512 - RNA, 18 nt, Human
agcugggacuacaggcac

SEQ ID NO: 3310513 - RNA, 19 nt, Human
ugcuccagcuguucagcug

SEQ ID NO: 3310514 - RNA, 16 nt, Human
ugcuccagcuguucag

SEQ ID NO: 3310515 - RNA, 21 nt, Human
ugcucugcugacagacacagg

SEQ ID NO: 3310516 - RNA, 22 nt, Human
ugcucugcugacagacacaggc

SEQ ID NO: 3310517 - RNA, 16 nt, Human
ugcucugcugacagac

SEQ ID NO: 3310518 - RNA, 14 nt, Human
ugcugagucugaag

SEQ ID NO: 3310519 - RNA, 15 nt, Human
ugcugagucugaagg

SEQ ID NO: 3310520 - RNA, 23 nt, Human
aggacuuuucuuuguggcuuccu

SEQ ID NO: 3310521 - RNA, 17 nt, Human
aggagauuggaaggaac

SEQ ID NO: 3310522 - RNA, 14 nt, Human
aggagcagccacau

SEQ ID NO: 3310523 - RNA, 22 nt, Human
aggagccccgaggccuucucug

SEQ ID NO: 3310524 - RNA, 17 nt, Human
aggagccccgaggccuu

SEQ ID NO: 3310525 - RNA, 19 nt, Human
aggacauugcggacagcca

SEQ ID NO: 3310526 - RNA, 23 nt, Human
aggacauugcggacagccacggc

SEQ ID NO: 3310527 - RNA, 15 nt, Human
aggacauugcggaca

SEQ ID NO: 3310528 - RNA, 17 nt, Human
aggacauugcggacagc

SEQ ID NO: 3310529 - RNA, 18 nt, Human
aggacauugcggacagcc

SEQ ID NO: 3310530 - RNA, 19 nt, Human
ugcuugggcuucauccucc

SEQ ID NO: 3310531 - RNA, 15 nt, Human
uggaaauauuaagaa

SEQ ID NO: 3310532 - RNA, 21 nt, Human
ugcuuggaggaaggaaaccca

SEQ ID NO: 3310533 - RNA, 16 nt, Human
ugcuugggcuucaucc

SEQ ID NO: 3310534 - RNA, 12 nt, Human
ugcuugggcuuc

SEQ ID NO: 3310535 - RNA, 16 nt, Human
ugcuuggaggaaggaa

SEQ ID NO: 3310536 - RNA, 17 nt, Human
aggagccuccugcccuu

SEQ ID NO: 3310537 - RNA, 18 nt, Human
uggacacagcucuucucc

SEQ ID NO: 3310538 - RNA, 15 nt, Human
uggacacagcucuuc

SEQ ID NO: 3310539 - RNA, 16 nt, Human
uggacacagcucuucu

SEQ ID NO: 3310540 - RNA, 13 nt, Human
uggacccugaggc

SEQ ID NO: 3310541 - RNA, 12 nt, Human
uggacccugagg

SEQ ID NO: 3310542 - RNA, 14 nt, Human
uggacccugaggcc

SEQ ID NO: 3310543 - RNA, 17 nt, Human
aggcaacucaucuuagg

SEQ ID NO: 3310544 - RNA, 19 nt, Human
aggauuuugauccaagcug

SEQ ID NO: 3310545 - RNA, 19 nt, Human
aggaugcccaaagaugcag

SEQ ID NO: 3310546 - RNA, 14 nt, Human
aggaugcccaaaga

SEQ ID NO: 3310547 - RNA, 20 nt, Human
uggaaauauuaagaaagacu

SEQ ID NO: 3310548 - RNA, 18 nt, Human
uggaaaugggcagagcag

SEQ ID NO: 3310549 - RNA, 23 nt, Human
uggaaaugggcagagcagagacc

SEQ ID NO: 3310550 - RNA, 17 nt, Human
aggaugaucuaggaaga

SEQ ID NO: 3310551 - RNA, 16 nt, Human
aggaugaucuaggaag

SEQ ID NO: 3310552 - RNA, 17 nt, Human
aggauccugagccagau

SEQ ID NO: 3310553 - RNA, 22 nt, Human
aggaucucuugagccugggagg

SEQ ID NO: 3310554 - RNA, 21 nt, Human
aggaucucuugagccugggag

SEQ ID NO: 3310555 - RNA, 16 nt, Human
aggauccugagccaga

SEQ ID NO: 3310556 - RNA, 15 nt, Human
aggauccugagccag

SEQ ID NO: 3310557 - RNA, 21 nt, Human
agcccaggccuccuacagcuu

SEQ ID NO: 3310558 - RNA, 17 nt, Human
agccccaaaacucuccu

SEQ ID NO: 3310559 - RNA, 16 nt, Human
agccccaaaacucucc

SEQ ID NO: 3310560 - RNA, 20 nt, Human
agccccauucugccugccca

SEQ ID NO: 3310561 - RNA, 18 nt, Human
agccccaaaacucuccuc

SEQ ID NO: 3310562 - RNA, 21 nt, Human
agccccauucugccugcccag

SEQ ID NO: 3310563 - RNA, 22 nt, Human
agccccauucugccugcccagg

SEQ ID NO: 3310564 - RNA, 20 nt, Human
ugcaaaccaucauugaaauc

SEQ ID NO: 3310565 - RNA, 21 nt, Human
ugcaaaccaucauugaaaucu

SEQ ID NO: 3310566 - RNA, 14 nt, Human
agcccugguggcag

SEQ ID NO: 3310567 - RNA, 15 nt, Human
agcccugguggcagu

SEQ ID NO: 3310568 - RNA, 16 nt, Human
agcccugguggcagug

SEQ ID NO: 3310569 - RNA, 21 nt, Human
ugcacacaccagagcccaccu

SEQ ID NO: 3310570 - RNA, 17 nt, Human
ugcacacaccagagccc

SEQ ID NO: 3310571 - RNA, 18 nt, Human
ugcacacaccagagccca

SEQ ID NO: 3310572 - RNA, 23 nt, Human
agccucugaaaaccaauguucuc

SEQ ID NO: 3310573 - RNA, 22 nt, Human
ugcagccucaaccuccugggcu

SEQ ID NO: 3310574 - RNA, 20 nt, Human
ugcagccucaaccuccuggg

SEQ ID NO: 3310575 - RNA, 21 nt, Human
ugcagccucaaccuccugggc

SEQ ID NO: 3310576 - RNA, 18 nt, Human
agccucacaguccuuacc

SEQ ID NO: 3310577 - RNA, 17 nt, Human
agccucacaguccuuac

SEQ ID NO: 3310578 - RNA, 20 nt, Human
agccucaaccuccugggcua

SEQ ID NO: 3310579 - RNA, 19 nt, Human
agccucaaccuccugggcu

SEQ ID NO: 3310580 - RNA, 22 nt, Human
ugcagacaggcaagcaccuccu

SEQ ID NO: 3310581 - RNA, 15 nt, Human
ugcacuccccugcug

SEQ ID NO: 3310582 - RNA, 19 nt, Human
ugcacuccccugcugggug

SEQ ID NO: 3310583 - RNA, 17 nt, Human
ugcacuccccugcuggg

SEQ ID NO: 3310584 - RNA, 16 nt, Human
ugcacuccccugcugg

SEQ ID NO: 3310585 - RNA, 15 nt, Human
ugcacacauuuuuua

SEQ ID NO: 3310586 - RNA, 13 nt, Human
ugcacacauuuuu

SEQ ID NO: 3310587 - RNA, 12 nt, Human
ugcacacauuuu

SEQ ID NO: 3310588 - RNA, 11 nt, Human
ugcacacauuu

SEQ ID NO: 3310589 - RNA, 21 nt, Human
agcccuuagcagggaaacagc

SEQ ID NO: 3310590 - RNA, 17 nt, Human
agccgagaucacgccac

SEQ ID NO: 3310591 - RNA, 21 nt, Human
agccgagauagccaaggccaa

SEQ ID NO: 3310592 - RNA, 20 nt, Human
agccgagauagccaaggcca

SEQ ID NO: 3310593 - RNA, 16 nt, Human
ugcagacucuacagag

SEQ ID NO: 3310594 - RNA, 17 nt, Human
ugcagacucuacagagg

SEQ ID NO: 3310595 - RNA, 16 nt, Human
agcccuuagcagggaa

SEQ ID NO: 3310596 - RNA, 19 nt, Human
ugauggggcccugccuccu

SEQ ID NO: 3310597 - RNA, 16 nt, Human
ugauggggcccugccu

SEQ ID NO: 3310598 - RNA, 15 nt, Human
ugauggggcccugcc

SEQ ID NO: 3310599 - RNA, 14 nt, Human
ugauggggcccugc

SEQ ID NO: 3310600 - RNA, 23 nt, Human
ugaugcuucuucagagacuccug

SEQ ID NO: 3310601 - RNA, 16 nt, Human
ugaugagaggaaauca

SEQ ID NO: 3310602 - RNA, 15 nt, Human
ugaugagaggaaauc

SEQ ID NO: 3310603 - RNA, 14 nt, Human
ugaugagaggaaau

SEQ ID NO: 3310604 - RNA, 13 nt, Human
ugaugagaggaaa

SEQ ID NO: 3310605 - RNA, 22 nt, Human
ugauccucccaccucagccucc

SEQ ID NO: 3310606 - RNA, 21 nt, Human
ugauccucccaccucagccuc

SEQ ID NO: 3310607 - RNA, 15 nt, Human
ugauccucccaccuc

SEQ ID NO: 3310608 - RNA, 16 nt, Human
ugauccuaguuccacc

SEQ ID NO: 3310609 - RNA, 16 nt, Human
agccacugcaccgggc

SEQ ID NO: 3310610 - RNA, 19 nt, Human
ugauuaaccacuucagcug

SEQ ID NO: 3310611 - RNA, 20 nt, Human
ugauuaaauucuugcaaagu

SEQ ID NO: 3310612 - RNA, 13 nt, Human
ugauggugcaaug

SEQ ID NO: 3310613 - RNA, 19 nt, Human
ugauuaaauucuugcaaag

SEQ ID NO: 3310614 - RNA, 18 nt, Human
agccacugcaccgggcca

SEQ ID NO: 3310615 - RNA, 19 nt, Human
agccacugcaccgggccac

SEQ ID NO: 3310616 - RNA, 10 nt, Human
agccagagga

SEQ ID NO: 3310617 - RNA, 22 nt, Human
ugauucccaagcucugcuccuc

SEQ ID NO: 3310618 - RNA, 23 nt, Human
ugauucccaagcucugcuccucu

SEQ ID NO: 3310619 - RNA, 21 nt, Human
ugauucauaaugacuuaagca

SEQ ID NO: 3310620 - RNA, 16 nt, Human
ugauucauaaugacuu

SEQ ID NO: 3310621 - RNA, 15 nt, Human
ugauucauaaugacu

SEQ ID NO: 3310622 - RNA, 14 nt, Human
agcccaggaaaggc

SEQ ID NO: 3310623 - RNA, 17 nt, Human
ugauuuggggauauuuu

SEQ ID NO: 3310624 - RNA, 22 nt, Human
ugauuuccguuaaaauaccagc

SEQ ID NO: 3310625 - RNA, 18 nt, Human
ugauuuccguuaaaauac

SEQ ID NO: 3310626 - RNA, 13 nt, Human
agccaguaaaugg

SEQ ID NO: 3310627 - RNA, 21 nt, Human
agccaguaaaugggggugcau

SEQ ID NO: 3310628 - RNA, 13 nt, Human
agcccacuucugc

SEQ ID NO: 3310629 - RNA, 14 nt, Human
agcccacuucugcc

SEQ ID NO: 3310630 - RNA, 15 nt, Human
agcccacuucugcca

SEQ ID NO: 3310631 - RNA, 23 nt, Human
agcucuguccugggagugagcug

SEQ ID NO: 3310632 - RNA, 22 nt, Human
agcuccuucuguccuacucugu

SEQ ID NO: 3310633 - RNA, 23 nt, Human
agcuccuucuguccuacucugug

SEQ ID NO: 3310634 - RNA, 21 nt, Human
agcuccagcucaccagcccca

SEQ ID NO: 3310635 - RNA, 18 nt, Human
agcuccagcucaccagcc

SEQ ID NO: 3310636 - RNA, 19 nt, Human
agcuccagcucaccagccc

SEQ ID NO: 3310637 - RNA, 13 nt, Human
agcuccagcucac

SEQ ID NO: 3310638 - RNA, 17 nt, Human
agcuccagcucaccagc

SEQ ID NO: 3310639 - RNA, 19 nt, Human
agcuccaagcucccaggca

SEQ ID NO: 3310640 - RNA, 18 nt, Human
agcuccaagcucccaggc

SEQ ID NO: 3310641 - RNA, 16 nt, Human
agcuccaagcucccag

SEQ ID NO: 3310642 - RNA, 17 nt, Human
agcuccaagcucccagg

SEQ ID NO: 3310643 - RNA, 19 nt, Human
ugcccuaaaguguauuuuu

SEQ ID NO: 3310644 - RNA, 19 nt, Human
ugcccuuaccugccaggaa

SEQ ID NO: 3310645 - RNA, 20 nt, Human
ugccgcagcccugcagaggg

SEQ ID NO: 3310646 - RNA, 14 nt, Human
ugccgcagcccugc

SEQ ID NO: 3310647 - RNA, 22 nt, Human
ugcccuuaccugccaggaagcc

SEQ ID NO: 3310648 - RNA, 18 nt, Human
ugcccugugggcccccaa

SEQ ID NO: 3310649 - RNA, 15 nt, Human
ugcccugugggcccc

SEQ ID NO: 3310650 - RNA, 15 nt, Human
agcucuucuccaggc

SEQ ID NO: 3310651 - RNA, 16 nt, Human
agcucuucuccaggcu

SEQ ID NO: 3310652 - RNA, 23 nt, Human
ugcccugugaguacuacaguccu

SEQ ID NO: 3310653 - RNA, 19 nt, Human
ugccucccaucacccgcua

SEQ ID NO: 3310654 - RNA, 22 nt, Human
ugccucccaucacccgcuaaga

SEQ ID NO: 3310655 - RNA, 16 nt, Human
ugccucucucaggcca

SEQ ID NO: 3310656 - RNA, 17 nt, Human
ugccucucucaggccaa

SEQ ID NO: 3310657 - RNA, 23 nt, Human
agcugcuuuugucuaugggacuc

SEQ ID NO: 3310658 - RNA, 24 nt, Human
agcugcuuuugucuaugggacuca

SEQ ID NO: 3310659 - RNA, 15 nt, Human
agcugggacuacagg

SEQ ID NO: 3310660 - RNA, 10 nt, Human
agcugccugu

SEQ ID NO: 3310661 - RNA, 13 nt, Human
agcugccuguuca

SEQ ID NO: 3310662 - RNA, 22 nt, Human
agcugcuuuugucuaugggacu

SEQ ID NO: 3310663 - RNA, 17 nt, Human
ugccugcccaggccccu

SEQ ID NO: 3310664 - RNA, 16 nt, Human
ugccugcccaggcccc

SEQ ID NO: 3310665 - RNA, 18 nt, Human
ugccugcccaggccccug

SEQ ID NO: 3310666 - RNA, 19 nt, Human
ugccugcccaggccccugc

SEQ ID NO: 3310667 - RNA, 14 nt, Human
ugccucugacacac

SEQ ID NO: 3310668 - RNA, 16 nt, Human
ugccucugacacacag

SEQ ID NO: 3310669 - RNA, 11 nt, Human
ugccucugccu

SEQ ID NO: 3310670 - RNA, 21 nt, Human
agcuaggccuggccagaugca

SEQ ID NO: 3310671 - RNA, 16 nt, Human
agcuaggccuggccag

SEQ ID NO: 3310672 - RNA, 15 nt, Human
agcuccaagcuccca

SEQ ID NO: 3310673 - RNA, 19 nt, Human
agcuauucaguaauaacuc

SEQ ID NO: 3310674 - RNA, 13 nt, Human
agcucagggccug

SEQ ID NO: 3310675 - RNA, 12 nt, Human
agcucagggccu

SEQ ID NO: 3310676 - RNA, 19 nt, Human
agcucagggccuggcucag

SEQ ID NO: 3310677 - RNA, 18 nt, Human
agcucagggccuggcuca

SEQ ID NO: 3310678 - RNA, 20 nt, Human
agcucagggccuggcucagg

SEQ ID NO: 3310679 - RNA, 23 nt, Human
ugccccgaacauguuuuucuucu

SEQ ID NO: 3310680 - RNA, 20 nt, Human
ugcccuaaaguguauuuuuu

SEQ ID NO: 3310681 - RNA, 20 nt, Human
ugcccaaagaugcagccggu

SEQ ID NO: 3310682 - RNA, 17 nt, Human
ugcccaaagaugcagcc

SEQ ID NO: 3310683 - RNA, 17 nt, Human
ugcccagccccuucuga

SEQ ID NO: 3310684 - RNA, 16 nt, Human
ugcccagccccuucug

SEQ ID NO: 3310685 - RNA, 12 nt, Human
ugcccagccccu

SEQ ID NO: 3310686 - RNA, 13 nt, Human
ugcccagccccuu

SEQ ID NO: 3310687 - RNA, 14 nt, Human
ugcccaggccccug

SEQ ID NO: 3310688 - RNA, 15 nt, Human
ugcccaggccccugc

SEQ ID NO: 3310689 - RNA, 17 nt, Human
ugcccaggccccugcca

SEQ ID NO: 3310690 - RNA, 18 nt, Human
ugcccaggccccugccac

SEQ ID NO: 3310691 - RNA, 18 nt, Human
ugcauuugaggucuguuc

SEQ ID NO: 3310692 - RNA, 19 nt, Human
ugcauuugaggucuguucu

SEQ ID NO: 3310693 - RNA, 20 nt, Human
ugcauuuaaaagauacaguu

SEQ ID NO: 3310694 - RNA, 22 nt, Human
agcgauucuucugcuucagccu

SEQ ID NO: 3310695 - RNA, 23 nt, Human
agccuugaccauucuccaccugc

SEQ ID NO: 3310696 - RNA, 22 nt, Human
agccuugaccauucuccaccug

SEQ ID NO: 3310697 - RNA, 13 nt, Human
agccuugaacuuu

SEQ ID NO: 3310698 - RNA, 22 nt, Human
agccuugaacuuugaccucugc

SEQ ID NO: 3310699 - RNA, 16 nt, Human
agccuugaacuuugac

SEQ ID NO: 3310700 - RNA, 18 nt, Human
agccuuccagggguggga

SEQ ID NO: 3310701 - RNA, 15 nt, Human
agccuugaacuuuga

SEQ ID NO: 3310702 - RNA, 21 nt, Human
ugcauuugaggucuguucuuu

SEQ ID NO: 3310703 - RNA, 20 nt, Human
ugcauuugaggucuguucuu

SEQ ID NO: 3310704 - RNA, 18 nt, Human
ugccagcuuaucucaggg

SEQ ID NO: 3310705 - RNA, 13 nt, Human
agcggcuggcagc

SEQ ID NO: 3310706 - RNA, 22 nt, Human
agcggggacagcuccuucuguc

SEQ ID NO: 3310707 - RNA, 19 nt, Human
agcggggacagcuccuucu

SEQ ID NO: 3310708 - RNA, 20 nt, Human
agcggggacagcuccuucug

SEQ ID NO: 3310709 - RNA, 23 nt, Human
agcggcuggcagcccaccccuca

SEQ ID NO: 3310710 - RNA, 17 nt, Human
uuaaaacaacacucaca

SEQ ID NO: 3310711 - RNA, 18 nt, Human
uuaaaaaguggaaaaaua

SEQ ID NO: 3310712 - RNA, 13 nt, Human
uuaaauaaaucau

SEQ ID NO: 3310713 - RNA, 15 nt, Human
uuaaauaaaucauaa

SEQ ID NO: 3310714 - RNA, 21 nt, Human
uuaaauaaugugaaacuggau

SEQ ID NO: 3310715 - RNA, 20 nt, Human
uuaaauaaugugaaacugga

SEQ ID NO: 3310716 - RNA, 22 nt, Human
uuaaauaaugugaaacuggauu

SEQ ID NO: 3310717 - RNA, 19 nt, Human
uuaaauaaugugaaacugg

SEQ ID NO: 3310718 - RNA, 17 nt, Human
uuaaaccgccaaggcug

SEQ ID NO: 3310719 - RNA, 22 nt, Human
aguuuucacucuuauugcccac

SEQ ID NO: 3310720 - RNA, 13 nt, Human
uuaaauucuugca

SEQ ID NO: 3310721 - RNA, 16 nt, Human
uuaaauucuugcaaag

SEQ ID NO: 3310722 - RNA, 15 nt, Human
aguuucuccaagcag

SEQ ID NO: 3310723 - RNA, 13 nt, Human
aguuucuccaagc

SEQ ID NO: 3310724 - RNA, 15 nt, Human
uguuuucaguguaca

SEQ ID NO: 3310725 - RNA, 21 nt, Human
uguuuuauuuuaauucaguug

SEQ ID NO: 3310726 - RNA, 12 nt, Human
aguucucuccuu

SEQ ID NO: 3310727 - RNA, 13 nt, Human
aguucucuccuuc

SEQ ID NO: 3310728 - RNA, 16 nt, Human
aguucucuccuucuuc

SEQ ID NO: 3310729 - RNA, 16 nt, Human
uguuugccucugccuc

SEQ ID NO: 3310730 - RNA, 14 nt, Human
uguuugccucugcc

SEQ ID NO: 3310731 - RNA, 14 nt, Human
uguugucagcugaa

SEQ ID NO: 3310732 - RNA, 15 nt, Human
uguuuggggaugaga

SEQ ID NO: 3310733 - RNA, 23 nt, Human
aguugauagcacagacccugccc

SEQ ID NO: 3310734 - RNA, 22 nt, Human
aguugauagcacagacccugcc

SEQ ID NO: 3310735 - RNA, 13 nt, Human
aguugauucagcu

SEQ ID NO: 3310736 - RNA, 18 nt, Human
aguugauucagcucugca

SEQ ID NO: 3310737 - RNA, 17 nt, Human
aguugauucagcucugc

SEQ ID NO: 3310738 - RNA, 15 nt, Human
aguugauucagcucu

SEQ ID NO: 3310739 - RNA, 14 nt, Human
aguugauucagcuc

SEQ ID NO: 3310740 - RNA, 23 nt, Human
aguugauucagcucugcaagaau

SEQ ID NO: 3310741 - RNA, 14 nt, Human
aguugauagcacag

SEQ ID NO: 3310742 - RNA, 21 nt, Human
aguugauagcacagacccugc

SEQ ID NO: 3310743 - RNA, 20 nt, Human
aguugauagcacagacccug

SEQ ID NO: 3310744 - RNA, 19 nt, Human
aguugauagcacagacccu

SEQ ID NO: 3310745 - RNA, 15 nt, Human
aguugauagcacaga

SEQ ID NO: 3310746 - RNA, 13 nt, Human
uguugggccagga

SEQ ID NO: 3310747 - RNA, 16 nt, Human
uguugggccaggagcc

SEQ ID NO: 3310748 - RNA, 13 nt, Human
uguugucagcuga

SEQ ID NO: 3310749 - RNA, 21 nt, Human
aguuauuuuuauuuauuuaaa

SEQ ID NO: 3310750 - RNA, 18 nt, Human
uguucuuuccaaaguaca

SEQ ID NO: 3310751 - RNA, 20 nt, Human
agugggggaguggccacaga

SEQ ID NO: 3310752 - RNA, 19 nt, Human
agugggggaguggccacag

SEQ ID NO: 3310753 - RNA, 18 nt, Human
agugggugaauaauacag

SEQ ID NO: 3310754 - RNA, 13 nt, Human
agugggugaauaa

SEQ ID NO: 3310755 - RNA, 11 nt, Human
aguggcagcug

SEQ ID NO: 3310756 - RNA, 12 nt, Human
aguggcagcugc

SEQ ID NO: 3310757 - RNA, 13 nt, Human
aguggcagcugcu

SEQ ID NO: 3310758 - RNA, 14 nt, Human
aguggcagcugcuu

SEQ ID NO: 3310759 - RNA, 20 nt, Human
aguggcagcugcuuuugucu

SEQ ID NO: 3310760 - RNA, 19 nt, Human
agugggugaauaauacagu

SEQ ID NO: 3310761 - RNA, 21 nt, Human
agugguuccuaauccucuagg

SEQ ID NO: 3310762 - RNA, 21 nt, Human
aguguacauggaauaacaugu

SEQ ID NO: 3310763 - RNA, 22 nt, Human
aguguacauggaauaacaugua

SEQ ID NO: 3310764 - RNA, 23 nt, Human
aguguacauggaauaacauguaa

SEQ ID NO: 3310765 - RNA, 19 nt, Human
uguucuuucacccuuuucu

SEQ ID NO: 3310766 - RNA, 14 nt, Human
uguucuuuccaaag

SEQ ID NO: 3310767 - RNA, 13 nt, Human
uguucuuuccaaa

SEQ ID NO: 3310768 - RNA, 18 nt, Human
uguucuugguuuguaaau

SEQ ID NO: 3310769 - RNA, 17 nt, Human
uguucuugguuuguaaa

SEQ ID NO: 3310770 - RNA, 14 nt, Human
uguucugggacaca

SEQ ID NO: 3310771 - RNA, 16 nt, Human
uguucuuaauucuuag

SEQ ID NO: 3310772 - RNA, 14 nt, Human
uguucuuaauucuu

SEQ ID NO: 3310773 - RNA, 12 nt, Human
uguucugggaca

SEQ ID NO: 3310774 - RNA, 13 nt, Human
uguucugggacac

SEQ ID NO: 3310775 - RNA, 12 nt, Human
auacaaaagcau

SEQ ID NO: 3310776 - RNA, 15 nt, Human
auacaaaagcaugug

SEQ ID NO: 3310777 - RNA, 13 nt, Human
auacaaaagcaug

SEQ ID NO: 3310778 - RNA, 13 nt, Human
uuauacauaaaca

SEQ ID NO: 3310779 - RNA, 20 nt, Human
auacuacaguuuguuaguau

SEQ ID NO: 3310780 - RNA, 16 nt, Human
auacuacaguuuguua

SEQ ID NO: 3310781 - RNA, 15 nt, Human
auacuacaguuuguu

SEQ ID NO: 3310782 - RNA, 13 nt, Human
auacuacaguuug

SEQ ID NO: 3310783 - RNA, 21 nt, Human
auacuaaccagcagaaaugcc

SEQ ID NO: 3310784 - RNA, 19 nt, Human
auaccagccaguaaauggg

SEQ ID NO: 3310785 - RNA, 17 nt, Human
auaccagccaguaaaug

SEQ ID NO: 3310786 - RNA, 16 nt, Human
auacauuugauaaagu

SEQ ID NO: 3310787 - RNA, 14 nt, Human
auacaggaaaagcu

SEQ ID NO: 3310788 - RNA, 19 nt, Human
auacaggaaaagcugcuga

SEQ ID NO: 3310789 - RNA, 20 nt, Human
auacaggaaaagcugcugac

SEQ ID NO: 3310790 - RNA, 14 nt, Human
auaauucuacuuug

SEQ ID NO: 3310791 - RNA, 19 nt, Human
auaauacaguaucucaggg

SEQ ID NO: 3310792 - RNA, 22 nt, Human
auaaguuaacuuccaauuuaca

SEQ ID NO: 3310793 - RNA, 21 nt, Human
auaauacaccacuacauucug

SEQ ID NO: 3310794 - RNA, 23 nt, Human
auaauacaccacuacauucuguu

SEQ ID NO: 3310795 - RNA, 23 nt, Human
auaagaaccuuuugagugccuua

SEQ ID NO: 3310796 - RNA, 17 nt, Human
auaaguuaacuuccaau

SEQ ID NO: 3310797 - RNA, 22 nt, Human
auaagaaccuuuugagugccuu

SEQ ID NO: 3310798 - RNA, 16 nt, Human
uuacaggaaguacugg

SEQ ID NO: 3310799 - RNA, 15 nt, Human
uuacaggaaguacug

SEQ ID NO: 3310800 - RNA, 22 nt, Human
uuacaggaaguacuggagaaaa

SEQ ID NO: 3310801 - RNA, 18 nt, Human
uuacaggaaguacuggag

SEQ ID NO: 3310802 - RNA, 23 nt, Human
uuaccauuuugggguacccacug

SEQ ID NO: 3310803 - RNA, 20 nt, Human
auaacauguaauuaaguacu

SEQ ID NO: 3310804 - RNA, 15 nt, Human
auaaacuuuaccuuu

SEQ ID NO: 3310805 - RNA, 13 nt, Human
auaaacuuuaccu

SEQ ID NO: 3310806 - RNA, 12 nt, Human
ugguggcagcug

SEQ ID NO: 3310807 - RNA, 23 nt, Human
ugguggcagcucaccucucccuu

SEQ ID NO: 3310808 - RNA, 20 nt, Human
ugguggcagcucaccucucc

SEQ ID NO: 3310809 - RNA, 19 nt, Human
ugguggcagcucaccucuc

SEQ ID NO: 3310810 - RNA, 16 nt, Human
ugguggcagcucaccu

SEQ ID NO: 3310811 - RNA, 12 nt, Human
ugguggcagcuc

SEQ ID NO: 3310812 - RNA, 15 nt, Human
ugguggcagagugga

SEQ ID NO: 3310813 - RNA, 20 nt, Human
ugguucaggguuggccccug

SEQ ID NO: 3310814 - RNA, 22 nt, Human
ugguucaggguuggccccugcc

SEQ ID NO: 3310815 - RNA, 17 nt, Human
ugguguuuccuggcacu

SEQ ID NO: 3310816 - RNA, 15 nt, Human
ugguguuuccuggca

SEQ ID NO: 3310817 - RNA, 14 nt, Human
ugguuauggagagg

SEQ ID NO: 3310818 - RNA, 13 nt, Human
ugguuuucuguuc

SEQ ID NO: 3310819 - RNA, 21 nt, Human
aggugauccacccaccucagc

SEQ ID NO: 3310820 - RNA, 23 nt, Human
aggugauccacccaccucagccu

SEQ ID NO: 3310821 - RNA, 15 nt, Human
ugguuucagaaaugu

SEQ ID NO: 3310822 - RNA, 14 nt, Human
ugguuucagaaaug

SEQ ID NO: 3310823 - RNA, 21 nt, Human
ugguuuguaaauuaacuuuua

SEQ ID NO: 3310824 - RNA, 12 nt, Human
ugguuuucuguu

SEQ ID NO: 3310825 - RNA, 18 nt, Human
uguacaugaaaacacauu

SEQ ID NO: 3310826 - RNA, 17 nt, Human
uguacaugaaaacacau

SEQ ID NO: 3310827 - RNA, 19 nt, Human
uguacaugaaaacacauuu

SEQ ID NO: 3310828 - RNA, 19 nt, Human
uguacaaaguagaagucuu

SEQ ID NO: 3310829 - RNA, 23 nt, Human
uguacaaaguagaagucuuagau

SEQ ID NO: 3310830 - RNA, 21 nt, Human
uguaauuugugauacaaugcu

SEQ ID NO: 3310831 - RNA, 17 nt, Human
uguaauuugugauacaa

SEQ ID NO: 3310832 - RNA, 18 nt, Human
uguaaggaaugauuaauu

SEQ ID NO: 3310833 - RNA, 16 nt, Human
uguaauuugugauaca

SEQ ID NO: 3310834 - RNA, 22 nt, Human
uguaagcucuacugaggugcua

SEQ ID NO: 3310835 - RNA, 13 nt, Human
uguaaggaaugau

SEQ ID NO: 3310836 - RNA, 15 nt, Human
uguaaggaaugauua

SEQ ID NO: 3310837 - RNA, 14 nt, Human
uguaaggaaugauu

SEQ ID NO: 3310838 - RNA, 14 nt, Human
agguggggcagcuu

SEQ ID NO: 3310839 - RNA, 23 nt, Human
agguggggucacucuggcagcuc

SEQ ID NO: 3310840 - RNA, 13 nt, Human
agguggggcagcu

SEQ ID NO: 3310841 - RNA, 23 nt, Human
aggugugaaccaccacacccagc

SEQ ID NO: 3310842 - RNA, 18 nt, Human
aggugugacugaauuucu

SEQ ID NO: 3310843 - RNA, 22 nt, Human
aggugugaaccaccacacccag

SEQ ID NO: 3310844 - RNA, 20 nt, Human
aggugugacugaauuucuuu

SEQ ID NO: 3310845 - RNA, 14 nt, Human
aggugugagucacc

SEQ ID NO: 3310846 - RNA, 17 nt, Human
aggguugggcugguguc

SEQ ID NO: 3310847 - RNA, 21 nt, Human
aggucaaggcugcagugagcc

SEQ ID NO: 3310848 - RNA, 23 nt, Human
aggucauuuuuuuuaagaaaaag

SEQ ID NO: 3310849 - RNA, 22 nt, Human
aggucauuuuuuuuaagaaaaa

SEQ ID NO: 3310850 - RNA, 18 nt, Human
aggucuugaacuccuggc

SEQ ID NO: 3310851 - RNA, 20 nt, Human
aggucauuuuuuuuaagaaa

SEQ ID NO: 3310852 - RNA, 20 nt, Human
aggucuugaacuccuggccu

SEQ ID NO: 3310853 - RNA, 21 nt, Human
aggucuugaacuccuggccuc

SEQ ID NO: 3310854 - RNA, 12 nt, Human
uggucuguguga

SEQ ID NO: 3310855 - RNA, 16 nt, Human
uggucuuauuuguaaa

SEQ ID NO: 3310856 - RNA, 18 nt, Human
uggucugacccacugcuu

SEQ ID NO: 3310857 - RNA, 19 nt, Human
ugguccauagagagcaaga

SEQ ID NO: 3310858 - RNA, 19 nt, Human
aggguggugaccucugccu

SEQ ID NO: 3310859 - RNA, 17 nt, Human
aggguggugaccucugc

SEQ ID NO: 3310860 - RNA, 18 nt, Human
aggguggugaccucugcc

SEQ ID NO: 3310861 - RNA, 19 nt, Human
uggugaacagaacaaaagg

SEQ ID NO: 3310862 - RNA, 13 nt, Human
aggguuggccccu

SEQ ID NO: 3310863 - RNA, 14 nt, Human
aggguuggccccug

SEQ ID NO: 3310864 - RNA, 13 nt, Human
aggguugggcugg

SEQ ID NO: 3310865 - RNA, 15 nt, Human
aggguugggcuggug

SEQ ID NO: 3310866 - RNA, 23 nt, Human
uggguggaugccugguggcagcu

SEQ ID NO: 3310867 - RNA, 14 nt, Human
uggguggaugccug

SEQ ID NO: 3310868 - RNA, 20 nt, Human
uggucaccaaaucagcugcu

SEQ ID NO: 3310869 - RNA, 23 nt, Human
uggucaccaaaucagcugcuacu

SEQ ID NO: 3310870 - RNA, 21 nt, Human
uggucaccaaaucagcugcua

SEQ ID NO: 3310871 - RNA, 16 nt, Human
ugguccauagagagca

SEQ ID NO: 3310872 - RNA, 15 nt, Human
ugguccauagagagc

SEQ ID NO: 3310873 - RNA, 13 nt, Human
agggggcugggac

SEQ ID NO: 3310874 - RNA, 19 nt, Human
aggguacuaaggaaucuuu

SEQ ID NO: 3310875 - RNA, 16 nt, Human
aggguaucaggugcug

SEQ ID NO: 3310876 - RNA, 16 nt, Human
agucacugagacagcc

SEQ ID NO: 3310877 - RNA, 15 nt, Human
agucacugagacagc

SEQ ID NO: 3310878 - RNA, 17 nt, Human
agucacugagacagccc

SEQ ID NO: 3310879 - RNA, 15 nt, Human
ugucagcauagaagu

SEQ ID NO: 3310880 - RNA, 22 nt, Human
aguagcugggacuacaggcacc

SEQ ID NO: 3310881 - RNA, 19 nt, Human
aguagcugggacuacaggc

SEQ ID NO: 3310882 - RNA, 21 nt, Human
aguagcugggacuacaggcac

SEQ ID NO: 3310883 - RNA, 14 nt, Human
aguauuauaccuuu

SEQ ID NO: 3310884 - RNA, 15 nt, Human
aguauuauaccuuuu

SEQ ID NO: 3310885 - RNA, 15 nt, Human
uguaucccaugagcc

SEQ ID NO: 3310886 - RNA, 14 nt, Human
uguauguguaagua

SEQ ID NO: 3310887 - RNA, 12 nt, Human
uguagagccagg

SEQ ID NO: 3310888 - RNA, 15 nt, Human
uguagagccaggguc

SEQ ID NO: 3310889 - RNA, 15 nt, Human
ugucaaaguggugag

SEQ ID NO: 3310890 - RNA, 14 nt, Human
ugucaaagugguga

SEQ ID NO: 3310891 - RNA, 19 nt, Human
ugucaaaguggugagaggc

SEQ ID NO: 3310892 - RNA, 16 nt, Human
ugucaaaguggugaga

SEQ ID NO: 3310893 - RNA, 13 nt, Human
aguagcugggacu

SEQ ID NO: 3310894 - RNA, 14 nt, Human
aguagcugggacua

SEQ ID NO: 3310895 - RNA, 20 nt, Human
agucccaccuuggcugcagg

SEQ ID NO: 3310896 - RNA, 21 nt, Human
agucccaccuuggcugcaggg

SEQ ID NO: 3310897 - RNA, 23 nt, Human
agucccaccuuggcugcagggag

SEQ ID NO: 3310898 - RNA, 19 nt, Human
aguccccuguuuguuucug

SEQ ID NO: 3310899 - RNA, 14 nt, Human
aguccccuguuugu

SEQ ID NO: 3310900 - RNA, 19 nt, Human
agucagggguucccuuuuu

SEQ ID NO: 3310901 - RNA, 16 nt, Human
ugucagccauuccugu

SEQ ID NO: 3310902 - RNA, 12 nt, Human
ugucccuuuucc

SEQ ID NO: 3310903 - RNA, 13 nt, Human
ugucucugagagu

SEQ ID NO: 3310904 - RNA, 12 nt, Human
agucccugccaa

SEQ ID NO: 3310905 - RNA, 16 nt, Human
agucccugccaaugga

SEQ ID NO: 3310906 - RNA, 14 nt, Human
agucccugccaaug

SEQ ID NO: 3310907 - RNA, 13 nt, Human
agucccugccaau

SEQ ID NO: 3310908 - RNA, 23 nt, Human
aguccccuguuuguuucugaaag

SEQ ID NO: 3310909 - RNA, 22 nt, Human
ugucucuuuaaugucacaggca

SEQ ID NO: 3310910 - RNA, 21 nt, Human
ugucucuuuaaugucacaggc

SEQ ID NO: 3310911 - RNA, 22 nt, Human
ugucucuugguccugcugcagu

SEQ ID NO: 3310912 - RNA, 21 nt, Human
ugucucuugguccugcugcag

SEQ ID NO: 3310913 - RNA, 20 nt, Human
ugucucuugguccugcugca

SEQ ID NO: 3310914 - RNA, 19 nt, Human
ugucucuugguccugcugc

SEQ ID NO: 3310915 - RNA, 18 nt, Human
ugucucuugguccugcug

SEQ ID NO: 3310916 - RNA, 15 nt, Human
ugucuugcaauggca

SEQ ID NO: 3310917 - RNA, 17 nt, Human
ugucuugcaauggcagc

SEQ ID NO: 3310918 - RNA, 18 nt, Human
ugucuugcaauggcagcc

SEQ ID NO: 3310919 - RNA, 20 nt, Human
ugucuugcaauggcagccuu

SEQ ID NO: 3310920 - RNA, 21 nt, Human
ugucuugcaauggcagccuug

SEQ ID NO: 3310921 - RNA, 16 nt, Human
ugugaaccaccacacc

SEQ ID NO: 3310922 - RNA, 21 nt, Human
ugugaaccaccacacccagcc

SEQ ID NO: 3310923 - RNA, 22 nt, Human
ugugaaccaccacacccagccc

SEQ ID NO: 3310924 - RNA, 23 nt, Human
ugugaaccaccacacccagccca

SEQ ID NO: 3310925 - RNA, 15 nt, Human
ugugaaccaccacac

SEQ ID NO: 3310926 - RNA, 19 nt, Human
ugugagcacaaagguagcu

SEQ ID NO: 3310927 - RNA, 14 nt, Human
ugugaagagaacca

SEQ ID NO: 3310928 - RNA, 23 nt, Human
agugaaaaaggaggaagagaaaa

SEQ ID NO: 3310929 - RNA, 20 nt, Human
agugaaaaaggaggaagaga

SEQ ID NO: 3310930 - RNA, 17 nt, Human
agugaaaaaggaggaag

SEQ ID NO: 3310931 - RNA, 11 nt, Human
agugaaaaagg

SEQ ID NO: 3310932 - RNA, 13 nt, Human
agugagacucugu

SEQ ID NO: 3310933 - RNA, 21 nt, Human
agugagacccugucucaaaaa

SEQ ID NO: 3310934 - RNA, 17 nt, Human
agugagacccugucuca

SEQ ID NO: 3310935 - RNA, 22 nt, Human
agugagacucugucucaaaaaa

SEQ ID NO: 3310936 - RNA, 16 nt, Human
agugagacucugucuc

SEQ ID NO: 3310937 - RNA, 17 nt, Human
agugagacucugucuca

SEQ ID NO: 3310938 - RNA, 17 nt, Human
ugugauggggcccugcc

SEQ ID NO: 3310939 - RNA, 16 nt, Human
ugugauggggcccugc

SEQ ID NO: 3310940 - RNA, 15 nt, Human
ugugauggggcccug

SEQ ID NO: 3310941 - RNA, 22 nt, Human
agugagcacuaaggugugcucu

SEQ ID NO: 3310942 - RNA, 14 nt, Human
aaaaacacaaaagu

SEQ ID NO: 3310943 - RNA, 12 nt, Human
aaaacacauuuu

SEQ ID NO: 3310944 - RNA, 12 nt, Human
aaaaagaggcua

SEQ ID NO: 3310945 - RNA, 13 nt, Human
aaaaacugauuuu

SEQ ID NO: 3310946 - RNA, 14 nt, Human
aaaaacauggccuu

SEQ ID NO: 3310947 - RNA, 15 nt, Human
aaaaacugauuuuuu

SEQ ID NO: 3310948 - RNA, 22 nt, Human
aaguuguaggcauaaagucagg

SEQ ID NO: 3310949 - RNA, 22 nt, Human
aagugcugggauuacaggugug

SEQ ID NO: 3310950 - RNA, 16 nt, Human
aagucuuagauguaua

SEQ ID NO: 3310951 - RNA, 20 nt, Human
aagguuaauguucaucaucc

SEQ ID NO: 3310952 - RNA, 15 nt, Human
aagguuaauaaagua

SEQ ID NO: 3310953 - RNA, 16 nt, Human
aagguuaauaaaguaa

SEQ ID NO: 3310954 - RNA, 11 nt, Human
aaggugggagg

SEQ ID NO: 3310955 - RNA, 23 nt, Human
aaguacuucuccacccugcucuc

SEQ ID NO: 3310956 - RNA, 11 nt, Human
aaguacuucuu

SEQ ID NO: 3310957 - RNA, 16 nt, Human
aaguaucccuacugua

SEQ ID NO: 3310958 - RNA, 14 nt, Human
aagcagaggaagga

SEQ ID NO: 3310959 - RNA, 18 nt, Human
aagccauaauuguucuua

SEQ ID NO: 3310960 - RNA, 16 nt, Human
aaggcaaggcugucaa

SEQ ID NO: 3310961 - RNA, 18 nt, Human
aaggcaaggcugucaauu

SEQ ID NO: 3310962 - RNA, 17 nt, Human
aaggcaaggcugucaau

SEQ ID NO: 3310963 - RNA, 11 nt, Human
aagcugggcag

SEQ ID NO: 3310964 - RNA, 13 nt, Human
aagcugggcaggu

SEQ ID NO: 3310965 - RNA, 18 nt, Human
aaggacauugcggacagc

SEQ ID NO: 3310966 - RNA, 20 nt, Human
aagcugcacccucaggcagg

SEQ ID NO: 3310967 - RNA, 21 nt, Human
aagcugcacccucaggcaggu

SEQ ID NO: 3310968 - RNA, 22 nt, Human
aagcugcacccucaggcaggug

SEQ ID NO: 3310969 - RNA, 12 nt, Human
aagcguggugga

SEQ ID NO: 3310970 - RNA, 21 nt, Human
aagcgugagccacugcaccgg

SEQ ID NO: 3310971 - RNA, 13 nt, Human
aaugucaguguga

SEQ ID NO: 3310972 - RNA, 16 nt, Human
aaugucagugugacug

SEQ ID NO: 3310973 - RNA, 15 nt, Human
aaugucagugugacu

SEQ ID NO: 3310974 - RNA, 22 nt, Human
aaugucuaguuguaacaccaug

SEQ ID NO: 3310975 - RNA, 21 nt, Human
aaugucagugugacugaucuc

SEQ ID NO: 3310976 - RNA, 17 nt, Human
aaugucagugugacuga

SEQ ID NO: 3310977 - RNA, 20 nt, Human
aaugucucuuuaaugucaca

SEQ ID NO: 3310978 - RNA, 13 nt, Human
aaugggcagagca

SEQ ID NO: 3310979 - RNA, 15 nt, Human
aaugggcagagcaga

SEQ ID NO: 3310980 - RNA, 18 nt, Human
aauuaaaacacaacaucu

SEQ ID NO: 3310981 - RNA, 19 nt, Human
aauguuugccucugccucu

SEQ ID NO: 3310982 - RNA, 16 nt, Human
aauguuugccucugcc

SEQ ID NO: 3310983 - RNA, 18 nt, Human
aauguuugccucugccuc

SEQ ID NO: 3310984 - RNA, 18 nt, Human
aauuaguggcacuugcuu

SEQ ID NO: 3310985 - RNA, 13 nt, Human
aaucuccaaaaua

SEQ ID NO: 3310986 - RNA, 14 nt, Human
aaucuccaaaauaa

SEQ ID NO: 3310987 - RNA, 21 nt, Human
aaugaugauccuaggcauuug

SEQ ID NO: 3310988 - RNA, 22 nt, Human
aaucugcuuuuuaaagaaugcu

SEQ ID NO: 3310989 - RNA, 16 nt, Human
aaugaaccacaucuug

SEQ ID NO: 3310990 - RNA, 17 nt, Human
aaugaaccacaucuugc

SEQ ID NO: 3310991 - RNA, 23 nt, Human
aaugaaccacaucuugcucugcu

SEQ ID NO: 3310992 - RNA, 18 nt, Human
aauauaggaacuuaaaua

SEQ ID NO: 3310993 - RNA, 16 nt, Human
aauauaggaacuuaaa

SEQ ID NO: 3310994 - RNA, 21 nt, Human
aauauaggaacuuaaauaaug

SEQ ID NO: 3310995 - RNA, 20 nt, Human
aauauaggaacuuaaauaau

SEQ ID NO: 3310996 - RNA, 19 nt, Human
aacaccucugcacaagcug

SEQ ID NO: 3310997 - RNA, 19 nt, Human
aacacauuuuucuuaggga

SEQ ID NO: 3310998 - RNA, 14 nt, Human
aacccuggugacca

SEQ ID NO: 3310999 - RNA, 14 nt, Human
aacauguaauuaag

SEQ ID NO: 3311000 - RNA, 21 nt, Human
aacauguaauuaaguacuaug

SEQ ID NO: 3311001 - RNA, 22 nt, Human
aaccacucuaucaaguauuaua

SEQ ID NO: 3311002 - RNA, 14 nt, Human
aacaucaacaucuu

SEQ ID NO: 3311003 - RNA, 20 nt, Human
aacuuugaccucugcagcaa

SEQ ID NO: 3311004 - RNA, 19 nt, Human
aacuuugaccucugcagca

SEQ ID NO: 3311005 - RNA, 15 nt, Human
aacuuuuauaaacuu

SEQ ID NO: 3311006 - RNA, 12 nt, Human
aacuuuuauaaa

SEQ ID NO: 3311007 - RNA, 13 nt, Human
aacuuugaccucu

SEQ ID NO: 3311008 - RNA, 17 nt, Human
aacuuugaccucugcag

SEQ ID NO: 3311009 - RNA, 14 nt, Human
aacuuugaccucug

SEQ ID NO: 3311010 - RNA, 19 nt, Human
aacuuuuauaaacuuuacc

SEQ ID NO: 3311011 - RNA, 16 nt, Human
aacuuuuauaaacuuu

SEQ ID NO: 3311012 - RNA, 16 nt, Human
aacucaccugccccuc

SEQ ID NO: 3311013 - RNA, 15 nt, Human
aacucaccugccccu

SEQ ID NO: 3311014 - RNA, 12 nt, Human
aacucaccccag

SEQ ID NO: 3311015 - RNA, 17 nt, Human
aacuuaaauaaugugaa

SEQ ID NO: 3311016 - RNA, 19 nt, Human
aacugauuuuuuuuuccuu

SEQ ID NO: 3311017 - RNA, 17 nt, Human
aacugauuuuuuuuucc

SEQ ID NO: 3311018 - RNA, 18 nt, Human
aaauggaagacagcucuu

SEQ ID NO: 3311019 - RNA, 16 nt, Human
aaauggaaaugggcag

SEQ ID NO: 3311020 - RNA, 20 nt, Human
aaauggacguguuaugacuc

SEQ ID NO: 3311021 - RNA, 22 nt, Human
aaauggacguguuaugacucca

SEQ ID NO: 3311022 - RNA, 21 nt, Human
aaauggacguguuaugacucc

SEQ ID NO: 3311023 - RNA, 11 nt, Human
aaagugcuggg

SEQ ID NO: 3311024 - RNA, 11 nt, Human
aaagagguuuu

SEQ ID NO: 3311025 - RNA, 15 nt, Human
aaaacacauuuuucu

SEQ ID NO: 3311026 - RNA, 13 nt, Human
aaaacacauuuuu

SEQ ID NO: 3311027 - RNA, 13 nt, Human
aaaauucagugga

SEQ ID NO: 3311028 - RNA, 18 nt, Human
aaacacuguucucugccc

SEQ ID NO: 3311029 - RNA, 22 nt, Human
aaacacuguucucugcccucca

SEQ ID NO: 3311030 - RNA, 19 nt, Human
aaacacuguucucugcccu

SEQ ID NO: 3311031 - RNA, 14 nt, Human
acuggaagcacagc

SEQ ID NO: 3311032 - RNA, 15 nt, Human
acuggaagcacagcu

SEQ ID NO: 3311033 - RNA, 12 nt, Human
acugucuucagu

SEQ ID NO: 3311034 - RNA, 18 nt, Human
acuucugccauauucugu

SEQ ID NO: 3311035 - RNA, 19 nt, Human
acuucacauauugauuucc

SEQ ID NO: 3311036 - RNA, 23 nt, Human
agaaaauggacguguuaugacuc

SEQ ID NO: 3311037 - RNA, 22 nt, Human
agaaaauggacguguuaugacu

SEQ ID NO: 3311038 - RNA, 20 nt, Human
agaaaauggacguguuauga

SEQ ID NO: 3311039 - RNA, 15 nt, Human
agaaaauggacgugu

SEQ ID NO: 3311040 - RNA, 23 nt, Human
agaaaauggaagacagcucuuau

SEQ ID NO: 3311041 - RNA, 22 nt, Human
acuuuuauaaacuuuaccuuuu

SEQ ID NO: 3311042 - RNA, 19 nt, Human
acuuuuauaaacuuuaccu

SEQ ID NO: 3311043 - RNA, 15 nt, Human
acuuuuauaaacuuu

SEQ ID NO: 3311044 - RNA, 23 nt, Human
acuuuguucuggcucuuccaggc

SEQ ID NO: 3311045 - RNA, 20 nt, Human
acuuuguucuggcucuucca

SEQ ID NO: 3311046 - RNA, 21 nt, Human
acuuuccucuuuggucuacac

SEQ ID NO: 3311047 - RNA, 23 nt, Human
acuuuccuucauucaacccaccu

SEQ ID NO: 3311048 - RNA, 20 nt, Human
agaaaggaggggauagagag

SEQ ID NO: 3311049 - RNA, 23 nt, Human
agaaaggaggggauagagagaga

SEQ ID NO: 3311050 - RNA, 15 nt, Human
agaaauaaaguuucu

SEQ ID NO: 3311051 - RNA, 18 nt, Human
agaaauaaaguuucuguu

SEQ ID NO: 3311052 - RNA, 14 nt, Human
acucuaucaaguau

SEQ ID NO: 3311053 - RNA, 20 nt, Human
acucuggcagcucagagagg

SEQ ID NO: 3311054 - RNA, 16 nt, Human
acucuaucaaguauua

SEQ ID NO: 3311055 - RNA, 18 nt, Human
acucuuaaaacccaagug

SEQ ID NO: 3311056 - RNA, 11 nt, Human
acucuuaaaac

SEQ ID NO: 3311057 - RNA, 16 nt, Human
acucugugucaggugg

SEQ ID NO: 3311058 - RNA, 18 nt, Human
acucuacccucuuagaaa

SEQ ID NO: 3311059 - RNA, 13 nt, Human
acucuacccucuu

SEQ ID NO: 3311060 - RNA, 21 nt, Human
acucuacccucuuagaaaaac

SEQ ID NO: 3311061 - RNA, 14 nt, Human
acucccccaggugg

SEQ ID NO: 3311062 - RNA, 17 nt, Human
acuccccugcugggugu

SEQ ID NO: 3311063 - RNA, 13 nt, Human
acuccccugcugg

SEQ ID NO: 3311064 - RNA, 18 nt, Human
acucaaaagcugggcagg

SEQ ID NO: 3311065 - RNA, 16 nt, Human
acucaaacucuuaaaa

SEQ ID NO: 3311066 - RNA, 17 nt, Human
acucaaacucuuaaaac

SEQ ID NO: 3311067 - RNA, 15 nt, Human
acgcugugcugcccu

SEQ ID NO: 3311068 - RNA, 17 nt, Human
acgcugugcugcccugc

SEQ ID NO: 3311069 - RNA, 16 nt, Human
acgcugugcugcccug

SEQ ID NO: 3311070 - RNA, 18 nt, Human
acgcugugcugcccugcc

SEQ ID NO: 3311071 - RNA, 11 nt, Human
acguggcugcu

SEQ ID NO: 3311072 - RNA, 15 nt, Human
acguggcugcuucaa

SEQ ID NO: 3311073 - RNA, 14 nt, Human
acguggcugcuuca

SEQ ID NO: 3311074 - RNA, 13 nt, Human
acguggcugcuuc

SEQ ID NO: 3311075 - RNA, 22 nt, Human
acuaaguuuuuauggcuuuugu

SEQ ID NO: 3311076 - RNA, 15 nt, Human
acuaaguuuuuaugg

SEQ ID NO: 3311077 - RNA, 13 nt, Human
acgauuucuguuu

SEQ ID NO: 3311078 - RNA, 12 nt, Human
acgauuucuguu

SEQ ID NO: 3311079 - RNA, 18 nt, Human
acgccacugcacuauagc

SEQ ID NO: 3311080 - RNA, 17 nt, Human
acgauuucuguuuagau

SEQ ID NO: 3311081 - RNA, 14 nt, Human
acgauuucuguuua

SEQ ID NO: 3311082 - RNA, 20 nt, Human
accugccccucaacucuccu

SEQ ID NO: 3311083 - RNA, 23 nt, Human
accugccccucaacucuccucca

SEQ ID NO: 3311084 - RNA, 21 nt, Human
accucugcacaagcugcaccc

SEQ ID NO: 3311085 - RNA, 18 nt, Human
accucugcacaagcugca

SEQ ID NO: 3311086 - RNA, 16 nt, Human
accucugcacaagcug

SEQ ID NO: 3311087 - RNA, 23 nt, Human
accuuucaauaggaaaaacugau

SEQ ID NO: 3311088 - RNA, 21 nt, Human
accuuucaauaggaaaaacug

SEQ ID NO: 3311089 - RNA, 17 nt, Human
accuuucaauaggaaaa

SEQ ID NO: 3311090 - RNA, 16 nt, Human
accuuucaauaggaaa

SEQ ID NO: 3311091 - RNA, 12 nt, Human
accuuggcucaa

SEQ ID NO: 3311092 - RNA, 14 nt, Human
accuuggcucaagu

SEQ ID NO: 3311093 - RNA, 12 nt, Human
accuuggcugca

SEQ ID NO: 3311094 - RNA, 23 nt, Human
acagcuccuucuguccuacucug

SEQ ID NO: 3311095 - RNA, 23 nt, Human
acagcugccugggaucccucauc

SEQ ID NO: 3311096 - RNA, 13 nt, Human
acagcugccuggg

SEQ ID NO: 3311097 - RNA, 14 nt, Human
acagcugccuggga

SEQ ID NO: 3311098 - RNA, 12 nt, Human
acagcuccuucu

SEQ ID NO: 3311099 - RNA, 13 nt, Human
acagcuccuucug

SEQ ID NO: 3311100 - RNA, 14 nt, Human
acagcuccuucugu

SEQ ID NO: 3311101 - RNA, 19 nt, Human
acaggugugaaccaccaca

SEQ ID NO: 3311102 - RNA, 20 nt, Human
acaggugugaaccaccacac

SEQ ID NO: 3311103 - RNA, 23 nt, Human
acaggugugaaccaccacaccca

SEQ ID NO: 3311104 - RNA, 18 nt, Human
acaggcaagcaccuccug

SEQ ID NO: 3311105 - RNA, 15 nt, Human
acaggcaagcaccuc

SEQ ID NO: 3311106 - RNA, 16 nt, Human
acaggcaagcaccucc

SEQ ID NO: 3311107 - RNA, 21 nt, Human
acagaggggguggccucccaa

SEQ ID NO: 3311108 - RNA, 22 nt, Human
acagaggggguggccucccaac

SEQ ID NO: 3311109 - RNA, 12 nt, Human
acagagucucac

SEQ ID NO: 3311110 - RNA, 14 nt, Human
acagagucucacug

SEQ ID NO: 3311111 - RNA, 17 nt, Human
acagagucucacuguug

SEQ ID NO: 3311112 - RNA, 19 nt, Human
acagagucucacuguugcc

SEQ ID NO: 3311113 - RNA, 19 nt, Human
acagccacggccaggccag

SEQ ID NO: 3311114 - RNA, 15 nt, Human
acagccaugauucuu

SEQ ID NO: 3311115 - RNA, 13 nt, Human
acaaagacugagu

SEQ ID NO: 3311116 - RNA, 21 nt, Human
acaaaccuguuucugcagcca

SEQ ID NO: 3311117 - RNA, 15 nt, Human
acaaacgggcucagc

SEQ ID NO: 3311118 - RNA, 15 nt, Human
acacggacacucaaa

SEQ ID NO: 3311119 - RNA, 14 nt, Human
acacuaaccacgcu

SEQ ID NO: 3311120 - RNA, 11 nt, Human
acacagcucug

SEQ ID NO: 3311121 - RNA, 12 nt, Human
acacagcucugu

SEQ ID NO: 3311122 - RNA, 12 nt, Human
acaccagagccc

SEQ ID NO: 3311123 - RNA, 21 nt, Human
acaccacuacauucuguuaau

SEQ ID NO: 3311124 - RNA, 14 nt, Human
acaauuuauuaugg

SEQ ID NO: 3311125 - RNA, 16 nt, Human
acaauuuauuauggca

SEQ ID NO: 3311126 - RNA, 15 nt, Human
acaauuuauuauggc

SEQ ID NO: 3311127 - RNA, 18 nt, Human
acacaaacgggcucagca

SEQ ID NO: 3311128 - RNA, 21 nt, Human
acauguuuuucuucucccuca

SEQ ID NO: 3311129 - RNA, 20 nt, Human
acaugcacagcuaacaugga

SEQ ID NO: 3311130 - RNA, 18 nt, Human
acaugcaaggucauuuuu

SEQ ID NO: 3311131 - RNA, 19 nt, Human
acaugcaaggucauuuuuu

SEQ ID NO: 3311132 - RNA, 19 nt, Human
acauguuuuucuucucccu

SEQ ID NO: 3311133 - RNA, 23 nt, Human
acauaaacaagaccacguuucua

SEQ ID NO: 3311134 - RNA, 19 nt, Human
acaucagcacgauuucugu

SEQ ID NO: 3311135 - RNA, 22 nt, Human
acaucagcacgauuucuguuua

SEQ ID NO: 3311136 - RNA, 21 nt, Human
acaucagcacgauuucuguuu

SEQ ID NO: 3311137 - RNA, 20 nt, Human
acaucagcacgauuucuguu

SEQ ID NO: 3311138 - RNA, 21 nt, Human
accaacgucugugccauuuug

SEQ ID NO: 3311139 - RNA, 17 nt, Human
accagcagccuggaccc

SEQ ID NO: 3311140 - RNA, 14 nt, Human
accagcagccugga

SEQ ID NO: 3311141 - RNA, 13 nt, Human
accagcagccugg

SEQ ID NO: 3311142 - RNA, 14 nt, Human
accacuacauucug

SEQ ID NO: 3311143 - RNA, 19 nt, Human
accacguuucuaaaggcua

SEQ ID NO: 3311144 - RNA, 15 nt, Human
accacguuucuaaag

SEQ ID NO: 3311145 - RNA, 15 nt, Human
accccggccaccugc

SEQ ID NO: 3311146 - RNA, 23 nt, Human
acccaagggccuggccugagcug

SEQ ID NO: 3311147 - RNA, 16 nt, Human
acccaagggccuggcc

SEQ ID NO: 3311148 - RNA, 13 nt, Human
acccaagggccug

SEQ ID NO: 3311149 - RNA, 16 nt, Human
acccaugcugcccugu

SEQ ID NO: 3311150 - RNA, 19 nt, Human
acccaugcugcccugugag

SEQ ID NO: 3311151 - RNA, 18 nt, Human
acccaugcugcccuguga

SEQ ID NO: 3311152 - RNA, 17 nt, Human
acccaugcugcccugug

SEQ ID NO: 3311153 - RNA, 22 nt, Human
accaucccugaaggccccgccc

SEQ ID NO: 3311154 - RNA, 21 nt, Human
accaucccugaaggccccgcc

SEQ ID NO: 3311155 - RNA, 16 nt, Human
accaucaugucuggcu

SEQ ID NO: 3311156 - RNA, 17 nt, Human
accaucaugucuggcua

SEQ ID NO: 3311157 - RNA, 16 nt, Human
accaucccugaaggcc

SEQ ID NO: 3311158 - RNA, 18 nt, Human
accaucccugaaggcccc

SEQ ID NO: 3311159 - RNA, 14 nt, Human
accaucaugucugg

SEQ ID NO: 3311160 - RNA, 18 nt, Human
agccucccaaagugcugg

SEQ ID NO: 3311161 - RNA, 19 nt, Human
agccucccaaagugcuggg

SEQ ID NO: 3311162 - RNA, 21 nt, Human
agccgagaucacgccacugca

SEQ ID NO: 3311163 - RNA, 19 nt, Human
agccgagauugcaccacug

SEQ ID NO: 3311164 - RNA, 20 nt, Human
agccgagauugcaccacugc

SEQ ID NO: 3311165 - RNA, 18 nt, Human
agccgagaucacgccacu

SEQ ID NO: 3311166 - RNA, 22 nt, Human
agccgcuggggccaguuggucc

SEQ ID NO: 3311167 - RNA, 14 nt, Human
agccgcuggggcca

SEQ ID NO: 3311168 - RNA, 22 nt, Human
agccucccgaguagcugggacu

SEQ ID NO: 3311169 - RNA, 17 nt, Human
agccucccaaagugcug

SEQ ID NO: 3311170 - RNA, 18 nt, Human
agccucccgaauagcugg

SEQ ID NO: 3311171 - RNA, 19 nt, Human
agccucccgaauagcuggg

SEQ ID NO: 3311172 - RNA, 20 nt, Human
agccucccgaauagcuggga

SEQ ID NO: 3311173 - RNA, 22 nt, Human
agccucccgaauagcugggacu

SEQ ID NO: 3311174 - RNA, 17 nt, Human
agccucccgaguagcug

SEQ ID NO: 3311175 - RNA, 16 nt, Human
agccccagugcccaca

SEQ ID NO: 3311176 - RNA, 20 nt, Human
agccccaucccaaacccuuc

SEQ ID NO: 3311177 - RNA, 15 nt, Human
agcccugagcuuucu

SEQ ID NO: 3311178 - RNA, 19 nt, Human
agccgagaucacgccacug

SEQ ID NO: 3311179 - RNA, 20 nt, Human
agccgagaucacgccacugc

SEQ ID NO: 3311180 - RNA, 15 nt, Human
agcagccacauuccu

SEQ ID NO: 3311181 - RNA, 21 nt, Human
agcagccacauuccugaugcu

SEQ ID NO: 3311182 - RNA, 19 nt, Human
agcacuaaggugugcucug

SEQ ID NO: 3311183 - RNA, 22 nt, Human
agccagauuucacucuccuugg

SEQ ID NO: 3311184 - RNA, 20 nt, Human
agccagaggagagaggaccc

SEQ ID NO: 3311185 - RNA, 18 nt, Human
agccagaggagagaggac

SEQ ID NO: 3311186 - RNA, 20 nt, Human
agccaaggccaaaggaagca

SEQ ID NO: 3311187 - RNA, 22 nt, Human
agccaaggccaaaggaagcaca

SEQ ID NO: 3311188 - RNA, 23 nt, Human
agccaaggccaaaggaagcacau

SEQ ID NO: 3311189 - RNA, 18 nt, Human
agccaaagcuaggccugg

SEQ ID NO: 3311190 - RNA, 19 nt, Human
agccaaagcuaggccuggc

SEQ ID NO: 3311191 - RNA, 20 nt, Human
agccaaagcuaggccuggcc

SEQ ID NO: 3311192 - RNA, 12 nt, Human
agcaugccugga

SEQ ID NO: 3311193 - RNA, 19 nt, Human
agacggagucccaccuugg

SEQ ID NO: 3311194 - RNA, 18 nt, Human
agacggagucccaccuug

SEQ ID NO: 3311195 - RNA, 16 nt, Human
agacagcccgggcucu

SEQ ID NO: 3311196 - RNA, 17 nt, Human
agacagcccgggcucug

SEQ ID NO: 3311197 - RNA, 20 nt, Human
agacagcccgggcucugccu

SEQ ID NO: 3311198 - RNA, 18 nt, Human
agacagcccgggcucugc

SEQ ID NO: 3311199 - RNA, 21 nt, Human
agaccaucccugaaggccccg

SEQ ID NO: 3311200 - RNA, 18 nt, Human
agaccaucccugaaggcc

SEQ ID NO: 3311201 - RNA, 17 nt, Human
agaccaucccugaaggc

SEQ ID NO: 3311202 - RNA, 14 nt, Human
agaccaucccugaa

SEQ ID NO: 3311203 - RNA, 13 nt, Human
agaccaucccuga

SEQ ID NO: 3311204 - RNA, 17 nt, Human
agacaaugacuuacugu

SEQ ID NO: 3311205 - RNA, 13 nt, Human
agacaaugacuua

SEQ ID NO: 3311206 - RNA, 21 nt, Human
agacaauuuauuauggcacau

SEQ ID NO: 3311207 - RNA, 15 nt, Human
agacaauuuauuaug

SEQ ID NO: 3311208 - RNA, 14 nt, Human
agacaauuuauuau

SEQ ID NO: 3311209 - RNA, 21 nt, Human
agagaagagauugugguuuca

SEQ ID NO: 3311210 - RNA, 10 nt, Human
agagaagaga

SEQ ID NO: 3311211 - RNA, 23 nt, Human
agagaggguggugaccucugccu

SEQ ID NO: 3311212 - RNA, 23 nt, Human
agacugaguacguugugcauuug

SEQ ID NO: 3311213 - RNA, 23 nt, Human
agaggguggugaccucugccuga

SEQ ID NO: 3311214 - RNA, 13 nt, Human
agauagccaaggc

SEQ ID NO: 3311215 - RNA, 22 nt, Human
agauacuuggggggcugaggug

SEQ ID NO: 3311216 - RNA, 13 nt, Human
agaggagaggggc

SEQ ID NO: 3311217 - RNA, 16 nt, Human
agaggggaagagacuu

SEQ ID NO: 3311218 - RNA, 22 nt, Human
agaggggaacagacuggaagca

SEQ ID NO: 3311219 - RNA, 16 nt, Human
agauagccaaggccaa

SEQ ID NO: 3311220 - RNA, 15 nt, Human
agauagccaaggcca

SEQ ID NO: 3311221 - RNA, 20 nt, Human
aggauguucugggacacagu

SEQ ID NO: 3311222 - RNA, 18 nt, Human
aggauguucugggacaca

SEQ ID NO: 3311223 - RNA, 17 nt, Human
aggaggggauagagaga

SEQ ID NO: 3311224 - RNA, 12 nt, Human
aggauucuuccu

SEQ ID NO: 3311225 - RNA, 20 nt, Human
aggaccccuccaugugggcu

SEQ ID NO: 3311226 - RNA, 20 nt, Human
aggaccucaggugagaagca

SEQ ID NO: 3311227 - RNA, 14 nt, Human
aggaccucagguga

SEQ ID NO: 3311228 - RNA, 15 nt, Human
aggagagcuagcagc

SEQ ID NO: 3311229 - RNA, 16 nt, Human
aggagaggggcacagg

SEQ ID NO: 3311230 - RNA, 14 nt, Human
aggagaggggcaca

SEQ ID NO: 3311231 - RNA, 18 nt, Human
aggagaggggcacagggu

SEQ ID NO: 3311232 - RNA, 15 nt, Human
aggaaaaacugauuu

SEQ ID NO: 3311233 - RNA, 13 nt, Human
aggaaaaacugau

SEQ ID NO: 3311234 - RNA, 17 nt, Human
agcugggugucaagagg

SEQ ID NO: 3311235 - RNA, 22 nt, Human
agcugggugucaagagggucug

SEQ ID NO: 3311236 - RNA, 21 nt, Human
agcuggucccacucaguccau

SEQ ID NO: 3311237 - RNA, 19 nt, Human
agcuggucccacucagucc

SEQ ID NO: 3311238 - RNA, 23 nt, Human
aggcuagugugguguuuccuggc

SEQ ID NO: 3311239 - RNA, 17 nt, Human
agggacgcuacccggga

SEQ ID NO: 3311240 - RNA, 21 nt, Human
agggacgcuacccgggaaggg

SEQ ID NO: 3311241 - RNA, 13 nt, Human
agggacagagggg

SEQ ID NO: 3311242 - RNA, 12 nt, Human
agggacagaggg

SEQ ID NO: 3311243 - RNA, 18 nt, Human
aggcugccucucccauca

SEQ ID NO: 3311244 - RNA, 17 nt, Human
agggcacaccgggcacu

SEQ ID NO: 3311245 - RNA, 20 nt, Human
agggcacaccgggcacucag

SEQ ID NO: 3311246 - RNA, 21 nt, Human
agggcacaccgggcacucaga

SEQ ID NO: 3311247 - RNA, 22 nt, Human
agggcacagaaaauggaagaca

SEQ ID NO: 3311248 - RNA, 17 nt, Human
agggccuggccugagcu

SEQ ID NO: 3311249 - RNA, 16 nt, Human
agggccuggccugagc

SEQ ID NO: 3311250 - RNA, 15 nt, Human
agggccuggccugag

SEQ ID NO: 3311251 - RNA, 14 nt, Human
agggccuggccuga

SEQ ID NO: 3311252 - RNA, 19 nt, Human
agggcgggaggauguucug

SEQ ID NO: 3311253 - RNA, 16 nt, Human
aggggauagagagaga

SEQ ID NO: 3311254 - RNA, 21 nt, Human
aggggauagagagagaccacu

SEQ ID NO: 3311255 - RNA, 15 nt, Human
aggggcacagggucu

SEQ ID NO: 3311256 - RNA, 17 nt, Human
aggugcugccauccagg

SEQ ID NO: 3311257 - RNA, 16 nt, Human
aggugcugccauccag

SEQ ID NO: 3311258 - RNA, 14 nt, Human
aggucgaggcagga

SEQ ID NO: 3311259 - RNA, 14 nt, Human
agguuaauguucau

SEQ ID NO: 3311260 - RNA, 17 nt, Human
agguucaaagauauuuu

SEQ ID NO: 3311261 - RNA, 15 nt, Human
agguucaaagauauu

SEQ ID NO: 3311262 - RNA, 15 nt, Human
agguuaauaaaguaa

SEQ ID NO: 3311263 - RNA, 13 nt, Human
agguucagcuugu

SEQ ID NO: 3311264 - RNA, 17 nt, Human
agguaaggaauaccugu

SEQ ID NO: 3311265 - RNA, 22 nt, Human
auaugccugggcagaaggaaga

SEQ ID NO: 3311266 - RNA, 19 nt, Human
auaugcuuauacacuuaca

SEQ ID NO: 3311267 - RNA, 14 nt, Human
auaugcuuauacac

SEQ ID NO: 3311268 - RNA, 16 nt, Human
auaugcuuauacacuu

SEQ ID NO: 3311269 - RNA, 13 nt, Human
auauucaggaagc

SEQ ID NO: 3311270 - RNA, 16 nt, Human
auauucaggaagcuca

SEQ ID NO: 3311271 - RNA, 14 nt, Human
auauucaggaagcu

SEQ ID NO: 3311272 - RNA, 15 nt, Human
auaguaugguggcug

SEQ ID NO: 3311273 - RNA, 12 nt, Human
auaccugucccc

SEQ ID NO: 3311274 - RNA, 21 nt, Human
auaaugugaaacuggauuaaa

SEQ ID NO: 3311275 - RNA, 19 nt, Human
auaaugugaaacuggauua

SEQ ID NO: 3311276 - RNA, 18 nt, Human
auaaugugaaacuggauu

SEQ ID NO: 3311277 - RNA, 23 nt, Human
agugugacaaggauugcuacugu

SEQ ID NO: 3311278 - RNA, 18 nt, Human
aguuacagacaaagcgug

SEQ ID NO: 3311279 - RNA, 17 nt, Human
aguuacagacaaagcgu

SEQ ID NO: 3311280 - RNA, 16 nt, Human
aguuguuacauuuuua

SEQ ID NO: 3311281 - RNA, 15 nt, Human
aguuguuacauuuuu

SEQ ID NO: 3311282 - RNA, 13 nt, Human
aguuguuacauuu

SEQ ID NO: 3311283 - RNA, 16 nt, Human
agucaagugaaaaagg

SEQ ID NO: 3311284 - RNA, 20 nt, Human
agucaagugaaaaaggagga

SEQ ID NO: 3311285 - RNA, 20 nt, Human
augugggcuaguugggcuuc

SEQ ID NO: 3311286 - RNA, 14 nt, Human
auguguaaguauuc

SEQ ID NO: 3311287 - RNA, 11 nt, Human
auuaaauuaug

SEQ ID NO: 3311288 - RNA, 16 nt, Human
auuaaaugcccagccc

SEQ ID NO: 3311289 - RNA, 13 nt, Human
auuaaauucuugc

SEQ ID NO: 3311290 - RNA, 15 nt, Human
auuaaaugcccagcc

SEQ ID NO: 3311291 - RNA, 14 nt, Human
auuaaaugcccagc

SEQ ID NO: 3311292 - RNA, 16 nt, Human
auguuuuaagaggcag

SEQ ID NO: 3311293 - RNA, 18 nt, Human
auguuuuaagaggcaggg

SEQ ID NO: 3311294 - RNA, 18 nt, Human
auguucucugaggacacu

SEQ ID NO: 3311295 - RNA, 17 nt, Human
auguucucugaggacac

SEQ ID NO: 3311296 - RNA, 20 nt, Human
auguucuuaguggauguucu

SEQ ID NO: 3311297 - RNA, 15 nt, Human
auguucuuaauucuu

SEQ ID NO: 3311298 - RNA, 22 nt, Human
auguucugacccugcuucaaau

SEQ ID NO: 3311299 - RNA, 14 nt, Human
auguucuuaauucu

SEQ ID NO: 3311300 - RNA, 17 nt, Human
auguaagcucuacugag

SEQ ID NO: 3311301 - RNA, 15 nt, Human
auggucggaaaacau

SEQ ID NO: 3311302 - RNA, 15 nt, Human
augucacaggcaggu

SEQ ID NO: 3311303 - RNA, 14 nt, Human
augucacaggcagg

SEQ ID NO: 3311304 - RNA, 16 nt, Human
augucacaggcagguc

SEQ ID NO: 3311305 - RNA, 20 nt, Human
auggaaaugggcagagcaga

SEQ ID NO: 3311306 - RNA, 19 nt, Human
auggaaaugggcagagcag

SEQ ID NO: 3311307 - RNA, 22 nt, Human
augcuucuucagagacuccugc

SEQ ID NO: 3311308 - RNA, 15 nt, Human
augggaaugaauguc

SEQ ID NO: 3311309 - RNA, 23 nt, Human
auggcugccaaugggagcucaug

SEQ ID NO: 3311310 - RNA, 21 nt, Human
augcacagcuaacauggaagu

SEQ ID NO: 3311311 - RNA, 14 nt, Human
augcacagcuaaca

SEQ ID NO: 3311312 - RNA, 23 nt, Human
augcacagaguuguuacauuuuu

SEQ ID NO: 3311313 - RNA, 22 nt, Human
augcacacauuuuuuaaaugca

SEQ ID NO: 3311314 - RNA, 19 nt, Human
augcacacauuuuuuaaau

SEQ ID NO: 3311315 - RNA, 17 nt, Human
augcacacauuuuuuaa

SEQ ID NO: 3311316 - RNA, 23 nt, Human
augcaugaaguaauaugcacaca

SEQ ID NO: 3311317 - RNA, 20 nt, Human
augcaugaaguaauaugcac

SEQ ID NO: 3311318 - RNA, 12 nt, Human
augcauuugaaa

SEQ ID NO: 3311319 - RNA, 10 nt, Human
augcauuuga

SEQ ID NO: 3311320 - RNA, 18 nt, Human
augcauuugaaaauuuug

SEQ ID NO: 3311321 - RNA, 15 nt, Human
augccugguggcagc

SEQ ID NO: 3311322 - RNA, 16 nt, Human
augccugguggcagcu

SEQ ID NO: 3311323 - RNA, 17 nt, Human
augccugguggcagcug

SEQ ID NO: 3311324 - RNA, 17 nt, Human
augccugggcagaagga

SEQ ID NO: 3311325 - RNA, 14 nt, Human
augccugguggcag

SEQ ID NO: 3311326 - RNA, 23 nt, Human
augccuggauggggcugcaccgg

SEQ ID NO: 3311327 - RNA, 21 nt, Human
augccuggauggggcugcacc

SEQ ID NO: 3311328 - RNA, 13 nt, Human
aucgaugcagugc

SEQ ID NO: 3311329 - RNA, 11 nt, Human
auccuccucag

SEQ ID NO: 3311330 - RNA, 22 nt, Human
auccuccaggugcacaagcucc

SEQ ID NO: 3311331 - RNA, 19 nt, Human
auccuccaggugcacaagc

SEQ ID NO: 3311332 - RNA, 14 nt, Human
auccuccaggugca

SEQ ID NO: 3311333 - RNA, 13 nt, Human
auccuccaggugc

SEQ ID NO: 3311334 - RNA, 15 nt, Human
aucccuacuguaauu

SEQ ID NO: 3311335 - RNA, 22 nt, Human
auccucauacccacccccaccc

SEQ ID NO: 3311336 - RNA, 19 nt, Human
auccucauacccaccccca

SEQ ID NO: 3311337 - RNA, 17 nt, Human
auccucauacccacccc

SEQ ID NO: 3311338 - RNA, 18 nt, Human
auccucauacccaccccc

SEQ ID NO: 3311339 - RNA, 18 nt, Human
auccacccaccucagccu

SEQ ID NO: 3311340 - RNA, 20 nt, Human
auccacccaccucagccucc

SEQ ID NO: 3311341 - RNA, 16 nt, Human
auccacccaccucagc

SEQ ID NO: 3311342 - RNA, 19 nt, Human
aucauggagguuugaagau

SEQ ID NO: 3311343 - RNA, 20 nt, Human
aucagccugcuccagcuguu

SEQ ID NO: 3311344 - RNA, 13 nt, Human
aucagcugcuacu

SEQ ID NO: 3311345 - RNA, 23 nt, Human
aucagcugcuacuacuccuguag

SEQ ID NO: 3311346 - RNA, 12 nt, Human
aucagcugcuac

SEQ ID NO: 3311347 - RNA, 21 nt, Human
aucagccugggcaaugugaua

SEQ ID NO: 3311348 - RNA, 20 nt, Human
aucagccugggcaaugugau

SEQ ID NO: 3311349 - RNA, 11 nt, Human
aucagccuggg

SEQ ID NO: 3311350 - RNA, 12 nt, Human
augagccuggca

SEQ ID NO: 3311351 - RNA, 17 nt, Human
augacuccagaauuucc

SEQ ID NO: 3311352 - RNA, 16 nt, Human
augacuccagaauuuc

SEQ ID NO: 3311353 - RNA, 12 nt, Human
augacuccagaa

SEQ ID NO: 3311354 - RNA, 12 nt, Human
augacccagugg

SEQ ID NO: 3311355 - RNA, 14 nt, Human
augagccuggcaag

SEQ ID NO: 3311356 - RNA, 13 nt, Human
augagccuggcaa

SEQ ID NO: 3311357 - RNA, 19 nt, Human
aucuuccaacucaaacucu

SEQ ID NO: 3311358 - RNA, 22 nt, Human
aucucucgugauugauaagaac

SEQ ID NO: 3311359 - RNA, 17 nt, Human
aucuucuuuauaauucu

SEQ ID NO: 3311360 - RNA, 14 nt, Human
aucuucuuuauaau

SEQ ID NO: 3311361 - RNA, 17 nt, Human
aucuugaagacuuuucu

SEQ ID NO: 3311362 - RNA, 17 nt, Human
caaaauaaaaaugaggu

SEQ ID NO: 3311363 - RNA, 22 nt, Human
caaaacucuccucugcugcugg

SEQ ID NO: 3311364 - RNA, 21 nt, Human
caaaacucuccucugcugcug

SEQ ID NO: 3311365 - RNA, 20 nt, Human
caaaacucuccucugcugcu

SEQ ID NO: 3311366 - RNA, 19 nt, Human
caaaacucuccucugcugc

SEQ ID NO: 3311367 - RNA, 21 nt, Human
auuuugggguacccacugcuc

SEQ ID NO: 3311368 - RNA, 22 nt, Human
auuuugggguacccacugcucu

SEQ ID NO: 3311369 - RNA, 23 nt, Human
auuuugggguacccacugcucug

SEQ ID NO: 3311370 - RNA, 16 nt, Human
caaaaaaugcuugcuu

SEQ ID NO: 3311371 - RNA, 20 nt, Human
caaaaacauggccuuugcuu

SEQ ID NO: 3311372 - RNA, 13 nt, Human
caaaaaggcagga

SEQ ID NO: 3311373 - RNA, 13 nt, Human
caaaggaagcaca

SEQ ID NO: 3311374 - RNA, 12 nt, Human
caaaggaagcac

SEQ ID NO: 3311375 - RNA, 13 nt, Human
caaagcuaggccu

SEQ ID NO: 3311376 - RNA, 14 nt, Human
caaagcuaggccug

SEQ ID NO: 3311377 - RNA, 19 nt, Human
caaagcuaggccuggccag

SEQ ID NO: 3311378 - RNA, 18 nt, Human
caaagcuaggccuggcca

SEQ ID NO: 3311379 - RNA, 14 nt, Human
caaaggaagcacau

SEQ ID NO: 3311380 - RNA, 16 nt, Human
caaaggguaucaggug

SEQ ID NO: 3311381 - RNA, 18 nt, Human
caaaggguaucaggugcu

SEQ ID NO: 3311382 - RNA, 17 nt, Human
caaacucaccugccccu

SEQ ID NO: 3311383 - RNA, 22 nt, Human
caaagccaaagcuaggccuggc

SEQ ID NO: 3311384 - RNA, 18 nt, Human
caaagccuccuccagccg

SEQ ID NO: 3311385 - RNA, 17 nt, Human
caaagccuccuccagcc

SEQ ID NO: 3311386 - RNA, 15 nt, Human
caaaauguaggguua

SEQ ID NO: 3311387 - RNA, 12 nt, Human
caaaauaaaacu

SEQ ID NO: 3311388 - RNA, 15 nt, Human
caaacacauacagga

SEQ ID NO: 3311389 - RNA, 20 nt, Human
caaacccuucagugccaaaa

SEQ ID NO: 3311390 - RNA, 14 nt, Human
caaacccuucagug

SEQ ID NO: 3311391 - RNA, 23 nt, Human
caaagugcugggauuacaggugu

SEQ ID NO: 3311392 - RNA, 19 nt, Human
caaagugcugggauuacag

SEQ ID NO: 3311393 - RNA, 11 nt, Human
caaauuucuaa

SEQ ID NO: 3311394 - RNA, 12 nt, Human
caaauuucuaaa

SEQ ID NO: 3311395 - RNA, 17 nt, Human
caaugcacuuuguucug

SEQ ID NO: 3311396 - RNA, 15 nt, Human
caaugggagcucaug

SEQ ID NO: 3311397 - RNA, 21 nt, Human
caaugcacuuuguucuggcuc

SEQ ID NO: 3311398 - RNA, 20 nt, Human
caaugcacuuuguucuggcu

SEQ ID NO: 3311399 - RNA, 23 nt, Human
caauucucauuugucacacacuu

SEQ ID NO: 3311400 - RNA, 16 nt, Human
caauuacaggaaguac

SEQ ID NO: 3311401 - RNA, 17 nt, Human
caaugugauaaaacccc

SEQ ID NO: 3311402 - RNA, 15 nt, Human
caaugugauaaaacc

SEQ ID NO: 3311403 - RNA, 13 nt, Human
caauaggaaaaac

SEQ ID NO: 3311404 - RNA, 12 nt, Human
caauaggaaaaa

SEQ ID NO: 3311405 - RNA, 23 nt, Human
caaugaccuuucaauaggaaaaa

SEQ ID NO: 3311406 - RNA, 21 nt, Human
caaugaccuuucaauaggaaa

SEQ ID NO: 3311407 - RNA, 15 nt, Human
caaugacuuacugua

SEQ ID NO: 3311408 - RNA, 18 nt, Human
caaugacuuacuguacau

SEQ ID NO: 3311409 - RNA, 17 nt, Human
caaugacuuacuguaca

SEQ ID NO: 3311410 - RNA, 17 nt, Human
caauauucgcuguguca

SEQ ID NO: 3311411 - RNA, 17 nt, Human
caagcuggucccacuca

SEQ ID NO: 3311412 - RNA, 19 nt, Human
caagcuggucccacucagu

SEQ ID NO: 3311413 - RNA, 22 nt, Human
caagccaccaacauacucccau

SEQ ID NO: 3311414 - RNA, 18 nt, Human
caagcaggacauggacaa

SEQ ID NO: 3311415 - RNA, 14 nt, Human
caagcaggacaugg

SEQ ID NO: 3311416 - RNA, 14 nt, Human
caagcaccuccugc

SEQ ID NO: 3311417 - RNA, 20 nt, Human
caagcgauucuucugcuuca

SEQ ID NO: 3311418 - RNA, 22 nt, Human
caagcgauucuucugcuucagc

SEQ ID NO: 3311419 - RNA, 19 nt, Human
caagcgauucuucugcuuc

SEQ ID NO: 3311420 - RNA, 18 nt, Human
caagugagagcugggugu

SEQ ID NO: 3311421 - RNA, 19 nt, Human
caagugagacccugucuca

SEQ ID NO: 3311422 - RNA, 21 nt, Human
caaguccucuuuucugagagg

SEQ ID NO: 3311423 - RNA, 14 nt, Human
caagugagagcugg

SEQ ID NO: 3311424 - RNA, 15 nt, Human
caagugagagcuggg

SEQ ID NO: 3311425 - RNA, 17 nt, Human
caagugagagcugggug

SEQ ID NO: 3311426 - RNA, 14 nt, Human
caaguuaaauaaau

SEQ ID NO: 3311427 - RNA, 13 nt, Human
caaggucauuuuu

SEQ ID NO: 3311428 - RNA, 20 nt, Human
caaggucauuuuuuuuaaga

SEQ ID NO: 3311429 - RNA, 14 nt, Human
caaggucauuuuuu

SEQ ID NO: 3311430 - RNA, 14 nt, Human
caaguccucuuuuc

SEQ ID NO: 3311431 - RNA, 21 nt, Human
caaggcugucaauuacaggaa

SEQ ID NO: 3311432 - RNA, 23 nt, Human
caaggcugucaauuacaggaagu

SEQ ID NO: 3311433 - RNA, 12 nt, Human
caaggcugcagu

SEQ ID NO: 3311434 - RNA, 17 nt, Human
caaggggcccaaauucu

SEQ ID NO: 3311435 - RNA, 18 nt, Human
caaggggcccaaauucuu

SEQ ID NO: 3311436 - RNA, 22 nt, Human
caaccccuucgcuccugugucu

SEQ ID NO: 3311437 - RNA, 22 nt, Human
caacacucacauuuauucugcu

SEQ ID NO: 3311438 - RNA, 18 nt, Human
caacacucauugaccuga

SEQ ID NO: 3311439 - RNA, 22 nt, Human
caacacucauugaccugaggcc

SEQ ID NO: 3311440 - RNA, 20 nt, Human
caacacucauugaccugagg

SEQ ID NO: 3311441 - RNA, 14 nt, Human
caaccuccugggcu

SEQ ID NO: 3311442 - RNA, 15 nt, Human
caaccuccugggcua

SEQ ID NO: 3311443 - RNA, 14 nt, Human
caacgucugugcca

SEQ ID NO: 3311444 - RNA, 13 nt, Human
caacgucugugcc

SEQ ID NO: 3311445 - RNA, 20 nt, Human
caagaacuuuccaggaaggc

SEQ ID NO: 3311446 - RNA, 16 nt, Human
caagaccuucuccuuc

SEQ ID NO: 3311447 - RNA, 14 nt, Human
caagaccuucuccu

SEQ ID NO: 3311448 - RNA, 17 nt, Human
caagacgcugugcugcc

SEQ ID NO: 3311449 - RNA, 16 nt, Human
caagacgcugugcugc

SEQ ID NO: 3311450 - RNA, 18 nt, Human
caagaccuucuccuucac

SEQ ID NO: 3311451 - RNA, 17 nt, Human
caagaccuucuccuuca

SEQ ID NO: 3311452 - RNA, 18 nt, Human
caagacgcugugcugccc

SEQ ID NO: 3311453 - RNA, 15 nt, Human
caagacgcugugcug

SEQ ID NO: 3311454 - RNA, 23 nt, Human
caagacgcugugcugcccugccc

SEQ ID NO: 3311455 - RNA, 15 nt, Human
caagagcccaggccu

SEQ ID NO: 3311456 - RNA, 14 nt, Human
caagagcccaggcc

SEQ ID NO: 3311457 - RNA, 13 nt, Human
caagagcccaggc

SEQ ID NO: 3311458 - RNA, 18 nt, Human
caagacucuuuggacacu

SEQ ID NO: 3311459 - RNA, 15 nt, Human
caagcaccuccugcc

SEQ ID NO: 3311460 - RNA, 16 nt, Human
caagcaccuccugccu

SEQ ID NO: 3311461 - RNA, 17 nt, Human
caagcaccuccugccuc

SEQ ID NO: 3311462 - RNA, 16 nt, Human
caagagcccaggccuc

SEQ ID NO: 3311463 - RNA, 14 nt, Human
cacauaucugucau

SEQ ID NO: 3311464 - RNA, 14 nt, Human
cacaguucucuccu

SEQ ID NO: 3311465 - RNA, 15 nt, Human
cacaguucucuccuu

SEQ ID NO: 3311466 - RNA, 22 nt, Human
cacagugagucgaggacaggga

SEQ ID NO: 3311467 - RNA, 21 nt, Human
cacagugagucgaggacaggg

SEQ ID NO: 3311468 - RNA, 21 nt, Human
cacaguccuuaccagcagagc

SEQ ID NO: 3311469 - RNA, 15 nt, Human
cacaguccuuaccag

SEQ ID NO: 3311470 - RNA, 13 nt, Human
cacaguccuuacc

SEQ ID NO: 3311471 - RNA, 11 nt, Human
cacaggcaggu

SEQ ID NO: 3311472 - RNA, 14 nt, Human
cacaggcaggucca

SEQ ID NO: 3311473 - RNA, 15 nt, Human
cacaggcagguccag

SEQ ID NO: 3311474 - RNA, 23 nt, Human
cacagcugggguggggaccucag

SEQ ID NO: 3311475 - RNA, 22 nt, Human
cacagcugggguggggaccuca

SEQ ID NO: 3311476 - RNA, 21 nt, Human
cacagcuucauuuccuguguc

SEQ ID NO: 3311477 - RNA, 22 nt, Human
cacagcuucauuuccugugucu

SEQ ID NO: 3311478 - RNA, 22 nt, Human
caggugugagucaccaagccca

SEQ ID NO: 3311479 - RNA, 23 nt, Human
caggugugagucaccaagcccag

SEQ ID NO: 3311480 - RNA, 16 nt, Human
caggugugaaccacca

SEQ ID NO: 3311481 - RNA, 19 nt, Human
caggugugaaccaccacac

SEQ ID NO: 3311482 - RNA, 22 nt, Human
caggugugaaccaccacaccca

SEQ ID NO: 3311483 - RNA, 23 nt, Human
caggugugaaccaccacacccag

SEQ ID NO: 3311484 - RNA, 20 nt, Human
caggugugagucaccaagcc

SEQ ID NO: 3311485 - RNA, 21 nt, Human
caggugugagucaccaagccc

SEQ ID NO: 3311486 - RNA, 16 nt, Human
caggugugagucacca

SEQ ID NO: 3311487 - RNA, 15 nt, Human
caggugucccugcac

SEQ ID NO: 3311488 - RNA, 16 nt, Human
caggugucccugcacu

SEQ ID NO: 3311489 - RNA, 18 nt, Human
caggugucccugcacuug

SEQ ID NO: 3311490 - RNA, 19 nt, Human
caggugucccugcacuugc

SEQ ID NO: 3311491 - RNA, 12 nt, Human
caggugugaacc

SEQ ID NO: 3311492 - RNA, 12 nt, Human
caguaauaacuc

SEQ ID NO: 3311493 - RNA, 13 nt, Human
caguaauaacucu

SEQ ID NO: 3311494 - RNA, 22 nt, Human
caguaaaugggggugcauuuga

SEQ ID NO: 3311495 - RNA, 21 nt, Human
caguaaaugggggugcauuug

SEQ ID NO: 3311496 - RNA, 20 nt, Human
caguaaaugggggugcauuu

SEQ ID NO: 3311497 - RNA, 12 nt, Human
cagguucagcuu

SEQ ID NO: 3311498 - RNA, 13 nt, Human
cagguucagcuug

SEQ ID NO: 3311499 - RNA, 18 nt, Human
caggugguuauggagagg

SEQ ID NO: 3311500 - RNA, 23 nt, Human
cagguggggucacucuggcagcu

SEQ ID NO: 3311501 - RNA, 22 nt, Human
cagguggggucacucuggcagc

SEQ ID NO: 3311502 - RNA, 21 nt, Human
cagguggggucacucuggcag

SEQ ID NO: 3311503 - RNA, 20 nt, Human
cagguggggucacucuggca

SEQ ID NO: 3311504 - RNA, 19 nt, Human
cagguggggucacucuggc

SEQ ID NO: 3311505 - RNA, 13 nt, Human
cagguggggcagc

SEQ ID NO: 3311506 - RNA, 14 nt, Human
cagguggggcagcu

SEQ ID NO: 3311507 - RNA, 15 nt, Human
cagguggggcagcuu

SEQ ID NO: 3311508 - RNA, 16 nt, Human
cagguggggcagcuug

SEQ ID NO: 3311509 - RNA, 17 nt, Human
cagguggggcagcuuga

SEQ ID NO: 3311510 - RNA, 18 nt, Human
cagguggggucacucugg

SEQ ID NO: 3311511 - RNA, 11 nt, Human
caggugucccu

SEQ ID NO: 3311512 - RNA, 14 nt, Human
caggugucccugca

SEQ ID NO: 3311513 - RNA, 20 nt, Human
caggugguuauggagagggu

SEQ ID NO: 3311514 - RNA, 20 nt, Human
cagguaacaggcagauacag

SEQ ID NO: 3311515 - RNA, 21 nt, Human
cagguaacaggcagauacagg

SEQ ID NO: 3311516 - RNA, 21 nt, Human
caggugagaagcagaggaagg

SEQ ID NO: 3311517 - RNA, 20 nt, Human
caggugagaagcagaggaag

SEQ ID NO: 3311518 - RNA, 13 nt, Human
caggugagaagca

SEQ ID NO: 3311519 - RNA, 18 nt, Human
caggucuugaacuccugg

SEQ ID NO: 3311520 - RNA, 19 nt, Human
caggucuugaacuccuggc

SEQ ID NO: 3311521 - RNA, 20 nt, Human
caggucuugaacuccuggcc

SEQ ID NO: 3311522 - RNA, 21 nt, Human
caggucuugaacuccuggccu

SEQ ID NO: 3311523 - RNA, 22 nt, Human
caggucuugaacuccuggccuc

SEQ ID NO: 3311524 - RNA, 23 nt, Human
caggucuugaacuccuggccuca

SEQ ID NO: 3311525 - RNA, 21 nt, Human
caggggugggacacccuguga

SEQ ID NO: 3311526 - RNA, 20 nt, Human
caggggugggacacccugug

SEQ ID NO: 3311527 - RNA, 15 nt, Human
caggggugggacacc

SEQ ID NO: 3311528 - RNA, 14 nt, Human
caggggugggacac

SEQ ID NO: 3311529 - RNA, 21 nt, Human
cagggucucacuauguugccc

SEQ ID NO: 3311530 - RNA, 22 nt, Human
cagggucucacuauguugccca

SEQ ID NO: 3311531 - RNA, 23 nt, Human
cagggucucacuauguugcccag

SEQ ID NO: 3311532 - RNA, 15 nt, Human
cagggucucacucug

SEQ ID NO: 3311533 - RNA, 23 nt, Human
cagggucccugguggcagcucac

SEQ ID NO: 3311534 - RNA, 18 nt, Human
caggguccuguagcccua

SEQ ID NO: 3311535 - RNA, 14 nt, Human
cagguaacaggcag

SEQ ID NO: 3311536 - RNA, 15 nt, Human
cagguaacaggcaga

SEQ ID NO: 3311537 - RNA, 16 nt, Human
cagguaacaggcagau

SEQ ID NO: 3311538 - RNA, 17 nt, Human
cagguaacaggcagaua

SEQ ID NO: 3311539 - RNA, 16 nt, Human
caggguuuugccaugu

SEQ ID NO: 3311540 - RNA, 16 nt, Human
cagggucucacucugu

SEQ ID NO: 3311541 - RNA, 21 nt, Human
caggguauuccagagugggga

SEQ ID NO: 3311542 - RNA, 20 nt, Human
caggguauuccagagugggg

SEQ ID NO: 3311543 - RNA, 22 nt, Human
cagggucccugguggcagcuca

SEQ ID NO: 3311544 - RNA, 19 nt, Human
cagggucccugguggcagc

SEQ ID NO: 3311545 - RNA, 18 nt, Human
cagggucccugguggcag

SEQ ID NO: 3311546 - RNA, 15 nt, Human
cagggucccuggugg

SEQ ID NO: 3311547 - RNA, 12 nt, Human
cagggucccugg

SEQ ID NO: 3311548 - RNA, 14 nt, Human
cagggucccuggug

SEQ ID NO: 3311549 - RNA, 21 nt, Human
caguaucuugaagacuuuucu

SEQ ID NO: 3311550 - RNA, 18 nt, Human
caguaucuugaagacuuu

SEQ ID NO: 3311551 - RNA, 12 nt, Human
caguaucuugaa

SEQ ID NO: 3311552 - RNA, 15 nt, Human
caguaucucagggcc

SEQ ID NO: 3311553 - RNA, 13 nt, Human
caguaucucaggg

SEQ ID NO: 3311554 - RNA, 14 nt, Human
caguccauugaaag

SEQ ID NO: 3311555 - RNA, 16 nt, Human
caguccauagcagaga

SEQ ID NO: 3311556 - RNA, 16 nt, Human
caguauuacuucugcu

SEQ ID NO: 3311557 - RNA, 18 nt, Human
caguauuacuucugcuac

SEQ ID NO: 3311558 - RNA, 17 nt, Human
cagucccugccaaugga

SEQ ID NO: 3311559 - RNA, 15 nt, Human
caguccucccaucuc

SEQ ID NO: 3311560 - RNA, 14 nt, Human
caguccucccaucu

SEQ ID NO: 3311561 - RNA, 13 nt, Human
caguccucccauc

SEQ ID NO: 3311562 - RNA, 12 nt, Human
caguccucccau

SEQ ID NO: 3311563 - RNA, 16 nt, Human
cagucccugccaaugg

SEQ ID NO: 3311564 - RNA, 15 nt, Human
cagucccugccaaug

SEQ ID NO: 3311565 - RNA, 14 nt, Human
cagucccugccaau

SEQ ID NO: 3311566 - RNA, 13 nt, Human
cagucccugccaa

SEQ ID NO: 3311567 - RNA, 12 nt, Human
cagucccugcca

SEQ ID NO: 3311568 - RNA, 19 nt, Human
cagugagucgaggacaggg

SEQ ID NO: 3311569 - RNA, 20 nt, Human
cagugagucgaggacaggga

SEQ ID NO: 3311570 - RNA, 22 nt, Human
cagugagucgaggacagggagg

SEQ ID NO: 3311571 - RNA, 23 nt, Human
cagugagucgaggacagggaggu

SEQ ID NO: 3311572 - RNA, 13 nt, Human
cagugccuuaugg

SEQ ID NO: 3311573 - RNA, 11 nt, Human
cagugccuuau

SEQ ID NO: 3311574 - RNA, 18 nt, Human
cagugccgagaaggaagc

SEQ ID NO: 3311575 - RNA, 15 nt, Human
cagugccgagaagga

SEQ ID NO: 3311576 - RNA, 22 nt, Human
cagugccuuauggaacacucug

SEQ ID NO: 3311577 - RNA, 21 nt, Human
cagugccuuauggaacacucu

SEQ ID NO: 3311578 - RNA, 20 nt, Human
cagugccuuauggaacacuc

SEQ ID NO: 3311579 - RNA, 19 nt, Human
cagugccuuauggaacacu

SEQ ID NO: 3311580 - RNA, 18 nt, Human
cagugccuuauggaacac

SEQ ID NO: 3311581 - RNA, 17 nt, Human
cagugccuuauggaaca

SEQ ID NO: 3311582 - RNA, 16 nt, Human
cagugccuuauggaac

SEQ ID NO: 3311583 - RNA, 15 nt, Human
cagugccuuauggaa

SEQ ID NO: 3311584 - RNA, 21 nt, Human
cagugaggcucugcccuuggu

SEQ ID NO: 3311585 - RNA, 17 nt, Human
cagugagucgaggacag

SEQ ID NO: 3311586 - RNA, 18 nt, Human
cagugagucgaggacagg

SEQ ID NO: 3311587 - RNA, 20 nt, Human
cagugaggcucugcccuugg

SEQ ID NO: 3311588 - RNA, 19 nt, Human
cagugaggcucugcccuug

SEQ ID NO: 3311589 - RNA, 18 nt, Human
cagugaggcucugcccuu

SEQ ID NO: 3311590 - RNA, 17 nt, Human
cagugaggcucugcccu

SEQ ID NO: 3311591 - RNA, 16 nt, Human
cagugaggcucugccc

SEQ ID NO: 3311592 - RNA, 15 nt, Human
cagugaggcucugcc

SEQ ID NO: 3311593 - RNA, 14 nt, Human
cagugaggcucugc

SEQ ID NO: 3311594 - RNA, 13 nt, Human
cagugaggcucug

SEQ ID NO: 3311595 - RNA, 12 nt, Human
cagugaggcucu

SEQ ID NO: 3311596 - RNA, 24 nt, Human
cagugagccgagauugcaccacug

SEQ ID NO: 3311597 - RNA, 19 nt, Human
cagucuggaaugcaguggu

SEQ ID NO: 3311598 - RNA, 17 nt, Human
caguccucccaucucac

SEQ ID NO: 3311599 - RNA, 16 nt, Human
caguccucccaucuca

SEQ ID NO: 3311600 - RNA, 18 nt, Human
cagucuggaaugcagugg

SEQ ID NO: 3311601 - RNA, 21 nt, Human
caguccuuaccagcagagcac

SEQ ID NO: 3311602 - RNA, 20 nt, Human
caguccuuaccagcagagca

SEQ ID NO: 3311603 - RNA, 19 nt, Human
caguccuuaccagcagagc

SEQ ID NO: 3311604 - RNA, 18 nt, Human
caguccuuaccagcagag

SEQ ID NO: 3311605 - RNA, 15 nt, Human
caguccuuaccagca

SEQ ID NO: 3311606 - RNA, 23 nt, Human
cagugccuuauggaacacucuga

SEQ ID NO: 3311607 - RNA, 12 nt, Human
caggagugagca

SEQ ID NO: 3311608 - RNA, 20 nt, Human
caggagccuccugcccuuac

SEQ ID NO: 3311609 - RNA, 17 nt, Human
caggagccuccugcccu

SEQ ID NO: 3311610 - RNA, 14 nt, Human
caggagccuccugc

SEQ ID NO: 3311611 - RNA, 15 nt, Human
caggagccccgaggc

SEQ ID NO: 3311612 - RNA, 16 nt, Human
caggagccccgaggcc

SEQ ID NO: 3311613 - RNA, 18 nt, Human
caggagccccgaggccuu

SEQ ID NO: 3311614 - RNA, 19 nt, Human
caggagcagccacauuccu

SEQ ID NO: 3311615 - RNA, 14 nt, Human
caggagcagccaca

SEQ ID NO: 3311616 - RNA, 13 nt, Human
caggagcagccac

SEQ ID NO: 3311617 - RNA, 12 nt, Human
caggagcagcca

SEQ ID NO: 3311618 - RNA, 20 nt, Human
caggagccccgaggccuucu

SEQ ID NO: 3311619 - RNA, 22 nt, Human
caggagccccgaggccuucucu

SEQ ID NO: 3311620 - RNA, 23 nt, Human
caggagccccgaggccuucucug

SEQ ID NO: 3311621 - RNA, 23 nt, Human
caggaguuugagaccaaccuggg

SEQ ID NO: 3311622 - RNA, 22 nt, Human
caggaguuugagaccaaccugg

SEQ ID NO: 3311623 - RNA, 21 nt, Human
caggaguuugagaccaaccug

SEQ ID NO: 3311624 - RNA, 17 nt, Human
caggcaugguggcccac

SEQ ID NO: 3311625 - RNA, 23 nt, Human
caggcaggucuugaacuccuggc

SEQ ID NO: 3311626 - RNA, 15 nt, Human
caggcaggugggaug

SEQ ID NO: 3311627 - RNA, 13 nt, Human
caggcaggucuug

SEQ ID NO: 3311628 - RNA, 22 nt, Human
caggcaggucuugaacuccugg

SEQ ID NO: 3311629 - RNA, 14 nt, Human
caggcagguccagg

SEQ ID NO: 3311630 - RNA, 15 nt, Human
caggcagguccaggg

SEQ ID NO: 3311631 - RNA, 19 nt, Human
caggcagguccaggguuug

SEQ ID NO: 3311632 - RNA, 12 nt, Human
caggcaggucuu

SEQ ID NO: 3311633 - RNA, 24 nt, Human
caggcauuccccaggaggccagcc

SEQ ID NO: 3311634 - RNA, 23 nt, Human
caggcauuccccaggaggccagc

SEQ ID NO: 3311635 - RNA, 22 nt, Human
caggcauuccccaggaggccag

SEQ ID NO: 3311636 - RNA, 21 nt, Human
caggcauuccccaggaggcca

SEQ ID NO: 3311637 - RNA, 20 nt, Human
caggcauuccccaggaggcc

SEQ ID NO: 3311638 - RNA, 19 nt, Human
caggcauuccccaggaggc

SEQ ID NO: 3311639 - RNA, 18 nt, Human
caggcauuccccaggagg

SEQ ID NO: 3311640 - RNA, 15 nt, Human
caggcauguucucug

SEQ ID NO: 3311641 - RNA, 18 nt, Human
caggcauguucucugagg

SEQ ID NO: 3311642 - RNA, 19 nt, Human
caggcauguucucugagga

SEQ ID NO: 3311643 - RNA, 20 nt, Human
caggcauguucucugaggac

SEQ ID NO: 3311644 - RNA, 17 nt, Human
caggcauuccccaggag

SEQ ID NO: 3311645 - RNA, 16 nt, Human
caggcauuccccagga

SEQ ID NO: 3311646 - RNA, 15 nt, Human
caggcauuccccagg

SEQ ID NO: 3311647 - RNA, 13 nt, Human
caggcauucccca

SEQ ID NO: 3311648 - RNA, 20 nt, Human
caggauucuuccucccuccc

SEQ ID NO: 3311649 - RNA, 14 nt, Human
caggcaagcaccuc

SEQ ID NO: 3311650 - RNA, 15 nt, Human
caggcaagcaccucc

SEQ ID NO: 3311651 - RNA, 16 nt, Human
caggcaagcaccuccu

SEQ ID NO: 3311652 - RNA, 21 nt, Human
caggcaagcaccuccugccuc

SEQ ID NO: 3311653 - RNA, 15 nt, Human
caggcagccaggcca

SEQ ID NO: 3311654 - RNA, 14 nt, Human
caggcagccaggcc

SEQ ID NO: 3311655 - RNA, 17 nt, Human
caggcagccaggccaca

SEQ ID NO: 3311656 - RNA, 16 nt, Human
caggcagccaggccac

SEQ ID NO: 3311657 - RNA, 13 nt, Human
caggcagguccag

SEQ ID NO: 3311658 - RNA, 17 nt, Human
caggauucuuccucccu

SEQ ID NO: 3311659 - RNA, 18 nt, Human
caggauucuuccucccuc

SEQ ID NO: 3311660 - RNA, 23 nt, Human
caggauggccgggcgcgguggcu

SEQ ID NO: 3311661 - RNA, 14 nt, Human
caggaucagucuga

SEQ ID NO: 3311662 - RNA, 13 nt, Human
caggaucagucug

SEQ ID NO: 3311663 - RNA, 13 nt, Human
caggccccugcca

SEQ ID NO: 3311664 - RNA, 23 nt, Human
caggccaaacucaccugccccuc

SEQ ID NO: 3311665 - RNA, 18 nt, Human
caggccaaacucaccugc

SEQ ID NO: 3311666 - RNA, 13 nt, Human
caggccacaagac

SEQ ID NO: 3311667 - RNA, 18 nt, Human
caggccacaagacccuug

SEQ ID NO: 3311668 - RNA, 17 nt, Human
caggccacaagacccuu

SEQ ID NO: 3311669 - RNA, 20 nt, Human
caggccacaagacccuugug

SEQ ID NO: 3311670 - RNA, 22 nt, Human
caggccaggcccucugcccacu

SEQ ID NO: 3311671 - RNA, 21 nt, Human
caggccaggcccucugcccac

SEQ ID NO: 3311672 - RNA, 20 nt, Human
caggccaggcccucugccca

SEQ ID NO: 3311673 - RNA, 13 nt, Human
caggcccggcucc

SEQ ID NO: 3311674 - RNA, 14 nt, Human
caggcccggcucca

SEQ ID NO: 3311675 - RNA, 15 nt, Human
caggcccggcuccag

SEQ ID NO: 3311676 - RNA, 15 nt, Human
caggccccugccacc

SEQ ID NO: 3311677 - RNA, 17 nt, Human
caggccccugccacccu

SEQ ID NO: 3311678 - RNA, 19 nt, Human
caggccccugccacccugg

SEQ ID NO: 3311679 - RNA, 20 nt, Human
caggccccugccacccuggg

SEQ ID NO: 3311680 - RNA, 13 nt, Human
cagggacagaggg

SEQ ID NO: 3311681 - RNA, 20 nt, Human
cagggacagaggggguggcc

SEQ ID NO: 3311682 - RNA, 14 nt, Human
cagggacagagggg

SEQ ID NO: 3311683 - RNA, 16 nt, Human
cagggaaacagcuaau

SEQ ID NO: 3311684 - RNA, 22 nt, Human
cagggaaacagcuaaugggaca

SEQ ID NO: 3311685 - RNA, 19 nt, Human
cagggccuggcucaggugg

SEQ ID NO: 3311686 - RNA, 16 nt, Human
cagggccuggcucagg

SEQ ID NO: 3311687 - RNA, 13 nt, Human
cagggccuggcuc

SEQ ID NO: 3311688 - RNA, 15 nt, Human
cagggccuggcucag

SEQ ID NO: 3311689 - RNA, 14 nt, Human
cagggccuggcuca

SEQ ID NO: 3311690 - RNA, 19 nt, Human
caggggaggguagagcgga

SEQ ID NO: 3311691 - RNA, 23 nt, Human
cagggacagaggggguggccucc

SEQ ID NO: 3311692 - RNA, 14 nt, Human
cagggcacaccggg

SEQ ID NO: 3311693 - RNA, 22 nt, Human
cagggcacaccgggcacucaga

SEQ ID NO: 3311694 - RNA, 23 nt, Human
cagggcacaccgggcacucagaa

SEQ ID NO: 3311695 - RNA, 15 nt, Human
cagggcacaccgggc

SEQ ID NO: 3311696 - RNA, 17 nt, Human
cagggcacaccgggcac

SEQ ID NO: 3311697 - RNA, 19 nt, Human
cagggcacaccgggcacuc

SEQ ID NO: 3311698 - RNA, 21 nt, Human
cagggcacaccgggcacucag

SEQ ID NO: 3311699 - RNA, 14 nt, Human
caggcuccuuuagc

SEQ ID NO: 3311700 - RNA, 19 nt, Human
caggcuccuuuagcgccca

SEQ ID NO: 3311701 - RNA, 20 nt, Human
caggcuccuuuagcgcccag

SEQ ID NO: 3311702 - RNA, 23 nt, Human
caggcucucaggccagcugcuug

SEQ ID NO: 3311703 - RNA, 21 nt, Human
caggcucucaggccagcugcu

SEQ ID NO: 3311704 - RNA, 20 nt, Human
caggcucucaggccagcugc

SEQ ID NO: 3311705 - RNA, 19 nt, Human
caggcucucaggccagcug

SEQ ID NO: 3311706 - RNA, 18 nt, Human
caggcucucaggccagcu

SEQ ID NO: 3311707 - RNA, 17 nt, Human
caggcucucaggccagc

SEQ ID NO: 3311708 - RNA, 21 nt, Human
caggcuccuuuagcgcccagu

SEQ ID NO: 3311709 - RNA, 12 nt, Human
caggcucucagg

SEQ ID NO: 3311710 - RNA, 20 nt, Human
caggcucgggcuccccagcc

SEQ ID NO: 3311711 - RNA, 16 nt, Human
caggcucucaggccag

SEQ ID NO: 3311712 - RNA, 15 nt, Human
caggcucucaggcca

SEQ ID NO: 3311713 - RNA, 14 nt, Human
caggcucucaggcc

SEQ ID NO: 3311714 - RNA, 13 nt, Human
caggcucucaggc

SEQ ID NO: 3311715 - RNA, 22 nt, Human
caggcccucugcccacucccug

SEQ ID NO: 3311716 - RNA, 21 nt, Human
caggcccucugcccacucccu

SEQ ID NO: 3311717 - RNA, 20 nt, Human
caggcccucugcccacuccc

SEQ ID NO: 3311718 - RNA, 19 nt, Human
caggcccucugcccacucc

SEQ ID NO: 3311719 - RNA, 17 nt, Human
caggcccucugcccacu

SEQ ID NO: 3311720 - RNA, 16 nt, Human
caggcccucugcccac

SEQ ID NO: 3311721 - RNA, 22 nt, Human
caggcccggcuccaggcuccuu

SEQ ID NO: 3311722 - RNA, 20 nt, Human
caggcccggcuccaggcucc

SEQ ID NO: 3311723 - RNA, 21 nt, Human
caggcccggcuccaggcuccu

SEQ ID NO: 3311724 - RNA, 15 nt, Human
caggcccucugccca

SEQ ID NO: 3311725 - RNA, 14 nt, Human
caggcccucugccc

SEQ ID NO: 3311726 - RNA, 13 nt, Human
caggcccucugcc

SEQ ID NO: 3311727 - RNA, 17 nt, Human
caggcccggcuccaggc

SEQ ID NO: 3311728 - RNA, 16 nt, Human
caggcccggcuccagg

SEQ ID NO: 3311729 - RNA, 18 nt, Human
caggcccggcuccaggcu

SEQ ID NO: 3311730 - RNA, 19 nt, Human
caggcccggcuccaggcuc

SEQ ID NO: 3311731 - RNA, 23 nt, Human
caggcugggcuucaguggcagcu

SEQ ID NO: 3311732 - RNA, 12 nt, Human
caggcuggucuc

SEQ ID NO: 3311733 - RNA, 19 nt, Human
caggcuggucucaaacucu

SEQ ID NO: 3311734 - RNA, 14 nt, Human
caggcuguauccca

SEQ ID NO: 3311735 - RNA, 20 nt, Human
caggcuguaucccaugagcc

SEQ ID NO: 3311736 - RNA, 21 nt, Human
caggcuguaucccaugagccu

SEQ ID NO: 3311737 - RNA, 22 nt, Human
caggcuguaucccaugagccuc

SEQ ID NO: 3311738 - RNA, 23 nt, Human
caggcuguaucccaugagccuca

SEQ ID NO: 3311739 - RNA, 21 nt, Human
caggcuuagucacugagacag

SEQ ID NO: 3311740 - RNA, 20 nt, Human
caggcuuagucacugagaca

SEQ ID NO: 3311741 - RNA, 17 nt, Human
caggcuuagucacugag

SEQ ID NO: 3311742 - RNA, 16 nt, Human
caggcuuagucacuga

SEQ ID NO: 3311743 - RNA, 23 nt, Human
caggcuuagucacugagacagcc

SEQ ID NO: 3311744 - RNA, 22 nt, Human
caggcuuagucacugagacagc

SEQ ID NO: 3311745 - RNA, 20 nt, Human
cagcuaacauggaaguacua

SEQ ID NO: 3311746 - RNA, 15 nt, Human
cagcuaaugggacac

SEQ ID NO: 3311747 - RNA, 16 nt, Human
cagcuaaugggacacu

SEQ ID NO: 3311748 - RNA, 21 nt, Human
cagcgagcccugguggcagug

SEQ ID NO: 3311749 - RNA, 18 nt, Human
cagcuaacauggaaguac

SEQ ID NO: 3311750 - RNA, 19 nt, Human
cagcuaacauggaaguacu

SEQ ID NO: 3311751 - RNA, 13 nt, Human
cagcgagcccugg

SEQ ID NO: 3311752 - RNA, 16 nt, Human
cagcgagcccuggugg

SEQ ID NO: 3311753 - RNA, 17 nt, Human
cagcgagcccugguggc

SEQ ID NO: 3311754 - RNA, 19 nt, Human
cagcgagcccugguggcag

SEQ ID NO: 3311755 - RNA, 20 nt, Human
cagcgagcccugguggcagu

SEQ ID NO: 3311756 - RNA, 12 nt, Human
cagcucagagag

SEQ ID NO: 3311757 - RNA, 20 nt, Human
cagcucaccucucccuugga

SEQ ID NO: 3311758 - RNA, 19 nt, Human
cagcucaccucucccuugg

SEQ ID NO: 3311759 - RNA, 22 nt, Human
cagcucaccagccccagugccc

SEQ ID NO: 3311760 - RNA, 14 nt, Human
cagcucaccagccc

SEQ ID NO: 3311761 - RNA, 20 nt, Human
cagcucaccagccccagugc

SEQ ID NO: 3311762 - RNA, 21 nt, Human
cagcucaccagccccagugcc

SEQ ID NO: 3311763 - RNA, 17 nt, Human
cagcucaccucucccuu

SEQ ID NO: 3311764 - RNA, 16 nt, Human
cagcucaccucucccu

SEQ ID NO: 3311765 - RNA, 15 nt, Human
cagcucaccucuccc

SEQ ID NO: 3311766 - RNA, 13 nt, Human
cagcucaccucuc

SEQ ID NO: 3311767 - RNA, 13 nt, Human
cagcucaccagcc

SEQ ID NO: 3311768 - RNA, 15 nt, Human
cagcucaccagcccc

SEQ ID NO: 3311769 - RNA, 16 nt, Human
cagcucaccagcccca

SEQ ID NO: 3311770 - RNA, 17 nt, Human
cagcucaccagccccag

SEQ ID NO: 3311771 - RNA, 19 nt, Human
cagcucaccagccccagug

SEQ ID NO: 3311772 - RNA, 19 nt, Human
cagccuggacccuguggau

SEQ ID NO: 3311773 - RNA, 15 nt, Human
cagccuggacccugu

SEQ ID NO: 3311774 - RNA, 20 nt, Human
cagccugcuccagcuguuca

SEQ ID NO: 3311775 - RNA, 23 nt, Human
cagccucccgaauagcugggacu

SEQ ID NO: 3311776 - RNA, 19 nt, Human
cagccucccgaguagcugg

SEQ ID NO: 3311777 - RNA, 20 nt, Human
cagccucccgaguagcuggg

SEQ ID NO: 3311778 - RNA, 21 nt, Human
cagccucccgaguagcuggga

SEQ ID NO: 3311779 - RNA, 22 nt, Human
cagccucccgaguagcugggac

SEQ ID NO: 3311780 - RNA, 23 nt, Human
cagccucccgaguagcugggacu

SEQ ID NO: 3311781 - RNA, 19 nt, Human
cagccugggcaaugugaua

SEQ ID NO: 3311782 - RNA, 16 nt, Human
cagccugggcaaugug

SEQ ID NO: 3311783 - RNA, 24 nt, Human
cagccuugaccauucuccaccugc

SEQ ID NO: 3311784 - RNA, 23 nt, Human
cagccuugaccauucuccaccug

SEQ ID NO: 3311785 - RNA, 22 nt, Human
cagccuugaccauucuccaccu

SEQ ID NO: 3311786 - RNA, 17 nt, Human
cagccuugaccauucuc

SEQ ID NO: 3311787 - RNA, 21 nt, Human
cagccuugaccauucuccacc

SEQ ID NO: 3311788 - RNA, 20 nt, Human
cagccuugaccauucuccac

SEQ ID NO: 3311789 - RNA, 19 nt, Human
cagccucccaaagugcugg

SEQ ID NO: 3311790 - RNA, 20 nt, Human
cagccucccaaagugcuggg

SEQ ID NO: 3311791 - RNA, 21 nt, Human
cagccucccaaagugcuggga

SEQ ID NO: 3311792 - RNA, 23 nt, Human
cagccucccaaagugcugggauu

SEQ ID NO: 3311793 - RNA, 20 nt, Human
cagccucccgaauagcuggg

SEQ ID NO: 3311794 - RNA, 21 nt, Human
cagccucccgaauagcuggga

SEQ ID NO: 3311795 - RNA, 22 nt, Human
cagccucccgaauagcugggac

SEQ ID NO: 3311796 - RNA, 17 nt, Human
cagccucaaccuccugg

SEQ ID NO: 3311797 - RNA, 18 nt, Human
cagccucaaccuccuggg

SEQ ID NO: 3311798 - RNA, 19 nt, Human
cagccucaaccuccugggc

SEQ ID NO: 3311799 - RNA, 20 nt, Human
cagccucaaccuccugggcu

SEQ ID NO: 3311800 - RNA, 21 nt, Human
cagccucaaccuccugggcua

SEQ ID NO: 3311801 - RNA, 20 nt, Human
cagccucacaguccuuacca

SEQ ID NO: 3311802 - RNA, 15 nt, Human
cagccucacaguccu

SEQ ID NO: 3311803 - RNA, 14 nt, Human
cagccucacagucc

SEQ ID NO: 3311804 - RNA, 21 nt, Human
cagccguguaaccauggaccc

SEQ ID NO: 3311805 - RNA, 16 nt, Human
cagcccugcagagggc

SEQ ID NO: 3311806 - RNA, 15 nt, Human
cagcccugcagaggg

SEQ ID NO: 3311807 - RNA, 14 nt, Human
cagcccugcagagg

SEQ ID NO: 3311808 - RNA, 13 nt, Human
cagcccugcagag

SEQ ID NO: 3311809 - RNA, 20 nt, Human
cagcccugcagagggcacag

SEQ ID NO: 3311810 - RNA, 18 nt, Human
cagcccugcagagggcac

SEQ ID NO: 3311811 - RNA, 13 nt, Human
cagccccagugcc

SEQ ID NO: 3311812 - RNA, 14 nt, Human
cagccccagugccc

SEQ ID NO: 3311813 - RNA, 15 nt, Human
cagccccagugccca

SEQ ID NO: 3311814 - RNA, 16 nt, Human
cagccccagugcccac

SEQ ID NO: 3311815 - RNA, 17 nt, Human
cagccccagugcccaca

SEQ ID NO: 3311816 - RNA, 18 nt, Human
cagccccagugcccacag

SEQ ID NO: 3311817 - RNA, 21 nt, Human
cagccccaucccaaacccuuc

SEQ ID NO: 3311818 - RNA, 11 nt, Human
cagccccaucc

SEQ ID NO: 3311819 - RNA, 21 nt, Human
cagccccuguucuggcagagu

SEQ ID NO: 3311820 - RNA, 22 nt, Human
cagccccuggaugcagccucac

SEQ ID NO: 3311821 - RNA, 20 nt, Human
cagccccuguucuggcagag

SEQ ID NO: 3311822 - RNA, 16 nt, Human
cagccccauucugccu

SEQ ID NO: 3311823 - RNA, 17 nt, Human
cagccccauucugccug

SEQ ID NO: 3311824 - RNA, 18 nt, Human
cagccccauucugccugc

SEQ ID NO: 3311825 - RNA, 23 nt, Human
cagccccuggaugcagccucaca

SEQ ID NO: 3311826 - RNA, 13 nt, Human
cagccccauucug

SEQ ID NO: 3311827 - RNA, 14 nt, Human
cagccccauucugc

SEQ ID NO: 3311828 - RNA, 22 nt, Human
cagccccauccucuguacagag

SEQ ID NO: 3311829 - RNA, 16 nt, Human
cagccccauccucugu

SEQ ID NO: 3311830 - RNA, 14 nt, Human
cagccccauccucu

SEQ ID NO: 3311831 - RNA, 13 nt, Human
cagccccauccuc

SEQ ID NO: 3311832 - RNA, 12 nt, Human
cagccccauccu

SEQ ID NO: 3311833 - RNA, 22 nt, Human
cagccccaucccaaacccuuca

SEQ ID NO: 3311834 - RNA, 24 nt, Human
cagccccuucugacccaugcugcc

SEQ ID NO: 3311835 - RNA, 23 nt, Human
cagccccuucugacccaugcugc

SEQ ID NO: 3311836 - RNA, 22 nt, Human
cagccccuucugacccaugcug

SEQ ID NO: 3311837 - RNA, 21 nt, Human
cagccccuucugacccaugcu

SEQ ID NO: 3311838 - RNA, 19 nt, Human
cagccccuucugacccaug

SEQ ID NO: 3311839 - RNA, 17 nt, Human
cagccccuucugaccca

SEQ ID NO: 3311840 - RNA, 16 nt, Human
cagccccuucugaccc

SEQ ID NO: 3311841 - RNA, 16 nt, Human
cagcccgggcucugcc

SEQ ID NO: 3311842 - RNA, 15 nt, Human
cagcccgggcucugc

SEQ ID NO: 3311843 - RNA, 14 nt, Human
cagcccgggcucug

SEQ ID NO: 3311844 - RNA, 13 nt, Human
cagcccgggcucu

SEQ ID NO: 3311845 - RNA, 22 nt, Human
cagcccgggcucugccucccau

SEQ ID NO: 3311846 - RNA, 21 nt, Human
cagcccgggcucugccuccca

SEQ ID NO: 3311847 - RNA, 20 nt, Human
cagcccgggcucugccuccc

SEQ ID NO: 3311848 - RNA, 19 nt, Human
cagcccgggcucugccucc

SEQ ID NO: 3311849 - RNA, 18 nt, Human
cagcccgggcucugccuc

SEQ ID NO: 3311850 - RNA, 17 nt, Human
cagcccgggcucugccu

SEQ ID NO: 3311851 - RNA, 21 nt, Human
cagcucugcaagaauugaagc

SEQ ID NO: 3311852 - RNA, 16 nt, Human
cagcucugcaagaauu

SEQ ID NO: 3311853 - RNA, 15 nt, Human
cagcucugcaagaau

SEQ ID NO: 3311854 - RNA, 16 nt, Human
cagcuccuucuguccu

SEQ ID NO: 3311855 - RNA, 17 nt, Human
cagcuccuucuguccua

SEQ ID NO: 3311856 - RNA, 21 nt, Human
cagcuccuucuguccuacucu

SEQ ID NO: 3311857 - RNA, 23 nt, Human
cagcuccuucuguccuacucugu

SEQ ID NO: 3311858 - RNA, 20 nt, Human
cagcucagagagggugggag

SEQ ID NO: 3311859 - RNA, 19 nt, Human
cagcucagagaggguggga

SEQ ID NO: 3311860 - RNA, 17 nt, Human
cagcucagagagggugg

SEQ ID NO: 3311861 - RNA, 13 nt, Human
cagcucagagagg

SEQ ID NO: 3311862 - RNA, 13 nt, Human
cagcucuggucca

SEQ ID NO: 3311863 - RNA, 10 nt, Human
cagcucuggu

SEQ ID NO: 3311864 - RNA, 21 nt, Human
cagcucugguccauagagagc

SEQ ID NO: 3311865 - RNA, 18 nt, Human
cagcucugguccauagag

SEQ ID NO: 3311866 - RNA, 17 nt, Human
cagcucugguccauaga

SEQ ID NO: 3311867 - RNA, 16 nt, Human
cagcucugguccauag

SEQ ID NO: 3311868 - RNA, 12 nt, Human
cagcucuguccu

SEQ ID NO: 3311869 - RNA, 13 nt, Human
cagcucuguccug

SEQ ID NO: 3311870 - RNA, 23 nt, Human
cagcucugguccauagagagcaa

SEQ ID NO: 3311871 - RNA, 22 nt, Human
cagcucugguccauagagagca

SEQ ID NO: 3311872 - RNA, 14 nt, Human
cagcucuguccugg

SEQ ID NO: 3311873 - RNA, 16 nt, Human
cagcucuguccuggga

SEQ ID NO: 3311874 - RNA, 17 nt, Human
cagcucuguccugggag

SEQ ID NO: 3311875 - RNA, 18 nt, Human
cagcucuguccugggagu

SEQ ID NO: 3311876 - RNA, 23 nt, Human
cagcucuguccugggagugagcu

SEQ ID NO: 3311877 - RNA, 21 nt, Human
cagcucuuauauugccauuuc

SEQ ID NO: 3311878 - RNA, 10 nt, Human
cagcucuuau

SEQ ID NO: 3311879 - RNA, 13 nt, Human
cagcucuucucca

SEQ ID NO: 3311880 - RNA, 14 nt, Human
cagcucuucuccag

SEQ ID NO: 3311881 - RNA, 15 nt, Human
cagcucuucuccagg

SEQ ID NO: 3311882 - RNA, 16 nt, Human
cagcucuucuccaggc

SEQ ID NO: 3311883 - RNA, 17 nt, Human
cagcucuucuccaggcu

SEQ ID NO: 3311884 - RNA, 18 nt, Human
cagcucuucuccaggcug

SEQ ID NO: 3311885 - RNA, 19 nt, Human
cagcucuucuccaggcugu

SEQ ID NO: 3311886 - RNA, 23 nt, Human
cagcucuucuccaggcuguaucc

SEQ ID NO: 3311887 - RNA, 18 nt, Human
cagcugguugagguuuca

SEQ ID NO: 3311888 - RNA, 23 nt, Human
cagcugggguggggaccucaggc

SEQ ID NO: 3311889 - RNA, 22 nt, Human
cagcugggguggggaccucagg

SEQ ID NO: 3311890 - RNA, 21 nt, Human
cagcugggguggggaccucag

SEQ ID NO: 3311891 - RNA, 23 nt, Human
cagcugcuuuugucuaugggacu

SEQ ID NO: 3311892 - RNA, 22 nt, Human
cagcugcuuuugucuaugggac

SEQ ID NO: 3311893 - RNA, 17 nt, Human
cagcugcuacuacuccu

SEQ ID NO: 3311894 - RNA, 22 nt, Human
cagcugcuugggcuucauccuc

SEQ ID NO: 3311895 - RNA, 21 nt, Human
cagcugcuugggcuucauccu

SEQ ID NO: 3311896 - RNA, 19 nt, Human
cagcugcuugggcuucauc

SEQ ID NO: 3311897 - RNA, 18 nt, Human
cagcugcuugggcuucau

SEQ ID NO: 3311898 - RNA, 16 nt, Human
cagcugcuugggcuuc

SEQ ID NO: 3311899 - RNA, 15 nt, Human
cagcugcuugggcuu

SEQ ID NO: 3311900 - RNA, 14 nt, Human
cagcugcuugggcu

SEQ ID NO: 3311901 - RNA, 13 nt, Human
cagcugcuugggc

SEQ ID NO: 3311902 - RNA, 18 nt, Human
cagcugcgguccacccag

SEQ ID NO: 3311903 - RNA, 15 nt, Human
cagcugccugggauc

SEQ ID NO: 3311904 - RNA, 19 nt, Human
cagcugcgguccacccagg

SEQ ID NO: 3311905 - RNA, 20 nt, Human
cagcugcgguccacccagga

SEQ ID NO: 3311906 - RNA, 21 nt, Human
cagcugcgguccacccaggag

SEQ ID NO: 3311907 - RNA, 22 nt, Human
cagcugcgguccacccaggagc

SEQ ID NO: 3311908 - RNA, 23 nt, Human
cagcugcgguccacccaggagcc

SEQ ID NO: 3311909 - RNA, 24 nt, Human
cagcugcgguccacccaggagccc

SEQ ID NO: 3311910 - RNA, 23 nt, Human
cagcugccugggaucccucaucc

SEQ ID NO: 3311911 - RNA, 18 nt, Human
cagcugccugggaucccu

SEQ ID NO: 3311912 - RNA, 18 nt, Human
cagcuuguaaauagcuca

SEQ ID NO: 3311913 - RNA, 19 nt, Human
cagcuuguaaauagcucag

SEQ ID NO: 3311914 - RNA, 20 nt, Human
cagcuuguaaauagcucagg

SEQ ID NO: 3311915 - RNA, 21 nt, Human
cagcuuguaaauagcucaggu

SEQ ID NO: 3311916 - RNA, 22 nt, Human
cagcuuguaaauagcucaggug

SEQ ID NO: 3311917 - RNA, 23 nt, Human
cagcuuuguuuguugucagcuga

SEQ ID NO: 3311918 - RNA, 22 nt, Human
cagcuuuguuuguugucagcug

SEQ ID NO: 3311919 - RNA, 21 nt, Human
cagcuuuguuuguugucagcu

SEQ ID NO: 3311920 - RNA, 12 nt, Human
cagcuuuguuug

SEQ ID NO: 3311921 - RNA, 19 nt, Human
cagcuucauuuccuguguc

SEQ ID NO: 3311922 - RNA, 20 nt, Human
cagcuucauuuccugugucu

SEQ ID NO: 3311923 - RNA, 21 nt, Human
cagcuucauuuccugugucuu

SEQ ID NO: 3311924 - RNA, 14 nt, Human
cagcuugaggguug

SEQ ID NO: 3311925 - RNA, 15 nt, Human
cagcuugaggguugg

SEQ ID NO: 3311926 - RNA, 21 nt, Human
cagcuugaccgugaggccaga

SEQ ID NO: 3311927 - RNA, 20 nt, Human
cagcuugaccgugaggccag

SEQ ID NO: 3311928 - RNA, 19 nt, Human
cagcuugaccgugaggcca

SEQ ID NO: 3311929 - RNA, 18 nt, Human
cagcuugaccgugaggcc

SEQ ID NO: 3311930 - RNA, 18 nt, Human
cagcuugaggguugggcu

SEQ ID NO: 3311931 - RNA, 19 nt, Human
cagcuugaggguugggcug

SEQ ID NO: 3311932 - RNA, 20 nt, Human
cagcuugaggguugggcugg

SEQ ID NO: 3311933 - RNA, 21 nt, Human
cagcuugaggguugggcuggu

SEQ ID NO: 3311934 - RNA, 20 nt, Human
caggaaguacuggagaaaau

SEQ ID NO: 3311935 - RNA, 18 nt, Human
caggaaguacuggagaaa

SEQ ID NO: 3311936 - RNA, 17 nt, Human
caggaaguacuggagaa

SEQ ID NO: 3311937 - RNA, 12 nt, Human
caggaaguacug

SEQ ID NO: 3311938 - RNA, 16 nt, Human
caggaaguacuggaga

SEQ ID NO: 3311939 - RNA, 14 nt, Human
caggaaguacugga

SEQ ID NO: 3311940 - RNA, 15 nt, Human
caggaaggcuaaagg

SEQ ID NO: 3311941 - RNA, 22 nt, Human
caggaagccagcaggcucucag

SEQ ID NO: 3311942 - RNA, 21 nt, Human
caggaagccagcaggcucuca

SEQ ID NO: 3311943 - RNA, 19 nt, Human
caggaagccagcaggcucu

SEQ ID NO: 3311944 - RNA, 18 nt, Human
caggaagccagcaggcuc

SEQ ID NO: 3311945 - RNA, 17 nt, Human
caggaagccagcaggcu

SEQ ID NO: 3311946 - RNA, 16 nt, Human
caggaagccagcaggc

SEQ ID NO: 3311947 - RNA, 14 nt, Human
caggaagccagcag

SEQ ID NO: 3311948 - RNA, 13 nt, Human
caggaagcucagg

SEQ ID NO: 3311949 - RNA, 15 nt, Human
caggaagcucagggc

SEQ ID NO: 3311950 - RNA, 14 nt, Human
caggaagcucaggg

SEQ ID NO: 3311951 - RNA, 19 nt, Human
caggaagcucagggccugg

SEQ ID NO: 3311952 - RNA, 18 nt, Human
caggaagcucagggccug

SEQ ID NO: 3311953 - RNA, 17 nt, Human
caggaagcucagggccu

SEQ ID NO: 3311954 - RNA, 16 nt, Human
caggaagcucagggcc

SEQ ID NO: 3311955 - RNA, 23 nt, Human
caggaagcucagggccuggcuca

SEQ ID NO: 3311956 - RNA, 22 nt, Human
caggaagcucagggccuggcuc

SEQ ID NO: 3311957 - RNA, 21 nt, Human
caggaagcucagggccuggcu

SEQ ID NO: 3311958 - RNA, 20 nt, Human
caggaagcucagggccuggc

SEQ ID NO: 3311959 - RNA, 16 nt, Human
cagccaaagccuccuc

SEQ ID NO: 3311960 - RNA, 15 nt, Human
cagccaaagccuccu

SEQ ID NO: 3311961 - RNA, 21 nt, Human
cagccaaagccuccuccagcc

SEQ ID NO: 3311962 - RNA, 18 nt, Human
cagccaaagccuccucca

SEQ ID NO: 3311963 - RNA, 21 nt, Human
cagcauccuggcacccggccc

SEQ ID NO: 3311964 - RNA, 19 nt, Human
cagcauccuggcacccggc

SEQ ID NO: 3311965 - RNA, 20 nt, Human
cagcauccuggcacccggcc

SEQ ID NO: 3311966 - RNA, 14 nt, Human
cagcauccuggcac

SEQ ID NO: 3311967 - RNA, 15 nt, Human
cagcauccuggcacc

SEQ ID NO: 3311968 - RNA, 16 nt, Human
cagcauccuggcaccc

SEQ ID NO: 3311969 - RNA, 17 nt, Human
cagcauccuggcacccg

SEQ ID NO: 3311970 - RNA, 20 nt, Human
cagcagggagggcuucugcc

SEQ ID NO: 3311971 - RNA, 19 nt, Human
cagcaggcucucaggccag

SEQ ID NO: 3311972 - RNA, 18 nt, Human
cagcaggcucucaggcca

SEQ ID NO: 3311973 - RNA, 17 nt, Human
cagcaggcucucaggcc

SEQ ID NO: 3311974 - RNA, 16 nt, Human
cagcaggcucucaggc

SEQ ID NO: 3311975 - RNA, 22 nt, Human
cagcaggcucucaggccagcug

SEQ ID NO: 3311976 - RNA, 20 nt, Human
cagcaggcucucaggccagc

SEQ ID NO: 3311977 - RNA, 18 nt, Human
cagcagggagggcuucug

SEQ ID NO: 3311978 - RNA, 18 nt, Human
cagcagccuggacccugu

SEQ ID NO: 3311979 - RNA, 15 nt, Human
cagcagccuggaccc

SEQ ID NO: 3311980 - RNA, 14 nt, Human
cagcagccuggacc

SEQ ID NO: 3311981 - RNA, 12 nt, Human
cagcagccugga

SEQ ID NO: 3311982 - RNA, 22 nt, Human
cagcagccuggacccuguggau

SEQ ID NO: 3311983 - RNA, 19 nt, Human
cagcagccuggacccugug

SEQ ID NO: 3311984 - RNA, 12 nt, Human
cagcaggcucuc

SEQ ID NO: 3311985 - RNA, 15 nt, Human
cagcaggcucucagg

SEQ ID NO: 3311986 - RNA, 14 nt, Human
cagcaggcucucag

SEQ ID NO: 3311987 - RNA, 23 nt, Human
cagccacggccaggccagaggga

SEQ ID NO: 3311988 - RNA, 13 nt, Human
cagccaguaaaug

SEQ ID NO: 3311989 - RNA, 22 nt, Human
cagccaguaaaugggggugcau

SEQ ID NO: 3311990 - RNA, 14 nt, Human
cagccacggccagg

SEQ ID NO: 3311991 - RNA, 15 nt, Human
cagccacggccaggc

SEQ ID NO: 3311992 - RNA, 16 nt, Human
cagccacggccaggcc

SEQ ID NO: 3311993 - RNA, 17 nt, Human
cagccacggccaggcca

SEQ ID NO: 3311994 - RNA, 18 nt, Human
cagccacggccaggccag

SEQ ID NO: 3311995 - RNA, 19 nt, Human
cagccacggccaggccaga

SEQ ID NO: 3311996 - RNA, 21 nt, Human
cagccacggccaggccagagg

SEQ ID NO: 3311997 - RNA, 22 nt, Human
cagccacggccaggccagaggg

SEQ ID NO: 3311998 - RNA, 19 nt, Human
cagccacauuccugaugcu

SEQ ID NO: 3311999 - RNA, 17 nt, Human
cagccacauuccugaug

SEQ ID NO: 3312000 - RNA, 15 nt, Human
cagccacauuccuga

SEQ ID NO: 3312001 - RNA, 14 nt, Human
cagccacauuccug

SEQ ID NO: 3312002 - RNA, 18 nt, Human
cagcccacuucugccaua

SEQ ID NO: 3312003 - RNA, 22 nt, Human
cagccccaaaacucuccucugc

SEQ ID NO: 3312004 - RNA, 21 nt, Human
cagccccaaaacucuccucug

SEQ ID NO: 3312005 - RNA, 20 nt, Human
cagccccaaaacucuccucu

SEQ ID NO: 3312006 - RNA, 15 nt, Human
cagcccaccccucaa

SEQ ID NO: 3312007 - RNA, 15 nt, Human
cagcccacuucugcc

SEQ ID NO: 3312008 - RNA, 18 nt, Human
cagaugggugcuuggagg

SEQ ID NO: 3312009 - RNA, 23 nt, Human
cagaugggugcuuggaggaagga

SEQ ID NO: 3312010 - RNA, 18 nt, Human
cagcaaaagaugcuucuc

SEQ ID NO: 3312011 - RNA, 14 nt, Human
cagauucuuuccug

SEQ ID NO: 3312012 - RNA, 17 nt, Human
cagcaaggagauuuaca

SEQ ID NO: 3312013 - RNA, 18 nt, Human
cagcaaggagauuuacaa

SEQ ID NO: 3312014 - RNA, 12 nt, Human
cagcaagugaga

SEQ ID NO: 3312015 - RNA, 14 nt, Human
cagcaagugagagc

SEQ ID NO: 3312016 - RNA, 15 nt, Human
cagcaagugagagcu

SEQ ID NO: 3312017 - RNA, 16 nt, Human
cagcaagugagagcug

SEQ ID NO: 3312018 - RNA, 17 nt, Human
cagcaagugagagcugg

SEQ ID NO: 3312019 - RNA, 22 nt, Human
cagcaauaaagcagcguuucua

SEQ ID NO: 3312020 - RNA, 19 nt, Human
cagcaagugagagcugggu

SEQ ID NO: 3312021 - RNA, 21 nt, Human
cagcaagugagagcugggugu

SEQ ID NO: 3312022 - RNA, 21 nt, Human
cagcaauaaagcagcguuucu

SEQ ID NO: 3312023 - RNA, 13 nt, Human
cagcaauaaagca

SEQ ID NO: 3312024 - RNA, 17 nt, Human
cagcagaaaugccuuac

SEQ ID NO: 3312025 - RNA, 15 nt, Human
cagcagaaaugccuu

SEQ ID NO: 3312026 - RNA, 22 nt, Human
cagcagaaaugccuuacccuca

SEQ ID NO: 3312027 - RNA, 19 nt, Human
cagcagaaaugccuuaccc

SEQ ID NO: 3312028 - RNA, 13 nt, Human
cagcagagcaccu

SEQ ID NO: 3312029 - RNA, 11 nt, Human
cagcagagcac

SEQ ID NO: 3312030 - RNA, 13 nt, Human
cagaggagagagg

SEQ ID NO: 3312031 - RNA, 19 nt, Human
cagaggagagaggaccccc

SEQ ID NO: 3312032 - RNA, 15 nt, Human
cagaggagagaggac

SEQ ID NO: 3312033 - RNA, 11 nt, Human
cagaggcagcc

SEQ ID NO: 3312034 - RNA, 20 nt, Human
cagaggagagaggacccccu

SEQ ID NO: 3312035 - RNA, 21 nt, Human
cagagcccacgcccccacugg

SEQ ID NO: 3312036 - RNA, 20 nt, Human
cagagcccacgcccccacug

SEQ ID NO: 3312037 - RNA, 19 nt, Human
cagagcccacgcccccacu

SEQ ID NO: 3312038 - RNA, 17 nt, Human
cagagcccacgccccca

SEQ ID NO: 3312039 - RNA, 23 nt, Human
cagagcccacgcccccacuggug

SEQ ID NO: 3312040 - RNA, 13 nt, Human
cagaggaaggaga

SEQ ID NO: 3312041 - RNA, 13 nt, Human
cagagccugcagu

SEQ ID NO: 3312042 - RNA, 20 nt, Human
cagaggaaagcaaaggagau

SEQ ID NO: 3312043 - RNA, 12 nt, Human
cagagccugcag

SEQ ID NO: 3312044 - RNA, 23 nt, Human
cagagcaccuuagacagucccug

SEQ ID NO: 3312045 - RNA, 12 nt, Human
cagagcagagac

SEQ ID NO: 3312046 - RNA, 11 nt, Human
cagagcagaga

SEQ ID NO: 3312047 - RNA, 22 nt, Human
cagagcaccuuagacagucccu

SEQ ID NO: 3312048 - RNA, 21 nt, Human
cagagcaccuuagacaguccc

SEQ ID NO: 3312049 - RNA, 19 nt, Human
cagagcaccuuagacaguc

SEQ ID NO: 3312050 - RNA, 18 nt, Human
cagagcaccuuagacagu

SEQ ID NO: 3312051 - RNA, 21 nt, Human
cagagcagagaccaucccuga

SEQ ID NO: 3312052 - RNA, 19 nt, Human
cagagcagagaccaucccu

SEQ ID NO: 3312053 - RNA, 18 nt, Human
cagagcagagaccauccc

SEQ ID NO: 3312054 - RNA, 17 nt, Human
cagagcagagaccaucc

SEQ ID NO: 3312055 - RNA, 15 nt, Human
cagagcagagaccau

SEQ ID NO: 3312056 - RNA, 14 nt, Human
cagagcagagacca

SEQ ID NO: 3312057 - RNA, 13 nt, Human
cagagcagagacc

SEQ ID NO: 3312058 - RNA, 15 nt, Human
cagagcccaccuugg

SEQ ID NO: 3312059 - RNA, 17 nt, Human
cagagcccaccuuggcu

SEQ ID NO: 3312060 - RNA, 19 nt, Human
cagagcccaccuuggcuca

SEQ ID NO: 3312061 - RNA, 20 nt, Human
cagagcccaccuuggcucaa

SEQ ID NO: 3312062 - RNA, 16 nt, Human
cagagcccacgccccc

SEQ ID NO: 3312063 - RNA, 19 nt, Human
cagagaaugaaagggccca

SEQ ID NO: 3312064 - RNA, 15 nt, Human
cagagaauucucuua

SEQ ID NO: 3312065 - RNA, 20 nt, Human
cagagaaugaaagggcccag

SEQ ID NO: 3312066 - RNA, 21 nt, Human
cagagaaugaaagggcccaga

SEQ ID NO: 3312067 - RNA, 13 nt, Human
cagagaccauccc

SEQ ID NO: 3312068 - RNA, 16 nt, Human
cagagaccaucccuga

SEQ ID NO: 3312069 - RNA, 14 nt, Human
cagagaccaucccu

SEQ ID NO: 3312070 - RNA, 15 nt, Human
cagagacacaagccu

SEQ ID NO: 3312071 - RNA, 14 nt, Human
cagagacacaagcc

SEQ ID NO: 3312072 - RNA, 17 nt, Human
cagagacacaagccuuc

SEQ ID NO: 3312073 - RNA, 16 nt, Human
cagagacacaagccuu

SEQ ID NO: 3312074 - RNA, 16 nt, Human
cagagcaccuuagaca

SEQ ID NO: 3312075 - RNA, 20 nt, Human
cagagcaagugagacccugu

SEQ ID NO: 3312076 - RNA, 14 nt, Human
cagagcaagugaga

SEQ ID NO: 3312077 - RNA, 18 nt, Human
cagagacuccugcaggca

SEQ ID NO: 3312078 - RNA, 17 nt, Human
cagagacuccugcaggc

SEQ ID NO: 3312079 - RNA, 16 nt, Human
cagagacuccugcagg

SEQ ID NO: 3312080 - RNA, 15 nt, Human
cagagacuccugcag

SEQ ID NO: 3312081 - RNA, 14 nt, Human
cagagacuccugca

SEQ ID NO: 3312082 - RNA, 13 nt, Human
cagagacuccugc

SEQ ID NO: 3312083 - RNA, 20 nt, Human
cagagaccaucccugaaggc

SEQ ID NO: 3312084 - RNA, 19 nt, Human
cagagaccaucccugaagg

SEQ ID NO: 3312085 - RNA, 18 nt, Human
cagagaccaucccugaag

SEQ ID NO: 3312086 - RNA, 17 nt, Human
cagagaccaucccugaa

SEQ ID NO: 3312087 - RNA, 21 nt, Human
cagagaccaucccugaaggcc

SEQ ID NO: 3312088 - RNA, 18 nt, Human
cagaguuguuacauuuuu

SEQ ID NO: 3312089 - RNA, 15 nt, Human
cagaguuguuacauu

SEQ ID NO: 3312090 - RNA, 19 nt, Human
cagaguuguuacauuuuua

SEQ ID NO: 3312091 - RNA, 22 nt, Human
cagaguugaagacagagcuaca

SEQ ID NO: 3312092 - RNA, 14 nt, Human
cagaguuguuacau

SEQ ID NO: 3312093 - RNA, 20 nt, Human
cagaguugaagacagagcua

SEQ ID NO: 3312094 - RNA, 19 nt, Human
cagaguugaagacagagcu

SEQ ID NO: 3312095 - RNA, 18 nt, Human
cagaguugaagacagagc

SEQ ID NO: 3312096 - RNA, 17 nt, Human
cagaguugaagacagag

SEQ ID NO: 3312097 - RNA, 14 nt, Human
cagaguugaagaca

SEQ ID NO: 3312098 - RNA, 16 nt, Human
cagaguugaagacaga

SEQ ID NO: 3312099 - RNA, 15 nt, Human
cagaguugaagacag

SEQ ID NO: 3312100 - RNA, 22 nt, Human
cagauacaggaaaagcugcuga

SEQ ID NO: 3312101 - RNA, 20 nt, Human
cagauacaggaaaagcugcu

SEQ ID NO: 3312102 - RNA, 21 nt, Human
cagauacaggaaaagcugcug

SEQ ID NO: 3312103 - RNA, 20 nt, Human
cagaucucuaacuucaccau

SEQ ID NO: 3312104 - RNA, 17 nt, Human
cagaugcaccagcccuu

SEQ ID NO: 3312105 - RNA, 22 nt, Human
cagaugcaccagcccuuagcag

SEQ ID NO: 3312106 - RNA, 14 nt, Human
cagaugcaccagcc

SEQ ID NO: 3312107 - RNA, 16 nt, Human
cagaugcaccagcccu

SEQ ID NO: 3312108 - RNA, 13 nt, Human
cagaugcaccagc

SEQ ID NO: 3312109 - RNA, 13 nt, Human
cagagucucacug

SEQ ID NO: 3312110 - RNA, 17 nt, Human
cagagucucacuguugc

SEQ ID NO: 3312111 - RNA, 19 nt, Human
cagagucucacuguugccc

SEQ ID NO: 3312112 - RNA, 20 nt, Human
cagagucucacuguugccca

SEQ ID NO: 3312113 - RNA, 21 nt, Human
cagagucucacuguugcccag

SEQ ID NO: 3312114 - RNA, 15 nt, Human
cagagggccugcaag

SEQ ID NO: 3312115 - RNA, 20 nt, Human
cagagggagugacagaggca

SEQ ID NO: 3312116 - RNA, 21 nt, Human
cagagggagugacagaggcag

SEQ ID NO: 3312117 - RNA, 22 nt, Human
cagagggagugacagaggcagc

SEQ ID NO: 3312118 - RNA, 23 nt, Human
cagagggagugacagaggcagcc

SEQ ID NO: 3312119 - RNA, 19 nt, Human
cagagugagacucugucuc

SEQ ID NO: 3312120 - RNA, 20 nt, Human
cagagugagacucugucuca

SEQ ID NO: 3312121 - RNA, 22 nt, Human
cagagucucacuguugcccagg

SEQ ID NO: 3312122 - RNA, 23 nt, Human
cagagucucacuguugcccaggc

SEQ ID NO: 3312123 - RNA, 16 nt, Human
cagagugagacucugu

SEQ ID NO: 3312124 - RNA, 17 nt, Human
cagagugagacucuguc

SEQ ID NO: 3312125 - RNA, 18 nt, Human
cagagugagacucugucu

SEQ ID NO: 3312126 - RNA, 20 nt, Human
cagaggccaugggccuccug

SEQ ID NO: 3312127 - RNA, 21 nt, Human
cagaggccaugggccuccugu

SEQ ID NO: 3312128 - RNA, 23 nt, Human
cagaggcagccccauucugccug

SEQ ID NO: 3312129 - RNA, 19 nt, Human
cagaggccaugggccuccu

SEQ ID NO: 3312130 - RNA, 16 nt, Human
cagaggccaugggccu

SEQ ID NO: 3312131 - RNA, 12 nt, Human
cagaggcagccc

SEQ ID NO: 3312132 - RNA, 13 nt, Human
cagaggcagcccc

SEQ ID NO: 3312133 - RNA, 14 nt, Human
cagaggcagcccca

SEQ ID NO: 3312134 - RNA, 15 nt, Human
cagaggcagccccau

SEQ ID NO: 3312135 - RNA, 18 nt, Human
cagaggcagccccauucu

SEQ ID NO: 3312136 - RNA, 19 nt, Human
cagaggcagccccauucug

SEQ ID NO: 3312137 - RNA, 20 nt, Human
cagaggcagccccauucugc

SEQ ID NO: 3312138 - RNA, 22 nt, Human
cagaggcagccccauucugccu

SEQ ID NO: 3312139 - RNA, 14 nt, Human
cagagggagugaca

SEQ ID NO: 3312140 - RNA, 16 nt, Human
cagagggagugacaga

SEQ ID NO: 3312141 - RNA, 18 nt, Human
cagagggagugacagagg

SEQ ID NO: 3312142 - RNA, 19 nt, Human
cagagggagugacagaggc

SEQ ID NO: 3312143 - RNA, 23 nt, Human
cagaggcugccucucccaucacu

SEQ ID NO: 3312144 - RNA, 13 nt, Human
cagaggcugccuc

SEQ ID NO: 3312145 - RNA, 23 nt, Human
cagaaaauggaagacagcucuua

SEQ ID NO: 3312146 - RNA, 22 nt, Human
cagaaaauggaagacagcucuu

SEQ ID NO: 3312147 - RNA, 21 nt, Human
cagaaaauggaagacagcucu

SEQ ID NO: 3312148 - RNA, 20 nt, Human
cagaaaauggaagacagcuc

SEQ ID NO: 3312149 - RNA, 16 nt, Human
cagaaaauggaagaca

SEQ ID NO: 3312150 - RNA, 22 nt, Human
cacuuuuguucuugguuuguaa

SEQ ID NO: 3312151 - RNA, 14 nt, Human
cacuuuuguucuug

SEQ ID NO: 3312152 - RNA, 16 nt, Human
cacuuugggaggccaa

SEQ ID NO: 3312153 - RNA, 13 nt, Human
cacuuugggaggc

SEQ ID NO: 3312154 - RNA, 12 nt, Human
cacuuugggagg

SEQ ID NO: 3312155 - RNA, 23 nt, Human
cacuuuguucuggcucuuccagg

SEQ ID NO: 3312156 - RNA, 16 nt, Human
cacuuuguucuggcuc

SEQ ID NO: 3312157 - RNA, 14 nt, Human
cacuuuguucuggc

SEQ ID NO: 3312158 - RNA, 13 nt, Human
cacuuuguucugg

SEQ ID NO: 3312159 - RNA, 22 nt, Human
cacuuucuagccagaggagaga

SEQ ID NO: 3312160 - RNA, 21 nt, Human
cagaagacacugaugggcaac

SEQ ID NO: 3312161 - RNA, 19 nt, Human
cagaaggaagacuucaucc

SEQ ID NO: 3312162 - RNA, 18 nt, Human
cagaaggaagacuucauc

SEQ ID NO: 3312163 - RNA, 17 nt, Human
cagaaggaagacuucau

SEQ ID NO: 3312164 - RNA, 16 nt, Human
cagaaggaagacuuca

SEQ ID NO: 3312165 - RNA, 17 nt, Human
cagaaucucaaauaacu

SEQ ID NO: 3312166 - RNA, 18 nt, Human
cagaaucucaaauaacua

SEQ ID NO: 3312167 - RNA, 19 nt, Human
cagacauacuaaccagcag

SEQ ID NO: 3312168 - RNA, 20 nt, Human
cagacaguuaagagaaauga

SEQ ID NO: 3312169 - RNA, 19 nt, Human
cagacaccuugacagggca

SEQ ID NO: 3312170 - RNA, 20 nt, Human
cagacaccuugacagggcac

SEQ ID NO: 3312171 - RNA, 22 nt, Human
cagacaccuugacagggcacac

SEQ ID NO: 3312172 - RNA, 13 nt, Human
cagacacaggccc

SEQ ID NO: 3312173 - RNA, 14 nt, Human
cagacacaggcccg

SEQ ID NO: 3312174 - RNA, 15 nt, Human
cagacacaggcccgg

SEQ ID NO: 3312175 - RNA, 17 nt, Human
cagacacaggcccggcu

SEQ ID NO: 3312176 - RNA, 18 nt, Human
cagacacaggcccggcuc

SEQ ID NO: 3312177 - RNA, 21 nt, Human
cagacacaggcccggcuccag

SEQ ID NO: 3312178 - RNA, 22 nt, Human
cagacacaggcccggcuccagg

SEQ ID NO: 3312179 - RNA, 23 nt, Human
cagacacaggcccggcuccaggc

SEQ ID NO: 3312180 - RNA, 23 nt, Human
cagacacauguccaagaagccca

SEQ ID NO: 3312181 - RNA, 22 nt, Human
cagacacauguccaagaagccc

SEQ ID NO: 3312182 - RNA, 21 nt, Human
cagacacauguccaagaagcc

SEQ ID NO: 3312183 - RNA, 17 nt, Human
cagacacauguccaaga

SEQ ID NO: 3312184 - RNA, 14 nt, Human
cagacacaugucca

SEQ ID NO: 3312185 - RNA, 22 nt, Human
cagacaaagcgugguggacaug

SEQ ID NO: 3312186 - RNA, 16 nt, Human
cagacaacaaaccugu

SEQ ID NO: 3312187 - RNA, 20 nt, Human
cagacaacaaaccuguuucu

SEQ ID NO: 3312188 - RNA, 12 nt, Human
cagacaaagcgu

SEQ ID NO: 3312189 - RNA, 24 nt, Human
cagaauuucccaaagcagugcaug

SEQ ID NO: 3312190 - RNA, 20 nt, Human
cagaauuucccaaagcagug

SEQ ID NO: 3312191 - RNA, 19 nt, Human
cagaauuucccaaagcagu

SEQ ID NO: 3312192 - RNA, 18 nt, Human
cagaauuucccaaagcag

SEQ ID NO: 3312193 - RNA, 17 nt, Human
cagaauuucccaaagca

SEQ ID NO: 3312194 - RNA, 11 nt, Human
cagaauucuca

SEQ ID NO: 3312195 - RNA, 18 nt, Human
cagaauucucuaguuuga

SEQ ID NO: 3312196 - RNA, 15 nt, Human
cagaauucucuaguu

SEQ ID NO: 3312197 - RNA, 14 nt, Human
cagaauuucccaaa

SEQ ID NO: 3312198 - RNA, 19 nt, Human
cagagaaaguacuucucca

SEQ ID NO: 3312199 - RNA, 23 nt, Human
cagagaaaguacuucuccacccu

SEQ ID NO: 3312200 - RNA, 16 nt, Human
cagacccggcugcgug

SEQ ID NO: 3312201 - RNA, 12 nt, Human
cagacccugccc

SEQ ID NO: 3312202 - RNA, 14 nt, Human
cagacccugcccug

SEQ ID NO: 3312203 - RNA, 13 nt, Human
cagacccugcccu

SEQ ID NO: 3312204 - RNA, 12 nt, Human
cagacccggcug

SEQ ID NO: 3312205 - RNA, 14 nt, Human
cagacccggcugcg

SEQ ID NO: 3312206 - RNA, 21 nt, Human
cagacccugcccugugggccc

SEQ ID NO: 3312207 - RNA, 17 nt, Human
cagacccugcccugugg

SEQ ID NO: 3312208 - RNA, 16 nt, Human
cagacccugcccugug

SEQ ID NO: 3312209 - RNA, 15 nt, Human
cagacccugcccugu

SEQ ID NO: 3312210 - RNA, 22 nt, Human
cagacccugcccugugggcccc

SEQ ID NO: 3312211 - RNA, 20 nt, Human
cagaccacaaaacuuuucua

SEQ ID NO: 3312212 - RNA, 14 nt, Human
cagaccacaaaacu

SEQ ID NO: 3312213 - RNA, 18 nt, Human
cacuuucuagccagagga

SEQ ID NO: 3312214 - RNA, 20 nt, Human
cacuuucuagccagaggaga

SEQ ID NO: 3312215 - RNA, 19 nt, Human
cacuuucuagccagaggag

SEQ ID NO: 3312216 - RNA, 14 nt, Human
cacuugcagacucu

SEQ ID NO: 3312217 - RNA, 18 nt, Human
cacuugcagacucuacag

SEQ ID NO: 3312218 - RNA, 19 nt, Human
cacuugcagacucuacaga

SEQ ID NO: 3312219 - RNA, 22 nt, Human
cacuugcagacucuacagaggc

SEQ ID NO: 3312220 - RNA, 24 nt, Human
cacuugcagacucuacagaggcca

SEQ ID NO: 3312221 - RNA, 16 nt, Human
cacuugacaucaacug

SEQ ID NO: 3312222 - RNA, 20 nt, Human
cacuugagaauuacccuuuu

SEQ ID NO: 3312223 - RNA, 19 nt, Human
cacuugacaucaacugcau

SEQ ID NO: 3312224 - RNA, 17 nt, Human
cacuugagaauuacccu

SEQ ID NO: 3312225 - RNA, 13 nt, Human
cacuugaguccag

SEQ ID NO: 3312226 - RNA, 13 nt, Human
cacuugcagacuc

SEQ ID NO: 3312227 - RNA, 23 nt, Human
cacuucgggaggucgaggcagga

SEQ ID NO: 3312228 - RNA, 21 nt, Human
cacuucgggaggucgaggcag

SEQ ID NO: 3312229 - RNA, 22 nt, Human
cacuucugccauauucuguugg

SEQ ID NO: 3312230 - RNA, 16 nt, Human
cacuucccuacaugga

SEQ ID NO: 3312231 - RNA, 21 nt, Human
cacuucagcugacuuuucugu

SEQ ID NO: 3312232 - RNA, 12 nt, Human
cacuucagcuga

SEQ ID NO: 3312233 - RNA, 13 nt, Human
cacugugaagaga

SEQ ID NO: 3312234 - RNA, 14 nt, Human
cacugugccaugug

SEQ ID NO: 3312235 - RNA, 22 nt, Human
cacuguucucugcccuccaaga

SEQ ID NO: 3312236 - RNA, 21 nt, Human
cacuguucucugcccuccaag

SEQ ID NO: 3312237 - RNA, 19 nt, Human
cacuguucucugcccucca

SEQ ID NO: 3312238 - RNA, 17 nt, Human
cacuguucucugcccuc

SEQ ID NO: 3312239 - RNA, 16 nt, Human
cacuguucucugcccu

SEQ ID NO: 3312240 - RNA, 15 nt, Human
cacuguucucugccc

SEQ ID NO: 3312241 - RNA, 14 nt, Human
cacuguucucugcc

SEQ ID NO: 3312242 - RNA, 13 nt, Human
cacuguucucugc

SEQ ID NO: 3312243 - RNA, 22 nt, Human
cacugugcugagucugaaggcu

SEQ ID NO: 3312244 - RNA, 21 nt, Human
cacugugcugagucugaaggc

SEQ ID NO: 3312245 - RNA, 20 nt, Human
cacugugcugagucugaagg

SEQ ID NO: 3312246 - RNA, 17 nt, Human
cacugugcugagucuga

SEQ ID NO: 3312247 - RNA, 15 nt, Human
cacugugcugagucu

SEQ ID NO: 3312248 - RNA, 13 nt, Human
cacugugcugagu

SEQ ID NO: 3312249 - RNA, 18 nt, Human
cacugugccaugugccag

SEQ ID NO: 3312250 - RNA, 15 nt, Human
cacugugccaugugc

SEQ ID NO: 3312251 - RNA, 16 nt, Human
cacugugccaugugcc

SEQ ID NO: 3312252 - RNA, 12 nt, Human
cacugcucuggu

SEQ ID NO: 3312253 - RNA, 14 nt, Human
cacugcaccgggcc

SEQ ID NO: 3312254 - RNA, 15 nt, Human
cacugcaccgggcca

SEQ ID NO: 3312255 - RNA, 16 nt, Human
cacugcaccgggccac

SEQ ID NO: 3312256 - RNA, 18 nt, Human
cacugcaccgggccacag

SEQ ID NO: 3312257 - RNA, 19 nt, Human
cacugcaccgggccacaga

SEQ ID NO: 3312258 - RNA, 18 nt, Human
cacugcacuauagccuag

SEQ ID NO: 3312259 - RNA, 21 nt, Human
cacugcuuuuggucuguguga

SEQ ID NO: 3312260 - RNA, 17 nt, Human
cacuggaacacuaauga

SEQ ID NO: 3312261 - RNA, 16 nt, Human
cacugcuuccagugag

SEQ ID NO: 3312262 - RNA, 15 nt, Human
cacugcuuccaguga

SEQ ID NO: 3312263 - RNA, 14 nt, Human
cacugcuuccagug

SEQ ID NO: 3312264 - RNA, 13 nt, Human
cacugcuuaacuu

SEQ ID NO: 3312265 - RNA, 20 nt, Human
cacugcuuuuggucugugug

SEQ ID NO: 3312266 - RNA, 22 nt, Human
cacugcuuccagugaggcucug

SEQ ID NO: 3312267 - RNA, 21 nt, Human
cacugcuuccagugaggcucu

SEQ ID NO: 3312268 - RNA, 20 nt, Human
cacugcuuccagugaggcuc

SEQ ID NO: 3312269 - RNA, 19 nt, Human
cacugcuuccagugaggcu

SEQ ID NO: 3312270 - RNA, 18 nt, Human
cacugcuuccagugaggc

SEQ ID NO: 3312271 - RNA, 23 nt, Human
cacugacauuguuggccaaagcc

SEQ ID NO: 3312272 - RNA, 15 nt, Human
cacucugucgcccag

SEQ ID NO: 3312273 - RNA, 16 nt, Human
cacucugucgcccagu

SEQ ID NO: 3312274 - RNA, 19 nt, Human
cacucugucgcccagucug

SEQ ID NO: 3312275 - RNA, 23 nt, Human
cacucuggcagcucagagagggu

SEQ ID NO: 3312276 - RNA, 21 nt, Human
cacucuggcagcucagagagg

SEQ ID NO: 3312277 - RNA, 20 nt, Human
cacucuggcagcucagagag

SEQ ID NO: 3312278 - RNA, 19 nt, Human
cacucuggcagcucagaga

SEQ ID NO: 3312279 - RNA, 17 nt, Human
cacucuggcagcucaga

SEQ ID NO: 3312280 - RNA, 16 nt, Human
cacucuggcagcucag

SEQ ID NO: 3312281 - RNA, 15 nt, Human
cacucuggcagcuca

SEQ ID NO: 3312282 - RNA, 13 nt, Human
cacugagacagcc

SEQ ID NO: 3312283 - RNA, 12 nt, Human
cacugagacagc

SEQ ID NO: 3312284 - RNA, 22 nt, Human
cacugagacagcccgggcucug

SEQ ID NO: 3312285 - RNA, 19 nt, Human
cacugagacagcccgggcu

SEQ ID NO: 3312286 - RNA, 17 nt, Human
cacugagacagcccggg

SEQ ID NO: 3312287 - RNA, 14 nt, Human
cacugagacagccc

SEQ ID NO: 3312288 - RNA, 14 nt, Human
cacugcaaccuccg

SEQ ID NO: 3312289 - RNA, 16 nt, Human
cacugcaaccuccgcc

SEQ ID NO: 3312290 - RNA, 23 nt, Human
cacugcaaccuccgccucuuggg

SEQ ID NO: 3312291 - RNA, 13 nt, Human
cacugcaaccucc

SEQ ID NO: 3312292 - RNA, 23 nt, Human
cacugagacagcccgggcucugc

SEQ ID NO: 3312293 - RNA, 14 nt, Human
cacugaugggcaac

SEQ ID NO: 3312294 - RNA, 18 nt, Human
cacugaugggcaaccccc

SEQ ID NO: 3312295 - RNA, 24 nt, Human
cacugaugggcaacccccagccug

SEQ ID NO: 3312296 - RNA, 14 nt, Human
cacuaaccacgcug

SEQ ID NO: 3312297 - RNA, 15 nt, Human
cacuaaccacgcugg

SEQ ID NO: 3312298 - RNA, 16 nt, Human
cacuaaccacgcugga

SEQ ID NO: 3312299 - RNA, 18 nt, Human
cacuaaccacgcuggacc

SEQ ID NO: 3312300 - RNA, 17 nt, Human
cacuaaggugugcucug

SEQ ID NO: 3312301 - RNA, 18 nt, Human
cacuaaggugugcucuga

SEQ ID NO: 3312302 - RNA, 14 nt, Human
cacuauaauguaag

SEQ ID NO: 3312303 - RNA, 14 nt, Human
cacuauagccuagg

SEQ ID NO: 3312304 - RNA, 18 nt, Human
cacuauaauguaagcucu

SEQ ID NO: 3312305 - RNA, 21 nt, Human
cacuauagccuaggugacaga

SEQ ID NO: 3312306 - RNA, 16 nt, Human
cacuauguugcccagg

SEQ ID NO: 3312307 - RNA, 17 nt, Human
cacuauguugcccaggc

SEQ ID NO: 3312308 - RNA, 18 nt, Human
cacuauguugcccaggca

SEQ ID NO: 3312309 - RNA, 19 nt, Human
cacuauguugcccaggcag

SEQ ID NO: 3312310 - RNA, 15 nt, Human
cacuauguugcccag

SEQ ID NO: 3312311 - RNA, 20 nt, Human
cacucaaaagcugggcaggu

SEQ ID NO: 3312312 - RNA, 20 nt, Human
cacuauguugcccaggcagg

SEQ ID NO: 3312313 - RNA, 21 nt, Human
cacuauguugcccaggcaggu

SEQ ID NO: 3312314 - RNA, 19 nt, Human
cacucaaaagcugggcagg

SEQ ID NO: 3312315 - RNA, 18 nt, Human
cacucaaaagcugggcag

SEQ ID NO: 3312316 - RNA, 17 nt, Human
cacucaaaagcugggca

SEQ ID NO: 3312317 - RNA, 15 nt, Human
cacucaaaagcuggg

SEQ ID NO: 3312318 - RNA, 12 nt, Human
cacucagaagac

SEQ ID NO: 3312319 - RNA, 16 nt, Human
cacucagaagacacug

SEQ ID NO: 3312320 - RNA, 17 nt, Human
cacucagaagacacuga

SEQ ID NO: 3312321 - RNA, 19 nt, Human
cacucacauuuauucugcu

SEQ ID NO: 3312322 - RNA, 20 nt, Human
cacucacauuuauucugcuc

SEQ ID NO: 3312323 - RNA, 22 nt, Human
cacucagaagacacugaugggc

SEQ ID NO: 3312324 - RNA, 18 nt, Human
cacucagaagacacugau

SEQ ID NO: 3312325 - RNA, 19 nt, Human
cacucagaagacacugaug

SEQ ID NO: 3312326 - RNA, 15 nt, Human
cacucauugaccuga

SEQ ID NO: 3312327 - RNA, 16 nt, Human
cacucaguccauagca

SEQ ID NO: 3312328 - RNA, 15 nt, Human
cacuccccugcuggg

SEQ ID NO: 3312329 - RNA, 12 nt, Human
cacucccugcaa

SEQ ID NO: 3312330 - RNA, 16 nt, Human
cacucccugcaaccug

SEQ ID NO: 3312331 - RNA, 13 nt, Human
cacucccugcaac

SEQ ID NO: 3312332 - RNA, 22 nt, Human
cacucauugaccugaggcccuu

SEQ ID NO: 3312333 - RNA, 20 nt, Human
cacucauugaccugaggccc

SEQ ID NO: 3312334 - RNA, 19 nt, Human
cacucauugaccugaggcc

SEQ ID NO: 3312335 - RNA, 18 nt, Human
cacucauugaccugaggc

SEQ ID NO: 3312336 - RNA, 17 nt, Human
cacucccugcaaccuga

SEQ ID NO: 3312337 - RNA, 21 nt, Human
cacuccuucacagaugggugc

SEQ ID NO: 3312338 - RNA, 14 nt, Human
cacuccuucacaga

SEQ ID NO: 3312339 - RNA, 14 nt, Human
cacucuggcagcuc

SEQ ID NO: 3312340 - RNA, 13 nt, Human
cacucuggcagcu

SEQ ID NO: 3312341 - RNA, 12 nt, Human
cacucuggcagc

SEQ ID NO: 3312342 - RNA, 12 nt, Human
cacucuccuugg

SEQ ID NO: 3312343 - RNA, 23 nt, Human
cacucugagacucgcgacaaugc

SEQ ID NO: 3312344 - RNA, 12 nt, Human
cacucugagacu

SEQ ID NO: 3312345 - RNA, 19 nt, Human
cacgugguccuaaucuucu

SEQ ID NO: 3312346 - RNA, 16 nt, Human
cacgugguccuaaucu

SEQ ID NO: 3312347 - RNA, 23 nt, Human
cacguuucuaaaggcuaccuuug

SEQ ID NO: 3312348 - RNA, 14 nt, Human
cacguuucuaaagg

SEQ ID NO: 3312349 - RNA, 12 nt, Human
cacguuucuaaa

SEQ ID NO: 3312350 - RNA, 18 nt, Human
cacguacacacacauaca

SEQ ID NO: 3312351 - RNA, 19 nt, Human
cacguacacacacauacac

SEQ ID NO: 3312352 - RNA, 14 nt, Human
cacguacacacaca

SEQ ID NO: 3312353 - RNA, 15 nt, Human
cacggcucacugcag

SEQ ID NO: 3312354 - RNA, 20 nt, Human
cacgcuggaccuugaacugg

SEQ ID NO: 3312355 - RNA, 17 nt, Human
cacgcuggaccuugaac

SEQ ID NO: 3312356 - RNA, 16 nt, Human
cacggcucacugcagc

SEQ ID NO: 3312357 - RNA, 17 nt, Human
cacggcucacugcagcc

SEQ ID NO: 3312358 - RNA, 19 nt, Human
cacggcucacugcagccuc

SEQ ID NO: 3312359 - RNA, 20 nt, Human
cacggcucacugcagccuca

SEQ ID NO: 3312360 - RNA, 20 nt, Human
cacgccuguaauccuagcac

SEQ ID NO: 3312361 - RNA, 19 nt, Human
cacgccuguaauccuagca

SEQ ID NO: 3312362 - RNA, 15 nt, Human
cacgcgugcacacac

SEQ ID NO: 3312363 - RNA, 16 nt, Human
cacgcgugcacacacc

SEQ ID NO: 3312364 - RNA, 21 nt, Human
cacgcgugcacacaccagagc

SEQ ID NO: 3312365 - RNA, 23 nt, Human
cacgcgugcacacaccagagccc

SEQ ID NO: 3312366 - RNA, 17 nt, Human
cacgcacuucgggaggu

SEQ ID NO: 3312367 - RNA, 14 nt, Human
cacgauuucuguuu

SEQ ID NO: 3312368 - RNA, 12 nt, Human
cacgauuucugu

SEQ ID NO: 3312369 - RNA, 16 nt, Human
cacgauuucuguuuag

SEQ ID NO: 3312370 - RNA, 18 nt, Human
cacgcccccacuggugac

SEQ ID NO: 3312371 - RNA, 17 nt, Human
cacgcccccacugguga

SEQ ID NO: 3312372 - RNA, 23 nt, Human
cacgccagauucuuuccugaggc

SEQ ID NO: 3312373 - RNA, 15 nt, Human
cacgcccccacuggu

SEQ ID NO: 3312374 - RNA, 13 nt, Human
cacgcccccacug

SEQ ID NO: 3312375 - RNA, 13 nt, Human
cacgccacugcac

SEQ ID NO: 3312376 - RNA, 15 nt, Human
cacgccacugcacua

SEQ ID NO: 3312377 - RNA, 19 nt, Human
cacgccagauucuuuccug

SEQ ID NO: 3312378 - RNA, 22 nt, Human
cacgccagauucuuuccugagg

SEQ ID NO: 3312379 - RNA, 20 nt, Human
cacgccagauucuuuccuga

SEQ ID NO: 3312380 - RNA, 15 nt, Human
caccuugacagggca

SEQ ID NO: 3312381 - RNA, 16 nt, Human
caccuugacagggcac

SEQ ID NO: 3312382 - RNA, 13 nt, Human
caccuugacaggg

SEQ ID NO: 3312383 - RNA, 17 nt, Human
cacgacugcccggcagg

SEQ ID NO: 3312384 - RNA, 16 nt, Human
cacgacugcccggcag

SEQ ID NO: 3312385 - RNA, 22 nt, Human
cacgaauauugcugauggugca

SEQ ID NO: 3312386 - RNA, 19 nt, Human
cacgaauauugcugauggu

SEQ ID NO: 3312387 - RNA, 16 nt, Human
cacgaauauugcugau

SEQ ID NO: 3312388 - RNA, 23 nt, Human
caccuuagacagucccugccaau

SEQ ID NO: 3312389 - RNA, 21 nt, Human
caccuuagacagucccugcca

SEQ ID NO: 3312390 - RNA, 19 nt, Human
caccuuagacagucccugc

SEQ ID NO: 3312391 - RNA, 18 nt, Human
caccuuagacagucccug

SEQ ID NO: 3312392 - RNA, 16 nt, Human
caccuuagacaguccc

SEQ ID NO: 3312393 - RNA, 14 nt, Human
caccuuagacaguc

SEQ ID NO: 3312394 - RNA, 15 nt, Human
caccgggcacucaga

SEQ ID NO: 3312395 - RNA, 22 nt, Human
caccgggcacucagaagacacu

SEQ ID NO: 3312396 - RNA, 15 nt, Human
caccgggccacagag

SEQ ID NO: 3312397 - RNA, 18 nt, Human
caccgggccacagagaaa

SEQ ID NO: 3312398 - RNA, 14 nt, Human
caccgggcacucag

SEQ ID NO: 3312399 - RNA, 20 nt, Human
caccggcuggccuggccccu

SEQ ID NO: 3312400 - RNA, 18 nt, Human
caccggcuggccuggccc

SEQ ID NO: 3312401 - RNA, 17 nt, Human
caccggcuggccuggcc

SEQ ID NO: 3312402 - RNA, 14 nt, Human
caccggcuggccug

SEQ ID NO: 3312403 - RNA, 16 nt, Human
caccggcuggccuggc

SEQ ID NO: 3312404 - RNA, 15 nt, Human
caccggcuggccugg

SEQ ID NO: 3312405 - RNA, 21 nt, Human
caccgcagacaggaccaggga

SEQ ID NO: 3312406 - RNA, 17 nt, Human
caccucucccuuggauu

SEQ ID NO: 3312407 - RNA, 14 nt, Human
caccucucccuugg

SEQ ID NO: 3312408 - RNA, 13 nt, Human
caccucucccuug

SEQ ID NO: 3312409 - RNA, 13 nt, Human
caccuccugccuc

SEQ ID NO: 3312410 - RNA, 11 nt, Human
caccuccugcc

SEQ ID NO: 3312411 - RNA, 14 nt, Human
caccuccugccucg

SEQ ID NO: 3312412 - RNA, 23 nt, Human
caccuggccucugcacuccccug

SEQ ID NO: 3312413 - RNA, 20 nt, Human
caccuggccucugcacuccc

SEQ ID NO: 3312414 - RNA, 19 nt, Human
caccuggccucugcacucc

SEQ ID NO: 3312415 - RNA, 18 nt, Human
caccuggccucugcacuc

SEQ ID NO: 3312416 - RNA, 17 nt, Human
caccuggccucugcacu

SEQ ID NO: 3312417 - RNA, 15 nt, Human
caccuggccucugca

SEQ ID NO: 3312418 - RNA, 14 nt, Human
caccuggccucugc

SEQ ID NO: 3312419 - RNA, 13 nt, Human
caccuggccucug

SEQ ID NO: 3312420 - RNA, 12 nt, Human
caccuggccucu

SEQ ID NO: 3312421 - RNA, 19 nt, Human
caccucugcacaagcugca

SEQ ID NO: 3312422 - RNA, 18 nt, Human
caccucugcacaagcugc

SEQ ID NO: 3312423 - RNA, 19 nt, Human
caccucucucacuccuuga

SEQ ID NO: 3312424 - RNA, 18 nt, Human
caccucucucacuccuug

SEQ ID NO: 3312425 - RNA, 17 nt, Human
caccucucucacuccuu

SEQ ID NO: 3312426 - RNA, 15 nt, Human
caccucucucacucc

SEQ ID NO: 3312427 - RNA, 14 nt, Human
caccugaagacuca

SEQ ID NO: 3312428 - RNA, 15 nt, Human
caccugaagacucau

SEQ ID NO: 3312429 - RNA, 23 nt, Human
caccugaagacucauucuucugu

SEQ ID NO: 3312430 - RNA, 20 nt, Human
caccugcggugcuaucuccc

SEQ ID NO: 3312431 - RNA, 23 nt, Human
caccugcggugcuaucuccccca

SEQ ID NO: 3312432 - RNA, 20 nt, Human
caccuggaauauauaaccag

SEQ ID NO: 3312433 - RNA, 13 nt, Human
caccgcagacagg

SEQ ID NO: 3312434 - RNA, 12 nt, Human
caccgcagacag

SEQ ID NO: 3312435 - RNA, 18 nt, Human
caccgcagacaggaccag

SEQ ID NO: 3312436 - RNA, 17 nt, Human
caccgcagacaggacca

SEQ ID NO: 3312437 - RNA, 15 nt, Human
caccgcagacaggac

SEQ ID NO: 3312438 - RNA, 14 nt, Human
caccgcagacagga

SEQ ID NO: 3312439 - RNA, 22 nt, Human
caccgaaaacguggcugcuuca

SEQ ID NO: 3312440 - RNA, 21 nt, Human
caccgaaaacguggcugcuuc

SEQ ID NO: 3312441 - RNA, 19 nt, Human
caccgaaaacguggcugcu

SEQ ID NO: 3312442 - RNA, 18 nt, Human
caccgaaaacguggcugc

SEQ ID NO: 3312443 - RNA, 15 nt, Human
caccgaaaacguggc

SEQ ID NO: 3312444 - RNA, 23 nt, Human
cacccugugauggggcccugccu

SEQ ID NO: 3312445 - RNA, 22 nt, Human
cacccugugauggggcccugcc

SEQ ID NO: 3312446 - RNA, 21 nt, Human
cacccugugauggggcccugc

SEQ ID NO: 3312447 - RNA, 20 nt, Human
cacccugugauggggcccug

SEQ ID NO: 3312448 - RNA, 18 nt, Human
cacccugugauggggccc

SEQ ID NO: 3312449 - RNA, 15 nt, Human
cacccugugaugggg

SEQ ID NO: 3312450 - RNA, 12 nt, Human
cacccugugaug

SEQ ID NO: 3312451 - RNA, 11 nt, Human
cacccugugau

SEQ ID NO: 3312452 - RNA, 20 nt, Human
caccccucaacaccucugca

SEQ ID NO: 3312453 - RNA, 13 nt, Human
cacauauugauuu

SEQ ID NO: 3312454 - RNA, 12 nt, Human
cacccggccccu

SEQ ID NO: 3312455 - RNA, 19 nt, Human
cacccgcuaagagggaggg

SEQ ID NO: 3312456 - RNA, 13 nt, Human
cacccggccccug

SEQ ID NO: 3312457 - RNA, 14 nt, Human
cacccggccccugc

SEQ ID NO: 3312458 - RNA, 16 nt, Human
cacccggccccugcug

SEQ ID NO: 3312459 - RNA, 17 nt, Human
cacccggccccugcugg

SEQ ID NO: 3312460 - RNA, 18 nt, Human
cacccggccccugcuggu

SEQ ID NO: 3312461 - RNA, 21 nt, Human
cacccggccccugcugguuca

SEQ ID NO: 3312462 - RNA, 16 nt, Human
cacgccagauucuuuc

SEQ ID NO: 3312463 - RNA, 22 nt, Human
ggcagagcagagaccaucccug

SEQ ID NO: 3312464 - RNA, 18 nt, Human
ggcacccggccccugcug

SEQ ID NO: 3312465 - RNA, 19 nt, Human
ggcacccggccccugcugg

SEQ ID NO: 3312466 - RNA, 17 nt, Human
ggcacccggccccugcu

SEQ ID NO: 3312467 - RNA, 18 nt, Human
ggcacucagaagacacug

SEQ ID NO: 3312468 - RNA, 19 nt, Human
ggcacucagaagacacuga

SEQ ID NO: 3312469 - RNA, 18 nt, Human
ggcaagcaccuccugccu

SEQ ID NO: 3312470 - RNA, 19 nt, Human
ggcaagcaccuccugccuc

SEQ ID NO: 3312471 - RNA, 16 nt, Human
ggcaccagcagccugg

SEQ ID NO: 3312472 - RNA, 17 nt, Human
ggcaccagcagccugga

SEQ ID NO: 3312473 - RNA, 21 nt, Human
ggauucuuccucccucccucu

SEQ ID NO: 3312474 - RNA, 16 nt, Human
ggauucuuccucccuc

SEQ ID NO: 3312475 - RNA, 17 nt, Human
ggcaagcaccuccugcc

SEQ ID NO: 3312476 - RNA, 18 nt, Human
ggaugccugguggcagcu

SEQ ID NO: 3312477 - RNA, 19 nt, Human
ggaugccugguggcagcug

SEQ ID NO: 3312478 - RNA, 20 nt, Human
ggaugccugguggcagcugc

SEQ ID NO: 3312479 - RNA, 16 nt, Human
ggaugaucuaggaaga

SEQ ID NO: 3312480 - RNA, 22 nt, Human
ggaugaucuaggaagacuuugg

SEQ ID NO: 3312481 - RNA, 18 nt, Human
ggaugaucuaggaagacu

SEQ ID NO: 3312482 - RNA, 23 nt, Human
ggagucccaccuuggcugcaggg

SEQ ID NO: 3312483 - RNA, 19 nt, Human
ggaugcccaaagaugcagc

SEQ ID NO: 3312484 - RNA, 13 nt, Human
ggaugccuggugg

SEQ ID NO: 3312485 - RNA, 17 nt, Human
ggaugccugguggcagc

SEQ ID NO: 3312486 - RNA, 18 nt, Human
ggaugcccaaagaugcag

SEQ ID NO: 3312487 - RNA, 20 nt, Human
ggcauguucucugaggacac

SEQ ID NO: 3312488 - RNA, 22 nt, Human
ggccacagaaaauucuucucca

SEQ ID NO: 3312489 - RNA, 20 nt, Human
ggccacugugaagagaacca

SEQ ID NO: 3312490 - RNA, 17 nt, Human
ggccaggcccucugccc

SEQ ID NO: 3312491 - RNA, 16 nt, Human
ggccaggcccucugcc

SEQ ID NO: 3312492 - RNA, 15 nt, Human
ggccaggcccucugc

SEQ ID NO: 3312493 - RNA, 14 nt, Human
ggccaggcccucug

SEQ ID NO: 3312494 - RNA, 13 nt, Human
ggccaggagccuc

SEQ ID NO: 3312495 - RNA, 11 nt, Human
ggccaggagcc

SEQ ID NO: 3312496 - RNA, 12 nt, Human
ggcccagagagg

SEQ ID NO: 3312497 - RNA, 19 nt, Human
ggcagaguugaagacagag

SEQ ID NO: 3312498 - RNA, 17 nt, Human
ggcagaguugaagacag

SEQ ID NO: 3312499 - RNA, 21 nt, Human
ggcagcugcgguccacccagg

SEQ ID NO: 3312500 - RNA, 23 nt, Human
ggcagcugcgguccacccaggag

SEQ ID NO: 3312501 - RNA, 24 nt, Human
ggcagcugcgguccacccaggagc

SEQ ID NO: 3312502 - RNA, 12 nt, Human
ggcaggguccua

SEQ ID NO: 3312503 - RNA, 17 nt, Human
ggcagggucucacucug

SEQ ID NO: 3312504 - RNA, 17 nt, Human
ggcagguuggugggggc

SEQ ID NO: 3312505 - RNA, 23 nt, Human
ggcaugugaugagaggaaaucac

SEQ ID NO: 3312506 - RNA, 18 nt, Human
ggcaugugaugagaggaa

SEQ ID NO: 3312507 - RNA, 22 nt, Human
ggcaugacacgaauauugcuga

SEQ ID NO: 3312508 - RNA, 18 nt, Human
ggaccuugaacuggguac

SEQ ID NO: 3312509 - RNA, 19 nt, Human
ggaccagagcugccaccug

SEQ ID NO: 3312510 - RNA, 14 nt, Human
ggaccagagcugcc

SEQ ID NO: 3312511 - RNA, 22 nt, Human
ggacagccacggccaggccaga

SEQ ID NO: 3312512 - RNA, 11 nt, Human
ggacagcuccu

SEQ ID NO: 3312513 - RNA, 15 nt, Human
ggacagcuccuucug

SEQ ID NO: 3312514 - RNA, 16 nt, Human
ggacagcuccuucugu

SEQ ID NO: 3312515 - RNA, 16 nt, Human
ggacagaggggguggc

SEQ ID NO: 3312516 - RNA, 22 nt, Human
ggacacucaaaagcugggcagg

SEQ ID NO: 3312517 - RNA, 21 nt, Human
ggagucccaccuuggcugcag

SEQ ID NO: 3312518 - RNA, 22 nt, Human
ggagucccaccuuggcugcagg

SEQ ID NO: 3312519 - RNA, 15 nt, Human
ggaggauguucuggg

SEQ ID NO: 3312520 - RNA, 18 nt, Human
ggaggauguucugggaca

SEQ ID NO: 3312521 - RNA, 21 nt, Human
ggaggauguucugggacacag

SEQ ID NO: 3312522 - RNA, 17 nt, Human
ggagggagggcuccaga

SEQ ID NO: 3312523 - RNA, 16 nt, Human
ggagggagggcuccag

SEQ ID NO: 3312524 - RNA, 13 nt, Human
ggagggagggcuc

SEQ ID NO: 3312525 - RNA, 12 nt, Human
ggagggagggcu

SEQ ID NO: 3312526 - RNA, 15 nt, Human
ggagccuccugcccu

SEQ ID NO: 3312527 - RNA, 14 nt, Human
ggagccuccugccc

SEQ ID NO: 3312528 - RNA, 16 nt, Human
gggacucaaugcacug

SEQ ID NO: 3312529 - RNA, 23 nt, Human
gggacucaaugcacugacauugu

SEQ ID NO: 3312530 - RNA, 17 nt, Human
gggacucaaugcacuga

SEQ ID NO: 3312531 - RNA, 19 nt, Human
gggacucaaugcacugaca

SEQ ID NO: 3312532 - RNA, 14 nt, Human
gggacacccuguga

SEQ ID NO: 3312533 - RNA, 19 nt, Human
gggaauguuugccucugcc

SEQ ID NO: 3312534 - RNA, 21 nt, Human
gggaauguuugccucugccuc

SEQ ID NO: 3312535 - RNA, 23 nt, Human
gggaggaucucuugagccuggga

SEQ ID NO: 3312536 - RNA, 22 nt, Human
gggaggauguucugggacacag

SEQ ID NO: 3312537 - RNA, 21 nt, Human
gggaggauugcuugagcucag

SEQ ID NO: 3312538 - RNA, 20 nt, Human
gggaggugggauccuccagg

SEQ ID NO: 3312539 - RNA, 23 nt, Human
gggaggauugcuugagcucagga

SEQ ID NO: 3312540 - RNA, 21 nt, Human
gggagugaguugauagcacag

SEQ ID NO: 3312541 - RNA, 13 nt, Human
gggagcugccugu

SEQ ID NO: 3312542 - RNA, 21 nt, Human
gggagcugccuguucagcucc

SEQ ID NO: 3312543 - RNA, 22 nt, Human
gggagcugccuguucagcucca

SEQ ID NO: 3312544 - RNA, 14 nt, Human
ggcuguuggcuggg

SEQ ID NO: 3312545 - RNA, 15 nt, Human
ggcuguuggcugggg

SEQ ID NO: 3312546 - RNA, 16 nt, Human
ggcuguuggcuggggg

SEQ ID NO: 3312547 - RNA, 20 nt, Human
ggcuguuggcugggggccuc

SEQ ID NO: 3312548 - RNA, 18 nt, Human
ggcuuggggaccagagcu

SEQ ID NO: 3312549 - RNA, 17 nt, Human
ggcuuggggaccagagc

SEQ ID NO: 3312550 - RNA, 21 nt, Human
ggcuucacggaagagccuugc

SEQ ID NO: 3312551 - RNA, 20 nt, Human
ggcuucacggaagagccuug

SEQ ID NO: 3312552 - RNA, 14 nt, Human
ggcuuagucacuga

SEQ ID NO: 3312553 - RNA, 18 nt, Human
ggcugggcucccuuccca

SEQ ID NO: 3312554 - RNA, 21 nt, Human
ggcugggcucccuucccaccu

SEQ ID NO: 3312555 - RNA, 20 nt, Human
ggcugggcucccuucccacc

SEQ ID NO: 3312556 - RNA, 16 nt, Human
ggcugggggaagaagc

SEQ ID NO: 3312557 - RNA, 11 nt, Human
ggcugggcuuc

SEQ ID NO: 3312558 - RNA, 21 nt, Human
ggcugggcuucaguggcagcu

SEQ ID NO: 3312559 - RNA, 22 nt, Human
ggcugggcuucaguggcagcug

SEQ ID NO: 3312560 - RNA, 18 nt, Human
ggcugggcuucaguggca

SEQ ID NO: 3312561 - RNA, 19 nt, Human
ggcugcuucaaggauccug

SEQ ID NO: 3312562 - RNA, 15 nt, Human
ggcugcuucaaggau

SEQ ID NO: 3312563 - RNA, 20 nt, Human
ggcugcuucaaggauccuga

SEQ ID NO: 3312564 - RNA, 14 nt, Human
ggcugcuucaagga

SEQ ID NO: 3312565 - RNA, 17 nt, Human
ggcgcugccccuggcag

SEQ ID NO: 3312566 - RNA, 11 nt, Human
ggcgcugcccc

SEQ ID NO: 3312567 - RNA, 15 nt, Human
ggcgcgguggcucac

SEQ ID NO: 3312568 - RNA, 9 nt, Human
ggcuccaga

SEQ ID NO: 3312569 - RNA, 13 nt, Human
ggcuaugcauuug

SEQ ID NO: 3312570 - RNA, 12 nt, Human
ggcuaugcauuu

SEQ ID NO: 3312571 - RNA, 12 nt, Human
ggcuccaggcuc

SEQ ID NO: 3312572 - RNA, 13 nt, Human
ggcuccaggcucc

SEQ ID NO: 3312573 - RNA, 13 nt, Human
ggcuccaggagca

SEQ ID NO: 3312574 - RNA, 17 nt, Human
ggcuccaggagcagcca

SEQ ID NO: 3312575 - RNA, 16 nt, Human
ggcuccaggagcagcc

SEQ ID NO: 3312576 - RNA, 14 nt, Human
ggcuccaggagcag

SEQ ID NO: 3312577 - RNA, 10 nt, Human
ggcuccagac

SEQ ID NO: 3312578 - RNA, 14 nt, Human
ggcuccaggcuccu

SEQ ID NO: 3312579 - RNA, 16 nt, Human
ggcucucaggccagcu

SEQ ID NO: 3312580 - RNA, 15 nt, Human
ggcucucaggccagc

SEQ ID NO: 3312581 - RNA, 20 nt, Human
ggcucucaggccagcugcuu

SEQ ID NO: 3312582 - RNA, 19 nt, Human
ggcucucaggccagcugcu

SEQ ID NO: 3312583 - RNA, 18 nt, Human
ggcucucaggccagcugc

SEQ ID NO: 3312584 - RNA, 17 nt, Human
ggcucucaggccagcug

SEQ ID NO: 3312585 - RNA, 14 nt, Human
ggcucucaggccag

SEQ ID NO: 3312586 - RNA, 12 nt, Human
ggcucugcccuu

SEQ ID NO: 3312587 - RNA, 15 nt, Human
ggcucugccucccau

SEQ ID NO: 3312588 - RNA, 13 nt, Human
ggcucugccuccc

SEQ ID NO: 3312589 - RNA, 15 nt, Human
ggcucugcccuuggu

SEQ ID NO: 3312590 - RNA, 14 nt, Human
ggcucugcccuugg

SEQ ID NO: 3312591 - RNA, 16 nt, Human
ggcucugccucccauc

SEQ ID NO: 3312592 - RNA, 22 nt, Human
ggccucugcacuccccugcugg

SEQ ID NO: 3312593 - RNA, 19 nt, Human
ggccucugcacuccccugc

SEQ ID NO: 3312594 - RNA, 18 nt, Human
ggccucugcacuccccug

SEQ ID NO: 3312595 - RNA, 13 nt, Human
ggccuggccccuc

SEQ ID NO: 3312596 - RNA, 14 nt, Human
ggccuggccugagc

SEQ ID NO: 3312597 - RNA, 13 nt, Human
ggccuggccugag

SEQ ID NO: 3312598 - RNA, 10 nt, Human
ggccuggccu

SEQ ID NO: 3312599 - RNA, 23 nt, Human
ggccuggccccucagggucccug

SEQ ID NO: 3312600 - RNA, 18 nt, Human
ggccuggccccucagggu

SEQ ID NO: 3312601 - RNA, 17 nt, Human
ggccuggccccucaggg

SEQ ID NO: 3312602 - RNA, 15 nt, Human
ggccuggccccucag

SEQ ID NO: 3312603 - RNA, 14 nt, Human
ggccuggccccuca

SEQ ID NO: 3312604 - RNA, 22 nt, Human
ggccugggggcugggcagagga

SEQ ID NO: 3312605 - RNA, 23 nt, Human
ggccugggggcugggcagaggaa

SEQ ID NO: 3312606 - RNA, 16 nt, Human
ggccuggccugagcug

SEQ ID NO: 3312607 - RNA, 15 nt, Human
ggccuggccugagcu

SEQ ID NO: 3312608 - RNA, 24 nt, Human
ggcgcagcauauucaggaagcuca

SEQ ID NO: 3312609 - RNA, 23 nt, Human
ggcgcagcauauucaggaagcuc

SEQ ID NO: 3312610 - RNA, 16 nt, Human
ggccucugcacucccc

SEQ ID NO: 3312611 - RNA, 20 nt, Human
ggccucgguguggagaagcg

SEQ ID NO: 3312612 - RNA, 14 nt, Human
ggccuccugugugu

SEQ ID NO: 3312613 - RNA, 20 nt, Human
ggccuagcauacguacacau

SEQ ID NO: 3312614 - RNA, 22 nt, Human
ggccuagcauacguacacauuu

SEQ ID NO: 3312615 - RNA, 14 nt, Human
ggccucaagugauu

SEQ ID NO: 3312616 - RNA, 22 nt, Human
ggccucaagugauucuccugcc

SEQ ID NO: 3312617 - RNA, 20 nt, Human
ggcccagagggccugcaagg

SEQ ID NO: 3312618 - RNA, 19 nt, Human
ggcccagagggccugcaag

SEQ ID NO: 3312619 - RNA, 17 nt, Human
ggcccagagggccugca

SEQ ID NO: 3312620 - RNA, 14 nt, Human
ggcccagagggccu

SEQ ID NO: 3312621 - RNA, 17 nt, Human
gccugaagucacacagu

SEQ ID NO: 3312622 - RNA, 19 nt, Human
gcccaguuggguggaugcc

SEQ ID NO: 3312623 - RNA, 21 nt, Human
gcccaguuggguggaugccug

SEQ ID NO: 3312624 - RNA, 15 nt, Human
gccugaagucacaca

SEQ ID NO: 3312625 - RNA, 16 nt, Human
gccugaagucacacag

SEQ ID NO: 3312626 - RNA, 12 nt, Human
gccugagcuggg

SEQ ID NO: 3312627 - RNA, 18 nt, Human
gccuggauggggcugcac

SEQ ID NO: 3312628 - RNA, 16 nt, Human
gccuggauggggcugc

SEQ ID NO: 3312629 - RNA, 20 nt, Human
gccuggauggggcugcaccg

SEQ ID NO: 3312630 - RNA, 18 nt, Human
gccugggcagaaggaaga

SEQ ID NO: 3312631 - RNA, 14 nt, Human
gccuggccccucag

SEQ ID NO: 3312632 - RNA, 13 nt, Human
gccuggccccuca

SEQ ID NO: 3312633 - RNA, 20 nt, Human
gccuggccagaugcaccagc

SEQ ID NO: 3312634 - RNA, 16 nt, Human
gccuggccagaugcac

SEQ ID NO: 3312635 - RNA, 21 nt, Human
gccuggccagaugcaccagcc

SEQ ID NO: 3312636 - RNA, 20 nt, Human
gccuguaauccuagcacuuu

SEQ ID NO: 3312637 - RNA, 15 nt, Human
gccuguaauccuagc

SEQ ID NO: 3312638 - RNA, 15 nt, Human
gccuuacacaauggu

SEQ ID NO: 3312639 - RNA, 21 nt, Human
gcgacaaugcaaaccaucauu

SEQ ID NO: 3312640 - RNA, 20 nt, Human
gcgacaaugcaaaccaucau

SEQ ID NO: 3312641 - RNA, 13 nt, Human
gcgacaaugcaaa

SEQ ID NO: 3312642 - RNA, 12 nt, Human
gcgacaaugcaa

SEQ ID NO: 3312643 - RNA, 15 nt, Human
gcggggacagcuccu

SEQ ID NO: 3312644 - RNA, 17 nt, Human
gcggggacagcuccuuc

SEQ ID NO: 3312645 - RNA, 19 nt, Human
gcggugagaggggaacaga

SEQ ID NO: 3312646 - RNA, 13 nt, Human
gcgguccacccag

SEQ ID NO: 3312647 - RNA, 14 nt, Human
gcgguccacccagg

SEQ ID NO: 3312648 - RNA, 21 nt, Human
gcgcugccccuggcagccccu

SEQ ID NO: 3312649 - RNA, 18 nt, Human
gcgcugccccuggcagcc

SEQ ID NO: 3312650 - RNA, 17 nt, Human
gcgcugccccuggcagc

SEQ ID NO: 3312651 - RNA, 16 nt, Human
gcggagaaaggaaggg

SEQ ID NO: 3312652 - RNA, 19 nt, Human
gcggagacggagucccacc

SEQ ID NO: 3312653 - RNA, 14 nt, Human
gcggggacagcucc

SEQ ID NO: 3312654 - RNA, 21 nt, Human
gcgccuuaaggauguucuagc

SEQ ID NO: 3312655 - RNA, 23 nt, Human
gcgcccaguuggguggaugccug

SEQ ID NO: 3312656 - RNA, 12 nt, Human
gcuccugugucu

SEQ ID NO: 3312657 - RNA, 13 nt, Human
gcuccugugucuu

SEQ ID NO: 3312658 - RNA, 13 nt, Human
gcuccuucugucc

SEQ ID NO: 3312659 - RNA, 17 nt, Human
gcuccuuuagcgcccag

SEQ ID NO: 3312660 - RNA, 17 nt, Human
gcucgagcaugccugga

SEQ ID NO: 3312661 - RNA, 21 nt, Human
gcucgagcaugccuggauggg

SEQ ID NO: 3312662 - RNA, 19 nt, Human
gcucgagcaugccuggaug

SEQ ID NO: 3312663 - RNA, 24 nt, Human
gcuccgcuuucuacccagcgagcc

SEQ ID NO: 3312664 - RNA, 19 nt, Human
gcucccuucccaccucucu

SEQ ID NO: 3312665 - RNA, 20 nt, Human
gcucccuucccaccucucuc

SEQ ID NO: 3312666 - RNA, 18 nt, Human
gcuccgcuuucuacccag

SEQ ID NO: 3312667 - RNA, 21 nt, Human
gcuccgcuuucuacccagcga

SEQ ID NO: 3312668 - RNA, 22 nt, Human
gcuccgcuuucuacccagcgag

SEQ ID NO: 3312669 - RNA, 23 nt, Human
gcuccgcuuucuacccagcgagc

SEQ ID NO: 3312670 - RNA, 20 nt, Human
gcuccagcuguucagcuggu

SEQ ID NO: 3312671 - RNA, 21 nt, Human
gcuccagcuguucagcugguu

SEQ ID NO: 3312672 - RNA, 11 nt, Human
gcuccaggagc

SEQ ID NO: 3312673 - RNA, 14 nt, Human
gcuccaggagcagc

SEQ ID NO: 3312674 - RNA, 12 nt, Human
gcuccaggagca

SEQ ID NO: 3312675 - RNA, 18 nt, Human
gcuccaggagcagccaca

SEQ ID NO: 3312676 - RNA, 17 nt, Human
gcuccaggagcagccac

SEQ ID NO: 3312677 - RNA, 16 nt, Human
gcuccaggagcagcca

SEQ ID NO: 3312678 - RNA, 15 nt, Human
gcuccaggagcagcc

SEQ ID NO: 3312679 - RNA, 12 nt, Human
gcuccaggcucc

SEQ ID NO: 3312680 - RNA, 24 nt, Human
gcuccaggcuccuuuagcgcccag

SEQ ID NO: 3312681 - RNA, 21 nt, Human
gcuaguugggcuuccucauag

SEQ ID NO: 3312682 - RNA, 22 nt, Human
gcggugcuaucucccccagccc

SEQ ID NO: 3312683 - RNA, 19 nt, Human
gcggugcuaucucccccag

SEQ ID NO: 3312684 - RNA, 19 nt, Human
gcucaaguccucuuuucug

SEQ ID NO: 3312685 - RNA, 22 nt, Human
gcucaaguccucuuuucugaga

SEQ ID NO: 3312686 - RNA, 14 nt, Human
gcuaucucccccag

SEQ ID NO: 3312687 - RNA, 18 nt, Human
gcucaaguccucuuuucu

SEQ ID NO: 3312688 - RNA, 13 nt, Human
gcuaucuccccca

SEQ ID NO: 3312689 - RNA, 18 nt, Human
gcucaccucucccuugga

SEQ ID NO: 3312690 - RNA, 17 nt, Human
gcucaccucucccuugg

SEQ ID NO: 3312691 - RNA, 16 nt, Human
gcucaccucucccuug

SEQ ID NO: 3312692 - RNA, 14 nt, Human
gcucaccucucccu

SEQ ID NO: 3312693 - RNA, 16 nt, Human
gcucacauaucuguca

SEQ ID NO: 3312694 - RNA, 12 nt, Human
gcucaccagccc

SEQ ID NO: 3312695 - RNA, 13 nt, Human
gcucaccagcccc

SEQ ID NO: 3312696 - RNA, 14 nt, Human
gcucaccagcccca

SEQ ID NO: 3312697 - RNA, 15 nt, Human
gcucaccagccccag

SEQ ID NO: 3312698 - RNA, 16 nt, Human
gcucagcggggacagc

SEQ ID NO: 3312699 - RNA, 17 nt, Human
gcucagcggggacagcu

SEQ ID NO: 3312700 - RNA, 18 nt, Human
gcucagcggggacagcuc

SEQ ID NO: 3312701 - RNA, 23 nt, Human
gcucagcggggacagcuccuucu

SEQ ID NO: 3312702 - RNA, 22 nt, Human
gcucagcggggacagcuccuuc

SEQ ID NO: 3312703 - RNA, 22 nt, Human
gcugcaaaggguaucaggugcu

SEQ ID NO: 3312704 - RNA, 14 nt, Human
gcugcaguugccag

SEQ ID NO: 3312705 - RNA, 13 nt, Human
gcugcaguugcca

SEQ ID NO: 3312706 - RNA, 18 nt, Human
gcugcauuuaaaagauac

SEQ ID NO: 3312707 - RNA, 17 nt, Human
gcugcauuuaaaagaua

SEQ ID NO: 3312708 - RNA, 19 nt, Human
gcugcauuuaaaagauaca

SEQ ID NO: 3312709 - RNA, 20 nt, Human
gcugccaaugggagcucaug

SEQ ID NO: 3312710 - RNA, 12 nt, Human
gcugccaccugc

SEQ ID NO: 3312711 - RNA, 17 nt, Human
gcugacagacacaggcc

SEQ ID NO: 3312712 - RNA, 18 nt, Human
gcugacagacacaggccc

SEQ ID NO: 3312713 - RNA, 19 nt, Human
gcugacagacacaggcccg

SEQ ID NO: 3312714 - RNA, 22 nt, Human
gcugacuguuuucucuugagag

SEQ ID NO: 3312715 - RNA, 21 nt, Human
gcucucaggccagcugcuugg

SEQ ID NO: 3312716 - RNA, 20 nt, Human
gcucucaggccagcugcuug

SEQ ID NO: 3312717 - RNA, 22 nt, Human
gcugcuuuugucuaugggacuc

SEQ ID NO: 3312718 - RNA, 22 nt, Human
gcugcuugggcuucauccuccu

SEQ ID NO: 3312719 - RNA, 15 nt, Human
gcuggaccuugaacu

SEQ ID NO: 3312720 - RNA, 20 nt, Human
gcugccuguucagcuccagc

SEQ ID NO: 3312721 - RNA, 22 nt, Human
gcugccuguucagcuccagcuc

SEQ ID NO: 3312722 - RNA, 18 nt, Human
gcugccuguucagcucca

SEQ ID NO: 3312723 - RNA, 19 nt, Human
gcugccuguucagcuccag

SEQ ID NO: 3312724 - RNA, 14 nt, Human
gcugcgguccaccc

SEQ ID NO: 3312725 - RNA, 15 nt, Human
gcugcgguccaccca

SEQ ID NO: 3312726 - RNA, 19 nt, Human
gcugcgguccacccaggag

SEQ ID NO: 3312727 - RNA, 21 nt, Human
gcugcgguccacccaggagcc

SEQ ID NO: 3312728 - RNA, 22 nt, Human
gcugcgguccacccaggagccc

SEQ ID NO: 3312729 - RNA, 24 nt, Human
gcugcccugcccaccuggccucug

SEQ ID NO: 3312730 - RNA, 23 nt, Human
gcugcccugcccaccuggccucu

SEQ ID NO: 3312731 - RNA, 22 nt, Human
gcugcccugcccaccuggccuc

SEQ ID NO: 3312732 - RNA, 21 nt, Human
gcugcccugcccaccuggccu

SEQ ID NO: 3312733 - RNA, 20 nt, Human
gcugcccugcccaccuggcc

SEQ ID NO: 3312734 - RNA, 18 nt, Human
gcugcccugcccaccugg

SEQ ID NO: 3312735 - RNA, 16 nt, Human
gcugcccugcccaccu

SEQ ID NO: 3312736 - RNA, 14 nt, Human
gcugcccugcccac

SEQ ID NO: 3312737 - RNA, 13 nt, Human
gcugcccugccca

SEQ ID NO: 3312738 - RNA, 12 nt, Human
gcugcccugccc

SEQ ID NO: 3312739 - RNA, 19 nt, Human
gcugggcuucaguggcagc

SEQ ID NO: 3312740 - RNA, 21 nt, Human
gcugggcuucaguggcagcug

SEQ ID NO: 3312741 - RNA, 22 nt, Human
gcugggcuucaguggcagcugc

SEQ ID NO: 3312742 - RNA, 20 nt, Human
gcugggcuucaguggcagcu

SEQ ID NO: 3312743 - RNA, 21 nt, Human
gcugggcucccuucccaccuc

SEQ ID NO: 3312744 - RNA, 19 nt, Human
gcugggaugauuggagggg

SEQ ID NO: 3312745 - RNA, 15 nt, Human
gcuggccuggccccu

SEQ ID NO: 3312746 - RNA, 14 nt, Human
gcuggccuggcccc

SEQ ID NO: 3312747 - RNA, 12 nt, Human
gcuggccuggcc

SEQ ID NO: 3312748 - RNA, 13 nt, Human
gcuggccuggccc

SEQ ID NO: 3312749 - RNA, 14 nt, Human
gcugggggccucag

SEQ ID NO: 3312750 - RNA, 15 nt, Human
gcugggggccucagu

SEQ ID NO: 3312751 - RNA, 18 nt, Human
gcugggggccucagugcc

SEQ ID NO: 3312752 - RNA, 13 nt, Human
gcugggggccuca

SEQ ID NO: 3312753 - RNA, 20 nt, Human
gcuggucccacucaguccau

SEQ ID NO: 3312754 - RNA, 15 nt, Human
gcugugucucccuuc

SEQ ID NO: 3312755 - RNA, 17 nt, Human
gcugucagccauuccug

SEQ ID NO: 3312756 - RNA, 14 nt, Human
gcuggugucaccug

SEQ ID NO: 3312757 - RNA, 15 nt, Human
gcuggugucaccuga

SEQ ID NO: 3312758 - RNA, 16 nt, Human
gcugucccuuuuccuu

SEQ ID NO: 3312759 - RNA, 22 nt, Human
gcugucccuuacgugaguccug

SEQ ID NO: 3312760 - RNA, 23 nt, Human
gcugucccuuacgugaguccugg

SEQ ID NO: 3312761 - RNA, 17 nt, Human
gcuucucacugccaugc

SEQ ID NO: 3312762 - RNA, 22 nt, Human
gcuucucacugccaugccagcu

SEQ ID NO: 3312763 - RNA, 18 nt, Human
gcuucauuuccugugucu

SEQ ID NO: 3312764 - RNA, 20 nt, Human
gcuuauacacuuacacuuua

SEQ ID NO: 3312765 - RNA, 19 nt, Human
gcuucaguggcagcugcuu

SEQ ID NO: 3312766 - RNA, 20 nt, Human
gcuucaguggcagcugcuuu

SEQ ID NO: 3312767 - RNA, 21 nt, Human
gcuucauccuccucagaucuu

SEQ ID NO: 3312768 - RNA, 18 nt, Human
gcagauggagaccccuug

SEQ ID NO: 3312769 - RNA, 22 nt, Human
gcacuucgggaggucgaggcag

SEQ ID NO: 3312770 - RNA, 14 nt, Human
gcacuugcagacuc

SEQ ID NO: 3312771 - RNA, 17 nt, Human
gcagacucuacagaggc

SEQ ID NO: 3312772 - RNA, 18 nt, Human
gcagacucuacagaggcc

SEQ ID NO: 3312773 - RNA, 19 nt, Human
gcagacucuacagaggcca

SEQ ID NO: 3312774 - RNA, 22 nt, Human
gcagacucuacagaggccaugg

SEQ ID NO: 3312775 - RNA, 19 nt, Human
gcagagaccaucccugaag

SEQ ID NO: 3312776 - RNA, 21 nt, Human
gcagagaccaucccugaaggc

SEQ ID NO: 3312777 - RNA, 20 nt, Human
gcagagaccaucccugaagg

SEQ ID NO: 3312778 - RNA, 22 nt, Human
gcagagaccaucccugaaggcc

SEQ ID NO: 3312779 - RNA, 17 nt, Human
gcagccucacaguccuu

SEQ ID NO: 3312780 - RNA, 15 nt, Human
gcagccucacagucc

SEQ ID NO: 3312781 - RNA, 19 nt, Human
gcagccucacaguccuuac

SEQ ID NO: 3312782 - RNA, 19 nt, Human
gcagcagggagggcuucug

SEQ ID NO: 3312783 - RNA, 18 nt, Human
gcagcagggagggcuucu

SEQ ID NO: 3312784 - RNA, 16 nt, Human
gcagcucaccucuccc

SEQ ID NO: 3312785 - RNA, 14 nt, Human
gcagcucagagagg

SEQ ID NO: 3312786 - RNA, 21 nt, Human
gcagcucaccucucccuugga

SEQ ID NO: 3312787 - RNA, 20 nt, Human
gcagcucaccucucccuugg

SEQ ID NO: 3312788 - RNA, 17 nt, Human
gcagcucaccucucccu

SEQ ID NO: 3312789 - RNA, 19 nt, Human
gcagcucagagaggguggg

SEQ ID NO: 3312790 - RNA, 18 nt, Human
gcagcucagagagggugg

SEQ ID NO: 3312791 - RNA, 20 nt, Human
gauugugucucuugguccug

SEQ ID NO: 3312792 - RNA, 21 nt, Human
gcacagcuucauuuccugugu

SEQ ID NO: 3312793 - RNA, 23 nt, Human
gcacagcuucauuuccugugucu

SEQ ID NO: 3312794 - RNA, 13 nt, Human
gcaccagcagccu

SEQ ID NO: 3312795 - RNA, 15 nt, Human
gcaccaucucuccuc

SEQ ID NO: 3312796 - RNA, 14 nt, Human
gcaccaucucuccu

SEQ ID NO: 3312797 - RNA, 17 nt, Human
gcaccaucucuccuccu

SEQ ID NO: 3312798 - RNA, 19 nt, Human
gcacuguuuuauuuuaauu

SEQ ID NO: 3312799 - RNA, 12 nt, Human
gcacugggcuug

SEQ ID NO: 3312800 - RNA, 20 nt, Human
gcacuauaauguaagcucua

SEQ ID NO: 3312801 - RNA, 14 nt, Human
gcacuauaauguaa

SEQ ID NO: 3312802 - RNA, 15 nt, Human
gcacuauaauguaag

SEQ ID NO: 3312803 - RNA, 14 nt, Human
gcacugcuuccagu

SEQ ID NO: 3312804 - RNA, 13 nt, Human
gcacugcuuccag

SEQ ID NO: 3312805 - RNA, 12 nt, Human
gcacugcuucca

SEQ ID NO: 3312806 - RNA, 19 nt, Human
gcacuaaggugugcucuga

SEQ ID NO: 3312807 - RNA, 20 nt, Human
gcacuaaggugugcucugau

SEQ ID NO: 3312808 - RNA, 14 nt, Human
gcacgugugugcac

SEQ ID NO: 3312809 - RNA, 19 nt, Human
gcacccucaggcagguggg

SEQ ID NO: 3312810 - RNA, 16 nt, Human
gcacccucaggcaggu

SEQ ID NO: 3312811 - RNA, 17 nt, Human
gcaggcagccaggccac

SEQ ID NO: 3312812 - RNA, 18 nt, Human
gcaggcagccaggccaca

SEQ ID NO: 3312813 - RNA, 22 nt, Human
gcagggcucagcggggacagcu

SEQ ID NO: 3312814 - RNA, 16 nt, Human
gcagggucucacucug

SEQ ID NO: 3312815 - RNA, 19 nt, Human
gcaggguccuagaaauucc

SEQ ID NO: 3312816 - RNA, 19 nt, Human
gcauacguacacauuuuau

SEQ ID NO: 3312817 - RNA, 18 nt, Human
gcauacguacacauuuua

SEQ ID NO: 3312818 - RNA, 22 nt, Human
gcaguggugcgaucuggguuca

SEQ ID NO: 3312819 - RNA, 19 nt, Human
gcaguggugguuuucuguu

SEQ ID NO: 3312820 - RNA, 20 nt, Human
gcaguggugcgaucuggguu

SEQ ID NO: 3312821 - RNA, 21 nt, Human
gcaguggugcgaucuggguuc

SEQ ID NO: 3312822 - RNA, 21 nt, Human
gcaguggugguuuucuguucu

SEQ ID NO: 3312823 - RNA, 20 nt, Human
gcaguggugguuuucuguuc

SEQ ID NO: 3312824 - RNA, 11 nt, Human
gcagugggagc

SEQ ID NO: 3312825 - RNA, 18 nt, Human
gcaguggugcgaucuggg

SEQ ID NO: 3312826 - RNA, 19 nt, Human
gcaguggugcgaucugggu

SEQ ID NO: 3312827 - RNA, 12 nt, Human
gcaucaggccag

SEQ ID NO: 3312828 - RNA, 18 nt, Human
gcaucaggccaggcccuc

SEQ ID NO: 3312829 - RNA, 23 nt, Human
gcaucaggccaggcccucugccc

SEQ ID NO: 3312830 - RNA, 20 nt, Human
gcaugaaguaauaugcacac

SEQ ID NO: 3312831 - RNA, 22 nt, Human
gcaugaaguaauaugcacacau

SEQ ID NO: 3312832 - RNA, 21 nt, Human
gcaugaaguaauaugcacaca

SEQ ID NO: 3312833 - RNA, 22 nt, Human
gcaugacacgaauauugcugau

SEQ ID NO: 3312834 - RNA, 18 nt, Human
gcaugaaguaauaugcac

SEQ ID NO: 3312835 - RNA, 21 nt, Human
gcaugacacgaauauugcuga

SEQ ID NO: 3312836 - RNA, 20 nt, Human
gcaugacacgaauauugcug

SEQ ID NO: 3312837 - RNA, 22 nt, Human
gcauuccccaggaggccagccu

SEQ ID NO: 3312838 - RNA, 18 nt, Human
gcauuugaggucuguucu

SEQ ID NO: 3312839 - RNA, 21 nt, Human
gcauuccccaggaggccagcc

SEQ ID NO: 3312840 - RNA, 20 nt, Human
gcauuccccaggaggccagc

SEQ ID NO: 3312841 - RNA, 19 nt, Human
gcauuccccaggaggccag

SEQ ID NO: 3312842 - RNA, 18 nt, Human
gcauuccccaggaggcca

SEQ ID NO: 3312843 - RNA, 17 nt, Human
gcauuccccaggaggcc

SEQ ID NO: 3312844 - RNA, 16 nt, Human
gcauuccccaggaggc

SEQ ID NO: 3312845 - RNA, 15 nt, Human
gcauuccccaggagg

SEQ ID NO: 3312846 - RNA, 14 nt, Human
gcauuccccaggag

SEQ ID NO: 3312847 - RNA, 12 nt, Human
gcauuccccagg

SEQ ID NO: 3312848 - RNA, 19 nt, Human
gcauuaucuagauacugua

SEQ ID NO: 3312849 - RNA, 24 nt, Human
gcauuaucuagauacuguaucaug

SEQ ID NO: 3312850 - RNA, 22 nt, Human
gcauuaucuagauacuguauca

SEQ ID NO: 3312851 - RNA, 14 nt, Human
gcaugccuggaugg

SEQ ID NO: 3312852 - RNA, 13 nt, Human
gcauguuacauaa

SEQ ID NO: 3312853 - RNA, 16 nt, Human
gccauuuguguuuaua

SEQ ID NO: 3312854 - RNA, 24 nt, Human
gccaugcuccuggcccacugcauc

SEQ ID NO: 3312855 - RNA, 19 nt, Human
gccaugccagcuuaucuca

SEQ ID NO: 3312856 - RNA, 18 nt, Human
gccaugccagcuuaucuc

SEQ ID NO: 3312857 - RNA, 13 nt, Human
gccaugccagcuu

SEQ ID NO: 3312858 - RNA, 18 nt, Human
gccaugaggaacaaggca

SEQ ID NO: 3312859 - RNA, 17 nt, Human
gccagguuuuuggucug

SEQ ID NO: 3312860 - RNA, 20 nt, Human
gccagucaccccggccaccu

SEQ ID NO: 3312861 - RNA, 18 nt, Human
gccagucaccccggccac

SEQ ID NO: 3312862 - RNA, 17 nt, Human
gccagucaccccggcca

SEQ ID NO: 3312863 - RNA, 13 nt, Human
gccagggacagag

SEQ ID NO: 3312864 - RNA, 18 nt, Human
gccagggacagagggggu

SEQ ID NO: 3312865 - RNA, 16 nt, Human
gccagggacagagggg

SEQ ID NO: 3312866 - RNA, 15 nt, Human
gccaggcuggucuca

SEQ ID NO: 3312867 - RNA, 23 nt, Human
gccagggacagaggggguggccu

SEQ ID NO: 3312868 - RNA, 21 nt, Human
gccagauuucacucuccuugg

SEQ ID NO: 3312869 - RNA, 18 nt, Human
gccagauuucacucuccu

SEQ ID NO: 3312870 - RNA, 16 nt, Human
gccagauuucacucuc

SEQ ID NO: 3312871 - RNA, 15 nt, Human
gccagaugcaccagc

SEQ ID NO: 3312872 - RNA, 24 nt, Human
gcccagccccuucugacccaugcu

SEQ ID NO: 3312873 - RNA, 20 nt, Human
gcccagccccuucugaccca

SEQ ID NO: 3312874 - RNA, 17 nt, Human
gcccagccccuucugac

SEQ ID NO: 3312875 - RNA, 16 nt, Human
gcccagccccuucuga

SEQ ID NO: 3312876 - RNA, 14 nt, Human
gcccagccccuucu

SEQ ID NO: 3312877 - RNA, 13 nt, Human
gcccagccccuuc

SEQ ID NO: 3312878 - RNA, 15 nt, Human
gcccaguugggugga

SEQ ID NO: 3312879 - RNA, 19 nt, Human
gcccagucuggaaugcagu

SEQ ID NO: 3312880 - RNA, 23 nt, Human
gcccaggcuuagucacugagaca

SEQ ID NO: 3312881 - RNA, 21 nt, Human
gcccaggcuuagucacugaga

SEQ ID NO: 3312882 - RNA, 19 nt, Human
gcccaggcuuagucacuga

SEQ ID NO: 3312883 - RNA, 22 nt, Human
gcccaggcuggcgugcaguggu

SEQ ID NO: 3312884 - RNA, 19 nt, Human
gcccaggcuggcgugcagu

SEQ ID NO: 3312885 - RNA, 20 nt, Human
gcccaggcuggcgugcagug

SEQ ID NO: 3312886 - RNA, 20 nt, Human
gcccaggaaaggcuccagga

SEQ ID NO: 3312887 - RNA, 19 nt, Human
gcccaggaaaggcuccagg

SEQ ID NO: 3312888 - RNA, 18 nt, Human
gcccaggaaaggcuccag

SEQ ID NO: 3312889 - RNA, 21 nt, Human
gcccaaugcacuuuguucugg

SEQ ID NO: 3312890 - RNA, 12 nt, Human
gcccagagggcc

SEQ ID NO: 3312891 - RNA, 19 nt, Human
gcccagagggccugcaagg

SEQ ID NO: 3312892 - RNA, 18 nt, Human
gcccagagggccugcaag

SEQ ID NO: 3312893 - RNA, 15 nt, Human
gcccagagggccugc

SEQ ID NO: 3312894 - RNA, 14 nt, Human
gcccagagggccug

SEQ ID NO: 3312895 - RNA, 9 nt, Human
gcccagccc

SEQ ID NO: 3312896 - RNA, 12 nt, Human
gcccagccccuu

SEQ ID NO: 3312897 - RNA, 11 nt, Human
gcccagccccu

SEQ ID NO: 3312898 - RNA, 22 nt, Human
gcccagagggccugcaagggag

SEQ ID NO: 3312899 - RNA, 21 nt, Human
gcccagagggccugcaaggga

SEQ ID NO: 3312900 - RNA, 20 nt, Human
gcccagagggccugcaaggg

SEQ ID NO: 3312901 - RNA, 22 nt, Human
gccaccugcggugcuaucuccc

SEQ ID NO: 3312902 - RNA, 20 nt, Human
gccaccugcggugcuaucuc

SEQ ID NO: 3312903 - RNA, 14 nt, Human
gccaccugcggugc

SEQ ID NO: 3312904 - RNA, 18 nt, Human
gccacggccaggccagag

SEQ ID NO: 3312905 - RNA, 17 nt, Human
gccacggccaggccaga

SEQ ID NO: 3312906 - RNA, 19 nt, Human
gccacggccaggccagagg

SEQ ID NO: 3312907 - RNA, 17 nt, Human
gccaccugccuguuggg

SEQ ID NO: 3312908 - RNA, 10 nt, Human
gccagaggag

SEQ ID NO: 3312909 - RNA, 16 nt, Human
gccagagacacaagcc

SEQ ID NO: 3312910 - RNA, 19 nt, Human
gccagagacacaagccuuc

SEQ ID NO: 3312911 - RNA, 17 nt, Human
gccagagacacaagccu

SEQ ID NO: 3312912 - RNA, 21 nt, Human
gccagagggagugacagaggc

SEQ ID NO: 3312913 - RNA, 22 nt, Human
gccagagggagugacagaggca

SEQ ID NO: 3312914 - RNA, 19 nt, Human
gccagaggagagaggaccc

SEQ ID NO: 3312915 - RNA, 17 nt, Human
gccagaggagagaggac

SEQ ID NO: 3312916 - RNA, 15 nt, Human
gccagaggagagagg

SEQ ID NO: 3312917 - RNA, 13 nt, Human
gccagaggagaga

SEQ ID NO: 3312918 - RNA, 12 nt, Human
gccagaggagag

SEQ ID NO: 3312919 - RNA, 23 nt, Human
gccagagggagugacagaggcag

SEQ ID NO: 3312920 - RNA, 16 nt, Human
gccagaugcaccagcc

SEQ ID NO: 3312921 - RNA, 17 nt, Human
gccagaugcaccagccc

SEQ ID NO: 3312922 - RNA, 18 nt, Human
gccagaugcaccagcccu

SEQ ID NO: 3312923 - RNA, 15 nt, Human
gccaaggugggagga

SEQ ID NO: 3312924 - RNA, 14 nt, Human
gccaaggugggagg

SEQ ID NO: 3312925 - RNA, 23 nt, Human
gccaaggugggaggauugcuuga

SEQ ID NO: 3312926 - RNA, 21 nt, Human
gccaaggcugggggaagaagc

SEQ ID NO: 3312927 - RNA, 23 nt, Human
gcauuuggugguuucagaaaugu

SEQ ID NO: 3312928 - RNA, 22 nt, Human
gcauuuggugguuucagaaaug

SEQ ID NO: 3312929 - RNA, 20 nt, Human
gcauuugaggucuguucuuu

SEQ ID NO: 3312930 - RNA, 19 nt, Human
gcauuugaggucuguucuu

SEQ ID NO: 3312931 - RNA, 23 nt, Human
gccacagagaaaguacuucucca

SEQ ID NO: 3312932 - RNA, 13 nt, Human
gccacagagaaag

SEQ ID NO: 3312933 - RNA, 14 nt, Human
gccacagagaaagu

SEQ ID NO: 3312934 - RNA, 20 nt, Human
gccacagagaaaguacuucu

SEQ ID NO: 3312935 - RNA, 22 nt, Human
gccacaagacccuugugguccc

SEQ ID NO: 3312936 - RNA, 16 nt, Human
gccacaagacccuugu

SEQ ID NO: 3312937 - RNA, 13 nt, Human
gaggcagccccau

SEQ ID NO: 3312938 - RNA, 12 nt, Human
gaggccagccuu

SEQ ID NO: 3312939 - RNA, 13 nt, Human
gaggccagccuug

SEQ ID NO: 3312940 - RNA, 23 nt, Human
gaggcagccccauucugccugcc

SEQ ID NO: 3312941 - RNA, 21 nt, Human
gaggcagccccauucugccug

SEQ ID NO: 3312942 - RNA, 22 nt, Human
gaggcagccccauucugccugc

SEQ ID NO: 3312943 - RNA, 12 nt, Human
gaggauguucug

SEQ ID NO: 3312944 - RNA, 17 nt, Human
gaggauguucugggaca

SEQ ID NO: 3312945 - RNA, 20 nt, Human
gaggauguucugggacacag

SEQ ID NO: 3312946 - RNA, 23 nt, Human
gaggaguuugggguaugggagag

SEQ ID NO: 3312947 - RNA, 13 nt, Human
gaggacagggagg

SEQ ID NO: 3312948 - RNA, 22 nt, Human
gaggacagggaggugaccccag

SEQ ID NO: 3312949 - RNA, 14 nt, Human
gaggaauccagacc

SEQ ID NO: 3312950 - RNA, 21 nt, Human
gaggaaggaaacccagcucug

SEQ ID NO: 3312951 - RNA, 22 nt, Human
gaggaaggaaacccagcucugg

SEQ ID NO: 3312952 - RNA, 15 nt, Human
gaggaauccagaccc

SEQ ID NO: 3312953 - RNA, 22 nt, Human
gaggcccuucucuccagccccu

SEQ ID NO: 3312954 - RNA, 24 nt, Human
gaggcccuucucuccagccccugg

SEQ ID NO: 3312955 - RNA, 23 nt, Human
gaggcccuucucuccagccccug

SEQ ID NO: 3312956 - RNA, 15 nt, Human
gaggcugggcucccu

SEQ ID NO: 3312957 - RNA, 14 nt, Human
gaggcugggcuccc

SEQ ID NO: 3312958 - RNA, 13 nt, Human
gaggcugggcucc

SEQ ID NO: 3312959 - RNA, 12 nt, Human
gaggggccucuu

SEQ ID NO: 3312960 - RNA, 22 nt, Human
gaggggccucuuaugggcuggg

SEQ ID NO: 3312961 - RNA, 23 nt, Human
gagggcacagaaaauggaagaca

SEQ ID NO: 3312962 - RNA, 22 nt, Human
gagggcacagaaaauggaagac

SEQ ID NO: 3312963 - RNA, 14 nt, Human
gagggcacagaaaa

SEQ ID NO: 3312964 - RNA, 13 nt, Human
gagggagugacag

SEQ ID NO: 3312965 - RNA, 14 nt, Human
gagggagguaagga

SEQ ID NO: 3312966 - RNA, 14 nt, Human
gagggagugacaga

SEQ ID NO: 3312967 - RNA, 14 nt, Human
gagggagggagggc

SEQ ID NO: 3312968 - RNA, 15 nt, Human
gagggagggcuccag

SEQ ID NO: 3312969 - RNA, 15 nt, Human
gagggagggagggcu

SEQ ID NO: 3312970 - RNA, 23 nt, Human
gagcuacacaggggaaaagagga

SEQ ID NO: 3312971 - RNA, 13 nt, Human
gagcugccaccug

SEQ ID NO: 3312972 - RNA, 16 nt, Human
gagcugccaccugccu

SEQ ID NO: 3312973 - RNA, 15 nt, Human
gagcugccaccugcc

SEQ ID NO: 3312974 - RNA, 15 nt, Human
gagccuggcaagaau

SEQ ID NO: 3312975 - RNA, 10 nt, Human
gagccuggca

SEQ ID NO: 3312976 - RNA, 21 nt, Human
gagccugggaggucaaggcug

SEQ ID NO: 3312977 - RNA, 13 nt, Human
gagccugggaggu

SEQ ID NO: 3312978 - RNA, 20 nt, Human
gagccucagcauccuggcac

SEQ ID NO: 3312979 - RNA, 21 nt, Human
gagccucagcauccuggcacc

SEQ ID NO: 3312980 - RNA, 14 nt, Human
gagccuccugcccu

SEQ ID NO: 3312981 - RNA, 13 nt, Human
gagccuccugccc

SEQ ID NO: 3312982 - RNA, 15 nt, Human
gagcccugguggcag

SEQ ID NO: 3312983 - RNA, 16 nt, Human
gagcccugguggcagu

SEQ ID NO: 3312984 - RNA, 19 nt, Human
gagccucagcauccuggca

SEQ ID NO: 3312985 - RNA, 17 nt, Human
gagcccugguggcagug

SEQ ID NO: 3312986 - RNA, 22 nt, Human
gagccuccugcccuuaccugcc

SEQ ID NO: 3312987 - RNA, 20 nt, Human
gagccuccugcccuuaccug

SEQ ID NO: 3312988 - RNA, 13 nt, Human
gagaucagccugg

SEQ ID NO: 3312989 - RNA, 16 nt, Human
gagaucagccugggca

SEQ ID NO: 3312990 - RNA, 14 nt, Human
gagaucagccuggg

SEQ ID NO: 3312991 - RNA, 20 nt, Human
gagaucaaccccuucgcucc

SEQ ID NO: 3312992 - RNA, 22 nt, Human
gagcaagacgcugugcugcccu

SEQ ID NO: 3312993 - RNA, 18 nt, Human
gagcaagacgcugugcug

SEQ ID NO: 3312994 - RNA, 21 nt, Human
gagcaagacgcugugcugccc

SEQ ID NO: 3312995 - RNA, 19 nt, Human
gagcaaaaucgaugcagug

SEQ ID NO: 3312996 - RNA, 17 nt, Human
gagcaccuuagacaguc

SEQ ID NO: 3312997 - RNA, 22 nt, Human
gagccacugcaccgggccacag

SEQ ID NO: 3312998 - RNA, 11 nt, Human
gagcccacgcc

SEQ ID NO: 3312999 - RNA, 14 nt, Human
gagcccaggccucc

SEQ ID NO: 3313000 - RNA, 13 nt, Human
gagcccaggccuc

SEQ ID NO: 3313001 - RNA, 14 nt, Human
gagcccugguggca

SEQ ID NO: 3313002 - RNA, 12 nt, Human
gagcccaggccu

SEQ ID NO: 3313003 - RNA, 16 nt, Human
gagcccacgcccccac

SEQ ID NO: 3313004 - RNA, 15 nt, Human
gagcccacgccccca

SEQ ID NO: 3313005 - RNA, 12 nt, Human
gagcccacgccc

SEQ ID NO: 3313006 - RNA, 18 nt, Human
gagcagccacauuccuga

SEQ ID NO: 3313007 - RNA, 20 nt, Human
gagccacugcaccgggccac

SEQ ID NO: 3313008 - RNA, 15 nt, Human
gagucugaaggcugg

SEQ ID NO: 3313009 - RNA, 12 nt, Human
gagugggcccaa

SEQ ID NO: 3313010 - RNA, 13 nt, Human
gaguucugguucc

SEQ ID NO: 3313011 - RNA, 20 nt, Human
gaguucaucuugaauuguaa

SEQ ID NO: 3313012 - RNA, 23 nt, Human
gaguucaucuugaauuguaagga

SEQ ID NO: 3313013 - RNA, 17 nt, Human
gauacaaaagcauguga

SEQ ID NO: 3313014 - RNA, 18 nt, Human
gauagcacagacccugcc

SEQ ID NO: 3313015 - RNA, 17 nt, Human
gauagcacagacccugc

SEQ ID NO: 3313016 - RNA, 18 nt, Human
gauacaaugcugugcccu

SEQ ID NO: 3313017 - RNA, 13 nt, Human
gauacaaugcugu

SEQ ID NO: 3313018 - RNA, 19 nt, Human
gauagcacagacccugccc

SEQ ID NO: 3313019 - RNA, 12 nt, Human
gauagccaaggc

SEQ ID NO: 3313020 - RNA, 16 nt, Human
gauagcacagacccug

SEQ ID NO: 3313021 - RNA, 13 nt, Human
gauagccaaggcc

SEQ ID NO: 3313022 - RNA, 23 nt, Human
gauauaugcucugcauguuacau

SEQ ID NO: 3313023 - RNA, 21 nt, Human
gaucaaccccuucgcuccugu

SEQ ID NO: 3313024 - RNA, 22 nt, Human
gaucaaccccuucgcuccugug

SEQ ID NO: 3313025 - RNA, 14 nt, Human
gagguucccuuuga

SEQ ID NO: 3313026 - RNA, 19 nt, Human
gagguucaaagauauuuug

SEQ ID NO: 3313027 - RNA, 19 nt, Human
gagguuuuaaaaaaauccc

SEQ ID NO: 3313028 - RNA, 16 nt, Human
gaguacguugugcauu

SEQ ID NO: 3313029 - RNA, 19 nt, Human
gaguacuacaguccuccca

SEQ ID NO: 3313030 - RNA, 18 nt, Human
gaguacuacaguccuccc

SEQ ID NO: 3313031 - RNA, 15 nt, Human
gaguacuacaguccu

SEQ ID NO: 3313032 - RNA, 20 nt, Human
gaguacguugugcauuuggu

SEQ ID NO: 3313033 - RNA, 18 nt, Human
gaguacguugugcauuug

SEQ ID NO: 3313034 - RNA, 17 nt, Human
gaguacguugugcauuu

SEQ ID NO: 3313035 - RNA, 22 nt, Human
gaggggggaggugggauccucc

SEQ ID NO: 3313036 - RNA, 15 nt, Human
gaggggggagguggg

SEQ ID NO: 3313037 - RNA, 18 nt, Human
gaggugggauccuccagg

SEQ ID NO: 3313038 - RNA, 22 nt, Human
gaggugggauccuccaggugca

SEQ ID NO: 3313039 - RNA, 21 nt, Human
gaggugggauccuccaggugc

SEQ ID NO: 3313040 - RNA, 23 nt, Human
gaguccccuguuuguuucugaaa

SEQ ID NO: 3313041 - RNA, 14 nt, Human
gaguccccuguuug

SEQ ID NO: 3313042 - RNA, 12 nt, Human
gaguccccuguu

SEQ ID NO: 3313043 - RNA, 21 nt, Human
gagucccaccuuggcugcagg

SEQ ID NO: 3313044 - RNA, 12 nt, Human
gaguagcuggga

SEQ ID NO: 3313045 - RNA, 14 nt, Human
gaguagcugggacu

SEQ ID NO: 3313046 - RNA, 17 nt, Human
gagucgaggacagggag

SEQ ID NO: 3313047 - RNA, 16 nt, Human
gagucgaggacaggga

SEQ ID NO: 3313048 - RNA, 19 nt, Human
gagucucacuguugcccag

SEQ ID NO: 3313049 - RNA, 20 nt, Human
gagucucacuguugcccagg

SEQ ID NO: 3313050 - RNA, 21 nt, Human
gagucucacuguugcccaggc

SEQ ID NO: 3313051 - RNA, 21 nt, Human
gagucugaaggcuggguucug

SEQ ID NO: 3313052 - RNA, 22 nt, Human
gagucucacuguugcccaggcu

SEQ ID NO: 3313053 - RNA, 23 nt, Human
gagucucacuguugcccaggcug

SEQ ID NO: 3313054 - RNA, 22 nt, Human
gaugggcaacccccagccugcu

SEQ ID NO: 3313055 - RNA, 22 nt, Human
gaugagaaagguugaagcacca

SEQ ID NO: 3313056 - RNA, 11 nt, Human
gaugagaaagg

SEQ ID NO: 3313057 - RNA, 20 nt, Human
gaugaccuugaaugaugcca

SEQ ID NO: 3313058 - RNA, 18 nt, Human
gauccucccaccucagcc

SEQ ID NO: 3313059 - RNA, 16 nt, Human
gaucuuugcagacagg

SEQ ID NO: 3313060 - RNA, 15 nt, Human
gaugaaaaaauaaca

SEQ ID NO: 3313061 - RNA, 23 nt, Human
gaucaaccccuucgcuccugugu

SEQ ID NO: 3313062 - RNA, 13 nt, Human
gaucacgccacug

SEQ ID NO: 3313063 - RNA, 14 nt, Human
gaucacgccacugc

SEQ ID NO: 3313064 - RNA, 15 nt, Human
gaucacgccacugca

SEQ ID NO: 3313065 - RNA, 18 nt, Human
gauccuaguuccaccauc

SEQ ID NO: 3313066 - RNA, 18 nt, Human
gauccuaggcauuugcug

SEQ ID NO: 3313067 - RNA, 11 nt, Human
gauccuccagg

SEQ ID NO: 3313068 - RNA, 19 nt, Human
gauccucccaccucagccu

SEQ ID NO: 3313069 - RNA, 20 nt, Human
gauccucccaccucagccuc

SEQ ID NO: 3313070 - RNA, 19 nt, Human
gauccugagccagauuuca

SEQ ID NO: 3313071 - RNA, 15 nt, Human
gauccugagccagau

SEQ ID NO: 3313072 - RNA, 14 nt, Human
gauccugagccaga

SEQ ID NO: 3313073 - RNA, 13 nt, Human
gauccugagccag

SEQ ID NO: 3313074 - RNA, 20 nt, Human
gauuguccccgacccuugcc

SEQ ID NO: 3313075 - RNA, 15 nt, Human
gauuguccccgaccc

SEQ ID NO: 3313076 - RNA, 18 nt, Human
gauugcuugagcucagga

SEQ ID NO: 3313077 - RNA, 23 nt, Human
gauugacgggacuguugguauug

SEQ ID NO: 3313078 - RNA, 21 nt, Human
gauucccaagcucugcuccuc

SEQ ID NO: 3313079 - RNA, 22 nt, Human
gauucccaagcucugcuccucu

SEQ ID NO: 3313080 - RNA, 12 nt, Human
gauucagacagc

SEQ ID NO: 3313081 - RNA, 14 nt, Human
gauguucugggaca

SEQ ID NO: 3313082 - RNA, 16 nt, Human
gauguucugggacaca

SEQ ID NO: 3313083 - RNA, 20 nt, Human
gauggugcaaugaccuuuca

SEQ ID NO: 3313084 - RNA, 23 nt, Human
gauggugcaaugaccuuucaaua

SEQ ID NO: 3313085 - RNA, 17 nt, Human
gauggugcaaugaccuu

SEQ ID NO: 3313086 - RNA, 21 nt, Human
gauguucuuucacccuuuucu

SEQ ID NO: 3313087 - RNA, 21 nt, Human
gauguuuuaaggaugcuugua

SEQ ID NO: 3313088 - RNA, 14 nt, Human
gauguuuuccauga

SEQ ID NO: 3313089 - RNA, 15 nt, Human
gauguuuuccaugag

SEQ ID NO: 3313090 - RNA, 19 nt, Human
gauuaaauucuugcaaagu

SEQ ID NO: 3313091 - RNA, 12 nt, Human
gauuaaauucuu

SEQ ID NO: 3313092 - RNA, 18 nt, Human
gauuaaccacuucagcug

SEQ ID NO: 3313093 - RNA, 21 nt, Human
gauuaaccacuucagcugacu

SEQ ID NO: 3313094 - RNA, 19 nt, Human
gauuaaccacuucagcuga

SEQ ID NO: 3313095 - RNA, 19 nt, Human
gauucaacagguuuuccug

SEQ ID NO: 3313096 - RNA, 14 nt, Human
cugagccagauuuc

SEQ ID NO: 3313097 - RNA, 13 nt, Human
cugagccagauuu

SEQ ID NO: 3313098 - RNA, 19 nt, Human
cugagacagcccgggcucu

SEQ ID NO: 3313099 - RNA, 20 nt, Human
cugagacagcccgggcucug

SEQ ID NO: 3313100 - RNA, 21 nt, Human
cugagacagcccgggcucugc

SEQ ID NO: 3313101 - RNA, 16 nt, Human
cugacagacacaggcc

SEQ ID NO: 3313102 - RNA, 14 nt, Human
cugaauuucuuuug

SEQ ID NO: 3313103 - RNA, 15 nt, Human
cugacagacacaggc

SEQ ID NO: 3313104 - RNA, 17 nt, Human
cugacagacacaggccc

SEQ ID NO: 3313105 - RNA, 18 nt, Human
cugacagacacaggcccg

SEQ ID NO: 3313106 - RNA, 16 nt, Human
cucuucuccaggcugu

SEQ ID NO: 3313107 - RNA, 21 nt, Human
cucuuuggucuacacugugcu

SEQ ID NO: 3313108 - RNA, 23 nt, Human
cucuuuggucuacacugugcuga

SEQ ID NO: 3313109 - RNA, 22 nt, Human
cucuuuggucuacacugugcug

SEQ ID NO: 3313110 - RNA, 14 nt, Human
cucuuuucaaaaca

SEQ ID NO: 3313111 - RNA, 23 nt, Human
cugaaagggacgcuacccgggaa

SEQ ID NO: 3313112 - RNA, 16 nt, Human
cugaagucacacagug

SEQ ID NO: 3313113 - RNA, 21 nt, Human
cugaagucacacagugagucg

SEQ ID NO: 3313114 - RNA, 18 nt, Human
cugaagucacacagugag

SEQ ID NO: 3313115 - RNA, 19 nt, Human
cugaagucacacagugagu

SEQ ID NO: 3313116 - RNA, 17 nt, Human
cugaagucacacaguga

SEQ ID NO: 3313117 - RNA, 20 nt, Human
cugaagucuuuguacagaca

SEQ ID NO: 3313118 - RNA, 17 nt, Human
cugaagucuuuguacag

SEQ ID NO: 3313119 - RNA, 22 nt, Human
cugaagucccagauacuugggg

SEQ ID NO: 3313120 - RNA, 17 nt, Human
cugaaguucagcugcau

SEQ ID NO: 3313121 - RNA, 19 nt, Human
cugaaugguuuucaaaaua

SEQ ID NO: 3313122 - RNA, 20 nt, Human
cugaaugguuuucaaaauaa

SEQ ID NO: 3313123 - RNA, 12 nt, Human
cugaauuucuuu

SEQ ID NO: 3313124 - RNA, 20 nt, Human
cucuggcagcucagagaggg

SEQ ID NO: 3313125 - RNA, 23 nt, Human
cucuggcagcucagagagggugg

SEQ ID NO: 3313126 - RNA, 16 nt, Human
cucugccucugacaca

SEQ ID NO: 3313127 - RNA, 21 nt, Human
cucugccucccaucacccgcu

SEQ ID NO: 3313128 - RNA, 19 nt, Human
cucugccucugacacacag

SEQ ID NO: 3313129 - RNA, 20 nt, Human
cucugccucugacacacagc

SEQ ID NO: 3313130 - RNA, 14 nt, Human
cucuguccugggag

SEQ ID NO: 3313131 - RNA, 13 nt, Human
cucuguccuggga

SEQ ID NO: 3313132 - RNA, 15 nt, Human
cucuguccugggagu

SEQ ID NO: 3313133 - RNA, 22 nt, Human
cucuguccugggagugagcugg

SEQ ID NO: 3313134 - RNA, 18 nt, Human
cucugucgcccagucugg

SEQ ID NO: 3313135 - RNA, 19 nt, Human
cucugucgcccagucugga

SEQ ID NO: 3313136 - RNA, 17 nt, Human
cucugucgcccagucug

SEQ ID NO: 3313137 - RNA, 13 nt, Human
cucugucgcccag

SEQ ID NO: 3313138 - RNA, 19 nt, Human
cucugugucagguggggca

SEQ ID NO: 3313139 - RNA, 20 nt, Human
cucugugucagguggggcag

SEQ ID NO: 3313140 - RNA, 21 nt, Human
cucugugucagguggggcagc

SEQ ID NO: 3313141 - RNA, 22 nt, Human
cucugugucagguggggcagcu

SEQ ID NO: 3313142 - RNA, 23 nt, Human
cucugugucagguggggcagcuu

SEQ ID NO: 3313143 - RNA, 15 nt, Human
cucuucuccaggcug

SEQ ID NO: 3313144 - RNA, 13 nt, Human
cucuucuccaggc

SEQ ID NO: 3313145 - RNA, 12 nt, Human
cucugcccuugg

SEQ ID NO: 3313146 - RNA, 17 nt, Human
cucugccucccaucacc

SEQ ID NO: 3313147 - RNA, 16 nt, Human
cucugccucccaucac

SEQ ID NO: 3313148 - RNA, 14 nt, Human
cucugccucccauc

SEQ ID NO: 3313149 - RNA, 13 nt, Human
cucugccucccau

SEQ ID NO: 3313150 - RNA, 20 nt, Human
cucugcccacucccugcaac

SEQ ID NO: 3313151 - RNA, 18 nt, Human
cucugcccacucccugca

SEQ ID NO: 3313152 - RNA, 17 nt, Human
cucugcccacucccugc

SEQ ID NO: 3313153 - RNA, 16 nt, Human
cucugcccacucccug

SEQ ID NO: 3313154 - RNA, 15 nt, Human
cucugcccacucccu

SEQ ID NO: 3313155 - RNA, 13 nt, Human
cucugcccacucc

SEQ ID NO: 3313156 - RNA, 13 nt, Human
cucugcacaagcu

SEQ ID NO: 3313157 - RNA, 10 nt, Human
cucugcacaa

SEQ ID NO: 3313158 - RNA, 15 nt, Human
cucugcacaagcugc

SEQ ID NO: 3313159 - RNA, 14 nt, Human
cucugcacaagcug

SEQ ID NO: 3313160 - RNA, 22 nt, Human
cucugaaggacauugcggacag

SEQ ID NO: 3313161 - RNA, 14 nt, Human
cucugacacacagc

SEQ ID NO: 3313162 - RNA, 15 nt, Human
cucugacacacagcu

SEQ ID NO: 3313163 - RNA, 16 nt, Human
cucugacacacagcuc

SEQ ID NO: 3313164 - RNA, 17 nt, Human
cucugacacacagcucu

SEQ ID NO: 3313165 - RNA, 18 nt, Human
cucugacacacagcucug

SEQ ID NO: 3313166 - RNA, 19 nt, Human
cucugacacacagcucugu

SEQ ID NO: 3313167 - RNA, 23 nt, Human
cucugacagaagaaccccagggu

SEQ ID NO: 3313168 - RNA, 21 nt, Human
cucugagacucgcgacaaugc

SEQ ID NO: 3313169 - RNA, 23 nt, Human
cucugagacucgcgacaaugcaa

SEQ ID NO: 3313170 - RNA, 20 nt, Human
cucugagacucgcgacaaug

SEQ ID NO: 3313171 - RNA, 12 nt, Human
cucugaggacac

SEQ ID NO: 3313172 - RNA, 14 nt, Human
cucugaggacacua

SEQ ID NO: 3313173 - RNA, 24 nt, Human
cugaggcccuucucuccagccccu

SEQ ID NO: 3313174 - RNA, 13 nt, Human
cugaggcugggcu

SEQ ID NO: 3313175 - RNA, 22 nt, Human
cugaggcugggcucccuuccca

SEQ ID NO: 3313176 - RNA, 17 nt, Human
cugaggcugggcucccu

SEQ ID NO: 3313177 - RNA, 16 nt, Human
cugaggcugggcuccc

SEQ ID NO: 3313178 - RNA, 15 nt, Human
cugaggcugggcucc

SEQ ID NO: 3313179 - RNA, 14 nt, Human
cugauggugcaaug

SEQ ID NO: 3313180 - RNA, 16 nt, Human
cugauggugcaaugac

SEQ ID NO: 3313181 - RNA, 15 nt, Human
cugauggugcaauga

SEQ ID NO: 3313182 - RNA, 21 nt, Human
cugauccuaguuccaccauca

SEQ ID NO: 3313183 - RNA, 20 nt, Human
cugauccuaguuccaccauc

SEQ ID NO: 3313184 - RNA, 21 nt, Human
cugauaaagaugagugagcau

SEQ ID NO: 3313185 - RNA, 17 nt, Human
cugagucugaaggcugg

SEQ ID NO: 3313186 - RNA, 19 nt, Human
cugagucugaaggcugggu

SEQ ID NO: 3313187 - RNA, 18 nt, Human
cugagucugaaggcuggg

SEQ ID NO: 3313188 - RNA, 22 nt, Human
cugagugggggaucacagccuc

SEQ ID NO: 3313189 - RNA, 17 nt, Human
cugauugugucucuugg

SEQ ID NO: 3313190 - RNA, 21 nt, Human
cugauggugcaaugaccuuuc

SEQ ID NO: 3313191 - RNA, 20 nt, Human
cugauggugcaaugaccuuu

SEQ ID NO: 3313192 - RNA, 19 nt, Human
cugauggugcaaugaccuu

SEQ ID NO: 3313193 - RNA, 17 nt, Human
cugauggugcaaugacc

SEQ ID NO: 3313194 - RNA, 21 nt, Human
cugauugugucucuugguccu

SEQ ID NO: 3313195 - RNA, 23 nt, Human
cugauuuuuuuuuccuucagugc

SEQ ID NO: 3313196 - RNA, 22 nt, Human
cugauuuuuuuuuccuucagug

SEQ ID NO: 3313197 - RNA, 21 nt, Human
cugauuuuuuuuuccuucagu

SEQ ID NO: 3313198 - RNA, 20 nt, Human
cugauuuuuuuuuccuucag

SEQ ID NO: 3313199 - RNA, 19 nt, Human
cugauuuuuuuuuccuuca

SEQ ID NO: 3313200 - RNA, 18 nt, Human
cugauuuuuuuuuccuuc

SEQ ID NO: 3313201 - RNA, 16 nt, Human
cugauuuuuuuuuccu

SEQ ID NO: 3313202 - RNA, 12 nt, Human
cugcaccgggcc

SEQ ID NO: 3313203 - RNA, 23 nt, Human
cugcaccggcuggccuggccccu

SEQ ID NO: 3313204 - RNA, 15 nt, Human
cugcacuccccugcu

SEQ ID NO: 3313205 - RNA, 14 nt, Human
cugcacuccccugc

SEQ ID NO: 3313206 - RNA, 22 nt, Human
cugcaccggcuggccuggcccc

SEQ ID NO: 3313207 - RNA, 20 nt, Human
cugcaccggcuggccuggcc

SEQ ID NO: 3313208 - RNA, 14 nt, Human
cugcacccucaggc

SEQ ID NO: 3313209 - RNA, 13 nt, Human
cugcacccucagg

SEQ ID NO: 3313210 - RNA, 18 nt, Human
cugcacuugcagacucua

SEQ ID NO: 3313211 - RNA, 17 nt, Human
cugcacuccccugcugg

SEQ ID NO: 3313212 - RNA, 16 nt, Human
cugcacuccccugcug

SEQ ID NO: 3313213 - RNA, 18 nt, Human
cugcacaagcugcacccu

SEQ ID NO: 3313214 - RNA, 22 nt, Human
cugcacaagcugcacccucagg

SEQ ID NO: 3313215 - RNA, 18 nt, Human
cugcaauaaggggagagu

SEQ ID NO: 3313216 - RNA, 21 nt, Human
cugccugcccaggccccugcc

SEQ ID NO: 3313217 - RNA, 22 nt, Human
cugccugcccaggccccugcca

SEQ ID NO: 3313218 - RNA, 17 nt, Human
cugccucugacacacag

SEQ ID NO: 3313219 - RNA, 15 nt, Human
cugccucugacacac

SEQ ID NO: 3313220 - RNA, 18 nt, Human
cugccucugacacacagc

SEQ ID NO: 3313221 - RNA, 21 nt, Human
cugccucugacacacagcucu

SEQ ID NO: 3313222 - RNA, 19 nt, Human
cugcgguccacccaggagc

SEQ ID NO: 3313223 - RNA, 17 nt, Human
cugcgguccacccagga

SEQ ID NO: 3313224 - RNA, 18 nt, Human
cugcgguccacccaggag

SEQ ID NO: 3313225 - RNA, 13 nt, Human
cugccgcagcccu

SEQ ID NO: 3313226 - RNA, 12 nt, Human
cugccgcagccc

SEQ ID NO: 3313227 - RNA, 23 nt, Human
cugccgcagcccugcagagggca

SEQ ID NO: 3313228 - RNA, 22 nt, Human
cugccgcagcccugcagagggc

SEQ ID NO: 3313229 - RNA, 21 nt, Human
cugccgcagcccugcagaggg

SEQ ID NO: 3313230 - RNA, 20 nt, Human
cugccgcagcccugcagagg

SEQ ID NO: 3313231 - RNA, 19 nt, Human
cugccgcagcccugcagag

SEQ ID NO: 3313232 - RNA, 19 nt, Human
cugccucagccucccaaag

SEQ ID NO: 3313233 - RNA, 15 nt, Human
cugccucagccuccc

SEQ ID NO: 3313234 - RNA, 14 nt, Human
cugccucagccucc

SEQ ID NO: 3313235 - RNA, 17 nt, Human
cugcaguugccagucac

SEQ ID NO: 3313236 - RNA, 22 nt, Human
cugcaguugccagucaccccgg

SEQ ID NO: 3313237 - RNA, 21 nt, Human
cugcaguugccagucaccccg

SEQ ID NO: 3313238 - RNA, 17 nt, Human
cugcacuugcagacucu

SEQ ID NO: 3313239 - RNA, 23 nt, Human
cugcacuugcagacucuacagag

SEQ ID NO: 3313240 - RNA, 19 nt, Human
cugcaguugccagucaccc

SEQ ID NO: 3313241 - RNA, 22 nt, Human
cugcaucguuucaucuuccaac

SEQ ID NO: 3313242 - RNA, 16 nt, Human
cugcaucguuucaucu

SEQ ID NO: 3313243 - RNA, 22 nt, Human
cugcaugcgggcuuccuccugg

SEQ ID NO: 3313244 - RNA, 18 nt, Human
cugcaugcgggcuuccuc

SEQ ID NO: 3313245 - RNA, 19 nt, Human
cugccaaugggagcucaug

SEQ ID NO: 3313246 - RNA, 18 nt, Human
cugccaaugggagcucau

SEQ ID NO: 3313247 - RNA, 17 nt, Human
cugccaaugggagcuca

SEQ ID NO: 3313248 - RNA, 18 nt, Human
cugcccacucccugcaac

SEQ ID NO: 3313249 - RNA, 16 nt, Human
cugcccacucccugca

SEQ ID NO: 3313250 - RNA, 15 nt, Human
cugcccacucccugc

SEQ ID NO: 3313251 - RNA, 14 nt, Human
cugcccacucccug

SEQ ID NO: 3313252 - RNA, 22 nt, Human
cugcccaccuggccucugcacu

SEQ ID NO: 3313253 - RNA, 20 nt, Human
cugcccaccuggccucugca

SEQ ID NO: 3313254 - RNA, 19 nt, Human
cugcccaccuggccucugc

SEQ ID NO: 3313255 - RNA, 18 nt, Human
cugcccaccuggccucug

SEQ ID NO: 3313256 - RNA, 17 nt, Human
cugcccaccuggccucu

SEQ ID NO: 3313257 - RNA, 14 nt, Human
cugccaugccagcu

SEQ ID NO: 3313258 - RNA, 13 nt, Human
cugcccaccuggc

SEQ ID NO: 3313259 - RNA, 15 nt, Human
cugcccaccuggccu

SEQ ID NO: 3313260 - RNA, 14 nt, Human
cugcccaccuggcc

SEQ ID NO: 3313261 - RNA, 13 nt, Human
cugccaggcaugg

SEQ ID NO: 3313262 - RNA, 11 nt, Human
cugccaggcau

SEQ ID NO: 3313263 - RNA, 23 nt, Human
cuccaggagcagccacauuccug

SEQ ID NO: 3313264 - RNA, 18 nt, Human
cuccaggagcagccacau

SEQ ID NO: 3313265 - RNA, 13 nt, Human
cuccaggagcagc

SEQ ID NO: 3313266 - RNA, 11 nt, Human
cuccaggagca

SEQ ID NO: 3313267 - RNA, 17 nt, Human
cuccaggagcagccaca

SEQ ID NO: 3313268 - RNA, 16 nt, Human
cuccaggagcagccac

SEQ ID NO: 3313269 - RNA, 15 nt, Human
cuccaggagcagcca

SEQ ID NO: 3313270 - RNA, 14 nt, Human
cuccaggagcagcc

SEQ ID NO: 3313271 - RNA, 12 nt, Human
cuccagccuggg

SEQ ID NO: 3313272 - RNA, 17 nt, Human
cuccagccccuggaugc

SEQ ID NO: 3313273 - RNA, 16 nt, Human
cuccagccccuggaug

SEQ ID NO: 3313274 - RNA, 20 nt, Human
cuccagccccuggaugcagc

SEQ ID NO: 3313275 - RNA, 14 nt, Human
cuccaccugccagg

SEQ ID NO: 3313276 - RNA, 13 nt, Human
cuccaccugccag

SEQ ID NO: 3313277 - RNA, 12 nt, Human
cuccaccugcca

SEQ ID NO: 3313278 - RNA, 15 nt, Human
cuccagccccuggau

SEQ ID NO: 3313279 - RNA, 17 nt, Human
cucauuugucacacacu

SEQ ID NO: 3313280 - RNA, 16 nt, Human
cuccaaaauaaaacuu

SEQ ID NO: 3313281 - RNA, 15 nt, Human
cuccaaaauaaaacu

SEQ ID NO: 3313282 - RNA, 15 nt, Human
cuccacccugcucuc

SEQ ID NO: 3313283 - RNA, 13 nt, Human
cuccacccugcuc

SEQ ID NO: 3313284 - RNA, 15 nt, Human
cucagcauccuggca

SEQ ID NO: 3313285 - RNA, 18 nt, Human
cucagcauccuggcaccc

SEQ ID NO: 3313286 - RNA, 23 nt, Human
cucaggaguuugagaccaaccug

SEQ ID NO: 3313287 - RNA, 18 nt, Human
cucaggaguuugagacca

SEQ ID NO: 3313288 - RNA, 13 nt, Human
cucagggccuggc

SEQ ID NO: 3313289 - RNA, 15 nt, Human
cucagggccuggcuc

SEQ ID NO: 3313290 - RNA, 14 nt, Human
cucagggccuggcu

SEQ ID NO: 3313291 - RNA, 16 nt, Human
cucagggccuggcuca

SEQ ID NO: 3313292 - RNA, 15 nt, Human
cucagggccuggucg

SEQ ID NO: 3313293 - RNA, 14 nt, Human
cucagggccugguc

SEQ ID NO: 3313294 - RNA, 17 nt, Human
cucagggucccuggugg

SEQ ID NO: 3313295 - RNA, 16 nt, Human
cucagggucccuggug

SEQ ID NO: 3313296 - RNA, 15 nt, Human
cucagggucccuggu

SEQ ID NO: 3313297 - RNA, 20 nt, Human
cucaggugagaagcagagga

SEQ ID NO: 3313298 - RNA, 19 nt, Human
cucaggugagaagcagagg

SEQ ID NO: 3313299 - RNA, 14 nt, Human
cucaggugagaagc

SEQ ID NO: 3313300 - RNA, 16 nt, Human
cucaggugagaagcag

SEQ ID NO: 3313301 - RNA, 21 nt, Human
cucauaguaugguggcugggu

SEQ ID NO: 3313302 - RNA, 15 nt, Human
cucauacccaccccc

SEQ ID NO: 3313303 - RNA, 14 nt, Human
cucauacucaccuc

SEQ ID NO: 3313304 - RNA, 22 nt, Human
cucauacucaccucaccccacu

SEQ ID NO: 3313305 - RNA, 20 nt, Human
cucaggugauccacccaccu

SEQ ID NO: 3313306 - RNA, 14 nt, Human
cucagggucccugg

SEQ ID NO: 3313307 - RNA, 18 nt, Human
cucaggugauccacccac

SEQ ID NO: 3313308 - RNA, 19 nt, Human
cucaggugauccacccacc

SEQ ID NO: 3313309 - RNA, 21 nt, Human
cucauacccacccccacccaa

SEQ ID NO: 3313310 - RNA, 19 nt, Human
cucauacccacccccaccc

SEQ ID NO: 3313311 - RNA, 18 nt, Human
cucauacccacccccacc

SEQ ID NO: 3313312 - RNA, 16 nt, Human
cucauacccaccccca

SEQ ID NO: 3313313 - RNA, 15 nt, Human
cucauccucauaccc

SEQ ID NO: 3313314 - RNA, 22 nt, Human
cucaucaccaacgucugugcca

SEQ ID NO: 3313315 - RNA, 21 nt, Human
cucaucaccaacgucugugcc

SEQ ID NO: 3313316 - RNA, 23 nt, Human
cucauaguaugguggcuggguug

SEQ ID NO: 3313317 - RNA, 20 nt, Human
cucauaguaugguggcuggg

SEQ ID NO: 3313318 - RNA, 22 nt, Human
cuccccagcaagugagagcugg

SEQ ID NO: 3313319 - RNA, 23 nt, Human
cuccccagcaagugagagcuggg

SEQ ID NO: 3313320 - RNA, 21 nt, Human
cuccccagcaagugagagcug

SEQ ID NO: 3313321 - RNA, 18 nt, Human
cucccgaguagcugggac

SEQ ID NO: 3313322 - RNA, 19 nt, Human
cucccgaguagcugggacu

SEQ ID NO: 3313323 - RNA, 20 nt, Human
cucccgaguagcugggacua

SEQ ID NO: 3313324 - RNA, 18 nt, Human
cuccucagaucuucugug

SEQ ID NO: 3313325 - RNA, 20 nt, Human
cucccuuggauuguccccga

SEQ ID NO: 3313326 - RNA, 15 nt, Human
cuccgaccagacacc

SEQ ID NO: 3313327 - RNA, 15 nt, Human
cuccuccagagucag

SEQ ID NO: 3313328 - RNA, 13 nt, Human
cuccuccagaguc

SEQ ID NO: 3313329 - RNA, 15 nt, Human
cuccuccagccgcca

SEQ ID NO: 3313330 - RNA, 19 nt, Human
cucgagcaugccuggaugg

SEQ ID NO: 3313331 - RNA, 16 nt, Human
cucgagcaugccugga

SEQ ID NO: 3313332 - RNA, 15 nt, Human
cucgagcaugccugg

SEQ ID NO: 3313333 - RNA, 13 nt, Human
cucgagcaugccu

SEQ ID NO: 3313334 - RNA, 23 nt, Human
cuccuuggugucgggcaugacac

SEQ ID NO: 3313335 - RNA, 22 nt, Human
cucgagcaugccuggauggggc

SEQ ID NO: 3313336 - RNA, 18 nt, Human
cuccugccucgaacuggc

SEQ ID NO: 3313337 - RNA, 20 nt, Human
cuccugccucgaacuggcug

SEQ ID NO: 3313338 - RNA, 21 nt, Human
cuccugccucgaacuggcugc

SEQ ID NO: 3313339 - RNA, 17 nt, Human
cuccugccucagccucc

SEQ ID NO: 3313340 - RNA, 16 nt, Human
cuccugccucagccuc

SEQ ID NO: 3313341 - RNA, 12 nt, Human
cuccugccucag

SEQ ID NO: 3313342 - RNA, 11 nt, Human
cuccugccuca

SEQ ID NO: 3313343 - RNA, 13 nt, Human
cuccucuccccag

SEQ ID NO: 3313344 - RNA, 15 nt, Human
cuccucuccccagca

SEQ ID NO: 3313345 - RNA, 14 nt, Human
cuccuggaaauauu

SEQ ID NO: 3313346 - RNA, 21 nt, Human
cuccugugugugcgccuacag

SEQ ID NO: 3313347 - RNA, 23 nt, Human
cuccugugugugcgccuacagga

SEQ ID NO: 3313348 - RNA, 24 nt, Human
cuccugugugugcgccuacaggag

SEQ ID NO: 3313349 - RNA, 20 nt, Human
cuccugugugugcgccuaca

SEQ ID NO: 3313350 - RNA, 21 nt, Human
cucaacaccucugcacaagcu

SEQ ID NO: 3313351 - RNA, 13 nt, Human
cucaaccuccugg

SEQ ID NO: 3313352 - RNA, 15 nt, Human
cucaaccuccugggc

SEQ ID NO: 3313353 - RNA, 22 nt, Human
cucacaguccuuaccagcagag

SEQ ID NO: 3313354 - RNA, 19 nt, Human
cucacaguccuuaccagca

SEQ ID NO: 3313355 - RNA, 17 nt, Human
cucacaguccuuaccag

SEQ ID NO: 3313356 - RNA, 15 nt, Human
cucacauuuauucug

SEQ ID NO: 3313357 - RNA, 19 nt, Human
cucacauuuauucugcuca

SEQ ID NO: 3313358 - RNA, 22 nt, Human
cucacauuuauucugcucacau

SEQ ID NO: 3313359 - RNA, 13 nt, Human
cucaccagcccca

SEQ ID NO: 3313360 - RNA, 14 nt, Human
cucaccagccccag

SEQ ID NO: 3313361 - RNA, 15 nt, Human
cucaccagccccagu

SEQ ID NO: 3313362 - RNA, 17 nt, Human
cucaccagccccagugc

SEQ ID NO: 3313363 - RNA, 18 nt, Human
cucaccagccccagugcc

SEQ ID NO: 3313364 - RNA, 17 nt, Human
cucaagugauucuccug

SEQ ID NO: 3313365 - RNA, 21 nt, Human
cucaaguccucuuuucugaga

SEQ ID NO: 3313366 - RNA, 14 nt, Human
cucaaguccucuuu

SEQ ID NO: 3313367 - RNA, 15 nt, Human
cucacaguccuuacc

SEQ ID NO: 3313368 - RNA, 21 nt, Human
cucacacaugagcaucaggcc

SEQ ID NO: 3313369 - RNA, 24 nt, Human
cucacacaugagcaucaggccagg

SEQ ID NO: 3313370 - RNA, 22 nt, Human
cucacacaugagcaucaggcca

SEQ ID NO: 3313371 - RNA, 11 nt, Human
cucacucuguc

SEQ ID NO: 3313372 - RNA, 12 nt, Human
cucacucugucg

SEQ ID NO: 3313373 - RNA, 13 nt, Human
cucacuccuugaa

SEQ ID NO: 3313374 - RNA, 13 nt, Human
cucacugcagccu

SEQ ID NO: 3313375 - RNA, 12 nt, Human
cucacugcagcc

SEQ ID NO: 3313376 - RNA, 22 nt, Human
cucacucugucgcccagucugg

SEQ ID NO: 3313377 - RNA, 13 nt, Human
cucacucugucgc

SEQ ID NO: 3313378 - RNA, 21 nt, Human
cucacucugucgcccagucug

SEQ ID NO: 3313379 - RNA, 14 nt, Human
cucaccccagcccc

SEQ ID NO: 3313380 - RNA, 15 nt, Human
cucaccccagcccca

SEQ ID NO: 3313381 - RNA, 19 nt, Human
cucacuauguugcccaggc

SEQ ID NO: 3313382 - RNA, 20 nt, Human
cucacuauguugcccaggca

SEQ ID NO: 3313383 - RNA, 23 nt, Human
cucacuauguugcccaggcaggu

SEQ ID NO: 3313384 - RNA, 21 nt, Human
cucacuauguugcccaggcag

SEQ ID NO: 3313385 - RNA, 22 nt, Human
cucacuauguugcccaggcagg

SEQ ID NO: 3313386 - RNA, 20 nt, Human
cucacuguugcccaggcugg

SEQ ID NO: 3313387 - RNA, 22 nt, Human
cucacugccaugccagcuuauc

SEQ ID NO: 3313388 - RNA, 19 nt, Human
cucacugccaugccagcuu

SEQ ID NO: 3313389 - RNA, 19 nt, Human
cucacuguugcccaggcug

SEQ ID NO: 3313390 - RNA, 21 nt, Human
cucacuguugcccaggcuggc

SEQ ID NO: 3313391 - RNA, 22 nt, Human
cucacuguugcccaggcuggcg

SEQ ID NO: 3313392 - RNA, 14 nt, Human
cucagagagggugg

SEQ ID NO: 3313393 - RNA, 16 nt, Human
cucagcauccuggcac

SEQ ID NO: 3313394 - RNA, 17 nt, Human
cucagcauccuggcacc

SEQ ID NO: 3313395 - RNA, 21 nt, Human
cucagcaaaagaugcuucuca

SEQ ID NO: 3313396 - RNA, 15 nt, Human
cucagaucuucugug

SEQ ID NO: 3313397 - RNA, 21 nt, Human
cuauaauguaagcucuacuga

SEQ ID NO: 3313398 - RNA, 22 nt, Human
cuauaauuuaccugaagucuuu

SEQ ID NO: 3313399 - RNA, 16 nt, Human
cuauaauguaagcucu

SEQ ID NO: 3313400 - RNA, 17 nt, Human
cuauagccuaggugaca

SEQ ID NO: 3313401 - RNA, 15 nt, Human
cuauuagagaagaga

SEQ ID NO: 3313402 - RNA, 18 nt, Human
cuaugggacucaaugcac

SEQ ID NO: 3313403 - RNA, 22 nt, Human
cuaugggacucaaugcacugac

SEQ ID NO: 3313404 - RNA, 23 nt, Human
cuaugggacucaaugcacugaca

SEQ ID NO: 3313405 - RNA, 24 nt, Human
cuaggugacagagugagacucugu

SEQ ID NO: 3313406 - RNA, 14 nt, Human
cuaggugacagagu

SEQ ID NO: 3313407 - RNA, 18 nt, Human
cuaggugacagagugaga

SEQ ID NO: 3313408 - RNA, 22 nt, Human
cgcccaguuggguggaugccug

SEQ ID NO: 3313409 - RNA, 17 nt, Human
cgccaucccagccccaa

SEQ ID NO: 3313410 - RNA, 20 nt, Human
cgccaucccagccccaauga

SEQ ID NO: 3313411 - RNA, 15 nt, Human
cgccaugcuccuggc

SEQ ID NO: 3313412 - RNA, 23 nt, Human
cgcccaguuggguggaugccugg

SEQ ID NO: 3313413 - RNA, 22 nt, Human
gaacuggguacuuguggacaca

SEQ ID NO: 3313414 - RNA, 12 nt, Human
gaacuugguucc

SEQ ID NO: 3313415 - RNA, 23 nt, Human
gaacuugguucccauuugcuccu

SEQ ID NO: 3313416 - RNA, 13 nt, Human
gaacuuggcgcug

SEQ ID NO: 3313417 - RNA, 16 nt, Human
gaacuuggcgcugccc

SEQ ID NO: 3313418 - RNA, 15 nt, Human
gaacuuggcgcugcc

SEQ ID NO: 3313419 - RNA, 16 nt, Human
gaaccaccacacccag

SEQ ID NO: 3313420 - RNA, 15 nt, Human
gaacagacuggaagc

SEQ ID NO: 3313421 - RNA, 16 nt, Human
gaacagacuggaagca

SEQ ID NO: 3313422 - RNA, 20 nt, Human
gaaccacaucuugcucugcu

SEQ ID NO: 3313423 - RNA, 21 nt, Human
gaaccacaucuugcucugcug

SEQ ID NO: 3313424 - RNA, 17 nt, Human
gaaauuuguuauaauga

SEQ ID NO: 3313425 - RNA, 14 nt, Human
gaaaugggcagagc

SEQ ID NO: 3313426 - RNA, 20 nt, Human
gaaaugggcagagcagagac

SEQ ID NO: 3313427 - RNA, 20 nt, Human
gaaauaucugaaaauguaug

SEQ ID NO: 3313428 - RNA, 13 nt, Human
gaaauauaauuga

SEQ ID NO: 3313429 - RNA, 21 nt, Human
gaaauaucugaaaauguaugu

SEQ ID NO: 3313430 - RNA, 19 nt, Human
gaaugaaagggcccagaga

SEQ ID NO: 3313431 - RNA, 14 nt, Human
gaaugaaagggccc

SEQ ID NO: 3313432 - RNA, 16 nt, Human
gaaucucaaauaacua

SEQ ID NO: 3313433 - RNA, 15 nt, Human
gaauagcugggacua

SEQ ID NO: 3313434 - RNA, 14 nt, Human
gaauagcugggacu

SEQ ID NO: 3313435 - RNA, 12 nt, Human
gaaguuucugcc

SEQ ID NO: 3313436 - RNA, 21 nt, Human
gaaggauacaaaagcauguga

SEQ ID NO: 3313437 - RNA, 19 nt, Human
gaaggauacaaaagcaugu

SEQ ID NO: 3313438 - RNA, 12 nt, Human
gaaggauacaaa

SEQ ID NO: 3313439 - RNA, 18 nt, Human
gaaggaaacccagcucug

SEQ ID NO: 3313440 - RNA, 17 nt, Human
gaaggaaacccagcucu

SEQ ID NO: 3313441 - RNA, 14 nt, Human
gaaggaaacccagc

SEQ ID NO: 3313442 - RNA, 16 nt, Human
gaaggccccgcccagg

SEQ ID NO: 3313443 - RNA, 15 nt, Human
gaaggccccgcccag

SEQ ID NO: 3313444 - RNA, 14 nt, Human
gaaggccccgccca

SEQ ID NO: 3313445 - RNA, 21 nt, Human
gaagccgcuggggccaguugg

SEQ ID NO: 3313446 - RNA, 22 nt, Human
gaagcccaggaaaggcuccagg

SEQ ID NO: 3313447 - RNA, 21 nt, Human
gaagcccaggaaaggcuccag

SEQ ID NO: 3313448 - RNA, 19 nt, Human
gaagcccaggaaaggcucc

SEQ ID NO: 3313449 - RNA, 20 nt, Human
gaagcccaggaaaggcucca

SEQ ID NO: 3313450 - RNA, 23 nt, Human
gaagccagcaggcucucaggcca

SEQ ID NO: 3313451 - RNA, 19 nt, Human
gaagacucauucuucugua

SEQ ID NO: 3313452 - RNA, 21 nt, Human
gaagacucauucuucuguacg

SEQ ID NO: 3313453 - RNA, 16 nt, Human
gaagccagcaggcucu

SEQ ID NO: 3313454 - RNA, 15 nt, Human
gaagccagcaggcuc

SEQ ID NO: 3313455 - RNA, 22 nt, Human
cuuuccaaaugcccagcuuaaa

SEQ ID NO: 3313456 - RNA, 19 nt, Human
cuuuccaaaugcccagcuu

SEQ ID NO: 3313457 - RNA, 18 nt, Human
cuuuccaaaugcccagcu

SEQ ID NO: 3313458 - RNA, 16 nt, Human
cuuuccaaaugcccag

SEQ ID NO: 3313459 - RNA, 21 nt, Human
cuuguguguuuauugucaaag

SEQ ID NO: 3313460 - RNA, 21 nt, Human
cuuguggacacagcucuucuc

SEQ ID NO: 3313461 - RNA, 20 nt, Human
cuuguguguuuauugucaaa

SEQ ID NO: 3313462 - RNA, 16 nt, Human
cuuggggggcugaggu

SEQ ID NO: 3313463 - RNA, 22 nt, Human
cuuggggaccagagcugccacc

SEQ ID NO: 3313464 - RNA, 15 nt, Human
cuuggggggcugagg

SEQ ID NO: 3313465 - RNA, 13 nt, Human
cuugggcuucauc

SEQ ID NO: 3313466 - RNA, 14 nt, Human
cuugggccacugug

SEQ ID NO: 3313467 - RNA, 21 nt, Human
cuuggggaccagagcugccac

SEQ ID NO: 3313468 - RNA, 20 nt, Human
cuuggggaccagagcugcca

SEQ ID NO: 3313469 - RNA, 22 nt, Human
cuugggcuucauccuccucaga

SEQ ID NO: 3313470 - RNA, 14 nt, Human
cuuggcugcaggga

SEQ ID NO: 3313471 - RNA, 17 nt, Human
cuuggcugcagggaguc

SEQ ID NO: 3313472 - RNA, 22 nt, Human
cuuggaggaaggaaacccagcu

SEQ ID NO: 3313473 - RNA, 12 nt, Human
cuuggagggcau

SEQ ID NO: 3313474 - RNA, 23 nt, Human
cuuggagggcaugaagacagaua

SEQ ID NO: 3313475 - RNA, 16 nt, Human
cuuggcugcagggagu

SEQ ID NO: 3313476 - RNA, 16 nt, Human
cuugcucugcugacag

SEQ ID NO: 3313477 - RNA, 13 nt, Human
cuuggaagcuccg

SEQ ID NO: 3313478 - RNA, 13 nt, Human
cuuggaggaagga

SEQ ID NO: 3313479 - RNA, 16 nt, Human
cuuggaaaugggagac

SEQ ID NO: 3313480 - RNA, 13 nt, Human
cuugcucugcuga

SEQ ID NO: 3313481 - RNA, 14 nt, Human
cuugcucugcugac

SEQ ID NO: 3313482 - RNA, 17 nt, Human
cuucuccacccugcucu

SEQ ID NO: 3313483 - RNA, 18 nt, Human
cuucuccacccugcucuc

SEQ ID NO: 3313484 - RNA, 16 nt, Human
cuucuccacccugcuc

SEQ ID NO: 3313485 - RNA, 21 nt, Human
cuucuccacccugcucuccga

SEQ ID NO: 3313486 - RNA, 14 nt, Human
gaaaaucagccugc

SEQ ID NO: 3313487 - RNA, 16 nt, Human
gaaaaucagccugcuc

SEQ ID NO: 3313488 - RNA, 13 nt, Human
gaaaagcugcuga

SEQ ID NO: 3313489 - RNA, 17 nt, Human
gaaaagcugcugacagu

SEQ ID NO: 3313490 - RNA, 18 nt, Human
gaaacagcuaaugggaca

SEQ ID NO: 3313491 - RNA, 13 nt, Human
gaaaacacauuuu

SEQ ID NO: 3313492 - RNA, 12 nt, Human
gaaaacaugcua

SEQ ID NO: 3313493 - RNA, 15 nt, Human
gaaaacaugcuacac

SEQ ID NO: 3313494 - RNA, 14 nt, Human
gaaaacaugcuaca

SEQ ID NO: 3313495 - RNA, 14 nt, Human
gaaaacguggcugc

SEQ ID NO: 3313496 - RNA, 18 nt, Human
gaaaacguggcugcuuca

SEQ ID NO: 3313497 - RNA, 16 nt, Human
gaaaacguggcugcuu

SEQ ID NO: 3313498 - RNA, 15 nt, Human
gaaaacguggcugcu

SEQ ID NO: 3313499 - RNA, 15 nt, Human
cuuuuuuggcugcug

SEQ ID NO: 3313500 - RNA, 14 nt, Human
cuuuuuuggcugcu

SEQ ID NO: 3313501 - RNA, 17 nt, Human
gaaaaaggaugcacaga

SEQ ID NO: 3313502 - RNA, 23 nt, Human
gaaaaaggaugcacagaguuguu

SEQ ID NO: 3313503 - RNA, 21 nt, Human
cuuuugagugccuuacacaau

SEQ ID NO: 3313504 - RNA, 16 nt, Human
cuuuugagcauuuaga

SEQ ID NO: 3313505 - RNA, 15 nt, Human
cuuuuuucacuacau

SEQ ID NO: 3313506 - RNA, 14 nt, Human
cuuugugauuuuug

SEQ ID NO: 3313507 - RNA, 22 nt, Human
cuuuguccccaccgcagacagg

SEQ ID NO: 3313508 - RNA, 15 nt, Human
cuuuguccccaccgc

SEQ ID NO: 3313509 - RNA, 18 nt, Human
cuuuguccccaccgcaga

SEQ ID NO: 3313510 - RNA, 13 nt, Human
cuuugggaggcca

SEQ ID NO: 3313511 - RNA, 14 nt, Human
cuuuguucuggcuc

SEQ ID NO: 3313512 - RNA, 18 nt, Human
cuuugugauuuuuguaau

SEQ ID NO: 3313513 - RNA, 17 nt, Human
cuuugugauuuuuguaa

SEQ ID NO: 3313514 - RNA, 16 nt, Human
cuuucccaucuuccaa

SEQ ID NO: 3313515 - RNA, 16 nt, Human
cuuuggacccugaggc

SEQ ID NO: 3313516 - RNA, 15 nt, Human
cuuuggacccugagg

SEQ ID NO: 3313517 - RNA, 18 nt, Human
cuuuggacccugaggccc

SEQ ID NO: 3313518 - RNA, 17 nt, Human
cuuuggacccugaggcc

SEQ ID NO: 3313519 - RNA, 19 nt, Human
cuuuggacccugaggccca

SEQ ID NO: 3313520 - RNA, 23 nt, Human
cuuuucuugcaugaggcuagugu

SEQ ID NO: 3313521 - RNA, 18 nt, Human
cuuuucuugcaugaggcu

SEQ ID NO: 3313522 - RNA, 18 nt, Human
cuuuucuguccgagcuuu

SEQ ID NO: 3313523 - RNA, 22 nt, Human
cuuuucauaaccuagccuuaga

SEQ ID NO: 3313524 - RNA, 20 nt, Human
cuuuucauaaccuagccuua

SEQ ID NO: 3313525 - RNA, 18 nt, Human
cuuuguuuguugucagcu

SEQ ID NO: 3313526 - RNA, 19 nt, Human
cuucgggaggucgaggcag

SEQ ID NO: 3313527 - RNA, 16 nt, Human
cuucucacugccaugc

SEQ ID NO: 3313528 - RNA, 21 nt, Human
cuucucacugccaugccagcu

SEQ ID NO: 3313529 - RNA, 16 nt, Human
cuucgcuccugugucu

SEQ ID NO: 3313530 - RNA, 17 nt, Human
cuucgcuccugugucuu

SEQ ID NO: 3313531 - RNA, 17 nt, Human
cuucccuacaguugaaa

SEQ ID NO: 3313532 - RNA, 16 nt, Human
cuucagccucccgagu

SEQ ID NO: 3313533 - RNA, 20 nt, Human
cuucagccucccgaguagcu

SEQ ID NO: 3313534 - RNA, 14 nt, Human
cuucagccucccga

SEQ ID NO: 3313535 - RNA, 19 nt, Human
cuucagcugacuuuucugu

SEQ ID NO: 3313536 - RNA, 15 nt, Human
cuucagcugacuuuu

SEQ ID NO: 3313537 - RNA, 14 nt, Human
cuucaguaagccgu

SEQ ID NO: 3313538 - RNA, 13 nt, Human
cuuccacaagagc

SEQ ID NO: 3313539 - RNA, 15 nt, Human
cuuccacaagagccc

SEQ ID NO: 3313540 - RNA, 14 nt, Human
cuuccacaagagcc

SEQ ID NO: 3313541 - RNA, 14 nt, Human
cuucagugccaaaa

SEQ ID NO: 3313542 - RNA, 15 nt, Human
cuucaaauauuuccc

SEQ ID NO: 3313543 - RNA, 22 nt, Human
cuuagucacugagacagcccgg

SEQ ID NO: 3313544 - RNA, 20 nt, Human
cuuagucacugagacagccc

SEQ ID NO: 3313545 - RNA, 21 nt, Human
cuuagucacugagacagcccg

SEQ ID NO: 3313546 - RNA, 16 nt, Human
cuucaaggauccugag

SEQ ID NO: 3313547 - RNA, 20 nt, Human
cuucaaggauccugagccag

SEQ ID NO: 3313548 - RNA, 19 nt, Human
cuucaaggauccugagcca

SEQ ID NO: 3313549 - RNA, 18 nt, Human
cuucaaggauccugagcc

SEQ ID NO: 3313550 - RNA, 17 nt, Human
cuucaaggauccugagc

SEQ ID NO: 3313551 - RNA, 23 nt, Human
cuucaaggauccugagccagauu

SEQ ID NO: 3313552 - RNA, 22 nt, Human
cuucaaggauccugagccagau

SEQ ID NO: 3313553 - RNA, 21 nt, Human
cuucaaggauccugagccaga

SEQ ID NO: 3313554 - RNA, 24 nt, Human
cuucagagacuccugcaggcagcc

SEQ ID NO: 3313555 - RNA, 23 nt, Human
cuucacauauugauuuccguuaa

SEQ ID NO: 3313556 - RNA, 14 nt, Human
cuucacauauugau

SEQ ID NO: 3313557 - RNA, 20 nt, Human
cuuaauucuuagcucauucu

SEQ ID NO: 3313558 - RNA, 16 nt, Human
cuuaaucuaaauggaa

SEQ ID NO: 3313559 - RNA, 20 nt, Human
cuuaccugccaggaagccag

SEQ ID NO: 3313560 - RNA, 13 nt, Human
cuuaccugccagg

SEQ ID NO: 3313561 - RNA, 20 nt, Human
cuuagaaaaaccaccaccau

SEQ ID NO: 3313562 - RNA, 17 nt, Human
cuuagaagucacacagu

SEQ ID NO: 3313563 - RNA, 20 nt, Human
cuuagaagucacacaguauu

SEQ ID NO: 3313564 - RNA, 19 nt, Human
cuuagaauuaguggcacuu

SEQ ID NO: 3313565 - RNA, 21 nt, Human
cuuagguuggcaaaaaggcag

SEQ ID NO: 3313566 - RNA, 23 nt, Human
cuuagguuggcaaaaaggcagga

SEQ ID NO: 3313567 - RNA, 21 nt, Human
cuguuuuauuuuaauucaguu

SEQ ID NO: 3313568 - RNA, 17 nt, Human
cuuaaaaaguggaaaaa

SEQ ID NO: 3313569 - RNA, 16 nt, Human
cuuaaaaaguggaaaa

SEQ ID NO: 3313570 - RNA, 17 nt, Human
cuguugcccaggcuggc

SEQ ID NO: 3313571 - RNA, 17 nt, Human
cuguuuagauaauacac

SEQ ID NO: 3313572 - RNA, 14 nt, Human
cuguuuagauaaua

SEQ ID NO: 3313573 - RNA, 18 nt, Human
cuguuuagauaauacacc

SEQ ID NO: 3313574 - RNA, 17 nt, Human
cuguuucaaacuuuacu

SEQ ID NO: 3313575 - RNA, 15 nt, Human
cuguuucaaacuuua

SEQ ID NO: 3313576 - RNA, 19 nt, Human
cuguuugcuaagugaggau

SEQ ID NO: 3313577 - RNA, 17 nt, Human
cuguuugcuaagugagg

SEQ ID NO: 3313578 - RNA, 16 nt, Human
cuguuaauaguucagg

SEQ ID NO: 3313579 - RNA, 21 nt, Human
cuguucuuucuggcuaugcau

SEQ ID NO: 3313580 - RNA, 14 nt, Human
cuguucuuucuggc

SEQ ID NO: 3313581 - RNA, 13 nt, Human
cuguucuuucugg

SEQ ID NO: 3313582 - RNA, 21 nt, Human
cuguucuuuccaaaguacacu

SEQ ID NO: 3313583 - RNA, 19 nt, Human
cuguucuuuccaaaguaca

SEQ ID NO: 3313584 - RNA, 16 nt, Human
cuguucuuuccaaagu

SEQ ID NO: 3313585 - RNA, 15 nt, Human
cuguucuuuccaaag

SEQ ID NO: 3313586 - RNA, 12 nt, Human
cuguugcccagg

SEQ ID NO: 3313587 - RNA, 13 nt, Human
cuguugcccaggc

SEQ ID NO: 3313588 - RNA, 14 nt, Human
cuguugcccaggcu

SEQ ID NO: 3313589 - RNA, 15 nt, Human
cuguugcccaggcug

SEQ ID NO: 3313590 - RNA, 16 nt, Human
cuguugcccaggcugg

SEQ ID NO: 3313591 - RNA, 23 nt, Human
cuguucuuucuggcuaugcauuu

SEQ ID NO: 3313592 - RNA, 23 nt, Human
cugugucuugcaauggcagccuu

SEQ ID NO: 3313593 - RNA, 20 nt, Human
cugugucuuuuuucacuaca

SEQ ID NO: 3313594 - RNA, 22 nt, Human
cuguggguuucuaaagcugcca

SEQ ID NO: 3313595 - RNA, 21 nt, Human
cuguggguuucuaaagcugcc

SEQ ID NO: 3313596 - RNA, 22 nt, Human
cugugaaaggaaagagggaggu

SEQ ID NO: 3313597 - RNA, 16 nt, Human
cugugaaaggaaagag

SEQ ID NO: 3313598 - RNA, 20 nt, Human
cugugauggggcccugccuc

SEQ ID NO: 3313599 - RNA, 23 nt, Human
cugugauggggcccugccuccuu

SEQ ID NO: 3313600 - RNA, 21 nt, Human
cugugauggggcccugccucc

SEQ ID NO: 3313601 - RNA, 16 nt, Human
cugugauggggcccug

SEQ ID NO: 3313602 - RNA, 15 nt, Human
cugugauggggcccu

SEQ ID NO: 3313603 - RNA, 14 nt, Human
cugugccaugugcc

SEQ ID NO: 3313604 - RNA, 19 nt, Human
cugugcccuaaaguguauu

SEQ ID NO: 3313605 - RNA, 15 nt, Human
cugugccaugugcca

SEQ ID NO: 3313606 - RNA, 22 nt, Human
cugugccauuuuguauuuuacu

SEQ ID NO: 3313607 - RNA, 18 nt, Human
cugucuucaguaagccgu

SEQ ID NO: 3313608 - RNA, 15 nt, Human
cugugaaaggaaaga

SEQ ID NO: 3313609 - RNA, 21 nt, Human
cugucauuugagcagggcuca

SEQ ID NO: 3313610 - RNA, 22 nt, Human
cugucauuugagcagggcucag

SEQ ID NO: 3313611 - RNA, 20 nt, Human
cugucauuugagcagggcuc

SEQ ID NO: 3313612 - RNA, 18 nt, Human
cugucaauuacaggaagu

SEQ ID NO: 3313613 - RNA, 14 nt, Human
cugguggcagcugc

SEQ ID NO: 3313614 - RNA, 16 nt, Human
cugguggcagcucacc

SEQ ID NO: 3313615 - RNA, 18 nt, Human
cugguggcagcucaccuc

SEQ ID NO: 3313616 - RNA, 17 nt, Human
cugguggcagcucaccu

SEQ ID NO: 3313617 - RNA, 15 nt, Human
cugguggcagcugcg

SEQ ID NO: 3313618 - RNA, 20 nt, Human
cugguggcagcucaccucuc

SEQ ID NO: 3313619 - RNA, 14 nt, Human
cugguggcaguggg

SEQ ID NO: 3313620 - RNA, 18 nt, Human
cugguggcagugggagcu

SEQ ID NO: 3313621 - RNA, 15 nt, Human
cuguaauuugugaua

SEQ ID NO: 3313622 - RNA, 14 nt, Human
cuguaauuugugau

SEQ ID NO: 3313623 - RNA, 18 nt, Human
cuguacagagcccacgcc

SEQ ID NO: 3313624 - RNA, 15 nt, Human
cuguacagagcccac

SEQ ID NO: 3313625 - RNA, 14 nt, Human
cuguacagagccca

SEQ ID NO: 3313626 - RNA, 22 nt, Human
cugguuagagguucccuuugac

SEQ ID NO: 3313627 - RNA, 21 nt, Human
cugguuagagguucccuuuga

SEQ ID NO: 3313628 - RNA, 20 nt, Human
cuguauuuuguuuuugucuu

SEQ ID NO: 3313629 - RNA, 13 nt, Human
cugucaauuacag

SEQ ID NO: 3313630 - RNA, 16 nt, Human
cugucaauuacaggaa

SEQ ID NO: 3313631 - RNA, 15 nt, Human
cugucaauuacagga

SEQ ID NO: 3313632 - RNA, 21 nt, Human
cuguaucccaugagccucagc

SEQ ID NO: 3313633 - RNA, 20 nt, Human
cuguaucccaugagccucag

SEQ ID NO: 3313634 - RNA, 19 nt, Human
cuguaucccaugagccuca

SEQ ID NO: 3313635 - RNA, 19 nt, Human
cuguacgucugacaggcaa

SEQ ID NO: 3313636 - RNA, 20 nt, Human
cuguacgucugacaggcaau

SEQ ID NO: 3313637 - RNA, 14 nt, Human
cuguacgucugaca

SEQ ID NO: 3313638 - RNA, 15 nt, Human
cuguacgucugacag

SEQ ID NO: 3313639 - RNA, 16 nt, Human
cuguacgucugacagg

SEQ ID NO: 3313640 - RNA, 18 nt, Human
cuguacgucugacaggca

SEQ ID NO: 3313641 - RNA, 21 nt, Human
cuguacaugaaaacacauuuu

SEQ ID NO: 3313642 - RNA, 20 nt, Human
cuguacaugaaaacacauuu

SEQ ID NO: 3313643 - RNA, 17 nt, Human
cuguacaugaaaacaca

SEQ ID NO: 3313644 - RNA, 15 nt, Human
cugggcuucaguggc

SEQ ID NO: 3313645 - RNA, 21 nt, Human
cugggcuuggggaccagagcu

SEQ ID NO: 3313646 - RNA, 22 nt, Human
cugggcuuggggaccagagcug

SEQ ID NO: 3313647 - RNA, 18 nt, Human
cugggcuugucuguagau

SEQ ID NO: 3313648 - RNA, 14 nt, Human
cugggggcugggca

SEQ ID NO: 3313649 - RNA, 18 nt, Human
cugggggccucagugcca

SEQ ID NO: 3313650 - RNA, 21 nt, Human
cugggauuacaagcgugagcc

SEQ ID NO: 3313651 - RNA, 21 nt, Human
cccacaaaggagagcuagcag

SEQ ID NO: 3313652 - RNA, 20 nt, Human
cccaaugcacuuuguucugg

SEQ ID NO: 3313653 - RNA, 16 nt, Human
cccaaugcacuuuguu

SEQ ID NO: 3313654 - RNA, 17 nt, Human
cccaccuggccucugca

SEQ ID NO: 3313655 - RNA, 21 nt, Human
cccaccuggccucugcacucc

SEQ ID NO: 3313656 - RNA, 19 nt, Human
cccaccuggccucugcacu

SEQ ID NO: 3313657 - RNA, 16 nt, Human
cccaccuggccucugc

SEQ ID NO: 3313658 - RNA, 20 nt, Human
cccaccuuggcugcagggag

SEQ ID NO: 3313659 - RNA, 21 nt, Human
cccacgacugcccggcagggu

SEQ ID NO: 3313660 - RNA, 20 nt, Human
cccacgacugcccggcaggg

SEQ ID NO: 3313661 - RNA, 12 nt, Human
cccacuucugcc

SEQ ID NO: 3313662 - RNA, 23 nt, Human
cccacuugagaauuacccuuuug

SEQ ID NO: 3313663 - RNA, 14 nt, Human
cccacgcuggagug

SEQ ID NO: 3313664 - RNA, 19 nt, Human
cccacgcuggagugcagug

SEQ ID NO: 3313665 - RNA, 20 nt, Human
cccacgcuggagugcaguga

SEQ ID NO: 3313666 - RNA, 17 nt, Human
cccaccucagccucccg

SEQ ID NO: 3313667 - RNA, 22 nt, Human
cccaccucucucacuccuugaa

SEQ ID NO: 3313668 - RNA, 19 nt, Human
cccaccucucucacuccuu

SEQ ID NO: 3313669 - RNA, 20 nt, Human
cccaccgcagacaggaccag

SEQ ID NO: 3313670 - RNA, 19 nt, Human
cccaccgcagacaggacca

SEQ ID NO: 3313671 - RNA, 16 nt, Human
cccgggcucugccucc

SEQ ID NO: 3313672 - RNA, 20 nt, Human
cccuacaguugaaaaacagc

SEQ ID NO: 3313673 - RNA, 14 nt, Human
cccagagggccugc

SEQ ID NO: 3313674 - RNA, 21 nt, Human
cccgaggccuucucugaagga

SEQ ID NO: 3313675 - RNA, 15 nt, Human
cccagagggccugca

SEQ ID NO: 3313676 - RNA, 13 nt, Human
cccgaguagcugg

SEQ ID NO: 3313677 - RNA, 14 nt, Human
cccgaguagcuggg

SEQ ID NO: 3313678 - RNA, 15 nt, Human
cccgaguagcuggga

SEQ ID NO: 3313679 - RNA, 16 nt, Human
cccgaguagcugggac

SEQ ID NO: 3313680 - RNA, 17 nt, Human
cccgaguagcugggacu

SEQ ID NO: 3313681 - RNA, 18 nt, Human
cccgaguagcugggacua

SEQ ID NO: 3313682 - RNA, 21 nt, Human
cccgaguagcugggacuacag

SEQ ID NO: 3313683 - RNA, 20 nt, Human
cccgcugucagccauuccug

SEQ ID NO: 3313684 - RNA, 19 nt, Human
cccgcugucagccauuccu

SEQ ID NO: 3313685 - RNA, 22 nt, Human
cccgcccaggcuuagucacuga

SEQ ID NO: 3313686 - RNA, 22 nt, Human
cccgaguagcugggacuacagg

SEQ ID NO: 3313687 - RNA, 12 nt, Human
cccgggcucugc

SEQ ID NO: 3313688 - RNA, 15 nt, Human
cccgggcucugccuc

SEQ ID NO: 3313689 - RNA, 14 nt, Human
cccgggcucugccu

SEQ ID NO: 3313690 - RNA, 15 nt, Human
cccugguggcagcuc

SEQ ID NO: 3313691 - RNA, 17 nt, Human
cccugguggcagcucac

SEQ ID NO: 3313692 - RNA, 16 nt, Human
cccugguggcagcuca

SEQ ID NO: 3313693 - RNA, 21 nt, Human
cccugcuggguguggcgcagc

SEQ ID NO: 3313694 - RNA, 16 nt, Human
cccugcuggguguggc

SEQ ID NO: 3313695 - RNA, 18 nt, Human
cccugcccaccuggccuc

SEQ ID NO: 3313696 - RNA, 17 nt, Human
cccugcccaccuggccu

SEQ ID NO: 3313697 - RNA, 14 nt, Human
cccugcccaccugg

SEQ ID NO: 3313698 - RNA, 13 nt, Human
cccugcccaccug

SEQ ID NO: 3313699 - RNA, 12 nt, Human
cccugcacuugc

SEQ ID NO: 3313700 - RNA, 19 nt, Human
cccugcacuugcagacucu

SEQ ID NO: 3313701 - RNA, 23 nt, Human
cccugaggcccagagggccugca

SEQ ID NO: 3313702 - RNA, 20 nt, Human
cccugaggcccagagggccu

SEQ ID NO: 3313703 - RNA, 19 nt, Human
cccugaggcccagagggcc

SEQ ID NO: 3313704 - RNA, 18 nt, Human
cccugaggcccagagggc

SEQ ID NO: 3313705 - RNA, 17 nt, Human
cccugaggcccagaggg

SEQ ID NO: 3313706 - RNA, 16 nt, Human
cccugaggcccagagg

SEQ ID NO: 3313707 - RNA, 15 nt, Human
cccugaggcccagag

SEQ ID NO: 3313708 - RNA, 14 nt, Human
cccugaggcccaga

SEQ ID NO: 3313709 - RNA, 15 nt, Human
cccugaaagcccuga

SEQ ID NO: 3313710 - RNA, 13 nt, Human
cccugaggcccag

SEQ ID NO: 3313711 - RNA, 16 nt, Human
cccucuggggcuguuc

SEQ ID NO: 3313712 - RNA, 12 nt, Human
cccucuggggcu

SEQ ID NO: 3313713 - RNA, 20 nt, Human
ccgggcgcgguggcucacgc

SEQ ID NO: 3313714 - RNA, 22 nt, Human
ccgggcucugccucccaucacc

SEQ ID NO: 3313715 - RNA, 20 nt, Human
ccgggaagggggcugggaca

SEQ ID NO: 3313716 - RNA, 19 nt, Human
ccgcuuucuacccagcgag

SEQ ID NO: 3313717 - RNA, 15 nt, Human
ccggcuggccuggcc

SEQ ID NO: 3313718 - RNA, 18 nt, Human
ccggcuggccuggccccu

SEQ ID NO: 3313719 - RNA, 17 nt, Human
ccggcuggccuggcccc

SEQ ID NO: 3313720 - RNA, 12 nt, Human
ccgcuuucuacc

SEQ ID NO: 3313721 - RNA, 14 nt, Human
ccgaggccuucucu

SEQ ID NO: 3313722 - RNA, 20 nt, Human
ccgaguagcugggacuacag

SEQ ID NO: 3313723 - RNA, 16 nt, Human
ccgaguagcugggacu

SEQ ID NO: 3313724 - RNA, 17 nt, Human
ccgaguagcugggacua

SEQ ID NO: 3313725 - RNA, 14 nt, Human
ccgcacugggcuug

SEQ ID NO: 3313726 - RNA, 21 nt, Human
ccgcuaagagggagggagggc

SEQ ID NO: 3313727 - RNA, 23 nt, Human
ccgcuaagagggagggagggcuc

SEQ ID NO: 3313728 - RNA, 22 nt, Human
ccuauauuguuuucaguguaca

SEQ ID NO: 3313729 - RNA, 18 nt, Human
ccuauauuguuuucagug

SEQ ID NO: 3313730 - RNA, 23 nt, Human
ccuaguuccaccaucaagccacc

SEQ ID NO: 3313731 - RNA, 21 nt, Human
ccuaguuccaccaucaagcca

SEQ ID NO: 3313732 - RNA, 13 nt, Human
ccuaguuccacca

SEQ ID NO: 3313733 - RNA, 14 nt, Human
ccuaaaguguauuu

SEQ ID NO: 3313734 - RNA, 22 nt, Human
ccuccaggugcacaagcuccaa

SEQ ID NO: 3313735 - RNA, 21 nt, Human
ccuccaggugcacaagcucca

SEQ ID NO: 3313736 - RNA, 19 nt, Human
ccuccaggugcacaagcuc

SEQ ID NO: 3313737 - RNA, 23 nt, Human
ccuccaugugggcuaguugggcu

SEQ ID NO: 3313738 - RNA, 15 nt, Human
ccucccaaagugcug

SEQ ID NO: 3313739 - RNA, 19 nt, Human
ccucagucuggcccuuccu

SEQ ID NO: 3313740 - RNA, 11 nt, Human
ccucagugcca

SEQ ID NO: 3313741 - RNA, 12 nt, Human
ccucauacccac

SEQ ID NO: 3313742 - RNA, 20 nt, Human
ccucagucuggcccuuccuu

SEQ ID NO: 3313743 - RNA, 20 nt, Human
ccucauaguaugguggcugg

SEQ ID NO: 3313744 - RNA, 13 nt, Human
ccucauacccacc

SEQ ID NO: 3313745 - RNA, 21 nt, Human
ccucauaguaugguggcuggg

SEQ ID NO: 3313746 - RNA, 22 nt, Human
ccucauaguaugguggcugggu

SEQ ID NO: 3313747 - RNA, 14 nt, Human
ccucaucaccaacg

SEQ ID NO: 3313748 - RNA, 13 nt, Human
ccucaucaccaac

SEQ ID NO: 3313749 - RNA, 20 nt, Human
ccucauccucauacccaccc

SEQ ID NO: 3313750 - RNA, 13 nt, Human
ccucauccucaua

SEQ ID NO: 3313751 - RNA, 16 nt, Human
ccucuaggaggucucu

SEQ ID NO: 3313752 - RNA, 14 nt, Human
ccucgguguggaga

SEQ ID NO: 3313753 - RNA, 16 nt, Human
ccucggugccuuccuc

SEQ ID NO: 3313754 - RNA, 13 nt, Human
ccuccugccucga

SEQ ID NO: 3313755 - RNA, 23 nt, Human
ccuccugccucgaacuggcugca

SEQ ID NO: 3313756 - RNA, 14 nt, Human
ccuccugggcuaag

SEQ ID NO: 3313757 - RNA, 19 nt, Human
ccucccgaguagcugggac

SEQ ID NO: 3313758 - RNA, 20 nt, Human
ccucccgaguagcugggacu

SEQ ID NO: 3313759 - RNA, 21 nt, Human
ccucccgaguagcugggacua

SEQ ID NO: 3313760 - RNA, 14 nt, Human
ccuccucagaucuu

SEQ ID NO: 3313761 - RNA, 10 nt, Human
ccucccuccc

SEQ ID NO: 3313762 - RNA, 17 nt, Human
ccucccgaauagcuggg

SEQ ID NO: 3313763 - RNA, 18 nt, Human
ccuucgcuccugugucuu

SEQ ID NO: 3313764 - RNA, 22 nt, Human
ccuucauuuggcauuccccacu

SEQ ID NO: 3313765 - RNA, 17 nt, Human
ccuucacagaugggugc

SEQ ID NO: 3313766 - RNA, 20 nt, Human
ccuucaccuuuguccccacc

SEQ ID NO: 3313767 - RNA, 19 nt, Human
ccuucaccuuuguccccac

SEQ ID NO: 3313768 - RNA, 21 nt, Human
ccuucaccuuuguccccaccg

SEQ ID NO: 3313769 - RNA, 10 nt, Human
ccuucagugc

SEQ ID NO: 3313770 - RNA, 11 nt, Human
ccuucagugcc

SEQ ID NO: 3313771 - RNA, 14 nt, Human
ccuucagugccaaa

SEQ ID NO: 3313772 - RNA, 19 nt, Human
ccuucauuuggcauucccc

SEQ ID NO: 3313773 - RNA, 19 nt, Human
ccuugaacuuugaccucug

SEQ ID NO: 3313774 - RNA, 23 nt, Human
ccuugaccauucuccaccugcca

SEQ ID NO: 3313775 - RNA, 22 nt, Human
ccuugaccauucuccaccugcc

SEQ ID NO: 3313776 - RNA, 13 nt, Human
ccuugacucuuuc

SEQ ID NO: 3313777 - RNA, 15 nt, Human
ccuucggcgccuuaa

SEQ ID NO: 3313778 - RNA, 19 nt, Human
ccuucuccuucaccuuugu

SEQ ID NO: 3313779 - RNA, 15 nt, Human
ccuucuccuucaccu

SEQ ID NO: 3313780 - RNA, 18 nt, Human
ccuuugacgccaucccag

SEQ ID NO: 3313781 - RNA, 17 nt, Human
ccuuugacgccauccca

SEQ ID NO: 3313782 - RNA, 16 nt, Human
ccuuugacgccauccc

SEQ ID NO: 3313783 - RNA, 21 nt, Human
ccuuggugucgggcaugacac

SEQ ID NO: 3313784 - RNA, 22 nt, Human
ccuuggugucgggcaugacacg

SEQ ID NO: 3313785 - RNA, 22 nt, Human
ccuugguuaggcauugugggaa

SEQ ID NO: 3313786 - RNA, 21 nt, Human
ccuugguuaggcauuguggga

SEQ ID NO: 3313787 - RNA, 20 nt, Human
ccuuacacaaugguuuucuu

SEQ ID NO: 3313788 - RNA, 14 nt, Human
ccuuacacaauggu

SEQ ID NO: 3313789 - RNA, 17 nt, Human
ccuuagaagucacacag

SEQ ID NO: 3313790 - RNA, 18 nt, Human
ccuuagaagucacacagu

SEQ ID NO: 3313791 - RNA, 19 nt, Human
ccuuaccugccaggaagcc

SEQ ID NO: 3313792 - RNA, 14 nt, Human
ccuuaccugccagg

SEQ ID NO: 3313793 - RNA, 20 nt, Human
ccuuaccagcagagcaccuu

SEQ ID NO: 3313794 - RNA, 17 nt, Human
ccuuaccagcagagcac

SEQ ID NO: 3313795 - RNA, 15 nt, Human
ccuuacccucauguu

SEQ ID NO: 3313796 - RNA, 23 nt, Human
ccuguugggccaggagccuccug

SEQ ID NO: 3313797 - RNA, 16 nt, Human
ccuguuucugcagcca

SEQ ID NO: 3313798 - RNA, 18 nt, Human
ccuguuuguuucugaaag

SEQ ID NO: 3313799 - RNA, 14 nt, Human
ccuguuuguuucug

SEQ ID NO: 3313800 - RNA, 17 nt, Human
ccugugucuugcaaugg

SEQ ID NO: 3313801 - RNA, 19 nt, Human
ccugugucuugcaauggca

SEQ ID NO: 3313802 - RNA, 21 nt, Human
ccugugucuugcaauggcagc

SEQ ID NO: 3313803 - RNA, 22 nt, Human
ccugugucuugcaauggcagcc

SEQ ID NO: 3313804 - RNA, 20 nt, Human
ccugugugugcgccuacagg

SEQ ID NO: 3313805 - RNA, 21 nt, Human
ccugugugugcgccuacagga

SEQ ID NO: 3313806 - RNA, 20 nt, Human
cgagauugcaccacugcacu

SEQ ID NO: 3313807 - RNA, 18 nt, Human
cgagaucacgccacugca

SEQ ID NO: 3313808 - RNA, 20 nt, Human
cgagaucacgccacugcacu

SEQ ID NO: 3313809 - RNA, 20 nt, Human
cgagcaggcuucuucccccc

SEQ ID NO: 3313810 - RNA, 17 nt, Human
cgagcaugccuggaugg

SEQ ID NO: 3313811 - RNA, 16 nt, Human
cgagcaugccuggaug

SEQ ID NO: 3313812 - RNA, 13 nt, Human
cgagcaugccugg

SEQ ID NO: 3313813 - RNA, 14 nt, Human
cgagcaugccugga

SEQ ID NO: 3313814 - RNA, 13 nt, Human
cgaauagcuggga

SEQ ID NO: 3313815 - RNA, 14 nt, Human
cgaauagcugggac

SEQ ID NO: 3313816 - RNA, 17 nt, Human
cgagaucacgccacugc

SEQ ID NO: 3313817 - RNA, 18 nt, Human
cgagauagccaaggccaa

SEQ ID NO: 3313818 - RNA, 12 nt, Human
cgaacuggcugc

SEQ ID NO: 3313819 - RNA, 14 nt, Human
cgaacuggcugcaa

SEQ ID NO: 3313820 - RNA, 19 nt, Human
cgaaagggacuuggaagcu

SEQ ID NO: 3313821 - RNA, 20 nt, Human
cgaaaggaugaaagugacca

SEQ ID NO: 3313822 - RNA, 22 nt, Human
cgaaagggacuuggaagcuccg

SEQ ID NO: 3313823 - RNA, 23 nt, Human
cgaacauguuuuucuucucccuc

SEQ ID NO: 3313824 - RNA, 12 nt, Human
cgaaagaacagu

SEQ ID NO: 3313825 - RNA, 21 nt, Human
cgaaagaacaguccauugaaa

SEQ ID NO: 3313826 - RNA, 20 nt, Human
cgaaaacguggcugcuucaa

SEQ ID NO: 3313827 - RNA, 15 nt, Human
cgaaaacguggcugc

SEQ ID NO: 3313828 - RNA, 19 nt, Human
cgaaaacguggcugcuuca

SEQ ID NO: 3313829 - RNA, 18 nt, Human
cgaaaacguggcugcuuc

SEQ ID NO: 3313830 - RNA, 22 nt, Human
ccuuugacgccaucccagcccc

SEQ ID NO: 3313831 - RNA, 21 nt, Human
ccuuugacgccaucccagccc

SEQ ID NO: 3313832 - RNA, 20 nt, Human
ccuuugacgccaucccagcc

SEQ ID NO: 3313833 - RNA, 15 nt, Human
cgagcccugguggca

SEQ ID NO: 3313834 - RNA, 16 nt, Human
cgagcccugguggcag

SEQ ID NO: 3313835 - RNA, 18 nt, Human
cgagcaugccuggauggg

SEQ ID NO: 3313836 - RNA, 20 nt, Human
cgauuucuguuuagauaaua

SEQ ID NO: 3313837 - RNA, 14 nt, Human
cgcagcccugcaga

SEQ ID NO: 3313838 - RNA, 16 nt, Human
cgcagacaggaccagg

SEQ ID NO: 3313839 - RNA, 15 nt, Human
cgcagacaggaccag

SEQ ID NO: 3313840 - RNA, 22 nt, Human
cgccaggggaaaaucagccugc

SEQ ID NO: 3313841 - RNA, 21 nt, Human
cgccagauucuuuccugaggc

SEQ ID NO: 3313842 - RNA, 20 nt, Human
cgccagauucuuuccugagg

SEQ ID NO: 3313843 - RNA, 19 nt, Human
cgccagauucuuuccugag

SEQ ID NO: 3313844 - RNA, 17 nt, Human
cgccagauucuuuccug

SEQ ID NO: 3313845 - RNA, 17 nt, Human
cgccaugcuccuggccc

SEQ ID NO: 3313846 - RNA, 14 nt, Human
ccugagcuuucugc

SEQ ID NO: 3313847 - RNA, 20 nt, Human
ccugagccagauuucacucu

SEQ ID NO: 3313848 - RNA, 16 nt, Human
ccugagcuuucugcua

SEQ ID NO: 3313849 - RNA, 18 nt, Human
ccugaggcccagagggcc

SEQ ID NO: 3313850 - RNA, 21 nt, Human
ccugaggcccagagggccugc

SEQ ID NO: 3313851 - RNA, 23 nt, Human
ccugacaacacucauugaccuga

SEQ ID NO: 3313852 - RNA, 14 nt, Human
ccugcaagaacaag

SEQ ID NO: 3313853 - RNA, 23 nt, Human
ccugcaggcagccaggccacaag

SEQ ID NO: 3313854 - RNA, 15 nt, Human
ccugauugugucucu

SEQ ID NO: 3313855 - RNA, 21 nt, Human
ccugaugcuucuucagagacu

SEQ ID NO: 3313856 - RNA, 20 nt, Human
ccugaugcuucuucagagac

SEQ ID NO: 3313857 - RNA, 19 nt, Human
ccugaugcuucuucagaga

SEQ ID NO: 3313858 - RNA, 12 nt, Human
ccugaggcccuu

SEQ ID NO: 3313859 - RNA, 11 nt, Human
ccugaggcccu

SEQ ID NO: 3313860 - RNA, 17 nt, Human
ccugauugugucucuug

SEQ ID NO: 3313861 - RNA, 21 nt, Human
ccugcaaccugauugugucuc

SEQ ID NO: 3313862 - RNA, 22 nt, Human
ccugcaaccugauugugucucu

SEQ ID NO: 3313863 - RNA, 16 nt, Human
ccugccagggacagag

SEQ ID NO: 3313864 - RNA, 15 nt, Human
ccugccagggacaga

SEQ ID NO: 3313865 - RNA, 14 nt, Human
ccugccagggacag

SEQ ID NO: 3313866 - RNA, 13 nt, Human
ccugccagggaca

SEQ ID NO: 3313867 - RNA, 12 nt, Human
ccugccagggac

SEQ ID NO: 3313868 - RNA, 22 nt, Human
ccugccaggaagccagcaggcu

SEQ ID NO: 3313869 - RNA, 21 nt, Human
ccugccaggaagccagcaggc

SEQ ID NO: 3313870 - RNA, 19 nt, Human
ccugccaggaagccagcag

SEQ ID NO: 3313871 - RNA, 18 nt, Human
ccugccaggaagccagca

SEQ ID NO: 3313872 - RNA, 11 nt, Human
ccugccaggga

SEQ ID NO: 3313873 - RNA, 16 nt, Human
ccugccaggcauggug

SEQ ID NO: 3313874 - RNA, 23 nt, Human
ccugccaggaagccagcaggcuc

SEQ ID NO: 3313875 - RNA, 15 nt, Human
ccugccaggcauggu

SEQ ID NO: 3313876 - RNA, 17 nt, Human
ccugccaggaagccagc

SEQ ID NO: 3313877 - RNA, 15 nt, Human
ccugccaggaagcca

SEQ ID NO: 3313878 - RNA, 14 nt, Human
ccugccaggaagcc

SEQ ID NO: 3313879 - RNA, 13 nt, Human
ccugccaggaagc

SEQ ID NO: 3313880 - RNA, 22 nt, Human
ccuggcacccggccccugcugg

SEQ ID NO: 3313881 - RNA, 21 nt, Human
ccuggcacccggccccugcug

SEQ ID NO: 3313882 - RNA, 23 nt, Human
ccuggcacccggccccugcuggu

SEQ ID NO: 3313883 - RNA, 13 nt, Human
ccuggcagccccu

SEQ ID NO: 3313884 - RNA, 12 nt, Human
ccuggcagcccc

SEQ ID NO: 3313885 - RNA, 18 nt, Human
ccuggaauauauaaccag

SEQ ID NO: 3313886 - RNA, 15 nt, Human
ccuggccagaugcac

SEQ ID NO: 3313887 - RNA, 14 nt, Human
ccugcuucaaauau

SEQ ID NO: 3313888 - RNA, 21 nt, Human
ccugcucuccgaccagacacc

SEQ ID NO: 3313889 - RNA, 22 nt, Human
ccugcggugcuaucucccccag

SEQ ID NO: 3313890 - RNA, 22 nt, Human
ccugcucuccgaccagacaccu

SEQ ID NO: 3313891 - RNA, 17 nt, Human
ccugcggugcuaucucc

SEQ ID NO: 3313892 - RNA, 16 nt, Human
ccugcggugcuaucuc

SEQ ID NO: 3313893 - RNA, 22 nt, Human
ccugccccucaacucuccucca

SEQ ID NO: 3313894 - RNA, 23 nt, Human
ccugccuguugggccaggagccu

SEQ ID NO: 3313895 - RNA, 17 nt, Human
ccauguuggccaggcug

SEQ ID NO: 3313896 - RNA, 16 nt, Human
ccauguuggccaggcu

SEQ ID NO: 3313897 - RNA, 18 nt, Human
ccauucuccaccugccag

SEQ ID NO: 3313898 - RNA, 19 nt, Human
ccauauucuguuggccagu

SEQ ID NO: 3313899 - RNA, 22 nt, Human
cccaaauggaaaugggcagagc

SEQ ID NO: 3313900 - RNA, 18 nt, Human
cccaaauggaaaugggca

SEQ ID NO: 3313901 - RNA, 16 nt, Human
cccaaagugcugggau

SEQ ID NO: 3313902 - RNA, 13 nt, Human
cccaaagugcugg

SEQ ID NO: 3313903 - RNA, 15 nt, Human
cccaaagugcuggga

SEQ ID NO: 3313904 - RNA, 18 nt, Human
cccaaaacucuccucugc

SEQ ID NO: 3313905 - RNA, 16 nt, Human
cccaaaacucuccucu

SEQ ID NO: 3313906 - RNA, 16 nt, Human
cccaaagcagugcaug

SEQ ID NO: 3313907 - RNA, 20 nt, Human
ccauucuccaccugccaggg

SEQ ID NO: 3313908 - RNA, 19 nt, Human
ccauucuccaccugccagg

SEQ ID NO: 3313909 - RNA, 14 nt, Human
ccauuuguguuuau

SEQ ID NO: 3313910 - RNA, 16 nt, Human
ccaggagccccgaggc

SEQ ID NO: 3313911 - RNA, 19 nt, Human
ccaggagccccgaggccuu

SEQ ID NO: 3313912 - RNA, 19 nt, Human
ccaggagccuccugcccuu

SEQ ID NO: 3313913 - RNA, 20 nt, Human
ccaggagccccgaggccuuc

SEQ ID NO: 3313914 - RNA, 21 nt, Human
ccaggcauuccccaggaggcc

SEQ ID NO: 3313915 - RNA, 19 nt, Human
ccaggcauuccccaggagg

SEQ ID NO: 3313916 - RNA, 18 nt, Human
ccaggcauuccccaggag

SEQ ID NO: 3313917 - RNA, 17 nt, Human
ccaggcauuccccagga

SEQ ID NO: 3313918 - RNA, 24 nt, Human
ccaggcuguaucccaugagccuca

SEQ ID NO: 3313919 - RNA, 17 nt, Human
ccaggcuuagucacuga

SEQ ID NO: 3313920 - RNA, 23 nt, Human
ccaggcccucugcccacucccug

SEQ ID NO: 3313921 - RNA, 22 nt, Human
ccaggcccucugcccacucccu

SEQ ID NO: 3313922 - RNA, 21 nt, Human
ccaggcccucugcccacuccc

SEQ ID NO: 3313923 - RNA, 20 nt, Human
ccaggcccucugcccacucc

SEQ ID NO: 3313924 - RNA, 15 nt, Human
ccagguucagcuugu

SEQ ID NO: 3313925 - RNA, 17 nt, Human
ccagguuuuuggucuga

SEQ ID NO: 3313926 - RNA, 19 nt, Human
ccagucuggaaugcagugg

SEQ ID NO: 3313927 - RNA, 20 nt, Human
ccagucuggaaugcaguggu

SEQ ID NO: 3313928 - RNA, 13 nt, Human
ccagugaggcucu

SEQ ID NO: 3313929 - RNA, 18 nt, Human
ccagucuggaaugcagug

SEQ ID NO: 3313930 - RNA, 18 nt, Human
ccaggugcacaagcucca

SEQ ID NO: 3313931 - RNA, 20 nt, Human
ccaggugcacaagcuccaag

SEQ ID NO: 3313932 - RNA, 19 nt, Human
ccaggugcacaagcuccaa

SEQ ID NO: 3313933 - RNA, 21 nt, Human
ccagggacagaggggguggcc

SEQ ID NO: 3313934 - RNA, 15 nt, Human
ccagggacagagggg

SEQ ID NO: 3313935 - RNA, 14 nt, Human
ccagggacagaggg

SEQ ID NO: 3313936 - RNA, 20 nt, Human
ccaggcuuagucacugagac

SEQ ID NO: 3313937 - RNA, 23 nt, Human
ccauauucuguuggccaguguga

SEQ ID NO: 3313938 - RNA, 22 nt, Human
ccaguguuguggauuuaacaga

SEQ ID NO: 3313939 - RNA, 23 nt, Human
ccagugcccacaggaucagucug

SEQ ID NO: 3313940 - RNA, 16 nt, Human
ccagugaggcucugcc

SEQ ID NO: 3313941 - RNA, 15 nt, Human
ccagugaggcucugc

SEQ ID NO: 3313942 - RNA, 14 nt, Human
ccagugaggcucug

SEQ ID NO: 3313943 - RNA, 22 nt, Human
ccagugguuccuaauccucuag

SEQ ID NO: 3313944 - RNA, 20 nt, Human
ccagugccgagaaggaagcc

SEQ ID NO: 3313945 - RNA, 15 nt, Human
ccagccaaagccucc

SEQ ID NO: 3313946 - RNA, 19 nt, Human
ccagccaaagccuccucca

SEQ ID NO: 3313947 - RNA, 18 nt, Human
ccagccaaagccuccucc

SEQ ID NO: 3313948 - RNA, 13 nt, Human
ccagccccagugc

SEQ ID NO: 3313949 - RNA, 15 nt, Human
ccagccccagugccc

SEQ ID NO: 3313950 - RNA, 19 nt, Human
ccagccccaaaacucuccu

SEQ ID NO: 3313951 - RNA, 23 nt, Human
ccagccccaaaacucuccucugc

SEQ ID NO: 3313952 - RNA, 16 nt, Human
ccagccccagugccca

SEQ ID NO: 3313953 - RNA, 16 nt, Human
ccagcccuuagcaggg

SEQ ID NO: 3313954 - RNA, 17 nt, Human
ccagcccuuagcaggga

SEQ ID NO: 3313955 - RNA, 23 nt, Human
ccagccgagauagccaaggccaa

SEQ ID NO: 3313956 - RNA, 14 nt, Human
ccagccgccaugcu

SEQ ID NO: 3313957 - RNA, 18 nt, Human
ccagccgccaugcuccug

SEQ ID NO: 3313958 - RNA, 15 nt, Human
ccagcaagugagagc

SEQ ID NO: 3313959 - RNA, 14 nt, Human
ccagauuucacucu

SEQ ID NO: 3313960 - RNA, 20 nt, Human
ccagcaagugagagcugggu

SEQ ID NO: 3313961 - RNA, 21 nt, Human
ccagcaagugagagcugggug

SEQ ID NO: 3313962 - RNA, 22 nt, Human
ccagcaagugagagcugggugu

SEQ ID NO: 3313963 - RNA, 11 nt, Human
ccagagcugcc

SEQ ID NO: 3313964 - RNA, 13 nt, Human
ccagagcugccac

SEQ ID NO: 3313965 - RNA, 12 nt, Human
ccagagcugcca

SEQ ID NO: 3313966 - RNA, 19 nt, Human
ccagagcugccaccugccu

SEQ ID NO: 3313967 - RNA, 16 nt, Human
ccagagcugccaccug

SEQ ID NO: 3313968 - RNA, 15 nt, Human
ccagagcugccaccu

SEQ ID NO: 3313969 - RNA, 14 nt, Human
ccagagcugccacc

SEQ ID NO: 3313970 - RNA, 16 nt, Human
ccagagggagugacag

SEQ ID NO: 3313971 - RNA, 17 nt, Human
ccagagggagugacaga

SEQ ID NO: 3313972 - RNA, 18 nt, Human
ccagagggagugacagag

SEQ ID NO: 3313973 - RNA, 19 nt, Human
ccagagggagugacagagg

SEQ ID NO: 3313974 - RNA, 20 nt, Human
ccagagggagugacagaggc

SEQ ID NO: 3313975 - RNA, 21 nt, Human
ccagagggagugacagaggca

SEQ ID NO: 3313976 - RNA, 21 nt, Human
ccagaggagagaggacccccu

SEQ ID NO: 3313977 - RNA, 22 nt, Human
ccagaggagagaggacccccug

SEQ ID NO: 3313978 - RNA, 17 nt, Human
ccagacaccuugacagg

SEQ ID NO: 3313979 - RNA, 19 nt, Human
ccagacaccuugacagggc

SEQ ID NO: 3313980 - RNA, 21 nt, Human
ccagagaggguggugaccucu

SEQ ID NO: 3313981 - RNA, 23 nt, Human
ccagagaggguggugaccucugc

SEQ ID NO: 3313982 - RNA, 14 nt, Human
ccagagaggguggu

SEQ ID NO: 3313983 - RNA, 13 nt, Human
ccagagagggugg

SEQ ID NO: 3313984 - RNA, 18 nt, Human
ccagauucuuuccugagg

SEQ ID NO: 3313985 - RNA, 22 nt, Human
ccagauucuuuccugaggcugg

SEQ ID NO: 3313986 - RNA, 21 nt, Human
ccagauucuuuccugaggcug

SEQ ID NO: 3313987 - RNA, 20 nt, Human
ccagauucuuuccugaggcu

SEQ ID NO: 3313988 - RNA, 19 nt, Human
ccagauucuuuccugaggc

SEQ ID NO: 3313989 - RNA, 13 nt, Human
ccagagggccugc

SEQ ID NO: 3313990 - RNA, 22 nt, Human
ccagagggagugacagaggcag

SEQ ID NO: 3313991 - RNA, 23 nt, Human
ccagagggagugacagaggcagc

SEQ ID NO: 3313992 - RNA, 23 nt, Human
ccagaugcaccagcccuuagcag

SEQ ID NO: 3313993 - RNA, 16 nt, Human
ccagagggccugcaag

SEQ ID NO: 3313994 - RNA, 15 nt, Human
ccagagggccugcaa

SEQ ID NO: 3313995 - RNA, 19 nt, Human
ccagauugcaacaggcugg

SEQ ID NO: 3313996 - RNA, 20 nt, Human
ccagauugcaacaggcuggg

SEQ ID NO: 3313997 - RNA, 23 nt, Human
ccagauucuuuccugaggcuggg

SEQ ID NO: 3313998 - RNA, 18 nt, Human
ccagauugcaacaggcug

SEQ ID NO: 3313999 - RNA, 21 nt, Human
ccagauugcaacaggcugggc

SEQ ID NO: 3314000 - RNA, 12 nt, Human
ccagauuucacu

SEQ ID NO: 3314001 - RNA, 17 nt, Human
ccaccucccacaaagga

SEQ ID NO: 3314002 - RNA, 16 nt, Human
ccaccugccagggaca

SEQ ID NO: 3314003 - RNA, 20 nt, Human
ccaccugccuguugggccag

SEQ ID NO: 3314004 - RNA, 17 nt, Human
ccaccugccuguugggc

SEQ ID NO: 3314005 - RNA, 16 nt, Human
ccaccuggccucugca

SEQ ID NO: 3314006 - RNA, 15 nt, Human
ccaccuggccucugc

SEQ ID NO: 3314007 - RNA, 22 nt, Human
ccaccugcggugcuaucucccc

SEQ ID NO: 3314008 - RNA, 19 nt, Human
ccacgcuggagugcaguga

SEQ ID NO: 3314009 - RNA, 14 nt, Human
ccaccuggccucug

SEQ ID NO: 3314010 - RNA, 17 nt, Human
ccaccuggccucugcac

SEQ ID NO: 3314011 - RNA, 12 nt, Human
ccacggccaggc

SEQ ID NO: 3314012 - RNA, 13 nt, Human
ccacggccaggcc

SEQ ID NO: 3314013 - RNA, 14 nt, Human
ccacggccaggcca

SEQ ID NO: 3314014 - RNA, 15 nt, Human
ccacggccaggccag

SEQ ID NO: 3314015 - RNA, 12 nt, Human
ccacccaggagc

SEQ ID NO: 3314016 - RNA, 14 nt, Human
ccacccaggagccc

SEQ ID NO: 3314017 - RNA, 12 nt, Human
ccaccucagccu

SEQ ID NO: 3314018 - RNA, 17 nt, Human
ccacccugaaagcccug

SEQ ID NO: 3314019 - RNA, 16 nt, Human
ccacccugaaagcccu

SEQ ID NO: 3314020 - RNA, 13 nt, Human
ccaccucagccuc

SEQ ID NO: 3314021 - RNA, 14 nt, Human
ccaccucagccucc

SEQ ID NO: 3314022 - RNA, 15 nt, Human
ccaccucagccuccc

SEQ ID NO: 3314023 - RNA, 18 nt, Human
ccacucaguccauagcag

SEQ ID NO: 3314024 - RNA, 13 nt, Human
ccacucccugcaa

SEQ ID NO: 3314025 - RNA, 12 nt, Human
ccacucccugca

SEQ ID NO: 3314026 - RNA, 23 nt, Human
ccacuacggaauaguuggcuagg

SEQ ID NO: 3314027 - RNA, 22 nt, Human
ccacuacggaauaguuggcuag

SEQ ID NO: 3314028 - RNA, 18 nt, Human
ccacuacauucuguuaau

SEQ ID NO: 3314029 - RNA, 18 nt, Human
ccacugcacuccagccug

SEQ ID NO: 3314030 - RNA, 15 nt, Human
ccacucccugcaacc

SEQ ID NO: 3314031 - RNA, 19 nt, Human
ccacugcacuccagccugg

SEQ ID NO: 3314032 - RNA, 20 nt, Human
ccacugcacuccagccuggg

SEQ ID NO: 3314033 - RNA, 16 nt, Human
ccacugcgaccacaag

SEQ ID NO: 3314034 - RNA, 13 nt, Human
ccacguuucuaaa

SEQ ID NO: 3314035 - RNA, 13 nt, Human
ccacacccagccc

SEQ ID NO: 3314036 - RNA, 14 nt, Human
ccacacccagccca

SEQ ID NO: 3314037 - RNA, 12 nt, Human
ccacacccagcc

SEQ ID NO: 3314038 - RNA, 18 nt, Human
ccaccaacauacucccau

SEQ ID NO: 3314039 - RNA, 14 nt, Human
ccaccaacauacuc

SEQ ID NO: 3314040 - RNA, 16 nt, Human
ccacaucuugcucugc

SEQ ID NO: 3314041 - RNA, 20 nt, Human
ccacaucuugcucugcugac

SEQ ID NO: 3314042 - RNA, 22 nt, Human
ccacaucuugcucugcugacag

SEQ ID NO: 3314043 - RNA, 23 nt, Human
ccacaucuugcucugcugacaga

SEQ ID NO: 3314044 - RNA, 14 nt, Human
ccacaucuugcucu

SEQ ID NO: 3314045 - RNA, 16 nt, Human
ccacccaccucagccu

SEQ ID NO: 3314046 - RNA, 14 nt, Human
ccacccaccucagc

SEQ ID NO: 3314047 - RNA, 15 nt, Human
ccacccaccucagcc

SEQ ID NO: 3314048 - RNA, 13 nt, Human
ccacccaccucag

SEQ ID NO: 3314049 - RNA, 22 nt, Human
ccacccaagggccuggccugag

SEQ ID NO: 3314050 - RNA, 21 nt, Human
ccacccaagggccuggccuga

SEQ ID NO: 3314051 - RNA, 20 nt, Human
ccacccaagggccuggccug

SEQ ID NO: 3314052 - RNA, 16 nt, Human
ccacccaagggccugg

SEQ ID NO: 3314053 - RNA, 19 nt, Human
ccacccaagggccuggccu

SEQ ID NO: 3314054 - RNA, 17 nt, Human
ccacccaagggccuggc

SEQ ID NO: 3314055 - RNA, 14 nt, Human
ccaccacacccagc

SEQ ID NO: 3314056 - RNA, 16 nt, Human
ccaccacacccagccc

SEQ ID NO: 3314057 - RNA, 20 nt, Human
ccaccaacauacucccaucu

SEQ ID NO: 3314058 - RNA, 13 nt, Human
caugagcaucagg

SEQ ID NO: 3314059 - RNA, 12 nt, Human
caugagccucag

SEQ ID NO: 3314060 - RNA, 15 nt, Human
caugagccucagcau

SEQ ID NO: 3314061 - RNA, 17 nt, Human
caugagccucagcaucc

SEQ ID NO: 3314062 - RNA, 18 nt, Human
caugagccucagcauccu

SEQ ID NO: 3314063 - RNA, 19 nt, Human
caugagccucagcauccug

SEQ ID NO: 3314064 - RNA, 20 nt, Human
caugagccucagcauccugg

SEQ ID NO: 3314065 - RNA, 21 nt, Human
caugagccucagcauccuggc

SEQ ID NO: 3314066 - RNA, 23 nt, Human
caugagcaucaggccaggcccuc

SEQ ID NO: 3314067 - RNA, 22 nt, Human
caugagcaucaggccaggcccu

SEQ ID NO: 3314068 - RNA, 21 nt, Human
caugagcaucaggccaggccc

SEQ ID NO: 3314069 - RNA, 20 nt, Human
caugagcaucaggccaggcc

SEQ ID NO: 3314070 - RNA, 18 nt, Human
caugagcaucaggccagg

SEQ ID NO: 3314071 - RNA, 17 nt, Human
caugagcaucaggccag

SEQ ID NO: 3314072 - RNA, 16 nt, Human
caugagcaucaggcca

SEQ ID NO: 3314073 - RNA, 15 nt, Human
caugagcaucaggcc

SEQ ID NO: 3314074 - RNA, 13 nt, Human
caugaguccccug

SEQ ID NO: 3314075 - RNA, 23 nt, Human
caugaguccccuguuuguuucug

SEQ ID NO: 3314076 - RNA, 15 nt, Human
caugaguccccuguu

SEQ ID NO: 3314077 - RNA, 14 nt, Human
caugaguccccugu

SEQ ID NO: 3314078 - RNA, 23 nt, Human
caugaggaacaaggcaaggcugu

SEQ ID NO: 3314079 - RNA, 22 nt, Human
caugagccucagcauccuggca

SEQ ID NO: 3314080 - RNA, 23 nt, Human
caugagccucagcauccuggcac

SEQ ID NO: 3314081 - RNA, 21 nt, Human
caugaggaacaaggcaaggcu

SEQ ID NO: 3314082 - RNA, 20 nt, Human
caugaggaacaaggcaaggc

SEQ ID NO: 3314083 - RNA, 17 nt, Human
caugaggaacaaggcaa

SEQ ID NO: 3314084 - RNA, 16 nt, Human
caugaggaacaaggca

SEQ ID NO: 3314085 - RNA, 13 nt, Human
caugaaaacacau

SEQ ID NO: 3314086 - RNA, 17 nt, Human
caugaaaacacauuuuu

SEQ ID NO: 3314087 - RNA, 16 nt, Human
caugaaaacacauuuu

SEQ ID NO: 3314088 - RNA, 15 nt, Human
caugaaaacacauuu

SEQ ID NO: 3314089 - RNA, 14 nt, Human
caugaaaacacauu

SEQ ID NO: 3314090 - RNA, 21 nt, Human
caugaaaacacauuuuucuua

SEQ ID NO: 3314091 - RNA, 19 nt, Human
caugaaaacacauuuuucu

SEQ ID NO: 3314092 - RNA, 12 nt, Human
caugaagacaga

SEQ ID NO: 3314093 - RNA, 16 nt, Human
caucucuacaaaaagc

SEQ ID NO: 3314094 - RNA, 15 nt, Human
caucucuccuccuuu

SEQ ID NO: 3314095 - RNA, 21 nt, Human
caucuugaauuguaaggaaug

SEQ ID NO: 3314096 - RNA, 16 nt, Human
caucuugaauuguaag

SEQ ID NO: 3314097 - RNA, 15 nt, Human
caucuugcucugcug

SEQ ID NO: 3314098 - RNA, 16 nt, Human
caucuugcucugcuga

SEQ ID NO: 3314099 - RNA, 17 nt, Human
caucuugcucugcugac

SEQ ID NO: 3314100 - RNA, 14 nt, Human
caucaugucuggcu

SEQ ID NO: 3314101 - RNA, 15 nt, Human
caucaugucuggcua

SEQ ID NO: 3314102 - RNA, 13 nt, Human
caucaugucuggc

SEQ ID NO: 3314103 - RNA, 16 nt, Human
caucauccuaagcuau

SEQ ID NO: 3314104 - RNA, 12 nt, Human
caucacccgcua

SEQ ID NO: 3314105 - RNA, 20 nt, Human
caucaccaacgucugugcca

SEQ ID NO: 3314106 - RNA, 17 nt, Human
cauccagguucagcuug

SEQ ID NO: 3314107 - RNA, 14 nt, Human
cauccacugugcca

SEQ ID NO: 3314108 - RNA, 17 nt, Human
cauccacugugccaugu

SEQ ID NO: 3314109 - RNA, 23 nt, Human
cauccacugugccaugugccagg

SEQ ID NO: 3314110 - RNA, 22 nt, Human
caucccugaaggccccgcccag

SEQ ID NO: 3314111 - RNA, 22 nt, Human
cauauucuguuggccaguguga

SEQ ID NO: 3314112 - RNA, 18 nt, Human
cauauucuguuggccagu

SEQ ID NO: 3314113 - RNA, 17 nt, Human
cauauugauuuccguua

SEQ ID NO: 3314114 - RNA, 21 nt, Human
cauauugauuuccguuaaaau

SEQ ID NO: 3314115 - RNA, 16 nt, Human
cauaguaugguggcug

SEQ ID NO: 3314116 - RNA, 15 nt, Human
cauaguaugguggcu

SEQ ID NO: 3314117 - RNA, 23 nt, Human
cauauaagauucauauuuacuuc

SEQ ID NO: 3314118 - RNA, 23 nt, Human
cauauauauguuuuaagaggcag

SEQ ID NO: 3314119 - RNA, 14 nt, Human
caucaacaucuugg

SEQ ID NO: 3314120 - RNA, 18 nt, Human
caugggccuccugugugu

SEQ ID NO: 3314121 - RNA, 18 nt, Human
cauggacaugaucuucuu

SEQ ID NO: 3314122 - RNA, 15 nt, Human
cauggacuuccacug

SEQ ID NO: 3314123 - RNA, 15 nt, Human
caugcugucccuuac

SEQ ID NO: 3314124 - RNA, 13 nt, Human
caugcugucccuu

SEQ ID NO: 3314125 - RNA, 12 nt, Human
caugucuggcua

SEQ ID NO: 3314126 - RNA, 15 nt, Human
caugugaugagagga

SEQ ID NO: 3314127 - RNA, 17 nt, Human
caugugaugagaggaaa

SEQ ID NO: 3314128 - RNA, 16 nt, Human
caugugaugagaggaa

SEQ ID NO: 3314129 - RNA, 20 nt, Human
caugugaugagaggaaauca

SEQ ID NO: 3314130 - RNA, 18 nt, Human
caugugaugagaggaaau

SEQ ID NO: 3314131 - RNA, 21 nt, Human
caugugaugagaggaaaucac

SEQ ID NO: 3314132 - RNA, 22 nt, Human
caugugccagguuuuuggucug

SEQ ID NO: 3314133 - RNA, 14 nt, Human
caugugcacaugca

SEQ ID NO: 3314134 - RNA, 23 nt, Human
cauggucggaaaacaugcuacac

SEQ ID NO: 3314135 - RNA, 19 nt, Human
cauggucggaaaacaugcu

SEQ ID NO: 3314136 - RNA, 17 nt, Human
cauggucggaaaacaug

SEQ ID NO: 3314137 - RNA, 18 nt, Human
cauguuuuucuucucccu

SEQ ID NO: 3314138 - RNA, 19 nt, Human
cauguuuuucuucucccuc

SEQ ID NO: 3314139 - RNA, 20 nt, Human
cauguuuuucuucucccuca

SEQ ID NO: 3314140 - RNA, 23 nt, Human
cauguuugauguaucugagcagg

SEQ ID NO: 3314141 - RNA, 14 nt, Human
cauguuugugauug

SEQ ID NO: 3314142 - RNA, 12 nt, Human
cauguuugugau

SEQ ID NO: 3314143 - RNA, 13 nt, Human
cauuccccaggag

SEQ ID NO: 3314144 - RNA, 17 nt, Human
cauuccccaggaggcca

SEQ ID NO: 3314145 - RNA, 15 nt, Human
cauuccccaggaggc

SEQ ID NO: 3314146 - RNA, 20 nt, Human
cauuccccaggaggccagcc

SEQ ID NO: 3314147 - RNA, 19 nt, Human
cauuccccaggaggccagc

SEQ ID NO: 3314148 - RNA, 18 nt, Human
cauuccccaggaggccag

SEQ ID NO: 3314149 - RNA, 23 nt, Human
cauucuucuguacgucugacagg

SEQ ID NO: 3314150 - RNA, 17 nt, Human
cauucuguuaaucauua

SEQ ID NO: 3314151 - RNA, 12 nt, Human
cauucugccugc

SEQ ID NO: 3314152 - RNA, 13 nt, Human
cauucugccugcc

SEQ ID NO: 3314153 - RNA, 15 nt, Human
cauucugccugccca

SEQ ID NO: 3314154 - RNA, 16 nt, Human
cauucugccugcccag

SEQ ID NO: 3314155 - RNA, 17 nt, Human
cauucugccugcccagg

SEQ ID NO: 3314156 - RNA, 18 nt, Human
cauucugccugcccaggc

SEQ ID NO: 3314157 - RNA, 19 nt, Human
cauucugccugcccaggcc

SEQ ID NO: 3314158 - RNA, 20 nt, Human
cauucugccugcccaggccc

SEQ ID NO: 3314159 - RNA, 23 nt, Human
cauuccugaugcuucuucagaga

SEQ ID NO: 3314160 - RNA, 22 nt, Human
cauuccugaugcuucuucagag

SEQ ID NO: 3314161 - RNA, 19 nt, Human
cauuccugaugcuucuuca

SEQ ID NO: 3314162 - RNA, 16 nt, Human
cauuccugaugcuucu

SEQ ID NO: 3314163 - RNA, 14 nt, Human
cauuccugaugcuu

SEQ ID NO: 3314164 - RNA, 13 nt, Human
cauugugggaagg

SEQ ID NO: 3314165 - RNA, 15 nt, Human
cauugugggaagggg

SEQ ID NO: 3314166 - RNA, 15 nt, Human
cauuuaaaaaaaauc

SEQ ID NO: 3314167 - RNA, 18 nt, Human
cauugaccugaggcccuu

SEQ ID NO: 3314168 - RNA, 14 nt, Human
cauugaccugaggc

SEQ ID NO: 3314169 - RNA, 17 nt, Human
cauugaccugaggcccu

SEQ ID NO: 3314170 - RNA, 15 nt, Human
cauugaccugaggcc

SEQ ID NO: 3314171 - RNA, 19 nt, Human
cauuugaaaauuuugaugu

SEQ ID NO: 3314172 - RNA, 17 nt, Human
cauuugaaaauuuugau

SEQ ID NO: 3314173 - RNA, 22 nt, Human
cauuugaggucuguucuuucca

SEQ ID NO: 3314174 - RNA, 13 nt, Human
cauuugcugaaua

SEQ ID NO: 3314175 - RNA, 22 nt, Human
cauuuuauuuuauuaugcauga

SEQ ID NO: 3314176 - RNA, 23 nt, Human
cauuuuauuuuauuaugcaugaa

SEQ ID NO: 3314177 - RNA, 21 nt, Human
cauuuuuaagugcugcauuua

SEQ ID NO: 3314178 - RNA, 17 nt, Human
cauuuuuaguagagaca

SEQ ID NO: 3314179 - RNA, 18 nt, Human
uuuuauuuuuagacagag

SEQ ID NO: 3314180 - RNA, 17 nt, Human
uuuucaaaauaaaaaug

SEQ ID NO: 3314181 - RNA, 19 nt, Human
uuuuaucgucacugcuuaa

SEQ ID NO: 3314182 - RNA, 21 nt, Human
uuuuauacauaaacaagacca

SEQ ID NO: 3314183 - RNA, 13 nt, Human
uuuuauacauaaa

SEQ ID NO: 3314184 - RNA, 15 nt, Human
uuuuacuaauagaca

SEQ ID NO: 3314185 - RNA, 22 nt, Human
uuuucccuauuagagaagagau

SEQ ID NO: 3314186 - RNA, 18 nt, Human
uuuucccuauuagagaag

SEQ ID NO: 3314187 - RNA, 22 nt, Human
uuuucuacucgaguuacagaca

SEQ ID NO: 3314188 - RNA, 20 nt, Human
uuuucuacucgaguuacaga

SEQ ID NO: 3314189 - RNA, 13 nt, Human
uuuucuacucgag

SEQ ID NO: 3314190 - RNA, 13 nt, Human
uuuucuucucccu

SEQ ID NO: 3314191 - RNA, 22 nt, Human
uuuucuuguguguuuauuguca

SEQ ID NO: 3314192 - RNA, 15 nt, Human
uuuguauucucuccu

SEQ ID NO: 3314193 - RNA, 15 nt, Human
uuuguugucagcuga

SEQ ID NO: 3314194 - RNA, 22 nt, Human
uuuguuaguaugaggcauuugu

SEQ ID NO: 3314195 - RNA, 13 nt, Human
uuugagugccuua

SEQ ID NO: 3314196 - RNA, 17 nt, Human
uuuccguuaaaauacca

SEQ ID NO: 3314197 - RNA, 15 nt, Human
uuuccguuaaaauac

SEQ ID NO: 3314198 - RNA, 21 nt, Human
uuugagugccuuacacaaugg

SEQ ID NO: 3314199 - RNA, 12 nt, Human
uuuggaaaauaa

SEQ ID NO: 3314200 - RNA, 11 nt, Human
uuuuuaaaugc

SEQ ID NO: 3314201 - RNA, 12 nt, Human
uuuuuaagaaaa

SEQ ID NO: 3314202 - RNA, 17 nt, Human
uuuuuaagugcugcauu

SEQ ID NO: 3314203 - RNA, 16 nt, Human
uuuuuaagugcugcau

SEQ ID NO: 3314204 - RNA, 23 nt, Human
uuuuuaagugcugcauuuaaaag

SEQ ID NO: 3314205 - RNA, 22 nt, Human
uuuuuaagugcugcauuuaaaa

SEQ ID NO: 3314206 - RNA, 19 nt, Human
uuuuuaagugcugcauuua

SEQ ID NO: 3314207 - RNA, 18 nt, Human
uuuuuaagugcugcauuu

SEQ ID NO: 3314208 - RNA, 11 nt, Human
uuuuuuuacua

SEQ ID NO: 3314209 - RNA, 12 nt, Human
uuuuuuuuaaga

SEQ ID NO: 3314210 - RNA, 13 nt, Human
uuuuuuuugacaa

SEQ ID NO: 3314211 - RNA, 21 nt, Human
uugaccucaggugauccaccc

SEQ ID NO: 3314212 - RNA, 15 nt, Human
uugaccucugcagca

SEQ ID NO: 3314213 - RNA, 14 nt, Human
uugaccucugcagc

SEQ ID NO: 3314214 - RNA, 15 nt, Human
uugacgccaucccag

SEQ ID NO: 3314215 - RNA, 19 nt, Human
uugacgccaucccagcccc

SEQ ID NO: 3314216 - RNA, 18 nt, Human
uugacgccaucccagccc

SEQ ID NO: 3314217 - RNA, 17 nt, Human
uugacgccaucccagcc

SEQ ID NO: 3314218 - RNA, 18 nt, Human
uugaacuggguacuugug

SEQ ID NO: 3314219 - RNA, 14 nt, Human
uugaauuguaagga

SEQ ID NO: 3314220 - RNA, 23 nt, Human
uugauagcacagacccugcccug

SEQ ID NO: 3314221 - RNA, 13 nt, Human
uugaggguugggc

SEQ ID NO: 3314222 - RNA, 16 nt, Human
uugaggguugggcugg

SEQ ID NO: 3314223 - RNA, 11 nt, Human
uugagccuggg

SEQ ID NO: 3314224 - RNA, 16 nt, Human
uugaugaucuuugcag

SEQ ID NO: 3314225 - RNA, 21 nt, Human
uugcaaaguaucccuacugua

SEQ ID NO: 3314226 - RNA, 15 nt, Human
uugaacuccuggccu

SEQ ID NO: 3314227 - RNA, 16 nt, Human
uugaacuccuggccuc

SEQ ID NO: 3314228 - RNA, 20 nt, Human
uugaaaaaccauuuugcugu

SEQ ID NO: 3314229 - RNA, 21 nt, Human
uucuuuccaaaguacacuguu

SEQ ID NO: 3314230 - RNA, 23 nt, Human
uugaaaacacuguucucugcccu

SEQ ID NO: 3314231 - RNA, 22 nt, Human
uugaaaacacuguucucugccc

SEQ ID NO: 3314232 - RNA, 21 nt, Human
uucuuauacauuugauaaagu

SEQ ID NO: 3314233 - RNA, 21 nt, Human
uucuuccacaagagcccaggc

SEQ ID NO: 3314234 - RNA, 12 nt, Human
uucuuucagcca

SEQ ID NO: 3314235 - RNA, 14 nt, Human
uucuuuccaaagua

SEQ ID NO: 3314236 - RNA, 21 nt, Human
uucuuguguguuuauugucaa

SEQ ID NO: 3314237 - RNA, 13 nt, Human
uucuuccucccuc

SEQ ID NO: 3314238 - RNA, 14 nt, Human
uucuuguguguuua

SEQ ID NO: 3314239 - RNA, 19 nt, Human
uucugcuucagccucccga

SEQ ID NO: 3314240 - RNA, 15 nt, Human
uucugcuucagccuc

SEQ ID NO: 3314241 - RNA, 16 nt, Human
uucugcuucagccucc

SEQ ID NO: 3314242 - RNA, 14 nt, Human
uucugcuucagccu

SEQ ID NO: 3314243 - RNA, 19 nt, Human
uucuguccuacucuguguc

SEQ ID NO: 3314244 - RNA, 18 nt, Human
uucuguauuuuguuuuug

SEQ ID NO: 3314245 - RNA, 20 nt, Human
uuccugaggcugggcucccu

SEQ ID NO: 3314246 - RNA, 15 nt, Human
uuccugaggcugggc

SEQ ID NO: 3314247 - RNA, 23 nt, Human
uuccugaugcuucuucagagacu

SEQ ID NO: 3314248 - RNA, 18 nt, Human
uuccugaagaauugaaaa

SEQ ID NO: 3314249 - RNA, 12 nt, Human
uuccauggccuc

SEQ ID NO: 3314250 - RNA, 16 nt, Human
uuccauggccucuuca

SEQ ID NO: 3314251 - RNA, 21 nt, Human
uuccuugaguugauucagcuc

SEQ ID NO: 3314252 - RNA, 20 nt, Human
uuccuugaguugauucagcu

SEQ ID NO: 3314253 - RNA, 12 nt, Human
uucuacccagcg

SEQ ID NO: 3314254 - RNA, 19 nt, Human
uucuacccagcgagcccug

SEQ ID NO: 3314255 - RNA, 13 nt, Human
uucuacgccaggg

SEQ ID NO: 3314256 - RNA, 20 nt, Human
uucuacccagcgagcccugg

SEQ ID NO: 3314257 - RNA, 21 nt, Human
uucuacccagcgagcccuggu

SEQ ID NO: 3314258 - RNA, 14 nt, Human
uucuacccaggugc

SEQ ID NO: 3314259 - RNA, 22 nt, Human
uucuacucgaguuacagacaaa

SEQ ID NO: 3314260 - RNA, 18 nt, Human
uucugacccugcuucaaa

SEQ ID NO: 3314261 - RNA, 22 nt, Human
uucugacccaugcugcccugug

SEQ ID NO: 3314262 - RNA, 23 nt, Human
uucugacccaugcugcccuguga

SEQ ID NO: 3314263 - RNA, 16 nt, Human
uucucugcccuccaag

SEQ ID NO: 3314264 - RNA, 19 nt, Human
uucugauccuaguuccacc

SEQ ID NO: 3314265 - RNA, 19 nt, Human
uucugcucacauaucuguc

SEQ ID NO: 3314266 - RNA, 19 nt, Human
uucucuccuguaccucuug

SEQ ID NO: 3314267 - RNA, 14 nt, Human
uucucugaggacac

SEQ ID NO: 3314268 - RNA, 12 nt, Human
uucucugcccuc

SEQ ID NO: 3314269 - RNA, 11 nt, Human
uucucugcccu

SEQ ID NO: 3314270 - RNA, 14 nt, Human
uucucuccagcccc

SEQ ID NO: 3314271 - RNA, 13 nt, Human
uucucuccagccc

SEQ ID NO: 3314272 - RNA, 15 nt, Human
uucucuccagccccu

SEQ ID NO: 3314273 - RNA, 18 nt, Human
uucucuccuguaccucuu

SEQ ID NO: 3314274 - RNA, 14 nt, Human
uucucuccuguacc

SEQ ID NO: 3314275 - RNA, 16 nt, Human
uucuccacccugcucu

SEQ ID NO: 3314276 - RNA, 20 nt, Human
uucuccaccugccagggaca

SEQ ID NO: 3314277 - RNA, 18 nt, Human
uucuccaccugccaggga

SEQ ID NO: 3314278 - RNA, 16 nt, Human
uucuccaccugccagg

SEQ ID NO: 3314279 - RNA, 15 nt, Human
uucuccaccugccag

SEQ ID NO: 3314280 - RNA, 14 nt, Human
uucuccaccugcca

SEQ ID NO: 3314281 - RNA, 12 nt, Human
uucuccaccugc

SEQ ID NO: 3314282 - RNA, 21 nt, Human
uucuccaccucccacaaagga

SEQ ID NO: 3314283 - RNA, 16 nt, Human
uuauggcuuuugugca

SEQ ID NO: 3314284 - RNA, 17 nt, Human
uuauggcuuuugugcau

SEQ ID NO: 3314285 - RNA, 17 nt, Human
uuauggaacacucugag

SEQ ID NO: 3314286 - RNA, 16 nt, Human
uuauggaacacucuga

SEQ ID NO: 3314287 - RNA, 21 nt, Human
uuauggacaaugacccagugg

SEQ ID NO: 3314288 - RNA, 20 nt, Human
uuauggaacacucugagacu

SEQ ID NO: 3314289 - RNA, 18 nt, Human
uuauggaacacucugaga

SEQ ID NO: 3314290 - RNA, 21 nt, Human
uuauuaaaugcccagccccuu

SEQ ID NO: 3314291 - RNA, 19 nt, Human
uuauuaaaugcccagcccc

SEQ ID NO: 3314292 - RNA, 11 nt, Human
uuauacauaaa

SEQ ID NO: 3314293 - RNA, 15 nt, Human
uuauaaugaaugaaa

SEQ ID NO: 3314294 - RNA, 18 nt, Human
uuauaauaauguuaacau

SEQ ID NO: 3314295 - RNA, 15 nt, Human
uuauaauaauguuaa

SEQ ID NO: 3314296 - RNA, 17 nt, Human
ugugaaaagaaaaauga

SEQ ID NO: 3314297 - RNA, 15 nt, Human
ugugaaaagaaaaau

SEQ ID NO: 3314298 - RNA, 13 nt, Human
ugugaaaagaaaa

SEQ ID NO: 3314299 - RNA, 18 nt, Human
uuauuuuauuaugcauga

SEQ ID NO: 3314300 - RNA, 21 nt, Human
uucaacagguuuuccugaaga

SEQ ID NO: 3314301 - RNA, 18 nt, Human
uucaaaugcuguaacuuu

SEQ ID NO: 3314302 - RNA, 22 nt, Human
uuauuuuggaaaauaaauuauu

SEQ ID NO: 3314303 - RNA, 17 nt, Human
uucagacagcugccugg

SEQ ID NO: 3314304 - RNA, 16 nt, Human
uucagacagcugccug

SEQ ID NO: 3314305 - RNA, 15 nt, Human
uucagacagcugccu

SEQ ID NO: 3314306 - RNA, 14 nt, Human
uucagacagcugcc

SEQ ID NO: 3314307 - RNA, 17 nt, Human
uucacggaagagccuug

SEQ ID NO: 3314308 - RNA, 22 nt, Human
uucaccuuuguccccaccgcag

SEQ ID NO: 3314309 - RNA, 13 nt, Human
uucacggaagagc

SEQ ID NO: 3314310 - RNA, 13 nt, Human
uucacccuuuucu

SEQ ID NO: 3314311 - RNA, 14 nt, Human
uucaccuuuguccc

SEQ ID NO: 3314312 - RNA, 20 nt, Human
uucaccuuuguccccaccgc

SEQ ID NO: 3314313 - RNA, 19 nt, Human
uucaccuuuguccccaccg

SEQ ID NO: 3314314 - RNA, 21 nt, Human
uucaauaggaaaaacugauuu

SEQ ID NO: 3314315 - RNA, 22 nt, Human
uucaauaggaaaaacugauuuu

SEQ ID NO: 3314316 - RNA, 20 nt, Human
uucaauaggaaaaacugauu

SEQ ID NO: 3314317 - RNA, 13 nt, Human
uuccaaaguacac

SEQ ID NO: 3314318 - RNA, 16 nt, Human
uuccaaaguacacugu

SEQ ID NO: 3314319 - RNA, 19 nt, Human
uuccaacccucaucaccaa

SEQ ID NO: 3314320 - RNA, 15 nt, Human
uuccauggacuuugu

SEQ ID NO: 3314321 - RNA, 14 nt, Human
uuccauggacuuug

SEQ ID NO: 3314322 - RNA, 15 nt, Human
uucauaaccuagccu

SEQ ID NO: 3314323 - RNA, 19 nt, Human
uucauccuccucagaucuu

SEQ ID NO: 3314324 - RNA, 15 nt, Human
uucauccuccucaga

SEQ ID NO: 3314325 - RNA, 13 nt, Human
uucaguguacaug

SEQ ID NO: 3314326 - RNA, 12 nt, Human
uucaguguacau

SEQ ID NO: 3314327 - RNA, 17 nt, Human
uucaguggcagcugcuu

SEQ ID NO: 3314328 - RNA, 15 nt, Human
uucaguggcagcugc

SEQ ID NO: 3314329 - RNA, 16 nt, Human
uucaguggcagcugcu

SEQ ID NO: 3314330 - RNA, 21 nt, Human
uucagcugguugagguuucaa

SEQ ID NO: 3314331 - RNA, 12 nt, Human
uucagcuccagc

SEQ ID NO: 3314332 - RNA, 15 nt, Human
uucagcuccagcuca

SEQ ID NO: 3314333 - RNA, 14 nt, Human
uucaguggcagcug

SEQ ID NO: 3314334 - RNA, 13 nt, Human
uucaguggcagcu

SEQ ID NO: 3314335 - RNA, 17 nt, Human
uugugcauuaucuagau

SEQ ID NO: 3314336 - RNA, 12 nt, Human
uugugcauuugg

SEQ ID NO: 3314337 - RNA, 23 nt, Human
uugugcauuaucuagauacugua

SEQ ID NO: 3314338 - RNA, 22 nt, Human
uugugcauuaucuagauacugu

SEQ ID NO: 3314339 - RNA, 21 nt, Human
uuguguuuauauauaagccaa

SEQ ID NO: 3314340 - RNA, 13 nt, Human
uuguguucaccuu

SEQ ID NO: 3314341 - RNA, 23 nt, Human
uuguggauuuaacagaaauguac

SEQ ID NO: 3314342 - RNA, 22 nt, Human
uuguggauuuaacagaaaugua

SEQ ID NO: 3314343 - RNA, 17 nt, Human
uuguggacacagcucuu

SEQ ID NO: 3314344 - RNA, 16 nt, Human
uuguggacacagcucu

SEQ ID NO: 3314345 - RNA, 21 nt, Human
uuguggauuuaacagaaaugu

SEQ ID NO: 3314346 - RNA, 20 nt, Human
uuguggauuuaacagaaaug

SEQ ID NO: 3314347 - RNA, 14 nt, Human
uuguuacauuuuua

SEQ ID NO: 3314348 - RNA, 21 nt, Human
uuguuaguaugaggcauuugu

SEQ ID NO: 3314349 - RNA, 19 nt, Human
uuguuaguaugaggcauuu

SEQ ID NO: 3314350 - RNA, 20 nt, Human
uuguuagugugucuuagugu

SEQ ID NO: 3314351 - RNA, 22 nt, Human
uuguuaguaugaggcauuuguu

SEQ ID NO: 3314352 - RNA, 13 nt, Human
uuggucuguguga

SEQ ID NO: 3314353 - RNA, 22 nt, Human
uuggguucaagcgauucuucug

SEQ ID NO: 3314354 - RNA, 17 nt, Human
uuguaaauagcucaggu

SEQ ID NO: 3314355 - RNA, 14 nt, Human
uuguacauaaugcg

SEQ ID NO: 3314356 - RNA, 18 nt, Human
uuguacauaaugcgugca

SEQ ID NO: 3314357 - RNA, 23 nt, Human
uuguaaauuaacuuuuauaaacu

SEQ ID NO: 3314358 - RNA, 18 nt, Human
uuguaaauuaacuuuuau

SEQ ID NO: 3314359 - RNA, 16 nt, Human
uuguaaauuaacuuuu

SEQ ID NO: 3314360 - RNA, 15 nt, Human
uuguaaauuaacuuu

SEQ ID NO: 3314361 - RNA, 19 nt, Human
uuguauucucuccuguacc

SEQ ID NO: 3314362 - RNA, 16 nt, Human
uuguauucucuccugu

SEQ ID NO: 3314363 - RNA, 15 nt, Human
uuguauucucuccug

SEQ ID NO: 3314364 - RNA, 20 nt, Human
uugugaaaggaaagaggcuc

SEQ ID NO: 3314365 - RNA, 12 nt, Human
uugugauuuuug

SEQ ID NO: 3314366 - RNA, 17 nt, Human
uugugauuuuuguaauu

SEQ ID NO: 3314367 - RNA, 16 nt, Human
uugugauuuuuguaau

SEQ ID NO: 3314368 - RNA, 15 nt, Human
uugucuuaaaaagug

SEQ ID NO: 3314369 - RNA, 14 nt, Human
uuucauuuagguga

SEQ ID NO: 3314370 - RNA, 18 nt, Human
uuucauuuaggugaggaa

SEQ ID NO: 3314371 - RNA, 13 nt, Human
uuucaguguacau

SEQ ID NO: 3314372 - RNA, 14 nt, Human
uuucaguguacaug

SEQ ID NO: 3314373 - RNA, 14 nt, Human
uuucaauaggaaaa

SEQ ID NO: 3314374 - RNA, 12 nt, Human
uuucaauaggaa

SEQ ID NO: 3314375 - RNA, 17 nt, Human
uuucaauaggaaaaacu

SEQ ID NO: 3314376 - RNA, 16 nt, Human
uuuauggcuuuugugc

SEQ ID NO: 3314377 - RNA, 14 nt, Human
uuuauggcuuuugu

SEQ ID NO: 3314378 - RNA, 13 nt, Human
uuuauuauggcac

SEQ ID NO: 3314379 - RNA, 13 nt, Human
uuuauuaugcaug

SEQ ID NO: 3314380 - RNA, 18 nt, Human
uuuaacagaaauguacag

SEQ ID NO: 3314381 - RNA, 19 nt, Human
uuuaagugcugcauuuaaa

SEQ ID NO: 3314382 - RNA, 22 nt, Human
uuuaagaaaaaggaugcacaga

SEQ ID NO: 3314383 - RNA, 18 nt, Human
uuuaagaaaaaggaugca

SEQ ID NO: 3314384 - RNA, 15 nt, Human
uuuacuucuuauaca

SEQ ID NO: 3314385 - RNA, 19 nt, Human
uuuacuucuuauacauuug

SEQ ID NO: 3314386 - RNA, 22 nt, Human
uuuacuucuuauacauuugaua

SEQ ID NO: 3314387 - RNA, 14 nt, Human
uuuagaaauauaau

SEQ ID NO: 3314388 - RNA, 12 nt, Human
uuuagacagagu

SEQ ID NO: 3314389 - RNA, 18 nt, Human
ugggaugauuggaggggg

SEQ ID NO: 3314390 - RNA, 16 nt, Human
ugggaggaucucuuga

SEQ ID NO: 3314391 - RNA, 15 nt, Human
ugggacacccuguga

SEQ ID NO: 3314392 - RNA, 14 nt, Human
ugggacacccugug

SEQ ID NO: 3314393 - RNA, 13 nt, Human
ugggacacccugu

SEQ ID NO: 3314394 - RNA, 16 nt, Human
ugggaaugaaugucag

SEQ ID NO: 3314395 - RNA, 14 nt, Human
ugggcagagcagag

SEQ ID NO: 3314396 - RNA, 17 nt, Human
ugggcagagcagagacc

SEQ ID NO: 3314397 - RNA, 15 nt, Human
ugggcagagcagaga

SEQ ID NO: 3314398 - RNA, 13 nt, Human
ugggcagagcaga

SEQ ID NO: 3314399 - RNA, 22 nt, Human
ugggccuccugugugugcgccu

SEQ ID NO: 3314400 - RNA, 22 nt, Human
ugggcuucaguggcagcugcuu

SEQ ID NO: 3314401 - RNA, 21 nt, Human
ugggcuucaguggcagcugcu

SEQ ID NO: 3314402 - RNA, 15 nt, Human
ugggcuucauccucc

SEQ ID NO: 3314403 - RNA, 22 nt, Human
ugggcuuggggaccagagcugc

SEQ ID NO: 3314404 - RNA, 23 nt, Human
ugggcuuggggaccagagcugcc

SEQ ID NO: 3314405 - RNA, 17 nt, Human
ugggcuugucuguagau

SEQ ID NO: 3314406 - RNA, 19 nt, Human
ugggggcugggcagaggaa

SEQ ID NO: 3314407 - RNA, 19 nt, Human
uggggggcugaggugggag

SEQ ID NO: 3314408 - RNA, 16 nt, Human
ugggggccucagugcc

SEQ ID NO: 3314409 - RNA, 16 nt, Human
uggcugcugaaggcuc

SEQ ID NO: 3314410 - RNA, 14 nt, Human
uggcugcugaaggc

SEQ ID NO: 3314411 - RNA, 13 nt, Human
uggcugcugaagg

SEQ ID NO: 3314412 - RNA, 11 nt, Human
uggcugcugaa

SEQ ID NO: 3314413 - RNA, 20 nt, Human
uggccuagcauacguacaca

SEQ ID NO: 3314414 - RNA, 22 nt, Human
uggccccucagggucccuggug

SEQ ID NO: 3314415 - RNA, 21 nt, Human
uggccccucagggucccuggu

SEQ ID NO: 3314416 - RNA, 17 nt, Human
uggcagcugcgguccac

SEQ ID NO: 3314417 - RNA, 20 nt, Human
uggccccucagggucccugg

SEQ ID NO: 3314418 - RNA, 13 nt, Human
uggccccucaggg

SEQ ID NO: 3314419 - RNA, 22 nt, Human
uggccucccaacucaccccagc

SEQ ID NO: 3314420 - RNA, 21 nt, Human
uggccucccaacucaccccag

SEQ ID NO: 3314421 - RNA, 20 nt, Human
uggccucccaacucacccca

SEQ ID NO: 3314422 - RNA, 19 nt, Human
uggccucccaacucacccc

SEQ ID NO: 3314423 - RNA, 14 nt, Human
uggccucccaacuc

SEQ ID NO: 3314424 - RNA, 11 nt, Human
uggccucccaa

SEQ ID NO: 3314425 - RNA, 18 nt, Human
uggccucaagugauucuc

SEQ ID NO: 3314426 - RNA, 23 nt, Human
uggccucaagugauucuccugcc

SEQ ID NO: 3314427 - RNA, 23 nt, Human
uggccuagcauacguacacauuu

SEQ ID NO: 3314428 - RNA, 23 nt, Human
uggacguguuaugacuccagaau

SEQ ID NO: 3314429 - RNA, 19 nt, Human
uggacguguuaugacucca

SEQ ID NO: 3314430 - RNA, 19 nt, Human
uggacuaacuugucuuugg

SEQ ID NO: 3314431 - RNA, 18 nt, Human
uggacaggcauguucucu

SEQ ID NO: 3314432 - RNA, 22 nt, Human
uggacaggcauguucucugagg

SEQ ID NO: 3314433 - RNA, 17 nt, Human
uggacaggcauguucuc

SEQ ID NO: 3314434 - RNA, 21 nt, Human
uggcacuauaauguaagcucu

SEQ ID NO: 3314435 - RNA, 15 nt, Human
uggauuuaacagaaa

SEQ ID NO: 3314436 - RNA, 22 nt, Human
uggcacuauaauguaagcucua

SEQ ID NO: 3314437 - RNA, 19 nt, Human
uggcacugcuuccagugag

SEQ ID NO: 3314438 - RNA, 22 nt, Human
uggcacugcuuccagugaggcu

SEQ ID NO: 3314439 - RNA, 18 nt, Human
uggcagcucagagagggu

SEQ ID NO: 3314440 - RNA, 23 nt, Human
uggaggggggaggugggauccuc

SEQ ID NO: 3314441 - RNA, 21 nt, Human
uggauuguccccgacccuugc

SEQ ID NO: 3314442 - RNA, 22 nt, Human
uggaugcagccucacaguccuu

SEQ ID NO: 3314443 - RNA, 21 nt, Human
uggaugcagccucacaguccu

SEQ ID NO: 3314444 - RNA, 13 nt, Human
uggaugcagccuc

SEQ ID NO: 3314445 - RNA, 18 nt, Human
ugcuugugaaaggaaaga

SEQ ID NO: 3314446 - RNA, 13 nt, Human
ugcuucuucagag

SEQ ID NO: 3314447 - RNA, 17 nt, Human
uggaacacucugagacu

SEQ ID NO: 3314448 - RNA, 15 nt, Human
uggaacacucugaga

SEQ ID NO: 3314449 - RNA, 14 nt, Human
uggaacacucugag

SEQ ID NO: 3314450 - RNA, 12 nt, Human
ugcuucucacug

SEQ ID NO: 3314451 - RNA, 21 nt, Human
ugcuuccagugaggcucugcc

SEQ ID NO: 3314452 - RNA, 23 nt, Human
ugcuuccagugaggcucugcccu

SEQ ID NO: 3314453 - RNA, 22 nt, Human
ugcuuccagugaggcucugccc

SEQ ID NO: 3314454 - RNA, 19 nt, Human
ugcuuaacuucacauauug

SEQ ID NO: 3314455 - RNA, 18 nt, Human
ugcuuaacuucacauauu

SEQ ID NO: 3314456 - RNA, 17 nt, Human
ugcuuaacuucacauau

SEQ ID NO: 3314457 - RNA, 14 nt, Human
ugcuuaacuucaca

SEQ ID NO: 3314458 - RNA, 13 nt, Human
ugcuuaacuucac

SEQ ID NO: 3314459 - RNA, 15 nt, Human
ugguuuucuguucuu

SEQ ID NO: 3314460 - RNA, 19 nt, Human
ugguuuucuuguguguuua

SEQ ID NO: 3314461 - RNA, 21 nt, Human
ugguuuuuaaaaaacugcuga

SEQ ID NO: 3314462 - RNA, 23 nt, Human
ugguuuuuaaaaaacugcugacu

SEQ ID NO: 3314463 - RNA, 16 nt, Human
ugguuuucuguucuuu

SEQ ID NO: 3314464 - RNA, 14 nt, Human
uguaacaagccacc

SEQ ID NO: 3314465 - RNA, 17 nt, Human
uguaacaagccacccca

SEQ ID NO: 3314466 - RNA, 11 nt, Human
uguacagagcc

SEQ ID NO: 3314467 - RNA, 14 nt, Human
uguacagacaacaa

SEQ ID NO: 3314468 - RNA, 18 nt, Human
ugguugaugaucuuugca

SEQ ID NO: 3314469 - RNA, 16 nt, Human
uggugucaccugaaga

SEQ ID NO: 3314470 - RNA, 15 nt, Human
uggugucgggcauga

SEQ ID NO: 3314471 - RNA, 18 nt, Human
uggugucgggcaugacac

SEQ ID NO: 3314472 - RNA, 23 nt, Human
ugguucaggguuggccccugccc

SEQ ID NO: 3314473 - RNA, 20 nt, Human
uggguacuuguggacacagc

SEQ ID NO: 3314474 - RNA, 23 nt, Human
uggguacuuguggacacagcucu

SEQ ID NO: 3314475 - RNA, 12 nt, Human
ugguggcagugg

SEQ ID NO: 3314476 - RNA, 19 nt, Human
uggugcaaugaccuuucaa

SEQ ID NO: 3314477 - RNA, 14 nt, Human
uggugcaaugaccu

SEQ ID NO: 3314478 - RNA, 20 nt, Human
ugguggcagugggagcugcc

SEQ ID NO: 3314479 - RNA, 13 nt, Human
ugguggcaguggg

SEQ ID NO: 3314480 - RNA, 18 nt, Human
ugguggcagugggagcug

SEQ ID NO: 3314481 - RNA, 18 nt, Human
uggugggggccucggugu

SEQ ID NO: 3314482 - RNA, 16 nt, Human
uggugggggccucggu

SEQ ID NO: 3314483 - RNA, 13 nt, Human
ugguggcuggguu

SEQ ID NO: 3314484 - RNA, 19 nt, Human
uggugguuuucuguucuuu

SEQ ID NO: 3314485 - RNA, 18 nt, Human
uggugguuucagaaaugu

SEQ ID NO: 3314486 - RNA, 17 nt, Human
uggugguuucagaaaug

SEQ ID NO: 3314487 - RNA, 12 nt, Human
uguccugggagu

SEQ ID NO: 3314488 - RNA, 19 nt, Human
uguccugggagugagcugg

SEQ ID NO: 3314489 - RNA, 20 nt, Human
uguccugggagugagcuggu

SEQ ID NO: 3314490 - RNA, 14 nt, Human
ugucuaaugaaacc

SEQ ID NO: 3314491 - RNA, 17 nt, Human
uguccccgacccuugcc

SEQ ID NO: 3314492 - RNA, 19 nt, Human
uguccccgcacugggcuug

SEQ ID NO: 3314493 - RNA, 17 nt, Human
uguccccgcacugggcu

SEQ ID NO: 3314494 - RNA, 16 nt, Human
ugucuuuucuugcaug

SEQ ID NO: 3314495 - RNA, 23 nt, Human
ugucuuuggacccugaggcccag

SEQ ID NO: 3314496 - RNA, 14 nt, Human
ugucuaugggacuc

SEQ ID NO: 3314497 - RNA, 15 nt, Human
ugucuaugggacuca

SEQ ID NO: 3314498 - RNA, 16 nt, Human
ugucuaugggacucaa

SEQ ID NO: 3314499 - RNA, 23 nt, Human
ugucuaguuguuugauucagaca

SEQ ID NO: 3314500 - RNA, 15 nt, Human
ugucuaguuguuuga

SEQ ID NO: 3314501 - RNA, 21 nt, Human
ugucucaaaaaaagaaaaaga

SEQ ID NO: 3314502 - RNA, 19 nt, Human
ugucaauuacaggaaguac

SEQ ID NO: 3314503 - RNA, 21 nt, Human
ugucaauuacaggaaguacug

SEQ ID NO: 3314504 - RNA, 14 nt, Human
ugucacaggcaggu

SEQ ID NO: 3314505 - RNA, 13 nt, Human
ugucacaggcagg

SEQ ID NO: 3314506 - RNA, 15 nt, Human
ugucacaggcagguc

SEQ ID NO: 3314507 - RNA, 16 nt, Human
ugucacaggcaggucc

SEQ ID NO: 3314508 - RNA, 17 nt, Human
ugucacaggcaggucca

SEQ ID NO: 3314509 - RNA, 21 nt, Human
ugucacaggcagguccagggu

SEQ ID NO: 3314510 - RNA, 14 nt, Human
ugucagugugacug

SEQ ID NO: 3314511 - RNA, 15 nt, Human
ugucagugugacuga

SEQ ID NO: 3314512 - RNA, 19 nt, Human
ugucagugugacugaucuc

SEQ ID NO: 3314513 - RNA, 16 nt, Human
ugucagugugacugau

SEQ ID NO: 3314514 - RNA, 23 nt, Human
uguacagcaaggagauuuacaac

SEQ ID NO: 3314515 - RNA, 22 nt, Human
uguacagcaaggagauuuacaa

SEQ ID NO: 3314516 - RNA, 12 nt, Human
uguacagagccc

SEQ ID NO: 3314517 - RNA, 21 nt, Human
uguacagagcccacgccccca

SEQ ID NO: 3314518 - RNA, 13 nt, Human
uguaucugagcag

SEQ ID NO: 3314519 - RNA, 13 nt, Human
ugagcaucaggcc

SEQ ID NO: 3314520 - RNA, 15 nt, Human
ugagcaucaggccag

SEQ ID NO: 3314521 - RNA, 14 nt, Human
ugagcaucaggcca

SEQ ID NO: 3314522 - RNA, 13 nt, Human
ugagccucagcau

SEQ ID NO: 3314523 - RNA, 12 nt, Human
ugagacccuguc

SEQ ID NO: 3314524 - RNA, 15 nt, Human
ugagaucagccuggg

SEQ ID NO: 3314525 - RNA, 19 nt, Human
ugagaggggaacagacugg

SEQ ID NO: 3314526 - RNA, 17 nt, Human
ugagaguagagucacug

SEQ ID NO: 3314527 - RNA, 22 nt, Human
ugagaggcauccaguaucuuga

SEQ ID NO: 3314528 - RNA, 23 nt, Human
ugagacucgcgacaaugcaaacc

SEQ ID NO: 3314529 - RNA, 23 nt, Human
ugagaggcauccaguaucuugaa

SEQ ID NO: 3314530 - RNA, 13 nt, Human
ugagacucugucu

SEQ ID NO: 3314531 - RNA, 14 nt, Human
ugagacucugucuc

SEQ ID NO: 3314532 - RNA, 12 nt, Human
ugagacucuguc

SEQ ID NO: 3314533 - RNA, 19 nt, Human
ugaccauucuccaccugcc

SEQ ID NO: 3314534 - RNA, 15 nt, Human
ucuugaacuccuggc

SEQ ID NO: 3314535 - RNA, 22 nt, Human
ugaccauucuccaccugccagg

SEQ ID NO: 3314536 - RNA, 21 nt, Human
ugaccauucuccaccugccag

SEQ ID NO: 3314537 - RNA, 20 nt, Human
ugaccauucuccaccugcca

SEQ ID NO: 3314538 - RNA, 16 nt, Human
ugaccucugcagcaau

SEQ ID NO: 3314539 - RNA, 13 nt, Human
ugaccucugcagc

SEQ ID NO: 3314540 - RNA, 22 nt, Human
ugaccucaggugauccacccac

SEQ ID NO: 3314541 - RNA, 13 nt, Human
ugaccuuucaaua

SEQ ID NO: 3314542 - RNA, 14 nt, Human
ugaccuuucaauag

SEQ ID NO: 3314543 - RNA, 16 nt, Human
ugaccuuucaauagga

SEQ ID NO: 3314544 - RNA, 15 nt, Human
ugaccuuucaauagg

SEQ ID NO: 3314545 - RNA, 12 nt, Human
ugaccucugccu

SEQ ID NO: 3314546 - RNA, 23 nt, Human
ugaccucugcagcaauaaagcag

SEQ ID NO: 3314547 - RNA, 21 nt, Human
ugaccucugcagcaauaaagc

SEQ ID NO: 3314548 - RNA, 18 nt, Human
ugaccucugcagcaauaa

SEQ ID NO: 3314549 - RNA, 13 nt, Human
ugacugaauuucu

SEQ ID NO: 3314550 - RNA, 15 nt, Human
ugacugaauuucuuu

SEQ ID NO: 3314551 - RNA, 14 nt, Human
ugacugaauuucuu

SEQ ID NO: 3314552 - RNA, 20 nt, Human
ugacgccaucccagccccaa

SEQ ID NO: 3314553 - RNA, 19 nt, Human
ugacgccaucccagcccca

SEQ ID NO: 3314554 - RNA, 18 nt, Human
ugacgccaucccagcccc

SEQ ID NO: 3314555 - RNA, 17 nt, Human
ugacgccaucccagccc

SEQ ID NO: 3314556 - RNA, 22 nt, Human
ugaccuuucaauaggaaaaacu

SEQ ID NO: 3314557 - RNA, 18 nt, Human
ugaccuuucaauaggaaa

SEQ ID NO: 3314558 - RNA, 16 nt, Human
ugacgccaucccagcc

SEQ ID NO: 3314559 - RNA, 15 nt, Human
ugacgccaucccagc

SEQ ID NO: 3314560 - RNA, 14 nt, Human
ugacgccaucccag

SEQ ID NO: 3314561 - RNA, 13 nt, Human
ugacgccauccca

SEQ ID NO: 3314562 - RNA, 21 nt, Human
ugaucacggcucacugcagcc

SEQ ID NO: 3314563 - RNA, 22 nt, Human
ugaucacggcucacugcagccu

SEQ ID NO: 3314564 - RNA, 21 nt, Human
ugauccacccaccucagccuc

SEQ ID NO: 3314565 - RNA, 22 nt, Human
ugauccacccaccucagccucc

SEQ ID NO: 3314566 - RNA, 21 nt, Human
ugaucuaggaagacuuuggaa

SEQ ID NO: 3314567 - RNA, 19 nt, Human
ugaucuaggaagacuuugg

SEQ ID NO: 3314568 - RNA, 17 nt, Human
ugaucucucgugauuga

SEQ ID NO: 3314569 - RNA, 15 nt, Human
ugaucuaggaagacu

SEQ ID NO: 3314570 - RNA, 13 nt, Human
ugaucauccacug

SEQ ID NO: 3314571 - RNA, 24 nt, Human
ugaucauccacugugccaugugcc

SEQ ID NO: 3314572 - RNA, 17 nt, Human
ugauccaagcugguccc

SEQ ID NO: 3314573 - RNA, 21 nt, Human
ugauccaagcuggucccacuc

SEQ ID NO: 3314574 - RNA, 15 nt, Human
ugauccacccaccuc

SEQ ID NO: 3314575 - RNA, 20 nt, Human
ugauccacccaccucagccu

SEQ ID NO: 3314576 - RNA, 19 nt, Human
ugauccacccaccucagcc

SEQ ID NO: 3314577 - RNA, 22 nt, Human
ugaugcuucuucagagacuccu

SEQ ID NO: 3314578 - RNA, 21 nt, Human
ugaugcuucuucagagacucc

SEQ ID NO: 3314579 - RNA, 19 nt, Human
ugaugcuucuucagagacu

SEQ ID NO: 3314580 - RNA, 18 nt, Human
ugaugcuucuucagagac

SEQ ID NO: 3314581 - RNA, 18 nt, Human
ugaucuuugcagacaggc

SEQ ID NO: 3314582 - RNA, 21 nt, Human
ugaucuuugcagacaggcaag

SEQ ID NO: 3314583 - RNA, 23 nt, Human
ugaucuuugcagacaggcaagca

SEQ ID NO: 3314584 - RNA, 19 nt, Human
ugaucuuugcagacaggca

SEQ ID NO: 3314585 - RNA, 20 nt, Human
ugaucuuugcagacaggcaa

SEQ ID NO: 3314586 - RNA, 14 nt, Human
ugaugccaugagga

SEQ ID NO: 3314587 - RNA, 23 nt, Human
ugaugaucuuugcagacaggcaa

SEQ ID NO: 3314588 - RNA, 20 nt, Human
ugaugaugaaaugaggucag

SEQ ID NO: 3314589 - RNA, 22 nt, Human
ugaugaucuuugcagacaggca

SEQ ID NO: 3314590 - RNA, 19 nt, Human
ugaguugauucagcucugc

SEQ ID NO: 3314591 - RNA, 16 nt, Human
ugaguugauucagcuc

SEQ ID NO: 3314592 - RNA, 15 nt, Human
ugagucgaggacagg

SEQ ID NO: 3314593 - RNA, 16 nt, Human
ugagucgaggacaggg

SEQ ID NO: 3314594 - RNA, 23 nt, Human
ugaguugauagcacagacccugc

SEQ ID NO: 3314595 - RNA, 21 nt, Human
ugaguugauagcacagacccu

SEQ ID NO: 3314596 - RNA, 23 nt, Human
ugauagcacagacccugcccugu

SEQ ID NO: 3314597 - RNA, 22 nt, Human
ugauagcacagacccugcccug

SEQ ID NO: 3314598 - RNA, 16 nt, Human
ugauagcacagacccu

SEQ ID NO: 3314599 - RNA, 15 nt, Human
ugauagcacagaccc

SEQ ID NO: 3314600 - RNA, 14 nt, Human
ugauagcacagacc

SEQ ID NO: 3314601 - RNA, 21 nt, Human
ugauagcacagacccugcccu

SEQ ID NO: 3314602 - RNA, 20 nt, Human
ugauagcacagacccugccc

SEQ ID NO: 3314603 - RNA, 18 nt, Human
ugauagcacagacccugc

SEQ ID NO: 3314604 - RNA, 17 nt, Human
ugauagcacagacccug

SEQ ID NO: 3314605 - RNA, 20 nt, Human
ugaguccccuguuuguuucu

SEQ ID NO: 3314606 - RNA, 18 nt, Human
ugaguccuggcaugggaa

SEQ ID NO: 3314607 - RNA, 11 nt, Human
ugaguccuggc

SEQ ID NO: 3314608 - RNA, 14 nt, Human
ugagucgaggacag

SEQ ID NO: 3314609 - RNA, 22 nt, Human
ugaguccuggcaugggaaugaa

SEQ ID NO: 3314610 - RNA, 19 nt, Human
ugaguccuggcaugggaau

SEQ ID NO: 3314611 - RNA, 21 nt, Human
ugaguccccuguuuguuucug

SEQ ID NO: 3314612 - RNA, 19 nt, Human
ugagguuucaaaccucccu

SEQ ID NO: 3314613 - RNA, 16 nt, Human
ugaggugcuauguucu

SEQ ID NO: 3314614 - RNA, 15 nt, Human
ugaggugcuauguuc

SEQ ID NO: 3314615 - RNA, 11 nt, Human
ugaggcugggc

SEQ ID NO: 3314616 - RNA, 15 nt, Human
ugaggucuguucuuu

SEQ ID NO: 3314617 - RNA, 14 nt, Human
ugaggucuguucuu

SEQ ID NO: 3314618 - RNA, 20 nt, Human
ugaggucuguucuuuccaaa

SEQ ID NO: 3314619 - RNA, 20 nt, Human
ugccaugaggaacaaggcaa

SEQ ID NO: 3314620 - RNA, 23 nt, Human
ugccaugaggaacaaggcaaggc

SEQ ID NO: 3314621 - RNA, 15 nt, Human
ugccaugugccaggu

SEQ ID NO: 3314622 - RNA, 14 nt, Human
ugccaugugccagg

SEQ ID NO: 3314623 - RNA, 15 nt, Human
ugccauguuggccag

SEQ ID NO: 3314624 - RNA, 12 nt, Human
ugccauguuggc

SEQ ID NO: 3314625 - RNA, 20 nt, Human
ugcccaccuggccucugcac

SEQ ID NO: 3314626 - RNA, 18 nt, Human
ugcccacgcuggagugca

SEQ ID NO: 3314627 - RNA, 19 nt, Human
ugcccaccuggccucugca

SEQ ID NO: 3314628 - RNA, 21 nt, Human
ugcccacucccugcaaccuga

SEQ ID NO: 3314629 - RNA, 12 nt, Human
ugccauccaggu

SEQ ID NO: 3314630 - RNA, 15 nt, Human
ugccauccagguuca

SEQ ID NO: 3314631 - RNA, 17 nt, Human
ugccagguuuuuggucu

SEQ ID NO: 3314632 - RNA, 18 nt, Human
ugccaggaagccagcagg

SEQ ID NO: 3314633 - RNA, 16 nt, Human
ugccaggaagccagca

SEQ ID NO: 3314634 - RNA, 12 nt, Human
ugccaggaagcc

SEQ ID NO: 3314635 - RNA, 19 nt, Human
ugcauguuacauaagauaa

SEQ ID NO: 3314636 - RNA, 15 nt, Human
ugcauguuugugauu

SEQ ID NO: 3314637 - RNA, 17 nt, Human
ugcauuaucuagauacu

SEQ ID NO: 3314638 - RNA, 12 nt, Human
ugcauuaucuag

SEQ ID NO: 3314639 - RNA, 21 nt, Human
ugcccugcccaccuggccucu

SEQ ID NO: 3314640 - RNA, 23 nt, Human
ugcccugcccaccuggccucugc

SEQ ID NO: 3314641 - RNA, 22 nt, Human
ugcccugcccaccuggccucug

SEQ ID NO: 3314642 - RNA, 17 nt, Human
ugcccuaaaguguauuu

SEQ ID NO: 3314643 - RNA, 19 nt, Human
ugccgucuaccugaggggc

SEQ ID NO: 3314644 - RNA, 17 nt, Human
ugccgucuaccugaggg

SEQ ID NO: 3314645 - RNA, 16 nt, Human
ugccgucuaccugagg

SEQ ID NO: 3314646 - RNA, 15 nt, Human
ugccgucuaccugag

SEQ ID NO: 3314647 - RNA, 13 nt, Human
ugccucugggacu

SEQ ID NO: 3314648 - RNA, 22 nt, Human
ugccuccuuugugaggaagccg

SEQ ID NO: 3314649 - RNA, 20 nt, Human
ugccuccuuugugaggaagc

SEQ ID NO: 3314650 - RNA, 21 nt, Human
ugccuccuuugugaggaagcc

SEQ ID NO: 3314651 - RNA, 21 nt, Human
ugccucuucucuacucuaggg

SEQ ID NO: 3314652 - RNA, 17 nt, Human
ugccugguggcagcugc

SEQ ID NO: 3314653 - RNA, 18 nt, Human
ugccugguggcagcugcg

SEQ ID NO: 3314654 - RNA, 19 nt, Human
ugccugguggcagcugcgg

SEQ ID NO: 3314655 - RNA, 16 nt, Human
ugccugguggcagcug

SEQ ID NO: 3314656 - RNA, 20 nt, Human
ugauuuuuuuuuccuucagu

SEQ ID NO: 3314657 - RNA, 19 nt, Human
ugauuuuuuuuuccuucag

SEQ ID NO: 3314658 - RNA, 17 nt, Human
ugauuuuuuuuuccuuc

SEQ ID NO: 3314659 - RNA, 16 nt, Human
ugauuuuuuuuuccuu

SEQ ID NO: 3314660 - RNA, 23 nt, Human
ugauuuuuuuuuccuucagugcc

SEQ ID NO: 3314661 - RNA, 22 nt, Human
ugauuuuuuuuuccuucagugc

SEQ ID NO: 3314662 - RNA, 15 nt, Human
ugauuuucauugcug

SEQ ID NO: 3314663 - RNA, 13 nt, Human
ugauuuucauugc

SEQ ID NO: 3314664 - RNA, 13 nt, Human
ugcaacaggcugg

SEQ ID NO: 3314665 - RNA, 14 nt, Human
ugcaacaggcuggg

SEQ ID NO: 3314666 - RNA, 15 nt, Human
ugcaacaggcugggc

SEQ ID NO: 3314667 - RNA, 16 nt, Human
ugcaacaggcugggcu

SEQ ID NO: 3314668 - RNA, 17 nt, Human
ugcaacaggcugggcuu

SEQ ID NO: 3314669 - RNA, 19 nt, Human
ugcaacaggcugggcuuca

SEQ ID NO: 3314670 - RNA, 20 nt, Human
ugcaacaggcugggcuucag

SEQ ID NO: 3314671 - RNA, 13 nt, Human
ugcaaccuccgcc

SEQ ID NO: 3314672 - RNA, 14 nt, Human
ugcaaccuccgccu

SEQ ID NO: 3314673 - RNA, 20 nt, Human
ugcaaccugauugugucucu

SEQ ID NO: 3314674 - RNA, 19 nt, Human
ugcaaccugauugugucuc

SEQ ID NO: 3314675 - RNA, 18 nt, Human
ugcaaccuccgccucuug

SEQ ID NO: 3314676 - RNA, 20 nt, Human
ugcaaccuccgccucuuggg

SEQ ID NO: 3314677 - RNA, 21 nt, Human
ugcaaccuccgccucuugggu

SEQ ID NO: 3314678 - RNA, 22 nt, Human
ugcaaccugauugugucucuug

SEQ ID NO: 3314679 - RNA, 16 nt, Human
ugcacaaacagaggcc

SEQ ID NO: 3314680 - RNA, 15 nt, Human
ugcacaaacagaggc

SEQ ID NO: 3314681 - RNA, 17 nt, Human
ugcacagaguuguuaca

SEQ ID NO: 3314682 - RNA, 19 nt, Human
ugcacagaguuguuacauu

SEQ ID NO: 3314683 - RNA, 18 nt, Human
ugcacagaguuguuacau

SEQ ID NO: 3314684 - RNA, 20 nt, Human
ugcacaaacagaggccgcca

SEQ ID NO: 3314685 - RNA, 19 nt, Human
ugcacaaacagaggccgcc

SEQ ID NO: 3314686 - RNA, 17 nt, Human
ugcacaaacagaggccg

SEQ ID NO: 3314687 - RNA, 16 nt, Human
ugcaaugaccuuucaa

SEQ ID NO: 3314688 - RNA, 13 nt, Human
ugcaaugaccuuu

SEQ ID NO: 3314689 - RNA, 23 nt, Human
ugcaaugaccuuucaauaggaaa

SEQ ID NO: 3314690 - RNA, 22 nt, Human
ugcaaugaccuuucaauaggaa

SEQ ID NO: 3314691 - RNA, 19 nt, Human
ugcaaugaccuuucaauag

SEQ ID NO: 3314692 - RNA, 17 nt, Human
ugcaaugaccuuucaau

SEQ ID NO: 3314693 - RNA, 13 nt, Human
ugcaauggcagcc

SEQ ID NO: 3314694 - RNA, 14 nt, Human
ugcaauggcagccu

SEQ ID NO: 3314695 - RNA, 15 nt, Human
ugcaauggcagccuu

SEQ ID NO: 3314696 - RNA, 16 nt, Human
ugcaauggcagccuug

SEQ ID NO: 3314697 - RNA, 18 nt, Human
ugcacugacauuguuggc

SEQ ID NO: 3314698 - RNA, 21 nt, Human
ugcacugacauuguuggccaa

SEQ ID NO: 3314699 - RNA, 18 nt, Human
ugcaccggcuggccuggc

SEQ ID NO: 3314700 - RNA, 20 nt, Human
ugcaccggcuggccuggccc

SEQ ID NO: 3314701 - RNA, 19 nt, Human
ugcaccggcuggccuggcc

SEQ ID NO: 3314702 - RNA, 17 nt, Human
ugcaccuggaauauaua

SEQ ID NO: 3314703 - RNA, 22 nt, Human
ugcaccuggaauauauaaccag

SEQ ID NO: 3314704 - RNA, 20 nt, Human
ugcaccuggaauauauaacc

SEQ ID NO: 3314705 - RNA, 14 nt, Human
uccugccucagccu

SEQ ID NO: 3314706 - RNA, 13 nt, Human
uccugagccagau

SEQ ID NO: 3314707 - RNA, 14 nt, Human
uccuggcacccggc

SEQ ID NO: 3314708 - RNA, 16 nt, Human
uccuggcacccggccc

SEQ ID NO: 3314709 - RNA, 19 nt, Human
uccuggcacccggccccug

SEQ ID NO: 3314710 - RNA, 16 nt, Human
uccugccucagccucc

SEQ ID NO: 3314711 - RNA, 13 nt, Human
uccugccucagcc

SEQ ID NO: 3314712 - RNA, 15 nt, Human
uccugccucagccuc

SEQ ID NO: 3314713 - RNA, 20 nt, Human
uccuguaccucuugagccuu

SEQ ID NO: 3314714 - RNA, 14 nt, Human
uccuuaccagcaga

SEQ ID NO: 3314715 - RNA, 20 nt, Human
uccuggcacccggccccugc

SEQ ID NO: 3314716 - RNA, 21 nt, Human
uccuggcacccggccccugcu

SEQ ID NO: 3314717 - RNA, 17 nt, Human
uccuggcacugcuucca

SEQ ID NO: 3314718 - RNA, 22 nt, Human
uccuggcacugcuuccagugag

SEQ ID NO: 3314719 - RNA, 18 nt, Human
uccuggcacugcuuccag

SEQ ID NO: 3314720 - RNA, 23 nt, Human
uccuuuucacaguucucuccuuc

SEQ ID NO: 3314721 - RNA, 19 nt, Human
uccuucacagaugggugcu

SEQ ID NO: 3314722 - RNA, 20 nt, Human
uccuucaccuuuguccccac

SEQ ID NO: 3314723 - RNA, 18 nt, Human
uccuucaccuuugucccc

SEQ ID NO: 3314724 - RNA, 18 nt, Human
uccuucacagaugggugc

SEQ ID NO: 3314725 - RNA, 18 nt, Human
uccuuaccagcagagcac

SEQ ID NO: 3314726 - RNA, 17 nt, Human
uccuuaccagcagagca

SEQ ID NO: 3314727 - RNA, 16 nt, Human
uccuuaccagcagagc

SEQ ID NO: 3314728 - RNA, 22 nt, Human
uccuucaccuuuguccccaccg

SEQ ID NO: 3314729 - RNA, 21 nt, Human
uccuucaccuuuguccccacc

SEQ ID NO: 3314730 - RNA, 16 nt, Human
ucgugauugauaagaa

SEQ ID NO: 3314731 - RNA, 21 nt, Human
ucuaaaucuccaaaauaaaac

SEQ ID NO: 3314732 - RNA, 17 nt, Human
ucucaaauaacuaaaag

SEQ ID NO: 3314733 - RNA, 15 nt, Human
ucuaucaaguauuau

SEQ ID NO: 3314734 - RNA, 21 nt, Human
ucuaucaaguauuauaccuuu

SEQ ID NO: 3314735 - RNA, 21 nt, Human
ucuaggaagacuuuggaaaga

SEQ ID NO: 3314736 - RNA, 13 nt, Human
ucccuucccaccu

SEQ ID NO: 3314737 - RNA, 14 nt, Human
ucccugcacuugca

SEQ ID NO: 3314738 - RNA, 13 nt, Human
ucccugcacuugc

SEQ ID NO: 3314739 - RNA, 21 nt, Human
uccccuguuuguuucugaaag

SEQ ID NO: 3314740 - RNA, 20 nt, Human
uccccuguuuguuucugaaa

SEQ ID NO: 3314741 - RNA, 18 nt, Human
uccccuguuuguuucuga

SEQ ID NO: 3314742 - RNA, 17 nt, Human
uccagguuuaagcuguu

SEQ ID NO: 3314743 - RNA, 19 nt, Human
uccuccuuuucacaguucu

SEQ ID NO: 3314744 - RNA, 14 nt, Human
uccucuaggagguc

SEQ ID NO: 3314745 - RNA, 15 nt, Human
uccucuguacagagc

SEQ ID NO: 3314746 - RNA, 18 nt, Human
uccucuguacagagccca

SEQ ID NO: 3314747 - RNA, 17 nt, Human
uccucuguacagagccc

SEQ ID NO: 3314748 - RNA, 16 nt, Human
uccucuguacagagcc

SEQ ID NO: 3314749 - RNA, 16 nt, Human
uccucugcugcuggcu

SEQ ID NO: 3314750 - RNA, 15 nt, Human
uccucugcugcuggc

SEQ ID NO: 3314751 - RNA, 14 nt, Human
uccucugcugcugg

SEQ ID NO: 3314752 - RNA, 12 nt, Human
uccucugcugcu

SEQ ID NO: 3314753 - RNA, 22 nt, Human
uccuaguuccaccaucaagcca

SEQ ID NO: 3314754 - RNA, 18 nt, Human
uccuauauuguuuucagu

SEQ ID NO: 3314755 - RNA, 18 nt, Human
uccuacccacccuccuuu

SEQ ID NO: 3314756 - RNA, 13 nt, Human
uccgaccagacac

SEQ ID NO: 3314757 - RNA, 16 nt, Human
uccuaaucuucugaac

SEQ ID NO: 3314758 - RNA, 15 nt, Human
ucucuaguuugauua

SEQ ID NO: 3314759 - RNA, 14 nt, Human
ucucugaggacacu

SEQ ID NO: 3314760 - RNA, 17 nt, Human
ucucugaggacacuaac

SEQ ID NO: 3314761 - RNA, 19 nt, Human
ucucuaacuucaccauauu

SEQ ID NO: 3314762 - RNA, 12 nt, Human
ucucuaacuuca

SEQ ID NO: 3314763 - RNA, 13 nt, Human
ucuccuguaccuc

SEQ ID NO: 3314764 - RNA, 17 nt, Human
ucuccuguaccucuuga

SEQ ID NO: 3314765 - RNA, 16 nt, Human
ucuccuguaccucuug

SEQ ID NO: 3314766 - RNA, 22 nt, Human
ucucgugauugauaagaaccuu

SEQ ID NO: 3314767 - RNA, 14 nt, Human
ucucgugauugaua

SEQ ID NO: 3314768 - RNA, 17 nt, Human
ucuccugccucagccuc

SEQ ID NO: 3314769 - RNA, 15 nt, Human
ucuccugccucagcc

SEQ ID NO: 3314770 - RNA, 21 nt, Human
ucuccuggaaauauuaagaaa

SEQ ID NO: 3314771 - RNA, 15 nt, Human
ucuccuguaccucuu

SEQ ID NO: 3314772 - RNA, 20 nt, Human
ucugcaagaauugaagcagg

SEQ ID NO: 3314773 - RNA, 14 nt, Human
ucugacccacugcu

SEQ ID NO: 3314774 - RNA, 23 nt, Human
ucugaggaauccagacccggcug

SEQ ID NO: 3314775 - RNA, 13 nt, Human
ucugaaaauguau

SEQ ID NO: 3314776 - RNA, 16 nt, Human
ucugacacacagcucu

SEQ ID NO: 3314777 - RNA, 17 nt, Human
ucugacacacagcucug

SEQ ID NO: 3314778 - RNA, 18 nt, Human
ucugacacacagcucugu

SEQ ID NO: 3314779 - RNA, 19 nt, Human
ucugacacacagcucuguc

SEQ ID NO: 3314780 - RNA, 12 nt, Human
ucugacaggcaa

SEQ ID NO: 3314781 - RNA, 21 nt, Human
ucugacaggcaaugcuggcug

SEQ ID NO: 3314782 - RNA, 22 nt, Human
ucugacaggcaaugcuggcugu

SEQ ID NO: 3314783 - RNA, 13 nt, Human
ucugacccacugc

SEQ ID NO: 3314784 - RNA, 17 nt, Human
ucuggcuaugcauuuga

SEQ ID NO: 3314785 - RNA, 22 nt, Human
ucuggcuaugcauuugaaaauu

SEQ ID NO: 3314786 - RNA, 19 nt, Human
ucuggcuaugcauuugaaa

SEQ ID NO: 3314787 - RNA, 14 nt, Human
ucugggacacaguu

SEQ ID NO: 3314788 - RNA, 13 nt, Human
ucugggacacagu

SEQ ID NO: 3314789 - RNA, 23 nt, Human
ucuggugacuuuccucuuugguc

SEQ ID NO: 3314790 - RNA, 23 nt, Human
ucuggcucuuccaggcugggaga

SEQ ID NO: 3314791 - RNA, 18 nt, Human
ucuggcucuuccaggcug

SEQ ID NO: 3314792 - RNA, 14 nt, Human
ucuguccuacucug

SEQ ID NO: 3314793 - RNA, 16 nt, Human
ucuggugacuuuccuc

SEQ ID NO: 3314794 - RNA, 21 nt, Human
ucuguccugggagugagcugg

SEQ ID NO: 3314795 - RNA, 15 nt, Human
ucuguccuacucugu

SEQ ID NO: 3314796 - RNA, 19 nt, Human
ucuguccuacucuguguca

SEQ ID NO: 3314797 - RNA, 14 nt, Human
ucugucgcccaguc

SEQ ID NO: 3314798 - RNA, 14 nt, Human
ucugccugcccagg

SEQ ID NO: 3314799 - RNA, 13 nt, Human
ucugccugcccag

SEQ ID NO: 3314800 - RNA, 15 nt, Human
ucugccugcccaggc

SEQ ID NO: 3314801 - RNA, 18 nt, Human
ucugcuccucuccccagc

SEQ ID NO: 3314802 - RNA, 18 nt, Human
ucugcugacagacacagg

SEQ ID NO: 3314803 - RNA, 17 nt, Human
ucugcugacagacacag

SEQ ID NO: 3314804 - RNA, 21 nt, Human
ucuggacaggcauguucucug

SEQ ID NO: 3314805 - RNA, 14 nt, Human
ucuggacaggcaug

SEQ ID NO: 3314806 - RNA, 15 nt, Human
ucuggaaugcagugg

SEQ ID NO: 3314807 - RNA, 19 nt, Human
ucuggaauaaggagaauga

SEQ ID NO: 3314808 - RNA, 19 nt, Human
ucugcugacagacacaggc

SEQ ID NO: 3314809 - RNA, 20 nt, Human
ucugcugacagacacaggcc

SEQ ID NO: 3314810 - RNA, 21 nt, Human
ucugcugacagacacaggccc

SEQ ID NO: 3314811 - RNA, 22 nt, Human
ucugcugacagacacaggcccg

SEQ ID NO: 3314812 - RNA, 22 nt, Human
ucuuaaauauguggaguucauc

SEQ ID NO: 3314813 - RNA, 23 nt, Human
ucuucagaucucuaacuucacca

SEQ ID NO: 3314814 - RNA, 18 nt, Human
ucuucagaucucuaacuu

SEQ ID NO: 3314815 - RNA, 15 nt, Human
ucuucagaucucuaa

SEQ ID NO: 3314816 - RNA, 15 nt, Human
ucuucuccaggcugu

SEQ ID NO: 3314817 - RNA, 12 nt, Human
ucuugaacuccu

SEQ ID NO: 3314818 - RNA, 23 nt, Human
uccagccaaagccuccuccagcc

SEQ ID NO: 3314819 - RNA, 16 nt, Human
uccaggagcagccaca

SEQ ID NO: 3314820 - RNA, 17 nt, Human
uccagcuguucagcugg

SEQ ID NO: 3314821 - RNA, 15 nt, Human
uccagcucaccagcc

SEQ ID NO: 3314822 - RNA, 16 nt, Human
uccagcucaccagccc

SEQ ID NO: 3314823 - RNA, 17 nt, Human
uccagcucaccagcccc

SEQ ID NO: 3314824 - RNA, 22 nt, Human
uccaggggugggacacccugug

SEQ ID NO: 3314825 - RNA, 18 nt, Human
uccaggagcagccacauu

SEQ ID NO: 3314826 - RNA, 17 nt, Human
uccaggagcagccacau

SEQ ID NO: 3314827 - RNA, 15 nt, Human
uccaggugcacaagc

SEQ ID NO: 3314828 - RNA, 23 nt, Human
uccaggggugggacacccuguga

SEQ ID NO: 3314829 - RNA, 22 nt, Human
uccaggugcacaagcuccaagc

SEQ ID NO: 3314830 - RNA, 21 nt, Human
uccaggugcacaagcuccaag

SEQ ID NO: 3314831 - RNA, 20 nt, Human
uccaggugcacaagcuccaa

SEQ ID NO: 3314832 - RNA, 18 nt, Human
uccaggugcacaagcucc

SEQ ID NO: 3314833 - RNA, 15 nt, Human
uccagguucagcuug

SEQ ID NO: 3314834 - RNA, 16 nt, Human
uccagguucagcuugu

SEQ ID NO: 3314835 - RNA, 18 nt, Human
uccaaaauaaaacuuuuu

SEQ ID NO: 3314836 - RNA, 20 nt, Human
uccaaaauaaaacuuuuuaa

SEQ ID NO: 3314837 - RNA, 17 nt, Human
uccaauuuacauacucu

SEQ ID NO: 3314838 - RNA, 18 nt, Human
uccaauuuacauacucug

SEQ ID NO: 3314839 - RNA, 17 nt, Human
uccacaaguuaaauaaa

SEQ ID NO: 3314840 - RNA, 18 nt, Human
uccacaaguuaaauaaau

SEQ ID NO: 3314841 - RNA, 15 nt, Human
uccacaagagcccag

SEQ ID NO: 3314842 - RNA, 18 nt, Human
uccacaagagcccaggcc

SEQ ID NO: 3314843 - RNA, 17 nt, Human
uccacaagagcccaggc

SEQ ID NO: 3314844 - RNA, 16 nt, Human
uccacaagagcccagg

SEQ ID NO: 3314845 - RNA, 12 nt, Human
uccacccugcuc

SEQ ID NO: 3314846 - RNA, 21 nt, Human
uccaccugccagggacagagg

SEQ ID NO: 3314847 - RNA, 18 nt, Human
uccaccugccagggacag

SEQ ID NO: 3314848 - RNA, 15 nt, Human
uccaccugccaggga

SEQ ID NO: 3314849 - RNA, 17 nt, Human
uccaccugccagggaca

SEQ ID NO: 3314850 - RNA, 21 nt, Human
ucaucaccaacgucugugcca

SEQ ID NO: 3314851 - RNA, 20 nt, Human
ucaucaccaacgucugugcc

SEQ ID NO: 3314852 - RNA, 19 nt, Human
ucaucaccaacgucugugc

SEQ ID NO: 3314853 - RNA, 21 nt, Human
ucauacccacccccacccaag

SEQ ID NO: 3314854 - RNA, 13 nt, Human
ucaggugcugcca

SEQ ID NO: 3314855 - RNA, 14 nt, Human
ucaggugcugccau

SEQ ID NO: 3314856 - RNA, 23 nt, Human
ucaggugccucaagagaaggcaa

SEQ ID NO: 3314857 - RNA, 21 nt, Human
ucaggugagaagcagaggaag

SEQ ID NO: 3314858 - RNA, 23 nt, Human
ucaucuuagguuggcaaaaaggc

SEQ ID NO: 3314859 - RNA, 21 nt, Human
ucauucaacccaccugcgucu

SEQ ID NO: 3314860 - RNA, 22 nt, Human
ucauuaggugugacugaauuuc

SEQ ID NO: 3314861 - RNA, 13 nt, Human
ucauuuccugugu

SEQ ID NO: 3314862 - RNA, 16 nt, Human
ucauuuccugugucuu

SEQ ID NO: 3314863 - RNA, 13 nt, Human
ucagacagcugcc

SEQ ID NO: 3314864 - RNA, 10 nt, Human
ucagaaaugu

SEQ ID NO: 3314865 - RNA, 16 nt, Human
ucagaauucucuaguu

SEQ ID NO: 3314866 - RNA, 15 nt, Human
ucagaaauguguuau

SEQ ID NO: 3314867 - RNA, 23 nt, Human
ucagaauucucuaguuugauuaa

SEQ ID NO: 3314868 - RNA, 14 nt, Human
ucacugcuuaacuu

SEQ ID NO: 3314869 - RNA, 20 nt, Human
ucacugcuuaacuucacaua

SEQ ID NO: 3314870 - RNA, 17 nt, Human
ucacucuuauugcccac

SEQ ID NO: 3314871 - RNA, 22 nt, Human
ucacucugucgcccagucugga

SEQ ID NO: 3314872 - RNA, 13 nt, Human
ucaccagccccag

SEQ ID NO: 3314873 - RNA, 22 nt, Human
ucaccccggccaccugcggugc

SEQ ID NO: 3314874 - RNA, 20 nt, Human
ucacucuuauugcccacgcu

SEQ ID NO: 3314875 - RNA, 18 nt, Human
ucacugccaugccagcuu

SEQ ID NO: 3314876 - RNA, 16 nt, Human
ucagggccuggcucag

SEQ ID NO: 3314877 - RNA, 14 nt, Human
ucagggccuggcuc

SEQ ID NO: 3314878 - RNA, 16 nt, Human
ucaggugagaagcaga

SEQ ID NO: 3314879 - RNA, 15 nt, Human
ucaggugagaagcag

SEQ ID NO: 3314880 - RNA, 16 nt, Human
ucagcugaaccugggu

SEQ ID NO: 3314881 - RNA, 15 nt, Human
ucagcugaaccuggg

SEQ ID NO: 3314882 - RNA, 19 nt, Human
ucagccugcuccagcuguu

SEQ ID NO: 3314883 - RNA, 18 nt, Human
ucagccugcuccagcugu

SEQ ID NO: 3314884 - RNA, 20 nt, Human
ucagccucccgaauagcugg

SEQ ID NO: 3314885 - RNA, 21 nt, Human
ucagccucccgaguagcuggg

SEQ ID NO: 3314886 - RNA, 22 nt, Human
ucagccucccgaguagcuggga

SEQ ID NO: 3314887 - RNA, 20 nt, Human
ucagccucccgaguagcugg

SEQ ID NO: 3314888 - RNA, 18 nt, Human
ucagccucccgaguagcu

SEQ ID NO: 3314889 - RNA, 21 nt, Human
ucagccucccgaauagcuggg

SEQ ID NO: 3314890 - RNA, 22 nt, Human
ucagccucccgaauagcuggga

SEQ ID NO: 3314891 - RNA, 13 nt, Human
ucagccucccaaa

SEQ ID NO: 3314892 - RNA, 14 nt, Human
ucagccucccaaag

SEQ ID NO: 3314893 - RNA, 19 nt, Human
ucagccucccaaagugcug

SEQ ID NO: 3314894 - RNA, 21 nt, Human
ucagccucccaaagugcuggg

SEQ ID NO: 3314895 - RNA, 20 nt, Human
ucaauuacaggaaguacugg

SEQ ID NO: 3314896 - RNA, 19 nt, Human
ucacaguccuuaccagcag

SEQ ID NO: 3314897 - RNA, 23 nt, Human
ucacaguccuuaccagcagagca

SEQ ID NO: 3314898 - RNA, 22 nt, Human
ucacaguccuuaccagcagagc

SEQ ID NO: 3314899 - RNA, 16 nt, Human
ucacaggcagguccag

SEQ ID NO: 3314900 - RNA, 17 nt, Human
ucacaggcagguccagg

SEQ ID NO: 3314901 - RNA, 18 nt, Human
ucacaggcagguccaggg

SEQ ID NO: 3314902 - RNA, 19 nt, Human
ucaccaaaucagcugcuac

SEQ ID NO: 3314903 - RNA, 20 nt, Human
ucaccaaaucagcugcuacu

SEQ ID NO: 3314904 - RNA, 18 nt, Human
ucacauuuauucugcuca

SEQ ID NO: 3314905 - RNA, 19 nt, Human
ucacauuuauucugcucac

SEQ ID NO: 3314906 - RNA, 17 nt, Human
ucacauuuauucugcuc

SEQ ID NO: 3314907 - RNA, 23 nt, Human
ucaauuacaggaaguacuggaga

SEQ ID NO: 3314908 - RNA, 21 nt, Human
ucaauuacaggaaguacugga

SEQ ID NO: 3314909 - RNA, 18 nt, Human
ucaagugauucuccugcc

SEQ ID NO: 3314910 - RNA, 20 nt, Human
ucaagugauucuccugccuc

SEQ ID NO: 3314911 - RNA, 20 nt, Human
ucaaccccuucgcuccugug

SEQ ID NO: 3314912 - RNA, 23 nt, Human
ucaaccccuucgcuccugugucu

SEQ ID NO: 3314913 - RNA, 22 nt, Human
uauuuucccuauuagagaagag

SEQ ID NO: 3314914 - RNA, 15 nt, Human
ucaaaaaaagaaaaa

SEQ ID NO: 3314915 - RNA, 14 nt, Human
ucaaaaaaagaaaa

SEQ ID NO: 3314916 - RNA, 17 nt, Human
uauuuuuuucuuuucuu

SEQ ID NO: 3314917 - RNA, 14 nt, Human
uauuuuuuuacuaa

SEQ ID NO: 3314918 - RNA, 17 nt, Human
uauuuuauuaugcauga

SEQ ID NO: 3314919 - RNA, 14 nt, Human
uauuuuauuaugca

SEQ ID NO: 3314920 - RNA, 22 nt, Human
uauuggaaauuuguuauaauga

SEQ ID NO: 3314921 - RNA, 17 nt, Human
uauugcugauggugcaa

SEQ ID NO: 3314922 - RNA, 17 nt, Human
uauucucuccuguaccu

SEQ ID NO: 3314923 - RNA, 21 nt, Human
uauugauaugcuuauacacuu

SEQ ID NO: 3314924 - RNA, 12 nt, Human
uauuguuuucag

SEQ ID NO: 3314925 - RNA, 18 nt, Human
uauuguuuucaguguaca

SEQ ID NO: 3314926 - RNA, 20 nt, Human
uauuguuuucaguguacaug

SEQ ID NO: 3314927 - RNA, 22 nt, Human
uauuguuuucaguguacaugga

SEQ ID NO: 3314928 - RNA, 20 nt, Human
uauguugcccaggcaggucu

SEQ ID NO: 3314929 - RNA, 16 nt, Human
uauguugcccaggcag

SEQ ID NO: 3314930 - RNA, 19 nt, Human
uauguugcccaggcagguc

SEQ ID NO: 3314931 - RNA, 13 nt, Human
uauguugcccagg

SEQ ID NO: 3314932 - RNA, 24 nt, Human
uauuaagaaagacuaucuaaaugu

SEQ ID NO: 3314933 - RNA, 12 nt, Human
uauuaaauuaug

SEQ ID NO: 3314934 - RNA, 15 nt, Human
gggaguggccacaga

SEQ ID NO: 3314935 - RNA, 13 nt, Human
gggaguggccaca

SEQ ID NO: 3314936 - RNA, 18 nt, Human
augcacaaacagaggccg

SEQ ID NO: 3314937 - RNA, 15 nt, Human
augaugauccuaggc

SEQ ID NO: 3314938 - RNA, 23 nt, Human
augaugaaaugaggucagagccu

SEQ ID NO: 3314939 - RNA, 18 nt, Human
augaugaaaugaggucag

SEQ ID NO: 3314940 - RNA, 17 nt, Human
augaucuuugcagacag

SEQ ID NO: 3314941 - RNA, 18 nt, Human
augaucuucuuuauaauu

SEQ ID NO: 3314942 - RNA, 18 nt, Human
augaucuuugcagacagg

SEQ ID NO: 3314943 - RNA, 19 nt, Human
augaucuuugcagacaggc

SEQ ID NO: 3314944 - RNA, 21 nt, Human
augaucuuugcagacaggcaa

SEQ ID NO: 3314945 - RNA, 20 nt, Human
augccuggauggggcugcac

SEQ ID NO: 3314946 - RNA, 19 nt, Human
augccuggauggggcugca

SEQ ID NO: 3314947 - RNA, 22 nt, Human
augcacagaguuguuacauuuu

SEQ ID NO: 3314948 - RNA, 21 nt, Human
augcacagaguuguuacauuu

SEQ ID NO: 3314949 - RNA, 19 nt, Human
augcacagaguuguuacau

SEQ ID NO: 3314950 - RNA, 14 nt, Human
augcacacauuuuu

SEQ ID NO: 3314951 - RNA, 13 nt, Human
augcacacauuuu

SEQ ID NO: 3314952 - RNA, 18 nt, Human
augcacagaguuguuaca

SEQ ID NO: 3314953 - RNA, 15 nt, Human
augcacacauuuuuu

SEQ ID NO: 3314954 - RNA, 16 nt, Human
augcugcccugugagu

SEQ ID NO: 3314955 - RNA, 15 nt, Human
augcugcccugugag

SEQ ID NO: 3314956 - RNA, 14 nt, Human
augcugcccuguga

SEQ ID NO: 3314957 - RNA, 12 nt, Human
augcugcccugu

SEQ ID NO: 3314958 - RNA, 13 nt, Human
augcugcccugug

SEQ ID NO: 3314959 - RNA, 15 nt, Human
augcuuguacauaau

SEQ ID NO: 3314960 - RNA, 16 nt, Human
augcuuguacauaaug

SEQ ID NO: 3314961 - RNA, 17 nt, Human
auggcuuuugugcauua

SEQ ID NO: 3314962 - RNA, 16 nt, Human
auggcuuuugugcauu

SEQ ID NO: 3314963 - RNA, 17 nt, Human
augucacaggcaggucc

SEQ ID NO: 3314964 - RNA, 19 nt, Human
augucacaggcagguccag

SEQ ID NO: 3314965 - RNA, 13 nt, Human
augucacaggcag

SEQ ID NO: 3314966 - RNA, 23 nt, Human
auguaauuaaguacuauguauca

SEQ ID NO: 3314967 - RNA, 23 nt, Human
augggugcuuggaggaaggaaac

SEQ ID NO: 3314968 - RNA, 21 nt, Human
augggugcuuggaggaaggaa

SEQ ID NO: 3314969 - RNA, 20 nt, Human
augggugcuuggaggaagga

SEQ ID NO: 3314970 - RNA, 13 nt, Human
auguguaaguauu

SEQ ID NO: 3314971 - RNA, 16 nt, Human
auguucucucuucucc

SEQ ID NO: 3314972 - RNA, 13 nt, Human
auguucucugagg

SEQ ID NO: 3314973 - RNA, 17 nt, Human
auguucucucuucucca

SEQ ID NO: 3314974 - RNA, 15 nt, Human
auguucugggacaca

SEQ ID NO: 3314975 - RNA, 13 nt, Human
auguucugggaca

SEQ ID NO: 3314976 - RNA, 14 nt, Human
auguucugggacac

SEQ ID NO: 3314977 - RNA, 14 nt, Human
auguuugccucugc

SEQ ID NO: 3314978 - RNA, 15 nt, Human
auguuugccucugcc

SEQ ID NO: 3314979 - RNA, 17 nt, Human
auguuugccucugccuc

SEQ ID NO: 3314980 - RNA, 21 nt, Human
augaggcauuuguuugaacug

SEQ ID NO: 3314981 - RNA, 14 nt, Human
augaggcauuuguu

SEQ ID NO: 3314982 - RNA, 13 nt, Human
augaggcauuugu

SEQ ID NO: 3314983 - RNA, 16 nt, Human
augaaaacacauuuuu

SEQ ID NO: 3314984 - RNA, 15 nt, Human
augaaaacacauuuu

SEQ ID NO: 3314985 - RNA, 14 nt, Human
augaaaacacauuu

SEQ ID NO: 3314986 - RNA, 19 nt, Human
aucccaugagccucagcau

SEQ ID NO: 3314987 - RNA, 18 nt, Human
aucccaugagccucagca

SEQ ID NO: 3314988 - RNA, 15 nt, Human
auccagacccggcug

SEQ ID NO: 3314989 - RNA, 19 nt, Human
auccagacccggcugcgug

SEQ ID NO: 3314990 - RNA, 14 nt, Human
aucaugucuggcua

SEQ ID NO: 3314991 - RNA, 21 nt, Human
aucaccgaaaacguggcugcu

SEQ ID NO: 3314992 - RNA, 20 nt, Human
aucaccaacgucugugccau

SEQ ID NO: 3314993 - RNA, 13 nt, Human
aucaccagacagg

SEQ ID NO: 3314994 - RNA, 24 nt, Human
aucaaaagguuaauaaaguaauua

SEQ ID NO: 3314995 - RNA, 23 nt, Human
aucaaagagguuuuaaaaaaauc

SEQ ID NO: 3314996 - RNA, 20 nt, Human
aucaaagagguuuuaaaaaa

SEQ ID NO: 3314997 - RNA, 18 nt, Human
auaaggguaucuggugac

SEQ ID NO: 3314998 - RNA, 17 nt, Human
auacccacccccaccca

SEQ ID NO: 3314999 - RNA, 13 nt, Human
auacccaccccca

SEQ ID NO: 3315000 - RNA, 16 nt, Human
auacccacccccaccc

SEQ ID NO: 3315001 - RNA, 14 nt, Human
auacccacccccac

SEQ ID NO: 3315002 - RNA, 13 nt, Human
auacacuuacacu

SEQ ID NO: 3315003 - RNA, 22 nt, Human
auacacuuacacuuuaugcaca

SEQ ID NO: 3315004 - RNA, 14 nt, Human
auacaaugcugugc

SEQ ID NO: 3315005 - RNA, 16 nt, Human
auaccugucccccuga

SEQ ID NO: 3315006 - RNA, 15 nt, Human
auaccugucccccug

SEQ ID NO: 3315007 - RNA, 14 nt, Human
auaccugucccccu

SEQ ID NO: 3315008 - RNA, 13 nt, Human
auaccuguccccc

SEQ ID NO: 3315009 - RNA, 23 nt, Human
aguuugauuaaauucuugcaaag

SEQ ID NO: 3315010 - RNA, 22 nt, Human
aguuguuacauuuuuaagugcu

SEQ ID NO: 3315011 - RNA, 20 nt, Human
aguuguuacauuuuuaagug

SEQ ID NO: 3315012 - RNA, 19 nt, Human
aguuguuacauuuuuaagu

SEQ ID NO: 3315013 - RNA, 19 nt, Human
aguuugagaucagccuggg

SEQ ID NO: 3315014 - RNA, 18 nt, Human
aguuugagaucagccugg

SEQ ID NO: 3315015 - RNA, 20 nt, Human
aguuugagaucagccugggc

SEQ ID NO: 3315016 - RNA, 16 nt, Human
aguuugauuaaauucu

SEQ ID NO: 3315017 - RNA, 22 nt, Human
aguuugauuaaauucuugcaaa

SEQ ID NO: 3315018 - RNA, 20 nt, Human
aguuugauuaaauucuugca

SEQ ID NO: 3315019 - RNA, 18 nt, Human
aguuugauuaaauucuug

SEQ ID NO: 3315020 - RNA, 17 nt, Human
aguuugauuaaauucuu

SEQ ID NO: 3315021 - RNA, 12 nt, Human
auaacauguaau

SEQ ID NO: 3315022 - RNA, 13 nt, Human
auaacauguaauu

SEQ ID NO: 3315023 - RNA, 18 nt, Human
auaacauguaauuaagua

SEQ ID NO: 3315024 - RNA, 15 nt, Human
auagcacagacccug

SEQ ID NO: 3315025 - RNA, 18 nt, Human
auagcacagacccugccc

SEQ ID NO: 3315026 - RNA, 17 nt, Human
auagcacagacccugcc

SEQ ID NO: 3315027 - RNA, 15 nt, Human
auagccuaggugaca

SEQ ID NO: 3315028 - RNA, 17 nt, Human
auagccuaggugacaga

SEQ ID NO: 3315029 - RNA, 20 nt, Human
auaugcucugcauguuacau

SEQ ID NO: 3315030 - RNA, 16 nt, Human
auaugcucugcauguu

SEQ ID NO: 3315031 - RNA, 17 nt, Human
auaugcucugcauguua

SEQ ID NO: 3315032 - RNA, 22 nt, Human
auaugcacacauuuuuuaaaug

SEQ ID NO: 3315033 - RNA, 17 nt, Human
auauucaggaagcucag

SEQ ID NO: 3315034 - RNA, 19 nt, Human
auauucaggaagcucaggg

SEQ ID NO: 3315035 - RNA, 16 nt, Human
agugggagcugccugu

SEQ ID NO: 3315036 - RNA, 13 nt, Human
agugauccuccca

SEQ ID NO: 3315037 - RNA, 14 nt, Human
agugauucuccugc

SEQ ID NO: 3315038 - RNA, 18 nt, Human
agugccuuacacaauggu

SEQ ID NO: 3315039 - RNA, 15 nt, Human
agugauucuccugcc

SEQ ID NO: 3315040 - RNA, 17 nt, Human
agugccuuacacaaugg

SEQ ID NO: 3315041 - RNA, 14 nt, Human
agugauccucccac

SEQ ID NO: 3315042 - RNA, 15 nt, Human
agugauccucccacc

SEQ ID NO: 3315043 - RNA, 18 nt, Human
agugauccucccaccuca

SEQ ID NO: 3315044 - RNA, 23 nt, Human
agugauccucccaccucagccuc

SEQ ID NO: 3315045 - RNA, 24 nt, Human
agugauccucccaccucagccucc

SEQ ID NO: 3315046 - RNA, 15 nt, Human
agugccuuauggaac

SEQ ID NO: 3315047 - RNA, 14 nt, Human
agugccuuauggaa

SEQ ID NO: 3315048 - RNA, 13 nt, Human
agugccuuaugga

SEQ ID NO: 3315049 - RNA, 10 nt, Human
agugccuuau

SEQ ID NO: 3315050 - RNA, 16 nt, Human
agugccuuauggaaca

SEQ ID NO: 3315051 - RNA, 16 nt, Human
aguugauacuacaguu

SEQ ID NO: 3315052 - RNA, 13 nt, Human
aguucaucuugaa

SEQ ID NO: 3315053 - RNA, 19 nt, Human
aguucaucuugaauuguaa

SEQ ID NO: 3315054 - RNA, 15 nt, Human
aguucaucuugaauu

SEQ ID NO: 3315055 - RNA, 17 nt, Human
agucugaaggcuggguu

SEQ ID NO: 3315056 - RNA, 19 nt, Human
aguccuuaccagcagagca

SEQ ID NO: 3315057 - RNA, 22 nt, Human
aguccucuuuucugagaggacu

SEQ ID NO: 3315058 - RNA, 20 nt, Human
aguccuuaccagcagagcac

SEQ ID NO: 3315059 - RNA, 19 nt, Human
aguccucuuuucugagagg

SEQ ID NO: 3315060 - RNA, 14 nt, Human
aguccucuuuucug

SEQ ID NO: 3315061 - RNA, 17 nt, Human
aguaugaggcauuuguu

SEQ ID NO: 3315062 - RNA, 23 nt, Human
aguaugaggcauuuguuugaacu

SEQ ID NO: 3315063 - RNA, 21 nt, Human
aguaugaggcauuuguuugaa

SEQ ID NO: 3315064 - RNA, 20 nt, Human
aguaugaggcauuuguuuga

SEQ ID NO: 3315065 - RNA, 22 nt, Human
agucacacaguauuacuucugc

SEQ ID NO: 3315066 - RNA, 16 nt, Human
aggucuguucuuucca

SEQ ID NO: 3315067 - RNA, 15 nt, Human
aggucuguucuuucc

SEQ ID NO: 3315068 - RNA, 13 nt, Human
aggucuguucuuu

SEQ ID NO: 3315069 - RNA, 14 nt, Human
aguacguugugcau

SEQ ID NO: 3315070 - RNA, 15 nt, Human
aguacguugugcauu

SEQ ID NO: 3315071 - RNA, 18 nt, Human
aguacguugugcauuugg

SEQ ID NO: 3315072 - RNA, 17 nt, Human
aguacguugugcauuug

SEQ ID NO: 3315073 - RNA, 16 nt, Human
aguacguugugcauuu

SEQ ID NO: 3315074 - RNA, 14 nt, Human
aguacuauaauuua

SEQ ID NO: 3315075 - RNA, 22 nt, Human
aguacuacaguccucccaucuc

SEQ ID NO: 3315076 - RNA, 19 nt, Human
aguacuacaguccucccau

SEQ ID NO: 3315077 - RNA, 17 nt, Human
aguacuucuccacccug

SEQ ID NO: 3315078 - RNA, 12 nt, Human
aguacuucuuuu

SEQ ID NO: 3315079 - RNA, 22 nt, Human
aguacuucuccacccugcucuc

SEQ ID NO: 3315080 - RNA, 12 nt, Human
aguacuauguau

SEQ ID NO: 3315081 - RNA, 14 nt, Human
aguacuauguauca

SEQ ID NO: 3315082 - RNA, 15 nt, Human
agggacccuccacca

SEQ ID NO: 3315083 - RNA, 18 nt, Human
aggcuuagucacugagac

SEQ ID NO: 3315084 - RNA, 17 nt, Human
aggcuggguucugaucc

SEQ ID NO: 3315085 - RNA, 20 nt, Human
aggcuguaucccaugagccu

SEQ ID NO: 3315086 - RNA, 21 nt, Human
aggcuguaucccaugagccuc

SEQ ID NO: 3315087 - RNA, 22 nt, Human
aggcuguaucccaugagccuca

SEQ ID NO: 3315088 - RNA, 17 nt, Human
aggcuuagucacugaga

SEQ ID NO: 3315089 - RNA, 15 nt, Human
aggcuaccuuuguau

SEQ ID NO: 3315090 - RNA, 14 nt, Human
aggcuaccuuugua

SEQ ID NO: 3315091 - RNA, 13 nt, Human
aggcuaccuuugu

SEQ ID NO: 3315092 - RNA, 18 nt, Human
aggcuggguucugauccu

SEQ ID NO: 3315093 - RNA, 21 nt, Human
aggcccucugcccacucccug

SEQ ID NO: 3315094 - RNA, 23 nt, Human
aggcccucugcccacucccugca

SEQ ID NO: 3315095 - RNA, 22 nt, Human
aggcccucugcccacucccugc

SEQ ID NO: 3315096 - RNA, 12 nt, Human
aggcccuucucu

SEQ ID NO: 3315097 - RNA, 19 nt, Human
aggcccuucucuccagccc

SEQ ID NO: 3315098 - RNA, 15 nt, Human
aggcccuucucucca

SEQ ID NO: 3315099 - RNA, 15 nt, Human
aggccaggcccucug

SEQ ID NO: 3315100 - RNA, 14 nt, Human
aggccaggcccucu

SEQ ID NO: 3315101 - RNA, 13 nt, Human
aggccaggcccuc

SEQ ID NO: 3315102 - RNA, 23 nt, Human
aggccagcugcuugggcuucauc

SEQ ID NO: 3315103 - RNA, 20 nt, Human
aggcauuccccaggaggcca

SEQ ID NO: 3315104 - RNA, 19 nt, Human
aggcauuccccaggaggcc

SEQ ID NO: 3315105 - RNA, 15 nt, Human
aggcaugguggccca

SEQ ID NO: 3315106 - RNA, 17 nt, Human
aggcaugugaugagagg

SEQ ID NO: 3315107 - RNA, 17 nt, Human
aggcauguucucugagg

SEQ ID NO: 3315108 - RNA, 21 nt, Human
aggcaugugaugagaggaaau

SEQ ID NO: 3315109 - RNA, 20 nt, Human
aggcaugugaugagaggaaa

SEQ ID NO: 3315110 - RNA, 19 nt, Human
aggcaugugaugagaggaa

SEQ ID NO: 3315111 - RNA, 18 nt, Human
aggcauguucucugagga

SEQ ID NO: 3315112 - RNA, 19 nt, Human
aggcauguucucugaggac

SEQ ID NO: 3315113 - RNA, 12 nt, Human
aggcauguucuc

SEQ ID NO: 3315114 - RNA, 17 nt, Human
aggcauuccccaggagg

SEQ ID NO: 3315115 - RNA, 18 nt, Human
aggcauuccccaggaggc

SEQ ID NO: 3315116 - RNA, 14 nt, Human
agggccugcaaggg

SEQ ID NO: 3315117 - RNA, 15 nt, Human
agggccugcaaggga

SEQ ID NO: 3315118 - RNA, 13 nt, Human
agggccuggccug

SEQ ID NO: 3315119 - RNA, 12 nt, Human
agggccuggccu

SEQ ID NO: 3315120 - RNA, 16 nt, Human
agggauacccauccca

SEQ ID NO: 3315121 - RNA, 15 nt, Human
aggguaucuggugac

SEQ ID NO: 3315122 - RNA, 21 nt, Human
aggguaucuggugacuuuccu

SEQ ID NO: 3315123 - RNA, 13 nt, Human
aggguauuccaga

SEQ ID NO: 3315124 - RNA, 14 nt, Human
agggucccuggugg

SEQ ID NO: 3315125 - RNA, 12 nt, Human
agggucccuggu

SEQ ID NO: 3315126 - RNA, 22 nt, Human
agggucccugguggcagcucac

SEQ ID NO: 3315127 - RNA, 20 nt, Human
agggucccugguggcagcuc

SEQ ID NO: 3315128 - RNA, 17 nt, Human
agggucccugguggcag

SEQ ID NO: 3315129 - RNA, 16 nt, Human
agggucccugguggca

SEQ ID NO: 3315130 - RNA, 22 nt, Human
aggggcccaaauucuuucagug

SEQ ID NO: 3315131 - RNA, 21 nt, Human
aggggccucuuaugggcuggg

SEQ ID NO: 3315132 - RNA, 22 nt, Human
aggguuuugccauguuggccag

SEQ ID NO: 3315133 - RNA, 22 nt, Human
agguacgaaaagaggggaagag

SEQ ID NO: 3315134 - RNA, 16 nt, Human
agguaacaggcagaua

SEQ ID NO: 3315135 - RNA, 13 nt, Human
agguaacaggcag

SEQ ID NO: 3315136 - RNA, 14 nt, Human
agguaacaggcaga

SEQ ID NO: 3315137 - RNA, 13 nt, Human
agguacucuccug

SEQ ID NO: 3315138 - RNA, 14 nt, Human
agguacucuccugg

SEQ ID NO: 3315139 - RNA, 22 nt, Human
aggaauaccugucccccugaca

SEQ ID NO: 3315140 - RNA, 18 nt, Human
aggaauaccugucccccu

SEQ ID NO: 3315141 - RNA, 15 nt, Human
aggaauaccuguccc

SEQ ID NO: 3315142 - RNA, 21 nt, Human
aggaacuuaaauaaugugaaa

SEQ ID NO: 3315143 - RNA, 20 nt, Human
aggaacaaggcaaggcuguc

SEQ ID NO: 3315144 - RNA, 19 nt, Human
aggaacaaggcaaggcugu

SEQ ID NO: 3315145 - RNA, 17 nt, Human
aggaacaaggcaaggcu

SEQ ID NO: 3315146 - RNA, 16 nt, Human
aggaacaaggcaaggc

SEQ ID NO: 3315147 - RNA, 13 nt, Human
aggaacaaggcaa

SEQ ID NO: 3315148 - RNA, 12 nt, Human
aggaacaaggca

SEQ ID NO: 3315149 - RNA, 23 nt, Human
agcuuuguuuguugucagcugaa

SEQ ID NO: 3315150 - RNA, 22 nt, Human
agcuuuguuuguugucagcuga

SEQ ID NO: 3315151 - RNA, 19 nt, Human
agcuucauuuccugugucu

SEQ ID NO: 3315152 - RNA, 18 nt, Human
agcuucauuuccuguguc

SEQ ID NO: 3315153 - RNA, 15 nt, Human
aggagaggagagggg

SEQ ID NO: 3315154 - RNA, 19 nt, Human
agcgagcccugguggcagu

SEQ ID NO: 3315155 - RNA, 13 nt, Human
agcgagcccuggu

SEQ ID NO: 3315156 - RNA, 12 nt, Human
agccugggaggu

SEQ ID NO: 3315157 - RNA, 16 nt, Human
agcucaccagccccag

SEQ ID NO: 3315158 - RNA, 15 nt, Human
agcuaaugggacacu

SEQ ID NO: 3315159 - RNA, 12 nt, Human
agcucagagagg

SEQ ID NO: 3315160 - RNA, 14 nt, Human
agcucagagagggu

SEQ ID NO: 3315161 - RNA, 18 nt, Human
agcucagagaggguggga

SEQ ID NO: 3315162 - RNA, 19 nt, Human
agcucaccagccccagugc

SEQ ID NO: 3315163 - RNA, 15 nt, Human
agcucaccagcccca

SEQ ID NO: 3315164 - RNA, 12 nt, Human
agcucaccucuc

SEQ ID NO: 3315165 - RNA, 19 nt, Human
agcucaccucucccuugga

SEQ ID NO: 3315166 - RNA, 18 nt, Human
agcucaccucucccuugg

SEQ ID NO: 3315167 - RNA, 15 nt, Human
agcucaccucucccu

SEQ ID NO: 3315168 - RNA, 15 nt, Human
agcugaaccugggua

SEQ ID NO: 3315169 - RNA, 12 nt, Human
agcugcugacag

SEQ ID NO: 3315170 - RNA, 19 nt, Human
agcugcgguccacccagga

SEQ ID NO: 3315171 - RNA, 20 nt, Human
agcugcgguccacccaggag

SEQ ID NO: 3315172 - RNA, 13 nt, Human
agcugcgguccac

SEQ ID NO: 3315173 - RNA, 16 nt, Human
agcugcgguccaccca

SEQ ID NO: 3315174 - RNA, 17 nt, Human
agcugcgguccacccag

SEQ ID NO: 3315175 - RNA, 18 nt, Human
agcugcgguccacccagg

SEQ ID NO: 3315176 - RNA, 22 nt, Human
agcugguuuuuagcggagacgg

SEQ ID NO: 3315177 - RNA, 16 nt, Human
agcugguugagguuuc

SEQ ID NO: 3315178 - RNA, 18 nt, Human
agcuggucccacucaguc

SEQ ID NO: 3315179 - RNA, 13 nt, Human
agcugcugacagu

SEQ ID NO: 3315180 - RNA, 14 nt, Human
agcugcugacagug

SEQ ID NO: 3315181 - RNA, 16 nt, Human
agcuggucccacucag

SEQ ID NO: 3315182 - RNA, 17 nt, Human
agcuggucccacucagu

SEQ ID NO: 3315183 - RNA, 14 nt, Human
agaugagugagcau

SEQ ID NO: 3315184 - RNA, 20 nt, Human
agcaaaggagauuggaagga

SEQ ID NO: 3315185 - RNA, 18 nt, Human
agcaaaagaugcuucuca

SEQ ID NO: 3315186 - RNA, 18 nt, Human
agauucuuuccugaggcu

SEQ ID NO: 3315187 - RNA, 21 nt, Human
agauucuuuccugaggcuggg

SEQ ID NO: 3315188 - RNA, 19 nt, Human
agauucuuuccugaggcug

SEQ ID NO: 3315189 - RNA, 19 nt, Human
agauugcaacaggcugggc

SEQ ID NO: 3315190 - RNA, 23 nt, Human
agauugcaacaggcugggcuuca

SEQ ID NO: 3315191 - RNA, 20 nt, Human
agauugcaacaggcugggcu

SEQ ID NO: 3315192 - RNA, 21 nt, Human
agauugcaacaggcugggcuu

SEQ ID NO: 3315193 - RNA, 12 nt, Human
agcacagacccu

SEQ ID NO: 3315194 - RNA, 15 nt, Human
agcacagacccugcc

SEQ ID NO: 3315195 - RNA, 14 nt, Human
agcacagacccugc

SEQ ID NO: 3315196 - RNA, 16 nt, Human
agcacagacccugccc

SEQ ID NO: 3315197 - RNA, 17 nt, Human
agcacgauuucuguuua

SEQ ID NO: 3315198 - RNA, 21 nt, Human
agcacgauuucuguuuagaua

SEQ ID NO: 3315199 - RNA, 19 nt, Human
agcacgauuucuguuuaga

SEQ ID NO: 3315200 - RNA, 24 nt, Human
agccccaaaacucuccucugcugc

SEQ ID NO: 3315201 - RNA, 20 nt, Human
agcccgggcucugccuccca

SEQ ID NO: 3315202 - RNA, 18 nt, Human
agcccgggcucugccucc

SEQ ID NO: 3315203 - RNA, 17 nt, Human
agcccgggcucugccuc

SEQ ID NO: 3315204 - RNA, 15 nt, Human
agccccauccucugu

SEQ ID NO: 3315205 - RNA, 23 nt, Human
agccccauccucuguacagagcc

SEQ ID NO: 3315206 - RNA, 17 nt, Human
agccccauccucuguac

SEQ ID NO: 3315207 - RNA, 11 nt, Human
agccccauccu

SEQ ID NO: 3315208 - RNA, 17 nt, Human
agccccauucugccugc

SEQ ID NO: 3315209 - RNA, 18 nt, Human
agccccauucugccugcc

SEQ ID NO: 3315210 - RNA, 19 nt, Human
agccccauucugccugccc

SEQ ID NO: 3315211 - RNA, 13 nt, Human
agcauccuggcac

SEQ ID NO: 3315212 - RNA, 23 nt, Human
agcccacgcccccacuggugaca

SEQ ID NO: 3315213 - RNA, 20 nt, Human
agcccacgcccccacuggug

SEQ ID NO: 3315214 - RNA, 14 nt, Human
agcccacgccccca

SEQ ID NO: 3315215 - RNA, 16 nt, Human
agcccaccuuggcuca

SEQ ID NO: 3315216 - RNA, 14 nt, Human
agcccaccuuggcu

SEQ ID NO: 3315217 - RNA, 15 nt, Human
agcccaccccucaac

SEQ ID NO: 3315218 - RNA, 16 nt, Human
agccagcaggcucuca

SEQ ID NO: 3315219 - RNA, 11 nt, Human
agccagaggag

SEQ ID NO: 3315220 - RNA, 15 nt, Human
agccagaggagagag

SEQ ID NO: 3315221 - RNA, 13 nt, Human
agccagaggagag

SEQ ID NO: 3315222 - RNA, 17 nt, Human
agccagaggagagagga

SEQ ID NO: 3315223 - RNA, 14 nt, Human
agccagcaggcucu

SEQ ID NO: 3315224 - RNA, 14 nt, Human
agcauccuggcacc

SEQ ID NO: 3315225 - RNA, 17 nt, Human
agcauccuggcacccgg

SEQ ID NO: 3315226 - RNA, 16 nt, Human
agccaaagcuaggccu

SEQ ID NO: 3315227 - RNA, 18 nt, Human
agaaugaaagggcccaga

SEQ ID NO: 3315228 - RNA, 16 nt, Human
agaaugaaagggccca

SEQ ID NO: 3315229 - RNA, 19 nt, Human
agaaugcacaaacagaggc

SEQ ID NO: 3315230 - RNA, 23 nt, Human
agaagagaaugcacaaacagagg

SEQ ID NO: 3315231 - RNA, 13 nt, Human
agaagacacugau

SEQ ID NO: 3315232 - RNA, 21 nt, Human
agaagacacugaugggcaacc

SEQ ID NO: 3315233 - RNA, 14 nt, Human
agaaguaacuuacu

SEQ ID NO: 3315234 - RNA, 21 nt, Human
agacagagucucacuguugcc

SEQ ID NO: 3315235 - RNA, 22 nt, Human
agacagauacuccuccaagguu

SEQ ID NO: 3315236 - RNA, 15 nt, Human
agaccacguuucuaa

SEQ ID NO: 3315237 - RNA, 20 nt, Human
agacaaugacuuacuguaca

SEQ ID NO: 3315238 - RNA, 11 nt, Human
agacagagucu

SEQ ID NO: 3315239 - RNA, 13 nt, Human
agacagagcuaca

SEQ ID NO: 3315240 - RNA, 19 nt, Human
agacagagucucacuguug

SEQ ID NO: 3315241 - RNA, 20 nt, Human
agacagagucucacuguugc

SEQ ID NO: 3315242 - RNA, 15 nt, Human
agacagagcuacaca

SEQ ID NO: 3315243 - RNA, 19 nt, Human
agacaaugacuuacuguac

SEQ ID NO: 3315244 - RNA, 22 nt, Human
agacaaugacuuacuguacaug

SEQ ID NO: 3315245 - RNA, 21 nt, Human
agacaaugacuuacuguacau

SEQ ID NO: 3315246 - RNA, 20 nt, Human
agacugaguacguugugcau

SEQ ID NO: 3315247 - RNA, 22 nt, Human
agacugaguacguugugcauuu

SEQ ID NO: 3315248 - RNA, 18 nt, Human
agacucugucucaaaaaa

SEQ ID NO: 3315249 - RNA, 13 nt, Human
agacucugucuca

SEQ ID NO: 3315250 - RNA, 16 nt, Human
agacgcugugcugccc

SEQ ID NO: 3315251 - RNA, 13 nt, Human
agagccagggucu

SEQ ID NO: 3315252 - RNA, 16 nt, Human
agagagaccacuuuuc

SEQ ID NO: 3315253 - RNA, 16 nt, Human
agagggccugcaaggg

SEQ ID NO: 3315254 - RNA, 13 nt, Human
agagggccugcaa

SEQ ID NO: 3315255 - RNA, 19 nt, Human
agaggggguggccucccaa

SEQ ID NO: 3315256 - RNA, 17 nt, Human
agaggggguggccuccc

SEQ ID NO: 3315257 - RNA, 14 nt, Human
agaggacuuuucuu

SEQ ID NO: 3315258 - RNA, 21 nt, Human
agaggacuuuucuuuguggcu

SEQ ID NO: 3315259 - RNA, 22 nt, Human
agaggacuuuucuuuguggcuu

SEQ ID NO: 3315260 - RNA, 14 nt, Human
aaaggcuccaggag

SEQ ID NO: 3315261 - RNA, 14 nt, Human
aaaggcuaccuuug

SEQ ID NO: 3315262 - RNA, 17 nt, Human
aaaggcuaccuuuguau

SEQ ID NO: 3315263 - RNA, 21 nt, Human
aaaggcuccaggagcagccac

SEQ ID NO: 3315264 - RNA, 20 nt, Human
aaaggcuccaggagcagcca

SEQ ID NO: 3315265 - RNA, 22 nt, Human
aaaggcuccaggagcagccaca

SEQ ID NO: 3315266 - RNA, 15 nt, Human
aaagccaaagcuagg

SEQ ID NO: 3315267 - RNA, 11 nt, Human
aaauaaauuau

SEQ ID NO: 3315268 - RNA, 17 nt, Human
aaaccccaucucuacaa

SEQ ID NO: 3315269 - RNA, 18 nt, Human
aaacccagcucuggucca

SEQ ID NO: 3315270 - RNA, 17 nt, Human
aaacucuugaccucagg

SEQ ID NO: 3315271 - RNA, 14 nt, Human
aaacccuucagugc

SEQ ID NO: 3315272 - RNA, 19 nt, Human
aaacugauuuuuuuuuccu

SEQ ID NO: 3315273 - RNA, 13 nt, Human
aaacugauuuuuu

SEQ ID NO: 3315274 - RNA, 20 nt, Human
aaacugauuuuuuuuuccuu

SEQ ID NO: 3315275 - RNA, 15 nt, Human
aaagauacaguuacu

SEQ ID NO: 3315276 - RNA, 15 nt, Human
aaaauuagccaagug

SEQ ID NO: 3315277 - RNA, 17 nt, Human
aaacagcuaaugggaca

SEQ ID NO: 3315278 - RNA, 14 nt, Human
aaauuaacuuuuau

SEQ ID NO: 3315279 - RNA, 13 nt, Human
aaauuaacuuuua

SEQ ID NO: 3315280 - RNA, 12 nt, Human
aaauuaacuuuu

SEQ ID NO: 3315281 - RNA, 22 nt, Human
aacaaaccuguuucugcagcca

SEQ ID NO: 3315282 - RNA, 21 nt, Human
aacacauacaggaagguagaa

SEQ ID NO: 3315283 - RNA, 19 nt, Human
aaaucuccaaaauaaaacu

SEQ ID NO: 3315284 - RNA, 22 nt, Human
aaaucuccaaaauaaaacuuuu

SEQ ID NO: 3315285 - RNA, 14 nt, Human
aaauggacguguua

SEQ ID NO: 3315286 - RNA, 17 nt, Human
aaauggacguguuauga

SEQ ID NO: 3315287 - RNA, 15 nt, Human
aaauggacguguuau

SEQ ID NO: 3315288 - RNA, 17 nt, Human
aacucaaacucuuaaaa

SEQ ID NO: 3315289 - RNA, 17 nt, Human
aacucaccccagcccca

SEQ ID NO: 3315290 - RNA, 16 nt, Human
aacucaccccagcccc

SEQ ID NO: 3315291 - RNA, 18 nt, Human
aacucaccccagccccaa

SEQ ID NO: 3315292 - RNA, 15 nt, Human
aacucaccccagccc

SEQ ID NO: 3315293 - RNA, 22 nt, Human
aacaugcuacacacugcauguu

SEQ ID NO: 3315294 - RNA, 15 nt, Human
aacauggaaguacua

SEQ ID NO: 3315295 - RNA, 13 nt, Human
aacccuucagugc

SEQ ID NO: 3315296 - RNA, 17 nt, Human
aaccaguguuguggauu

SEQ ID NO: 3315297 - RNA, 19 nt, Human
aaccaguguuguggauuua

SEQ ID NO: 3315298 - RNA, 16 nt, Human
aacagcuaaugggaca

SEQ ID NO: 3315299 - RNA, 13 nt, Human
aagugcugcauuu

SEQ ID NO: 3315300 - RNA, 19 nt, Human
aauaauguuaacauggaca

SEQ ID NO: 3315301 - RNA, 21 nt, Human
aauaccugucccccugacaac

SEQ ID NO: 3315302 - RNA, 18 nt, Human
aaucuccaaaauaaaacu

SEQ ID NO: 3315303 - RNA, 15 nt, Human
aaugauagcuacugu

SEQ ID NO: 3315304 - RNA, 13 nt, Human
aaugauuaauuaa

SEQ ID NO: 3315305 - RNA, 12 nt, Human
aaugauuaauua

SEQ ID NO: 3315306 - RNA, 23 nt, Human
aaugcgugcauaccacuuuuguu

SEQ ID NO: 3315307 - RNA, 21 nt, Human
aaugcgugcauaccacuuuug

SEQ ID NO: 3315308 - RNA, 13 nt, Human
aaugggacacuaa

SEQ ID NO: 3315309 - RNA, 14 nt, Human
aaugggagcucaug

SEQ ID NO: 3315310 - RNA, 17 nt, Human
aaugggggugcauuuga

SEQ ID NO: 3315311 - RNA, 15 nt, Human
aaugggggugcauuu

SEQ ID NO: 3315312 - RNA, 15 nt, Human
aaugucacaggcagg

SEQ ID NO: 3315313 - RNA, 20 nt, Human
aagggacuuggaagcuccgc

SEQ ID NO: 3315314 - RNA, 18 nt, Human
aagggacgcuacccggga

SEQ ID NO: 3315315 - RNA, 21 nt, Human
aagccaccaacauacucccau

SEQ ID NO: 3315316 - RNA, 18 nt, Human
aagccagcaggcucucag

SEQ ID NO: 3315317 - RNA, 15 nt, Human
aagccagcaggcucu

SEQ ID NO: 3315318 - RNA, 15 nt, Human
aagcgauucuucugc

SEQ ID NO: 3315319 - RNA, 14 nt, Human
aagcgauucuucug

SEQ ID NO: 3315320 - RNA, 16 nt, Human
aagcgugagccacugc

SEQ ID NO: 3315321 - RNA, 16 nt, Human
aagcgauucuucugcu

SEQ ID NO: 3315322 - RNA, 17 nt, Human
aagcgugagccacugca

SEQ ID NO: 3315323 - RNA, 20 nt, Human
aagcgugagccacugcaccg

SEQ ID NO: 3315324 - RNA, 14 nt, Human
aagcugcugacagu

SEQ ID NO: 3315325 - RNA, 22 nt, Human
aagcugccagccgagauagcca

SEQ ID NO: 3315326 - RNA, 12 nt, Human
aagcugccagcc

SEQ ID NO: 3315327 - RNA, 11 nt, Human
aagcugccagc

SEQ ID NO: 3315328 - RNA, 16 nt, Human
aagcugcugacagugu

SEQ ID NO: 3315329 - RNA, 23 nt, Human
aaggaaugauuaauuaaaacaca

SEQ ID NO: 3315330 - RNA, 21 nt, Human
aagcagaggaaggagaggaga

SEQ ID NO: 3315331 - RNA, 19 nt, Human
aagccaccaacauacuccc

SEQ ID NO: 3315332 - RNA, 19 nt, Human
aagauuuugaaauuuuuau

SEQ ID NO: 3315333 - RNA, 20 nt, Human
aagauucauauuuacuucuu

SEQ ID NO: 3315334 - RNA, 16 nt, Human
aagacuuuggaaagac

SEQ ID NO: 3315335 - RNA, 16 nt, Human
aagacuuuggaaagag

SEQ ID NO: 3315336 - RNA, 14 nt, Human
acuuaaauaaugug

SEQ ID NO: 3315337 - RNA, 19 nt, Human
acuucugccauauucuguu

SEQ ID NO: 3315338 - RNA, 20 nt, Human
acuucugccauauucuguug

SEQ ID NO: 3315339 - RNA, 17 nt, Human
acuucuuauacauuuga

SEQ ID NO: 3315340 - RNA, 21 nt, Human
acucugugucagguggggcag

SEQ ID NO: 3315341 - RNA, 19 nt, Human
acucugugucagguggggc

SEQ ID NO: 3315342 - RNA, 19 nt, Human
acucugucucaaaaaaaca

SEQ ID NO: 3315343 - RNA, 12 nt, Human
acugaugggcaa

SEQ ID NO: 3315344 - RNA, 22 nt, Human
acugaugggcaacccccagccu

SEQ ID NO: 3315345 - RNA, 22 nt, Human
acugauggcuaauguacugcau

SEQ ID NO: 3315346 - RNA, 13 nt, Human
acugaucucucgu

SEQ ID NO: 3315347 - RNA, 22 nt, Human
acugacauuguuggccaaagcc

SEQ ID NO: 3315348 - RNA, 23 nt, Human
acugacauuguuggccaaagcca

SEQ ID NO: 3315349 - RNA, 22 nt, Human
acugauuuuuuuuuccuucagu

SEQ ID NO: 3315350 - RNA, 21 nt, Human
acugauuuuuuuuuccuucag

SEQ ID NO: 3315351 - RNA, 20 nt, Human
acugauuuuuuuuuccuuca

SEQ ID NO: 3315352 - RNA, 23 nt, Human
acugauuuuuuuuuccuucagug

SEQ ID NO: 3315353 - RNA, 22 nt, Human
acugcccggcaggguccuagaa

SEQ ID NO: 3315354 - RNA, 14 nt, Human
acugcuuuuggucu

SEQ ID NO: 3315355 - RNA, 15 nt, Human
acugcuuuuggucug

SEQ ID NO: 3315356 - RNA, 16 nt, Human
acugcuuuuggucugu

SEQ ID NO: 3315357 - RNA, 15 nt, Human
acugcccggcagggu

SEQ ID NO: 3315358 - RNA, 19 nt, Human
acggacacucaaaagcugg

SEQ ID NO: 3315359 - RNA, 16 nt, Human
acggaagagccuugcg

SEQ ID NO: 3315360 - RNA, 15 nt, Human
acggaagagccuugc

SEQ ID NO: 3315361 - RNA, 19 nt, Human
acgcuggagugcagugagc

SEQ ID NO: 3315362 - RNA, 18 nt, Human
acgcuggagugcagugag

SEQ ID NO: 3315363 - RNA, 15 nt, Human
acgucugacaggcaa

SEQ ID NO: 3315364 - RNA, 23 nt, Human
acgucugacaggcaaugcuggcu

SEQ ID NO: 3315365 - RNA, 15 nt, Human
acuaauagacaauuu

SEQ ID NO: 3315366 - RNA, 11 nt, Human
accugugucuc

SEQ ID NO: 3315367 - RNA, 16 nt, Human
acuauuguuagucucu

SEQ ID NO: 3315368 - RNA, 17 nt, Human
acuagggaagauaauau

SEQ ID NO: 3315369 - RNA, 15 nt, Human
accgggccacagaga

SEQ ID NO: 3315370 - RNA, 19 nt, Human
accgggccacagagaaagu

SEQ ID NO: 3315371 - RNA, 14 nt, Human
accgugaggccaga

SEQ ID NO: 3315372 - RNA, 20 nt, Human
accgggcacucagaagacac

SEQ ID NO: 3315373 - RNA, 18 nt, Human
accggcuggccuggcccc

SEQ ID NO: 3315374 - RNA, 17 nt, Human
accggcuggccuggccc

SEQ ID NO: 3315375 - RNA, 15 nt, Human
accggcuggccuggc

SEQ ID NO: 3315376 - RNA, 14 nt, Human
accggcuggccugg

SEQ ID NO: 3315377 - RNA, 15 nt, Human
acccaugcugcccug

SEQ ID NO: 3315378 - RNA, 14 nt, Human
acccaugcugcccu

SEQ ID NO: 3315379 - RNA, 16 nt, Human
accccacacacgccag

SEQ ID NO: 3315380 - RNA, 21 nt, Human
acccugugauggggcccugcc

SEQ ID NO: 3315381 - RNA, 22 nt, Human
acccugugauggggcccugccu

SEQ ID NO: 3315382 - RNA, 17 nt, Human
acccuguuaccauuuug

SEQ ID NO: 3315383 - RNA, 18 nt, Human
accucaggugagaagcag

SEQ ID NO: 3315384 - RNA, 22 nt, Human
accucaggccugggggcugggc

SEQ ID NO: 3315385 - RNA, 14 nt, Human
accucaggccuggg

SEQ ID NO: 3315386 - RNA, 13 nt, Human
accucaggccugg

SEQ ID NO: 3315387 - RNA, 12 nt, Human
accucaggccug

SEQ ID NO: 3315388 - RNA, 17 nt, Human
accgugaggccagagac

SEQ ID NO: 3315389 - RNA, 16 nt, Human
accgugaggccagaga

SEQ ID NO: 3315390 - RNA, 20 nt, Human
accucuugagccuugaacuu

SEQ ID NO: 3315391 - RNA, 19 nt, Human
accucuugagccuugaacu

SEQ ID NO: 3315392 - RNA, 17 nt, Human
accucuugagccuugaa

SEQ ID NO: 3315393 - RNA, 18 nt, Human
accugccagggacagagg

SEQ ID NO: 3315394 - RNA, 16 nt, Human
accugccagggacaga

SEQ ID NO: 3315395 - RNA, 15 nt, Human
accugccagggacag

SEQ ID NO: 3315396 - RNA, 13 nt, Human
accugccagggac

SEQ ID NO: 3315397 - RNA, 12 nt, Human
accugccaggga

SEQ ID NO: 3315398 - RNA, 11 nt, Human
accugccaggg

SEQ ID NO: 3315399 - RNA, 22 nt, Human
acaaaaugaaacgcaaccacca

SEQ ID NO: 3315400 - RNA, 13 nt, Human
acaaaaugaaacg

SEQ ID NO: 3315401 - RNA, 14 nt, Human
aauuuugauguuuu

SEQ ID NO: 3315402 - RNA, 17 nt, Human
aauuuauuauggcacau

SEQ ID NO: 3315403 - RNA, 20 nt, Human
aauuuauuuaugggauccug

SEQ ID NO: 3315404 - RNA, 12 nt, Human
aauuguaaggaa

SEQ ID NO: 3315405 - RNA, 16 nt, Human
aaugucacaggcaggu

SEQ ID NO: 3315406 - RNA, 19 nt, Human
aaugucacaggcaggucca

SEQ ID NO: 3315407 - RNA, 13 nt, Human
acagaggcagccc

SEQ ID NO: 3315408 - RNA, 23 nt, Human
acagaggcagccccauucugccu

SEQ ID NO: 3315409 - RNA, 17 nt, Human
acagaggccaugggccu

SEQ ID NO: 3315410 - RNA, 14 nt, Human
acagaggggguggc

SEQ ID NO: 3315411 - RNA, 21 nt, Human
acagaggccaugggccuccug

SEQ ID NO: 3315412 - RNA, 13 nt, Human
acagacaaagcgu

SEQ ID NO: 3315413 - RNA, 14 nt, Human
acagacaaagcgug

SEQ ID NO: 3315414 - RNA, 22 nt, Human
acacugugcugagucugaaggc

SEQ ID NO: 3315415 - RNA, 17 nt, Human
acacugugcugagucug

SEQ ID NO: 3315416 - RNA, 16 nt, Human
acaaggauugcuacug

SEQ ID NO: 3315417 - RNA, 20 nt, Human
acaaggaugaucuaggaaga

SEQ ID NO: 3315418 - RNA, 13 nt, Human
acaauuuauuaug

SEQ ID NO: 3315419 - RNA, 19 nt, Human
acacagcucuucuccaggc

SEQ ID NO: 3315420 - RNA, 19 nt, Human
acacaaaaguuucucuuuu

SEQ ID NO: 3315421 - RNA, 20 nt, Human
acacagcucuucuccaggcu

SEQ ID NO: 3315422 - RNA, 21 nt, Human
acacagcucuucuccaggcug

SEQ ID NO: 3315423 - RNA, 12 nt, Human
acacauuuuucu

SEQ ID NO: 3315424 - RNA, 14 nt, Human
acacauuuuuuaaa

SEQ ID NO: 3315425 - RNA, 14 nt, Human
acacgaauauugcu

SEQ ID NO: 3315426 - RNA, 12 nt, Human
acacgaauauug

SEQ ID NO: 3315427 - RNA, 20 nt, Human
acaccacuacauucuguuaa

SEQ ID NO: 3315428 - RNA, 17 nt, Human
acaccacuacauucugu

SEQ ID NO: 3315429 - RNA, 15 nt, Human
acaccacuacauucu

SEQ ID NO: 3315430 - RNA, 14 nt, Human
acaccacuacauuc

SEQ ID NO: 3315431 - RNA, 18 nt, Human
acacauuuuuuaaaugca

SEQ ID NO: 3315432 - RNA, 16 nt, Human
acacauuuuuuaaaug

SEQ ID NO: 3315433 - RNA, 21 nt, Human
acacgaauauugcugauggug

SEQ ID NO: 3315434 - RNA, 15 nt, Human
acacgaauauugcug

SEQ ID NO: 3315435 - RNA, 22 nt, Human
acagugagucgaggacagggag

SEQ ID NO: 3315436 - RNA, 22 nt, Human
acaggugugagucaccaagccc

SEQ ID NO: 3315437 - RNA, 23 nt, Human
acaggugugagucaccaagccca

SEQ ID NO: 3315438 - RNA, 19 nt, Human
acaggcaagcaccuccugc

SEQ ID NO: 3315439 - RNA, 15 nt, Human
acagcuccuucuguc

SEQ ID NO: 3315440 - RNA, 19 nt, Human
acagaggggguggccuccc

SEQ ID NO: 3315441 - RNA, 18 nt, Human
acagaggggguggccucc

SEQ ID NO: 3315442 - RNA, 17 nt, Human
acagaggggguggccuc

SEQ ID NO: 3315443 - RNA, 16 nt, Human
acagcuccuucugucc

SEQ ID NO: 3315444 - RNA, 18 nt, Human
acagcuccuucuguccua

SEQ ID NO: 3315445 - RNA, 14 nt, Human
acagcucuguccug

SEQ ID NO: 3315446 - RNA, 20 nt, Human
acaggcaagcaccuccugcc

SEQ ID NO: 3315447 - RNA, 23 nt, Human
acaggcaagcaccuccugccucg

SEQ ID NO: 3315448 - RNA, 16 nt, Human
acagcucuguccuggg

SEQ ID NO: 3315449 - RNA, 13 nt, Human
acagcucuguccu

SEQ ID NO: 3315450 - RNA, 15 nt, Human
acauaagauaaaugu

SEQ ID NO: 3315451 - RNA, 16 nt, Human
acauaagauaaaugug

SEQ ID NO: 3315452 - RNA, 16 nt, Human
acaugcaaggucauuu

SEQ ID NO: 3315453 - RNA, 18 nt, Human
acaugccucucucaggcc

SEQ ID NO: 3315454 - RNA, 17 nt, Human
acaugccucucucaggc

SEQ ID NO: 3315455 - RNA, 16 nt, Human
acaugccucucucagg

SEQ ID NO: 3315456 - RNA, 15 nt, Human
acaugccucucucag

SEQ ID NO: 3315457 - RNA, 17 nt, Human
acaugcaaggucauuuu

SEQ ID NO: 3315458 - RNA, 20 nt, Human
accagccccagugcccacag

SEQ ID NO: 3315459 - RNA, 18 nt, Human
accagccccagugcccac

SEQ ID NO: 3315460 - RNA, 19 nt, Human
accagccccagugcccaca

SEQ ID NO: 3315461 - RNA, 16 nt, Human
accagccccagugccc

SEQ ID NO: 3315462 - RNA, 17 nt, Human
accagccccagugccca

SEQ ID NO: 3315463 - RNA, 13 nt, Human
accagcagagcac

SEQ ID NO: 3315464 - RNA, 12 nt, Human
accagcagagca

SEQ ID NO: 3315465 - RNA, 14 nt, Human
accagcagaaaugc

SEQ ID NO: 3315466 - RNA, 19 nt, Human
acaugccucucucaggcca

SEQ ID NO: 3315467 - RNA, 21 nt, Human
acaugucuuuucuugcaugag

SEQ ID NO: 3315468 - RNA, 23 nt, Human
acaugucuuuucuugcaugaggc

SEQ ID NO: 3315469 - RNA, 23 nt, Human
accaucauugaaaucuuuuugcu

SEQ ID NO: 3315470 - RNA, 15 nt, Human
accaucaagccacca

SEQ ID NO: 3315471 - RNA, 12 nt, Human
accaucauugaa

SEQ ID NO: 3315472 - RNA, 15 nt, Human
accaucauugaaauc

SEQ ID NO: 3315473 - RNA, 14 nt, Human
accaucaagccacc

SEQ ID NO: 3315474 - RNA, 13 nt, Human
acccaugcugccc

SEQ ID NO: 3315475 - RNA, 15 nt, Human
acccacccuccuuuc

SEQ ID NO: 3315476 - RNA, 17 nt, Human
acccacccccacccaag

SEQ ID NO: 3315477 - RNA, 15 nt, Human
acccacccccaccca

SEQ ID NO: 3315478 - RNA, 17 nt, Human
cugggcagaaggaagac

SEQ ID NO: 3315479 - RNA, 18 nt, Human
cugggcagaaggaagacu

SEQ ID NO: 3315480 - RNA, 16 nt, Human
cugggcagaaggaaga

SEQ ID NO: 3315481 - RNA, 16 nt, Human
cuggggccgaaagaac

SEQ ID NO: 3315482 - RNA, 23 nt, Human
cuggugacuuuccucuuuggucu

SEQ ID NO: 3315483 - RNA, 14 nt, Human
cuggguucacugca

SEQ ID NO: 3315484 - RNA, 21 nt, Human
cuggugacuuuccucuuuggu

SEQ ID NO: 3315485 - RNA, 20 nt, Human
cuggugacuuuccucuuugg

SEQ ID NO: 3315486 - RNA, 15 nt, Human
cuggugacuuuccuc

SEQ ID NO: 3315487 - RNA, 16 nt, Human
cuggguguggcgcagc

SEQ ID NO: 3315488 - RNA, 17 nt, Human
cuggguguggcgcagca

SEQ ID NO: 3315489 - RNA, 22 nt, Human
cuggguggcaccagcagccugg

SEQ ID NO: 3315490 - RNA, 23 nt, Human
cuggguggcaccagcagccugga

SEQ ID NO: 3315491 - RNA, 21 nt, Human
cuggccccucagggucccugg

SEQ ID NO: 3315492 - RNA, 20 nt, Human
cuggccccucagggucccug

SEQ ID NO: 3315493 - RNA, 18 nt, Human
cuggccccucaggguccc

SEQ ID NO: 3315494 - RNA, 17 nt, Human
cuggccccucagggucc

SEQ ID NO: 3315495 - RNA, 12 nt, Human
cugggacacagu

SEQ ID NO: 3315496 - RNA, 13 nt, Human
cugggacacaguu

SEQ ID NO: 3315497 - RNA, 11 nt, Human
cugggacacag

SEQ ID NO: 3315498 - RNA, 13 nt, Human
cuggccccucagg

SEQ ID NO: 3315499 - RNA, 14 nt, Human
cuggcagcucagag

SEQ ID NO: 3315500 - RNA, 13 nt, Human
cuggcagcucaga

SEQ ID NO: 3315501 - RNA, 12 nt, Human
cuggcagcucag

SEQ ID NO: 3315502 - RNA, 18 nt, Human
cugucagccauuccuguu

SEQ ID NO: 3315503 - RNA, 16 nt, Human
cugucauuugagcagg

SEQ ID NO: 3315504 - RNA, 17 nt, Human
cugucauuugagcaggg

SEQ ID NO: 3315505 - RNA, 18 nt, Human
cugucauuugagcagggc

SEQ ID NO: 3315506 - RNA, 18 nt, Human
cuguaggaagguuaaugu

SEQ ID NO: 3315507 - RNA, 21 nt, Human
cuguaggaagguuaauguuca

SEQ ID NO: 3315508 - RNA, 15 nt, Human
cugugaagagaacca

SEQ ID NO: 3315509 - RNA, 14 nt, Human
cugugcucuggaca

SEQ ID NO: 3315510 - RNA, 19 nt, Human
cugugcucuggacaggcau

SEQ ID NO: 3315511 - RNA, 13 nt, Human
cugucgcccaguc

SEQ ID NO: 3315512 - RNA, 21 nt, Human
cugcugacagacacaggcccg

SEQ ID NO: 3315513 - RNA, 23 nt, Human
cugcugacagacacaggcccggc

SEQ ID NO: 3315514 - RNA, 15 nt, Human
cugcugacagacaca

SEQ ID NO: 3315515 - RNA, 18 nt, Human
cugcugacagacacaggc

SEQ ID NO: 3315516 - RNA, 19 nt, Human
cugcugacagacacaggcc

SEQ ID NO: 3315517 - RNA, 20 nt, Human
cugcugacagacacaggccc

SEQ ID NO: 3315518 - RNA, 13 nt, Human
cugcuuaacuuca

SEQ ID NO: 3315519 - RNA, 13 nt, Human
cugcuucagccuc

SEQ ID NO: 3315520 - RNA, 17 nt, Human
cugcuuaacuucacaua

SEQ ID NO: 3315521 - RNA, 15 nt, Human
cugcuuaacuucaca

SEQ ID NO: 3315522 - RNA, 14 nt, Human
cugcuucagccucc

SEQ ID NO: 3315523 - RNA, 16 nt, Human
cugcuucagccucccg

SEQ ID NO: 3315524 - RNA, 22 nt, Human
cugcuuuuuaaagaaugcucuu

SEQ ID NO: 3315525 - RNA, 16 nt, Human
cuggaaauauuaagaa

SEQ ID NO: 3315526 - RNA, 19 nt, Human
cugcuuuuuaaagaaugcu

SEQ ID NO: 3315527 - RNA, 17 nt, Human
cuggaacacuaaugagg

SEQ ID NO: 3315528 - RNA, 14 nt, Human
cugcccugugggcc

SEQ ID NO: 3315529 - RNA, 15 nt, Human
cugccucgaacuggc

SEQ ID NO: 3315530 - RNA, 17 nt, Human
cugccucgaacuggcug

SEQ ID NO: 3315531 - RNA, 18 nt, Human
cugccucgaacuggcugc

SEQ ID NO: 3315532 - RNA, 22 nt, Human
cugccugggaucccucauccuc

SEQ ID NO: 3315533 - RNA, 23 nt, Human
cugccugggaucccucauccuca

SEQ ID NO: 3315534 - RNA, 14 nt, Human
cugccuguucagcu

SEQ ID NO: 3315535 - RNA, 16 nt, Human
cugcuaauuccccaga

SEQ ID NO: 3315536 - RNA, 19 nt, Human
cugccuguugggccaggag

SEQ ID NO: 3315537 - RNA, 18 nt, Human
cugccuguugggccagga

SEQ ID NO: 3315538 - RNA, 14 nt, Human
cugccuguugggcc

SEQ ID NO: 3315539 - RNA, 16 nt, Human
cugccuguugggccag

SEQ ID NO: 3315540 - RNA, 15 nt, Human
cugcuacagagcaga

SEQ ID NO: 3315541 - RNA, 19 nt, Human
cugagacucgcgacaaugc

SEQ ID NO: 3315542 - RNA, 17 nt, Human
cugagacucgcgacaau

SEQ ID NO: 3315543 - RNA, 13 nt, Human
cugcauguuacau

SEQ ID NO: 3315544 - RNA, 15 nt, Human
cugcauguuugugau

SEQ ID NO: 3315545 - RNA, 22 nt, Human
cugcauuuaaaagauacaguua

SEQ ID NO: 3315546 - RNA, 20 nt, Human
cugcauuuaaaagauacagu

SEQ ID NO: 3315547 - RNA, 18 nt, Human
cugcauuuaaaagauaca

SEQ ID NO: 3315548 - RNA, 15 nt, Human
cugccaaugggagcu

SEQ ID NO: 3315549 - RNA, 11 nt, Human
cugccagggac

SEQ ID NO: 3315550 - RNA, 15 nt, Human
cugccagggacagag

SEQ ID NO: 3315551 - RNA, 12 nt, Human
cugccagggaca

SEQ ID NO: 3315552 - RNA, 20 nt, Human
cugccauauucuguuggcca

SEQ ID NO: 3315553 - RNA, 21 nt, Human
cugccauauucuguuggccag

SEQ ID NO: 3315554 - RNA, 22 nt, Human
cugccauauucuguuggccagu

SEQ ID NO: 3315555 - RNA, 23 nt, Human
cugccauauucuguuggccagug

SEQ ID NO: 3315556 - RNA, 12 nt, Human
cugcccugugag

SEQ ID NO: 3315557 - RNA, 18 nt, Human
cugcccugugggccccca

SEQ ID NO: 3315558 - RNA, 16 nt, Human
cugcccugugggcccc

SEQ ID NO: 3315559 - RNA, 15 nt, Human
cugcccugugggccc

SEQ ID NO: 3315560 - RNA, 22 nt, Human
cugccccucaacucuccuccag

SEQ ID NO: 3315561 - RNA, 14 nt, Human
cugccccucaacuc

SEQ ID NO: 3315562 - RNA, 20 nt, Human
cuucugacccaugcugcccu

SEQ ID NO: 3315563 - RNA, 22 nt, Human
cuucugacccaugcugcccugu

SEQ ID NO: 3315564 - RNA, 21 nt, Human
cuucugacccaugcugcccug

SEQ ID NO: 3315565 - RNA, 23 nt, Human
cuucuucagagacuccugcaggc

SEQ ID NO: 3315566 - RNA, 18 nt, Human
cuuccucccucccucuuu

SEQ ID NO: 3315567 - RNA, 17 nt, Human
cuuccugcaacaccuug

SEQ ID NO: 3315568 - RNA, 16 nt, Human
cuugaagacuuuucuu

SEQ ID NO: 3315569 - RNA, 18 nt, Human
cuugaauuguaaggaaug

SEQ ID NO: 3315570 - RNA, 19 nt, Human
cuugaauuguaaggaauga

SEQ ID NO: 3315571 - RNA, 14 nt, Human
cuugacagggcaca

SEQ ID NO: 3315572 - RNA, 15 nt, Human
cuugacagggcacac

SEQ ID NO: 3315573 - RNA, 13 nt, Human
cuugacagggcac

SEQ ID NO: 3315574 - RNA, 12 nt, Human
cuuggcgcugcc

SEQ ID NO: 3315575 - RNA, 17 nt, Human
cuuggcgcugccccugg

SEQ ID NO: 3315576 - RNA, 14 nt, Human
cuuggcgcugcccc

SEQ ID NO: 3315577 - RNA, 23 nt, Human
cuucccaccucucucacuccuug

SEQ ID NO: 3315578 - RNA, 21 nt, Human
cuucccaccucucucacuccu

SEQ ID NO: 3315579 - RNA, 11 nt, Human
cuucccaccuc

SEQ ID NO: 3315580 - RNA, 21 nt, Human
cuuccagugaggcucugcccu

SEQ ID NO: 3315581 - RNA, 23 nt, Human
cuuccagugaggcucugcccuug

SEQ ID NO: 3315582 - RNA, 22 nt, Human
cuuccagugaggcucugcccuu

SEQ ID NO: 3315583 - RNA, 17 nt, Human
cuucagagacuccugca

SEQ ID NO: 3315584 - RNA, 19 nt, Human
cuucagagacuccugcagg

SEQ ID NO: 3315585 - RNA, 18 nt, Human
cuucagagacuccugcag

SEQ ID NO: 3315586 - RNA, 16 nt, Human
cuuauggaacacucug

SEQ ID NO: 3315587 - RNA, 13 nt, Human
cuuauggaacacu

SEQ ID NO: 3315588 - RNA, 20 nt, Human
cuucaccuuuguccccaccg

SEQ ID NO: 3315589 - RNA, 21 nt, Human
cuucaccuuuguccccaccgc

SEQ ID NO: 3315590 - RNA, 22 nt, Human
cuucaccuuuguccccaccgca

SEQ ID NO: 3315591 - RNA, 19 nt, Human
cuucacggaagagccuugc

SEQ ID NO: 3315592 - RNA, 15 nt, Human
cuucacggaagagcc

SEQ ID NO: 3315593 - RNA, 20 nt, Human
cuuauggaacacucugagac

SEQ ID NO: 3315594 - RNA, 19 nt, Human
cuuauggaacacucugaga

SEQ ID NO: 3315595 - RNA, 17 nt, Human
cuuauggaacacucuga

SEQ ID NO: 3315596 - RNA, 12 nt, Human
cugugcugaguc

SEQ ID NO: 3315597 - RNA, 14 nt, Human
cugugcugagucug

SEQ ID NO: 3315598 - RNA, 20 nt, Human
cuuucagccaagaauucuua

SEQ ID NO: 3315599 - RNA, 23 nt, Human
cuuucagccaagaauucuuaaau

SEQ ID NO: 3315600 - RNA, 23 nt, Human
cuuucaauaggaaaaacugauuu

SEQ ID NO: 3315601 - RNA, 22 nt, Human
cuuuccugaggcugggcucccu

SEQ ID NO: 3315602 - RNA, 21 nt, Human
cuuuccugaggcugggcuccc

SEQ ID NO: 3315603 - RNA, 13 nt, Human
cuuuuauaaacuu

SEQ ID NO: 3315604 - RNA, 17 nt, Human
cuuugggccuggcuccc

SEQ ID NO: 3315605 - RNA, 17 nt, Human
cuuucuacccagcgagc

SEQ ID NO: 3315606 - RNA, 15 nt, Human
cuuucuagccagagg

SEQ ID NO: 3315607 - RNA, 16 nt, Human
cuuucuagccagagga

SEQ ID NO: 3315608 - RNA, 14 nt, Human
gaaaaacugauuuu

SEQ ID NO: 3315609 - RNA, 18 nt, Human
gaaaagaaaaaugagccu

SEQ ID NO: 3315610 - RNA, 21 nt, Human
gaaaauggaagacagcucuua

SEQ ID NO: 3315611 - RNA, 23 nt, Human
gaaaauggacguguuaugacucc

SEQ ID NO: 3315612 - RNA, 19 nt, Human
gaaaauggacguguuauga

SEQ ID NO: 3315613 - RNA, 15 nt, Human
gaaaauguaugugua

SEQ ID NO: 3315614 - RNA, 23 nt, Human
cuuuugcccacacuugggagcaa

SEQ ID NO: 3315615 - RNA, 18 nt, Human
cuuuugucuaugggacuc

SEQ ID NO: 3315616 - RNA, 17 nt, Human
cuuuugucuaugggacu

SEQ ID NO: 3315617 - RNA, 23 nt, Human
cuuuuuuggcugcugaaggcucg

SEQ ID NO: 3315618 - RNA, 13 nt, Human
cuuuugugcauua

SEQ ID NO: 3315619 - RNA, 12 nt, Human
cuuuugugcauu

SEQ ID NO: 3315620 - RNA, 20 nt, Human
gaaagacuaucuaaauguug

SEQ ID NO: 3315621 - RNA, 22 nt, Human
gaaaggcuccaggagcagccac

SEQ ID NO: 3315622 - RNA, 20 nt, Human
gaaaggcuccaggagcagcc

SEQ ID NO: 3315623 - RNA, 21 nt, Human
gaaaggcuccaggagcagcca

SEQ ID NO: 3315624 - RNA, 19 nt, Human
gaaaucaccgaaaacgugg

SEQ ID NO: 3315625 - RNA, 19 nt, Human
gaaagggacuuggaagcuc

SEQ ID NO: 3315626 - RNA, 20 nt, Human
gaaagggacgcuacccggga

SEQ ID NO: 3315627 - RNA, 22 nt, Human
gaaagggacuuggaagcuccgc

SEQ ID NO: 3315628 - RNA, 14 nt, Human
gauacccaucccau

SEQ ID NO: 3315629 - RNA, 13 nt, Human
gauacccauccca

SEQ ID NO: 3315630 - RNA, 16 nt, Human
gauacuacaguuuguu

SEQ ID NO: 3315631 - RNA, 11 nt, Human
gauacuacagu

SEQ ID NO: 3315632 - RNA, 20 nt, Human
gaguuugggguaugggagag

SEQ ID NO: 3315633 - RNA, 20 nt, Human
gaguuguuacauuuuuaagu

SEQ ID NO: 3315634 - RNA, 16 nt, Human
gaguuguuacauuuuu

SEQ ID NO: 3315635 - RNA, 18 nt, Human
gagugccuuacacaaugg

SEQ ID NO: 3315636 - RNA, 14 nt, Human
gaggucuguucuuu

SEQ ID NO: 3315637 - RNA, 13 nt, Human
gaggucuguucuu

SEQ ID NO: 3315638 - RNA, 11 nt, Human
gaggugggagg

SEQ ID NO: 3315639 - RNA, 12 nt, Human
gaggugggaucc

SEQ ID NO: 3315640 - RNA, 11 nt, Human
gagugcaguga

SEQ ID NO: 3315641 - RNA, 12 nt, Human
gagugcagugag

SEQ ID NO: 3315642 - RNA, 24 nt, Human
gagugagcacuaaggugugcucug

SEQ ID NO: 3315643 - RNA, 13 nt, Human
gagucccaccuug

SEQ ID NO: 3315644 - RNA, 12 nt, Human
gagugagcuggu

SEQ ID NO: 3315645 - RNA, 16 nt, Human
gagucccaccuuggcu

SEQ ID NO: 3315646 - RNA, 20 nt, Human
gagucccaccuuggcugcag

SEQ ID NO: 3315647 - RNA, 13 nt, Human
gagucaccaagcc

SEQ ID NO: 3315648 - RNA, 14 nt, Human
gagucaccaagccc

SEQ ID NO: 3315649 - RNA, 20 nt, Human
gauuacaggugugaaccacc

SEQ ID NO: 3315650 - RNA, 16 nt, Human
gaugagaggaaaucac

SEQ ID NO: 3315651 - RNA, 14 nt, Human
gaugaucuuugcag

SEQ ID NO: 3315652 - RNA, 20 nt, Human
gaugaucuuugcagacaggc

SEQ ID NO: 3315653 - RNA, 21 nt, Human
gaugaucuuugcagacaggca

SEQ ID NO: 3315654 - RNA, 17 nt, Human
gaucucuugagccuggg

SEQ ID NO: 3315655 - RNA, 16 nt, Human
gaucucuugagccugg

SEQ ID NO: 3315656 - RNA, 12 nt, Human
gaucucuugagc

SEQ ID NO: 3315657 - RNA, 15 nt, Human
gauauuuugcuuugu

SEQ ID NO: 3315658 - RNA, 16 nt, Human
gauauuuugcuuugug

SEQ ID NO: 3315659 - RNA, 15 nt, Human
gauauuuuuuucuuu

SEQ ID NO: 3315660 - RNA, 12 nt, Human
gcacugacauug

SEQ ID NO: 3315661 - RNA, 19 nt, Human
gcagagcaccuuagacagu

SEQ ID NO: 3315662 - RNA, 23 nt, Human
gcagagcaccuuagacagucccu

SEQ ID NO: 3315663 - RNA, 22 nt, Human
gcagagcaccuuagacaguccc

SEQ ID NO: 3315664 - RNA, 15 nt, Human
gcagagcagagacca

SEQ ID NO: 3315665 - RNA, 14 nt, Human
gcagagcagagacc

SEQ ID NO: 3315666 - RNA, 12 nt, Human
gcagagcagaga

SEQ ID NO: 3315667 - RNA, 24 nt, Human
gcagagcaccuuagacagucccug

SEQ ID NO: 3315668 - RNA, 20 nt, Human
gcagagcagagaccaucccu

SEQ ID NO: 3315669 - RNA, 19 nt, Human
gcagagcagagaccauccc

SEQ ID NO: 3315670 - RNA, 13 nt, Human
gcaagugagagcu

SEQ ID NO: 3315671 - RNA, 22 nt, Human
gcacaagcuccaagcucccagg

SEQ ID NO: 3315672 - RNA, 21 nt, Human
gcacaagcuccaagcucccag

SEQ ID NO: 3315673 - RNA, 23 nt, Human
gcacaagcuccaagcucccaggc

SEQ ID NO: 3315674 - RNA, 14 nt, Human
gcacaagcugcacc

SEQ ID NO: 3315675 - RNA, 21 nt, Human
gcaauaaagcagcguuucuau

SEQ ID NO: 3315676 - RNA, 18 nt, Human
gcaccggcuggccuggcc

SEQ ID NO: 3315677 - RNA, 23 nt, Human
gcaccggcuggccuggccccuca

SEQ ID NO: 3315678 - RNA, 21 nt, Human
gcaccggcuggccuggccccu

SEQ ID NO: 3315679 - RNA, 19 nt, Human
gcaccggcuggccuggccc

SEQ ID NO: 3315680 - RNA, 21 nt, Human
gcacaugccucucucaggcca

SEQ ID NO: 3315681 - RNA, 20 nt, Human
gcacaugccucucucaggcc

SEQ ID NO: 3315682 - RNA, 19 nt, Human
gcacaugccucucucaggc

SEQ ID NO: 3315683 - RNA, 18 nt, Human
gcacaugccucucucagg

SEQ ID NO: 3315684 - RNA, 17 nt, Human
gcacaugccucucucag

SEQ ID NO: 3315685 - RNA, 14 nt, Human
gcacaugccucucu

SEQ ID NO: 3315686 - RNA, 13 nt, Human
gcacaugccucuc

SEQ ID NO: 3315687 - RNA, 20 nt, Human
gcacaucagcacgauuucug

SEQ ID NO: 3315688 - RNA, 19 nt, Human
gcacaucagcacgauuucu

SEQ ID NO: 3315689 - RNA, 18 nt, Human
gcagcccaccccucaaca

SEQ ID NO: 3315690 - RNA, 14 nt, Human
gcagccaggccaca

SEQ ID NO: 3315691 - RNA, 13 nt, Human
gcagccaggccac

SEQ ID NO: 3315692 - RNA, 16 nt, Human
gcagccacauuccuga

SEQ ID NO: 3315693 - RNA, 15 nt, Human
gcagccacauuccug

SEQ ID NO: 3315694 - RNA, 14 nt, Human
gcagccacuauugu

SEQ ID NO: 3315695 - RNA, 12 nt, Human
gcagccaggcca

SEQ ID NO: 3315696 - RNA, 16 nt, Human
gcauaccacuuuuguu

SEQ ID NO: 3315697 - RNA, 20 nt, Human
gcauaccacuuuuguucuug

SEQ ID NO: 3315698 - RNA, 17 nt, Human
gcauaccacuuuuguuc

SEQ ID NO: 3315699 - RNA, 18 nt, Human
gcaggcucucaggccagc

SEQ ID NO: 3315700 - RNA, 23 nt, Human
gcaggcucucaggccagcugcuu

SEQ ID NO: 3315701 - RNA, 17 nt, Human
gcagcugcgguccaccc

SEQ ID NO: 3315702 - RNA, 22 nt, Human
gcaggcucucaggccagcugcu

SEQ ID NO: 3315703 - RNA, 20 nt, Human
gcaggcucucaggccagcug

SEQ ID NO: 3315704 - RNA, 22 nt, Human
gaaugaaugucagugugacuga

SEQ ID NO: 3315705 - RNA, 18 nt, Human
gaaugaaugucaguguga

SEQ ID NO: 3315706 - RNA, 14 nt, Human
gaaugaaugucagu

SEQ ID NO: 3315707 - RNA, 11 nt, Human
gaaugaauguc

SEQ ID NO: 3315708 - RNA, 15 nt, Human
gaagcucagggccug

SEQ ID NO: 3315709 - RNA, 14 nt, Human
gaagcucagggccu

SEQ ID NO: 3315710 - RNA, 23 nt, Human
gaagcucagggccuggcucaggu

SEQ ID NO: 3315711 - RNA, 21 nt, Human
gaagcucagggccuggcucag

SEQ ID NO: 3315712 - RNA, 20 nt, Human
gaagcucagggccuggcuca

SEQ ID NO: 3315713 - RNA, 19 nt, Human
gaagcucagggccuggcuc

SEQ ID NO: 3315714 - RNA, 18 nt, Human
gaagcucagggccuggcu

SEQ ID NO: 3315715 - RNA, 17 nt, Human
gaagcucagggccuggc

SEQ ID NO: 3315716 - RNA, 16 nt, Human
gaagcucagggccugg

SEQ ID NO: 3315717 - RNA, 17 nt, Human
gaaggcucgagcaugcc

SEQ ID NO: 3315718 - RNA, 16 nt, Human
gaaggcucgagcaugc

SEQ ID NO: 3315719 - RNA, 18 nt, Human
gaagucuuuguacagaca

SEQ ID NO: 3315720 - RNA, 20 nt, Human
gaagucuuuguacagacaac

SEQ ID NO: 3315721 - RNA, 19 nt, Human
gaagucuuuguacagacaa

SEQ ID NO: 3315722 - RNA, 13 nt, Human
gacacugaugggc

SEQ ID NO: 3315723 - RNA, 15 nt, Human
gacacugaugggcaa

SEQ ID NO: 3315724 - RNA, 23 nt, Human
gacagcccgggcucugccuccca

SEQ ID NO: 3315725 - RNA, 22 nt, Human
gacagcccgggcucugccuccc

SEQ ID NO: 3315726 - RNA, 21 nt, Human
gacagcccgggcucugccucc

SEQ ID NO: 3315727 - RNA, 20 nt, Human
gacagcccgggcucugccuc

SEQ ID NO: 3315728 - RNA, 20 nt, Human
gacaggguuuugccauguug

SEQ ID NO: 3315729 - RNA, 22 nt, Human
gacaggguuuugccauguuggc

SEQ ID NO: 3315730 - RNA, 21 nt, Human
gacacacagcucuguccuggg

SEQ ID NO: 3315731 - RNA, 19 nt, Human
gaauuuuggcugugucucc

SEQ ID NO: 3315732 - RNA, 14 nt, Human
gacacacagcucug

SEQ ID NO: 3315733 - RNA, 13 nt, Human
gacacacagcucu

SEQ ID NO: 3315734 - RNA, 15 nt, Human
gacacacagcucugu

SEQ ID NO: 3315735 - RNA, 17 nt, Human
gacacacagcucugucc

SEQ ID NO: 3315736 - RNA, 18 nt, Human
gacacacagcucuguccu

SEQ ID NO: 3315737 - RNA, 19 nt, Human
gacacacagcucuguccug

SEQ ID NO: 3315738 - RNA, 23 nt, Human
gaauuuuggcugugucucccuuc

SEQ ID NO: 3315739 - RNA, 20 nt, Human
gaauuuugugcccccaugua

SEQ ID NO: 3315740 - RNA, 21 nt, Human
gaauuuugugcccccauguaa

SEQ ID NO: 3315741 - RNA, 22 nt, Human
gacuaucuaaauguugaaagau

SEQ ID NO: 3315742 - RNA, 12 nt, Human
gacucugucuca

SEQ ID NO: 3315743 - RNA, 15 nt, Human
gagaagcggcuggca

SEQ ID NO: 3315744 - RNA, 13 nt, Human
gagaagcggcugg

SEQ ID NO: 3315745 - RNA, 12 nt, Human
gagaaggaagcc

SEQ ID NO: 3315746 - RNA, 21 nt, Human
gacuuuucuuuguggcuuccu

SEQ ID NO: 3315747 - RNA, 23 nt, Human
gacuuuucuuucagccaagaauu

SEQ ID NO: 3315748 - RNA, 23 nt, Human
gacuuuucuguccgagcuuugaa

SEQ ID NO: 3315749 - RNA, 18 nt, Human
gagcugggugucaagagg

SEQ ID NO: 3315750 - RNA, 17 nt, Human
gagcggagaaaggaagg

SEQ ID NO: 3315751 - RNA, 21 nt, Human
gagcggagaaaggaagggcug

SEQ ID NO: 3315752 - RNA, 18 nt, Human
gagcggagaaaggaaggg

SEQ ID NO: 3315753 - RNA, 20 nt, Human
gagcugccuguucagcucca

SEQ ID NO: 3315754 - RNA, 21 nt, Human
gagcugccuguucagcuccag

SEQ ID NO: 3315755 - RNA, 22 nt, Human
gagcugccuguucagcuccagc

SEQ ID NO: 3315756 - RNA, 19 nt, Human
gagccuugaacuuugaccu

SEQ ID NO: 3315757 - RNA, 22 nt, Human
gagccuugaacuuugaccucug

SEQ ID NO: 3315758 - RNA, 16 nt, Human
gagccuuccaggggug

SEQ ID NO: 3315759 - RNA, 15 nt, Human
gagccuuccaggggu

SEQ ID NO: 3315760 - RNA, 14 nt, Human
gagccuuccagggg

SEQ ID NO: 3315761 - RNA, 14 nt, Human
gagcagggcucagc

SEQ ID NO: 3315762 - RNA, 12 nt, Human
gagcaucaggcc

SEQ ID NO: 3315763 - RNA, 21 nt, Human
gagcaugccuggauggggcug

SEQ ID NO: 3315764 - RNA, 22 nt, Human
gagcaugccuggauggggcugc

SEQ ID NO: 3315765 - RNA, 13 nt, Human
gagauuuacaacu

SEQ ID NO: 3315766 - RNA, 18 nt, Human
gagauugcaccacugcac

SEQ ID NO: 3315767 - RNA, 14 nt, Human
gagaggcauccagu

SEQ ID NO: 3315768 - RNA, 17 nt, Human
gagacuccugcaggcag

SEQ ID NO: 3315769 - RNA, 16 nt, Human
gagacuccugcaggca

SEQ ID NO: 3315770 - RNA, 15 nt, Human
gagacuccugcaggc

SEQ ID NO: 3315771 - RNA, 14 nt, Human
gagacuccugcagg

SEQ ID NO: 3315772 - RNA, 21 nt, Human
gagaugaugccaugggcccuc

SEQ ID NO: 3315773 - RNA, 22 nt, Human
gagaggcauccaguaucuugaa

SEQ ID NO: 3315774 - RNA, 12 nt, Human
ggccugagcugg

SEQ ID NO: 3315775 - RNA, 15 nt, Human
ggccugagcugggau

SEQ ID NO: 3315776 - RNA, 12 nt, Human
ggccuucucuga

SEQ ID NO: 3315777 - RNA, 21 nt, Human
ggccugugucuaguuguuuga

SEQ ID NO: 3315778 - RNA, 16 nt, Human
ggccuggccagaugca

SEQ ID NO: 3315779 - RNA, 21 nt, Human
ggccuggccagaugcaccagc

SEQ ID NO: 3315780 - RNA, 14 nt, Human
ggccuuuggcuuca

SEQ ID NO: 3315781 - RNA, 13 nt, Human
ggccuuuggcuuc

SEQ ID NO: 3315782 - RNA, 15 nt, Human
ggccuucucugaagg

SEQ ID NO: 3315783 - RNA, 16 nt, Human
ggccuucucugaagga

SEQ ID NO: 3315784 - RNA, 19 nt, Human
ggcgugcaguggugcgauc

SEQ ID NO: 3315785 - RNA, 14 nt, Human
ggcgugcaguggug

SEQ ID NO: 3315786 - RNA, 16 nt, Human
ggcucacugcagccuc

SEQ ID NO: 3315787 - RNA, 17 nt, Human
ggcucacugcagccuca

SEQ ID NO: 3315788 - RNA, 19 nt, Human
ggcucagcaaaagaugcuu

SEQ ID NO: 3315789 - RNA, 23 nt, Human
ggcucagcaaaagaugcuucuca

SEQ ID NO: 3315790 - RNA, 20 nt, Human
ggcucagcggggacagcucc

SEQ ID NO: 3315791 - RNA, 21 nt, Human
ggcucagcggggacagcuccu

SEQ ID NO: 3315792 - RNA, 22 nt, Human
ggcucagcggggacagcuccuu

SEQ ID NO: 3315793 - RNA, 23 nt, Human
ggcucagcggggacagcuccuuc

SEQ ID NO: 3315794 - RNA, 24 nt, Human
ggcacugcuuccagugaggcucug

SEQ ID NO: 3315795 - RNA, 22 nt, Human
ggcacugcuuccagugaggcuc

SEQ ID NO: 3315796 - RNA, 15 nt, Human
ggcaccagcagccug

SEQ ID NO: 3315797 - RNA, 17 nt, Human
ggcagugggagcugccu

SEQ ID NO: 3315798 - RNA, 18 nt, Human
ggcagugggagcugccug

SEQ ID NO: 3315799 - RNA, 19 nt, Human
ggcagugggagcugccugu

SEQ ID NO: 3315800 - RNA, 18 nt, Human
ggcauccaguaucuugaa

SEQ ID NO: 3315801 - RNA, 17 nt, Human
ggccaaacucaccugcc

SEQ ID NO: 3315802 - RNA, 16 nt, Human
ggccaggcuggucuca

SEQ ID NO: 3315803 - RNA, 18 nt, Human
ggccaggcuggucucaaa

SEQ ID NO: 3315804 - RNA, 12 nt, Human
ggccaggcuggu

SEQ ID NO: 3315805 - RNA, 14 nt, Human
ggccaggcuggucu

SEQ ID NO: 3315806 - RNA, 14 nt, Human
ggcccuuccuuuuc

SEQ ID NO: 3315807 - RNA, 17 nt, Human
ggcccuucucuccagcc

SEQ ID NO: 3315808 - RNA, 16 nt, Human
ggcccuucucuccagc

SEQ ID NO: 3315809 - RNA, 18 nt, Human
ggcccuucucuccagccc

SEQ ID NO: 3315810 - RNA, 14 nt, Human
ggaggugaccccag

SEQ ID NO: 3315811 - RNA, 20 nt, Human
ggaggucaaggcugcaguga

SEQ ID NO: 3315812 - RNA, 16 nt, Human
ggaggggggagguggg

SEQ ID NO: 3315813 - RNA, 22 nt, Human
ggagguaaggaauaccuguccc

SEQ ID NO: 3315814 - RNA, 14 nt, Human
ggaggggggaggug

SEQ ID NO: 3315815 - RNA, 21 nt, Human
ggagcugccuguucagcucca

SEQ ID NO: 3315816 - RNA, 16 nt, Human
ggagcugaguggggga

SEQ ID NO: 3315817 - RNA, 12 nt, Human
ggagcugccugu

SEQ ID NO: 3315818 - RNA, 16 nt, Human
ggagccccgaggccuu

SEQ ID NO: 3315819 - RNA, 22 nt, Human
ggagccccgaggccuucucuga

SEQ ID NO: 3315820 - RNA, 20 nt, Human
ggaggccaaggugggaggau

SEQ ID NO: 3315821 - RNA, 11 nt, Human
ggaggccagcc

SEQ ID NO: 3315822 - RNA, 23 nt, Human
ggaggaaggaaacccagcucugg

SEQ ID NO: 3315823 - RNA, 20 nt, Human
ggaggaaggaaacccagcuc

SEQ ID NO: 3315824 - RNA, 19 nt, Human
ggaggaaggaaacccagcu

SEQ ID NO: 3315825 - RNA, 14 nt, Human
ggaguggccacaga

SEQ ID NO: 3315826 - RNA, 15 nt, Human
ggaguucugguuccu

SEQ ID NO: 3315827 - RNA, 18 nt, Human
ggauggauuuccagccaa

SEQ ID NO: 3315828 - RNA, 16 nt, Human
ggauggggcugcaccg

SEQ ID NO: 3315829 - RNA, 14 nt, Human
ggauccugagccag

SEQ ID NO: 3315830 - RNA, 13 nt, Human
ggauccugagcca

SEQ ID NO: 3315831 - RNA, 14 nt, Human
ggauccuccaggug

SEQ ID NO: 3315832 - RNA, 15 nt, Human
ggauccuccaggugc

SEQ ID NO: 3315833 - RNA, 18 nt, Human
ggaucucuugagccuggg

SEQ ID NO: 3315834 - RNA, 15 nt, Human
ggagugcagugagcc

SEQ ID NO: 3315835 - RNA, 23 nt, Human
ggcacagaaaauggaagacagcu

SEQ ID NO: 3315836 - RNA, 24 nt, Human
ggcacagaaaauggaagacagcuc

SEQ ID NO: 3315837 - RNA, 13 nt, Human
ggauguucuggga

SEQ ID NO: 3315838 - RNA, 16 nt, Human
ggauguucugggacac

SEQ ID NO: 3315839 - RNA, 15 nt, Human
ggauguucugggaca

SEQ ID NO: 3315840 - RNA, 13 nt, Human
gggaagagacuug

SEQ ID NO: 3315841 - RNA, 16 nt, Human
gggacagcuccuucug

SEQ ID NO: 3315842 - RNA, 23 nt, Human
gggacagaggggguggccuccca

SEQ ID NO: 3315843 - RNA, 22 nt, Human
gggacagaggggguggccuccc

SEQ ID NO: 3315844 - RNA, 13 nt, Human
gggacagaggggg

SEQ ID NO: 3315845 - RNA, 13 nt, Human
gggaaggauacaa

SEQ ID NO: 3315846 - RNA, 21 nt, Human
gggacagcuccuucuguccua

SEQ ID NO: 3315847 - RNA, 22 nt, Human
aaaacugcugacuguuuucucu

SEQ ID NO: 3315848 - RNA, 20 nt, Human
aaaacugcugacuguuuucu

SEQ ID NO: 3315849 - RNA, 13 nt, Human
aaaagaugcuucu

SEQ ID NO: 3315850 - RNA, 23 nt, Human
aaaacugcugacuguuuucucuu

SEQ ID NO: 3315851 - RNA, 14 nt, Human
aaaaaucucaaauu

SEQ ID NO: 3315852 - RNA, 21 nt, Human
aaaaccaauguucucucuucu

SEQ ID NO: 3315853 - RNA, 15 nt, Human
aaaacaugcuacaca

SEQ ID NO: 3315854 - RNA, 15 nt, Human
gggaggucgaggcag

SEQ ID NO: 3315855 - RNA, 19 nt, Human
gggaggucgaggcaggagg

SEQ ID NO: 3315856 - RNA, 18 nt, Human
gggaggucgaggcaggag

SEQ ID NO: 3315857 - RNA, 17 nt, Human
gggaggucgaggcagga

SEQ ID NO: 3315858 - RNA, 17 nt, Human
gggagggcuccagacac

SEQ ID NO: 3315859 - RNA, 15 nt, Human
gggagggcuccagac

SEQ ID NO: 3315860 - RNA, 14 nt, Human
gggagggcuccaga

SEQ ID NO: 3315861 - RNA, 19 nt, Human
gggaggccaaggugggagg

SEQ ID NO: 3315862 - RNA, 15 nt, Human
gggauuacaggugug

SEQ ID NO: 3315863 - RNA, 16 nt, Human
gggcaacccccagccu

SEQ ID NO: 3315864 - RNA, 18 nt, Human
gggcaacccccagccugc

SEQ ID NO: 3315865 - RNA, 12 nt, Human
gggcagagcaga

SEQ ID NO: 3315866 - RNA, 16 nt, Human
gggcagagcagagacc

SEQ ID NO: 3315867 - RNA, 22 nt, Human
gggcagagcagagaccaucccu

SEQ ID NO: 3315868 - RNA, 17 nt, Human
gggcagagcagagacca

SEQ ID NO: 3315869 - RNA, 14 nt, Human
gggcagaggaaagc

SEQ ID NO: 3315870 - RNA, 18 nt, Human
gggcuaguugggcuuccu

SEQ ID NO: 3315871 - RNA, 15 nt, Human
gggcgggaggauguu

SEQ ID NO: 3315872 - RNA, 19 nt, Human
gggccucuuaugggcuggg

SEQ ID NO: 3315873 - RNA, 20 nt, Human
gggccucuuaugggcugggu

SEQ ID NO: 3315874 - RNA, 15 nt, Human
gggccuccugugugu

SEQ ID NO: 3315875 - RNA, 13 nt, Human
gggccuccugugu

SEQ ID NO: 3315876 - RNA, 15 nt, Human
gggccucagugccac

SEQ ID NO: 3315877 - RNA, 23 nt, Human
gggccaguuggucccccuuccau

SEQ ID NO: 3315878 - RNA, 22 nt, Human
gggccaguuggucccccuucca

SEQ ID NO: 3315879 - RNA, 18 nt, Human
gggccaguuggucccccu

SEQ ID NO: 3315880 - RNA, 14 nt, Human
gggccaguuggucc

SEQ ID NO: 3315881 - RNA, 21 nt, Human
aaaaugagccuggcaagaaug

SEQ ID NO: 3315882 - RNA, 14 nt, Human
aaaaugagccuggc

SEQ ID NO: 3315883 - RNA, 11 nt, Human
gggccaggagc

SEQ ID NO: 3315884 - RNA, 22 nt, Human
gggcuggguucuacccaggugc

SEQ ID NO: 3315885 - RNA, 18 nt, Human
gggcugcaugcgggcuuc

SEQ ID NO: 3315886 - RNA, 21 nt, Human
gggcugcaugcgggcuuccuc

SEQ ID NO: 3315887 - RNA, 10 nt, Human
gggcucagca

SEQ ID NO: 3315888 - RNA, 22 nt, Human
gggcugcaccggcuggccuggc

SEQ ID NO: 3315889 - RNA, 20 nt, Human
gggcuggguucuacccaggu

SEQ ID NO: 3315890 - RNA, 20 nt, Human
aaacaagaccacguuucuaa

SEQ ID NO: 3315891 - RNA, 18 nt, Human
aaacaagaccacguuucu

SEQ ID NO: 3315892 - RNA, 16 nt, Human
aaacacauuuuucuua

SEQ ID NO: 3315893 - RNA, 12 nt, Human
aaacacauuuuu

SEQ ID NO: 3315894 - RNA, 12 nt, Human
ggggacagcucc

SEQ ID NO: 3315895 - RNA, 14 nt, Human
ggggacagcuccuu

SEQ ID NO: 3315896 - RNA, 20 nt, Human
ggggacagcuccuucugucc

SEQ ID NO: 3315897 - RNA, 15 nt, Human
ggggccucagugcca

SEQ ID NO: 3315898 - RNA, 13 nt, Human
aaauaaugugaaa

SEQ ID NO: 3315899 - RNA, 12 nt, Human
aaauaaugugaa

SEQ ID NO: 3315900 - RNA, 12 nt, Human
aaaguggugaga

SEQ ID NO: 3315901 - RNA, 21 nt, Human
aaaguuucucuuuucaaaaca

SEQ ID NO: 3315902 - RNA, 23 nt, Human
aaaguuucucuuuucaaaacauu

SEQ ID NO: 3315903 - RNA, 13 nt, Human
gguuucagaaaug

SEQ ID NO: 3315904 - RNA, 12 nt, Human
gguuucagaaau

SEQ ID NO: 3315905 - RNA, 14 nt, Human
gguuucagaaaugu

SEQ ID NO: 3315906 - RNA, 21 nt, Human
gguucccuuugacgccauccc

SEQ ID NO: 3315907 - RNA, 22 nt, Human
gguucaggguuggccccugccc

SEQ ID NO: 3315908 - RNA, 18 nt, Human
gguucaggguuggccccu

SEQ ID NO: 3315909 - RNA, 21 nt, Human
gguucaggguuggccccugcc

SEQ ID NO: 3315910 - RNA, 12 nt, Human
gguucagcuugu

SEQ ID NO: 3315911 - RNA, 12 nt, Human
gguguggaagag

SEQ ID NO: 3315912 - RNA, 13 nt, Human
ggugugcucugau

SEQ ID NO: 3315913 - RNA, 21 nt, Human
ggugugcggccuuuggcuuca

SEQ ID NO: 3315914 - RNA, 16 nt, Human
ggugugacugaauuuc

SEQ ID NO: 3315915 - RNA, 18 nt, Human
ggugugagucaccaagcc

SEQ ID NO: 3315916 - RNA, 16 nt, Human
ggugucgggcaugaca

SEQ ID NO: 3315917 - RNA, 13 nt, Human
ggugucgggcaug

SEQ ID NO: 3315918 - RNA, 23 nt, Human
gguggggucacucuggcagcuca

SEQ ID NO: 3315919 - RNA, 15 nt, Human
gguggggucacucug

SEQ ID NO: 3315920 - RNA, 13 nt, Human
gguggggcagcuu

SEQ ID NO: 3315921 - RNA, 17 nt, Human
gguggggcagcuugagg

SEQ ID NO: 3315922 - RNA, 19 nt, Human
ggugggauccuccaggugc

SEQ ID NO: 3315923 - RNA, 20 nt, Human
ggugggaggaucucuugagc

SEQ ID NO: 3315924 - RNA, 20 nt, Human
ggugggaggauugcuugagc

SEQ ID NO: 3315925 - RNA, 15 nt, Human
ggugggauccuccag

SEQ ID NO: 3315926 - RNA, 14 nt, Human
ggugggauccucca

SEQ ID NO: 3315927 - RNA, 18 nt, Human
ggugcaaugaccuuucaa

SEQ ID NO: 3315928 - RNA, 20 nt, Human
ggugcaaugaccuuucaaua

SEQ ID NO: 3315929 - RNA, 19 nt, Human
ggugcaaugaccuuucaau

SEQ ID NO: 3315930 - RNA, 16 nt, Human
ggugcaaugaccuuuc

SEQ ID NO: 3315931 - RNA, 21 nt, Human
ggugcauuugaggucuguucu

SEQ ID NO: 3315932 - RNA, 14 nt, Human
gguggaugccuggu

SEQ ID NO: 3315933 - RNA, 21 nt, Human
gguggaugccugguggcagcu

SEQ ID NO: 3315934 - RNA, 22 nt, Human
aaagcagcguuucuaugacaca

SEQ ID NO: 3315935 - RNA, 18 nt, Human
aaagcagcguuucuauga

SEQ ID NO: 3315936 - RNA, 16 nt, Human
aaagcagcguuucuau

SEQ ID NO: 3315937 - RNA, 15 nt, Human
aaagcagcguuucua

SEQ ID NO: 3315938 - RNA, 17 nt, Human
ggucuacacugugcuga

SEQ ID NO: 3315939 - RNA, 14 nt, Human
ggucggaaaacaug

SEQ ID NO: 3315940 - RNA, 14 nt, Human
gguccugcugcagu

SEQ ID NO: 3315941 - RNA, 13 nt, Human
ggucggaaaacau

SEQ ID NO: 3315942 - RNA, 13 nt, Human
aaagcaaaggaga

SEQ ID NO: 3315943 - RNA, 23 nt, Human
gguccuagaaauuccccacccug

SEQ ID NO: 3315944 - RNA, 23 nt, Human
gguccugcugcaguugccaguca

SEQ ID NO: 3315945 - RNA, 21 nt, Human
gguccugcugcaguugccagu

SEQ ID NO: 3315946 - RNA, 17 nt, Human
ggguguggcgcagcaua

SEQ ID NO: 3315947 - RNA, 17 nt, Human
ggguggaugccuggugg

SEQ ID NO: 3315948 - RNA, 15 nt, Human
ggguggcaccagcag

SEQ ID NO: 3315949 - RNA, 13 nt, Human
ggguggaugccug

SEQ ID NO: 3315950 - RNA, 19 nt, Human
gggugggacacccugugau

SEQ ID NO: 3315951 - RNA, 20 nt, Human
ggguggggaccucaggccug

SEQ ID NO: 3315952 - RNA, 17 nt, Human
ggguuucuaaagcugcc

SEQ ID NO: 3315953 - RNA, 14 nt, Human
gguaacaggcagau

SEQ ID NO: 3315954 - RNA, 20 nt, Human
gguaacaggcagauacagga

SEQ ID NO: 3315955 - RNA, 13 nt, Human
gguaacaggcaga

SEQ ID NO: 3315956 - RNA, 17 nt, Human
aaagacuaucuaaaugu

SEQ ID NO: 3315957 - RNA, 12 nt, Human
aaacuuuacuau

SEQ ID NO: 3315958 - RNA, 15 nt, Human
gguccauagagagca

SEQ ID NO: 3315959 - RNA, 22 nt, Human
aaacuuuaccuuuuuuauacau

SEQ ID NO: 3315960 - RNA, 17 nt, Human
aaacuuuaccuuuuuua

SEQ ID NO: 3315961 - RNA, 17 nt, Human
gguccacccaggagccc

SEQ ID NO: 3315962 - RNA, 12 nt, Human
gguccacccagg

SEQ ID NO: 3315963 - RNA, 13 nt, Human
gguccacccagga

SEQ ID NO: 3315964 - RNA, 15 nt, Human
gguccacccaggagc

SEQ ID NO: 3315965 - RNA, 16 nt, Human
gguccacccaggagcc

SEQ ID NO: 3315966 - RNA, 22 nt, Human
gguaugaucacggcucacugca

SEQ ID NO: 3315967 - RNA, 14 nt, Human
gguaugcaaucaaa

SEQ ID NO: 3315968 - RNA, 17 nt, Human
gcuuugaucccuucuua

SEQ ID NO: 3315969 - RNA, 14 nt, Human
gcuuugaucccuuc

SEQ ID NO: 3315970 - RNA, 15 nt, Human
gcuuuuggucugugu

SEQ ID NO: 3315971 - RNA, 18 nt, Human
gcuuuugucuaugggacu

SEQ ID NO: 3315972 - RNA, 16 nt, Human
ggaaacccagcucugg

SEQ ID NO: 3315973 - RNA, 18 nt, Human
ggaaaauuuuaaaaauac

SEQ ID NO: 3315974 - RNA, 20 nt, Human
ggaagacuucaucccucugg

SEQ ID NO: 3315975 - RNA, 17 nt, Human
ggaagacuucaucccuc

SEQ ID NO: 3315976 - RNA, 16 nt, Human
ggaagacaaugugaaa

SEQ ID NO: 3315977 - RNA, 14 nt, Human
ggaagacaauguga

SEQ ID NO: 3315978 - RNA, 15 nt, Human
ggaacacuccuucac

SEQ ID NO: 3315979 - RNA, 23 nt, Human
ggaacaaggcaaggcugucaauu

SEQ ID NO: 3315980 - RNA, 13 nt, Human
ggaacaccuccuc

SEQ ID NO: 3315981 - RNA, 15 nt, Human
ggaacaaggcaaggc

SEQ ID NO: 3315982 - RNA, 21 nt, Human
ggaacaaggcaaggcugucaa

SEQ ID NO: 3315983 - RNA, 17 nt, Human
ggaacaaggcaaggcug

SEQ ID NO: 3315984 - RNA, 22 nt, Human
ggaaaugggcagagcagagacc

SEQ ID NO: 3315985 - RNA, 18 nt, Human
ggaaaugggcagagcaga

SEQ ID NO: 3315986 - RNA, 17 nt, Human
ggaaaugggcagagcag

SEQ ID NO: 3315987 - RNA, 16 nt, Human
ggaaaugggcagagca

SEQ ID NO: 3315988 - RNA, 14 nt, Human
ggaaaugggcagag

SEQ ID NO: 3315989 - RNA, 23 nt, Human
gcuuccagugaggcucugcccuu

SEQ ID NO: 3315990 - RNA, 20 nt, Human
gcuugaccgugaggccagag

SEQ ID NO: 3315991 - RNA, 12 nt, Human
gcuucuucagag

SEQ ID NO: 3315992 - RNA, 15 nt, Human
gcuucuucagagacu

SEQ ID NO: 3315993 - RNA, 23 nt, Human
gcuuucuacccagcgagcccugg

SEQ ID NO: 3315994 - RNA, 18 nt, Human
gcuuguaaauagcucagg

SEQ ID NO: 3315995 - RNA, 19 nt, Human
gcuuguaaauagcucaggu

SEQ ID NO: 3315996 - RNA, 17 nt, Human
gcuuguaaauagcucag

SEQ ID NO: 3315997 - RNA, 18 nt, Human
gcuugaccuuuaagagaa

SEQ ID NO: 3315998 - RNA, 23 nt, Human
gcuugaccgugaggccagagaca

SEQ ID NO: 3315999 - RNA, 22 nt, Human
gcuuccagugaggcucugcccu

SEQ ID NO: 3316000 - RNA, 23 nt, Human
gcugguucaggguuggccccugc

SEQ ID NO: 3316001 - RNA, 14 nt, Human
gcuucaguggcagc

SEQ ID NO: 3316002 - RNA, 14 nt, Human
gcuucaaggauccu

SEQ ID NO: 3316003 - RNA, 13 nt, Human
gcuguuggcuggg

SEQ ID NO: 3316004 - RNA, 15 nt, Human
gcugcacccucaggc

SEQ ID NO: 3316005 - RNA, 13 nt, Human
gcugcacccucag

SEQ ID NO: 3316006 - RNA, 12 nt, Human
gcugccauccag

SEQ ID NO: 3316007 - RNA, 13 nt, Human
gcugccauccagg

SEQ ID NO: 3316008 - RNA, 15 nt, Human
gcugaggugggagga

SEQ ID NO: 3316009 - RNA, 13 nt, Human
gcugccccuggca

SEQ ID NO: 3316010 - RNA, 16 nt, Human
gcugccccuggcagcc

SEQ ID NO: 3316011 - RNA, 15 nt, Human
gcugccccuggcagc

SEQ ID NO: 3316012 - RNA, 18 nt, Human
gcugcugaaggcucgagc

SEQ ID NO: 3316013 - RNA, 12 nt, Human
gcugcugacagu

SEQ ID NO: 3316014 - RNA, 20 nt, Human
gcucugaucauccacugugc

SEQ ID NO: 3316015 - RNA, 21 nt, Human
gcucugaucauccacugugcc

SEQ ID NO: 3316016 - RNA, 22 nt, Human
gcucugaucauccacugugcca

SEQ ID NO: 3316017 - RNA, 17 nt, Human
gcugaauacagaggcaa

SEQ ID NO: 3316018 - RNA, 23 nt, Human
gcugaaggcucgagcaugccugg

SEQ ID NO: 3316019 - RNA, 23 nt, Human
gcucugguccauagagagcaaga

SEQ ID NO: 3316020 - RNA, 9 nt, Human
gcuccagac

SEQ ID NO: 3316021 - RNA, 23 nt, Human
gcuccagacacauguccaagaag

SEQ ID NO: 3316022 - RNA, 21 nt, Human
gcuccagacacauguccaaga

SEQ ID NO: 3316023 - RNA, 18 nt, Human
gcuccagacacaugucca

SEQ ID NO: 3316024 - RNA, 15 nt, Human
gcuccucuccccagc

SEQ ID NO: 3316025 - RNA, 13 nt, Human
gcuccagcucacc

SEQ ID NO: 3316026 - RNA, 14 nt, Human
gcuccagcucacca

SEQ ID NO: 3316027 - RNA, 23 nt, Human
gcucccaggcauuccccaggagg

SEQ ID NO: 3316028 - RNA, 19 nt, Human
gcucucaggccagcugcuu

SEQ ID NO: 3316029 - RNA, 18 nt, Human
gcucucaggccagcugcu

SEQ ID NO: 3316030 - RNA, 17 nt, Human
gcucucaggccagcugc

SEQ ID NO: 3316031 - RNA, 19 nt, Human
gcucuacugaggugcuaug

SEQ ID NO: 3316032 - RNA, 16 nt, Human
gcuccucuccccagca

SEQ ID NO: 3316033 - RNA, 19 nt, Human
gcuccucuccccagcaagu

SEQ ID NO: 3316034 - RNA, 18 nt, Human
gcucucaaguuaucaggg

SEQ ID NO: 3316035 - RNA, 16 nt, Human
gcucucaggccagcug

SEQ ID NO: 3316036 - RNA, 17 nt, Human
gccugcuaauuccccag

SEQ ID NO: 3316037 - RNA, 23 nt, Human
gccugcuaauuccccagauugca

SEQ ID NO: 3316038 - RNA, 19 nt, Human
gccuccuuugugaggaagc

SEQ ID NO: 3316039 - RNA, 21 nt, Human
gccuccuuugugaggaagccg

SEQ ID NO: 3316040 - RNA, 20 nt, Human
gccuccuuugugaggaagcc

SEQ ID NO: 3316041 - RNA, 19 nt, Human
gcuacuguccuacccaccc

SEQ ID NO: 3316042 - RNA, 20 nt, Human
gcuacuguccuacccacccu

SEQ ID NO: 3316043 - RNA, 17 nt, Human
gcguuucuaugacacau

SEQ ID NO: 3316044 - RNA, 16 nt, Human
gcuaauuuuucauuuu

SEQ ID NO: 3316045 - RNA, 14 nt, Human
gcgugcacacacca

SEQ ID NO: 3316046 - RNA, 18 nt, Human
gcgugcacacaccagagc

SEQ ID NO: 3316047 - RNA, 20 nt, Human
gcgugguggacaugcacagc

SEQ ID NO: 3316048 - RNA, 14 nt, Human
gcgauucuucugcu

SEQ ID NO: 3316049 - RNA, 13 nt, Human
gcgauucuucugc

SEQ ID NO: 3316050 - RNA, 17 nt, Human
gcccaggccccugccac

SEQ ID NO: 3316051 - RNA, 14 nt, Human
gccaugugccaggu

SEQ ID NO: 3316052 - RNA, 14 nt, Human
gcccaggcaggucu

SEQ ID NO: 3316053 - RNA, 15 nt, Human
gcccaggccccugcc

SEQ ID NO: 3316054 - RNA, 13 nt, Human
gcccaggccccug

SEQ ID NO: 3316055 - RNA, 13 nt, Human
gcccaggcagguc

SEQ ID NO: 3316056 - RNA, 12 nt, Human
gcccaggcaggu

SEQ ID NO: 3316057 - RNA, 15 nt, Human
gccccugcccggcug

SEQ ID NO: 3316058 - RNA, 21 nt, Human
gccccugcugguucaggguug

SEQ ID NO: 3316059 - RNA, 22 nt, Human
gccccugcugguucaggguugg

SEQ ID NO: 3316060 - RNA, 13 nt, Human
gccagugugacaa

SEQ ID NO: 3316061 - RNA, 13 nt, Human
gccaguugguccc

SEQ ID NO: 3316062 - RNA, 23 nt, Human
gccaguuggucccccuuccaugg

SEQ ID NO: 3316063 - RNA, 22 nt, Human
gccaguuggucccccuuccaug

SEQ ID NO: 3316064 - RNA, 21 nt, Human
gccaguuggucccccuuccau

SEQ ID NO: 3316065 - RNA, 20 nt, Human
gccaguuggucccccuucca

SEQ ID NO: 3316066 - RNA, 18 nt, Human
gccaguuggucccccuuc

SEQ ID NO: 3316067 - RNA, 16 nt, Human
gccaguuggucccccu

SEQ ID NO: 3316068 - RNA, 23 nt, Human
gccagcaggcucucaggccagcu

SEQ ID NO: 3316069 - RNA, 14 nt, Human
gccaggcccucugc

SEQ ID NO: 3316070 - RNA, 13 nt, Human
gccaggcccucug

SEQ ID NO: 3316071 - RNA, 18 nt, Human
gccaggccacaagacccu

SEQ ID NO: 3316072 - RNA, 13 nt, Human
gccaggccacaag

SEQ ID NO: 3316073 - RNA, 22 nt, Human
gccaggccagagggagugacag

SEQ ID NO: 3316074 - RNA, 15 nt, Human
gccaggccagaggga

SEQ ID NO: 3316075 - RNA, 21 nt, Human
gccaggccacaagacccuugu

SEQ ID NO: 3316076 - RNA, 19 nt, Human
cuccgcuuucuacccagcg

SEQ ID NO: 3316077 - RNA, 12 nt, Human
cucccaccucag

SEQ ID NO: 3316078 - RNA, 11 nt, Human
cuccaggugca

SEQ ID NO: 3316079 - RNA, 20 nt, Human
cuccacuuucuagccagagg

SEQ ID NO: 3316080 - RNA, 22 nt, Human
cuccacuuucuagccagaggag

SEQ ID NO: 3316081 - RNA, 15 nt, Human
cuccaagaccuucuc

SEQ ID NO: 3316082 - RNA, 16 nt, Human
cuccaagaccuucucc

SEQ ID NO: 3316083 - RNA, 18 nt, Human
cuccaagaccuucuccuu

SEQ ID NO: 3316084 - RNA, 17 nt, Human
cuccaagaccuucuccu

SEQ ID NO: 3316085 - RNA, 18 nt, Human
cuccagaauuucccaaag

SEQ ID NO: 3316086 - RNA, 15 nt, Human
cuccagaauuuccca

SEQ ID NO: 3316087 - RNA, 19 nt, Human
cuccagacacauguccaag

SEQ ID NO: 3316088 - RNA, 17 nt, Human
cuccagacacaugucca

SEQ ID NO: 3316089 - RNA, 16 nt, Human
cuccagacacaugucc

SEQ ID NO: 3316090 - RNA, 13 nt, Human
cucagugccacua

SEQ ID NO: 3316091 - RNA, 17 nt, Human
cucagucuggcccuucc

SEQ ID NO: 3316092 - RNA, 18 nt, Human
cucagucuggcccuuccu

SEQ ID NO: 3316093 - RNA, 19 nt, Human
cucauguucuuaauucuua

SEQ ID NO: 3316094 - RNA, 18 nt, Human
cucauguucuuaauucuu

SEQ ID NO: 3316095 - RNA, 14 nt, Human
cucauguucuuaau

SEQ ID NO: 3316096 - RNA, 12 nt, Human
cucauguucuua

SEQ ID NO: 3316097 - RNA, 23 nt, Human
cucagccucccgaauagcuggga

SEQ ID NO: 3316098 - RNA, 22 nt, Human
cucagccucccaaagugcuggg

SEQ ID NO: 3316099 - RNA, 21 nt, Human
cucagccucccaaagugcugg

SEQ ID NO: 3316100 - RNA, 14 nt, Human
cucagccucccaaa

SEQ ID NO: 3316101 - RNA, 16 nt, Human
cucagccucccaaagu

SEQ ID NO: 3316102 - RNA, 13 nt, Human
cucagccucccaa

SEQ ID NO: 3316103 - RNA, 13 nt, Human
cucaggccagcug

SEQ ID NO: 3316104 - RNA, 22 nt, Human
cucaggccagcugcuugggcuu

SEQ ID NO: 3316105 - RNA, 21 nt, Human
cucaggccagcugcuugggcu

SEQ ID NO: 3316106 - RNA, 20 nt, Human
cucaggccagcugcuugggc

SEQ ID NO: 3316107 - RNA, 14 nt, Human
cucaggccagcugc

SEQ ID NO: 3316108 - RNA, 21 nt, Human
cucaggccugggggcugggca

SEQ ID NO: 3316109 - RNA, 20 nt, Human
cucaggccugggggcugggc

SEQ ID NO: 3316110 - RNA, 14 nt, Human
cucaggccuggggg

SEQ ID NO: 3316111 - RNA, 13 nt, Human
cucaggccugggg

SEQ ID NO: 3316112 - RNA, 23 nt, Human
cugacccugcuucaaauauuucc

SEQ ID NO: 3316113 - RNA, 19 nt, Human
cugacccaugcugcccugu

SEQ ID NO: 3316114 - RNA, 17 nt, Human
cugacccaugcugcccu

SEQ ID NO: 3316115 - RNA, 18 nt, Human
cugacccaugcugcccug

SEQ ID NO: 3316116 - RNA, 12 nt, Human
cugacagacaca

SEQ ID NO: 3316117 - RNA, 14 nt, Human
cugacagacacagg

SEQ ID NO: 3316118 - RNA, 14 nt, Human
cugaaaauguaugu

SEQ ID NO: 3316119 - RNA, 16 nt, Human
cugaaaauguaugugu

SEQ ID NO: 3316120 - RNA, 19 nt, Human
cugaaggacauugcggaca

SEQ ID NO: 3316121 - RNA, 20 nt, Human
cugaaggacauugcggacag

SEQ ID NO: 3316122 - RNA, 17 nt, Human
cugaaggccccgcccag

SEQ ID NO: 3316123 - RNA, 17 nt, Human
cugaaggcuggguucug

SEQ ID NO: 3316124 - RNA, 14 nt, Human
cugaaggccccgcc

SEQ ID NO: 3316125 - RNA, 13 nt, Human
cugaaggccccgc

SEQ ID NO: 3316126 - RNA, 21 nt, Human
cucuguacagagcccacgccc

SEQ ID NO: 3316127 - RNA, 17 nt, Human
cucuguacagagcccac

SEQ ID NO: 3316128 - RNA, 15 nt, Human
cucugguuaucuaau

SEQ ID NO: 3316129 - RNA, 19 nt, Human
cucugguccauagagagca

SEQ ID NO: 3316130 - RNA, 18 nt, Human
cucugguccauagagagc

SEQ ID NO: 3316131 - RNA, 16 nt, Human
cucugguccauagaga

SEQ ID NO: 3316132 - RNA, 17 nt, Human
cucugcugacagacaca

SEQ ID NO: 3316133 - RNA, 18 nt, Human
cucugcugacagacacag

SEQ ID NO: 3316134 - RNA, 19 nt, Human
cucugcugacagacacagg

SEQ ID NO: 3316135 - RNA, 15 nt, Human
cucugguccauagag

SEQ ID NO: 3316136 - RNA, 23 nt, Human
cucugcagcaauaaagcagcguu

SEQ ID NO: 3316137 - RNA, 19 nt, Human
cucugcagcaauaaagcag

SEQ ID NO: 3316138 - RNA, 18 nt, Human
cucugcagcaauaaagca

SEQ ID NO: 3316139 - RNA, 13 nt, Human
cucugcagcaaua

SEQ ID NO: 3316140 - RNA, 15 nt, Human
cucucacuccuugaa

SEQ ID NO: 3316141 - RNA, 19 nt, Human
cucucagauuguaccauug

SEQ ID NO: 3316142 - RNA, 14 nt, Human
cucucacuccuuga

SEQ ID NO: 3316143 - RNA, 12 nt, Human
cucucacuccuu

SEQ ID NO: 3316144 - RNA, 15 nt, Human
cucugaaggacauug

SEQ ID NO: 3316145 - RNA, 21 nt, Human
cucuccgaccagacaccuuga

SEQ ID NO: 3316146 - RNA, 24 nt, Human
cucuccccagcaagugagagcugg

SEQ ID NO: 3316147 - RNA, 18 nt, Human
ccuuuuuuauacauaaac

SEQ ID NO: 3316148 - RNA, 17 nt, Human
ccuuuuuuauacauaaa

SEQ ID NO: 3316149 - RNA, 23 nt, Human
cgaccagacaccuugacagggca

SEQ ID NO: 3316150 - RNA, 21 nt, Human
ccuuuuuuagaguugauacua

SEQ ID NO: 3316151 - RNA, 12 nt, Human
ccuuuuuuauac

SEQ ID NO: 3316152 - RNA, 14 nt, Human
ccuuuagcgcccag

SEQ ID NO: 3316153 - RNA, 20 nt, Human
ccuuuagcgcccaguugggu

SEQ ID NO: 3316154 - RNA, 20 nt, Human
ccuuuucgcaggauucuucc

SEQ ID NO: 3316155 - RNA, 20 nt, Human
ccuugccgucuaccugaggg

SEQ ID NO: 3316156 - RNA, 17 nt, Human
ccuugccgucuaccuga

SEQ ID NO: 3316157 - RNA, 15 nt, Human
ccuggccugagcugg

SEQ ID NO: 3316158 - RNA, 14 nt, Human
ccuggccugagcug

SEQ ID NO: 3316159 - RNA, 20 nt, Human
ccuucugacccaugcugccc

SEQ ID NO: 3316160 - RNA, 17 nt, Human
ccuucugacccaugcug

SEQ ID NO: 3316161 - RNA, 16 nt, Human
ccuucugacccaugcu

SEQ ID NO: 3316162 - RNA, 12 nt, Human
ccuucugaccca

SEQ ID NO: 3316163 - RNA, 22 nt, Human
ccuucuggaauaaggagaauga

SEQ ID NO: 3316164 - RNA, 23 nt, Human
ccuucugacccaugcugcccugu

SEQ ID NO: 3316165 - RNA, 22 nt, Human
ccuucugacccaugcugcccug

SEQ ID NO: 3316166 - RNA, 21 nt, Human
ccuucugacccaugcugcccu

SEQ ID NO: 3316167 - RNA, 17 nt, Human
cggcucacugcagccuc

SEQ ID NO: 3316168 - RNA, 19 nt, Human
cggcucacugcagccucaa

SEQ ID NO: 3316169 - RNA, 18 nt, Human
cggcucacugcagccuca

SEQ ID NO: 3316170 - RNA, 15 nt, Human
cggccuuuggcuuca

SEQ ID NO: 3316171 - RNA, 12 nt, Human
cgccaaggcugg

SEQ ID NO: 3316172 - RNA, 16 nt, Human
cgccaaggcuggggga

SEQ ID NO: 3316173 - RNA, 13 nt, Human
cgccaaggcuggg

SEQ ID NO: 3316174 - RNA, 13 nt, Human
cgaguagcuggga

SEQ ID NO: 3316175 - RNA, 14 nt, Human
cgaguagcugggac

SEQ ID NO: 3316176 - RNA, 15 nt, Human
cgaguagcugggacu

SEQ ID NO: 3316177 - RNA, 18 nt, Human
cgaguuacagacaaagcg

SEQ ID NO: 3316178 - RNA, 17 nt, Human
cgaguuacagacaaagc

SEQ ID NO: 3316179 - RNA, 12 nt, Human
cuagcagcaggg

SEQ ID NO: 3316180 - RNA, 22 nt, Human
cuagcagcagggagggcuucug

SEQ ID NO: 3316181 - RNA, 23 nt, Human
cuagcagcagggagggcuucugc

SEQ ID NO: 3316182 - RNA, 17 nt, Human
cuagcauggcugccaau

SEQ ID NO: 3316183 - RNA, 19 nt, Human
cuagaaauuccccacccug

SEQ ID NO: 3316184 - RNA, 14 nt, Human
cuaccugaggggcc

SEQ ID NO: 3316185 - RNA, 11 nt, Human
cuaccugaggg

SEQ ID NO: 3316186 - RNA, 22 nt, Human
cuaguuccaccaucaagccacc

SEQ ID NO: 3316187 - RNA, 14 nt, Human
cuaguuccaccauc

SEQ ID NO: 3316188 - RNA, 20 nt, Human
cuaguuccaccaucaagcca

SEQ ID NO: 3316189 - RNA, 18 nt, Human
cuaguuccaccaucaagc

SEQ ID NO: 3316190 - RNA, 21 nt, Human
cuagggaaaaaccagcgugug

SEQ ID NO: 3316191 - RNA, 19 nt, Human
cuagggaaaaaccagcgug

SEQ ID NO: 3316192 - RNA, 13 nt, Human
cuacaguugaaaa

SEQ ID NO: 3316193 - RNA, 17 nt, Human
cuacaguccucccaucu

SEQ ID NO: 3316194 - RNA, 16 nt, Human
cuacaguccucccauc

SEQ ID NO: 3316195 - RNA, 15 nt, Human
cuacaguccucccau

SEQ ID NO: 3316196 - RNA, 13 nt, Human
cuacaguccuccc

SEQ ID NO: 3316197 - RNA, 18 nt, Human
cuaagugaggaugaaaaa

SEQ ID NO: 3316198 - RNA, 20 nt, Human
cuaagugauccucccaccuc

SEQ ID NO: 3316199 - RNA, 22 nt, Human
cuaagugauccucccaccucag

SEQ ID NO: 3316200 - RNA, 15 nt, Human
cuaacuucaccauau

SEQ ID NO: 3316201 - RNA, 16 nt, Human
cuaacuucaccauauu

SEQ ID NO: 3316202 - RNA, 16 nt, Human
cuaacuuuccuucauu

SEQ ID NO: 3316203 - RNA, 13 nt, Human
ccucuuggguuca

SEQ ID NO: 3316204 - RNA, 19 nt, Human
ccucuugagccuugaacuu

SEQ ID NO: 3316205 - RNA, 13 nt, Human
ccucuugagccuu

SEQ ID NO: 3316206 - RNA, 19 nt, Human
ccugcacuugcagacucua

SEQ ID NO: 3316207 - RNA, 22 nt, Human
ccugcacuugcagacucuacag

SEQ ID NO: 3316208 - RNA, 14 nt, Human
ccucugcugcuggc

SEQ ID NO: 3316209 - RNA, 13 nt, Human
ccucugcugcugg

SEQ ID NO: 3316210 - RNA, 18 nt, Human
ccucugcugcuggcuggu

SEQ ID NO: 3316211 - RNA, 17 nt, Human
ccucugcugcuggcugg

SEQ ID NO: 3316212 - RNA, 16 nt, Human
ccucugcugcuggcug

SEQ ID NO: 3316213 - RNA, 15 nt, Human
ccucugcugcuggcu

SEQ ID NO: 3316214 - RNA, 22 nt, Human
ccucugccugaagucacacagu

SEQ ID NO: 3316215 - RNA, 21 nt, Human
ccucugccugaagucacacag

SEQ ID NO: 3316216 - RNA, 12 nt, Human
ccucucucaggc

SEQ ID NO: 3316217 - RNA, 17 nt, Human
ccucucucacuccuuga

SEQ ID NO: 3316218 - RNA, 15 nt, Human
ccucucucacuccuu

SEQ ID NO: 3316219 - RNA, 14 nt, Human
ccucucucacuccu

SEQ ID NO: 3316220 - RNA, 13 nt, Human
ccucucucacucc

SEQ ID NO: 3316221 - RNA, 12 nt, Human
ccucucucacuc

SEQ ID NO: 3316222 - RNA, 14 nt, Human
ccucucucaggcca

SEQ ID NO: 3316223 - RNA, 12 nt, Human
ccuggccucugc

SEQ ID NO: 3316224 - RNA, 13 nt, Human
ccuggccugagcu

SEQ ID NO: 3316225 - RNA, 15 nt, Human
ccuggccucugcacu

SEQ ID NO: 3316226 - RNA, 14 nt, Human
ccuggccucugcac

SEQ ID NO: 3316227 - RNA, 14 nt, Human
ccugcccaggcccc

SEQ ID NO: 3316228 - RNA, 15 nt, Human
ccugcccaggccccu

SEQ ID NO: 3316229 - RNA, 22 nt, Human
ccugcccaggccccugccaccc

SEQ ID NO: 3316230 - RNA, 16 nt, Human
ccugcccaggccccug

SEQ ID NO: 3316231 - RNA, 12 nt, Human
ccugcugggugu

SEQ ID NO: 3316232 - RNA, 20 nt, Human
ccugcuggguguggcgcagc

SEQ ID NO: 3316233 - RNA, 14 nt, Human
ccugcugggugugg

SEQ ID NO: 3316234 - RNA, 19 nt, Human
ccuggaugcagccucacag

SEQ ID NO: 3316235 - RNA, 17 nt, Human
ccuggaugcagccucac

SEQ ID NO: 3316236 - RNA, 14 nt, Human
ccuggaugcagccu

SEQ ID NO: 3316237 - RNA, 13 nt, Human
ccuggaugcagcc

SEQ ID NO: 3316238 - RNA, 15 nt, Human
ccuggaguucugguu

SEQ ID NO: 3316239 - RNA, 17 nt, Human
ccuggaguucugguucc

SEQ ID NO: 3316240 - RNA, 16 nt, Human
ccuggaguucugguuc

SEQ ID NO: 3316241 - RNA, 23 nt, Human
ccucagccucccaaagugcuggg

SEQ ID NO: 3316242 - RNA, 22 nt, Human
ccucagccucccgaauagcugg

SEQ ID NO: 3316243 - RNA, 13 nt, Human
ccucauguucuua

SEQ ID NO: 3316244 - RNA, 20 nt, Human
ccuccaagaccuucuccuuc

SEQ ID NO: 3316245 - RNA, 19 nt, Human
ccucauguucuuaauucuu

SEQ ID NO: 3316246 - RNA, 23 nt, Human
ccucccaacucaccccagcccca

SEQ ID NO: 3316247 - RNA, 22 nt, Human
ccucccaaggggcccaaauucu

SEQ ID NO: 3316248 - RNA, 11 nt, Human
ccucagccucc

SEQ ID NO: 3316249 - RNA, 22 nt, Human
ccucagccucccaaagugcugg

SEQ ID NO: 3316250 - RNA, 15 nt, Human
ccucaagagaaggca

SEQ ID NO: 3316251 - RNA, 15 nt, Human
ccucaacucuccucc

SEQ ID NO: 3316252 - RNA, 16 nt, Human
ccucaaccuccugggc

SEQ ID NO: 3316253 - RNA, 16 nt, Human
cccuucgcuccugugu

SEQ ID NO: 3316254 - RNA, 18 nt, Human
cccuucgcuccugugucu

SEQ ID NO: 3316255 - RNA, 16 nt, Human
cccuucuaccuuccug

SEQ ID NO: 3316256 - RNA, 23 nt, Human
cccuucugacccaugcugcccug

SEQ ID NO: 3316257 - RNA, 22 nt, Human
cccuucugacccaugcugcccu

SEQ ID NO: 3316258 - RNA, 21 nt, Human
cccuucugacccaugcugccc

SEQ ID NO: 3316259 - RNA, 16 nt, Human
ccgccaugcuccuggc

SEQ ID NO: 3316260 - RNA, 12 nt, Human
ccgcccaggcuu

SEQ ID NO: 3316261 - RNA, 20 nt, Human
ccgcccaggcuuagucacug

SEQ ID NO: 3316262 - RNA, 20 nt, Human
ccgaauagcugggacuacag

SEQ ID NO: 3316263 - RNA, 17 nt, Human
ccgaauagcugggacua

SEQ ID NO: 3316264 - RNA, 18 nt, Human
ccgaccagacaccuugac

SEQ ID NO: 3316265 - RNA, 17 nt, Human
ccgccaaggcuggggga

SEQ ID NO: 3316266 - RNA, 16 nt, Human
ccgacccuugccgucu

SEQ ID NO: 3316267 - RNA, 13 nt, Human
cccugcccugugg

SEQ ID NO: 3316268 - RNA, 12 nt, Human
cccugcccugug

SEQ ID NO: 3316269 - RNA, 11 nt, Human
cccugcccugu

SEQ ID NO: 3316270 - RNA, 14 nt, Human
cccugcccuguggg

SEQ ID NO: 3316271 - RNA, 15 nt, Human
cccugcccugugggc

SEQ ID NO: 3316272 - RNA, 20 nt, Human
cccugcccugugggccccca

SEQ ID NO: 3316273 - RNA, 16 nt, Human
cccugcccugugggcc

SEQ ID NO: 3316274 - RNA, 13 nt, Human
cccuggcagcccc

SEQ ID NO: 3316275 - RNA, 12 nt, Human
cccuggcagccc

SEQ ID NO: 3316276 - RNA, 16 nt, Human
cccuggcagccccugu

SEQ ID NO: 3316277 - RNA, 14 nt, Human
cccuggcagccccu

SEQ ID NO: 3316278 - RNA, 18 nt, Human
cccuauuagagaagagau

SEQ ID NO: 3316279 - RNA, 22 nt, Human
cccgggaagggggcugggacau

SEQ ID NO: 3316280 - RNA, 11 nt, Human
cccggcuccag

SEQ ID NO: 3316281 - RNA, 12 nt, Human
cccggcuccagg

SEQ ID NO: 3316282 - RNA, 14 nt, Human
cccggccaccugcg

SEQ ID NO: 3316283 - RNA, 13 nt, Human
cccggccaccugc

SEQ ID NO: 3316284 - RNA, 13 nt, Human
cccggcuccaggc

SEQ ID NO: 3316285 - RNA, 14 nt, Human
cccggcuccaggcu

SEQ ID NO: 3316286 - RNA, 15 nt, Human
cccggcuccaggcuc

SEQ ID NO: 3316287 - RNA, 16 nt, Human
cccggcuccaggcucc

SEQ ID NO: 3316288 - RNA, 14 nt, Human
cccgaauagcuggg

SEQ ID NO: 3316289 - RNA, 22 nt, Human
ccccaaaacucuccucugcugc

SEQ ID NO: 3316290 - RNA, 23 nt, Human
ccccaaaacucuccucugcugcu

SEQ ID NO: 3316291 - RNA, 21 nt, Human
ccccaaaacucuccucugcug

SEQ ID NO: 3316292 - RNA, 23 nt, Human
ccccgacccuugccgucuaccug

SEQ ID NO: 3316293 - RNA, 22 nt, Human
cccccaaauggaaaugggcaga

SEQ ID NO: 3316294 - RNA, 21 nt, Human
ccccagcaagugagagcuggg

SEQ ID NO: 3316295 - RNA, 22 nt, Human
ccccagcaagugagagcugggu

SEQ ID NO: 3316296 - RNA, 17 nt, Human
cccacccccacccaagg

SEQ ID NO: 3316297 - RNA, 15 nt, Human
cccacccccacccaa

SEQ ID NO: 3316298 - RNA, 12 nt, Human
cccacccccacc

SEQ ID NO: 3316299 - RNA, 18 nt, Human
cccacccaagggccuggc

SEQ ID NO: 3316300 - RNA, 18 nt, Human
cccacccugaaagcccug

SEQ ID NO: 3316301 - RNA, 22 nt, Human
cccacccaagggccuggccuga

SEQ ID NO: 3316302 - RNA, 21 nt, Human
cccacccaagggccuggccug

SEQ ID NO: 3316303 - RNA, 20 nt, Human
cccacccaagggccuggccu

SEQ ID NO: 3316304 - RNA, 19 nt, Human
cccacugcuuuuggucugu

SEQ ID NO: 3316305 - RNA, 12 nt, Human
cccacugcucug

SEQ ID NO: 3316306 - RNA, 13 nt, Human
cccacugcucugg

SEQ ID NO: 3316307 - RNA, 13 nt, Human
cccaggcuggcgu

SEQ ID NO: 3316308 - RNA, 17 nt, Human
cccaggcuggcgugcag

SEQ ID NO: 3316309 - RNA, 22 nt, Human
cccagcuuaaaggggcuagagu

SEQ ID NO: 3316310 - RNA, 23 nt, Human
cccagcucugguccauagagagc

SEQ ID NO: 3316311 - RNA, 16 nt, Human
ccaccuuggcucaagu

SEQ ID NO: 3316312 - RNA, 17 nt, Human
ccagagggccugcaagg

SEQ ID NO: 3316313 - RNA, 19 nt, Human
ccagagggccugcaaggga

SEQ ID NO: 3316314 - RNA, 18 nt, Human
ccagagggccugcaaggg

SEQ ID NO: 3316315 - RNA, 18 nt, Human
ccagaugcaccagcccuu

SEQ ID NO: 3316316 - RNA, 17 nt, Human
ccagaugcaccagcccu

SEQ ID NO: 3316317 - RNA, 15 nt, Human
ccagaugcaccagcc

SEQ ID NO: 3316318 - RNA, 16 nt, Human
ccaggaaaggcuccag

SEQ ID NO: 3316319 - RNA, 15 nt, Human
ccaggaaaggcucca

SEQ ID NO: 3316320 - RNA, 14 nt, Human
ccaggaaaggcucc

SEQ ID NO: 3316321 - RNA, 12 nt, Human
ccaggaagccag

SEQ ID NO: 3316322 - RNA, 13 nt, Human
ccaggaagccagc

SEQ ID NO: 3316323 - RNA, 19 nt, Human
ccagcuuaaaggggcuaga

SEQ ID NO: 3316324 - RNA, 17 nt, Human
ccagcuguucagcuggu

SEQ ID NO: 3316325 - RNA, 22 nt, Human
ccagcucaccagccccagugcc

SEQ ID NO: 3316326 - RNA, 16 nt, Human
ccagcuguucagcugg

SEQ ID NO: 3316327 - RNA, 15 nt, Human
ccagcucaccagccc

SEQ ID NO: 3316328 - RNA, 16 nt, Human
ccagcucaccagcccc

SEQ ID NO: 3316329 - RNA, 11 nt, Human
ccagccccugg

SEQ ID NO: 3316330 - RNA, 20 nt, Human
ccagcagccuggacccugug

SEQ ID NO: 3316331 - RNA, 15 nt, Human
ccagcaggcucucag

SEQ ID NO: 3316332 - RNA, 13 nt, Human
ccagcaggcucuc

SEQ ID NO: 3316333 - RNA, 17 nt, Human
ccaguuggguggaugcc

SEQ ID NO: 3316334 - RNA, 19 nt, Human
ccaguuggguggaugccug

SEQ ID NO: 3316335 - RNA, 20 nt, Human
ccaguuggguggaugccugg

SEQ ID NO: 3316336 - RNA, 17 nt, Human
ccaucccugaaggcccc

SEQ ID NO: 3316337 - RNA, 15 nt, Human
ccaucccugaaggcc

SEQ ID NO: 3316338 - RNA, 14 nt, Human
ccaucccugaaggc

SEQ ID NO: 3316339 - RNA, 23 nt, Human
ccaguuggucccccuuccaugga

SEQ ID NO: 3316340 - RNA, 15 nt, Human
ccaucccagccccaa

SEQ ID NO: 3316341 - RNA, 13 nt, Human
ccaucccagcccc

SEQ ID NO: 3316342 - RNA, 14 nt, Human
ccaucccagcccca

SEQ ID NO: 3316343 - RNA, 21 nt, Human
ccaugagccucagcauccugg

SEQ ID NO: 3316344 - RNA, 23 nt, Human
ccaugagccucagcauccuggca

SEQ ID NO: 3316345 - RNA, 20 nt, Human
ccauggucggaaaacaugcu

SEQ ID NO: 3316346 - RNA, 19 nt, Human
ccaggggaaaaucagccug

SEQ ID NO: 3316347 - RNA, 13 nt, Human
ccaggggugggac

SEQ ID NO: 3316348 - RNA, 20 nt, Human
ccaggggaaaaucagccugc

SEQ ID NO: 3316349 - RNA, 17 nt, Human
ccaggggugggacaccc

SEQ ID NO: 3316350 - RNA, 14 nt, Human
ccaggggugggaca

SEQ ID NO: 3316351 - RNA, 23 nt, Human
ccaggggugggacacccugugau

SEQ ID NO: 3316352 - RNA, 16 nt, Human
ccaggcuggcgugcag

SEQ ID NO: 3316353 - RNA, 20 nt, Human
ccaggcuccuuuagcgccca

SEQ ID NO: 3316354 - RNA, 21 nt, Human
ccaggcuccuuuagcgcccag

SEQ ID NO: 3316355 - RNA, 17 nt, Human
ccaggcuggcgugcagu

SEQ ID NO: 3316356 - RNA, 18 nt, Human
ccaggcuggcgugcagug

SEQ ID NO: 3316357 - RNA, 12 nt, Human
cauuaucuagau

SEQ ID NO: 3316358 - RNA, 17 nt, Human
cauuaucuagauacugu

SEQ ID NO: 3316359 - RNA, 16 nt, Human
cauuaucuagauacug

SEQ ID NO: 3316360 - RNA, 15 nt, Human
cauguucucugagga

SEQ ID NO: 3316361 - RNA, 22 nt, Human
cauggccucuucagaucucuaa

SEQ ID NO: 3316362 - RNA, 22 nt, Human
cauggcugccaaugggagcuca

SEQ ID NO: 3316363 - RNA, 17 nt, Human
cauggcugccaauggga

SEQ ID NO: 3316364 - RNA, 18 nt, Human
cauuaucuagauacugua

SEQ ID NO: 3316365 - RNA, 21 nt, Human
cauucuccaccugccagggac

SEQ ID NO: 3316366 - RNA, 16 nt, Human
cauucuccuuguguua

SEQ ID NO: 3316367 - RNA, 17 nt, Human
ccaaaacucuccucugc

SEQ ID NO: 3316368 - RNA, 17 nt, Human
ccaaaaaaugcuugcuu

SEQ ID NO: 3316369 - RNA, 23 nt, Human
cauuuuucuuagggaaggauaca

SEQ ID NO: 3316370 - RNA, 23 nt, Human
cauuuggugguuucagaaaugug

SEQ ID NO: 3316371 - RNA, 22 nt, Human
cauuuggugguuucagaaaugu

SEQ ID NO: 3316372 - RNA, 21 nt, Human
cauuuggugguuucagaaaug

SEQ ID NO: 3316373 - RNA, 16 nt, Human
cauuuauucugcucac

SEQ ID NO: 3316374 - RNA, 15 nt, Human
cauuuauucugcuca

SEQ ID NO: 3316375 - RNA, 18 nt, Human
cauugcugggcuugucug

SEQ ID NO: 3316376 - RNA, 14 nt, Human
cauugcggacagcc

SEQ ID NO: 3316377 - RNA, 15 nt, Human
cauugcggacagcca

SEQ ID NO: 3316378 - RNA, 17 nt, Human
cauugcggacagccacg

SEQ ID NO: 3316379 - RNA, 21 nt, Human
cauugcggacagccacggcca

SEQ ID NO: 3316380 - RNA, 16 nt, Human
ccaaaucauaguggcu

SEQ ID NO: 3316381 - RNA, 16 nt, Human
ccaacgucugugccau

SEQ ID NO: 3316382 - RNA, 14 nt, Human
ccaaagugcuggga

SEQ ID NO: 3316383 - RNA, 23 nt, Human
ccaaugcacuuuguucuggcucu

SEQ ID NO: 3316384 - RNA, 22 nt, Human
ccaaugcacuuuguucuggcuc

SEQ ID NO: 3316385 - RNA, 20 nt, Human
ccaaugcacuuuguucuggc

SEQ ID NO: 3316386 - RNA, 20 nt, Human
ccaagcuggucccacucagu

SEQ ID NO: 3316387 - RNA, 20 nt, Human
ccaauguucucucuucucca

SEQ ID NO: 3316388 - RNA, 13 nt, Human
ccaccuuggcuca

SEQ ID NO: 3316389 - RNA, 14 nt, Human
ccaccuuggcucaa

SEQ ID NO: 3316390 - RNA, 15 nt, Human
ccaccuuggcucaag

SEQ ID NO: 3316391 - RNA, 13 nt, Human
ccaccgcagacag

SEQ ID NO: 3316392 - RNA, 18 nt, Human
ccaccgcagacaggacca

SEQ ID NO: 3316393 - RNA, 13 nt, Human
ccacccugcucuc

SEQ ID NO: 3316394 - RNA, 15 nt, Human
ccaccaucaagccac

SEQ ID NO: 3316395 - RNA, 20 nt, Human
ccaccaucaagccaccaaca

SEQ ID NO: 3316396 - RNA, 17 nt, Human
ccaccgcagacaggacc

SEQ ID NO: 3316397 - RNA, 14 nt, Human
ccaccgcagacagg

SEQ ID NO: 3316398 - RNA, 17 nt, Human
ccaccaucaagccacca

SEQ ID NO: 3316399 - RNA, 16 nt, Human
ccaccaucaagccacc

SEQ ID NO: 3316400 - RNA, 21 nt, Human
cauaaugcgugcauaccacuu

SEQ ID NO: 3316401 - RNA, 15 nt, Human
cauacaauuccaaac

SEQ ID NO: 3316402 - RNA, 16 nt, Human
cauauuaccacagaca

SEQ ID NO: 3316403 - RNA, 17 nt, Human
cauauuaccacagacau

SEQ ID NO: 3316404 - RNA, 21 nt, Human
cauauuaccacagacauacua

SEQ ID NO: 3316405 - RNA, 20 nt, Human
cauauuaccacagacauacu

SEQ ID NO: 3316406 - RNA, 17 nt, Human
cauaaugcgugcauacc

SEQ ID NO: 3316407 - RNA, 14 nt, Human
cauaaugcgugcau

SEQ ID NO: 3316408 - RNA, 18 nt, Human
cagucaccccggccaccu

SEQ ID NO: 3316409 - RNA, 14 nt, Human
caugacacgaauau

SEQ ID NO: 3316410 - RNA, 24 nt, Human
caugauuaaccacuucagcugacu

SEQ ID NO: 3316411 - RNA, 18 nt, Human
caugacacgaauauugcu

SEQ ID NO: 3316412 - RNA, 17 nt, Human
caugacacgaauauugc

SEQ ID NO: 3316413 - RNA, 15 nt, Human
caugcaaggucauuu

SEQ ID NO: 3316414 - RNA, 22 nt, Human
caugcaaggucauuuuuuuuaa

SEQ ID NO: 3316415 - RNA, 18 nt, Human
caugcaaggucauuuuuu

SEQ ID NO: 3316416 - RNA, 17 nt, Human
caugcaaggucauuuuu

SEQ ID NO: 3316417 - RNA, 15 nt, Human
caugcugcccuguga

SEQ ID NO: 3316418 - RNA, 19 nt, Human
cauggccuuugcuugaaag

SEQ ID NO: 3316419 - RNA, 22 nt, Human
cauggccuuugcuugaaagaaa

SEQ ID NO: 3316420 - RNA, 18 nt, Human
caugcugcccugugagua

SEQ ID NO: 3316421 - RNA, 16 nt, Human
caugcugcccugugag

SEQ ID NO: 3316422 - RNA, 13 nt, Human
caucaggccaggc

SEQ ID NO: 3316423 - RNA, 18 nt, Human
caucagcacgauuucugu

SEQ ID NO: 3316424 - RNA, 17 nt, Human
caucagcacgauuucug

SEQ ID NO: 3316425 - RNA, 23 nt, Human
cauccuggcacccggccccugcu

SEQ ID NO: 3316426 - RNA, 13 nt, Human
caucccagcccca

SEQ ID NO: 3316427 - RNA, 14 nt, Human
caucccagccccaa

SEQ ID NO: 3316428 - RNA, 16 nt, Human
caucccagccccaaug

SEQ ID NO: 3316429 - RNA, 12 nt, Human
caucccagcccc

SEQ ID NO: 3316430 - RNA, 23 nt, Human
caucaggccaggcccucugccca

SEQ ID NO: 3316431 - RNA, 22 nt, Human
caucaggccaggcccucugccc

SEQ ID NO: 3316432 - RNA, 21 nt, Human
caucaggccaggcccucugcc

SEQ ID NO: 3316433 - RNA, 20 nt, Human
caucaggccaggcccucugc

SEQ ID NO: 3316434 - RNA, 22 nt, Human
caucuuagguuggcaaaaaggc

SEQ ID NO: 3316435 - RNA, 21 nt, Human
caucuuagguuggcaaaaagg

SEQ ID NO: 3316436 - RNA, 19 nt, Human
caucugugaaaggaaagag

SEQ ID NO: 3316437 - RNA, 18 nt, Human
caucugugaaaggaaaga

SEQ ID NO: 3316438 - RNA, 16 nt, Human
cagcuguucagcuggu

SEQ ID NO: 3316439 - RNA, 15 nt, Human
cagcuguucagcugg

SEQ ID NO: 3316440 - RNA, 23 nt, Human
caggaaaggcuccaggagcagcc

SEQ ID NO: 3316441 - RNA, 22 nt, Human
caggaaaggcuccaggagcagc

SEQ ID NO: 3316442 - RNA, 21 nt, Human
caggaaaggcuccaggagcag

SEQ ID NO: 3316443 - RNA, 19 nt, Human
caggaaaagcugcugacag

SEQ ID NO: 3316444 - RNA, 20 nt, Human
caggaaaagcugcugacagu

SEQ ID NO: 3316445 - RNA, 20 nt, Human
caggaaaggcuccaggagca

SEQ ID NO: 3316446 - RNA, 13 nt, Human
caggaccagggau

SEQ ID NO: 3316447 - RNA, 16 nt, Human
caggccaggcccucug

SEQ ID NO: 3316448 - RNA, 15 nt, Human
caggccaggcccucu

SEQ ID NO: 3316449 - RNA, 14 nt, Human
caggccaggcccuc

SEQ ID NO: 3316450 - RNA, 13 nt, Human
caggccaggcccu

SEQ ID NO: 3316451 - RNA, 17 nt, Human
caggcaaugcuggcugu

SEQ ID NO: 3316452 - RNA, 21 nt, Human
caggcaaugcuggcuguuggc

SEQ ID NO: 3316453 - RNA, 19 nt, Human
caggcaaugcuggcuguug

SEQ ID NO: 3316454 - RNA, 20 nt, Human
caggcaaugcuggcuguugg

SEQ ID NO: 3316455 - RNA, 13 nt, Human
caggaggccagcc

SEQ ID NO: 3316456 - RNA, 12 nt, Human
caggaggccagc

SEQ ID NO: 3316457 - RNA, 15 nt, Human
caggccagcugcuug

SEQ ID NO: 3316458 - RNA, 13 nt, Human
caggccagcugcu

SEQ ID NO: 3316459 - RNA, 23 nt, Human
caggccagagggagugacagagg

SEQ ID NO: 3316460 - RNA, 15 nt, Human
caggcugggagagcc

SEQ ID NO: 3316461 - RNA, 14 nt, Human
caggcugggcuuca

SEQ ID NO: 3316462 - RNA, 16 nt, Human
cagggagggcuucugc

SEQ ID NO: 3316463 - RNA, 12 nt, Human
cagggcucagcg

SEQ ID NO: 3316464 - RNA, 15 nt, Human
cagggcucagcgggg

SEQ ID NO: 3316465 - RNA, 15 nt, Human
caggcuggcgugcag

SEQ ID NO: 3316466 - RNA, 19 nt, Human
caggcugggagagccuucc

SEQ ID NO: 3316467 - RNA, 18 nt, Human
caggcugggagagccuuc

SEQ ID NO: 3316468 - RNA, 16 nt, Human
caggcugggagagccu

SEQ ID NO: 3316469 - RNA, 17 nt, Human
caggcuggcgugcagug

SEQ ID NO: 3316470 - RNA, 23 nt, Human
caggccugggggcugggcagagg

SEQ ID NO: 3316471 - RNA, 18 nt, Human
caggcuggcgugcagugg

SEQ ID NO: 3316472 - RNA, 19 nt, Human
caggcuggcgugcaguggu

SEQ ID NO: 3316473 - RNA, 22 nt, Human
caggccugggggcugggcagag

SEQ ID NO: 3316474 - RNA, 20 nt, Human
caggccugggggcugggcag

SEQ ID NO: 3316475 - RNA, 14 nt, Human
cagucaccccggcc

SEQ ID NO: 3316476 - RNA, 17 nt, Human
cagucaccccggccacc

SEQ ID NO: 3316477 - RNA, 16 nt, Human
cagucaccccggccac

SEQ ID NO: 3316478 - RNA, 18 nt, Human
caguaaaugggggugcau

SEQ ID NO: 3316479 - RNA, 19 nt, Human
caguauuacuucugcuaca

SEQ ID NO: 3316480 - RNA, 19 nt, Human
caguaaaugggggugcauu

SEQ ID NO: 3316481 - RNA, 13 nt, Human
caggugcugccau

SEQ ID NO: 3316482 - RNA, 14 nt, Human
caggugcugccauc

SEQ ID NO: 3316483 - RNA, 14 nt, Human
caggguuggccccu

SEQ ID NO: 3316484 - RNA, 17 nt, Human
caggguuggccccugcc

SEQ ID NO: 3316485 - RNA, 21 nt, Human
caggguuggccccugcccggc

SEQ ID NO: 3316486 - RNA, 23 nt, Human
cagguuuuuggucugacccacug

SEQ ID NO: 3316487 - RNA, 15 nt, Human
caggguuggccccug

SEQ ID NO: 3316488 - RNA, 16 nt, Human
caggguuggccccugc

SEQ ID NO: 3316489 - RNA, 21 nt, Human
cagggucucuaccauccccug

SEQ ID NO: 3316490 - RNA, 22 nt, Human
cagggucucacucugucgccca

SEQ ID NO: 3316491 - RNA, 23 nt, Human
cagggucucacucugucgcccag

SEQ ID NO: 3316492 - RNA, 23 nt, Human
cagauacaggaaaagcugcugac

SEQ ID NO: 3316493 - RNA, 20 nt, Human
cagagacuccugcaggcagc

SEQ ID NO: 3316494 - RNA, 22 nt, Human
cagagacuccugcaggcagcca

SEQ ID NO: 3316495 - RNA, 21 nt, Human
cagagacuccugcaggcagcc

SEQ ID NO: 3316496 - RNA, 19 nt, Human
cagagacuccugcaggcag

SEQ ID NO: 3316497 - RNA, 14 nt, Human
cagagccugcaguu

SEQ ID NO: 3316498 - RNA, 22 nt, Human
cagagagggugggagugggccc

SEQ ID NO: 3316499 - RNA, 20 nt, Human
cagagagggugggagugggc

SEQ ID NO: 3316500 - RNA, 13 nt, Human
cagagaggguggg

SEQ ID NO: 3316501 - RNA, 16 nt, Human
cagagagggugggagu

SEQ ID NO: 3316502 - RNA, 22 nt, Human
cagagcuacacaggggaaaaga

SEQ ID NO: 3316503 - RNA, 17 nt, Human
cagagcuacacagggga

SEQ ID NO: 3316504 - RNA, 23 nt, Human
cagccgccaugcuccuggcccac

SEQ ID NO: 3316505 - RNA, 13 nt, Human
cagcccuuagcag

SEQ ID NO: 3316506 - RNA, 14 nt, Human
cagcguuucuauga

SEQ ID NO: 3316507 - RNA, 16 nt, Human
cagcguuucuaugaca

SEQ ID NO: 3316508 - RNA, 23 nt, Human
cagccccauucugccugcccagg

SEQ ID NO: 3316509 - RNA, 24 nt, Human
cagccccauucugccugcccaggc

SEQ ID NO: 3316510 - RNA, 19 nt, Human
cagccccauucugccugcc

SEQ ID NO: 3316511 - RNA, 20 nt, Human
cagccccauucugccugccc

SEQ ID NO: 3316512 - RNA, 22 nt, Human
cagccccauucugccugcccag

SEQ ID NO: 3316513 - RNA, 18 nt, Human
cagcauauucaggaagcu

SEQ ID NO: 3316514 - RNA, 17 nt, Human
cagcauauucaggaagc

SEQ ID NO: 3316515 - RNA, 16 nt, Human
cagcauauucaggaag

SEQ ID NO: 3316516 - RNA, 17 nt, Human
cagcauagaaguaacuu

SEQ ID NO: 3316517 - RNA, 21 nt, Human
cagauugcaacaggcugggcu

SEQ ID NO: 3316518 - RNA, 13 nt, Human
cagauuucacucu

SEQ ID NO: 3316519 - RNA, 18 nt, Human
cagauuucacucuccuug

SEQ ID NO: 3316520 - RNA, 19 nt, Human
cagauuugaacucuucaau

SEQ ID NO: 3316521 - RNA, 16 nt, Human
cagauuucacucuccu

SEQ ID NO: 3316522 - RNA, 15 nt, Human
cagauuucacucucc

SEQ ID NO: 3316523 - RNA, 16 nt, Human
caaaagaugcuucuca

SEQ ID NO: 3316524 - RNA, 18 nt, Human
caaaagaugcuucucacu

SEQ ID NO: 3316525 - RNA, 23 nt, Human
auuuuuuuuuccuucagugccuu

SEQ ID NO: 3316526 - RNA, 15 nt, Human
caaacagaggccgcc

SEQ ID NO: 3316527 - RNA, 19 nt, Human
caaaccaucauugaaaucu

SEQ ID NO: 3316528 - RNA, 21 nt, Human
caaaccaucauugaaaucuuu

SEQ ID NO: 3316529 - RNA, 20 nt, Human
caaagauauuuugcuuugug

SEQ ID NO: 3316530 - RNA, 18 nt, Human
caaagauauuuugcuuug

SEQ ID NO: 3316531 - RNA, 20 nt, Human
caaauggaaaugggcagagc

SEQ ID NO: 3316532 - RNA, 21 nt, Human
caaauggaaaugggcagagca

SEQ ID NO: 3316533 - RNA, 14 nt, Human
caaagaugcagccg

SEQ ID NO: 3316534 - RNA, 23 nt, Human
caaagauauuuugcuuugugauu

SEQ ID NO: 3316535 - RNA, 22 nt, Human
caaagauauuuugcuuugugau

SEQ ID NO: 3316536 - RNA, 14 nt, Human
caaaguagaagucu

SEQ ID NO: 3316537 - RNA, 21 nt, Human
caaaguagaagucuuagaugu

SEQ ID NO: 3316538 - RNA, 22 nt, Human
caaaguacacuguuucaaacuu

SEQ ID NO: 3316539 - RNA, 17 nt, Human
caaagcagugcaugcug

SEQ ID NO: 3316540 - RNA, 15 nt, Human
caaagcagugcaugc

SEQ ID NO: 3316541 - RNA, 23 nt, Human
auuuguuugaacugauaaagaug

SEQ ID NO: 3316542 - RNA, 22 nt, Human
auuuguuugaacugauaaagau

SEQ ID NO: 3316543 - RNA, 20 nt, Human
auuuguuugaacugauaaag

SEQ ID NO: 3316544 - RNA, 13 nt, Human
auuugcuccuuuc

SEQ ID NO: 3316545 - RNA, 20 nt, Human
auuugugauacaaugcugug

SEQ ID NO: 3316546 - RNA, 17 nt, Human
auuugugauacaaugcu

SEQ ID NO: 3316547 - RNA, 15 nt, Human
auuugugauacaaug

SEQ ID NO: 3316548 - RNA, 18 nt, Human
auuaggugugacugaauu

SEQ ID NO: 3316549 - RNA, 16 nt, Human
auuaggugugacugaa

SEQ ID NO: 3316550 - RNA, 21 nt, Human
auuaggugugacugaauuucu

SEQ ID NO: 3316551 - RNA, 19 nt, Human
auucauaaugacuuaagca

SEQ ID NO: 3316552 - RNA, 15 nt, Human
auucauaaugacuua

SEQ ID NO: 3316553 - RNA, 14 nt, Human
auucauaaugacuu

SEQ ID NO: 3316554 - RNA, 17 nt, Human
auuacaggaaguacugg

SEQ ID NO: 3316555 - RNA, 16 nt, Human
auuacaggugugaacc

SEQ ID NO: 3316556 - RNA, 16 nt, Human
auuguuagucucuuga

SEQ ID NO: 3316557 - RNA, 23 nt, Human
auugugucucuugguccugcugc

SEQ ID NO: 3316558 - RNA, 21 nt, Human
auugugucucuugguccugcu

SEQ ID NO: 3316559 - RNA, 18 nt, Human
auugugucucuugguccu

SEQ ID NO: 3316560 - RNA, 12 nt, Human
auugcugcuuga

SEQ ID NO: 3316561 - RNA, 23 nt, Human
auugcugauggugcaaugaccuu

SEQ ID NO: 3316562 - RNA, 14 nt, Human
auugcuugagcuca

SEQ ID NO: 3316563 - RNA, 19 nt, Human
auugcugauggugcaauga

SEQ ID NO: 3316564 - RNA, 18 nt, Human
auugcugauggugcaaug

SEQ ID NO: 3316565 - RNA, 16 nt, Human
auugcugauggugcaa

SEQ ID NO: 3316566 - RNA, 15 nt, Human
auugcugauggugca

SEQ ID NO: 3316567 - RNA, 11 nt, Human
auucuuuccug

SEQ ID NO: 3316568 - RNA, 11 nt, Human
auucuucugcu

SEQ ID NO: 3316569 - RNA, 12 nt, Human
auucuucugcuu

SEQ ID NO: 3316570 - RNA, 21 nt, Human
auugauaagaaccuuuugagu

SEQ ID NO: 3316571 - RNA, 14 nt, Human
auugcuacuguccu

SEQ ID NO: 3316572 - RNA, 15 nt, Human
auugcuacuguccua

SEQ ID NO: 3316573 - RNA, 20 nt, Human
auugcuacuguccuacccac

SEQ ID NO: 3316574 - RNA, 22 nt, Human
auugcuacuguccuacccaccc

SEQ ID NO: 3316575 - RNA, 16 nt, Human
cacuuacacuuuaugc

SEQ ID NO: 3316576 - RNA, 18 nt, Human
cacuuacacuuuaugcac

SEQ ID NO: 3316577 - RNA, 12 nt, Human
cacugcagccuc

SEQ ID NO: 3316578 - RNA, 20 nt, Human
cacugcacuccagccugggu

SEQ ID NO: 3316579 - RNA, 16 nt, Human
cacugcacuccagccu

SEQ ID NO: 3316580 - RNA, 15 nt, Human
cacugcacuccagcc

SEQ ID NO: 3316581 - RNA, 18 nt, Human
cacugcacuccagccugg

SEQ ID NO: 3316582 - RNA, 19 nt, Human
cacugcacuccagccuggg

SEQ ID NO: 3316583 - RNA, 19 nt, Human
cacugcacuauagccuagg

SEQ ID NO: 3316584 - RNA, 13 nt, Human
cacugcagccuca

SEQ ID NO: 3316585 - RNA, 16 nt, Human
cacugcauguuuguga

SEQ ID NO: 3316586 - RNA, 16 nt, Human
cacuccagccugggug

SEQ ID NO: 3316587 - RNA, 13 nt, Human
cacuccccugcug

SEQ ID NO: 3316588 - RNA, 12 nt, Human
cacuccccugcu

SEQ ID NO: 3316589 - RNA, 14 nt, Human
cacuccccugcugg

SEQ ID NO: 3316590 - RNA, 17 nt, Human
caccugccuguugggcc

SEQ ID NO: 3316591 - RNA, 19 nt, Human
caccugccuguugggccag

SEQ ID NO: 3316592 - RNA, 14 nt, Human
caccuuggcucaag

SEQ ID NO: 3316593 - RNA, 15 nt, Human
caccuuggcucaagu

SEQ ID NO: 3316594 - RNA, 13 nt, Human
caccuuggcugca

SEQ ID NO: 3316595 - RNA, 14 nt, Human
caccucagccuccc

SEQ ID NO: 3316596 - RNA, 12 nt, Human
caccucagccuc

SEQ ID NO: 3316597 - RNA, 13 nt, Human
caccucagccucc

SEQ ID NO: 3316598 - RNA, 14 nt, Human
caccugccccucaa

SEQ ID NO: 3316599 - RNA, 15 nt, Human
caccugccccucaac

SEQ ID NO: 3316600 - RNA, 17 nt, Human
cacccugaaagcccuga

SEQ ID NO: 3316601 - RNA, 15 nt, Human
cacccuggggagaaa

SEQ ID NO: 3316602 - RNA, 16 nt, Human
cacccuggggagaaag

SEQ ID NO: 3316603 - RNA, 14 nt, Human
cacccucaggcagg

SEQ ID NO: 3316604 - RNA, 11 nt, Human
caccccagccc

SEQ ID NO: 3316605 - RNA, 11 nt, Human
caauggcagcc

SEQ ID NO: 3316606 - RNA, 12 nt, Human
caauggcagccu

SEQ ID NO: 3316607 - RNA, 14 nt, Human
cacaagagcccagg

SEQ ID NO: 3316608 - RNA, 15 nt, Human
cacaagcuccaagcu

SEQ ID NO: 3316609 - RNA, 14 nt, Human
cacaagcuccaagc

SEQ ID NO: 3316610 - RNA, 13 nt, Human
cacaagcuccaag

SEQ ID NO: 3316611 - RNA, 16 nt, Human
cacaagagcccaggcc

SEQ ID NO: 3316612 - RNA, 21 nt, Human
cacaagcuccaagcucccagg

SEQ ID NO: 3316613 - RNA, 23 nt, Human
cacaagcuccaagcucccaggca

SEQ ID NO: 3316614 - RNA, 17 nt, Human
cacaagcuccaagcucc

SEQ ID NO: 3316615 - RNA, 23 nt, Human
cacaagcugcacccucaggcagg

SEQ ID NO: 3316616 - RNA, 17 nt, Human
cacaagcugcacccuca

SEQ ID NO: 3316617 - RNA, 17 nt, Human
cacacagcucuguccug

SEQ ID NO: 3316618 - RNA, 20 nt, Human
cacacagcucuguccuggga

SEQ ID NO: 3316619 - RNA, 19 nt, Human
cacaggggaaaagaggagu

SEQ ID NO: 3316620 - RNA, 18 nt, Human
cacaggggaaaagaggag

SEQ ID NO: 3316621 - RNA, 17 nt, Human
cacaggggaaaagagga

SEQ ID NO: 3316622 - RNA, 20 nt, Human
cacaguauuacuucugcuac

SEQ ID NO: 3316623 - RNA, 21 nt, Human
cacaguauuacuucugcuaca

SEQ ID NO: 3316624 - RNA, 19 nt, Human
cacaguauuacuucugcua

SEQ ID NO: 3316625 - RNA, 20 nt, Human
cacacaugagcaucaggcca

SEQ ID NO: 3316626 - RNA, 15 nt, Human
cacacauacacacac

SEQ ID NO: 3316627 - RNA, 21 nt, Human
cacacagugagucgaggacag

SEQ ID NO: 3316628 - RNA, 23 nt, Human
cacacagugagucgaggacaggg

SEQ ID NO: 3316629 - RNA, 18 nt, Human
cacacagugagucgagga

SEQ ID NO: 3316630 - RNA, 20 nt, Human
cacacaguauuacuucugcu

SEQ ID NO: 3316631 - RNA, 23 nt, Human
cacacaguauuacuucugcuaca

SEQ ID NO: 3316632 - RNA, 16 nt, Human
cacacagcucuguccu

SEQ ID NO: 3316633 - RNA, 22 nt, Human
cacagaaaauggaagacagcuc

SEQ ID NO: 3316634 - RNA, 20 nt, Human
cacagaaaauggaagacagc

SEQ ID NO: 3316635 - RNA, 19 nt, Human
cacagaaaauggaagacag

SEQ ID NO: 3316636 - RNA, 18 nt, Human
cacagaaaauggaagaca

SEQ ID NO: 3316637 - RNA, 22 nt, Human
cacacaugagcaucaggccagg

SEQ ID NO: 3316638 - RNA, 21 nt, Human
cacacaugagcaucaggccag

SEQ ID NO: 3316639 - RNA, 11 nt, Human
cacagccucug

SEQ ID NO: 3316640 - RNA, 21 nt, Human
cacagacauacuaaccagcag

SEQ ID NO: 3316641 - RNA, 19 nt, Human
cacagacauacuaaccagc

SEQ ID NO: 3316642 - RNA, 19 nt, Human
cacagaaaauucuucucca

SEQ ID NO: 3316643 - RNA, 23 nt, Human
cacagaaaauggaagacagcucu

SEQ ID NO: 3316644 - RNA, 18 nt, Human
cacagacauacuaaccag

SEQ ID NO: 3316645 - RNA, 17 nt, Human
caagucaagugaaaaag

SEQ ID NO: 3316646 - RNA, 13 nt, Human
caagucaagugaa

SEQ ID NO: 3316647 - RNA, 18 nt, Human
caaggccaaaggaagcac

SEQ ID NO: 3316648 - RNA, 17 nt, Human
caaggccaaaggaagca

SEQ ID NO: 3316649 - RNA, 16 nt, Human
caaggccaaaggaagc

SEQ ID NO: 3316650 - RNA, 15 nt, Human
caaggccaaaggaag

SEQ ID NO: 3316651 - RNA, 13 nt, Human
caagcucugcucc

SEQ ID NO: 3316652 - RNA, 12 nt, Human
caagcuccaagc

SEQ ID NO: 3316653 - RNA, 14 nt, Human
caagcucugcuccu

SEQ ID NO: 3316654 - RNA, 13 nt, Human
caagcugcacccu

SEQ ID NO: 3316655 - RNA, 18 nt, Human
caagcugcacccucaggc

SEQ ID NO: 3316656 - RNA, 14 nt, Human
caagcugcacccuc

SEQ ID NO: 3316657 - RNA, 19 nt, Human
caauaaagcagcguuucua

SEQ ID NO: 3316658 - RNA, 18 nt, Human
caagcgugagccacugca

SEQ ID NO: 3316659 - RNA, 17 nt, Human
uaggaaaaacugauuuu

SEQ ID NO: 3316660 - RNA, 16 nt, Human
uaggaaaaacugauuu

SEQ ID NO: 3316661 - RNA, 13 nt, Human
uagggaagauaau

SEQ ID NO: 3316662 - RNA, 14 nt, Human
uaggaaaaacugau

SEQ ID NO: 3316663 - RNA, 13 nt, Human
uaggaaaaacuga

SEQ ID NO: 3316664 - RNA, 17 nt, Human
uagcgcccaguugggug

SEQ ID NO: 3316665 - RNA, 14 nt, Human
uagcgcccaguugg

SEQ ID NO: 3316666 - RNA, 20 nt, Human
uagccugugccucugggacu

SEQ ID NO: 3316667 - RNA, 21 nt, Human
uagccuuagaagucacacagu

SEQ ID NO: 3316668 - RNA, 20 nt, Human
uagccuuagaagucacacag

SEQ ID NO: 3316669 - RNA, 23 nt, Human
acaaugcaaaccaucauugaaau

SEQ ID NO: 3316670 - RNA, 21 nt, Human
acaaugcaaaccaucauugaa

SEQ ID NO: 3316671 - RNA, 19 nt, Human
acaaugcaaaccaucauug

SEQ ID NO: 3316672 - RNA, 19 nt, Human
acaaugacuuacuguacau

SEQ ID NO: 3316673 - RNA, 20 nt, Human
acaaugacuuacuguacaug

SEQ ID NO: 3316674 - RNA, 22 nt, Human
acaaugacuuacuguacaugaa

SEQ ID NO: 3316675 - RNA, 18 nt, Human
acaaugcaaaccaucauu

SEQ ID NO: 3316676 - RNA, 17 nt, Human
acaaugcaaaccaucau

SEQ ID NO: 3316677 - RNA, 16 nt, Human
acaaugcaaaccauca

SEQ ID NO: 3316678 - RNA, 11 nt, Human
acaaugcaaac

SEQ ID NO: 3316679 - RNA, 19 nt, Human
uaggguaagugagagaggg

SEQ ID NO: 3316680 - RNA, 17 nt, Human
uaggguuauaauaaugu

SEQ ID NO: 3316681 - RNA, 15 nt, Human
uaggguuauaauaau

SEQ ID NO: 3316682 - RNA, 23 nt, Human
acacaggcccggcuccaggcucc

SEQ ID NO: 3316683 - RNA, 24 nt, Human
acacaggcccggcuccaggcuccu

SEQ ID NO: 3316684 - RNA, 19 nt, Human
acacaggcccggcuccagg

SEQ ID NO: 3316685 - RNA, 20 nt, Human
acacaggcccggcuccaggc

SEQ ID NO: 3316686 - RNA, 21 nt, Human
acacaggcccggcuccaggcu

SEQ ID NO: 3316687 - RNA, 22 nt, Human
acacaggcccggcuccaggcuc

SEQ ID NO: 3316688 - RNA, 22 nt, Human
acacacacgcgugcacacacca

SEQ ID NO: 3316689 - RNA, 17 nt, Human
acacaggcccggcucca

SEQ ID NO: 3316690 - RNA, 18 nt, Human
acacaggcccggcuccag

SEQ ID NO: 3316691 - RNA, 16 nt, Human
acacaggcccggcucc

SEQ ID NO: 3316692 - RNA, 15 nt, Human
uaguagagacagggu

SEQ ID NO: 3316693 - RNA, 22 nt, Human
uaguagagacaggguuuugcca

SEQ ID NO: 3316694 - RNA, 14 nt, Human
uagucacugagaca

SEQ ID NO: 3316695 - RNA, 14 nt, Human
uaguagagacaggg

SEQ ID NO: 3316696 - RNA, 21 nt, Human
uagacagucccugccaaugga

SEQ ID NO: 3316697 - RNA, 17 nt, Human
uagacagucccugccaa

SEQ ID NO: 3316698 - RNA, 14 nt, Human
aauuugugauacaa

SEQ ID NO: 3316699 - RNA, 18 nt, Human
aauuugugauacaaugcu

SEQ ID NO: 3316700 - RNA, 17 nt, Human
aauuugugauacaaugc

SEQ ID NO: 3316701 - RNA, 18 nt, Human
uagacaauuuauuauggc

SEQ ID NO: 3316702 - RNA, 10 nt, Human
uagacagagu

SEQ ID NO: 3316703 - RNA, 16 nt, Human
uagacagucccugcca

SEQ ID NO: 3316704 - RNA, 16 nt, Human
acaaaaagcauaaaaa

SEQ ID NO: 3316705 - RNA, 14 nt, Human
uagagccagggucu

SEQ ID NO: 3316706 - RNA, 22 nt, Human
uagagcggagaaaggaagggcu

SEQ ID NO: 3316707 - RNA, 14 nt, Human
uagcacagacccug

SEQ ID NO: 3316708 - RNA, 21 nt, Human
uagcacagacccugcccugug

SEQ ID NO: 3316709 - RNA, 20 nt, Human
uagcacagacccugcccugu

SEQ ID NO: 3316710 - RNA, 15 nt, Human
uagcacagacccugc

SEQ ID NO: 3316711 - RNA, 22 nt, Human
uagcacagacccugcccugugg

SEQ ID NO: 3316712 - RNA, 12 nt, Human
uagccaaggcca

SEQ ID NO: 3316713 - RNA, 13 nt, Human
uagccaaggccaa

SEQ ID NO: 3316714 - RNA, 16 nt, Human
uaugggacucaaugca

SEQ ID NO: 3316715 - RNA, 23 nt, Human
uaugggacucaaugcacugacau

SEQ ID NO: 3316716 - RNA, 20 nt, Human
uauggcccuggccuagcaua

SEQ ID NO: 3316717 - RNA, 21 nt, Human
uauggcccuggccuagcauac

SEQ ID NO: 3316718 - RNA, 23 nt, Human
uauggcuuuugugcauuaucuag

SEQ ID NO: 3316719 - RNA, 18 nt, Human
uaugcaugaaguaauaug

SEQ ID NO: 3316720 - RNA, 22 nt, Human
uaugcaugaaguaauaugcaca

SEQ ID NO: 3316721 - RNA, 15 nt, Human
acagcccgggcucug

SEQ ID NO: 3316722 - RNA, 15 nt, Human
uaugaggcauuuguu

SEQ ID NO: 3316723 - RNA, 14 nt, Human
uaugaggcauuugu

SEQ ID NO: 3316724 - RNA, 21 nt, Human
uaugaggcauuuguuugaacu

SEQ ID NO: 3316725 - RNA, 15 nt, Human
acagcuaaugggaca

SEQ ID NO: 3316726 - RNA, 16 nt, Human
acagcuaaugggacac

SEQ ID NO: 3316727 - RNA, 17 nt, Human
acagcuaaugggacacu

SEQ ID NO: 3316728 - RNA, 19 nt, Human
acagcuaaugggacacuaa

SEQ ID NO: 3316729 - RNA, 23 nt, Human
acagcuugaccgugaggccagag

SEQ ID NO: 3316730 - RNA, 22 nt, Human
acagcuugaccgugaggccaga

SEQ ID NO: 3316731 - RNA, 18 nt, Human
acaggaaaagcugcugac

SEQ ID NO: 3316732 - RNA, 19 nt, Human
acaggaaaagcugcugaca

SEQ ID NO: 3316733 - RNA, 20 nt, Human
acaggaaaagcugcugacag

SEQ ID NO: 3316734 - RNA, 21 nt, Human
acaggaaaagcugcugacagu

SEQ ID NO: 3316735 - RNA, 17 nt, Human
acagcuugaccgugagg

SEQ ID NO: 3316736 - RNA, 21 nt, Human
acagcuugaccgugaggccag

SEQ ID NO: 3316737 - RNA, 20 nt, Human
acagcuugaccgugaggcca

SEQ ID NO: 3316738 - RNA, 17 nt, Human
acagcuucauuuccugu

SEQ ID NO: 3316739 - RNA, 19 nt, Human
acagcuucauuuccugugu

SEQ ID NO: 3316740 - RNA, 21 nt, Human
acagcuucauuuccugugucu

SEQ ID NO: 3316741 - RNA, 18 nt, Human
acaggcccggcuccaggc

SEQ ID NO: 3316742 - RNA, 20 nt, Human
acaggcccggcuccaggcuc

SEQ ID NO: 3316743 - RNA, 21 nt, Human
acaggcccggcuccaggcucc

SEQ ID NO: 3316744 - RNA, 22 nt, Human
acaggcccggcuccaggcuccu

SEQ ID NO: 3316745 - RNA, 20 nt, Human
acaggaaaauuuuaaaaaua

SEQ ID NO: 3316746 - RNA, 15 nt, Human
acaggcagauacagg

SEQ ID NO: 3316747 - RNA, 16 nt, Human
acaggcccggcuccag

SEQ ID NO: 3316748 - RNA, 17 nt, Human
acaggcccggcuccagg

SEQ ID NO: 3316749 - RNA, 23 nt, Human
uauaggaacuuaaauaaugugaa

SEQ ID NO: 3316750 - RNA, 16 nt, Human
acacucauugaccuga

SEQ ID NO: 3316751 - RNA, 21 nt, Human
uauacacuuacacuuuaugca

SEQ ID NO: 3316752 - RNA, 22 nt, Human
uauacacuuacacuuuaugcac

SEQ ID NO: 3316753 - RNA, 18 nt, Human
uauaauuuaccugaaguc

SEQ ID NO: 3316754 - RNA, 17 nt, Human
uagucacugagacagcc

SEQ ID NO: 3316755 - RNA, 21 nt, Human
acacucaaaagcugggcaggu

SEQ ID NO: 3316756 - RNA, 22 nt, Human
acacuaaugaggaaacugcacu

SEQ ID NO: 3316757 - RNA, 15 nt, Human
acacuaaugaggaaa

SEQ ID NO: 3316758 - RNA, 19 nt, Human
acagacauacuaaccagca

SEQ ID NO: 3316759 - RNA, 18 nt, Human
acagacauacuaaccagc

SEQ ID NO: 3316760 - RNA, 16 nt, Human
acacuuacacuuuaug

SEQ ID NO: 3316761 - RNA, 20 nt, Human
acacuguuucaaacuuuacu

SEQ ID NO: 3316762 - RNA, 17 nt, Human
acacucauugaccugag

SEQ ID NO: 3316763 - RNA, 16 nt, Human
acacuguuucaaacuu

SEQ ID NO: 3316764 - RNA, 18 nt, Human
acacuguuucaaacuuua

SEQ ID NO: 3316765 - RNA, 17 nt, Human
acacuguuucaaacuuu

SEQ ID NO: 3316766 - RNA, 18 nt, Human
acacuuacacuuuaugca

SEQ ID NO: 3316767 - RNA, 21 nt, Human
acacuuacacuuuaugcacaa

SEQ ID NO: 3316768 - RNA, 10 nt, Human
uaucagaauu

SEQ ID NO: 3316769 - RNA, 17 nt, Human
uaucagaauucucagaa

SEQ ID NO: 3316770 - RNA, 19 nt, Human
uauccaacaucaacaucuu

SEQ ID NO: 3316771 - RNA, 20 nt, Human
acagacccugcccugugggc

SEQ ID NO: 3316772 - RNA, 22 nt, Human
uaucacccagaagaaaauagug

SEQ ID NO: 3316773 - RNA, 19 nt, Human
uaucacccagaagaaaaua

SEQ ID NO: 3316774 - RNA, 20 nt, Human
uaacuugucuuuggacccug

SEQ ID NO: 3316775 - RNA, 16 nt, Human
uaacuugucuuuggac

SEQ ID NO: 3316776 - RNA, 17 nt, Human
uaacauguaauuaagua

SEQ ID NO: 3316777 - RNA, 19 nt, Human
uaacauguaauuaaguacu

SEQ ID NO: 3316778 - RNA, 20 nt, Human
aauagccugccucuucucua

SEQ ID NO: 3316779 - RNA, 19 nt, Human
aauaccugucccccugaca

SEQ ID NO: 3316780 - RNA, 18 nt, Human
aauaccugucccccugac

SEQ ID NO: 3316781 - RNA, 15 nt, Human
aauaccugucccccu

SEQ ID NO: 3316782 - RNA, 19 nt, Human
aauaccagccaguaaaugg

SEQ ID NO: 3316783 - RNA, 17 nt, Human
aauaccagccaguaaau

SEQ ID NO: 3316784 - RNA, 12 nt, Human
aauaccaaggaa

SEQ ID NO: 3316785 - RNA, 13 nt, Human
aauacagaggcaa

SEQ ID NO: 3316786 - RNA, 21 nt, Human
aauacaccacuacauucuguu

SEQ ID NO: 3316787 - RNA, 21 nt, Human
uaaauuaacuuuuauaaacuu

SEQ ID NO: 3316788 - RNA, 18 nt, Human
uaaauuaacuuuuauaaa

SEQ ID NO: 3316789 - RNA, 20 nt, Human
uaaauuaacuuuuauaaacu

SEQ ID NO: 3316790 - RNA, 19 nt, Human
uaaauuaacuuuuauaaac

SEQ ID NO: 3316791 - RNA, 18 nt, Human
uaaaugaaaaucgugaca

SEQ ID NO: 3316792 - RNA, 21 nt, Human
aaguguauuuuuuuacuaaua

SEQ ID NO: 3316793 - RNA, 18 nt, Human
aaguguauuuuuuuacua

SEQ ID NO: 3316794 - RNA, 14 nt, Human
uaagauucauauuu

SEQ ID NO: 3316795 - RNA, 21 nt, Human
uaagcuauucaguaauaacuc

SEQ ID NO: 3316796 - RNA, 14 nt, Human
uaagcuauucagua

SEQ ID NO: 3316797 - RNA, 9 nt, Human
uaaggaaua

SEQ ID NO: 3316798 - RNA, 13 nt, Human
uaaggaagacaau

SEQ ID NO: 3316799 - RNA, 18 nt, Human
uaaggaauaccugucccc

SEQ ID NO: 3316800 - RNA, 17 nt, Human
uaaggaauaccuguccc

SEQ ID NO: 3316801 - RNA, 11 nt, Human
aaucagccugc

SEQ ID NO: 3316802 - RNA, 19 nt, Human
aaucagccugcuccagcug

SEQ ID NO: 3316803 - RNA, 18 nt, Human
aaucagccugcuccagcu

SEQ ID NO: 3316804 - RNA, 13 nt, Human
aaucagccugcuc

SEQ ID NO: 3316805 - RNA, 21 nt, Human
uaaguauucuuauuuaaugaa

SEQ ID NO: 3316806 - RNA, 17 nt, Human
aaucccauuuaaaaaaa

SEQ ID NO: 3316807 - RNA, 22 nt, Human
uacagagcccacgcccccacug

SEQ ID NO: 3316808 - RNA, 19 nt, Human
uacagagcccacgccccca

SEQ ID NO: 3316809 - RNA, 23 nt, Human
uacagagcagacaguuaagagaa

SEQ ID NO: 3316810 - RNA, 13 nt, Human
uacagacaaagcg

SEQ ID NO: 3316811 - RNA, 15 nt, Human
uacagacaaagcgug

SEQ ID NO: 3316812 - RNA, 14 nt, Human
uacagacaaagcgu

SEQ ID NO: 3316813 - RNA, 16 nt, Human
aaugguuuucaaaaua

SEQ ID NO: 3316814 - RNA, 14 nt, Human
aaugguuuucaaaa

SEQ ID NO: 3316815 - RNA, 16 nt, Human
aauggaagacagcucu

SEQ ID NO: 3316816 - RNA, 13 nt, Human
aauggaagacagc

SEQ ID NO: 3316817 - RNA, 14 nt, Human
aauggaaccacucu

SEQ ID NO: 3316818 - RNA, 22 nt, Human
aaugcuggcuguuggcuggggg

SEQ ID NO: 3316819 - RNA, 21 nt, Human
aaugcuggcuguuggcugggg

SEQ ID NO: 3316820 - RNA, 18 nt, Human
uaauuuuuuugagacaga

SEQ ID NO: 3316821 - RNA, 14 nt, Human
uacaaugcugugcc

SEQ ID NO: 3316822 - RNA, 13 nt, Human
uacaaugcugugc

SEQ ID NO: 3316823 - RNA, 11 nt, Human
aaugcaaacca

SEQ ID NO: 3316824 - RNA, 12 nt, Human
aaugcaaaccau

SEQ ID NO: 3316825 - RNA, 13 nt, Human
aaugcaccuggaa

SEQ ID NO: 3316826 - RNA, 11 nt, Human
aaugagccugg

SEQ ID NO: 3316827 - RNA, 20 nt, Human
aaugaccuuucaauaggaaa

SEQ ID NO: 3316828 - RNA, 21 nt, Human
aaugaccuuucaauaggaaaa

SEQ ID NO: 3316829 - RNA, 13 nt, Human
aaugagccuggca

SEQ ID NO: 3316830 - RNA, 12 nt, Human
aaugagccuggc

SEQ ID NO: 3316831 - RNA, 16 nt, Human
aaugaggucagagccu

SEQ ID NO: 3316832 - RNA, 18 nt, Human
aaugaggucagagccugc

SEQ ID NO: 3316833 - RNA, 13 nt, Human
aauuaacuuuuau

SEQ ID NO: 3316834 - RNA, 12 nt, Human
aauuaacuuuua

SEQ ID NO: 3316835 - RNA, 13 nt, Human
aauuaaguacuau

SEQ ID NO: 3316836 - RNA, 15 nt, Human
aauuaacuuuuauaa

SEQ ID NO: 3316837 - RNA, 16 nt, Human
aauuaaguacuaugua

SEQ ID NO: 3316838 - RNA, 17 nt, Human
aauuaaguacuauguau

SEQ ID NO: 3316839 - RNA, 21 nt, Human
aaugugcugaaugguuuucaa

SEQ ID NO: 3316840 - RNA, 12 nt, Human
uaccagcagagc

SEQ ID NO: 3316841 - RNA, 14 nt, Human
uaccagcagagcac

SEQ ID NO: 3316842 - RNA, 13 nt, Human
uaccagcagagca

SEQ ID NO: 3316843 - RNA, 22 nt, Human
uaccagcagagcaccuuagaca

SEQ ID NO: 3316844 - RNA, 18 nt, Human
uaccagccaguaaauggg

SEQ ID NO: 3316845 - RNA, 11 nt, Human
aauuaacuuuu

SEQ ID NO: 3316846 - RNA, 23 nt, Human
uaccucuugagccuugaacuuug

SEQ ID NO: 3316847 - RNA, 21 nt, Human
uaccucuugagccuugaacuu

SEQ ID NO: 3316848 - RNA, 22 nt, Human
uaccucuugagccuugaacuuu

SEQ ID NO: 3316849 - RNA, 23 nt, Human
uacccgggaagggggcugggaca

SEQ ID NO: 3316850 - RNA, 16 nt, Human
uaccugaagucuuugu

SEQ ID NO: 3316851 - RNA, 15 nt, Human
uaccugaggggccuc

SEQ ID NO: 3316852 - RNA, 13 nt, Human
uaccugaggggcc

SEQ ID NO: 3316853 - RNA, 14 nt, Human
uaccugaagucuuu

SEQ ID NO: 3316854 - RNA, 13 nt, Human
uaccugaagucuu

SEQ ID NO: 3316855 - RNA, 20 nt, Human
aauuacaggaaguacuggag

SEQ ID NO: 3316856 - RNA, 19 nt, Human
aauuacaggaaguacugga

SEQ ID NO: 3316857 - RNA, 17 nt, Human
aauuacaggaaguacug

SEQ ID NO: 3316858 - RNA, 16 nt, Human
uaccugaggggccucu

SEQ ID NO: 3316859 - RNA, 11 nt, Human
aauucaguugu

SEQ ID NO: 3316860 - RNA, 22 nt, Human
aauucaguuguuagugugucuu

SEQ ID NO: 3316861 - RNA, 17 nt, Human
aauucaguuguuagugu

SEQ ID NO: 3316862 - RNA, 22 nt, Human
aauuauuuauuaaaugcccagc

SEQ ID NO: 3316863 - RNA, 21 nt, Human
aauuauuuauuaaaugcccag

SEQ ID NO: 3316864 - RNA, 22 nt, Human
guggggucacucuggcagcuca

SEQ ID NO: 3316865 - RNA, 21 nt, Human
guggggucacucuggcagcuc

SEQ ID NO: 3316866 - RNA, 20 nt, Human
guggggucacucuggcagcu

SEQ ID NO: 3316867 - RNA, 17 nt, Human
guggggucacucuggca

SEQ ID NO: 3316868 - RNA, 12 nt, Human
aagaguaggaag

SEQ ID NO: 3316869 - RNA, 23 nt, Human
aagagggagggagggcuccagac

SEQ ID NO: 3316870 - RNA, 22 nt, Human
aagagggagggagggcuccaga

SEQ ID NO: 3316871 - RNA, 13 nt, Human
aagaguaggaaga

SEQ ID NO: 3316872 - RNA, 16 nt, Human
aagaugcuucucacug

SEQ ID NO: 3316873 - RNA, 17 nt, Human
aagaugcuucucacugc

SEQ ID NO: 3316874 - RNA, 19 nt, Human
aagaugcuucucacugcca

SEQ ID NO: 3316875 - RNA, 16 nt, Human
gugucagcauagaagu

SEQ ID NO: 3316876 - RNA, 20 nt, Human
gugucaagagggucugagga

SEQ ID NO: 3316877 - RNA, 23 nt, Human
guguauuuuuuuacuaauagaca

SEQ ID NO: 3316878 - RNA, 17 nt, Human
guguauuuuuuuacuaa

SEQ ID NO: 3316879 - RNA, 20 nt, Human
gugucagguggggcagcuug

SEQ ID NO: 3316880 - RNA, 22 nt, Human
gugugacaaggauugcuacugu

SEQ ID NO: 3316881 - RNA, 15 nt, Human
guggccucccaacuc

SEQ ID NO: 3316882 - RNA, 22 nt, Human
guggccucccaacucaccccag

SEQ ID NO: 3316883 - RNA, 21 nt, Human
guggccucccaacucacccca

SEQ ID NO: 3316884 - RNA, 15 nt, Human
gugggagcugccugu

SEQ ID NO: 3316885 - RNA, 18 nt, Human
gugggagcugccuguuca

SEQ ID NO: 3316886 - RNA, 15 nt, Human
guggggucacucugg

SEQ ID NO: 3316887 - RNA, 14 nt, Human
gugggagcugccug

SEQ ID NO: 3316888 - RNA, 15 nt, Human
gugggacacccugug

SEQ ID NO: 3316889 - RNA, 13 nt, Human
gugggacacccug

SEQ ID NO: 3316890 - RNA, 13 nt, Human
aagacgcugugcu

SEQ ID NO: 3316891 - RNA, 19 nt, Human
aagacgcugugcugcccug

SEQ ID NO: 3316892 - RNA, 18 nt, Human
aagacgcugugcugcccu

SEQ ID NO: 3316893 - RNA, 17 nt, Human
aagacgcugugcugccc

SEQ ID NO: 3316894 - RNA, 15 nt, Human
aagacgcugugcugc

SEQ ID NO: 3316895 - RNA, 19 nt, Human
aagaccuucuccuucaccu

SEQ ID NO: 3316896 - RNA, 18 nt, Human
aagaccuucuccuucacc

SEQ ID NO: 3316897 - RNA, 15 nt, Human
aagaccuucuccuuc

SEQ ID NO: 3316898 - RNA, 22 nt, Human
aagacugaguacguugugcauu

SEQ ID NO: 3316899 - RNA, 23 nt, Human
aagacugaguacguugugcauuu

SEQ ID NO: 3316900 - RNA, 16 nt, Human
aagcauuuacuuugug

SEQ ID NO: 3316901 - RNA, 12 nt, Human
aagcagugcaug

SEQ ID NO: 3316902 - RNA, 21 nt, Human
gugugugcgccuacaggagug

SEQ ID NO: 3316903 - RNA, 15 nt, Human
aagcagugcaugcug

SEQ ID NO: 3316904 - RNA, 14 nt, Human
aagcagugcaugcu

SEQ ID NO: 3316905 - RNA, 20 nt, Human
aagcagugcaugcugucccu

SEQ ID NO: 3316906 - RNA, 19 nt, Human
aagcccugagcuuucugcu

SEQ ID NO: 3316907 - RNA, 20 nt, Human
aagccgcuggggccaguugg

SEQ ID NO: 3316908 - RNA, 20 nt, Human
aagccaaagcuaggccuggc

SEQ ID NO: 3316909 - RNA, 22 nt, Human
aagccaaagcuaggccuggcca

SEQ ID NO: 3316910 - RNA, 17 nt, Human
aagcccaggaaaggcuc

SEQ ID NO: 3316911 - RNA, 14 nt, Human
aagcccaggaaagg

SEQ ID NO: 3316912 - RNA, 22 nt, Human
aagcccaggaaaggcuccagga

SEQ ID NO: 3316913 - RNA, 19 nt, Human
aagcccaggaaaggcucca

SEQ ID NO: 3316914 - RNA, 22 nt, Human
aagcuagacgagcaggcuucuu

SEQ ID NO: 3316915 - RNA, 20 nt, Human
aagccugaguuugcuuucaa

SEQ ID NO: 3316916 - RNA, 22 nt, Human
aagcuauucaguaauaacucua

SEQ ID NO: 3316917 - RNA, 12 nt, Human
aagcuaggccug

SEQ ID NO: 3316918 - RNA, 13 nt, Human
guucagcuccagc

SEQ ID NO: 3316919 - RNA, 17 nt, Human
aagcucagggccuggcu

SEQ ID NO: 3316920 - RNA, 16 nt, Human
aagcucagggccuggc

SEQ ID NO: 3316921 - RNA, 13 nt, Human
aagcucagggccu

SEQ ID NO: 3316922 - RNA, 12 nt, Human
aagcucagggcc

SEQ ID NO: 3316923 - RNA, 18 nt, Human
aagcuccaagcucccagg

SEQ ID NO: 3316924 - RNA, 17 nt, Human
aagcuccaagcucccag

SEQ ID NO: 3316925 - RNA, 20 nt, Human
aagcucagggccuggcucag

SEQ ID NO: 3316926 - RNA, 19 nt, Human
aagcucagggccuggcuca

SEQ ID NO: 3316927 - RNA, 18 nt, Human
aagcucagggccuggcuc

SEQ ID NO: 3316928 - RNA, 23 nt, Human
guuauuuuuauuuauuuaaauuu

SEQ ID NO: 3316929 - RNA, 22 nt, Human
guucaaagauauuuugcuuugu

SEQ ID NO: 3316930 - RNA, 21 nt, Human
guucaaagauauuuugcuuug

SEQ ID NO: 3316931 - RNA, 20 nt, Human
guucaaagauauuuugcuuu

SEQ ID NO: 3316932 - RNA, 20 nt, Human
guuaggcauugugggaaggg

SEQ ID NO: 3316933 - RNA, 19 nt, Human
guuaggcauugugggaagg

SEQ ID NO: 3316934 - RNA, 12 nt, Human
guuaagagaaau

SEQ ID NO: 3316935 - RNA, 11 nt, Human
guuaagagaaa

SEQ ID NO: 3316936 - RNA, 18 nt, Human
guuaagagaaaugagcuu

SEQ ID NO: 3316937 - RNA, 17 nt, Human
aaggggcaguggugguu

SEQ ID NO: 3316938 - RNA, 22 nt, Human
aaggggcccaaauucuuucagu

SEQ ID NO: 3316939 - RNA, 20 nt, Human
aagguagaaauaucugaaaa

SEQ ID NO: 3316940 - RNA, 19 nt, Human
guuucuauguguagggcgg

SEQ ID NO: 3316941 - RNA, 18 nt, Human
guuucugaaagggacgcu

SEQ ID NO: 3316942 - RNA, 12 nt, Human
aaggucauuuuu

SEQ ID NO: 3316943 - RNA, 22 nt, Human
guuucuaugacacaugcaaggu

SEQ ID NO: 3316944 - RNA, 15 nt, Human
aaggcuccaggagca

SEQ ID NO: 3316945 - RNA, 18 nt, Human
aaggcuccaggagcagcc

SEQ ID NO: 3316946 - RNA, 16 nt, Human
aaggcuccaggagcag

SEQ ID NO: 3316947 - RNA, 13 nt, Human
guuucaaacuuua

SEQ ID NO: 3316948 - RNA, 16 nt, Human
guuucaaacuuuacua

SEQ ID NO: 3316949 - RNA, 14 nt, Human
guuucaaacuuuac

SEQ ID NO: 3316950 - RNA, 22 nt, Human
aaggcucgagcaugccuggaug

SEQ ID NO: 3316951 - RNA, 20 nt, Human
aaggcucgagcaugccugga

SEQ ID NO: 3316952 - RNA, 19 nt, Human
aaggcucgagcaugccugg

SEQ ID NO: 3316953 - RNA, 18 nt, Human
aaggcucgagcaugccug

SEQ ID NO: 3316954 - RNA, 16 nt, Human
aaggcucgagcaugcc

SEQ ID NO: 3316955 - RNA, 22 nt, Human
aaggcuccaggagcagccacau

SEQ ID NO: 3316956 - RNA, 19 nt, Human
aaggcuccaggagcagcca

SEQ ID NO: 3316957 - RNA, 13 nt, Human
guugggcuggugu

SEQ ID NO: 3316958 - RNA, 17 nt, Human
guugggccaggagccuc

SEQ ID NO: 3316959 - RNA, 15 nt, Human
guugggccaggagcc

SEQ ID NO: 3316960 - RNA, 13 nt, Human
guuuauugucaaa

SEQ ID NO: 3316961 - RNA, 21 nt, Human
aaggauacaaaagcaugugag

SEQ ID NO: 3316962 - RNA, 13 nt, Human
aaggauacaaaag

SEQ ID NO: 3316963 - RNA, 23 nt, Human
guugcccaggcaggucuugaacu

SEQ ID NO: 3316964 - RNA, 12 nt, Human
guugcccaggcu

SEQ ID NO: 3316965 - RNA, 13 nt, Human
guugcccaggcug

SEQ ID NO: 3316966 - RNA, 19 nt, Human
guugcccaggcaggucuug

SEQ ID NO: 3316967 - RNA, 18 nt, Human
aaggaauaccuguccccc

SEQ ID NO: 3316968 - RNA, 11 nt, Human
aaggagagcua

SEQ ID NO: 3316969 - RNA, 14 nt, Human
aaggagauuuacaa

SEQ ID NO: 3316970 - RNA, 20 nt, Human
aaggaggggauagagagaga

SEQ ID NO: 3316971 - RNA, 16 nt, Human
aaggaagcacaugccu

SEQ ID NO: 3316972 - RNA, 17 nt, Human
aaggaauaccugucccc

SEQ ID NO: 3316973 - RNA, 14 nt, Human
aaggaagacuucau

SEQ ID NO: 3316974 - RNA, 13 nt, Human
aaggaagcacaug

SEQ ID NO: 3316975 - RNA, 15 nt, Human
aaggaagacuucauc

SEQ ID NO: 3316976 - RNA, 15 nt, Human
aaggaaagagggagg

SEQ ID NO: 3316977 - RNA, 21 nt, Human
uaaaauaccagccaguaaaug

SEQ ID NO: 3316978 - RNA, 22 nt, Human
uaaaauaccagccaguaaaugg

SEQ ID NO: 3316979 - RNA, 15 nt, Human
aagugagagcugggu

SEQ ID NO: 3316980 - RNA, 16 nt, Human
aagugaggaugaaaaa

SEQ ID NO: 3316981 - RNA, 19 nt, Human
aagugauucuccugccuca

SEQ ID NO: 3316982 - RNA, 15 nt, Human
aagugauucuccugc

SEQ ID NO: 3316983 - RNA, 16 nt, Human
aagugauucuccugcc

SEQ ID NO: 3316984 - RNA, 17 nt, Human
aagugauucuccugccu

SEQ ID NO: 3316985 - RNA, 18 nt, Human
aagugauucuccugccuc

SEQ ID NO: 3316986 - RNA, 15 nt, Human
uaaaaaucucaaauu

SEQ ID NO: 3316987 - RNA, 17 nt, Human
uaaaaaucucaaauuuc

SEQ ID NO: 3316988 - RNA, 16 nt, Human
uaaaaaucucaaauuu

SEQ ID NO: 3316989 - RNA, 15 nt, Human
guuuuucuucucccu

SEQ ID NO: 3316990 - RNA, 15 nt, Human
uaaaaaguggaaaaa

SEQ ID NO: 3316991 - RNA, 20 nt, Human
uaaaacuugauguguuaucu

SEQ ID NO: 3316992 - RNA, 22 nt, Human
uaaaacuugauguguuaucucu

SEQ ID NO: 3316993 - RNA, 21 nt, Human
uaaaaaucucaaauuucuaaa

SEQ ID NO: 3316994 - RNA, 20 nt, Human
uaaaaaucucaaauuucuaa

SEQ ID NO: 3316995 - RNA, 19 nt, Human
uaaaaaucucaaauuucua

SEQ ID NO: 3316996 - RNA, 21 nt, Human
aagugaaaaaggaggaagaga

SEQ ID NO: 3316997 - RNA, 19 nt, Human
aagugaagacaaugacuua

SEQ ID NO: 3316998 - RNA, 17 nt, Human
aagugaagacaaugacu

SEQ ID NO: 3316999 - RNA, 14 nt, Human
aagugagagcuggg

SEQ ID NO: 3317000 - RNA, 12 nt, Human
aagugagagagg

SEQ ID NO: 3317001 - RNA, 18 nt, Human
aaguacacuguuucaaac

SEQ ID NO: 3317002 - RNA, 13 nt, Human
aaguacacuguuu

SEQ ID NO: 3317003 - RNA, 21 nt, Human
aaguaauaugcacacauuuuu

SEQ ID NO: 3317004 - RNA, 14 nt, Human
guuucugccgcagc

SEQ ID NO: 3317005 - RNA, 15 nt, Human
guuucugccgcagcc

SEQ ID NO: 3317006 - RNA, 16 nt, Human
guuuugccauguuggc

SEQ ID NO: 3317007 - RNA, 20 nt, Human
guuuugccauguuggccagg

SEQ ID NO: 3317008 - RNA, 21 nt, Human
guuuugccauguuggccaggc

SEQ ID NO: 3317009 - RNA, 22 nt, Human
guuuugccauguuggccaggcu

SEQ ID NO: 3317010 - RNA, 23 nt, Human
aaguacacuguuucaaacuuuac

SEQ ID NO: 3317011 - RNA, 20 nt, Human
aaguacacuguuucaaacuu

SEQ ID NO: 3317012 - RNA, 19 nt, Human
aaguacacuguuucaaacu

SEQ ID NO: 3317013 - RNA, 16 nt, Human
guaucaggugcugcca

SEQ ID NO: 3317014 - RNA, 18 nt, Human
guaucaggugcugccauc

SEQ ID NO: 3317015 - RNA, 22 nt, Human
guaucaggugcugccauccagg

SEQ ID NO: 3317016 - RNA, 19 nt, Human
guaucccaugagccucagc

SEQ ID NO: 3317017 - RNA, 15 nt, Human
guaugguggcugggu

SEQ ID NO: 3317018 - RNA, 16 nt, Human
guaugguggcuggguu

SEQ ID NO: 3317019 - RNA, 14 nt, Human
guaugguggcuggg

SEQ ID NO: 3317020 - RNA, 13 nt, Human
guaugguggcugg

SEQ ID NO: 3317021 - RNA, 20 nt, Human
guaacaggaaaauuuuaaaa

SEQ ID NO: 3317022 - RNA, 19 nt, Human
aaaugggggugcauuugag

SEQ ID NO: 3317023 - RNA, 12 nt, Human
guaacaggcaga

SEQ ID NO: 3317024 - RNA, 22 nt, Human
guaacaggaaaauuuuaaaaau

SEQ ID NO: 3317025 - RNA, 22 nt, Human
guauuuuguuuuugucuuaaaa

SEQ ID NO: 3317026 - RNA, 19 nt, Human
aaaugucuaguuguaacac

SEQ ID NO: 3317027 - RNA, 11 nt, Human
aacagaaaugu

SEQ ID NO: 3317028 - RNA, 18 nt, Human
gucccccugacaacacuc

SEQ ID NO: 3317029 - RNA, 14 nt, Human
gucccccuuccaug

SEQ ID NO: 3317030 - RNA, 18 nt, Human
gucccccuuccauggacu

SEQ ID NO: 3317031 - RNA, 16 nt, Human
gucccccuuccaugga

SEQ ID NO: 3317032 - RNA, 16 nt, Human
guccuacccacccucc

SEQ ID NO: 3317033 - RNA, 15 nt, Human
guccuacccacccuc

SEQ ID NO: 3317034 - RNA, 12 nt, Human
guccuacucugu

SEQ ID NO: 3317035 - RNA, 13 nt, Human
aacagaaauguac

SEQ ID NO: 3317036 - RNA, 12 nt, Human
aacagaaaugua

SEQ ID NO: 3317037 - RNA, 14 nt, Human
aacagaaauguaca

SEQ ID NO: 3317038 - RNA, 21 nt, Human
gucauuuuuuuuaagaaaaag

SEQ ID NO: 3317039 - RNA, 19 nt, Human
gucauuuuuuuuaagaaaa

SEQ ID NO: 3317040 - RNA, 18 nt, Human
guccaagaagcccaggaa

SEQ ID NO: 3317041 - RNA, 17 nt, Human
guccaagaagcccagga

SEQ ID NO: 3317042 - RNA, 20 nt, Human
guccaagaagcccaggaaag

SEQ ID NO: 3317043 - RNA, 16 nt, Human
guccaagaagcccagg

SEQ ID NO: 3317044 - RNA, 15 nt, Human
guccaagaagcccag

SEQ ID NO: 3317045 - RNA, 13 nt, Human
guccaagaagccc

SEQ ID NO: 3317046 - RNA, 14 nt, Human
guccauagagagca

SEQ ID NO: 3317047 - RNA, 13 nt, Human
guccauagagagc

SEQ ID NO: 3317048 - RNA, 21 nt, Human
gucccaccccacacacgccag

SEQ ID NO: 3317049 - RNA, 20 nt, Human
gucccaccccacacacgcca

SEQ ID NO: 3317050 - RNA, 14 nt, Human
gucccaccuuggcu

SEQ ID NO: 3317051 - RNA, 15 nt, Human
gucccaccuuggcug

SEQ ID NO: 3317052 - RNA, 16 nt, Human
gucccaccuuggcugc

SEQ ID NO: 3317053 - RNA, 15 nt, Human
gucagugugacugau

SEQ ID NO: 3317054 - RNA, 18 nt, Human
aaauuuguuauaaugaau

SEQ ID NO: 3317055 - RNA, 22 nt, Human
gucacacaguauuacuucugcu

SEQ ID NO: 3317056 - RNA, 21 nt, Human
gucacacaguauuacuucugc

SEQ ID NO: 3317057 - RNA, 23 nt, Human
gucagaaguuucugccgcagccc

SEQ ID NO: 3317058 - RNA, 16 nt, Human
aacaaggcaaggcugu

SEQ ID NO: 3317059 - RNA, 15 nt, Human
aacaaggcaaggcug

SEQ ID NO: 3317060 - RNA, 20 nt, Human
aacaagaccacguuucuaaa

SEQ ID NO: 3317061 - RNA, 23 nt, Human
aaauuuugauguuuuaaggaugc

SEQ ID NO: 3317062 - RNA, 18 nt, Human
aaauuuugauguuuuaag

SEQ ID NO: 3317063 - RNA, 21 nt, Human
aacaaggcaaggcugucaauu

SEQ ID NO: 3317064 - RNA, 18 nt, Human
aacaaggcaaggcuguca

SEQ ID NO: 3317065 - RNA, 19 nt, Human
gugaacuugggccacugug

SEQ ID NO: 3317066 - RNA, 17 nt, Human
gugaacuugggccacug

SEQ ID NO: 3317067 - RNA, 13 nt, Human
gugaggccagaga

SEQ ID NO: 3317068 - RNA, 22 nt, Human
gugaggccagagacacaagccu

SEQ ID NO: 3317069 - RNA, 17 nt, Human
gugaggccagagacaca

SEQ ID NO: 3317070 - RNA, 23 nt, Human
aacugauuuuuuuuuccuucagu

SEQ ID NO: 3317071 - RNA, 21 nt, Human
aacucuucaaucucuugcacu

SEQ ID NO: 3317072 - RNA, 15 nt, Human
gugagucgaggacag

SEQ ID NO: 3317073 - RNA, 22 nt, Human
gugagucgaggacagggaggug

SEQ ID NO: 3317074 - RNA, 16 nt, Human
aacuggguacuugugg

SEQ ID NO: 3317075 - RNA, 21 nt, Human
aacuggguacuuguggacaca

SEQ ID NO: 3317076 - RNA, 22 nt, Human
aacugggggagggugaagugaa

SEQ ID NO: 3317077 - RNA, 21 nt, Human
aacugggggagggugaaguga

SEQ ID NO: 3317078 - RNA, 15 nt, Human
aacuggauuaaacuu

SEQ ID NO: 3317079 - RNA, 11 nt, Human
aacuggcugca

SEQ ID NO: 3317080 - RNA, 16 nt, Human
aacuggauuaaacuua

SEQ ID NO: 3317081 - RNA, 15 nt, Human
aacugcugacuguuu

SEQ ID NO: 3317082 - RNA, 23 nt, Human
aacugcugacuguuuucucuuga

SEQ ID NO: 3317083 - RNA, 21 nt, Human
aacugcugacuguuuucucuu

SEQ ID NO: 3317084 - RNA, 20 nt, Human
aacugcugacuguuuucucu

SEQ ID NO: 3317085 - RNA, 13 nt, Human
aacuuccaauuua

SEQ ID NO: 3317086 - RNA, 22 nt, Human
gugaugcgcaugucacggaggg

SEQ ID NO: 3317087 - RNA, 18 nt, Human
gugauggggcccugccuc

SEQ ID NO: 3317088 - RNA, 17 nt, Human
gugauggggcccugccu

SEQ ID NO: 3317089 - RNA, 16 nt, Human
gugauggggcccugcc

SEQ ID NO: 3317090 - RNA, 14 nt, Human
gugauggggcccug

SEQ ID NO: 3317091 - RNA, 16 nt, Human
gugaugagaggaaauc

SEQ ID NO: 3317092 - RNA, 14 nt, Human
gugaugagaggaaa

SEQ ID NO: 3317093 - RNA, 23 nt, Human
gugcauuaucuagauacuguauc

SEQ ID NO: 3317094 - RNA, 19 nt, Human
gugcauguguguucaugca

SEQ ID NO: 3317095 - RNA, 19 nt, Human
gugcauuaucuagauacug

SEQ ID NO: 3317096 - RNA, 15 nt, Human
gugcauuaucuagau

SEQ ID NO: 3317097 - RNA, 22 nt, Human
gugcaugcugucccuuacguga

SEQ ID NO: 3317098 - RNA, 21 nt, Human
gugcacacaccagagcccacc

SEQ ID NO: 3317099 - RNA, 19 nt, Human
gugauggggcccugccucc

SEQ ID NO: 3317100 - RNA, 22 nt, Human
gugcaaugaccuuucaauagga

SEQ ID NO: 3317101 - RNA, 22 nt, Human
gugaaccaccacacccagccca

SEQ ID NO: 3317102 - RNA, 23 nt, Human
gugaaccaccacacccagcccac

SEQ ID NO: 3317103 - RNA, 21 nt, Human
gugaaccaccacacccagccc

SEQ ID NO: 3317104 - RNA, 16 nt, Human
aacucuccucugcugc

SEQ ID NO: 3317105 - RNA, 18 nt, Human
aacucuccuccagaguca

SEQ ID NO: 3317106 - RNA, 15 nt, Human
aacucuccuccagag

SEQ ID NO: 3317107 - RNA, 12 nt, Human
aacuccuggccu

SEQ ID NO: 3317108 - RNA, 14 nt, Human
gucuggcccuuccu

SEQ ID NO: 3317109 - RNA, 18 nt, Human
gucuuuggacccugaggc

SEQ ID NO: 3317110 - RNA, 10 nt, Human
aacccagcuc

SEQ ID NO: 3317111 - RNA, 18 nt, Human
aaccaucauugaaaucuu

SEQ ID NO: 3317112 - RNA, 17 nt, Human
aaccaucauugaaaucu

SEQ ID NO: 3317113 - RNA, 12 nt, Human
aaccaucauuga

SEQ ID NO: 3317114 - RNA, 21 nt, Human
aaccaccacacccagcccacu

SEQ ID NO: 3317115 - RNA, 15 nt, Human
aaccaagucaaguga

SEQ ID NO: 3317116 - RNA, 19 nt, Human
aaccaccacacccagccca

SEQ ID NO: 3317117 - RNA, 16 nt, Human
agaugccgcauuugga

SEQ ID NO: 3317118 - RNA, 21 nt, Human
ugacccaugcugcccugugag

SEQ ID NO: 3317119 - RNA, 16 nt, Human
ugacccaugcugcccu

SEQ ID NO: 3317120 - RNA, 12 nt, Human
ugacccaugcug

SEQ ID NO: 3317121 - RNA, 15 nt, Human
ugacccaugcugccc

SEQ ID NO: 3317122 - RNA, 14 nt, Human
ugacccaugcugcc

SEQ ID NO: 3317123 - RNA, 13 nt, Human
ugacuuacuguac

SEQ ID NO: 3317124 - RNA, 16 nt, Human
ugacuuacuguacaug

SEQ ID NO: 3317125 - RNA, 15 nt, Human
ugacuuacuguacau

SEQ ID NO: 3317126 - RNA, 17 nt, Human
ugaccugaggcccuucu

SEQ ID NO: 3317127 - RNA, 19 nt, Human
ugaccugaggcccuucucu

SEQ ID NO: 3317128 - RNA, 18 nt, Human
ugaccugaggcccuucuc

SEQ ID NO: 3317129 - RNA, 19 nt, Human
agauucauauuuacuucuu

SEQ ID NO: 3317130 - RNA, 22 nt, Human
agauucauauuuacuucuuaua

SEQ ID NO: 3317131 - RNA, 12 nt, Human
ugacuuacugua

SEQ ID NO: 3317132 - RNA, 13 nt, Human
agauuggaaggaa

SEQ ID NO: 3317133 - RNA, 21 nt, Human
agauuuugaaauuuuuauuaa

SEQ ID NO: 3317134 - RNA, 16 nt, Human
agcaagacgcugugcu

SEQ ID NO: 3317135 - RNA, 13 nt, Human
agcaagacgcugu

SEQ ID NO: 3317136 - RNA, 23 nt, Human
agcaagacgcugugcugcccugc

SEQ ID NO: 3317137 - RNA, 22 nt, Human
agcaagacgcugugcugcccug

SEQ ID NO: 3317138 - RNA, 21 nt, Human
agcaagacgcugugcugcccu

SEQ ID NO: 3317139 - RNA, 20 nt, Human
agcaagacgcugugcugccc

SEQ ID NO: 3317140 - RNA, 17 nt, Human
agcaagacgcugugcug

SEQ ID NO: 3317141 - RNA, 16 nt, Human
agagggagggagggcu

SEQ ID NO: 3317142 - RNA, 15 nt, Human
agagguuaagguggg

SEQ ID NO: 3317143 - RNA, 16 nt, Human
agagguggggagcaga

SEQ ID NO: 3317144 - RNA, 14 nt, Human
ugaagucacacagu

SEQ ID NO: 3317145 - RNA, 15 nt, Human
agagucacuggaaca

SEQ ID NO: 3317146 - RNA, 17 nt, Human
agaguuguuacauuuuu

SEQ ID NO: 3317147 - RNA, 16 nt, Human
agaguuguuacauuuu

SEQ ID NO: 3317148 - RNA, 20 nt, Human
agaguuguuacauuuuuaag

SEQ ID NO: 3317149 - RNA, 19 nt, Human
agaguuguuacauuuuuaa

SEQ ID NO: 3317150 - RNA, 18 nt, Human
agauaauacaccacuaca

SEQ ID NO: 3317151 - RNA, 18 nt, Human
agaucaaaagguuaauaa

SEQ ID NO: 3317152 - RNA, 21 nt, Human
agauauuuugcuuugugauuu

SEQ ID NO: 3317153 - RNA, 20 nt, Human
agauauuuugcuuugugauu

SEQ ID NO: 3317154 - RNA, 16 nt, Human
agauacuguaucauga

SEQ ID NO: 3317155 - RNA, 15 nt, Human
agauacuguaucaug

SEQ ID NO: 3317156 - RNA, 20 nt, Human
agauacaggaaaagcugcug

SEQ ID NO: 3317157 - RNA, 13 nt, Human
agauacaguuacu

SEQ ID NO: 3317158 - RNA, 22 nt, Human
agauaauauuaaggaagacaau

SEQ ID NO: 3317159 - RNA, 18 nt, Human
agauaauauuaaggaaga

SEQ ID NO: 3317160 - RNA, 11 nt, Human
agauacuguau

SEQ ID NO: 3317161 - RNA, 22 nt, Human
agauacaguuacucagaauucu

SEQ ID NO: 3317162 - RNA, 19 nt, Human
ugacacacagcucuguccu

SEQ ID NO: 3317163 - RNA, 19 nt, Human
ugacaaagacugaguacgu

SEQ ID NO: 3317164 - RNA, 16 nt, Human
ugacacacagcucugu

SEQ ID NO: 3317165 - RNA, 18 nt, Human
ugacacacagcucugucc

SEQ ID NO: 3317166 - RNA, 20 nt, Human
ugacacaugcaaggucauuu

SEQ ID NO: 3317167 - RNA, 12 nt, Human
ugacacaugcaa

SEQ ID NO: 3317168 - RNA, 23 nt, Human
ugaauuucuuuugccguuauuaa

SEQ ID NO: 3317169 - RNA, 15 nt, Human
ugaauuucuuuugcc

SEQ ID NO: 3317170 - RNA, 22 nt, Human
ugaaaaaggaggaagagaaaaa

SEQ ID NO: 3317171 - RNA, 20 nt, Human
ugaaaaaggaggaagagaaa

SEQ ID NO: 3317172 - RNA, 16 nt, Human
ugaaaaucgugacaac

SEQ ID NO: 3317173 - RNA, 17 nt, Human
ugaaaauguauguguaa

SEQ ID NO: 3317174 - RNA, 19 nt, Human
ugaaaaucgugacaacacu

SEQ ID NO: 3317175 - RNA, 16 nt, Human
ugaaacgcaaccacca

SEQ ID NO: 3317176 - RNA, 16 nt, Human
ugaaaaaggaggaaga

SEQ ID NO: 3317177 - RNA, 14 nt, Human
ucuuuguggcuucc

SEQ ID NO: 3317178 - RNA, 22 nt, Human
ucuuuggucuacacugugcuga

SEQ ID NO: 3317179 - RNA, 20 nt, Human
ucuuucuggcuaugcauuug

SEQ ID NO: 3317180 - RNA, 19 nt, Human
ucuuucuggcuaugcauuu

SEQ ID NO: 3317181 - RNA, 21 nt, Human
ucuuucuggcuaugcauuuga

SEQ ID NO: 3317182 - RNA, 13 nt, Human
ugaaagacuguac

SEQ ID NO: 3317183 - RNA, 15 nt, Human
ugaaagacuguacaa

SEQ ID NO: 3317184 - RNA, 22 nt, Human
agagacuccugcaggcagccag

SEQ ID NO: 3317185 - RNA, 21 nt, Human
agagacuccugcaggcagcca

SEQ ID NO: 3317186 - RNA, 20 nt, Human
agagacuccugcaggcagcc

SEQ ID NO: 3317187 - RNA, 19 nt, Human
agagacuccugcaggcagc

SEQ ID NO: 3317188 - RNA, 18 nt, Human
agagacuccugcaggcag

SEQ ID NO: 3317189 - RNA, 17 nt, Human
agagacuccugcaggca

SEQ ID NO: 3317190 - RNA, 15 nt, Human
agagacuccugcagg

SEQ ID NO: 3317191 - RNA, 23 nt, Human
agagcaagacgcugugcugcccu

SEQ ID NO: 3317192 - RNA, 19 nt, Human
agagcaagacgcugugcug

SEQ ID NO: 3317193 - RNA, 22 nt, Human
agagaucaaccccuucgcuccu

SEQ ID NO: 3317194 - RNA, 20 nt, Human
agagcuagcagcagggaggg

SEQ ID NO: 3317195 - RNA, 17 nt, Human
agagccuuccaggggug

SEQ ID NO: 3317196 - RNA, 15 nt, Human
agagccuuccagggg

SEQ ID NO: 3317197 - RNA, 13 nt, Human
agagccuuccagg

SEQ ID NO: 3317198 - RNA, 23 nt, Human
agagcaccuuagacagucccugc

SEQ ID NO: 3317199 - RNA, 21 nt, Human
agagcaccuuagacagucccu

SEQ ID NO: 3317200 - RNA, 22 nt, Human
agagcaccuuagacagucccug

SEQ ID NO: 3317201 - RNA, 12 nt, Human
ucuucagagacu

SEQ ID NO: 3317202 - RNA, 18 nt, Human
ucuucagagacuccugca

SEQ ID NO: 3317203 - RNA, 17 nt, Human
ucuucagagacuccugc

SEQ ID NO: 3317204 - RNA, 20 nt, Human
ucuuccaggcugggagagcc

SEQ ID NO: 3317205 - RNA, 17 nt, Human
ucuuccaggcugggaga

SEQ ID NO: 3317206 - RNA, 15 nt, Human
ucuuccaggcuggga

SEQ ID NO: 3317207 - RNA, 20 nt, Human
ucuucagagacuccugcagg

SEQ ID NO: 3317208 - RNA, 14 nt, Human
ucuuccucccuccc

SEQ ID NO: 3317209 - RNA, 19 nt, Human
ucuucccuacaguugaaaa

SEQ ID NO: 3317210 - RNA, 15 nt, Human
ucuuccucccucccu

SEQ ID NO: 3317211 - RNA, 19 nt, Human
agacauacuaaccagcaga

SEQ ID NO: 3317212 - RNA, 20 nt, Human
ucuucuguggguuucuaaag

SEQ ID NO: 3317213 - RNA, 15 nt, Human
ucuucuguacgucug

SEQ ID NO: 3317214 - RNA, 23 nt, Human
ucuucuguacgucugacaggcaa

SEQ ID NO: 3317215 - RNA, 12 nt, Human
ucuucugcuuca

SEQ ID NO: 3317216 - RNA, 21 nt, Human
ucuucugaacuuggcgcugcc

SEQ ID NO: 3317217 - RNA, 14 nt, Human
ucuugguccugcug

SEQ ID NO: 3317218 - RNA, 17 nt, Human
ucuuggucagauuugaa

SEQ ID NO: 3317219 - RNA, 19 nt, Human
ucuugcaauggcagccuug

SEQ ID NO: 3317220 - RNA, 18 nt, Human
ucuugcaauggcagccuu

SEQ ID NO: 3317221 - RNA, 22 nt, Human
ucuugcaauggcagccuuggca

SEQ ID NO: 3317222 - RNA, 17 nt, Human
ucuugguccugcugcag

SEQ ID NO: 3317223 - RNA, 15 nt, Human
ucuugguccugcugc

SEQ ID NO: 3317224 - RNA, 16 nt, Human
ucuuuccugaggcugg

SEQ ID NO: 3317225 - RNA, 17 nt, Human
ucuuuccugaggcuggg

SEQ ID NO: 3317226 - RNA, 23 nt, Human
agaccuucuccuucaccuuuguc

SEQ ID NO: 3317227 - RNA, 21 nt, Human
agaccuucuccuucaccuuug

SEQ ID NO: 3317228 - RNA, 11 nt, Human
agaccuucucc

SEQ ID NO: 3317229 - RNA, 18 nt, Human
agaccuucuccuucaccu

SEQ ID NO: 3317230 - RNA, 15 nt, Human
agaccuucuccuuca

SEQ ID NO: 3317231 - RNA, 16 nt, Human
ucuugagccugggagg

SEQ ID NO: 3317232 - RNA, 13 nt, Human
ucuugagccuggg

SEQ ID NO: 3317233 - RNA, 20 nt, Human
ucuugagccuugaacuuuga

SEQ ID NO: 3317234 - RNA, 13 nt, Human
ucuugauucauaa

SEQ ID NO: 3317235 - RNA, 20 nt, Human
agaaagacuaucuaaauguu

SEQ ID NO: 3317236 - RNA, 22 nt, Human
agaaagacuaucuaaauguuga

SEQ ID NO: 3317237 - RNA, 22 nt, Human
ucugaaggacauugcggacagc

SEQ ID NO: 3317238 - RNA, 18 nt, Human
ucugaaggcuggguucug

SEQ ID NO: 3317239 - RNA, 15 nt, Human
agaaaugccuuaccc

SEQ ID NO: 3317240 - RNA, 23 nt, Human
agaaaaaauauuuuccugccagg

SEQ ID NO: 3317241 - RNA, 17 nt, Human
agaaaaaauauuuuccu

SEQ ID NO: 3317242 - RNA, 19 nt, Human
agaaaaaauauuuucccua

SEQ ID NO: 3317243 - RNA, 18 nt, Human
agaaaaaugagccuggca

SEQ ID NO: 3317244 - RNA, 17 nt, Human
agaaaaaugagccuggc

SEQ ID NO: 3317245 - RNA, 18 nt, Human
ucucuugguccugcugca

SEQ ID NO: 3317246 - RNA, 17 nt, Human
ucucuugguccugcugc

SEQ ID NO: 3317247 - RNA, 16 nt, Human
ucucuugguccugcug

SEQ ID NO: 3317248 - RNA, 19 nt, Human
ucuccuguaccucuugagc

SEQ ID NO: 3317249 - RNA, 23 nt, Human
ucuccuuggugucgggcaugaca

SEQ ID NO: 3317250 - RNA, 21 nt, Human
ucuccuuggugucgggcauga

SEQ ID NO: 3317251 - RNA, 16 nt, Human
acuuuguguucaccuu

SEQ ID NO: 3317252 - RNA, 12 nt, Human
ucucucaggcca

SEQ ID NO: 3317253 - RNA, 14 nt, Human
acuuguggacacag

SEQ ID NO: 3317254 - RNA, 16 nt, Human
acuuuaaaaggagcca

SEQ ID NO: 3317255 - RNA, 23 nt, Human
acuuuaccuuuuuuauacauaaa

SEQ ID NO: 3317256 - RNA, 23 nt, Human
acuuuggaaagacuuuuccaacc

SEQ ID NO: 3317257 - RNA, 14 nt, Human
acuuuggaaagagu

SEQ ID NO: 3317258 - RNA, 13 nt, Human
acuuuggaaagag

SEQ ID NO: 3317259 - RNA, 23 nt, Human
acuuuggaaagaguaggaagacu

SEQ ID NO: 3317260 - RNA, 23 nt, Human
ucugcccacucccugcaaccuga

SEQ ID NO: 3317261 - RNA, 23 nt, Human
agaagcccaggaaaggcuccagg

SEQ ID NO: 3317262 - RNA, 12 nt, Human
ucugcccuuggu

SEQ ID NO: 3317263 - RNA, 16 nt, Human
agaagcagaggaagga

SEQ ID NO: 3317264 - RNA, 23 nt, Human
agaaccuuuugagugccuuacac

SEQ ID NO: 3317265 - RNA, 19 nt, Human
agaaccuuuugagugccuu

SEQ ID NO: 3317266 - RNA, 16 nt, Human
ucuggcagcucagaga

SEQ ID NO: 3317267 - RNA, 17 nt, Human
ucuggcagcucagagag

SEQ ID NO: 3317268 - RNA, 23 nt, Human
ucuggcagaguugaagacagagc

SEQ ID NO: 3317269 - RNA, 20 nt, Human
ucuggcagaguugaagacag

SEQ ID NO: 3317270 - RNA, 21 nt, Human
ucuggcagcucagagagggug

SEQ ID NO: 3317271 - RNA, 18 nt, Human
ucuggcagcucagagagg

SEQ ID NO: 3317272 - RNA, 22 nt, Human
ucugcuuugggguuuaucagaa

SEQ ID NO: 3317273 - RNA, 22 nt, Human
agaaguuugagaucagccuggg

SEQ ID NO: 3317274 - RNA, 14 nt, Human
acuugucuuuggac

SEQ ID NO: 3317275 - RNA, 14 nt, Human
acuuggaagcuccg

SEQ ID NO: 3317276 - RNA, 20 nt, Human
acuucgggaggucgaggcag

SEQ ID NO: 3317277 - RNA, 17 nt, Human
acuucgggaggucgagg

SEQ ID NO: 3317278 - RNA, 18 nt, Human
acuucuccacccugcucu

SEQ ID NO: 3317279 - RNA, 16 nt, Human
ucuauuguuucuuuca

SEQ ID NO: 3317280 - RNA, 16 nt, Human
ucucaaaaaaagaaaa

SEQ ID NO: 3317281 - RNA, 19 nt, Human
ucuaccugaggggccucuu

SEQ ID NO: 3317282 - RNA, 12 nt, Human
ucuaccugaggg

SEQ ID NO: 3317283 - RNA, 20 nt, Human
acuuagagguggggagcaga

SEQ ID NO: 3317284 - RNA, 15 nt, Human
acuuacuguacauga

SEQ ID NO: 3317285 - RNA, 14 nt, Human
acuuacuguacaug

SEQ ID NO: 3317286 - RNA, 13 nt, Human
acuuacuguacau

SEQ ID NO: 3317287 - RNA, 18 nt, Human
acuuccaauuuacauacu

SEQ ID NO: 3317288 - RNA, 17 nt, Human
acuuccacugccauccu

SEQ ID NO: 3317289 - RNA, 16 nt, Human
acuucaucccucuggg

SEQ ID NO: 3317290 - RNA, 23 nt, Human
ucuaguuugauuaaauucuugca

SEQ ID NO: 3317291 - RNA, 22 nt, Human
ucuaguuugauuaaauucuugc

SEQ ID NO: 3317292 - RNA, 13 nt, Human
ucuagauacugua

SEQ ID NO: 3317293 - RNA, 24 nt, Human
ucuagauacuguaucaugacaaag

SEQ ID NO: 3317294 - RNA, 13 nt, Human
ucuagccagagga

SEQ ID NO: 3317295 - RNA, 21 nt, Human
acugggcuuggggaccagagc

SEQ ID NO: 3317296 - RNA, 15 nt, Human
acuggguacuugugg

SEQ ID NO: 3317297 - RNA, 14 nt, Human
ucgcuccugugucu

SEQ ID NO: 3317298 - RNA, 23 nt, Human
acuguccuacccacccuccuuuc

SEQ ID NO: 3317299 - RNA, 20 nt, Human
acuguaucaugacaaagacu

SEQ ID NO: 3317300 - RNA, 16 nt, Human
acuguaucaugacaaa

SEQ ID NO: 3317301 - RNA, 17 nt, Human
acuggguacuuguggac

SEQ ID NO: 3317302 - RNA, 16 nt, Human
acuguacaaaguagaa

SEQ ID NO: 3317303 - RNA, 22 nt, Human
acuguacaaaguagaagucuua

SEQ ID NO: 3317304 - RNA, 16 nt, Human
acuguacaugaaaaca

SEQ ID NO: 3317305 - RNA, 19 nt, Human
acuguacaugaaaacacau

SEQ ID NO: 3317306 - RNA, 14 nt, Human
acuguaucaugaca

SEQ ID NO: 3317307 - RNA, 21 nt, Human
acuguacaugaaaacacauuu

SEQ ID NO: 3317308 - RNA, 20 nt, Human
acuguacaugaaaacacauu

SEQ ID NO: 3317309 - RNA, 21 nt, Human
acuguuaauaguucagguaac

SEQ ID NO: 3317310 - RNA, 17 nt, Human
acuguuaauaguucagg

SEQ ID NO: 3317311 - RNA, 22 nt, Human
ucuaacuucaccauauuaccac

SEQ ID NO: 3317312 - RNA, 17 nt, Human
ucuaaagcugccagccg

SEQ ID NO: 3317313 - RNA, 16 nt, Human
ucuaaagcugccagcc

SEQ ID NO: 3317314 - RNA, 16 nt, Human
ucuaaaggcuaccuuu

SEQ ID NO: 3317315 - RNA, 13 nt, Human
ucuaaaggcuacc

SEQ ID NO: 3317316 - RNA, 14 nt, Human
ucuacccaggugcu

SEQ ID NO: 3317317 - RNA, 21 nt, Human
ucuacccucuuagaaaaacca

SEQ ID NO: 3317318 - RNA, 23 nt, Human
accugaggcccuucucuccagcc

SEQ ID NO: 3317319 - RNA, 12 nt, Human
ucauaaugacuu

SEQ ID NO: 3317320 - RNA, 18 nt, Human
accugaagacucauucuu

SEQ ID NO: 3317321 - RNA, 19 nt, Human
accugaauuuuggcugugu

SEQ ID NO: 3317322 - RNA, 17 nt, Human
accugccaggaagccag

SEQ ID NO: 3317323 - RNA, 16 nt, Human
accugccaggaagcca

SEQ ID NO: 3317324 - RNA, 18 nt, Human
accugccaggaagccagc

SEQ ID NO: 3317325 - RNA, 15 nt, Human
accugccaggaagcc

SEQ ID NO: 3317326 - RNA, 14 nt, Human
accugaggggccuc

SEQ ID NO: 3317327 - RNA, 22 nt, Human
accugaggcccuucucuccagc

SEQ ID NO: 3317328 - RNA, 17 nt, Human
ucauuuuuuuuaagaaa

SEQ ID NO: 3317329 - RNA, 18 nt, Human
ucauuuuuuuuaagaaaa

SEQ ID NO: 3317330 - RNA, 19 nt, Human
ucauuuuuaguagagacag

SEQ ID NO: 3317331 - RNA, 16 nt, Human
ucauuugucacacacu

SEQ ID NO: 3317332 - RNA, 14 nt, Human
ucauuugucacaca

SEQ ID NO: 3317333 - RNA, 16 nt, Human
accugcggugcuaucu

SEQ ID NO: 3317334 - RNA, 21 nt, Human
accugcgucucauacucaccu

SEQ ID NO: 3317335 - RNA, 23 nt, Human
accugccuguugggccaggagcc

SEQ ID NO: 3317336 - RNA, 20 nt, Human
accuggaauauauaaccagu

SEQ ID NO: 3317337 - RNA, 17 nt, Human
accuggaauauauaacc

SEQ ID NO: 3317338 - RNA, 20 nt, Human
uccacccaggagccccgagg

SEQ ID NO: 3317339 - RNA, 12 nt, Human
uccacccaccuc

SEQ ID NO: 3317340 - RNA, 18 nt, Human
uccaccaucaagccacca

SEQ ID NO: 3317341 - RNA, 13 nt, Human
uccacccaccuca

SEQ ID NO: 3317342 - RNA, 17 nt, Human
uccacccaggagccccg

SEQ ID NO: 3317343 - RNA, 13 nt, Human
accuggccucugc

SEQ ID NO: 3317344 - RNA, 12 nt, Human
accuggccucug

SEQ ID NO: 3317345 - RNA, 14 nt, Human
accuucuccuucac

SEQ ID NO: 3317346 - RNA, 22 nt, Human
accuucuccuucaccuuugucc

SEQ ID NO: 3317347 - RNA, 16 nt, Human
accuugacagggcaca

SEQ ID NO: 3317348 - RNA, 13 nt, Human
accuuugucccca

SEQ ID NO: 3317349 - RNA, 16 nt, Human
accuuuguccccaccg

SEQ ID NO: 3317350 - RNA, 14 nt, Human
accuuuuuuauaca

SEQ ID NO: 3317351 - RNA, 15 nt, Human
accuuuguccccacc

SEQ ID NO: 3317352 - RNA, 14 nt, Human
accuuuguccccac

SEQ ID NO: 3317353 - RNA, 18 nt, Human
accuuuuuuauacauaaa

SEQ ID NO: 3317354 - RNA, 17 nt, Human
accuuuuuuauacauaa

SEQ ID NO: 3317355 - RNA, 16 nt, Human
accuuuuuuauacaua

SEQ ID NO: 3317356 - RNA, 17 nt, Human
acgcuacccgggaaggg

SEQ ID NO: 3317357 - RNA, 13 nt, Human
acgcuacccggga

SEQ ID NO: 3317358 - RNA, 20 nt, Human
acgcgugcacacaccagagc

SEQ ID NO: 3317359 - RNA, 23 nt, Human
acgcgugcacacaccagagccca

SEQ ID NO: 3317360 - RNA, 14 nt, Human
acgcccccacuggu

SEQ ID NO: 3317361 - RNA, 19 nt, Human
acggagucccaccuuggcu

SEQ ID NO: 3317362 - RNA, 13 nt, Human
acggccaggccag

SEQ ID NO: 3317363 - RNA, 16 nt, Human
acggccaggccagagg

SEQ ID NO: 3317364 - RNA, 22 nt, Human
uccaggcuccuuuagcgcccag

SEQ ID NO: 3317365 - RNA, 18 nt, Human
uccaggcugggagagccu

SEQ ID NO: 3317366 - RNA, 17 nt, Human
uccaggcugggagagcc

SEQ ID NO: 3317367 - RNA, 14 nt, Human
uccaggcugggaga

SEQ ID NO: 3317368 - RNA, 18 nt, Human
acgccaucccagccccaa

SEQ ID NO: 3317369 - RNA, 17 nt, Human
acgccaucccagcccca

SEQ ID NO: 3317370 - RNA, 16 nt, Human
acgccaucccagcccc

SEQ ID NO: 3317371 - RNA, 15 nt, Human
acgccaucccagccc

SEQ ID NO: 3317372 - RNA, 14 nt, Human
acgccaucccagcc

SEQ ID NO: 3317373 - RNA, 11 nt, Human
acgccauccca

SEQ ID NO: 3317374 - RNA, 23 nt, Human
acgccaggggaaaaucagccugc

SEQ ID NO: 3317375 - RNA, 15 nt, Human
acgacugcccggcag

SEQ ID NO: 3317376 - RNA, 18 nt, Human
acgccaggggaaaaucag

SEQ ID NO: 3317377 - RNA, 17 nt, Human
uccaugaguccccuguu

SEQ ID NO: 3317378 - RNA, 16 nt, Human
uccaugaguccccugu

SEQ ID NO: 3317379 - RNA, 15 nt, Human
uccaugaguccccug

SEQ ID NO: 3317380 - RNA, 20 nt, Human
uccagugaggcucugcccuu

SEQ ID NO: 3317381 - RNA, 19 nt, Human
uccagugaggcucugcccu

SEQ ID NO: 3317382 - RNA, 18 nt, Human
uccagugaggcucugccc

SEQ ID NO: 3317383 - RNA, 17 nt, Human
uccagugaggcucugcc

SEQ ID NO: 3317384 - RNA, 14 nt, Human
acggcucacugcag

SEQ ID NO: 3317385 - RNA, 14 nt, Human
ucccacaaaggaga

SEQ ID NO: 3317386 - RNA, 14 nt, Human
ucccaaagugcugg

SEQ ID NO: 3317387 - RNA, 15 nt, Human
ucccaaagugcuggg

SEQ ID NO: 3317388 - RNA, 16 nt, Human
ucccaaagugcuggga

SEQ ID NO: 3317389 - RNA, 11 nt, Human
ucccaccccac

SEQ ID NO: 3317390 - RNA, 23 nt, Human
uccucuuuggucuacacugugcu

SEQ ID NO: 3317391 - RNA, 15 nt, Human
uccugaagaauugaa

SEQ ID NO: 3317392 - RNA, 19 nt, Human
acucuuucuauuguuucuu

SEQ ID NO: 3317393 - RNA, 21 nt, Human
uccucccaccucagccucccg

SEQ ID NO: 3317394 - RNA, 15 nt, Human
uccucccaccucagc

SEQ ID NO: 3317395 - RNA, 16 nt, Human
uccucccaccucagcc

SEQ ID NO: 3317396 - RNA, 18 nt, Human
uccucccaccucagccuc

SEQ ID NO: 3317397 - RNA, 20 nt, Human
uccucccaccucagccuccc

SEQ ID NO: 3317398 - RNA, 13 nt, Human
uccucccaccuca

SEQ ID NO: 3317399 - RNA, 14 nt, Human
uccucccaccucag

SEQ ID NO: 3317400 - RNA, 16 nt, Human
acucgcgacaaugcaa

SEQ ID NO: 3317401 - RNA, 15 nt, Human
acucgcgacaaugca

SEQ ID NO: 3317402 - RNA, 17 nt, Human
acucuggcagcucagag

SEQ ID NO: 3317403 - RNA, 16 nt, Human
acucuggcagcucaga

SEQ ID NO: 3317404 - RNA, 21 nt, Human
acucuuauugcccacgcugga

SEQ ID NO: 3317405 - RNA, 19 nt, Human
acucuuauugcccacgcug

SEQ ID NO: 3317406 - RNA, 19 nt, Human
acucuggcagcucagagag

SEQ ID NO: 3317407 - RNA, 13 nt, Human
uccguuaaaauac

SEQ ID NO: 3317408 - RNA, 15 nt, Human
uccguuaaaauacca

SEQ ID NO: 3317409 - RNA, 16 nt, Human
acucgaguuacagaca

SEQ ID NO: 3317410 - RNA, 20 nt, Human
uccuagcacuuugggaggcc

SEQ ID NO: 3317411 - RNA, 21 nt, Human
uccuagccugugccucuggga

SEQ ID NO: 3317412 - RNA, 14 nt, Human
acucagaauucucu

SEQ ID NO: 3317413 - RNA, 22 nt, Human
acucagaauucucuaguuugau

SEQ ID NO: 3317414 - RNA, 21 nt, Human
acucagaauucucuaguuuga

SEQ ID NO: 3317415 - RNA, 18 nt, Human
acucagaagacacugaug

SEQ ID NO: 3317416 - RNA, 21 nt, Human
acucaccugccccucaacucu

SEQ ID NO: 3317417 - RNA, 19 nt, Human
acucaccugccccucaacu

SEQ ID NO: 3317418 - RNA, 14 nt, Human
acucaccugccccu

SEQ ID NO: 3317419 - RNA, 14 nt, Human
acucagaagacacu

SEQ ID NO: 3317420 - RNA, 15 nt, Human
acucagaagacacug

SEQ ID NO: 3317421 - RNA, 16 nt, Human
acucagaagacacuga

SEQ ID NO: 3317422 - RNA, 17 nt, Human
acucagaagacacugau

SEQ ID NO: 3317423 - RNA, 18 nt, Human
acucauugaccugaggcc

SEQ ID NO: 3317424 - RNA, 17 nt, Human
acucauugaccugaggc

SEQ ID NO: 3317425 - RNA, 16 nt, Human
acucauugaccugagg

SEQ ID NO: 3317426 - RNA, 12 nt, Human
acucaucuuagg

SEQ ID NO: 3317427 - RNA, 23 nt, Human
ucccugaaggccccgcccaggcu

SEQ ID NO: 3317428 - RNA, 17 nt, Human
acucaccccagccccaa

SEQ ID NO: 3317429 - RNA, 17 nt, Human
ucccugaaggccccgcc

SEQ ID NO: 3317430 - RNA, 18 nt, Human
ucccugaaggccccgccc

SEQ ID NO: 3317431 - RNA, 22 nt, Human
ucccugaaggccccgcccaggc

SEQ ID NO: 3317432 - RNA, 21 nt, Human
ucccugaaggccccgcccagg

SEQ ID NO: 3317433 - RNA, 21 nt, Human
ucccucuuucccucccuuccu

SEQ ID NO: 3317434 - RNA, 18 nt, Human
ucccucagucuggcccuu

SEQ ID NO: 3317435 - RNA, 11 nt, Human
ucccucuuucc

SEQ ID NO: 3317436 - RNA, 13 nt, Human
ucccucuuucccu

SEQ ID NO: 3317437 - RNA, 12 nt, Human
acuauaauguaa

SEQ ID NO: 3317438 - RNA, 11 nt, Human
acuauaaugua

SEQ ID NO: 3317439 - RNA, 13 nt, Human
acuauaauguaag

SEQ ID NO: 3317440 - RNA, 14 nt, Human
acuauaauguaagc

SEQ ID NO: 3317441 - RNA, 12 nt, Human
acuauguaucaa

SEQ ID NO: 3317442 - RNA, 19 nt, Human
acucacauuuauucugcuc

SEQ ID NO: 3317443 - RNA, 20 nt, Human
acucacauuuauucugcuca

SEQ ID NO: 3317444 - RNA, 14 nt, Human
acucaaugcacuga

SEQ ID NO: 3317445 - RNA, 18 nt, Human
acuacggaauaguuggcu

SEQ ID NO: 3317446 - RNA, 13 nt, Human
acguacacacaca

SEQ ID NO: 3317447 - RNA, 12 nt, Human
acguacacauuu

SEQ ID NO: 3317448 - RNA, 13 nt, Human
acguacacauuuu

SEQ ID NO: 3317449 - RNA, 11 nt, Human
acccacugcuu

SEQ ID NO: 3317450 - RNA, 20 nt, Human
acccacugcuuuuggucugu

SEQ ID NO: 3317451 - RNA, 21 nt, Human
accauuuugggguacccacug

SEQ ID NO: 3317452 - RNA, 23 nt, Human
accauuuugcugucccuuuuccu

SEQ ID NO: 3317453 - RNA, 22 nt, Human
accauuuugcugucccuuuucc

SEQ ID NO: 3317454 - RNA, 18 nt, Human
accauucuccaccugcca

SEQ ID NO: 3317455 - RNA, 19 nt, Human
accauucuccaccugccag

SEQ ID NO: 3317456 - RNA, 21 nt, Human
accauucuccaccugccaggg

SEQ ID NO: 3317457 - RNA, 20 nt, Human
accauucuccaccugccagg

SEQ ID NO: 3317458 - RNA, 22 nt, Human
ucaccagccccagugcccacag

SEQ ID NO: 3317459 - RNA, 20 nt, Human
ucacuauguugcccaggcag

SEQ ID NO: 3317460 - RNA, 21 nt, Human
ucacuauguugcccaggcagg

SEQ ID NO: 3317461 - RNA, 23 nt, Human
ucacugagacagcccgggcucug

SEQ ID NO: 3317462 - RNA, 18 nt, Human
ucacugcaaccuccgccu

SEQ ID NO: 3317463 - RNA, 14 nt, Human
ucacuguugcccag

SEQ ID NO: 3317464 - RNA, 15 nt, Human
ucacuguugcccagg

SEQ ID NO: 3317465 - RNA, 13 nt, Human
acccagcgagccc

SEQ ID NO: 3317466 - RNA, 16 nt, Human
acccagcgagcccugg

SEQ ID NO: 3317467 - RNA, 17 nt, Human
acccagcgagcccuggu

SEQ ID NO: 3317468 - RNA, 13 nt, Human
acccaggagcccc

SEQ ID NO: 3317469 - RNA, 15 nt, Human
acccaggagccccga

SEQ ID NO: 3317470 - RNA, 13 nt, Human
accccagguuucu

SEQ ID NO: 3317471 - RNA, 11 nt, Human
acccaggugcu

SEQ ID NO: 3317472 - RNA, 15 nt, Human
ucagaucucuaacuu

SEQ ID NO: 3317473 - RNA, 16 nt, Human
ucagaucucuaacuuc

SEQ ID NO: 3317474 - RNA, 23 nt, Human
ucagagacuccugcaggcagcca

SEQ ID NO: 3317475 - RNA, 23 nt, Human
ucagagagggugggagugggccc

SEQ ID NO: 3317476 - RNA, 20 nt, Human
ucagaauucucagaaucuca

SEQ ID NO: 3317477 - RNA, 10 nt, Human
ucagaauucu

SEQ ID NO: 3317478 - RNA, 12 nt, Human
ucagaauucuca

SEQ ID NO: 3317479 - RNA, 22 nt, Human
ucagagacuccugcaggcagcc

SEQ ID NO: 3317480 - RNA, 23 nt, Human
ucagaaguuucugccgcagcccu

SEQ ID NO: 3317481 - RNA, 23 nt, Human
ucagugccuuauggaacacucug

SEQ ID NO: 3317482 - RNA, 22 nt, Human
ucagugccuuauggaacacucu

SEQ ID NO: 3317483 - RNA, 20 nt, Human
ucagugccuuauggaacacu

SEQ ID NO: 3317484 - RNA, 19 nt, Human
ucagugccuuauggaacac

SEQ ID NO: 3317485 - RNA, 14 nt, Human
ucaguggcagcugc

SEQ ID NO: 3317486 - RNA, 15 nt, Human
ucaguggcagcugcu

SEQ ID NO: 3317487 - RNA, 17 nt, Human
ucaguuguuaguguguc

SEQ ID NO: 3317488 - RNA, 13 nt, Human
ucaguggcagcug

SEQ ID NO: 3317489 - RNA, 18 nt, Human
ucagugccuuauggaaca

SEQ ID NO: 3317490 - RNA, 19 nt, Human
ucaguuguuagugugucuu

SEQ ID NO: 3317491 - RNA, 22 nt, Human
ucaggugucccugcacuugcag

SEQ ID NO: 3317492 - RNA, 13 nt, Human
ucaguaagccgug

SEQ ID NO: 3317493 - RNA, 13 nt, Human
ucaguaauaacuc

SEQ ID NO: 3317494 - RNA, 20 nt, Human
acccuugccgucuaccugag

SEQ ID NO: 3317495 - RNA, 20 nt, Human
accgaaaacguggcugcuuc

SEQ ID NO: 3317496 - RNA, 15 nt, Human
ucaggugucccugca

SEQ ID NO: 3317497 - RNA, 23 nt, Human
ucagguggggucacucuggcagc

SEQ ID NO: 3317498 - RNA, 17 nt, Human
ucaggugucccugcacu

SEQ ID NO: 3317499 - RNA, 18 nt, Human
ucaggugucccugcacuu

SEQ ID NO: 3317500 - RNA, 22 nt, Human
accgaaaacguggcugcuucaa

SEQ ID NO: 3317501 - RNA, 21 nt, Human
accgaaaacguggcugcuuca

SEQ ID NO: 3317502 - RNA, 22 nt, Human
ucagguggggucacucuggcag

SEQ ID NO: 3317503 - RNA, 21 nt, Human
ucagguggggucacucuggca

SEQ ID NO: 3317504 - RNA, 21 nt, Human
acccuccuuucaccacaugug

SEQ ID NO: 3317505 - RNA, 22 nt, Human
acccgggaagggggcugggaca

SEQ ID NO: 3317506 - RNA, 14 nt, Human
acccucauguucuu

SEQ ID NO: 3317507 - RNA, 17 nt, Human
acccucauguucuuaau

SEQ ID NO: 3317508 - RNA, 15 nt, Human
acccucauguucuua

SEQ ID NO: 3317509 - RNA, 20 nt, Human
acccgggaagggggcuggga

SEQ ID NO: 3317510 - RNA, 19 nt, Human
acccgggaagggggcuggg

SEQ ID NO: 3317511 - RNA, 21 nt, Human
acccugaggcccagagggccu

SEQ ID NO: 3317512 - RNA, 19 nt, Human
acccugaggcccagagggc

SEQ ID NO: 3317513 - RNA, 17 nt, Human
acccugaggcccagagg

SEQ ID NO: 3317514 - RNA, 11 nt, Human
acccugaggcc

SEQ ID NO: 3317515 - RNA, 23 nt, Human
acccugaggcccagagggccugc

SEQ ID NO: 3317516 - RNA, 17 nt, Human
ucaggcaggugggaugg

SEQ ID NO: 3317517 - RNA, 18 nt, Human
ucaggcaggugggaugga

SEQ ID NO: 3317518 - RNA, 23 nt, Human
ucaggccaaacucaccugccccu

SEQ ID NO: 3317519 - RNA, 13 nt, Human
acccccagccugc

SEQ ID NO: 3317520 - RNA, 12 nt, Human
acccccagccug

SEQ ID NO: 3317521 - RNA, 16 nt, Human
ucaggccaggcccucu

SEQ ID NO: 3317522 - RNA, 15 nt, Human
ucaggccaggcccuc

SEQ ID NO: 3317523 - RNA, 14 nt, Human
ucaggccaggcccu

SEQ ID NO: 3317524 - RNA, 13 nt, Human
ucaggccaggccc

SEQ ID NO: 3317525 - RNA, 12 nt, Human
ucaggccaggcc

SEQ ID NO: 3317526 - RNA, 13 nt, Human
ucaggccagcugc

SEQ ID NO: 3317527 - RNA, 17 nt, Human
ucaggguuggccccugc

SEQ ID NO: 3317528 - RNA, 19 nt, Human
ucaggggugugcggccuuu

SEQ ID NO: 3317529 - RNA, 12 nt, Human
ucaggggugugc

SEQ ID NO: 3317530 - RNA, 18 nt, Human
ucaggccaggcccucugc

SEQ ID NO: 3317531 - RNA, 17 nt, Human
ucaggccaggcccucug

SEQ ID NO: 3317532 - RNA, 19 nt, Human
ucaggccaggcccucugcc

SEQ ID NO: 3317533 - RNA, 18 nt, Human
ucaggguuggccccugcc

SEQ ID NO: 3317534 - RNA, 19 nt, Human
ucaggguuggccccugccc

SEQ ID NO: 3317535 - RNA, 19 nt, Human
acccgcuaagagggaggga

SEQ ID NO: 3317536 - RNA, 15 nt, Human
ucacagaugggugcu

SEQ ID NO: 3317537 - RNA, 14 nt, Human
ucacagaugggugc

SEQ ID NO: 3317538 - RNA, 17 nt, Human
ucaccagccccagugcc

SEQ ID NO: 3317539 - RNA, 16 nt, Human
ucaccagccccagugc

SEQ ID NO: 3317540 - RNA, 20 nt, Human
ucacauauugauuuccguua

SEQ ID NO: 3317541 - RNA, 18 nt, Human
ucacauauugauuuccgu

SEQ ID NO: 3317542 - RNA, 16 nt, Human
ucacauauugauuucc

SEQ ID NO: 3317543 - RNA, 16 nt, Human
accaaaucagcugcua

SEQ ID NO: 3317544 - RNA, 19 nt, Human
accaaaucagcugcuacua

SEQ ID NO: 3317545 - RNA, 16 nt, Human
accaacauacucccau

SEQ ID NO: 3317546 - RNA, 20 nt, Human
accaaccacugcgaccacaa

SEQ ID NO: 3317547 - RNA, 17 nt, Human
accacacagaggcugcc

SEQ ID NO: 3317548 - RNA, 15 nt, Human
accacacccagccca

SEQ ID NO: 3317549 - RNA, 16 nt, Human
accacacccagcccac

SEQ ID NO: 3317550 - RNA, 20 nt, Human
accacacccagcccacuucu

SEQ ID NO: 3317551 - RNA, 21 nt, Human
accacacccagcccacuucug

SEQ ID NO: 3317552 - RNA, 23 nt, Human
accacacccagcccacuucugcc

SEQ ID NO: 3317553 - RNA, 21 nt, Human
acauugcggacagccacggcc

SEQ ID NO: 3317554 - RNA, 22 nt, Human
acauugcggacagccacggcca

SEQ ID NO: 3317555 - RNA, 21 nt, Human
acauuuuuuaaaugcaccugg

SEQ ID NO: 3317556 - RNA, 23 nt, Human
acauuuuucuuagggaaggauac

SEQ ID NO: 3317557 - RNA, 13 nt, Human
acauuuuucuuag

SEQ ID NO: 3317558 - RNA, 18 nt, Human
acauuuuuaagugcugca

SEQ ID NO: 3317559 - RNA, 15 nt, Human
acauuuuuaagugcu

SEQ ID NO: 3317560 - RNA, 22 nt, Human
ucaauaggaaaaacugauuuuu

SEQ ID NO: 3317561 - RNA, 16 nt, Human
ucaagugauucuccug

SEQ ID NO: 3317562 - RNA, 17 nt, Human
ucaagugauucuccugc

SEQ ID NO: 3317563 - RNA, 17 nt, Human
ucaauaggaaaaacuga

SEQ ID NO: 3317564 - RNA, 19 nt, Human
ucaauaggaaaaacugauu

SEQ ID NO: 3317565 - RNA, 18 nt, Human
ucaauaggaaaaacugau

SEQ ID NO: 3317566 - RNA, 23 nt, Human
ucaaggauccugagccagauuuc

SEQ ID NO: 3317567 - RNA, 17 nt, Human
ucaagagggucugagga

SEQ ID NO: 3317568 - RNA, 15 nt, Human
acaucuugcucugcu

SEQ ID NO: 3317569 - RNA, 16 nt, Human
acaucuugcucugcug

SEQ ID NO: 3317570 - RNA, 14 nt, Human
acaucuugcucugc

SEQ ID NO: 3317571 - RNA, 19 nt, Human
acaucuuggucagauuuga

SEQ ID NO: 3317572 - RNA, 22 nt, Human
acaucuugcucugcugacagac

SEQ ID NO: 3317573 - RNA, 15 nt, Human
acaugaaaacacauu

SEQ ID NO: 3317574 - RNA, 17 nt, Human
uauuuuuguagagccag

SEQ ID NO: 3317575 - RNA, 15 nt, Human
uauuuugcuuuguga

SEQ ID NO: 3317576 - RNA, 13 nt, Human
uauuuugcuuugu

SEQ ID NO: 3317577 - RNA, 20 nt, Human
uauuuugcuuugugauuuuu

SEQ ID NO: 3317578 - RNA, 16 nt, Human
ucaaaagcugggcagg

SEQ ID NO: 3317579 - RNA, 22 nt, Human
ucaaagauauuuugcuuuguga

SEQ ID NO: 3317580 - RNA, 20 nt, Human
ucaaagauauuuugcuuugu

SEQ ID NO: 3317581 - RNA, 13 nt, Human
ucaaagauauuuu

SEQ ID NO: 3317582 - RNA, 13 nt, Human
acaugagcaucag

SEQ ID NO: 3317583 - RNA, 22 nt, Human
acaugaaaacacauuuuucuua

SEQ ID NO: 3317584 - RNA, 23 nt, Human
acaugaaaacacauuuuucuuag

SEQ ID NO: 3317585 - RNA, 23 nt, Human
acaugagcaucaggccaggcccu

SEQ ID NO: 3317586 - RNA, 20 nt, Human
acaugagcaucaggccaggc

SEQ ID NO: 3317587 - RNA, 20 nt, Human
acauggaauaacauguaauu

SEQ ID NO: 3317588 - RNA, 14 nt, Human
acauggaaguacua

SEQ ID NO: 3317589 - RNA, 18 nt, Human
acauggaauaacauguaa

SEQ ID NO: 3317590 - RNA, 15 nt, Human
acauggaguauaugu

SEQ ID NO: 3317591 - RNA, 19 nt, Human
acauggaguauaugucaag

SEQ ID NO: 3317592 - RNA, 14 nt, Human
acauggccuuugcu

SEQ ID NO: 3317593 - RNA, 20 nt, Human
auaaccaguguuguggauuu

SEQ ID NO: 3317594 - RNA, 11 nt, Human
auaaauuauuu

SEQ ID NO: 3317595 - RNA, 13 nt, Human
uuagacagagucu

SEQ ID NO: 3317596 - RNA, 20 nt, Human
uuagacagagucucacuguu

SEQ ID NO: 3317597 - RNA, 13 nt, Human
uuagacagucccu

SEQ ID NO: 3317598 - RNA, 19 nt, Human
uuacccucauguucuuaau

SEQ ID NO: 3317599 - RNA, 18 nt, Human
uuagccaagugugguaga

SEQ ID NO: 3317600 - RNA, 18 nt, Human
uuagcaaauucuguuuuu

SEQ ID NO: 3317601 - RNA, 15 nt, Human
uuaguuucuccaagc

SEQ ID NO: 3317602 - RNA, 22 nt, Human
uuaguuugcaguuacacuaaaa

SEQ ID NO: 3317603 - RNA, 18 nt, Human
uuagguuggcaaaaaggc

SEQ ID NO: 3317604 - RNA, 16 nt, Human
uuaggugaggaagcaa

SEQ ID NO: 3317605 - RNA, 16 nt, Human
uuaggugugacugaau

SEQ ID NO: 3317606 - RNA, 20 nt, Human
uuagggaaggauacaaaagc

SEQ ID NO: 3317607 - RNA, 15 nt, Human
uuaggugaggaagca

SEQ ID NO: 3317608 - RNA, 15 nt, Human
auaaugaaugaaaca

SEQ ID NO: 3317609 - RNA, 15 nt, Human
auaaugcgugcauac

SEQ ID NO: 3317610 - RNA, 22 nt, Human
auaauugacaggauuauuggaa

SEQ ID NO: 3317611 - RNA, 12 nt, Human
auaauacaccac

SEQ ID NO: 3317612 - RNA, 20 nt, Human
auaauacaccacuacauucu

SEQ ID NO: 3317613 - RNA, 18 nt, Human
auaauacaccacuacauu

SEQ ID NO: 3317614 - RNA, 13 nt, Human
aguuggucccccu

SEQ ID NO: 3317615 - RNA, 11 nt, Human
aguuggucccc

SEQ ID NO: 3317616 - RNA, 17 nt, Human
aguuggucccccuucca

SEQ ID NO: 3317617 - RNA, 13 nt, Human
uuaaaaaaaaucc

SEQ ID NO: 3317618 - RNA, 20 nt, Human
aguugccagucaccccggcc

SEQ ID NO: 3317619 - RNA, 23 nt, Human
aguugccagucaccccggccacc

SEQ ID NO: 3317620 - RNA, 13 nt, Human
aguugggcuuccu

SEQ ID NO: 3317621 - RNA, 19 nt, Human
aguugggcuuccucauagu

SEQ ID NO: 3317622 - RNA, 15 nt, Human
uuaaaaaucucaaau

SEQ ID NO: 3317623 - RNA, 14 nt, Human
uuaaaaaucucaaa

SEQ ID NO: 3317624 - RNA, 16 nt, Human
uuaaaaaucucaaauu

SEQ ID NO: 3317625 - RNA, 15 nt, Human
uuaaauaaugugaaa

SEQ ID NO: 3317626 - RNA, 18 nt, Human
uuaaauaaugugaaacug

SEQ ID NO: 3317627 - RNA, 16 nt, Human
uuaaauaaugugaaac

SEQ ID NO: 3317628 - RNA, 13 nt, Human
uuaaauaauguga

SEQ ID NO: 3317629 - RNA, 20 nt, Human
uuaacagaaauguacagcaa

SEQ ID NO: 3317630 - RNA, 16 nt, Human
uuaacagaaauguaca

SEQ ID NO: 3317631 - RNA, 19 nt, Human
uuaacagaaauguacagca

SEQ ID NO: 3317632 - RNA, 14 nt, Human
uuaagugcugcauu

SEQ ID NO: 3317633 - RNA, 16 nt, Human
uuaagugcugcauuua

SEQ ID NO: 3317634 - RNA, 15 nt, Human
uuaagugcugcauuu

SEQ ID NO: 3317635 - RNA, 19 nt, Human
uuaagugcugcauuuaaaa

SEQ ID NO: 3317636 - RNA, 22 nt, Human
uuaagaaagacuaucuaaaugu

SEQ ID NO: 3317637 - RNA, 9 nt, Human
uuaaggugg

SEQ ID NO: 3317638 - RNA, 23 nt, Human
uuaaucauuaggugugacugaau

SEQ ID NO: 3317639 - RNA, 22 nt, Human
uuaaucauuaggugugacugaa

SEQ ID NO: 3317640 - RNA, 13 nt, Human
uuaaucauuaggu

SEQ ID NO: 3317641 - RNA, 19 nt, Human
uuaaugaaagacuguacaa

SEQ ID NO: 3317642 - RNA, 18 nt, Human
uuaaugaaagacuguaca

SEQ ID NO: 3317643 - RNA, 22 nt, Human
uuaaucugguuuauuuuuguuc

SEQ ID NO: 3317644 - RNA, 20 nt, Human
uuaagaaaaaggaugcacag

SEQ ID NO: 3317645 - RNA, 19 nt, Human
uuaagaaaaaggaugcaca

SEQ ID NO: 3317646 - RNA, 21 nt, Human
uuaagaaaaaggaugcacaga

SEQ ID NO: 3317647 - RNA, 23 nt, Human
aguuuuuauggcuuuugugcauu

SEQ ID NO: 3317648 - RNA, 18 nt, Human
uguucuuaguuugcaguu

SEQ ID NO: 3317649 - RNA, 18 nt, Human
uguucuagcauggcugcc

SEQ ID NO: 3317650 - RNA, 15 nt, Human
uguugcccaggcugg

SEQ ID NO: 3317651 - RNA, 13 nt, Human
uguugcccaggcu

SEQ ID NO: 3317652 - RNA, 22 nt, Human
uguucuugguuuguaaauuaac

SEQ ID NO: 3317653 - RNA, 20 nt, Human
uguucuugguuuguaaauua

SEQ ID NO: 3317654 - RNA, 19 nt, Human
uguucuugguuuguaaauu

SEQ ID NO: 3317655 - RNA, 20 nt, Human
uguuuagauaauacaccacu

SEQ ID NO: 3317656 - RNA, 14 nt, Human
uguuuauugucaaa

SEQ ID NO: 3317657 - RNA, 16 nt, Human
aguucaauucucauuu

SEQ ID NO: 3317658 - RNA, 23 nt, Human
aguuccucauuagcauuuugcua

SEQ ID NO: 3317659 - RNA, 15 nt, Human
agugccuuacacaau

SEQ ID NO: 3317660 - RNA, 20 nt, Human
agugcugcauuuaaaagaua

SEQ ID NO: 3317661 - RNA, 19 nt, Human
agugcugggauuacaggug

SEQ ID NO: 3317662 - RNA, 20 nt, Human
agugcugggauuacaagcgu

SEQ ID NO: 3317663 - RNA, 22 nt, Human
agugcugcauuuaaaagauaca

SEQ ID NO: 3317664 - RNA, 16 nt, Human
agugcuuccaaggaug

SEQ ID NO: 3317665 - RNA, 16 nt, Human
uguggucccaccccac

SEQ ID NO: 3317666 - RNA, 19 nt, Human
ugugucagcauagaaguaa

SEQ ID NO: 3317667 - RNA, 20 nt, Human
ugugguguuuccuggcacug

SEQ ID NO: 3317668 - RNA, 23 nt, Human
uguguuaucacccagaagaaaau

SEQ ID NO: 3317669 - RNA, 14 nt, Human
uguguuaugaagca

SEQ ID NO: 3317670 - RNA, 13 nt, Human
ugugucucuuggu

SEQ ID NO: 3317671 - RNA, 17 nt, Human
ugugucagguggggcag

SEQ ID NO: 3317672 - RNA, 19 nt, Human
ugugucagguggggcagcu

SEQ ID NO: 3317673 - RNA, 11 nt, Human
aguggaaaaau

SEQ ID NO: 3317674 - RNA, 19 nt, Human
aguggaaaaauagccugcc

SEQ ID NO: 3317675 - RNA, 18 nt, Human
aguggaaaaauagccugc

SEQ ID NO: 3317676 - RNA, 19 nt, Human
uguuaaugauagcuacugu

SEQ ID NO: 3317677 - RNA, 21 nt, Human
uguuaacauggacaugaucuu

SEQ ID NO: 3317678 - RNA, 15 nt, Human
ugugcugcccugccc

SEQ ID NO: 3317679 - RNA, 21 nt, Human
uguggagaagcggcuggcagc

SEQ ID NO: 3317680 - RNA, 14 nt, Human
ugugcugcccugcc

SEQ ID NO: 3317681 - RNA, 13 nt, Human
ugugcugcccugc

SEQ ID NO: 3317682 - RNA, 12 nt, Human
ugugcugcccug

SEQ ID NO: 3317683 - RNA, 16 nt, Human
ugugcucuggacaggc

SEQ ID NO: 3317684 - RNA, 18 nt, Human
ugugcucuggacaggcau

SEQ ID NO: 3317685 - RNA, 22 nt, Human
ugugcucugaucauccacugug

SEQ ID NO: 3317686 - RNA, 12 nt, Human
ugugcucugauc

SEQ ID NO: 3317687 - RNA, 23 nt, Human
ugugcucugaucauccacugugc

SEQ ID NO: 3317688 - RNA, 15 nt, Human
ugugcucuggacagg

SEQ ID NO: 3317689 - RNA, 20 nt, Human
agucucacuguugcccaggc

SEQ ID NO: 3317690 - RNA, 18 nt, Human
agucucacuguugcccag

SEQ ID NO: 3317691 - RNA, 19 nt, Human
agucucacuguugcccagg

SEQ ID NO: 3317692 - RNA, 21 nt, Human
ugugcccuaaaguguauuuuu

SEQ ID NO: 3317693 - RNA, 20 nt, Human
ugugcccuaaaguguauuuu

SEQ ID NO: 3317694 - RNA, 16 nt, Human
agugagucgaggacag

SEQ ID NO: 3317695 - RNA, 22 nt, Human
agugauucuccugccucagccu

SEQ ID NO: 3317696 - RNA, 24 nt, Human
agugauucuccugccucagccucc

SEQ ID NO: 3317697 - RNA, 14 nt, Human
agugcccacaggau

SEQ ID NO: 3317698 - RNA, 14 nt, Human
agugccaaaaacaa

SEQ ID NO: 3317699 - RNA, 16 nt, Human
agugccaaaaacaaca

SEQ ID NO: 3317700 - RNA, 17 nt, Human
aggugguuauggagagg

SEQ ID NO: 3317701 - RNA, 14 nt, Human
agguuggugggggc

SEQ ID NO: 3317702 - RNA, 17 nt, Human
uguaacuuucugaaaua

SEQ ID NO: 3317703 - RNA, 23 nt, Human
uguaauuaaguacuauguaucaa

SEQ ID NO: 3317704 - RNA, 21 nt, Human
aggugcacaagcuccaagcuc

SEQ ID NO: 3317705 - RNA, 20 nt, Human
aggugggauccuccaggugc

SEQ ID NO: 3317706 - RNA, 18 nt, Human
aggugggauccuccaggu

SEQ ID NO: 3317707 - RNA, 20 nt, Human
aggugcacaagcuccaagcu

SEQ ID NO: 3317708 - RNA, 18 nt, Human
aggugcacaagcuccaag

SEQ ID NO: 3317709 - RNA, 17 nt, Human
aggugcacaagcuccaa

SEQ ID NO: 3317710 - RNA, 16 nt, Human
aggugcacaagcucca

SEQ ID NO: 3317711 - RNA, 15 nt, Human
aggugcacaagcucc

SEQ ID NO: 3317712 - RNA, 23 nt, Human
aggucuugaacuccuggccucaa

SEQ ID NO: 3317713 - RNA, 22 nt, Human
aggucuugaacuccuggccuca

SEQ ID NO: 3317714 - RNA, 13 nt, Human
uguagagugggag

SEQ ID NO: 3317715 - RNA, 14 nt, Human
uguaauuugugaua

SEQ ID NO: 3317716 - RNA, 11 nt, Human
agguuuuccug

SEQ ID NO: 3317717 - RNA, 20 nt, Human
aguaagccgugauuuucauu

SEQ ID NO: 3317718 - RNA, 19 nt, Human
aguaauaugcacacauuuu

SEQ ID NO: 3317719 - RNA, 18 nt, Human
aguaauaugcacacauuu

SEQ ID NO: 3317720 - RNA, 20 nt, Human
aguaauaugcacacauuuuu

SEQ ID NO: 3317721 - RNA, 17 nt, Human
aguaauaugcacacauu

SEQ ID NO: 3317722 - RNA, 12 nt, Human
aguagagacagg

SEQ ID NO: 3317723 - RNA, 18 nt, Human
uguaggaagguuaauguu

SEQ ID NO: 3317724 - RNA, 20 nt, Human
uguaggaagguuaauguuca

SEQ ID NO: 3317725 - RNA, 14 nt, Human
aguacacuguuuca

SEQ ID NO: 3317726 - RNA, 16 nt, Human
aguacacuguuucaaa

SEQ ID NO: 3317727 - RNA, 17 nt, Human
aguaugguggcuggguu

SEQ ID NO: 3317728 - RNA, 13 nt, Human
agucaccaagccc

SEQ ID NO: 3317729 - RNA, 16 nt, Human
ugucagcugaaccugg

SEQ ID NO: 3317730 - RNA, 18 nt, Human
agucacugagacagcccg

SEQ ID NO: 3317731 - RNA, 19 nt, Human
agucacugagacagcccgg

SEQ ID NO: 3317732 - RNA, 19 nt, Human
ugucagcugaaccugggua

SEQ ID NO: 3317733 - RNA, 19 nt, Human
ugucaagagggucugagga

SEQ ID NO: 3317734 - RNA, 15 nt, Human
ugucaagccauaauu

SEQ ID NO: 3317735 - RNA, 14 nt, Human
uguauuuuuuuacu

SEQ ID NO: 3317736 - RNA, 16 nt, Human
aguaggaagacuuugg

SEQ ID NO: 3317737 - RNA, 22 nt, Human
aguaggaagacuuuggaaagac

SEQ ID NO: 3317738 - RNA, 19 nt, Human
aguaggaagacuuuggaaa

SEQ ID NO: 3317739 - RNA, 18 nt, Human
aguaggaagacuuuggaa

SEQ ID NO: 3317740 - RNA, 17 nt, Human
aguaggaagacuuugga

SEQ ID NO: 3317741 - RNA, 16 nt, Human
agucucacuguugccc

SEQ ID NO: 3317742 - RNA, 17 nt, Human
agucucacuguugccca

SEQ ID NO: 3317743 - RNA, 23 nt, Human
aguccgaaagggacuuggaagcu

SEQ ID NO: 3317744 - RNA, 22 nt, Human
agucagaaguuucugccgcagc

SEQ ID NO: 3317745 - RNA, 14 nt, Human
ugucgcccagucug

SEQ ID NO: 3317746 - RNA, 15 nt, Human
ugucgcccagucugg

SEQ ID NO: 3317747 - RNA, 12 nt, Human
ugucgggcauga

SEQ ID NO: 3317748 - RNA, 15 nt, Human
ugucgggcaugacac

SEQ ID NO: 3317749 - RNA, 14 nt, Human
ugucgggcaugaca

SEQ ID NO: 3317750 - RNA, 14 nt, Human
uguccgagcuuuga

SEQ ID NO: 3317751 - RNA, 13 nt, Human
uguccgagcuuug

SEQ ID NO: 3317752 - RNA, 17 nt, Human
ugucccuuuuccuuuuu

SEQ ID NO: 3317753 - RNA, 20 nt, Human
uggggcugcaccggcuggcc

SEQ ID NO: 3317754 - RNA, 14 nt, Human
ugggguacccacug

SEQ ID NO: 3317755 - RNA, 16 nt, Human
uggggucacucuggca

SEQ ID NO: 3317756 - RNA, 18 nt, Human
uggggucacucuggcagc

SEQ ID NO: 3317757 - RNA, 17 nt, Human
uggggucacucuggcag

SEQ ID NO: 3317758 - RNA, 15 nt, Human
ugggguacccacugc

SEQ ID NO: 3317759 - RNA, 16 nt, Human
ugggguacccacugcu

SEQ ID NO: 3317760 - RNA, 20 nt, Human
ugggguacccacugcucugg

SEQ ID NO: 3317761 - RNA, 14 nt, Human
uggggcccugccuc

SEQ ID NO: 3317762 - RNA, 23 nt, Human
uggggaccucaggccugggggcu

SEQ ID NO: 3317763 - RNA, 17 nt, Human
uggggaccucaggccug

SEQ ID NO: 3317764 - RNA, 12 nt, Human
uggggagaaagu

SEQ ID NO: 3317765 - RNA, 16 nt, Human
uggggcccugccuccu

SEQ ID NO: 3317766 - RNA, 15 nt, Human
uggggcccugccucc

SEQ ID NO: 3317767 - RNA, 18 nt, Human
uggggcggugagagggga

SEQ ID NO: 3317768 - RNA, 23 nt, Human
agggcuucugccauuucugagau

SEQ ID NO: 3317769 - RNA, 15 nt, Human
ugggcucccuuccca

SEQ ID NO: 3317770 - RNA, 19 nt, Human
ugggcucccuucccaccuc

SEQ ID NO: 3317771 - RNA, 18 nt, Human
ugggcucccuucccaccu

SEQ ID NO: 3317772 - RNA, 20 nt, Human
ugggcucccuucccaccucu

SEQ ID NO: 3317773 - RNA, 19 nt, Human
ugggcuggguucuacccag

SEQ ID NO: 3317774 - RNA, 18 nt, Human
ugggcuggguucuaccca

SEQ ID NO: 3317775 - RNA, 13 nt, Human
uggggaccucagg

SEQ ID NO: 3317776 - RNA, 18 nt, Human
uggggaccagagcugcca

SEQ ID NO: 3317777 - RNA, 17 nt, Human
uggggaccagagcugcc

SEQ ID NO: 3317778 - RNA, 15 nt, Human
uggggaccagagcug

SEQ ID NO: 3317779 - RNA, 14 nt, Human
uggggaccagagcu

SEQ ID NO: 3317780 - RNA, 23 nt, Human
agggcccagagaggguggugacc

SEQ ID NO: 3317781 - RNA, 18 nt, Human
agggcccagagagggugg

SEQ ID NO: 3317782 - RNA, 17 nt, Human
agggaggugaccccagg

SEQ ID NO: 3317783 - RNA, 17 nt, Human
agggagugacagaggca

SEQ ID NO: 3317784 - RNA, 18 nt, Human
agggagugacagaggcag

SEQ ID NO: 3317785 - RNA, 19 nt, Human
agggagugacagaggcagc

SEQ ID NO: 3317786 - RNA, 15 nt, Human
agggagggcuucugc

SEQ ID NO: 3317787 - RNA, 17 nt, Human
ugggcaacccccagccu

SEQ ID NO: 3317788 - RNA, 20 nt, Human
ugggcaacccccagccugcu

SEQ ID NO: 3317789 - RNA, 20 nt, Human
ugggcccaaugcacuuuguu

SEQ ID NO: 3317790 - RNA, 16 nt, Human
ugggccaggagccucc

SEQ ID NO: 3317791 - RNA, 14 nt, Human
ugggccaggagccu

SEQ ID NO: 3317792 - RNA, 13 nt, Human
ugggccaggagcc

SEQ ID NO: 3317793 - RNA, 17 nt, Human
ugggaggucaaggcugc

SEQ ID NO: 3317794 - RNA, 23 nt, Human
ugggaggucaaggcugcagugag

SEQ ID NO: 3317795 - RNA, 20 nt, Human
ugggaggucaaggcugcagu

SEQ ID NO: 3317796 - RNA, 19 nt, Human
ugggaggucaaggcugcag

SEQ ID NO: 3317797 - RNA, 18 nt, Human
ugggaggucaaggcugca

SEQ ID NO: 3317798 - RNA, 16 nt, Human
ugggcaacccccagcc

SEQ ID NO: 3317799 - RNA, 22 nt, Human
uggguggcaccagcagccugga

SEQ ID NO: 3317800 - RNA, 22 nt, Human
ugggugcuuggaggaaggaaac

SEQ ID NO: 3317801 - RNA, 19 nt, Human
ugggugcuuggaggaagga

SEQ ID NO: 3317802 - RNA, 15 nt, Human
ugggugcuuggagga

SEQ ID NO: 3317803 - RNA, 22 nt, Human
agggucucacucugucgcccag

SEQ ID NO: 3317804 - RNA, 21 nt, Human
agggucucacucugucgccca

SEQ ID NO: 3317805 - RNA, 16 nt, Human
ugguacuaacuuuccu

SEQ ID NO: 3317806 - RNA, 19 nt, Human
uggggucacucuggcagcu

SEQ ID NO: 3317807 - RNA, 24 nt, Human
agggguucccuuuuuuggcugcug

SEQ ID NO: 3317808 - RNA, 20 nt, Human
agggucucacuauguugccc

SEQ ID NO: 3317809 - RNA, 21 nt, Human
agggucucacuauguugccca

SEQ ID NO: 3317810 - RNA, 22 nt, Human
agggucucacuauguugcccag

SEQ ID NO: 3317811 - RNA, 15 nt, Human
aggggguggccuccc

SEQ ID NO: 3317812 - RNA, 17 nt, Human
aggggguggccucccaa

SEQ ID NO: 3317813 - RNA, 22 nt, Human
aggggugggacacccugugaug

SEQ ID NO: 3317814 - RNA, 20 nt, Human
aggggugggacacccuguga

SEQ ID NO: 3317815 - RNA, 18 nt, Human
aggggugggacacccugu

SEQ ID NO: 3317816 - RNA, 12 nt, Human
aggucagagccu

SEQ ID NO: 3317817 - RNA, 17 nt, Human
aggucauuuuuuuuaag

SEQ ID NO: 3317818 - RNA, 17 nt, Human
agguagaaauaucugaa

SEQ ID NO: 3317819 - RNA, 19 nt, Human
agguagaaauaucugaaaa

SEQ ID NO: 3317820 - RNA, 18 nt, Human
aggguuggccccugcccg

SEQ ID NO: 3317821 - RNA, 23 nt, Human
aggguuggccccugcccggcugc

SEQ ID NO: 3317822 - RNA, 17 nt, Human
aggguuggccccugccc

SEQ ID NO: 3317823 - RNA, 23 nt, Human
agguagaaauaucugaaaaugua

SEQ ID NO: 3317824 - RNA, 21 nt, Human
agguaugcaaucaaaucugcu

SEQ ID NO: 3317825 - RNA, 17 nt, Human
agguaugcaaucaaauc

SEQ ID NO: 3317826 - RNA, 16 nt, Human
uggucugacccacugc

SEQ ID NO: 3317827 - RNA, 17 nt, Human
uggucugacccacugcu

SEQ ID NO: 3317828 - RNA, 21 nt, Human
aggguggugaccucugccuga

SEQ ID NO: 3317829 - RNA, 22 nt, Human
aggguguccggucccuguccca

SEQ ID NO: 3317830 - RNA, 13 nt, Human
aggguuauaauaa

SEQ ID NO: 3317831 - RNA, 15 nt, Human
uggucccaccccaca

SEQ ID NO: 3317832 - RNA, 14 nt, Human
uggucccaccccac

SEQ ID NO: 3317833 - RNA, 18 nt, Human
uggucaccaaaucagcug

SEQ ID NO: 3317834 - RNA, 22 nt, Human
uggucagauuugaacucuucaa

SEQ ID NO: 3317835 - RNA, 13 nt, Human
uggucccacccca

SEQ ID NO: 3317836 - RNA, 16 nt, Human
uggucucaaacucuug

SEQ ID NO: 3317837 - RNA, 19 nt, Human
uggucuacacugugcugag

SEQ ID NO: 3317838 - RNA, 16 nt, Human
uggucccaccccacac

SEQ ID NO: 3317839 - RNA, 17 nt, Human
uggucucaaacucuuga

SEQ ID NO: 3317840 - RNA, 23 nt, Human
uggucucaaacucuugaccucag

SEQ ID NO: 3317841 - RNA, 21 nt, Human
ugcugggauuacaagcgugag

SEQ ID NO: 3317842 - RNA, 17 nt, Human
ugcugggauuacaggug

SEQ ID NO: 3317843 - RNA, 18 nt, Human
ugcuggcuguuggcuggg

SEQ ID NO: 3317844 - RNA, 19 nt, Human
ugcugggauuacaagcgug

SEQ ID NO: 3317845 - RNA, 19 nt, Human
ugcuggcuguuggcugggg

SEQ ID NO: 3317846 - RNA, 21 nt, Human
ugcuggcuguuggcugggggc

SEQ ID NO: 3317847 - RNA, 21 nt, Human
ugcugcccugcccaccuggcc

SEQ ID NO: 3317848 - RNA, 19 nt, Human
ugcugcccugcccaccugg

SEQ ID NO: 3317849 - RNA, 11 nt, Human
ugcugcccugu

SEQ ID NO: 3317850 - RNA, 12 nt, Human
ugcugcccugcc

SEQ ID NO: 3317851 - RNA, 18 nt, Human
ugcugcccugcccaccug

SEQ ID NO: 3317852 - RNA, 17 nt, Human
ugcugcccugcccaccu

SEQ ID NO: 3317853 - RNA, 16 nt, Human
ugcugcccugcccacc

SEQ ID NO: 3317854 - RNA, 13 nt, Human
ugcugcccugccc

SEQ ID NO: 3317855 - RNA, 18 nt, Human
aggacacuaaccacgcug

SEQ ID NO: 3317856 - RNA, 23 nt, Human
ugcuucaaggauccugagccaga

SEQ ID NO: 3317857 - RNA, 21 nt, Human
ugcuucaaggauccugagcca

SEQ ID NO: 3317858 - RNA, 20 nt, Human
ugcuucaaggauccugagcc

SEQ ID NO: 3317859 - RNA, 17 nt, Human
ugcugucccuuacguga

SEQ ID NO: 3317860 - RNA, 15 nt, Human
ugcugucccuuuucc

SEQ ID NO: 3317861 - RNA, 19 nt, Human
ugcugucccuuacgugagu

SEQ ID NO: 3317862 - RNA, 17 nt, Human
ugcugucccuuuuccuu

SEQ ID NO: 3317863 - RNA, 19 nt, Human
ugcuaucucccccagcccc

SEQ ID NO: 3317864 - RNA, 18 nt, Human
ugcuaucucccccagccc

SEQ ID NO: 3317865 - RNA, 20 nt, Human
ugcuaucucccccagcccca

SEQ ID NO: 3317866 - RNA, 15 nt, Human
ugcucuggacaggca

SEQ ID NO: 3317867 - RNA, 16 nt, Human
ugcucuggacaggcau

SEQ ID NO: 3317868 - RNA, 14 nt, Human
ugcucuggacaggc

SEQ ID NO: 3317869 - RNA, 15 nt, Human
aggaaaggcuccagg

SEQ ID NO: 3317870 - RNA, 14 nt, Human
aggaaaggcuccag

SEQ ID NO: 3317871 - RNA, 13 nt, Human
aggaaaggcucca

SEQ ID NO: 3317872 - RNA, 19 nt, Human
aggaaaucaccgaaaacgu

SEQ ID NO: 3317873 - RNA, 15 nt, Human
aggaaaucaccgaaa

SEQ ID NO: 3317874 - RNA, 11 nt, Human
aggaagcacau

SEQ ID NO: 3317875 - RNA, 17 nt, Human
aggaagcacaugccucu

SEQ ID NO: 3317876 - RNA, 16 nt, Human
aggaagcacaugccuc

SEQ ID NO: 3317877 - RNA, 21 nt, Human
aggaagccagcaggcucucag

SEQ ID NO: 3317878 - RNA, 23 nt, Human
aggaagccagcaggcucucaggc

SEQ ID NO: 3317879 - RNA, 22 nt, Human
aggaagccagcaggcucucagg

SEQ ID NO: 3317880 - RNA, 20 nt, Human
aggaagccgcuggggccagu

SEQ ID NO: 3317881 - RNA, 19 nt, Human
aggaagccgcuggggccag

SEQ ID NO: 3317882 - RNA, 18 nt, Human
aggaagccgcuggggcca

SEQ ID NO: 3317883 - RNA, 18 nt, Human
aggaagccagcaggcucu

SEQ ID NO: 3317884 - RNA, 23 nt, Human
aggaaggaaacccagcucugguc

SEQ ID NO: 3317885 - RNA, 22 nt, Human
aggaaggaaacccagcucuggu

SEQ ID NO: 3317886 - RNA, 20 nt, Human
aggaaggaaacccagcucug

SEQ ID NO: 3317887 - RNA, 19 nt, Human
agcugugcucuggacaggc

SEQ ID NO: 3317888 - RNA, 20 nt, Human
agcugugcucuggacaggca

SEQ ID NO: 3317889 - RNA, 21 nt, Human
agcugugcucuggacaggcau

SEQ ID NO: 3317890 - RNA, 17 nt, Human
ugccuguucagcuccag

SEQ ID NO: 3317891 - RNA, 13 nt, Human
agcuguucagcug

SEQ ID NO: 3317892 - RNA, 18 nt, Human
ugccuguucagcuccagc

SEQ ID NO: 3317893 - RNA, 20 nt, Human
ugccuguucagcuccagcuc

SEQ ID NO: 3317894 - RNA, 19 nt, Human
ugccuguugggccaggagc

SEQ ID NO: 3317895 - RNA, 20 nt, Human
ugccuguugggccaggagcc

SEQ ID NO: 3317896 - RNA, 16 nt, Human
ugccuuauggaacacu

SEQ ID NO: 3317897 - RNA, 15 nt, Human
ugccuuauggaacac

SEQ ID NO: 3317898 - RNA, 21 nt, Human
agcugcuuuugucuaugggac

SEQ ID NO: 3317899 - RNA, 19 nt, Human
agcugccuguucagcucca

SEQ ID NO: 3317900 - RNA, 21 nt, Human
agcugcuugggcuucauccuc

SEQ ID NO: 3317901 - RNA, 21 nt, Human
agcugccuguucagcuccagc

SEQ ID NO: 3317902 - RNA, 20 nt, Human
agcugcuugggcuucauccu

SEQ ID NO: 3317903 - RNA, 20 nt, Human
agcugccuguucagcuccag

SEQ ID NO: 3317904 - RNA, 14 nt, Human
ugccuggauggggc

SEQ ID NO: 3317905 - RNA, 15 nt, Human
ugccuggauggggcu

SEQ ID NO: 3317906 - RNA, 12 nt, Human
ugcccaggcagg

SEQ ID NO: 3317907 - RNA, 13 nt, Human
ugcccaggcaggu

SEQ ID NO: 3317908 - RNA, 14 nt, Human
ugcccaggcagguc

SEQ ID NO: 3317909 - RNA, 13 nt, Human
ugccucugccucu

SEQ ID NO: 3317910 - RNA, 14 nt, Human
ugccucugccucug

SEQ ID NO: 3317911 - RNA, 13 nt, Human
ugccugcccaggc

SEQ ID NO: 3317912 - RNA, 15 nt, Human
ugccucugccucuga

SEQ ID NO: 3317913 - RNA, 14 nt, Human
ugccugcccaggcc

SEQ ID NO: 3317914 - RNA, 15 nt, Human
ugccugcccaggccc

SEQ ID NO: 3317915 - RNA, 12 nt, Human
ugccucugccuc

SEQ ID NO: 3317916 - RNA, 24 nt, Human
ugccugcccaggccccugccaccc

SEQ ID NO: 3317917 - RNA, 18 nt, Human
agcuugaggguugggcug

SEQ ID NO: 3317918 - RNA, 14 nt, Human
agcuugaggguugg

SEQ ID NO: 3317919 - RNA, 14 nt, Human
agcuguucagcugg

SEQ ID NO: 3317920 - RNA, 19 nt, Human
ugcggccuuuggcuucacg

SEQ ID NO: 3317921 - RNA, 17 nt, Human
ugcggccuuuggcuuca

SEQ ID NO: 3317922 - RNA, 20 nt, Human
ugcgggcuuccuccuggugu

SEQ ID NO: 3317923 - RNA, 17 nt, Human
ugcgguccacccaggag

SEQ ID NO: 3317924 - RNA, 18 nt, Human
ugcgguccacccaggagc

SEQ ID NO: 3317925 - RNA, 17 nt, Human
ugcggugcuaucucccc

SEQ ID NO: 3317926 - RNA, 23 nt, Human
ugcggacagccacggccaggcca

SEQ ID NO: 3317927 - RNA, 21 nt, Human
ugcggacagccacggccaggc

SEQ ID NO: 3317928 - RNA, 22 nt, Human
ugcggacagccacggccaggcc

SEQ ID NO: 3317929 - RNA, 21 nt, Human
ugcuugaggcaacucaucuua

SEQ ID NO: 3317930 - RNA, 14 nt, Human
ugcuuggaggaagg

SEQ ID NO: 3317931 - RNA, 15 nt, Human
ugcuuggaggaagga

SEQ ID NO: 3317932 - RNA, 13 nt, Human
ugcuuguacauaa

SEQ ID NO: 3317933 - RNA, 12 nt, Human
ugcuuguacaua

SEQ ID NO: 3317934 - RNA, 14 nt, Human
ugcuuuuggucugu

SEQ ID NO: 3317935 - RNA, 12 nt, Human
ugcuuugugauu

SEQ ID NO: 3317936 - RNA, 16 nt, Human
ugcuuugugauuuuug

SEQ ID NO: 3317937 - RNA, 14 nt, Human
ugcuuugugauuuu

SEQ ID NO: 3317938 - RNA, 16 nt, Human
ugcuuguacauaaugc

SEQ ID NO: 3317939 - RNA, 14 nt, Human
ugcuuguacauaau

SEQ ID NO: 3317940 - RNA, 22 nt, Human
ugcuuguacauaaugcgugcau

SEQ ID NO: 3317941 - RNA, 14 nt, Human
aggauccugagcca

SEQ ID NO: 3317942 - RNA, 13 nt, Human
aggauccugagcc

SEQ ID NO: 3317943 - RNA, 21 nt, Human
aggauacaaaagcaugugaga

SEQ ID NO: 3317944 - RNA, 17 nt, Human
uggaaaugggcagagca

SEQ ID NO: 3317945 - RNA, 22 nt, Human
uggagaagcggcuggcagccca

SEQ ID NO: 3317946 - RNA, 13 nt, Human
uggagaagcggcu

SEQ ID NO: 3317947 - RNA, 15 nt, Human
aggcacccaccauca

SEQ ID NO: 3317948 - RNA, 14 nt, Human
aggcaaugcuggcu

SEQ ID NO: 3317949 - RNA, 20 nt, Human
aggcacccaccaucaugucu

SEQ ID NO: 3317950 - RNA, 21 nt, Human
aggcacccaccaucaugucug

SEQ ID NO: 3317951 - RNA, 22 nt, Human
aggcacccaccaucaugucugg

SEQ ID NO: 3317952 - RNA, 17 nt, Human
aggcaaggcugucaauu

SEQ ID NO: 3317953 - RNA, 15 nt, Human
uggacccugaggccc

SEQ ID NO: 3317954 - RNA, 20 nt, Human
uggacccugaggcccagagg

SEQ ID NO: 3317955 - RNA, 19 nt, Human
uggacccugaggcccagag

SEQ ID NO: 3317956 - RNA, 21 nt, Human
uggacccugaggcccagaggg

SEQ ID NO: 3317957 - RNA, 23 nt, Human
uggacccuguggaugauaaaaca

SEQ ID NO: 3317958 - RNA, 18 nt, Human
uggacccugaggcccaga

SEQ ID NO: 3317959 - RNA, 16 nt, Human
uggacccugaggccca

SEQ ID NO: 3317960 - RNA, 23 nt, Human
uggacacagcucuucuccaggcu

SEQ ID NO: 3317961 - RNA, 21 nt, Human
uggacacagcucuucuccagg

SEQ ID NO: 3317962 - RNA, 22 nt, Human
uggacacagcucuucuccaggc

SEQ ID NO: 3317963 - RNA, 13 nt, Human
uggacacagcucu

SEQ ID NO: 3317964 - RNA, 14 nt, Human
uggacacagcucuu

SEQ ID NO: 3317965 - RNA, 12 nt, Human
aggaucucuuga

SEQ ID NO: 3317966 - RNA, 19 nt, Human
aggaucucuugagccuggg

SEQ ID NO: 3317967 - RNA, 18 nt, Human
aggaucucuugagccugg

SEQ ID NO: 3317968 - RNA, 17 nt, Human
aggaucucuugagccug

SEQ ID NO: 3317969 - RNA, 21 nt, Human
uggccuggccccucagggucc

SEQ ID NO: 3317970 - RNA, 18 nt, Human
uggccuggccccucaggg

SEQ ID NO: 3317971 - RNA, 12 nt, Human
uggccuggcccc

SEQ ID NO: 3317972 - RNA, 20 nt, Human
aggccugggggcugggcaga

SEQ ID NO: 3317973 - RNA, 18 nt, Human
aggccugggggcugggca

SEQ ID NO: 3317974 - RNA, 12 nt, Human
aggccuggggac

SEQ ID NO: 3317975 - RNA, 23 nt, Human
uggccgggcgcgguggcucacgc

SEQ ID NO: 3317976 - RNA, 13 nt, Human
uggccucuucaga

SEQ ID NO: 3317977 - RNA, 23 nt, Human
uggccagugugacaaggauugcu

SEQ ID NO: 3317978 - RNA, 21 nt, Human
uggccaaagccaaagcuaggc

SEQ ID NO: 3317979 - RNA, 23 nt, Human
uggccaaagccaaagcuaggccu

SEQ ID NO: 3317980 - RNA, 17 nt, Human
aggccccgcccaggcuu

SEQ ID NO: 3317981 - RNA, 13 nt, Human
uggcagccuuggc

SEQ ID NO: 3317982 - RNA, 17 nt, Human
uggcagccuuggcaaac

SEQ ID NO: 3317983 - RNA, 15 nt, Human
uggcagcucaccucu

SEQ ID NO: 3317984 - RNA, 19 nt, Human
uggcagcucaccucucccu

SEQ ID NO: 3317985 - RNA, 16 nt, Human
aggccacaagacccuu

SEQ ID NO: 3317986 - RNA, 14 nt, Human
aggccagagggagu

SEQ ID NO: 3317987 - RNA, 19 nt, Human
aggccacaagacccuugug

SEQ ID NO: 3317988 - RNA, 18 nt, Human
aggccacaagacccuugu

SEQ ID NO: 3317989 - RNA, 17 nt, Human
aggccacaagacccuug

SEQ ID NO: 3317990 - RNA, 16 nt, Human
aggccccgcccaggcu

SEQ ID NO: 3317991 - RNA, 21 nt, Human
aggcccagagggccugcaagg

SEQ ID NO: 3317992 - RNA, 20 nt, Human
aggccagagggagugacaga

SEQ ID NO: 3317993 - RNA, 16 nt, Human
aggccaaggugggagg

SEQ ID NO: 3317994 - RNA, 18 nt, Human
aggcagccaggccacaag

SEQ ID NO: 3317995 - RNA, 16 nt, Human
aggcagccccauucug

SEQ ID NO: 3317996 - RNA, 17 nt, Human
aggcagccccauucugc

SEQ ID NO: 3317997 - RNA, 15 nt, Human
aggccaaaggaagca

SEQ ID NO: 3317998 - RNA, 19 nt, Human
aggccaaaggaagcacaug

SEQ ID NO: 3317999 - RNA, 18 nt, Human
aggccaaaggaagcacau

SEQ ID NO: 3318000 - RNA, 16 nt, Human
aggccaaaggaagcac

SEQ ID NO: 3318001 - RNA, 22 nt, Human
uggauuaaacuuaaucuaaaug

SEQ ID NO: 3318002 - RNA, 13 nt, Human
uggauuguccccg

SEQ ID NO: 3318003 - RNA, 18 nt, Human
agccccuggaugcagccu

SEQ ID NO: 3318004 - RNA, 17 nt, Human
agccccuggaugcagcc

SEQ ID NO: 3318005 - RNA, 19 nt, Human
agccccuucugacccaugc

SEQ ID NO: 3318006 - RNA, 19 nt, Human
agccccuggaugcagccuc

SEQ ID NO: 3318007 - RNA, 17 nt, Human
agccccgaggccuucuc

SEQ ID NO: 3318008 - RNA, 22 nt, Human
agccccgaggccuucucugaag

SEQ ID NO: 3318009 - RNA, 16 nt, Human
agccccgaggccuucu

SEQ ID NO: 3318010 - RNA, 23 nt, Human
agccccauucugccugcccaggc

SEQ ID NO: 3318011 - RNA, 22 nt, Human
agccccaaaacucuccucugcu

SEQ ID NO: 3318012 - RNA, 21 nt, Human
agccccaaaacucuccucugc

SEQ ID NO: 3318013 - RNA, 20 nt, Human
agccccaaaacucuccucug

SEQ ID NO: 3318014 - RNA, 19 nt, Human
ugauucuccugccucagcc

SEQ ID NO: 3318015 - RNA, 15 nt, Human
ugauucuccugccuc

SEQ ID NO: 3318016 - RNA, 13 nt, Human
ugauucuccugcc

SEQ ID NO: 3318017 - RNA, 20 nt, Human
ugcacacauuuuuuaaaugc

SEQ ID NO: 3318018 - RNA, 10 nt, Human
ugcacacauu

SEQ ID NO: 3318019 - RNA, 17 nt, Human
ugcacccucaggcaggu

SEQ ID NO: 3318020 - RNA, 16 nt, Human
ugcacccucaggcagg

SEQ ID NO: 3318021 - RNA, 14 nt, Human
ugcacgugugugca

SEQ ID NO: 3318022 - RNA, 15 nt, Human
ugcacgugugugcac

SEQ ID NO: 3318023 - RNA, 22 nt, Human
agcccugguggcagugggagcu

SEQ ID NO: 3318024 - RNA, 23 nt, Human
agcccugguggcagugggagcug

SEQ ID NO: 3318025 - RNA, 15 nt, Human
ugcacaagcugcacc

SEQ ID NO: 3318026 - RNA, 14 nt, Human
ugcacaagcugcac

SEQ ID NO: 3318027 - RNA, 22 nt, Human
ugcacacaccagagcccaccuu

SEQ ID NO: 3318028 - RNA, 21 nt, Human
ugcacaagcugcacccucagg

SEQ ID NO: 3318029 - RNA, 18 nt, Human
ugcacaagcugcacccuc

SEQ ID NO: 3318030 - RNA, 24 nt, Human
agccccuucugacccaugcugccc

SEQ ID NO: 3318031 - RNA, 20 nt, Human
agccccuucugacccaugcu

SEQ ID NO: 3318032 - RNA, 21 nt, Human
agcccugguggcagugggagc

SEQ ID NO: 3318033 - RNA, 22 nt, Human
agccucagcauccuggcacccg

SEQ ID NO: 3318034 - RNA, 23 nt, Human
agccucagcauccuggcacccgg

SEQ ID NO: 3318035 - RNA, 16 nt, Human
agccucccaaagugcu

SEQ ID NO: 3318036 - RNA, 17 nt, Human
agccucagcauccuggc

SEQ ID NO: 3318037 - RNA, 19 nt, Human
agccucagcauccuggcac

SEQ ID NO: 3318038 - RNA, 20 nt, Human
agccucagcauccuggcacc

SEQ ID NO: 3318039 - RNA, 21 nt, Human
agccucagcauccuggcaccc

SEQ ID NO: 3318040 - RNA, 16 nt, Human
agccucagcauccugg

SEQ ID NO: 3318041 - RNA, 22 nt, Human
ugcacuauagccuaggugacag

SEQ ID NO: 3318042 - RNA, 23 nt, Human
ugcacuauagccuaggugacaga

SEQ ID NO: 3318043 - RNA, 23 nt, Human
agcccuucuaccuuccugcaaca

SEQ ID NO: 3318044 - RNA, 23 nt, Human
ugcagccucaaccuccugggcua

SEQ ID NO: 3318045 - RNA, 15 nt, Human
ugcagccucacaguc

SEQ ID NO: 3318046 - RNA, 13 nt, Human
ugcagccucacag

SEQ ID NO: 3318047 - RNA, 16 nt, Human
ugcagccucacagucc

SEQ ID NO: 3318048 - RNA, 14 nt, Human
ugcauaaguuaacu

SEQ ID NO: 3318049 - RNA, 18 nt, Human
agcuagacgagcaggcuu

SEQ ID NO: 3318050 - RNA, 17 nt, Human
agcgugagccacugcac

SEQ ID NO: 3318051 - RNA, 19 nt, Human
agcgugagccacugcaccg

SEQ ID NO: 3318052 - RNA, 22 nt, Human
agcgugagccacugcaccgggc

SEQ ID NO: 3318053 - RNA, 18 nt, Human
agcucaggugucccugca

SEQ ID NO: 3318054 - RNA, 17 nt, Human
agcucaggugucccugc

SEQ ID NO: 3318055 - RNA, 22 nt, Human
agcucaggugucccugcacuug

SEQ ID NO: 3318056 - RNA, 20 nt, Human
agcucaggugucccugcacu

SEQ ID NO: 3318057 - RNA, 21 nt, Human
agcucaggugucccugcacuu

SEQ ID NO: 3318058 - RNA, 14 nt, Human
agcuaggccuggcc

SEQ ID NO: 3318059 - RNA, 15 nt, Human
agcuaggccuggcca

SEQ ID NO: 3318060 - RNA, 12 nt, Human
agcuaggccugg

SEQ ID NO: 3318061 - RNA, 21 nt, Human
agcucauucuccuuguguuac

SEQ ID NO: 3318062 - RNA, 20 nt, Human
agcucauucuccuuguguua

SEQ ID NO: 3318063 - RNA, 20 nt, Human
ugcccacaggaucagucuga

SEQ ID NO: 3318064 - RNA, 19 nt, Human
ugcccacaggaucagucug

SEQ ID NO: 3318065 - RNA, 16 nt, Human
ugcccacaggaucagu

SEQ ID NO: 3318066 - RNA, 20 nt, Human
ugcccagccccuucugaccc

SEQ ID NO: 3318067 - RNA, 21 nt, Human
ugcccagccccuucugaccca

SEQ ID NO: 3318068 - RNA, 17 nt, Human
agccuuccagggguggg

SEQ ID NO: 3318069 - RNA, 16 nt, Human
agccuuccaggggugg

SEQ ID NO: 3318070 - RNA, 14 nt, Human
agccuuccaggggu

SEQ ID NO: 3318071 - RNA, 11 nt, Human
agccuuccagg

SEQ ID NO: 3318072 - RNA, 18 nt, Human
agcggagacggaguccca

SEQ ID NO: 3318073 - RNA, 20 nt, Human
agcggagaaaggaagggcug

SEQ ID NO: 3318074 - RNA, 20 nt, Human
ugcauuaucuagauacugua

SEQ ID NO: 3318075 - RNA, 16 nt, Human
agcggagaaaggaagg

SEQ ID NO: 3318076 - RNA, 18 nt, Human
ugccaaugggagcucaug

SEQ ID NO: 3318077 - RNA, 18 nt, Human
ugcauuaucuagauacug

SEQ ID NO: 3318078 - RNA, 22 nt, Human
ugcauuaucuagauacuguauc

SEQ ID NO: 3318079 - RNA, 21 nt, Human
ugcauuaucuagauacuguau

SEQ ID NO: 3318080 - RNA, 19 nt, Human
agccugugccucugggacu

SEQ ID NO: 3318081 - RNA, 21 nt, Human
agccugugccucugggacugg

SEQ ID NO: 3318082 - RNA, 22 nt, Human
agccuuagaagucacacaguau

SEQ ID NO: 3318083 - RNA, 17 nt, Human
agccugcuccagcuguu

SEQ ID NO: 3318084 - RNA, 16 nt, Human
agccugcuccagcugu

SEQ ID NO: 3318085 - RNA, 15 nt, Human
agccugcuccagcug

SEQ ID NO: 3318086 - RNA, 14 nt, Human
agccugcuccagcu

SEQ ID NO: 3318087 - RNA, 12 nt, Human
ugcauaccacuu

SEQ ID NO: 3318088 - RNA, 22 nt, Human
agccugcuccagcuguucagcu

SEQ ID NO: 3318089 - RNA, 19 nt, Human
agccugcuccagcuguuca

SEQ ID NO: 3318090 - RNA, 22 nt, Human
agccugggugacagagcaagug

SEQ ID NO: 3318091 - RNA, 15 nt, Human
ugauuaauuaaaaca

SEQ ID NO: 3318092 - RNA, 20 nt, Human
agccacugcaccgggccaca

SEQ ID NO: 3318093 - RNA, 13 nt, Human
agccacugcaccg

SEQ ID NO: 3318094 - RNA, 21 nt, Human
agccacugcaccgggccacag

SEQ ID NO: 3318095 - RNA, 22 nt, Human
agccacugcaccgggccacaga

SEQ ID NO: 3318096 - RNA, 23 nt, Human
ugauguuuuccaugaguccccug

SEQ ID NO: 3318097 - RNA, 17 nt, Human
ugauguuuuaaggaugc

SEQ ID NO: 3318098 - RNA, 20 nt, Human
ugaugauccuaggcauuugc

SEQ ID NO: 3318099 - RNA, 14 nt, Human
ugaugauccuaggc

SEQ ID NO: 3318100 - RNA, 16 nt, Human
ugauggugcaaugacc

SEQ ID NO: 3318101 - RNA, 15 nt, Human
ugauggugcaaugac

SEQ ID NO: 3318102 - RNA, 23 nt, Human
ugauggugcaaugaccuuucaau

SEQ ID NO: 3318103 - RNA, 17 nt, Human
ugauggugcaaugaccu

SEQ ID NO: 3318104 - RNA, 15 nt, Human
agccacggccaggcc

SEQ ID NO: 3318105 - RNA, 14 nt, Human
agccacggccaggc

SEQ ID NO: 3318106 - RNA, 19 nt, Human
agccaccaacauacuccca

SEQ ID NO: 3318107 - RNA, 23 nt, Human
agccaccaacauacucccaucug

SEQ ID NO: 3318108 - RNA, 20 nt, Human
agccaccaacauacucccau

SEQ ID NO: 3318109 - RNA, 18 nt, Human
agccacauuccugaugcu

SEQ ID NO: 3318110 - RNA, 14 nt, Human
agccacauuccuga

SEQ ID NO: 3318111 - RNA, 14 nt, Human
agccaggccacaag

SEQ ID NO: 3318112 - RNA, 12 nt, Human
agccaggccaca

SEQ ID NO: 3318113 - RNA, 22 nt, Human
agccaguaaaugggggugcauu

SEQ ID NO: 3318114 - RNA, 23 nt, Human
agccaguaaaugggggugcauuu

SEQ ID NO: 3318115 - RNA, 12 nt, Human
agccagggucuc

SEQ ID NO: 3318116 - RNA, 22 nt, Human
agccaggccacaagacccuugu

SEQ ID NO: 3318117 - RNA, 21 nt, Human
agccaggccacaagacccuug

SEQ ID NO: 3318118 - RNA, 14 nt, Human
ugauucagcucugc

SEQ ID NO: 3318119 - RNA, 13 nt, Human
ugauucagcucug

SEQ ID NO: 3318120 - RNA, 18 nt, Human
agcccaggaaaggcucca

SEQ ID NO: 3318121 - RNA, 24 nt, Human
agcccaggaaaggcuccaggagca

SEQ ID NO: 3318122 - RNA, 23 nt, Human
agcccaggaaaggcuccaggagc

SEQ ID NO: 3318123 - RNA, 22 nt, Human
agcccaggaaaggcuccaggag

SEQ ID NO: 3318124 - RNA, 15 nt, Human
ugauucccaagcucu

SEQ ID NO: 3318125 - RNA, 16 nt, Human
ugauucccaagcucug

SEQ ID NO: 3318126 - RNA, 18 nt, Human
ugauucccaagcucugcu

SEQ ID NO: 3318127 - RNA, 19 nt, Human
ugauucccaagcucugcuc

SEQ ID NO: 3318128 - RNA, 21 nt, Human
ugauucccaagcucugcuccu

SEQ ID NO: 3318129 - RNA, 21 nt, Human
agcccaggaaaggcuccagga

SEQ ID NO: 3318130 - RNA, 20 nt, Human
agcccaggaaaggcuccagg

SEQ ID NO: 3318131 - RNA, 19 nt, Human
agcccaggaaaggcuccag

SEQ ID NO: 3318132 - RNA, 22 nt, Human
agcccacuucugccauauucug

SEQ ID NO: 3318133 - RNA, 22 nt, Human
agcauauucaggaagcucaggg

SEQ ID NO: 3318134 - RNA, 20 nt, Human
ugaucacggcucacugcagc

SEQ ID NO: 3318135 - RNA, 12 nt, Human
agcaucaggcca

SEQ ID NO: 3318136 - RNA, 13 nt, Human
agcaucaggccag

SEQ ID NO: 3318137 - RNA, 18 nt, Human
ugaucacggcucacugca

SEQ ID NO: 3318138 - RNA, 19 nt, Human
ugaucacggcucacugcag

SEQ ID NO: 3318139 - RNA, 20 nt, Human
agcaucaggccaggcccucu

SEQ ID NO: 3318140 - RNA, 19 nt, Human
agcaucaggccaggcccuc

SEQ ID NO: 3318141 - RNA, 18 nt, Human
agcaucaggccaggcccu

SEQ ID NO: 3318142 - RNA, 17 nt, Human
agcaucaggccaggccc

SEQ ID NO: 3318143 - RNA, 16 nt, Human
agcaucaggccaggcc

SEQ ID NO: 3318144 - RNA, 14 nt, Human
agcaucaggccagg

SEQ ID NO: 3318145 - RNA, 12 nt, Human
agcauggcugcc

SEQ ID NO: 3318146 - RNA, 16 nt, Human
ugagugccuuacacaa

SEQ ID NO: 3318147 - RNA, 21 nt, Human
ugagugggugaauaauacagu

SEQ ID NO: 3318148 - RNA, 23 nt, Human
ugagugggggaucacagccucug

SEQ ID NO: 3318149 - RNA, 14 nt, Human
ugagucaccaagcc

SEQ ID NO: 3318150 - RNA, 16 nt, Human
ugagucaccaagccca

SEQ ID NO: 3318151 - RNA, 17 nt, Human
ugagucaccaagcccag

SEQ ID NO: 3318152 - RNA, 20 nt, Human
ugagugccuuacacaauggu

SEQ ID NO: 3318153 - RNA, 17 nt, Human
ugagugccuuacacaau

SEQ ID NO: 3318154 - RNA, 17 nt, Human
ugaguucauacccuguu

SEQ ID NO: 3318155 - RNA, 20 nt, Human
ugauaagaaccuuuugagug

SEQ ID NO: 3318156 - RNA, 17 nt, Human
ugauacuacaguuuguu

SEQ ID NO: 3318157 - RNA, 14 nt, Human
ugauacuacaguuu

SEQ ID NO: 3318158 - RNA, 21 nt, Human
ugauacaaugcugugcccuaa

SEQ ID NO: 3318159 - RNA, 20 nt, Human
ugauacaaugcugugcccua

SEQ ID NO: 3318160 - RNA, 18 nt, Human
ugauacaaugcugugccc

SEQ ID NO: 3318161 - RNA, 21 nt, Human
agcauacguacacauuuuauu

SEQ ID NO: 3318162 - RNA, 20 nt, Human
agcauacguacacauuuuau

SEQ ID NO: 3318163 - RNA, 19 nt, Human
agcauacguacacauuuua

SEQ ID NO: 3318164 - RNA, 18 nt, Human
agcauacguacacauuuu

SEQ ID NO: 3318165 - RNA, 17 nt, Human
agcauacguacacauuu

SEQ ID NO: 3318166 - RNA, 16 nt, Human
agcauacguacacauu

SEQ ID NO: 3318167 - RNA, 15 nt, Human
agcauacguacacau

SEQ ID NO: 3318168 - RNA, 12 nt, Human
ugagaauuaccc

SEQ ID NO: 3318169 - RNA, 15 nt, Human
ugaguacuacagucc

SEQ ID NO: 3318170 - RNA, 14 nt, Human
agcauauucaggaa

SEQ ID NO: 3318171 - RNA, 14 nt, Human
ugaguacuacaguc

SEQ ID NO: 3318172 - RNA, 23 nt, Human
ugaguacuacaguccucccaucu

SEQ ID NO: 3318173 - RNA, 22 nt, Human
ugaguacuacaguccucccauc

SEQ ID NO: 3318174 - RNA, 21 nt, Human
ugaguacuacaguccucccau

SEQ ID NO: 3318175 - RNA, 17 nt, Human
ugaguacuacaguccuc

SEQ ID NO: 3318176 - RNA, 13 nt, Human
uucacaguucucu

SEQ ID NO: 3318177 - RNA, 20 nt, Human
uucacaguucucuccuucuu

SEQ ID NO: 3318178 - RNA, 15 nt, Human
uucacaguucucucc

SEQ ID NO: 3318179 - RNA, 20 nt, Human
uucacagaugggugcuugga

SEQ ID NO: 3318180 - RNA, 17 nt, Human
auaggaaaaacugauuu

SEQ ID NO: 3318181 - RNA, 16 nt, Human
auaggaaaaacugauu

SEQ ID NO: 3318182 - RNA, 14 nt, Human
auaggaaaaacuga

SEQ ID NO: 3318183 - RNA, 12 nt, Human
auaggaaaaacu

SEQ ID NO: 3318184 - RNA, 17 nt, Human
uuauuuuuagacagagu

SEQ ID NO: 3318185 - RNA, 18 nt, Human
uuauuuuuagacagaguc

SEQ ID NO: 3318186 - RNA, 21 nt, Human
uucaagcgauucuucugcuuc

SEQ ID NO: 3318187 - RNA, 22 nt, Human
auaguuggcuaggaccccucca

SEQ ID NO: 3318188 - RNA, 22 nt, Human
auaguuaagcgugcauaaguua

SEQ ID NO: 3318189 - RNA, 15 nt, Human
auaguggugugauuu

SEQ ID NO: 3318190 - RNA, 17 nt, Human
auaguggcuuaaaacaa

SEQ ID NO: 3318191 - RNA, 13 nt, Human
auauauaaccagu

SEQ ID NO: 3318192 - RNA, 12 nt, Human
auauauaaccag

SEQ ID NO: 3318193 - RNA, 16 nt, Human
auaucugaaaauguau

SEQ ID NO: 3318194 - RNA, 17 nt, Human
auaucugaaaauguaug

SEQ ID NO: 3318195 - RNA, 20 nt, Human
auaucugaaaauguaugugu

SEQ ID NO: 3318196 - RNA, 13 nt, Human
auaugcacacauu

SEQ ID NO: 3318197 - RNA, 16 nt, Human
auaugcacacauuuuu

SEQ ID NO: 3318198 - RNA, 15 nt, Human
auaugcacacauuuu

SEQ ID NO: 3318199 - RNA, 14 nt, Human
auaugcacacauuu

SEQ ID NO: 3318200 - RNA, 17 nt, Human
auauguaacaagccacc

SEQ ID NO: 3318201 - RNA, 16 nt, Human
auauguaacaagccac

SEQ ID NO: 3318202 - RNA, 17 nt, Human
uucaucccucuggggcu

SEQ ID NO: 3318203 - RNA, 21 nt, Human
uucaucccucuggggcuguuc

SEQ ID NO: 3318204 - RNA, 13 nt, Human
uucagugccuuau

SEQ ID NO: 3318205 - RNA, 12 nt, Human
uucagugccuua

SEQ ID NO: 3318206 - RNA, 16 nt, Human
uucagugccaaaaaca

SEQ ID NO: 3318207 - RNA, 11 nt, Human
uucagaaaugu

SEQ ID NO: 3318208 - RNA, 13 nt, Human
uucccaagcucug

SEQ ID NO: 3318209 - RNA, 14 nt, Human
uucccaagcucugc

SEQ ID NO: 3318210 - RNA, 15 nt, Human
uucccaagcucugcu

SEQ ID NO: 3318211 - RNA, 16 nt, Human
uucccaagcucugcuc

SEQ ID NO: 3318212 - RNA, 18 nt, Human
uucccaagcucugcuccu

SEQ ID NO: 3318213 - RNA, 22 nt, Human
uucccaccucucucacuccuug

SEQ ID NO: 3318214 - RNA, 12 nt, Human
uucccaccucuc

SEQ ID NO: 3318215 - RNA, 23 nt, Human
uucccaaagcagugcaugcuguc

SEQ ID NO: 3318216 - RNA, 22 nt, Human
uuccagugaggcucugcccuug

SEQ ID NO: 3318217 - RNA, 21 nt, Human
uuccagugaggcucugcccuu

SEQ ID NO: 3318218 - RNA, 20 nt, Human
uuccagugaggcucugcccu

SEQ ID NO: 3318219 - RNA, 19 nt, Human
uuccagugaggcucugccc

SEQ ID NO: 3318220 - RNA, 17 nt, Human
uuccagugaggcucugc

SEQ ID NO: 3318221 - RNA, 21 nt, Human
uuccaggggugggacacccug

SEQ ID NO: 3318222 - RNA, 17 nt, Human
uuccaggggugggacac

SEQ ID NO: 3318223 - RNA, 18 nt, Human
uuccaccaucaagccacc

SEQ ID NO: 3318224 - RNA, 22 nt, Human
uuccacaagagcccaggccucc

SEQ ID NO: 3318225 - RNA, 19 nt, Human
uuccaccaucaagccacca

SEQ ID NO: 3318226 - RNA, 16 nt, Human
auauguggaguucauc

SEQ ID NO: 3318227 - RNA, 15 nt, Human
auauguggaguucau

SEQ ID NO: 3318228 - RNA, 15 nt, Human
uuccaaggguacuaa

SEQ ID NO: 3318229 - RNA, 17 nt, Human
uuccaaggguacuaagg

SEQ ID NO: 3318230 - RNA, 21 nt, Human
uucucacugccaugccagcuu

SEQ ID NO: 3318231 - RNA, 13 nt, Human
aucaggccaggcc

SEQ ID NO: 3318232 - RNA, 21 nt, Human
uucgcaggauucuuccucccu

SEQ ID NO: 3318233 - RNA, 19 nt, Human
aucaaccccuucgcuccug

SEQ ID NO: 3318234 - RNA, 20 nt, Human
aucaaccccuucgcuccugu

SEQ ID NO: 3318235 - RNA, 22 nt, Human
aucaaccccuucgcuccugugu

SEQ ID NO: 3318236 - RNA, 18 nt, Human
uucccuuuuuuggcugcu

SEQ ID NO: 3318237 - RNA, 19 nt, Human
uucccuuuuuuggcugcug

SEQ ID NO: 3318238 - RNA, 13 nt, Human
auccuaguuccac

SEQ ID NO: 3318239 - RNA, 21 nt, Human
auccuaggcauuugcugaaua

SEQ ID NO: 3318240 - RNA, 21 nt, Human
auccuaagcuauucaguaaua

SEQ ID NO: 3318241 - RNA, 20 nt, Human
uugaaauauaggaacuuaaa

SEQ ID NO: 3318242 - RNA, 11 nt, Human
uugaaaucuuu

SEQ ID NO: 3318243 - RNA, 21 nt, Human
uugaaauuuuuauuaaauuau

SEQ ID NO: 3318244 - RNA, 20 nt, Human
uucuguuuuucuaggccugg

SEQ ID NO: 3318245 - RNA, 11 nt, Human
uucuguucuuu

SEQ ID NO: 3318246 - RNA, 18 nt, Human
uucuguucuuucuggcua

SEQ ID NO: 3318247 - RNA, 13 nt, Human
uucuuaauucuua

SEQ ID NO: 3318248 - RNA, 23 nt, Human
uucuuccucccucccucuuuccc

SEQ ID NO: 3318249 - RNA, 12 nt, Human
uucuugcaaagu

SEQ ID NO: 3318250 - RNA, 22 nt, Human
uucuuucuggcuaugcauuuga

SEQ ID NO: 3318251 - RNA, 21 nt, Human
auccaagcuggucccacucag

SEQ ID NO: 3318252 - RNA, 15 nt, Human
uucugccgcagcccu

SEQ ID NO: 3318253 - RNA, 14 nt, Human
uucugccgcagccc

SEQ ID NO: 3318254 - RNA, 20 nt, Human
uucuggcuaugcauuugaaa

SEQ ID NO: 3318255 - RNA, 18 nt, Human
uucuggcuaugcauuuga

SEQ ID NO: 3318256 - RNA, 16 nt, Human
uucuggcuaugcauuu

SEQ ID NO: 3318257 - RNA, 13 nt, Human
uucugccgcagcc

SEQ ID NO: 3318258 - RNA, 14 nt, Human
uucugacccaugcu

SEQ ID NO: 3318259 - RNA, 16 nt, Human
uucucuuuucaaaaca

SEQ ID NO: 3318260 - RNA, 17 nt, Human
uucucuacucuagggaa

SEQ ID NO: 3318261 - RNA, 20 nt, Human
aucaggccaggcccucugcc

SEQ ID NO: 3318262 - RNA, 20 nt, Human
aucauugaaaucuuuuugcu

SEQ ID NO: 3318263 - RNA, 23 nt, Human
aucaggccaggcccucugcccac

SEQ ID NO: 3318264 - RNA, 22 nt, Human
aucaggccaggcccucugccca

SEQ ID NO: 3318265 - RNA, 21 nt, Human
aucaggccaggcccucugccc

SEQ ID NO: 3318266 - RNA, 21 nt, Human
aucauugaaaucuuuuugcuu

SEQ ID NO: 3318267 - RNA, 15 nt, Human
augcagccucacagu

SEQ ID NO: 3318268 - RNA, 14 nt, Human
augcagccucacag

SEQ ID NO: 3318269 - RNA, 13 nt, Human
augcagccucaca

SEQ ID NO: 3318270 - RNA, 15 nt, Human
augcacuuuguucug

SEQ ID NO: 3318271 - RNA, 13 nt, Human
uuguuuucagugu

SEQ ID NO: 3318272 - RNA, 16 nt, Human
uuguuuucaguguaca

SEQ ID NO: 3318273 - RNA, 14 nt, Human
uuuaagaggcaggg

SEQ ID NO: 3318274 - RNA, 23 nt, Human
uuuaaugaaagacuguacaaagu

SEQ ID NO: 3318275 - RNA, 17 nt, Human
uuuaagugcugcauuua

SEQ ID NO: 3318276 - RNA, 16 nt, Human
uuuaagugcugcauuu

SEQ ID NO: 3318277 - RNA, 15 nt, Human
uuuaagugcugcauu

SEQ ID NO: 3318278 - RNA, 12 nt, Human
uuuaauucaguu

SEQ ID NO: 3318279 - RNA, 21 nt, Human
augauucaacagguuuuccug

SEQ ID NO: 3318280 - RNA, 21 nt, Human
augauuaaccacuucagcuga

SEQ ID NO: 3318281 - RNA, 20 nt, Human
augauuaaccacuucagcug

SEQ ID NO: 3318282 - RNA, 19 nt, Human
augauuaaccacuucagcu

SEQ ID NO: 3318283 - RNA, 12 nt, Human
augcacuuuguu

SEQ ID NO: 3318284 - RNA, 13 nt, Human
augcaccagcccu

SEQ ID NO: 3318285 - RNA, 21 nt, Human
uugugaggaagccgcuggggc

SEQ ID NO: 3318286 - RNA, 18 nt, Human
uugugauacaaugcugug

SEQ ID NO: 3318287 - RNA, 13 nt, Human
uugugguuaaucu

SEQ ID NO: 3318288 - RNA, 19 nt, Human
uuguucuggcucuuccagg

SEQ ID NO: 3318289 - RNA, 17 nt, Human
uuguguguuuauuguca

SEQ ID NO: 3318290 - RNA, 22 nt, Human
uuguucuggcucuuccaggcug

SEQ ID NO: 3318291 - RNA, 20 nt, Human
uuguucuggcucuuccaggc

SEQ ID NO: 3318292 - RNA, 19 nt, Human
augcuccuggcccacugca

SEQ ID NO: 3318293 - RNA, 22 nt, Human
augcuguaacuuucugaaauaa

SEQ ID NO: 3318294 - RNA, 23 nt, Human
augcugucccuuacgugaguccu

SEQ ID NO: 3318295 - RNA, 19 nt, Human
augcugucccuuacgugag

SEQ ID NO: 3318296 - RNA, 15 nt, Human
auggaagacagcucu

SEQ ID NO: 3318297 - RNA, 16 nt, Human
auggaacacucugaga

SEQ ID NO: 3318298 - RNA, 15 nt, Human
auggaacacucugag

SEQ ID NO: 3318299 - RNA, 14 nt, Human
auggaacacucuga

SEQ ID NO: 3318300 - RNA, 11 nt, Human
auggaacacuc

SEQ ID NO: 3318301 - RNA, 20 nt, Human
uuuauggcuuuugugcauua

SEQ ID NO: 3318302 - RNA, 24 nt, Human
uuuauggcuuuugugcauuaucua

SEQ ID NO: 3318303 - RNA, 15 nt, Human
uuuaguagagacagg

SEQ ID NO: 3318304 - RNA, 18 nt, Human
auggcuaauguacugcau

SEQ ID NO: 3318305 - RNA, 20 nt, Human
auggccuuugcuugaaagaa

SEQ ID NO: 3318306 - RNA, 21 nt, Human
auggccgggcgcgguggcuca

SEQ ID NO: 3318307 - RNA, 23 nt, Human
auggcacaucagcacgauuucug

SEQ ID NO: 3318308 - RNA, 17 nt, Human
auggcacaucagcacga

SEQ ID NO: 3318309 - RNA, 20 nt, Human
auggacguguuaugacucca

SEQ ID NO: 3318310 - RNA, 19 nt, Human
auggacguguuaugacucc

SEQ ID NO: 3318311 - RNA, 23 nt, Human
auggacguguuaugacuccagaa

SEQ ID NO: 3318312 - RNA, 18 nt, Human
auggauuuccagccaaag

SEQ ID NO: 3318313 - RNA, 16 nt, Human
auggaagacagcucuu

SEQ ID NO: 3318314 - RNA, 13 nt, Human
uuucagaaaugug

SEQ ID NO: 3318315 - RNA, 14 nt, Human
auggacaugaucuu

SEQ ID NO: 3318316 - RNA, 20 nt, Human
augaaugucagugugacuga

SEQ ID NO: 3318317 - RNA, 14 nt, Human
uuggggauauuuuu

SEQ ID NO: 3318318 - RNA, 22 nt, Human
uuggggggcugaggugggagga

SEQ ID NO: 3318319 - RNA, 18 nt, Human
aucuuugcagacaggcaa

SEQ ID NO: 3318320 - RNA, 18 nt, Human
uuggcuagagguucaaag

SEQ ID NO: 3318321 - RNA, 23 nt, Human
uuggcgcugccccuggcagcccc

SEQ ID NO: 3318322 - RNA, 22 nt, Human
uuggcgcugccccuggcagccc

SEQ ID NO: 3318323 - RNA, 21 nt, Human
augagaaagguugaagcacca

SEQ ID NO: 3318324 - RNA, 22 nt, Human
augagaaagguugaagcaccaa

SEQ ID NO: 3318325 - RNA, 17 nt, Human
augacuuacuguacaug

SEQ ID NO: 3318326 - RNA, 16 nt, Human
augacuuacuguacau

SEQ ID NO: 3318327 - RNA, 18 nt, Human
augacacgaauauugcug

SEQ ID NO: 3318328 - RNA, 22 nt, Human
augacuuaagcacacuugacau

SEQ ID NO: 3318329 - RNA, 14 nt, Human
augacuuacuguac

SEQ ID NO: 3318330 - RNA, 22 nt, Human
augacacaugcaaggucauuuu

SEQ ID NO: 3318331 - RNA, 14 nt, Human
augacacaugcaag

SEQ ID NO: 3318332 - RNA, 23 nt, Human
aucugugaaaggaaagagggagg

SEQ ID NO: 3318333 - RNA, 19 nt, Human
aucuggguucacugcaacc

SEQ ID NO: 3318334 - RNA, 17 nt, Human
aucuggguucacugcaa

SEQ ID NO: 3318335 - RNA, 18 nt, Human
aucuugaauuguaaggaa

SEQ ID NO: 3318336 - RNA, 17 nt, Human
aucuugaauuguaagga

SEQ ID NO: 3318337 - RNA, 17 nt, Human
aucuugcucugcugaca

SEQ ID NO: 3318338 - RNA, 19 nt, Human
aucuugcucugcugacaga

SEQ ID NO: 3318339 - RNA, 13 nt, Human
uugccgucuaccu

SEQ ID NO: 3318340 - RNA, 18 nt, Human
uugccgucuaccugaggg

SEQ ID NO: 3318341 - RNA, 15 nt, Human
uugccgucuaccuga

SEQ ID NO: 3318342 - RNA, 19 nt, Human
uugccgucuaccugagggg

SEQ ID NO: 3318343 - RNA, 14 nt, Human
uugccguuauuaaa

SEQ ID NO: 3318344 - RNA, 14 nt, Human
uugauucagacagc

SEQ ID NO: 3318345 - RNA, 16 nt, Human
uugauucagacagcug

SEQ ID NO: 3318346 - RNA, 15 nt, Human
uugauucagacagcu

SEQ ID NO: 3318347 - RNA, 13 nt, Human
aucucccccagcc

SEQ ID NO: 3318348 - RNA, 12 nt, Human
aucucccccagc

SEQ ID NO: 3318349 - RNA, 15 nt, Human
aucucacacaugagc

SEQ ID NO: 3318350 - RNA, 19 nt, Human
auccuaguuccaccaucaa

SEQ ID NO: 3318351 - RNA, 15 nt, Human
auccuaguuccacca

SEQ ID NO: 3318352 - RNA, 20 nt, Human
auuccccagauugcaacagg

SEQ ID NO: 3318353 - RNA, 22 nt, Human
auuccccacccugaaagcccug

SEQ ID NO: 3318354 - RNA, 16 nt, Human
auuccccaggaggcca

SEQ ID NO: 3318355 - RNA, 20 nt, Human
auucaggaagcucagggccu

SEQ ID NO: 3318356 - RNA, 21 nt, Human
auucaguuguuagugugucuu

SEQ ID NO: 3318357 - RNA, 16 nt, Human
auucaguuguuagugu

SEQ ID NO: 3318358 - RNA, 23 nt, Human
auucaggaagcucagggccuggc

SEQ ID NO: 3318359 - RNA, 22 nt, Human
auucaggaagcucagggccugg

SEQ ID NO: 3318360 - RNA, 21 nt, Human
auucaggaagcucagggccug

SEQ ID NO: 3318361 - RNA, 18 nt, Human
auucagcucugcaagaau

SEQ ID NO: 3318362 - RNA, 14 nt, Human
auucagcucugcaa

SEQ ID NO: 3318363 - RNA, 13 nt, Human
auuagagaagaga

SEQ ID NO: 3318364 - RNA, 23 nt, Human
auuauuuauuaaaugcccagccc

SEQ ID NO: 3318365 - RNA, 22 nt, Human
uuuuuguuccacaaguuaaaua

SEQ ID NO: 3318366 - RNA, 19 nt, Human
auuaccacagacauacuaa

SEQ ID NO: 3318367 - RNA, 22 nt, Human
auuaccugaauuuuggcugugu

SEQ ID NO: 3318368 - RNA, 13 nt, Human
uuuguagagccag

SEQ ID NO: 3318369 - RNA, 22 nt, Human
uuuguaaauuaacuuuuauaaa

SEQ ID NO: 3318370 - RNA, 12 nt, Human
uuuguuugaacu

SEQ ID NO: 3318371 - RNA, 14 nt, Human
uuuguuugaacuga

SEQ ID NO: 3318372 - RNA, 13 nt, Human
uuuguuugaacug

SEQ ID NO: 3318373 - RNA, 19 nt, Human
uuugugaggaagccgcugg

SEQ ID NO: 3318374 - RNA, 18 nt, Human
uuugugaggaagccgcug

SEQ ID NO: 3318375 - RNA, 15 nt, Human
uuuuaagaggcaggg

SEQ ID NO: 3318376 - RNA, 16 nt, Human
uuuuaagaggcagggu

SEQ ID NO: 3318377 - RNA, 15 nt, Human
uuuuaagugcugcau

SEQ ID NO: 3318378 - RNA, 18 nt, Human
uuuguuugaacugauaaa

SEQ ID NO: 3318379 - RNA, 21 nt, Human
uuuuaaaaaacugcugacugu

SEQ ID NO: 3318380 - RNA, 12 nt, Human
auguauguguaa

SEQ ID NO: 3318381 - RNA, 15 nt, Human
auguaucugagcagg

SEQ ID NO: 3318382 - RNA, 15 nt, Human
auguaucaaugagua

SEQ ID NO: 3318383 - RNA, 22 nt, Human
uuugggggaaaauuuagaaaua

SEQ ID NO: 3318384 - RNA, 21 nt, Human
augucagugugacugaucucu

SEQ ID NO: 3318385 - RNA, 16 nt, Human
augucagugugacuga

SEQ ID NO: 3318386 - RNA, 15 nt, Human
augucagugugacug

SEQ ID NO: 3318387 - RNA, 23 nt, Human
auguccaagaagcccaggaaagg

SEQ ID NO: 3318388 - RNA, 18 nt, Human
auguccaagaagcccagg

SEQ ID NO: 3318389 - RNA, 19 nt, Human
auguccaagaagcccagga

SEQ ID NO: 3318390 - RNA, 23 nt, Human
augucucuuuaaugucacaggca

SEQ ID NO: 3318391 - RNA, 22 nt, Human
uuugccauguuggccaggcugg

SEQ ID NO: 3318392 - RNA, 13 nt, Human
uuuggggaagaac

SEQ ID NO: 3318393 - RNA, 22 nt, Human
uuugggaggccaaggugggagg

SEQ ID NO: 3318394 - RNA, 14 nt, Human
uuuggggauauuuu

SEQ ID NO: 3318395 - RNA, 21 nt, Human
auguucaucauccuaagcuau

SEQ ID NO: 3318396 - RNA, 21 nt, Human
uuuuaagugcugcauuuaaaa

SEQ ID NO: 3318397 - RNA, 17 nt, Human
uuuuaagugcugcauuu

SEQ ID NO: 3318398 - RNA, 16 nt, Human
uuuuaagugcugcauu

SEQ ID NO: 3318399 - RNA, 13 nt, Human
auguuggccaggc

SEQ ID NO: 3318400 - RNA, 14 nt, Human
auguuggccaggcu

SEQ ID NO: 3318401 - RNA, 23 nt, Human
uuuuagaguugauacuacaguuu

SEQ ID NO: 3318402 - RNA, 13 nt, Human
uuuuauaaacuuu

SEQ ID NO: 3318403 - RNA, 12 nt, Human
uuuuauaaacuu

SEQ ID NO: 3318404 - RNA, 19 nt, Human
uuuuauaaacuuuaccuuu

SEQ ID NO: 3318405 - RNA, 17 nt, Human
uuuuauaaacuuuaccu

SEQ ID NO: 3318406 - RNA, 14 nt, Human
uuuuauaaacuuua

SEQ ID NO: 3318407 - RNA, 19 nt, Human
uuuuccagguuuaagcugu

SEQ ID NO: 3318408 - RNA, 14 nt, Human
auguuuuccaugag

SEQ ID NO: 3318409 - RNA, 18 nt, Human
auguuuuucuucucccuc

SEQ ID NO: 3318410 - RNA, 17 nt, Human
auguuuuucuucucccu

SEQ ID NO: 3318411 - RNA, 13 nt, Human
auuaagaaagacu

SEQ ID NO: 3318412 - RNA, 14 nt, Human
auuaagaaagacua

SEQ ID NO: 3318413 - RNA, 23 nt, Human
auuaacuuuuauaaacuuuaccu

SEQ ID NO: 3318414 - RNA, 12 nt, Human
auuaacuuuuau

SEQ ID NO: 3318415 - RNA, 20 nt, Human
auuaacuuuuauaaacuuua

SEQ ID NO: 3318416 - RNA, 19 nt, Human
auuaacuuuuauaaacuuu

SEQ ID NO: 3318417 - RNA, 17 nt, Human
auuaacuuuuauaaacu

SEQ ID NO: 3318418 - RNA, 16 nt, Human
auuaacuuuuauaaac

SEQ ID NO: 3318419 - RNA, 20 nt, Human
auuaaccacuucagcugacu

SEQ ID NO: 3318420 - RNA, 18 nt, Human
auuaaccacuucagcuga

SEQ ID NO: 3318421 - RNA, 17 nt, Human
auuaaccacuucagcug

SEQ ID NO: 3318422 - RNA, 21 nt, Human
auuaaacuuaaucuaaaugga

SEQ ID NO: 3318423 - RNA, 19 nt, Human
auuaaacuuaaucuaaaug

SEQ ID NO: 3318424 - RNA, 16 nt, Human
auuaaacuuaaucuaa

SEQ ID NO: 3318425 - RNA, 17 nt, Human
auuaaacuuaaucuaaa

SEQ ID NO: 3318426 - RNA, 23 nt, Human
auuggcuuuggguugcaggaccu

SEQ ID NO: 3318427 - RNA, 16 nt, Human
auuuaacagaaaugua

SEQ ID NO: 3318428 - RNA, 15 nt, Human
auuuaacagaaaugu

SEQ ID NO: 3318429 - RNA, 20 nt, Human
auuuaacagaaauguacagc

SEQ ID NO: 3318430 - RNA, 19 nt, Human
auuuaacagaaauguacag

SEQ ID NO: 3318431 - RNA, 17 nt, Human
auuuaacagaaauguac

SEQ ID NO: 3318432 - RNA, 19 nt, Human
auuuaauuuuuuugagaca

SEQ ID NO: 3318433 - RNA, 23 nt, Human
auuuaauuuuuuugagacagagu

SEQ ID NO: 3318434 - RNA, 17 nt, Human
auucuccaccugccagg

SEQ ID NO: 3318435 - RNA, 16 nt, Human
auucuccaccugccag

SEQ ID NO: 3318436 - RNA, 13 nt, Human
auucuccaccugc

SEQ ID NO: 3318437 - RNA, 18 nt, Human
auucucagaaucucaaau

SEQ ID NO: 3318438 - RNA, 20 nt, Human
auucucagaaucucaaauaa

SEQ ID NO: 3318439 - RNA, 14 nt, Human
auucucagaaucuc

SEQ ID NO: 3318440 - RNA, 13 nt, Human
auucuacuuugag

SEQ ID NO: 3318441 - RNA, 16 nt, Human
auucuacuuugagugc

SEQ ID NO: 3318442 - RNA, 13 nt, Human
auugaccugaggc

SEQ ID NO: 3318443 - RNA, 15 nt, Human
auugcaacaggcugg

SEQ ID NO: 3318444 - RNA, 21 nt, Human
auugcaacaggcugggcuuca

SEQ ID NO: 3318445 - RNA, 23 nt, Human
auugccauuucuuccacaagagc

SEQ ID NO: 3318446 - RNA, 17 nt, Human
auugcccacgcuggagu

SEQ ID NO: 3318447 - RNA, 21 nt, Human
auugcccacgcuggagugcag

SEQ ID NO: 3318448 - RNA, 16 nt, Human
auugcggacagccacg

SEQ ID NO: 3318449 - RNA, 18 nt, Human
auugcggacagccacggc

SEQ ID NO: 3318450 - RNA, 19 nt, Human
auugcggacagccacggcc

SEQ ID NO: 3318451 - RNA, 17 nt, Human
auuuuauuaugcaugaa

SEQ ID NO: 3318452 - RNA, 15 nt, Human
auuuuauuaugcaug

SEQ ID NO: 3318453 - RNA, 14 nt, Human
auuuuauuaugcau

SEQ ID NO: 3318454 - RNA, 13 nt, Human
auuuuauuaugca

SEQ ID NO: 3318455 - RNA, 17 nt, Human
auuuggugguuucagaa

SEQ ID NO: 3318456 - RNA, 20 nt, Human
auuuggugguuucagaaaug

SEQ ID NO: 3318457 - RNA, 18 nt, Human
auuuggugguuucagaaa

SEQ ID NO: 3318458 - RNA, 17 nt, Human
auuugagcagggcucag

SEQ ID NO: 3318459 - RNA, 23 nt, Human
auuugaggucuguucuuuccaaa

SEQ ID NO: 3318460 - RNA, 22 nt, Human
auuugaggucuguucuuuccaa

SEQ ID NO: 3318461 - RNA, 20 nt, Human
auuucuuuugccguuauuaa

SEQ ID NO: 3318462 - RNA, 16 nt, Human
auuugagcagggcuca

SEQ ID NO: 3318463 - RNA, 20 nt, Human
auuuauuaaaugcccagccc

SEQ ID NO: 3318464 - RNA, 13 nt, Human
auuuauuauggca

SEQ ID NO: 3318465 - RNA, 21 nt, Human
auuucuaaaucuccaaaauaa

SEQ ID NO: 3318466 - RNA, 13 nt, Human
auuucuaaaucuc

SEQ ID NO: 3318467 - RNA, 12 nt, Human
auuucuaaaucu

SEQ ID NO: 3318468 - RNA, 14 nt, Human
auuuccugugucuu

SEQ ID NO: 3318469 - RNA, 16 nt, Human
auuuauuauggcacau

SEQ ID NO: 3318470 - RNA, 23 nt, Human
auuucuuuugccguuauuaaaaa

SEQ ID NO: 3318471 - RNA, 13 nt, Human
caagaagcccagg

SEQ ID NO: 3318472 - RNA, 13 nt, Human
caagacgcugugc

SEQ ID NO: 3318473 - RNA, 23 nt, Human
caagaccuucuccuucaccuuug

SEQ ID NO: 3318474 - RNA, 21 nt, Human
caagaccuucuccuucaccuu

SEQ ID NO: 3318475 - RNA, 22 nt, Human
caaauggaaaugggcagagcag

SEQ ID NO: 3318476 - RNA, 23 nt, Human
caaauggaaaugggcagagcaga

SEQ ID NO: 3318477 - RNA, 13 nt, Human
caaagugcuggga

SEQ ID NO: 3318478 - RNA, 19 nt, Human
caaagugcugggauuacaa

SEQ ID NO: 3318479 - RNA, 19 nt, Human
caaaguggugagaggcauc

SEQ ID NO: 3318480 - RNA, 23 nt, Human
caaagugcugggauuacaagcgu

SEQ ID NO: 3318481 - RNA, 14 nt, Human
caaauuucuaaauc

SEQ ID NO: 3318482 - RNA, 22 nt, Human
caaauuucuaaaucuccaaaau

SEQ ID NO: 3318483 - RNA, 15 nt, Human
caaauuucuaaaucu

SEQ ID NO: 3318484 - RNA, 16 nt, Human
caacauacucccaucu

SEQ ID NO: 3318485 - RNA, 20 nt, Human
caacauacucccaucuguga

SEQ ID NO: 3318486 - RNA, 12 nt, Human
caacaggcuggg

SEQ ID NO: 3318487 - RNA, 19 nt, Human
caacauacucccaucugug

SEQ ID NO: 3318488 - RNA, 17 nt, Human
caacauacucccaucug

SEQ ID NO: 3318489 - RNA, 20 nt, Human
caaaauaaaacuuuuuaaaa

SEQ ID NO: 3318490 - RNA, 16 nt, Human
caaaauaaaacuuuuu

SEQ ID NO: 3318491 - RNA, 14 nt, Human
caaaauaaaacuuu

SEQ ID NO: 3318492 - RNA, 21 nt, Human
caaaaucgaugcagugcuucc

SEQ ID NO: 3318493 - RNA, 14 nt, Human
caaaaguuucucuu

SEQ ID NO: 3318494 - RNA, 23 nt, Human
caaaacucuccucugcugcuggc

SEQ ID NO: 3318495 - RNA, 16 nt, Human
caaaacucuccucugc

SEQ ID NO: 3318496 - RNA, 15 nt, Human
caaaacucuccucug

SEQ ID NO: 3318497 - RNA, 18 nt, Human
auuuuauuuuauuaugca

SEQ ID NO: 3318498 - RNA, 21 nt, Human
caaaacgguuuuacugcagcu

SEQ ID NO: 3318499 - RNA, 15 nt, Human
caaaacgguuuuacu

SEQ ID NO: 3318500 - RNA, 21 nt, Human
caaacucuugaccucagguga

SEQ ID NO: 3318501 - RNA, 17 nt, Human
caaacucuugaccucag

SEQ ID NO: 3318502 - RNA, 19 nt, Human
caaacucuugaccucaggu

SEQ ID NO: 3318503 - RNA, 20 nt, Human
caaacucuugaccucaggug

SEQ ID NO: 3318504 - RNA, 22 nt, Human
caaaaugaaacgcaaccaccac

SEQ ID NO: 3318505 - RNA, 11 nt, Human
caaaaugaaac

SEQ ID NO: 3318506 - RNA, 13 nt, Human
caaacagaggccg

SEQ ID NO: 3318507 - RNA, 13 nt, Human
cacaaaggagagc

SEQ ID NO: 3318508 - RNA, 17 nt, Human
cacacacgcgugcacac

SEQ ID NO: 3318509 - RNA, 13 nt, Human
cacaaacagaggc

SEQ ID NO: 3318510 - RNA, 14 nt, Human
cacaaacagaggcc

SEQ ID NO: 3318511 - RNA, 18 nt, Human
caauuacaggaaguacug

SEQ ID NO: 3318512 - RNA, 17 nt, Human
caauuacaggaaguacu

SEQ ID NO: 3318513 - RNA, 14 nt, Human
caauguucucucuu

SEQ ID NO: 3318514 - RNA, 22 nt, Human
caaugugaaaagaaaaaugagc

SEQ ID NO: 3318515 - RNA, 19 nt, Human
caaugugaaaagaaaaaug

SEQ ID NO: 3318516 - RNA, 12 nt, Human
cacagagaaagu

SEQ ID NO: 3318517 - RNA, 19 nt, Human
cacagagaaaguacuucuc

SEQ ID NO: 3318518 - RNA, 20 nt, Human
cacagagaaaguacuucucc

SEQ ID NO: 3318519 - RNA, 23 nt, Human
cacagaugggugcuuggaggaag

SEQ ID NO: 3318520 - RNA, 13 nt, Human
cacagaggcugcc

SEQ ID NO: 3318521 - RNA, 22 nt, Human
cacagaguuguuacauuuuuaa

SEQ ID NO: 3318522 - RNA, 21 nt, Human
cacagaguuguuacauuuuua

SEQ ID NO: 3318523 - RNA, 21 nt, Human
cacagcucuucuccaggcugu

SEQ ID NO: 3318524 - RNA, 18 nt, Human
caagcgauucuucugcuu

SEQ ID NO: 3318525 - RNA, 21 nt, Human
caagcugcacccucaggcagg

SEQ ID NO: 3318526 - RNA, 15 nt, Human
caagcgauucuucug

SEQ ID NO: 3318527 - RNA, 17 nt, Human
caagcgauucuucugcu

SEQ ID NO: 3318528 - RNA, 21 nt, Human
caagcuggucccacucagucc

SEQ ID NO: 3318529 - RNA, 22 nt, Human
caagcugcacccucaggcaggu

SEQ ID NO: 3318530 - RNA, 20 nt, Human
caagcugcacccucaggcag

SEQ ID NO: 3318531 - RNA, 22 nt, Human
caagcuggucccacucagucca

SEQ ID NO: 3318532 - RNA, 23 nt, Human
caagcuggucccacucaguccau

SEQ ID NO: 3318533 - RNA, 19 nt, Human
caaggauccugagccagau

SEQ ID NO: 3318534 - RNA, 18 nt, Human
caaggauccugagccaga

SEQ ID NO: 3318535 - RNA, 16 nt, Human
caaggagauuuacaac

SEQ ID NO: 3318536 - RNA, 20 nt, Human
caaggauccugagccagauu

SEQ ID NO: 3318537 - RNA, 15 nt, Human
caaggcugcagugag

SEQ ID NO: 3318538 - RNA, 17 nt, Human
caaggauccugagccag

SEQ ID NO: 3318539 - RNA, 22 nt, Human
caaggcugcagugagccgagau

SEQ ID NO: 3318540 - RNA, 17 nt, Human
caaggcugcagugagcc

SEQ ID NO: 3318541 - RNA, 14 nt, Human
caauaggaaaaacu

SEQ ID NO: 3318542 - RNA, 15 nt, Human
caauaggaaaaacug

SEQ ID NO: 3318543 - RNA, 17 nt, Human
caauaggaaaaacugau

SEQ ID NO: 3318544 - RNA, 16 nt, Human
caauaggaaaaacuga

SEQ ID NO: 3318545 - RNA, 17 nt, Human
cacaguucaauucucau

SEQ ID NO: 3318546 - RNA, 12 nt, Human
ccuccauguggg

SEQ ID NO: 3318547 - RNA, 15 nt, Human
ccuccaugugggcua

SEQ ID NO: 3318548 - RNA, 17 nt, Human
ccucccaaagugcuggg

SEQ ID NO: 3318549 - RNA, 14 nt, Human
ccucccaacucacc

SEQ ID NO: 3318550 - RNA, 12 nt, Human
ccuccaggugca

SEQ ID NO: 3318551 - RNA, 11 nt, Human
ccuccaggugc

SEQ ID NO: 3318552 - RNA, 17 nt, Human
ccuccaggugcacaagc

SEQ ID NO: 3318553 - RNA, 15 nt, Human
ccucagggucccugg

SEQ ID NO: 3318554 - RNA, 20 nt, Human
ccucaggugagaagcagagg

SEQ ID NO: 3318555 - RNA, 18 nt, Human
ccucaggugagaagcaga

SEQ ID NO: 3318556 - RNA, 17 nt, Human
ccucaggugagaagcag

SEQ ID NO: 3318557 - RNA, 11 nt, Human
ccuccucagau

SEQ ID NO: 3318558 - RNA, 12 nt, Human
ccuccuccagcc

SEQ ID NO: 3318559 - RNA, 17 nt, Human
ccucccgaguagcuggg

SEQ ID NO: 3318560 - RNA, 18 nt, Human
ccucccgaguagcuggga

SEQ ID NO: 3318561 - RNA, 21 nt, Human
ccucccgaauagcugggacua

SEQ ID NO: 3318562 - RNA, 19 nt, Human
ccucccgaauagcugggac

SEQ ID NO: 3318563 - RNA, 20 nt, Human
ccucccgaauagcugggacu

SEQ ID NO: 3318564 - RNA, 16 nt, Human
ccucccaaagugcugg

SEQ ID NO: 3318565 - RNA, 15 nt, Human
ccucccaacucaccc

SEQ ID NO: 3318566 - RNA, 18 nt, Human
ccucccgaauagcuggga

SEQ ID NO: 3318567 - RNA, 15 nt, Human
ccucugcacuccccu

SEQ ID NO: 3318568 - RNA, 17 nt, Human
ccucugcacuccccugc

SEQ ID NO: 3318569 - RNA, 16 nt, Human
ccucugcacuccccug

SEQ ID NO: 3318570 - RNA, 18 nt, Human
ccucugcacuccccugcu

SEQ ID NO: 3318571 - RNA, 23 nt, Human
ccucugcacuccccugcugggug

SEQ ID NO: 3318572 - RNA, 18 nt, Human
ccucugcagcaauaaagc

SEQ ID NO: 3318573 - RNA, 14 nt, Human
ccucugcagcaaua

SEQ ID NO: 3318574 - RNA, 16 nt, Human
ccucugcccacucccu

SEQ ID NO: 3318575 - RNA, 13 nt, Human
ccucugcccacuc

SEQ ID NO: 3318576 - RNA, 21 nt, Human
ccucugacacacagcucuguc

SEQ ID NO: 3318577 - RNA, 18 nt, Human
ccucugacacacagcucu

SEQ ID NO: 3318578 - RNA, 14 nt, Human
ccucugacacacag

SEQ ID NO: 3318579 - RNA, 19 nt, Human
ccucugacacacagcucug

SEQ ID NO: 3318580 - RNA, 20 nt, Human
ccucugacacacagcucugu

SEQ ID NO: 3318581 - RNA, 13 nt, Human
ccucugacacaca

SEQ ID NO: 3318582 - RNA, 18 nt, Human
ccucgguguggagaagcg

SEQ ID NO: 3318583 - RNA, 21 nt, Human
ccuccuccagccgccaugcuc

SEQ ID NO: 3318584 - RNA, 22 nt, Human
ccucucccuuggauuguccccg

SEQ ID NO: 3318585 - RNA, 13 nt, Human
ccucucccuugga

SEQ ID NO: 3318586 - RNA, 20 nt, Human
ccucuccccagcaagugaga

SEQ ID NO: 3318587 - RNA, 15 nt, Human
ccucuccccagcaag

SEQ ID NO: 3318588 - RNA, 17 nt, Human
ccgggaagggggcuggg

SEQ ID NO: 3318589 - RNA, 17 nt, Human
cccuuggauuguccccg

SEQ ID NO: 3318590 - RNA, 20 nt, Human
cccuuguggucccaccccac

SEQ ID NO: 3318591 - RNA, 22 nt, Human
cccuuguggucccaccccacac

SEQ ID NO: 3318592 - RNA, 23 nt, Human
cccuugguuaggcauugugggaa

SEQ ID NO: 3318593 - RNA, 22 nt, Human
cccuugguuaggcauuguggga

SEQ ID NO: 3318594 - RNA, 12 nt, Human
cccuucccaccu

SEQ ID NO: 3318595 - RNA, 13 nt, Human
cccuucccaccuc

SEQ ID NO: 3318596 - RNA, 15 nt, Human
ccuaaaauucagugg

SEQ ID NO: 3318597 - RNA, 16 nt, Human
ccuaaaauucagugga

SEQ ID NO: 3318598 - RNA, 22 nt, Human
ccuacaguugaaaaacagcuga

SEQ ID NO: 3318599 - RNA, 19 nt, Human
ccuacagcuugaccgugag

SEQ ID NO: 3318600 - RNA, 21 nt, Human
ccuacaguugaaaaacagcug

SEQ ID NO: 3318601 - RNA, 13 nt, Human
ccuacccacccuc

SEQ ID NO: 3318602 - RNA, 18 nt, Human
ccuacccacccuccuuuc

SEQ ID NO: 3318603 - RNA, 19 nt, Human
ccuacuguaauuugugaua

SEQ ID NO: 3318604 - RNA, 21 nt, Human
ccuagaaauuccccacccuga

SEQ ID NO: 3318605 - RNA, 13 nt, Human
ccuaggugacaga

SEQ ID NO: 3318606 - RNA, 16 nt, Human
ccucagaucuucugug

SEQ ID NO: 3318607 - RNA, 23 nt, Human
ccucaggccugggggcugggcag

SEQ ID NO: 3318608 - RNA, 20 nt, Human
ccucagggucccugguggca

SEQ ID NO: 3318609 - RNA, 17 nt, Human
ccucagggucccuggug

SEQ ID NO: 3318610 - RNA, 16 nt, Human
ccucagggucccuggu

SEQ ID NO: 3318611 - RNA, 15 nt, Human
ccuaggugacagagu

SEQ ID NO: 3318612 - RNA, 17 nt, Human
ccuauuagagaagagau

SEQ ID NO: 3318613 - RNA, 16 nt, Human
ccuauuagagaagaga

SEQ ID NO: 3318614 - RNA, 23 nt, Human
ccucacaguccuuaccagcagag

SEQ ID NO: 3318615 - RNA, 24 nt, Human
ccucacaguccuuaccagcagagc

SEQ ID NO: 3318616 - RNA, 14 nt, Human
cccugccuccuuug

SEQ ID NO: 3318617 - RNA, 23 nt, Human
cccugccuccuuugugaggaagc

SEQ ID NO: 3318618 - RNA, 16 nt, Human
cccugccuccuuugug

SEQ ID NO: 3318619 - RNA, 12 nt, Human
cccugccacccu

SEQ ID NO: 3318620 - RNA, 14 nt, Human
cccugccacccugg

SEQ ID NO: 3318621 - RNA, 15 nt, Human
cccugccacccuggg

SEQ ID NO: 3318622 - RNA, 17 nt, Human
cccugccacccugggga

SEQ ID NO: 3318623 - RNA, 18 nt, Human
cccugccacccuggggag

SEQ ID NO: 3318624 - RNA, 22 nt, Human
cccugcacuugcagacucuaca

SEQ ID NO: 3318625 - RNA, 12 nt, Human
cccugcagaggg

SEQ ID NO: 3318626 - RNA, 18 nt, Human
cccugcagagggcacaga

SEQ ID NO: 3318627 - RNA, 16 nt, Human
cccugcaaccugauug

SEQ ID NO: 3318628 - RNA, 22 nt, Human
cccugcaaccugauugugucuc

SEQ ID NO: 3318629 - RNA, 13 nt, Human
cccugcugguuca

SEQ ID NO: 3318630 - RNA, 22 nt, Human
cccugcuggguguggcgcagca

SEQ ID NO: 3318631 - RNA, 19 nt, Human
cccugcugguucaggguug

SEQ ID NO: 3318632 - RNA, 20 nt, Human
cccugcugguucaggguugg

SEQ ID NO: 3318633 - RNA, 22 nt, Human
cccugguggcagugggagcugc

SEQ ID NO: 3318634 - RNA, 21 nt, Human
cccugguggcagugggagcug

SEQ ID NO: 3318635 - RNA, 14 nt, Human
cccugguggcagcu

SEQ ID NO: 3318636 - RNA, 22 nt, Human
cccucauccucauacccacccc

SEQ ID NO: 3318637 - RNA, 21 nt, Human
cccuccaagaccuucuccuuc

SEQ ID NO: 3318638 - RNA, 21 nt, Human
cccucagggucccugguggca

SEQ ID NO: 3318639 - RNA, 20 nt, Human
cccucagucuggcccuuccu

SEQ ID NO: 3318640 - RNA, 22 nt, Human
cccucaucaccaacgucugugc

SEQ ID NO: 3318641 - RNA, 20 nt, Human
cccucauccucauacccacc

SEQ ID NO: 3318642 - RNA, 17 nt, Human
cccucauccucauaccc

SEQ ID NO: 3318643 - RNA, 17 nt, Human
cccuccaugugggcuag

SEQ ID NO: 3318644 - RNA, 13 nt, Human
cccucccucuuuc

SEQ ID NO: 3318645 - RNA, 16 nt, Human
cccggcaggguccuag

SEQ ID NO: 3318646 - RNA, 22 nt, Human
cccuaaaguguauuuuuuuacu

SEQ ID NO: 3318647 - RNA, 17 nt, Human
cccuaaaguguauuuuu

SEQ ID NO: 3318648 - RNA, 15 nt, Human
cccucagggucccug

SEQ ID NO: 3318649 - RNA, 19 nt, Human
cccucagggucccuggugg

SEQ ID NO: 3318650 - RNA, 18 nt, Human
cccucagggucccuggug

SEQ ID NO: 3318651 - RNA, 17 nt, Human
cccucagggucccuggu

SEQ ID NO: 3318652 - RNA, 16 nt, Human
cccucagggucccugg

SEQ ID NO: 3318653 - RNA, 15 nt, Human
ccccuggcagccccu

SEQ ID NO: 3318654 - RNA, 14 nt, Human
ccccuggcagcccc

SEQ ID NO: 3318655 - RNA, 12 nt, Human
ccccuggcagcc

SEQ ID NO: 3318656 - RNA, 12 nt, Human
ccccaggaggcc

SEQ ID NO: 3318657 - RNA, 13 nt, Human
ccccagccugcua

SEQ ID NO: 3318658 - RNA, 15 nt, Human
ccccagccccauccu

SEQ ID NO: 3318659 - RNA, 16 nt, Human
ccccagccccauccca

SEQ ID NO: 3318660 - RNA, 20 nt, Human
cccgaggccuucucugaagg

SEQ ID NO: 3318661 - RNA, 15 nt, Human
cccgaggccuucucu

SEQ ID NO: 3318662 - RNA, 20 nt, Human
ccccuguucuggcagaguug

SEQ ID NO: 3318663 - RNA, 22 nt, Human
ccccuguccccgcacugggcuu

SEQ ID NO: 3318664 - RNA, 14 nt, Human
cccagcgagcccug

SEQ ID NO: 3318665 - RNA, 18 nt, Human
cccagcucugguccauag

SEQ ID NO: 3318666 - RNA, 16 nt, Human
cccagcucugguccau

SEQ ID NO: 3318667 - RNA, 15 nt, Human
cccagcucuggucca

SEQ ID NO: 3318668 - RNA, 12 nt, Human
cccagcucuggu

SEQ ID NO: 3318669 - RNA, 14 nt, Human
cccagcucuggucc

SEQ ID NO: 3318670 - RNA, 13 nt, Human
cccagcucugguc

SEQ ID NO: 3318671 - RNA, 13 nt, Human
cccaggagccccg

SEQ ID NO: 3318672 - RNA, 14 nt, Human
cccaggagccccga

SEQ ID NO: 3318673 - RNA, 13 nt, Human
cccaggaggccag

SEQ ID NO: 3318674 - RNA, 14 nt, Human
cccaggaggccagc

SEQ ID NO: 3318675 - RNA, 15 nt, Human
cccagccccauccuc

SEQ ID NO: 3318676 - RNA, 14 nt, Human
cccagccccauccu

SEQ ID NO: 3318677 - RNA, 14 nt, Human
cccagccccauccc

SEQ ID NO: 3318678 - RNA, 13 nt, Human
cccagccccaucc

SEQ ID NO: 3318679 - RNA, 18 nt, Human
cccagccccuucugaccc

SEQ ID NO: 3318680 - RNA, 19 nt, Human
cccagccccauccucugua

SEQ ID NO: 3318681 - RNA, 18 nt, Human
cccagccccauccucugu

SEQ ID NO: 3318682 - RNA, 13 nt, Human
cccagccccaaug

SEQ ID NO: 3318683 - RNA, 12 nt, Human
cccagccccauc

SEQ ID NO: 3318684 - RNA, 11 nt, Human
cccagccccau

SEQ ID NO: 3318685 - RNA, 17 nt, Human
cccagccccaaugaaca

SEQ ID NO: 3318686 - RNA, 23 nt, Human
cccagauugcaacaggcugggcu

SEQ ID NO: 3318687 - RNA, 13 nt, Human
ccaugugccaggu

SEQ ID NO: 3318688 - RNA, 13 nt, Human
ccauguuggccag

SEQ ID NO: 3318689 - RNA, 14 nt, Human
ccauguuggccagg

SEQ ID NO: 3318690 - RNA, 15 nt, Human
ccaugcugcccugug

SEQ ID NO: 3318691 - RNA, 18 nt, Human
ccaugcuccuggcccacu

SEQ ID NO: 3318692 - RNA, 15 nt, Human
ccaugcuccuggccc

SEQ ID NO: 3318693 - RNA, 17 nt, Human
ccaugcugcccugugag

SEQ ID NO: 3318694 - RNA, 16 nt, Human
ccaugcugcccuguga

SEQ ID NO: 3318695 - RNA, 13 nt, Human
ccaugcuccuggc

SEQ ID NO: 3318696 - RNA, 14 nt, Human
cccacgcccccacu

SEQ ID NO: 3318697 - RNA, 13 nt, Human
cccacgcccccac

SEQ ID NO: 3318698 - RNA, 15 nt, Human
cccaccuggccucug

SEQ ID NO: 3318699 - RNA, 12 nt, Human
cccaccuggccu

SEQ ID NO: 3318700 - RNA, 16 nt, Human
cccaccuuggcugcag

SEQ ID NO: 3318701 - RNA, 17 nt, Human
cccaccuuggcugcagg

SEQ ID NO: 3318702 - RNA, 19 nt, Human
cccaccuuggcugcaggga

SEQ ID NO: 3318703 - RNA, 19 nt, Human
ccauguuggccaggcuggu

SEQ ID NO: 3318704 - RNA, 21 nt, Human
ccauguuggccaggcuggucu

SEQ ID NO: 3318705 - RNA, 18 nt, Human
ccauguuggccaggcugg

SEQ ID NO: 3318706 - RNA, 15 nt, Human
ccauguuggccaggc

SEQ ID NO: 3318707 - RNA, 20 nt, Human
cccaucugugaaaggaaaga

SEQ ID NO: 3318708 - RNA, 13 nt, Human
cccaucucacaca

SEQ ID NO: 3318709 - RNA, 18 nt, Human
cccaucucacacaugagc

SEQ ID NO: 3318710 - RNA, 12 nt, Human
cccaucugugaa

SEQ ID NO: 3318711 - RNA, 14 nt, Human
cccaugcugcccug

SEQ ID NO: 3318712 - RNA, 13 nt, Human
cccaugcugcccu

SEQ ID NO: 3318713 - RNA, 12 nt, Human
cccaugcugccc

SEQ ID NO: 3318714 - RNA, 20 nt, Human
cccaugagccucagcauccu

SEQ ID NO: 3318715 - RNA, 15 nt, Human
cccaugagccucagc

SEQ ID NO: 3318716 - RNA, 16 nt, Human
cccaugagccucagca

SEQ ID NO: 3318717 - RNA, 17 nt, Human
cccaggcaggucuugaa

SEQ ID NO: 3318718 - RNA, 17 nt, Human
cccaggcauuccccagg

SEQ ID NO: 3318719 - RNA, 23 nt, Human
cccaggcaggucuugaacuccug

SEQ ID NO: 3318720 - RNA, 15 nt, Human
cccaggcauucccca

SEQ ID NO: 3318721 - RNA, 16 nt, Human
cccaggaggccagccu

SEQ ID NO: 3318722 - RNA, 15 nt, Human
cccaggaggccagcc

SEQ ID NO: 3318723 - RNA, 13 nt, Human
cccagguuucuau

SEQ ID NO: 3318724 - RNA, 15 nt, Human
cccagugccgagaag

SEQ ID NO: 3318725 - RNA, 21 nt, Human
cccagugcccacaggaucagu

SEQ ID NO: 3318726 - RNA, 10 nt, Human
cccagucugg

SEQ ID NO: 3318727 - RNA, 18 nt, Human
cccagucuggaaugcagu

SEQ ID NO: 3318728 - RNA, 19 nt, Human
cccagucuggaaugcagug

SEQ ID NO: 3318729 - RNA, 20 nt, Human
cccagugguuccuaauccuc

SEQ ID NO: 3318730 - RNA, 14 nt, Human
cccaguuagcucuc

SEQ ID NO: 3318731 - RNA, 21 nt, Human
ccauccucuguacagagccca

SEQ ID NO: 3318732 - RNA, 14 nt, Human
ccaucaugucuggc

SEQ ID NO: 3318733 - RNA, 16 nt, Human
ccaucaugucuggcua

SEQ ID NO: 3318734 - RNA, 23 nt, Human
ccauagagagcaagacgcugugc

SEQ ID NO: 3318735 - RNA, 15 nt, Human
ccauauucuguuggc

SEQ ID NO: 3318736 - RNA, 19 nt, Human
ccauauuaccacagacaua

SEQ ID NO: 3318737 - RNA, 18 nt, Human
ccauauucuguuggccag

SEQ ID NO: 3318738 - RNA, 12 nt, Human
ccaucacccgcu

SEQ ID NO: 3318739 - RNA, 13 nt, Human
ccaucaccagaca

SEQ ID NO: 3318740 - RNA, 23 nt, Human
ccagggacagaggggguggccuc

SEQ ID NO: 3318741 - RNA, 22 nt, Human
ccagggacagaggggguggccu

SEQ ID NO: 3318742 - RNA, 19 nt, Human
ccaggccccugccacccug

SEQ ID NO: 3318743 - RNA, 21 nt, Human
ccaggccccugccacccuggg

SEQ ID NO: 3318744 - RNA, 23 nt, Human
ccaggccccugccacccugggga

SEQ ID NO: 3318745 - RNA, 14 nt, Human
ccaggccagaggga

SEQ ID NO: 3318746 - RNA, 21 nt, Human
ccaggccagagggagugacag

SEQ ID NO: 3318747 - RNA, 14 nt, Human
ccaggagcagccac

SEQ ID NO: 3318748 - RNA, 12 nt, Human
ccaggccagagg

SEQ ID NO: 3318749 - RNA, 19 nt, Human
ccaggccuccuacagcuug

SEQ ID NO: 3318750 - RNA, 18 nt, Human
ccaggccuccuacagcuu

SEQ ID NO: 3318751 - RNA, 13 nt, Human
ccaggccuccuac

SEQ ID NO: 3318752 - RNA, 19 nt, Human
ccaggcccucugcccacuc

SEQ ID NO: 3318753 - RNA, 18 nt, Human
ccaggcccucugcccacu

SEQ ID NO: 3318754 - RNA, 17 nt, Human
ccaggcccucugcccac

SEQ ID NO: 3318755 - RNA, 16 nt, Human
ccaggcccucugccca

SEQ ID NO: 3318756 - RNA, 22 nt, Human
ccagcugugcucuggacaggca

SEQ ID NO: 3318757 - RNA, 23 nt, Human
ccagcugugcucuggacaggcau

SEQ ID NO: 3318758 - RNA, 19 nt, Human
ccaggaagccagcaggcuc

SEQ ID NO: 3318759 - RNA, 17 nt, Human
ccaggaagccagcaggc

SEQ ID NO: 3318760 - RNA, 15 nt, Human
ccaggaagccagcag

SEQ ID NO: 3318761 - RNA, 14 nt, Human
ccaggaagccagca

SEQ ID NO: 3318762 - RNA, 13 nt, Human
ccaggagcagcca

SEQ ID NO: 3318763 - RNA, 12 nt, Human
ccaggagcagcc

SEQ ID NO: 3318764 - RNA, 18 nt, Human
ccagcugugcucuggaca

SEQ ID NO: 3318765 - RNA, 20 nt, Human
ccagcugugcucuggacagg

SEQ ID NO: 3318766 - RNA, 21 nt, Human
ccagcugugcucuggacaggc

SEQ ID NO: 3318767 - RNA, 15 nt, Human
ccagcugcuugggcu

SEQ ID NO: 3318768 - RNA, 13 nt, Human
ccagcugcuuggg

SEQ ID NO: 3318769 - RNA, 18 nt, Human
ccagcugcuugggcuuca

SEQ ID NO: 3318770 - RNA, 16 nt, Human
ccagcugcuugggcuu

SEQ ID NO: 3318771 - RNA, 13 nt, Human
ccaagcucccagg

SEQ ID NO: 3318772 - RNA, 12 nt, Human
ccaagcucccag

SEQ ID NO: 3318773 - RNA, 14 nt, Human
ccaagcaggacaug

SEQ ID NO: 3318774 - RNA, 23 nt, Human
ccaagcagagguugggaggccau

SEQ ID NO: 3318775 - RNA, 13 nt, Human
ccacaagagccca

SEQ ID NO: 3318776 - RNA, 16 nt, Human
ccacaagacccuugug

SEQ ID NO: 3318777 - RNA, 18 nt, Human
ccacaaaggagagcuagc

SEQ ID NO: 3318778 - RNA, 18 nt, Human
ccaaggugggaggauugc

SEQ ID NO: 3318779 - RNA, 14 nt, Human
ccaaggcuggggga

SEQ ID NO: 3318780 - RNA, 21 nt, Human
ccacaagagcccaggccuccu

SEQ ID NO: 3318781 - RNA, 20 nt, Human
ccacaagagcccaggccucc

SEQ ID NO: 3318782 - RNA, 19 nt, Human
ccacaagagcccaggccuc

SEQ ID NO: 3318783 - RNA, 18 nt, Human
ccacaagagcccaggccu

SEQ ID NO: 3318784 - RNA, 17 nt, Human
ccacaagagcccaggcc

SEQ ID NO: 3318785 - RNA, 16 nt, Human
ccacaagagcccaggc

SEQ ID NO: 3318786 - RNA, 15 nt, Human
ccacaaguuaaauaa

SEQ ID NO: 3318787 - RNA, 20 nt, Human
ccacaaguuaaauaaaucau

SEQ ID NO: 3318788 - RNA, 13 nt, Human
ccaacaucaacau

SEQ ID NO: 3318789 - RNA, 14 nt, Human
ccaacauacuccca

SEQ ID NO: 3318790 - RNA, 16 nt, Human
ccaacaucaacaucuu

SEQ ID NO: 3318791 - RNA, 15 nt, Human
ccaaauucuuucagu

SEQ ID NO: 3318792 - RNA, 22 nt, Human
ccaaauucuuucaguggcuacc

SEQ ID NO: 3318793 - RNA, 15 nt, Human
ccaagaccuucuccu

SEQ ID NO: 3318794 - RNA, 15 nt, Human
ccaacccucaucacc

SEQ ID NO: 3318795 - RNA, 13 nt, Human
ccaacccucauca

SEQ ID NO: 3318796 - RNA, 13 nt, Human
ccaaagaugcagc

SEQ ID NO: 3318797 - RNA, 14 nt, Human
ccaaagaugcagcc

SEQ ID NO: 3318798 - RNA, 20 nt, Human
cauuuuuaguagagacaggg

SEQ ID NO: 3318799 - RNA, 21 nt, Human
ccaaaauaaaacuuuuuaaaa

SEQ ID NO: 3318800 - RNA, 18 nt, Human
ccaaaauaaaacuuuuua

SEQ ID NO: 3318801 - RNA, 16 nt, Human
ccaaacccuucagugc

SEQ ID NO: 3318802 - RNA, 19 nt, Human
cauuuuauuuuauuaugca

SEQ ID NO: 3318803 - RNA, 21 nt, Human
cauuuuauuuuauuaugcaug

SEQ ID NO: 3318804 - RNA, 20 nt, Human
cauuuugggguacccacugc

SEQ ID NO: 3318805 - RNA, 21 nt, Human
cauuuugggguacccacugcu

SEQ ID NO: 3318806 - RNA, 22 nt, Human
cauuuugggguacccacugcuc

SEQ ID NO: 3318807 - RNA, 24 nt, Human
cauuuugcuaaaugugaaugauga

SEQ ID NO: 3318808 - RNA, 21 nt, Human
cauuuugcuaaaugugaauga

SEQ ID NO: 3318809 - RNA, 18 nt, Human
cauuuugcuaaaugugaa

SEQ ID NO: 3318810 - RNA, 19 nt, Human
cauuuuuaguagagacagg

SEQ ID NO: 3318811 - RNA, 18 nt, Human
cauuuuuaguagagacag

SEQ ID NO: 3318812 - RNA, 20 nt, Human
cauuuuuaagugcugcauuu

SEQ ID NO: 3318813 - RNA, 15 nt, Human
cauuuuuaagugcug

SEQ ID NO: 3318814 - RNA, 23 nt, Human
cauuuugggguacccacugcucu

SEQ ID NO: 3318815 - RNA, 14 nt, Human
cauuugagcagggc

SEQ ID NO: 3318816 - RNA, 19 nt, Human
cauuugaggucuguucuuu

SEQ ID NO: 3318817 - RNA, 18 nt, Human
cauuugaggucuguucuu

SEQ ID NO: 3318818 - RNA, 17 nt, Human
cauuugaggucuguucu

SEQ ID NO: 3318819 - RNA, 23 nt, Human
cauuucuuccacaagagcccagg

SEQ ID NO: 3318820 - RNA, 21 nt, Human
cauuucuuccacaagagccca

SEQ ID NO: 3318821 - RNA, 17 nt, Human
cauuuacuuuguguuca

SEQ ID NO: 3318822 - RNA, 21 nt, Human
cauuuacuuuguguucaccuu

SEQ ID NO: 3318823 - RNA, 21 nt, Human
cauuuaaaagauacaguuacu

SEQ ID NO: 3318824 - RNA, 19 nt, Human
cauugaaaucuuuuugcuu

SEQ ID NO: 3318825 - RNA, 22 nt, Human
cauugaccugaggcccuucucu

SEQ ID NO: 3318826 - RNA, 13 nt, Human
cauugaccugagg

SEQ ID NO: 3318827 - RNA, 15 nt, Human
cauguuuuguuuacg

SEQ ID NO: 3318828 - RNA, 21 nt, Human
cauuaaagccugaguuugcuu

SEQ ID NO: 3318829 - RNA, 21 nt, Human
caugugccagguuuuuggucu

SEQ ID NO: 3318830 - RNA, 15 nt, Human
caugugcacaugcac

SEQ ID NO: 3318831 - RNA, 15 nt, Human
cauguuugugauuga

SEQ ID NO: 3318832 - RNA, 16 nt, Human
cauggucggaaaacau

SEQ ID NO: 3318833 - RNA, 18 nt, Human
cauguaauuaaguacuau

SEQ ID NO: 3318834 - RNA, 21 nt, Human
cauguaauuaaguacuaugua

SEQ ID NO: 3318835 - RNA, 23 nt, Human
caugucuuuucuugcaugaggcu

SEQ ID NO: 3318836 - RNA, 21 nt, Human
caugucuuuucuugcaugagg

SEQ ID NO: 3318837 - RNA, 19 nt, Human
caugucuuuucuugcauga

SEQ ID NO: 3318838 - RNA, 14 nt, Human
caugucuuuucuug

SEQ ID NO: 3318839 - RNA, 22 nt, Human
caugggaaugaaugucagugug

SEQ ID NO: 3318840 - RNA, 15 nt, Human
caugggccuccugug

SEQ ID NO: 3318841 - RNA, 17 nt, Human
caugggaaugaauguca

SEQ ID NO: 3318842 - RNA, 16 nt, Human
caugggccuccugugu

SEQ ID NO: 3318843 - RNA, 17 nt, Human
caugggccuccugugug

SEQ ID NO: 3318844 - RNA, 18 nt, Human
caugggaaugaaugucag

SEQ ID NO: 3318845 - RNA, 16 nt, Human
cauggaguauauguca

SEQ ID NO: 3318846 - RNA, 13 nt, Human
cauggacuuuguu

SEQ ID NO: 3318847 - RNA, 11 nt, Human
cauggacuuug

SEQ ID NO: 3318848 - RNA, 17 nt, Human
cauggagguuugaagau

SEQ ID NO: 3318849 - RNA, 22 nt, Human
caugcugucccuuacgugaguc

SEQ ID NO: 3318850 - RNA, 17 nt, Human
caugcugucccuuacgu

SEQ ID NO: 3318851 - RNA, 17 nt, Human
caugcgggcuuccuccu

SEQ ID NO: 3318852 - RNA, 23 nt, Human
caugccuggauggggcugcaccg

SEQ ID NO: 3318853 - RNA, 21 nt, Human
caugccuggauggggcugcac

SEQ ID NO: 3318854 - RNA, 18 nt, Human
caugccuggauggggcug

SEQ ID NO: 3318855 - RNA, 22 nt, Human
cauggaaguacuauaauuuacc

SEQ ID NO: 3318856 - RNA, 20 nt, Human
cauggaaguacuauaauuua

SEQ ID NO: 3318857 - RNA, 16 nt, Human
cauggaauaacaugua

SEQ ID NO: 3318858 - RNA, 13 nt, Human
caugccuggaugg

SEQ ID NO: 3318859 - RNA, 19 nt, Human
caugccucucucaggccaa

SEQ ID NO: 3318860 - RNA, 18 nt, Human
caugccucucucaggcca

SEQ ID NO: 3318861 - RNA, 17 nt, Human
caugccucucucaggcc

SEQ ID NO: 3318862 - RNA, 16 nt, Human
caugccucucucaggc

SEQ ID NO: 3318863 - RNA, 15 nt, Human
caugccucucucagg

SEQ ID NO: 3318864 - RNA, 14 nt, Human
caugccucucucag

SEQ ID NO: 3318865 - RNA, 13 nt, Human
caugccccugaac

SEQ ID NO: 3318866 - RNA, 20 nt, Human
caugccagcuuaucucaggg

SEQ ID NO: 3318867 - RNA, 19 nt, Human
caugccagcuuaucucagg

SEQ ID NO: 3318868 - RNA, 21 nt, Human
cauacccacccccacccaagg

SEQ ID NO: 3318869 - RNA, 18 nt, Human
cauacccacccccaccca

SEQ ID NO: 3318870 - RNA, 17 nt, Human
cauacccacccccaccc

SEQ ID NO: 3318871 - RNA, 14 nt, Human
cauacccaccccca

SEQ ID NO: 3318872 - RNA, 13 nt, Human
cauacguacacau

SEQ ID NO: 3318873 - RNA, 16 nt, Human
cauacguacacauuuu

SEQ ID NO: 3318874 - RNA, 15 nt, Human
cauacguacacauuu

SEQ ID NO: 3318875 - RNA, 21 nt, Human
cauacuaaccagcagaaaugc

SEQ ID NO: 3318876 - RNA, 14 nt, Human
cauacuaaccagca

SEQ ID NO: 3318877 - RNA, 18 nt, Human
cauacguacacauuuuau

SEQ ID NO: 3318878 - RNA, 17 nt, Human
cauacguacacauuuua

SEQ ID NO: 3318879 - RNA, 19 nt, Human
cauaccacuuuuguucuug

SEQ ID NO: 3318880 - RNA, 12 nt, Human
cauacccacccc

SEQ ID NO: 3318881 - RNA, 11 nt, Human
cauacccaccc

SEQ ID NO: 3318882 - RNA, 18 nt, Human
cauaccacuuuuguucuu

SEQ ID NO: 3318883 - RNA, 15 nt, Human
cauaccacuuuuguu

SEQ ID NO: 3318884 - RNA, 14 nt, Human
cauaccacuuuugu

SEQ ID NO: 3318885 - RNA, 13 nt, Human
cauaccacuuuug

SEQ ID NO: 3318886 - RNA, 14 nt, Human
cauaagauaaaugu

SEQ ID NO: 3318887 - RNA, 21 nt, Human
cauaaaaauuagccaagugug

SEQ ID NO: 3318888 - RNA, 22 nt, Human
cauaaacaagaccacguuucua

SEQ ID NO: 3318889 - RNA, 21 nt, Human
cauaaacaagaccacguuucu

SEQ ID NO: 3318890 - RNA, 20 nt, Human
cauaaacaagaccacguuuc

SEQ ID NO: 3318891 - RNA, 16 nt, Human
cauaaccuagccuuag

SEQ ID NO: 3318892 - RNA, 17 nt, Human
caguuguuagugugucu

SEQ ID NO: 3318893 - RNA, 18 nt, Human
caguuggucccccuucca

SEQ ID NO: 3318894 - RNA, 18 nt, Human
caguuggguggaugccug

SEQ ID NO: 3318895 - RNA, 19 nt, Human
caguuggguggaugccugg

SEQ ID NO: 3318896 - RNA, 22 nt, Human
caguuggucccccuuccaugga

SEQ ID NO: 3318897 - RNA, 21 nt, Human
caguuggucccccuuccaugg

SEQ ID NO: 3318898 - RNA, 20 nt, Human
caguuggucccccuuccaug

SEQ ID NO: 3318899 - RNA, 19 nt, Human
caguuggucccccuuccau

SEQ ID NO: 3318900 - RNA, 16 nt, Human
caguuggguggaugcc

SEQ ID NO: 3318901 - RNA, 23 nt, Human
caguugccagucaccccggccac

SEQ ID NO: 3318902 - RNA, 16 nt, Human
caguguacauggaaua

SEQ ID NO: 3318903 - RNA, 20 nt, Human
caguguacauggaauaacau

SEQ ID NO: 3318904 - RNA, 23 nt, Human
caguguacauggaauaacaugua

SEQ ID NO: 3318905 - RNA, 14 nt, Human
cagugugacaagga

SEQ ID NO: 3318906 - RNA, 12 nt, Human
cagugugacuga

SEQ ID NO: 3318907 - RNA, 22 nt, Human
cagugguuccuaauccucuagg

SEQ ID NO: 3318908 - RNA, 22 nt, Human
caguggugguuuucuguucuuu

SEQ ID NO: 3318909 - RNA, 12 nt, Human
caguggcagcug

SEQ ID NO: 3318910 - RNA, 13 nt, Human
caguggcagcugc

SEQ ID NO: 3318911 - RNA, 14 nt, Human
caguggcagcugcu

SEQ ID NO: 3318912 - RNA, 15 nt, Human
caguggcagcugcuu

SEQ ID NO: 3318913 - RNA, 16 nt, Human
caguggcagcugcuuu

SEQ ID NO: 3318914 - RNA, 14 nt, Human
caguuaagagaaau

SEQ ID NO: 3318915 - RNA, 13 nt, Human
caguuaagagaaa

SEQ ID NO: 3318916 - RNA, 22 nt, Human
caguguuguggauuuaacagaa

SEQ ID NO: 3318917 - RNA, 20 nt, Human
caguguuguggauuuaacag

SEQ ID NO: 3318918 - RNA, 19 nt, Human
caguguuguggauuuaaca

SEQ ID NO: 3318919 - RNA, 13 nt, Human
caguucucuccuu

SEQ ID NO: 3318920 - RNA, 15 nt, Human
caguucucuccuucu

SEQ ID NO: 3318921 - RNA, 14 nt, Human
caguucucuccuuc

SEQ ID NO: 3318922 - RNA, 22 nt, Human
caguucucuccuucuucccccc

SEQ ID NO: 3318923 - RNA, 19 nt, Human
caguugaaaaacagcugag

SEQ ID NO: 3318924 - RNA, 18 nt, Human
caguugaaaaacagcuga

SEQ ID NO: 3318925 - RNA, 12 nt, Human
caguugaaaaac

SEQ ID NO: 3318926 - RNA, 14 nt, Human
caucaagaugugac

SEQ ID NO: 3318927 - RNA, 14 nt, Human
cauauuuacuucuu

SEQ ID NO: 3318928 - RNA, 16 nt, Human
cauauuuacuucuuau

SEQ ID NO: 3318929 - RNA, 17 nt, Human
cauauuuacuucuuaua

SEQ ID NO: 3318930 - RNA, 20 nt, Human
cauauuuacuucuuauacau

SEQ ID NO: 3318931 - RNA, 22 nt, Human
cauauauauguuuuaagaggca

SEQ ID NO: 3318932 - RNA, 22 nt, Human
cauaguggcuuaaaacaacacu

SEQ ID NO: 3318933 - RNA, 20 nt, Human
cauaguaugguggcuggguu

SEQ ID NO: 3318934 - RNA, 18 nt, Human
cauaguaugguggcuggg

SEQ ID NO: 3318935 - RNA, 19 nt, Human
cauaguaugguggcugggu

SEQ ID NO: 3318936 - RNA, 17 nt, Human
cauaguaugguggcugg

SEQ ID NO: 3318937 - RNA, 11 nt, Human
cauacucugcu

SEQ ID NO: 3318938 - RNA, 20 nt, Human
cauacucccaucugugaaag

SEQ ID NO: 3318939 - RNA, 18 nt, Human
cauacucccaucugugaa

SEQ ID NO: 3318940 - RNA, 15 nt, Human
cauacucccaucugu

SEQ ID NO: 3318941 - RNA, 16 nt, Human
cauacucccaucugug

SEQ ID NO: 3318942 - RNA, 21 nt, Human
cauagagagcaagacgcugug

SEQ ID NO: 3318943 - RNA, 19 nt, Human
cauagagagcaagacgcug

SEQ ID NO: 3318944 - RNA, 23 nt, Human
cauagagagcaagacgcugugcu

SEQ ID NO: 3318945 - RNA, 16 nt, Human
cauccucauacccacc

SEQ ID NO: 3318946 - RNA, 15 nt, Human
cauccucauacccac

SEQ ID NO: 3318947 - RNA, 12 nt, Human
cauccuccucag

SEQ ID NO: 3318948 - RNA, 11 nt, Human
cauccuccuca

SEQ ID NO: 3318949 - RNA, 19 nt, Human
cauccuccucagaucuucu

SEQ ID NO: 3318950 - RNA, 18 nt, Human
cauccuccucagaucuuc

SEQ ID NO: 3318951 - RNA, 16 nt, Human
cauccuccucagaucu

SEQ ID NO: 3318952 - RNA, 15 nt, Human
cauccuccucagauc

SEQ ID NO: 3318953 - RNA, 22 nt, Human
cauccucauacccacccccacc

SEQ ID NO: 3318954 - RNA, 21 nt, Human
cauccucauacccacccccac

SEQ ID NO: 3318955 - RNA, 18 nt, Human
cauccucauacccacccc

SEQ ID NO: 3318956 - RNA, 17 nt, Human
cauccucauacccaccc

SEQ ID NO: 3318957 - RNA, 13 nt, Human
cauccucccaagg

SEQ ID NO: 3318958 - RNA, 15 nt, Human
caucuacccuccgau

SEQ ID NO: 3318959 - RNA, 19 nt, Human
cauccucuguacagagccc

SEQ ID NO: 3318960 - RNA, 18 nt, Human
cauccucuguacagagcc

SEQ ID NO: 3318961 - RNA, 15 nt, Human
cauccucuguacaga

SEQ ID NO: 3318962 - RNA, 17 nt, Human
caucucacacaugagca

SEQ ID NO: 3318963 - RNA, 16 nt, Human
caucucacacaugagc

SEQ ID NO: 3318964 - RNA, 20 nt, Human
caucucacacaugagcauca

SEQ ID NO: 3318965 - RNA, 22 nt, Human
caucuuccaaggguacuaagga

SEQ ID NO: 3318966 - RNA, 13 nt, Human
caucuugcucugc

SEQ ID NO: 3318967 - RNA, 14 nt, Human
caucuugcucugcu

SEQ ID NO: 3318968 - RNA, 19 nt, Human
caucuugcucugcugacag

SEQ ID NO: 3318969 - RNA, 20 nt, Human
caucuugcucugcugacaga

SEQ ID NO: 3318970 - RNA, 13 nt, Human
caucccugaaggc

SEQ ID NO: 3318971 - RNA, 11 nt, Human
caucccugaag

SEQ ID NO: 3318972 - RNA, 19 nt, Human
caucccucuggggcuguuc

SEQ ID NO: 3318973 - RNA, 15 nt, Human
caucccucuggggcu

SEQ ID NO: 3318974 - RNA, 15 nt, Human
cauccagguucagcu

SEQ ID NO: 3318975 - RNA, 15 nt, Human
caucaccaacgucug

SEQ ID NO: 3318976 - RNA, 13 nt, Human
caucauugaaauc

SEQ ID NO: 3318977 - RNA, 21 nt, Human
caucauugaaaucuuuuugcu

SEQ ID NO: 3318978 - RNA, 20 nt, Human
caucauugaaaucuuuuugc

SEQ ID NO: 3318979 - RNA, 15 nt, Human
caucauugaaaucuu

SEQ ID NO: 3318980 - RNA, 14 nt, Human
caucauugaaaucu

SEQ ID NO: 3318981 - RNA, 21 nt, Human
caucccugaaggccccgccca

SEQ ID NO: 3318982 - RNA, 19 nt, Human
caucccugaaggccccgcc

SEQ ID NO: 3318983 - RNA, 18 nt, Human
caucccugaaggccccgc

SEQ ID NO: 3318984 - RNA, 17 nt, Human
caucccugaaggccccg

SEQ ID NO: 3318985 - RNA, 20 nt, Human
gccaugaggaacaaggcaag

SEQ ID NO: 3318986 - RNA, 14 nt, Human
gccaugcuccuggc

SEQ ID NO: 3318987 - RNA, 21 nt, Human
gccagucaccccggccaccug

SEQ ID NO: 3318988 - RNA, 12 nt, Human
gccaguaaaugg

SEQ ID NO: 3318989 - RNA, 23 nt, Human
gccaguaaaugggggugcauuug

SEQ ID NO: 3318990 - RNA, 13 nt, Human
gccaggcuggucu

SEQ ID NO: 3318991 - RNA, 15 nt, Human
gccaugggccuccug

SEQ ID NO: 3318992 - RNA, 16 nt, Human
gccaugggccuccugu

SEQ ID NO: 3318993 - RNA, 16 nt, Human
gcccaccuggccucug

SEQ ID NO: 3318994 - RNA, 15 nt, Human
gcccaccuggccucu

SEQ ID NO: 3318995 - RNA, 24 nt, Human
gcccaccuggccucugcacucccc

SEQ ID NO: 3318996 - RNA, 21 nt, Human
gcccaccuggccucugcacuc

SEQ ID NO: 3318997 - RNA, 20 nt, Human
gcccaccuggccucugcacu

SEQ ID NO: 3318998 - RNA, 17 nt, Human
gcccaccuggccucugc

SEQ ID NO: 3318999 - RNA, 13 nt, Human
gcccaccuuggcu

SEQ ID NO: 3319000 - RNA, 15 nt, Human
gcccaccuuggcuca

SEQ ID NO: 3319001 - RNA, 16 nt, Human
gcccaccuuggcucaa

SEQ ID NO: 3319002 - RNA, 14 nt, Human
gcccacuucugcca

SEQ ID NO: 3319003 - RNA, 19 nt, Human
gccagauucuuuccugagg

SEQ ID NO: 3319004 - RNA, 21 nt, Human
gccagccgagauagccaaggc

SEQ ID NO: 3319005 - RNA, 22 nt, Human
gccagccgagauagccaaggcc

SEQ ID NO: 3319006 - RNA, 20 nt, Human
gccagauucuuuccugaggc

SEQ ID NO: 3319007 - RNA, 13 nt, Human
gccagauuucacu

SEQ ID NO: 3319008 - RNA, 24 nt, Human
gccagauucuuuccugaggcuggg

SEQ ID NO: 3319009 - RNA, 14 nt, Human
gccagaugcaccag

SEQ ID NO: 3319010 - RNA, 22 nt, Human
gccagaggagagaggacccccu

SEQ ID NO: 3319011 - RNA, 20 nt, Human
gccacugcaccgggccacag

SEQ ID NO: 3319012 - RNA, 21 nt, Human
gccacugcaccgggccacaga

SEQ ID NO: 3319013 - RNA, 19 nt, Human
gccacugcaccgggccaca

SEQ ID NO: 3319014 - RNA, 22 nt, Human
gccagagacacaagccuucggc

SEQ ID NO: 3319015 - RNA, 20 nt, Human
gccagagacacaagccuucg

SEQ ID NO: 3319016 - RNA, 21 nt, Human
gccagagacacaagccuucgg

SEQ ID NO: 3319017 - RNA, 20 nt, Human
gccaaggccaaaggaagcac

SEQ ID NO: 3319018 - RNA, 19 nt, Human
gccaaggccaaaggaagca

SEQ ID NO: 3319019 - RNA, 24 nt, Human
gccaaggccaaaggaagcacaugc

SEQ ID NO: 3319020 - RNA, 16 nt, Human
gccagcugcuugggcu

SEQ ID NO: 3319021 - RNA, 18 nt, Human
gccagcugcuugggcuuc

SEQ ID NO: 3319022 - RNA, 17 nt, Human
gccagcugcuugggcuu

SEQ ID NO: 3319023 - RNA, 14 nt, Human
gccaggaagccagc

SEQ ID NO: 3319024 - RNA, 13 nt, Human
gccaggaagccag

SEQ ID NO: 3319025 - RNA, 12 nt, Human
gccaggaagcca

SEQ ID NO: 3319026 - RNA, 20 nt, Human
gccagcugcuugggcuucau

SEQ ID NO: 3319027 - RNA, 11 nt, Human
gccaggaagcc

SEQ ID NO: 3319028 - RNA, 20 nt, Human
gccaggaagccagcaggcuc

SEQ ID NO: 3319029 - RNA, 20 nt, Human
gccaggagccuccugcccuu

SEQ ID NO: 3319030 - RNA, 19 nt, Human
gccaggagccuccugcccu

SEQ ID NO: 3319031 - RNA, 16 nt, Human
gccaggagccuccugc

SEQ ID NO: 3319032 - RNA, 14 nt, Human
gccaggagccuccu

SEQ ID NO: 3319033 - RNA, 21 nt, Human
gcccuccaagaccuucuccuu

SEQ ID NO: 3319034 - RNA, 19 nt, Human
gcccuccaagaccuucucc

SEQ ID NO: 3319035 - RNA, 23 nt, Human
gcccuccaagaccuucuccuuca

SEQ ID NO: 3319036 - RNA, 22 nt, Human
gcccuccaagaccuucuccuuc

SEQ ID NO: 3319037 - RNA, 18 nt, Human
gcccucugcccacucccu

SEQ ID NO: 3319038 - RNA, 16 nt, Human
gcccucugcccacucc

SEQ ID NO: 3319039 - RNA, 13 nt, Human
gcccucugcccac

SEQ ID NO: 3319040 - RNA, 13 nt, Human
gcccugcagaggg

SEQ ID NO: 3319041 - RNA, 14 nt, Human
gcccugcagagggc

SEQ ID NO: 3319042 - RNA, 15 nt, Human
gcccugcagagggca

SEQ ID NO: 3319043 - RNA, 16 nt, Human
gccccucagggucccu

SEQ ID NO: 3319044 - RNA, 23 nt, Human
gccccucaacucuccuccagagu

SEQ ID NO: 3319045 - RNA, 18 nt, Human
gccccgaggccuucucug

SEQ ID NO: 3319046 - RNA, 14 nt, Human
gccccucagggucc

SEQ ID NO: 3319047 - RNA, 15 nt, Human
gccccgaggccuucu

SEQ ID NO: 3319048 - RNA, 20 nt, Human
gccccuucugacccaugcug

SEQ ID NO: 3319049 - RNA, 14 nt, Human
gccccauucugccu

SEQ ID NO: 3319050 - RNA, 22 nt, Human
gccccauccucuguacagagcc

SEQ ID NO: 3319051 - RNA, 14 nt, Human
gccccauccucugu

SEQ ID NO: 3319052 - RNA, 13 nt, Human
gccccauccucug

SEQ ID NO: 3319053 - RNA, 21 nt, Human
gccccagugcccacaggauca

SEQ ID NO: 3319054 - RNA, 13 nt, Human
gccccagugccca

SEQ ID NO: 3319055 - RNA, 14 nt, Human
gccccagugcccac

SEQ ID NO: 3319056 - RNA, 18 nt, Human
gccccaucccaaacccuu

SEQ ID NO: 3319057 - RNA, 12 nt, Human
gccccagugccc

SEQ ID NO: 3319058 - RNA, 22 nt, Human
gcccaguuggguggaugccugg

SEQ ID NO: 3319059 - RNA, 15 nt, Human
gcccagagagggugg

SEQ ID NO: 3319060 - RNA, 21 nt, Human
gcccagagaggguggugaccu

SEQ ID NO: 3319061 - RNA, 23 nt, Human
gcccaggccccugccacccuggg

SEQ ID NO: 3319062 - RNA, 22 nt, Human
gcccaggccccugccacccugg

SEQ ID NO: 3319063 - RNA, 12 nt, Human
gcccaggcuggc

SEQ ID NO: 3319064 - RNA, 21 nt, Human
gccgggcgcgguggcucacgc

SEQ ID NO: 3319065 - RNA, 12 nt, Human
gccgcagcccug

SEQ ID NO: 3319066 - RNA, 11 nt, Human
gccgcagcccu

SEQ ID NO: 3319067 - RNA, 20 nt, Human
gccgagaucacgccacugca

SEQ ID NO: 3319068 - RNA, 21 nt, Human
gccgagaucacgccacugcac

SEQ ID NO: 3319069 - RNA, 22 nt, Human
gccgagaucacgccacugcacu

SEQ ID NO: 3319070 - RNA, 19 nt, Human
gccgagaucacgccacugc

SEQ ID NO: 3319071 - RNA, 17 nt, Human
gcccuucucuccagccc

SEQ ID NO: 3319072 - RNA, 16 nt, Human
gcccuucucuccagcc

SEQ ID NO: 3319073 - RNA, 14 nt, Human
gcccuucucuccag

SEQ ID NO: 3319074 - RNA, 17 nt, Human
gccgucuaccugagggg

SEQ ID NO: 3319075 - RNA, 16 nt, Human
gccgucuaccugaggg

SEQ ID NO: 3319076 - RNA, 15 nt, Human
gccgucuaccugagg

SEQ ID NO: 3319077 - RNA, 20 nt, Human
gccguguaaccauggaccca

SEQ ID NO: 3319078 - RNA, 18 nt, Human
gccucaaccuccugggcu

SEQ ID NO: 3319079 - RNA, 19 nt, Human
gccucaaccuccugggcua

SEQ ID NO: 3319080 - RNA, 17 nt, Human
gccucacaguccuuacc

SEQ ID NO: 3319081 - RNA, 13 nt, Human
gccucacaguccu

SEQ ID NO: 3319082 - RNA, 17 nt, Human
gccucaaccuccugggc

SEQ ID NO: 3319083 - RNA, 14 nt, Human
gccucucucaggcc

SEQ ID NO: 3319084 - RNA, 13 nt, Human
gccucucucaggc

SEQ ID NO: 3319085 - RNA, 17 nt, Human
gccucugacacacagcu

SEQ ID NO: 3319086 - RNA, 18 nt, Human
gccucugacacacagcuc

SEQ ID NO: 3319087 - RNA, 16 nt, Human
gccucugacacacagc

SEQ ID NO: 3319088 - RNA, 16 nt, Human
gccucucucaggccaa

SEQ ID NO: 3319089 - RNA, 19 nt, Human
gccucugacacacagcucu

SEQ ID NO: 3319090 - RNA, 20 nt, Human
gccucugacacacagcucug

SEQ ID NO: 3319091 - RNA, 21 nt, Human
gccucugacacacagcucugu

SEQ ID NO: 3319092 - RNA, 14 nt, Human
gccucugcacuccc

SEQ ID NO: 3319093 - RNA, 12 nt, Human
gccucugccucu

SEQ ID NO: 3319094 - RNA, 13 nt, Human
gccucugccucug

SEQ ID NO: 3319095 - RNA, 15 nt, Human
gccugcaagggagug

SEQ ID NO: 3319096 - RNA, 13 nt, Human
gccugcaagggag

SEQ ID NO: 3319097 - RNA, 18 nt, Human
gccucccgaguagcuggg

SEQ ID NO: 3319098 - RNA, 19 nt, Human
gccucccgaguagcuggga

SEQ ID NO: 3319099 - RNA, 17 nt, Human
gccucccgaguagcugg

SEQ ID NO: 3319100 - RNA, 18 nt, Human
gccucacaguccuuacca

SEQ ID NO: 3319101 - RNA, 15 nt, Human
gccucagcauccugg

SEQ ID NO: 3319102 - RNA, 16 nt, Human
gccucagcauccuggc

SEQ ID NO: 3319103 - RNA, 18 nt, Human
gccucccaaagugcuggg

SEQ ID NO: 3319104 - RNA, 19 nt, Human
gccucccaaagugcuggga

SEQ ID NO: 3319105 - RNA, 13 nt, Human
gccucccaacuca

SEQ ID NO: 3319106 - RNA, 16 nt, Human
gccucccaucacccgc

SEQ ID NO: 3319107 - RNA, 14 nt, Human
gccucccaucaccc

SEQ ID NO: 3319108 - RNA, 19 nt, Human
gccucccaacucaccccag

SEQ ID NO: 3319109 - RNA, 18 nt, Human
gccucccaacucacccca

SEQ ID NO: 3319110 - RNA, 17 nt, Human
gccucccaacucacccc

SEQ ID NO: 3319111 - RNA, 16 nt, Human
gccucccaacucaccc

SEQ ID NO: 3319112 - RNA, 16 nt, Human
gcuaccuuuguauucu

SEQ ID NO: 3319113 - RNA, 15 nt, Human
gcuaggaacacuccu

SEQ ID NO: 3319114 - RNA, 20 nt, Human
gcuaagagggagggagggcu

SEQ ID NO: 3319115 - RNA, 20 nt, Human
gcuacacacugcauguuugu

SEQ ID NO: 3319116 - RNA, 13 nt, Human
gcuacacacugca

SEQ ID NO: 3319117 - RNA, 14 nt, Human
gcuacacaggggaa

SEQ ID NO: 3319118 - RNA, 13 nt, Human
gcuaagagggagg

SEQ ID NO: 3319119 - RNA, 15 nt, Human
gcgccuacaggagug

SEQ ID NO: 3319120 - RNA, 11 nt, Human
gcggacagcca

SEQ ID NO: 3319121 - RNA, 13 nt, Human
gcggacagccacg

SEQ ID NO: 3319122 - RNA, 19 nt, Human
gcggaaugaaccacaucuu

SEQ ID NO: 3319123 - RNA, 15 nt, Human
gcggacagccacggc

SEQ ID NO: 3319124 - RNA, 19 nt, Human
gcgucucauacucaccuca

SEQ ID NO: 3319125 - RNA, 23 nt, Human
gcgacaaugcaaaccaucauuga

SEQ ID NO: 3319126 - RNA, 16 nt, Human
gccuuccagggguggg

SEQ ID NO: 3319127 - RNA, 15 nt, Human
gccuuccaggggugg

SEQ ID NO: 3319128 - RNA, 12 nt, Human
gccuuccagggg

SEQ ID NO: 3319129 - RNA, 19 nt, Human
gccuuauggaacacucuga

SEQ ID NO: 3319130 - RNA, 18 nt, Human
gccuuauggaacacucug

SEQ ID NO: 3319131 - RNA, 16 nt, Human
gccuuauggaacacuc

SEQ ID NO: 3319132 - RNA, 14 nt, Human
gccuuauggaacac

SEQ ID NO: 3319133 - RNA, 10 nt, Human
gccuuaugga

SEQ ID NO: 3319134 - RNA, 19 nt, Human
gccuuagaagucacacagu

SEQ ID NO: 3319135 - RNA, 17 nt, Human
gccuuagaagucacaca

SEQ ID NO: 3319136 - RNA, 18 nt, Human
gccuuagaagucacacag

SEQ ID NO: 3319137 - RNA, 21 nt, Human
gccuuacacaaugguuuucuu

SEQ ID NO: 3319138 - RNA, 18 nt, Human
gccuuacccucauguucu

SEQ ID NO: 3319139 - RNA, 20 nt, Human
gccuuacacaaugguuuucu

SEQ ID NO: 3319140 - RNA, 16 nt, Human
gccuuacacaaugguu

SEQ ID NO: 3319141 - RNA, 21 nt, Human
gccuguugggccaggagccuc

SEQ ID NO: 3319142 - RNA, 22 nt, Human
gccugggggcugggcagaggaa

SEQ ID NO: 3319143 - RNA, 21 nt, Human
gccugggggcugggcagagga

SEQ ID NO: 3319144 - RNA, 18 nt, Human
gccugguggcagcugcgg

SEQ ID NO: 3319145 - RNA, 19 nt, Human
gccugguggcagcugcggu

SEQ ID NO: 3319146 - RNA, 21 nt, Human
gccugguggcagcugcggucc

SEQ ID NO: 3319147 - RNA, 13 nt, Human
gccugguggcagc

SEQ ID NO: 3319148 - RNA, 21 nt, Human
gcagccccuguucuggcagag

SEQ ID NO: 3319149 - RNA, 20 nt, Human
gcagccccuguucuggcaga

SEQ ID NO: 3319150 - RNA, 13 nt, Human
gcagcccugcaga

SEQ ID NO: 3319151 - RNA, 17 nt, Human
gcagccccauucugccu

SEQ ID NO: 3319152 - RNA, 23 nt, Human
gcagcaauaaagcagcguuucua

SEQ ID NO: 3319153 - RNA, 16 nt, Human
gcagcaauaaagcagc

SEQ ID NO: 3319154 - RNA, 18 nt, Human
gcagccccauucugccug

SEQ ID NO: 3319155 - RNA, 19 nt, Human
gcagccccauucugccugc

SEQ ID NO: 3319156 - RNA, 21 nt, Human
gcagccccauucugccugccc

SEQ ID NO: 3319157 - RNA, 24 nt, Human
gcagccccauucugccugcccagg

SEQ ID NO: 3319158 - RNA, 20 nt, Human
gcagaguugaagacagagcu

SEQ ID NO: 3319159 - RNA, 21 nt, Human
gcagaguugaagacagagcua

SEQ ID NO: 3319160 - RNA, 17 nt, Human
gcagacaguuaagagaa

SEQ ID NO: 3319161 - RNA, 22 nt, Human
gcagauacaggaaaagcugcug

SEQ ID NO: 3319162 - RNA, 12 nt, Human
gcagcaauaaag

SEQ ID NO: 3319163 - RNA, 12 nt, Human
gcaggcagccag

SEQ ID NO: 3319164 - RNA, 14 nt, Human
gcaggcagccaggc

SEQ ID NO: 3319165 - RNA, 13 nt, Human
gcaggcagccagg

SEQ ID NO: 3319166 - RNA, 20 nt, Human
gcaggaggaucacuugaguc

SEQ ID NO: 3319167 - RNA, 23 nt, Human
gcaggaggaucacuugaguccag

SEQ ID NO: 3319168 - RNA, 14 nt, Human
gcagcucaccucuc

SEQ ID NO: 3319169 - RNA, 15 nt, Human
gcagccuuggcaaac

SEQ ID NO: 3319170 - RNA, 15 nt, Human
gcagcucaccucucc

SEQ ID NO: 3319171 - RNA, 17 nt, Human
gcagcccugcagagggc

SEQ ID NO: 3319172 - RNA, 16 nt, Human
gcagcccugcagaggg

SEQ ID NO: 3319173 - RNA, 15 nt, Human
gcagcccugcagagg

SEQ ID NO: 3319174 - RNA, 14 nt, Human
gcagcccugcagag

SEQ ID NO: 3319175 - RNA, 23 nt, Human
gcagacaggcaagcaccuccugc

SEQ ID NO: 3319176 - RNA, 19 nt, Human
gcagacaggcaagcaccuc

SEQ ID NO: 3319177 - RNA, 14 nt, Human
gcagacaggcaagc

SEQ ID NO: 3319178 - RNA, 15 nt, Human
gcagacaggaccagg

SEQ ID NO: 3319179 - RNA, 13 nt, Human
gcagacaggacca

SEQ ID NO: 3319180 - RNA, 12 nt, Human
gcagacaggacc

SEQ ID NO: 3319181 - RNA, 15 nt, Human
gcacugcuuccagug

SEQ ID NO: 3319182 - RNA, 20 nt, Human
gcacugcuuccagugaggcu

SEQ ID NO: 3319183 - RNA, 18 nt, Human
gcacugcuuccagugagg

SEQ ID NO: 3319184 - RNA, 16 nt, Human
gcacugcuuccaguga

SEQ ID NO: 3319185 - RNA, 14 nt, Human
gcaauggcagccuu

SEQ ID NO: 3319186 - RNA, 20 nt, Human
gcaccacugcacuccagccu

SEQ ID NO: 3319187 - RNA, 12 nt, Human
gcaauggcagcc

SEQ ID NO: 3319188 - RNA, 13 nt, Human
gcaauggcagccu

SEQ ID NO: 3319189 - RNA, 14 nt, Human
gcaccagcagccug

SEQ ID NO: 3319190 - RNA, 15 nt, Human
gcaccagcagccugg

SEQ ID NO: 3319191 - RNA, 22 nt, Human
gcaccacugcacuccagccugg

SEQ ID NO: 3319192 - RNA, 21 nt, Human
gcaccacugcacuccagccug

SEQ ID NO: 3319193 - RNA, 16 nt, Human
gcaccagcagccugga

SEQ ID NO: 3319194 - RNA, 22 nt, Human
gcacccaccaucaugucuggcu

SEQ ID NO: 3319195 - RNA, 18 nt, Human
gcacccggccccugcugg

SEQ ID NO: 3319196 - RNA, 19 nt, Human
gcacccggccccugcuggu

SEQ ID NO: 3319197 - RNA, 17 nt, Human
gcaccuuagacaguccc

SEQ ID NO: 3319198 - RNA, 14 nt, Human
gcaccuuagacagu

SEQ ID NO: 3319199 - RNA, 22 nt, Human
gcaccuggaauauauaaccagu

SEQ ID NO: 3319200 - RNA, 15 nt, Human
gcacccucaggcagg

SEQ ID NO: 3319201 - RNA, 21 nt, Human
gcaccuggaauauauaaccag

SEQ ID NO: 3319202 - RNA, 18 nt, Human
gcaccuggaauauauaac

SEQ ID NO: 3319203 - RNA, 18 nt, Human
gcaccuuagacagucccu

SEQ ID NO: 3319204 - RNA, 12 nt, Human
gcacgauuucug

SEQ ID NO: 3319205 - RNA, 17 nt, Human
gcauuaucuagauacug

SEQ ID NO: 3319206 - RNA, 13 nt, Human
gcauuugcugaau

SEQ ID NO: 3319207 - RNA, 21 nt, Human
gcauuugaggucuguucuuuc

SEQ ID NO: 3319208 - RNA, 14 nt, Human
gcauuugcugaaua

SEQ ID NO: 3319209 - RNA, 16 nt, Human
gcauuuguuugaacug

SEQ ID NO: 3319210 - RNA, 13 nt, Human
gccaaagccaaag

SEQ ID NO: 3319211 - RNA, 20 nt, Human
gccaaagccaaagcuaggcc

SEQ ID NO: 3319212 - RNA, 19 nt, Human
gccaaagccuccuccagcc

SEQ ID NO: 3319213 - RNA, 16 nt, Human
gccaaagccuccucca

SEQ ID NO: 3319214 - RNA, 16 nt, Human
gccaaagcuaggccug

SEQ ID NO: 3319215 - RNA, 22 nt, Human
gccaaagcuaggccuggccaga

SEQ ID NO: 3319216 - RNA, 18 nt, Human
gcauuuguuugaacugau

SEQ ID NO: 3319217 - RNA, 16 nt, Human
gccaaacucaccugcc

SEQ ID NO: 3319218 - RNA, 14 nt, Human
gccaaacucaccug

SEQ ID NO: 3319219 - RNA, 15 nt, Human
gcauguucucugagg

SEQ ID NO: 3319220 - RNA, 21 nt, Human
gcauguucucugaggacacua

SEQ ID NO: 3319221 - RNA, 14 nt, Human
gcauguucucugag

SEQ ID NO: 3319222 - RNA, 18 nt, Human
gcaugcgggcuuccuccu

SEQ ID NO: 3319223 - RNA, 22 nt, Human
gcaggggaggguagagcggaga

SEQ ID NO: 3319224 - RNA, 14 nt, Human
gcagggcucagcgg

SEQ ID NO: 3319225 - RNA, 17 nt, Human
gcagggucucacucugu

SEQ ID NO: 3319226 - RNA, 18 nt, Human
gcagggucucacucuguc

SEQ ID NO: 3319227 - RNA, 19 nt, Human
gcagggcucagcggggaca

SEQ ID NO: 3319228 - RNA, 21 nt, Human
gcagggcucagcggggacagc

SEQ ID NO: 3319229 - RNA, 16 nt, Human
gcaggcagccaggcca

SEQ ID NO: 3319230 - RNA, 15 nt, Human
gcaggcagccaggcc

SEQ ID NO: 3319231 - RNA, 15 nt, Human
gcagugcaugcuguc

SEQ ID NO: 3319232 - RNA, 16 nt, Human
gcagugcaugcugucc

SEQ ID NO: 3319233 - RNA, 22 nt, Human
gcagguccaggguuugaguuca

SEQ ID NO: 3319234 - RNA, 19 nt, Human
gcaggucuugaacuccugg

SEQ ID NO: 3319235 - RNA, 20 nt, Human
gcaggucuugaacuccuggc

SEQ ID NO: 3319236 - RNA, 17 nt, Human
gcaguuauuaacacuaa

SEQ ID NO: 3319237 - RNA, 23 nt, Human
gcaguggugguuuucuguucuuu

SEQ ID NO: 3319238 - RNA, 22 nt, Human
gcaguggugguuuucuguucuu

SEQ ID NO: 3319239 - RNA, 13 nt, Human
gcagugggagcug

SEQ ID NO: 3319240 - RNA, 12 nt, Human
gcagugggagcu

SEQ ID NO: 3319241 - RNA, 14 nt, Human
gcagugggagcugc

SEQ ID NO: 3319242 - RNA, 19 nt, Human
gauuucuguuuagauaaua

SEQ ID NO: 3319243 - RNA, 11 nt, Human
gauuucuguuu

SEQ ID NO: 3319244 - RNA, 15 nt, Human
gauuuccguuaaaau

SEQ ID NO: 3319245 - RNA, 18 nt, Human
gauugcaacaggcugggc

SEQ ID NO: 3319246 - RNA, 21 nt, Human
gauugcaacaggcugggcuuc

SEQ ID NO: 3319247 - RNA, 23 nt, Human
gauugcaccacugcacuccagcc

SEQ ID NO: 3319248 - RNA, 16 nt, Human
gauugcaccacugcac

SEQ ID NO: 3319249 - RNA, 20 nt, Human
gauugcaacaggcugggcuu

SEQ ID NO: 3319250 - RNA, 18 nt, Human
gauucuuuccugaggcug

SEQ ID NO: 3319251 - RNA, 17 nt, Human
gauucuuuccugaggcu

SEQ ID NO: 3319252 - RNA, 16 nt, Human
gauucuuuccugaggc

SEQ ID NO: 3319253 - RNA, 12 nt, Human
gauucuuuccug

SEQ ID NO: 3319254 - RNA, 19 nt, Human
gauucccaagcucugcucc

SEQ ID NO: 3319255 - RNA, 20 nt, Human
gauucccaagcucugcuccu

SEQ ID NO: 3319256 - RNA, 18 nt, Human
gauucagacagcugccug

SEQ ID NO: 3319257 - RNA, 19 nt, Human
gauucagacagcugccugg

SEQ ID NO: 3319258 - RNA, 15 nt, Human
gauucagcucugcaa

SEQ ID NO: 3319259 - RNA, 13 nt, Human
gauucagcucugc

SEQ ID NO: 3319260 - RNA, 19 nt, Human
gauggggcugcaccggcug

SEQ ID NO: 3319261 - RNA, 23 nt, Human
gauggggcugcaccggcuggccu

SEQ ID NO: 3319262 - RNA, 17 nt, Human
gauucauauuuacuucu

SEQ ID NO: 3319263 - RNA, 18 nt, Human
gauucauauuuacuucuu

SEQ ID NO: 3319264 - RNA, 19 nt, Human
gauucauauuuacuucuua

SEQ ID NO: 3319265 - RNA, 18 nt, Human
gauucccaagcucugcuc

SEQ ID NO: 3319266 - RNA, 16 nt, Human
gcaaaguaucccuacu

SEQ ID NO: 3319267 - RNA, 23 nt, Human
gcaagacgcugugcugcccugcc

SEQ ID NO: 3319268 - RNA, 22 nt, Human
gcaagacgcugugcugcccugc

SEQ ID NO: 3319269 - RNA, 21 nt, Human
gcaagacgcugugcugcccug

SEQ ID NO: 3319270 - RNA, 20 nt, Human
gcaagacgcugugcugcccu

SEQ ID NO: 3319271 - RNA, 14 nt, Human
gcaagacgcugugc

SEQ ID NO: 3319272 - RNA, 17 nt, Human
gcaagaauugaagcagg

SEQ ID NO: 3319273 - RNA, 18 nt, Human
gcaaggagauuuacaacu

SEQ ID NO: 3319274 - RNA, 11 nt, Human
gcaaggcuguc

SEQ ID NO: 3319275 - RNA, 23 nt, Human
gcaaugaccuuucaauaggaaaa

SEQ ID NO: 3319276 - RNA, 13 nt, Human
gcaaugcuggcug

SEQ ID NO: 3319277 - RNA, 14 nt, Human
gcaaugcuggcugu

SEQ ID NO: 3319278 - RNA, 22 nt, Human
gcaaugcuggcuguuggcuggg

SEQ ID NO: 3319279 - RNA, 23 nt, Human
gcaaugcuggcuguuggcugggg

SEQ ID NO: 3319280 - RNA, 22 nt, Human
gcaaugaccuuucaauaggaaa

SEQ ID NO: 3319281 - RNA, 20 nt, Human
gcaaugaccuuucaauagga

SEQ ID NO: 3319282 - RNA, 17 nt, Human
gcaaugaccuuucaaua

SEQ ID NO: 3319283 - RNA, 15 nt, Human
gcaaugaccuuucaa

SEQ ID NO: 3319284 - RNA, 17 nt, Human
gcaaucaaaucugcuuu

SEQ ID NO: 3319285 - RNA, 15 nt, Human
gcaaucaaaucugcu

SEQ ID NO: 3319286 - RNA, 13 nt, Human
gauggggcccugc

SEQ ID NO: 3319287 - RNA, 22 nt, Human
gauggggcccugccuccuuugu

SEQ ID NO: 3319288 - RNA, 14 nt, Human
gauggggcccugcc

SEQ ID NO: 3319289 - RNA, 20 nt, Human
gaugccugguggcagcugcg

SEQ ID NO: 3319290 - RNA, 18 nt, Human
gaugccugguggcagcug

SEQ ID NO: 3319291 - RNA, 19 nt, Human
gaugccugguggcagcugc

SEQ ID NO: 3319292 - RNA, 22 nt, Human
gauggauuuccagccaaagccu

SEQ ID NO: 3319293 - RNA, 22 nt, Human
gauggccgggcgcgguggcuca

SEQ ID NO: 3319294 - RNA, 13 nt, Human
gaugcaccagccc

SEQ ID NO: 3319295 - RNA, 22 nt, Human
gaugcacagaguuguuacauuu

SEQ ID NO: 3319296 - RNA, 21 nt, Human
gaugcacagaguuguuacauu

SEQ ID NO: 3319297 - RNA, 17 nt, Human
gaugccugguggcagcu

SEQ ID NO: 3319298 - RNA, 12 nt, Human
gaugcagccuca

SEQ ID NO: 3319299 - RNA, 14 nt, Human
gaugcagccucaca

SEQ ID NO: 3319300 - RNA, 18 nt, Human
gaucuuugcagacaggca

SEQ ID NO: 3319301 - RNA, 17 nt, Human
gaucuuugcagacaggc

SEQ ID NO: 3319302 - RNA, 16 nt, Human
gaucccucauccucau

SEQ ID NO: 3319303 - RNA, 15 nt, Human
gaucccucauccuca

SEQ ID NO: 3319304 - RNA, 22 nt, Human
gauccugagccagauuucacuc

SEQ ID NO: 3319305 - RNA, 21 nt, Human
gauccugagccagauuucacu

SEQ ID NO: 3319306 - RNA, 20 nt, Human
gaggaaggaaacccagcucu

SEQ ID NO: 3319307 - RNA, 19 nt, Human
gaggaaggaaacccagcuc

SEQ ID NO: 3319308 - RNA, 13 nt, Human
gaggaaggaaacc

SEQ ID NO: 3319309 - RNA, 18 nt, Human
gauacaggaaaagcugcu

SEQ ID NO: 3319310 - RNA, 20 nt, Human
gauagcacagacccugcccu

SEQ ID NO: 3319311 - RNA, 22 nt, Human
gauagcacagacccugcccugu

SEQ ID NO: 3319312 - RNA, 21 nt, Human
gauagcacagacccugcccug

SEQ ID NO: 3319313 - RNA, 22 nt, Human
gauaauacaccacuacauucug

SEQ ID NO: 3319314 - RNA, 21 nt, Human
gauaauacaccacuacauucu

SEQ ID NO: 3319315 - RNA, 18 nt, Human
gauaauacaccacuacau

SEQ ID NO: 3319316 - RNA, 14 nt, Human
gauaauacaccacu

SEQ ID NO: 3319317 - RNA, 17 nt, Human
gaucauccacugugcca

SEQ ID NO: 3319318 - RNA, 19 nt, Human
gaucauccacugugccaug

SEQ ID NO: 3319319 - RNA, 16 nt, Human
gaucauccacugugcc

SEQ ID NO: 3319320 - RNA, 21 nt, Human
gaucauccacugugccaugug

SEQ ID NO: 3319321 - RNA, 16 nt, Human
gaucacgccacugcac

SEQ ID NO: 3319322 - RNA, 18 nt, Human
gaucacgccacugcacua

SEQ ID NO: 3319323 - RNA, 22 nt, Human
gaucagucugauucccaagcuc

SEQ ID NO: 3319324 - RNA, 15 nt, Human
gaucagccugggcaa

SEQ ID NO: 3319325 - RNA, 12 nt, Human
gaucagccuggg

SEQ ID NO: 3319326 - RNA, 21 nt, Human
gagaaugcacaaacagaggcc

SEQ ID NO: 3319327 - RNA, 20 nt, Human
gagaaugcacaaacagaggc

SEQ ID NO: 3319328 - RNA, 17 nt, Human
gagacacaagccuucgg

SEQ ID NO: 3319329 - RNA, 15 nt, Human
gagacacaagccuuc

SEQ ID NO: 3319330 - RNA, 19 nt, Human
gagacagaguuuucacucu

SEQ ID NO: 3319331 - RNA, 12 nt, Human
gagacagcccgg

SEQ ID NO: 3319332 - RNA, 13 nt, Human
gacuuggaagcuc

SEQ ID NO: 3319333 - RNA, 21 nt, Human
gagaaaauggacguguuauga

SEQ ID NO: 3319334 - RNA, 14 nt, Human
gacuuggaagcucc

SEQ ID NO: 3319335 - RNA, 15 nt, Human
gacuuggaagcuccg

SEQ ID NO: 3319336 - RNA, 16 nt, Human
gacuuggaagcuccgc

SEQ ID NO: 3319337 - RNA, 19 nt, Human
gacucgcgacaaugcaaac

SEQ ID NO: 3319338 - RNA, 18 nt, Human
gacucgcgacaaugcaaa

SEQ ID NO: 3319339 - RNA, 17 nt, Human
gacuccugcaggcagcc

SEQ ID NO: 3319340 - RNA, 23 nt, Human
gagaaaguacuucuccacccugc

SEQ ID NO: 3319341 - RNA, 22 nt, Human
gagaaaguacuucuccacccug

SEQ ID NO: 3319342 - RNA, 24 nt, Human
gagacagcccgggcucugccuccc

SEQ ID NO: 3319343 - RNA, 23 nt, Human
gagacagcccgggcucugccucc

SEQ ID NO: 3319344 - RNA, 22 nt, Human
gagacagcccgggcucugccuc

SEQ ID NO: 3319345 - RNA, 21 nt, Human
gagacagcccgggcucugccu

SEQ ID NO: 3319346 - RNA, 20 nt, Human
gagacagcccgggcucugcc

SEQ ID NO: 3319347 - RNA, 19 nt, Human
gagacagcccgggcucugc

SEQ ID NO: 3319348 - RNA, 18 nt, Human
gagacagcccgggcucug

SEQ ID NO: 3319349 - RNA, 17 nt, Human
gagacagcccgggcucu

SEQ ID NO: 3319350 - RNA, 14 nt, Human
gagacagcccgggc

SEQ ID NO: 3319351 - RNA, 14 nt, Human
gagacucugucuca

SEQ ID NO: 3319352 - RNA, 13 nt, Human
gagacucugucuc

SEQ ID NO: 3319353 - RNA, 16 nt, Human
gagacucgcgacaaug

SEQ ID NO: 3319354 - RNA, 22 nt, Human
gagacuccugcaggcagccagg

SEQ ID NO: 3319355 - RNA, 13 nt, Human
gagagccuuccag

SEQ ID NO: 3319356 - RNA, 13 nt, Human
gagaggggaacag

SEQ ID NO: 3319357 - RNA, 21 nt, Human
gagagggugggagugggccca

SEQ ID NO: 3319358 - RNA, 20 nt, Human
gagagggugggagugggccc

SEQ ID NO: 3319359 - RNA, 17 nt, Human
gagagaagagaaugcac

SEQ ID NO: 3319360 - RNA, 15 nt, Human
gagcugaguggggga

SEQ ID NO: 3319361 - RNA, 15 nt, Human
gagccugcaguuauu

SEQ ID NO: 3319362 - RNA, 17 nt, Human
gagcuagcagcagggag

SEQ ID NO: 3319363 - RNA, 15 nt, Human
gagcuagcagcaggg

SEQ ID NO: 3319364 - RNA, 14 nt, Human
gaggaacaaggcaa

SEQ ID NO: 3319365 - RNA, 16 nt, Human
gaggaacaaggcaagg

SEQ ID NO: 3319366 - RNA, 17 nt, Human
gaggaagagaaaaaaua

SEQ ID NO: 3319367 - RNA, 13 nt, Human
gaggaagccgcug

SEQ ID NO: 3319368 - RNA, 17 nt, Human
gaggaagccgcuggggc

SEQ ID NO: 3319369 - RNA, 14 nt, Human
gaggaagccgcugg

SEQ ID NO: 3319370 - RNA, 18 nt, Human
gaggaagccgcuggggcc

SEQ ID NO: 3319371 - RNA, 17 nt, Human
gaggaaagcaaaggaga

SEQ ID NO: 3319372 - RNA, 16 nt, Human
gaggaaagcaaaggag

SEQ ID NO: 3319373 - RNA, 22 nt, Human
gagcuuucugcuaucaaagagg

SEQ ID NO: 3319374 - RNA, 20 nt, Human
gagcuuugaaaauucagugg

SEQ ID NO: 3319375 - RNA, 12 nt, Human
gagccugcaguu

SEQ ID NO: 3319376 - RNA, 17 nt, Human
gagccucagcauccugg

SEQ ID NO: 3319377 - RNA, 14 nt, Human
gagccucagcaucc

SEQ ID NO: 3319378 - RNA, 15 nt, Human
gagccucagcauccu

SEQ ID NO: 3319379 - RNA, 13 nt, Human
gagccucagcauc

SEQ ID NO: 3319380 - RNA, 21 nt, Human
gagccgagaucacgccacugc

SEQ ID NO: 3319381 - RNA, 22 nt, Human
gagccgagaucacgccacugca

SEQ ID NO: 3319382 - RNA, 19 nt, Human
gagccgagaucacgccacu

SEQ ID NO: 3319383 - RNA, 20 nt, Human
gagccgagaucacgccacug

SEQ ID NO: 3319384 - RNA, 18 nt, Human
gagcccacgcccccacug

SEQ ID NO: 3319385 - RNA, 21 nt, Human
gagauagccaaggccaaagga

SEQ ID NO: 3319386 - RNA, 20 nt, Human
gagauagccaaggccaaagg

SEQ ID NO: 3319387 - RNA, 19 nt, Human
gagauagccaaggccaaag

SEQ ID NO: 3319388 - RNA, 16 nt, Human
gagcagagaccauccc

SEQ ID NO: 3319389 - RNA, 18 nt, Human
gagcagagaccaucccug

SEQ ID NO: 3319390 - RNA, 17 nt, Human
gagcagagaccaucccu

SEQ ID NO: 3319391 - RNA, 23 nt, Human
gagcagagaccaucccugaaggc

SEQ ID NO: 3319392 - RNA, 21 nt, Human
gagcagagaccaucccugaag

SEQ ID NO: 3319393 - RNA, 19 nt, Human
gagcagagaccaucccuga

SEQ ID NO: 3319394 - RNA, 21 nt, Human
gagcagccacauuccugaugc

SEQ ID NO: 3319395 - RNA, 22 nt, Human
gagcagccacauuccugaugcu

SEQ ID NO: 3319396 - RNA, 13 nt, Human
gagccagauuuca

SEQ ID NO: 3319397 - RNA, 13 nt, Human
gagcccaccuugg

SEQ ID NO: 3319398 - RNA, 15 nt, Human
gagcccaccuuggcu

SEQ ID NO: 3319399 - RNA, 17 nt, Human
gagcccaccuuggcuca

SEQ ID NO: 3319400 - RNA, 18 nt, Human
gagccacugcaccgggcc

SEQ ID NO: 3319401 - RNA, 19 nt, Human
gagccacugcaccgggcca

SEQ ID NO: 3319402 - RNA, 13 nt, Human
gagccacugcacc

SEQ ID NO: 3319403 - RNA, 15 nt, Human
gagccagauuucacu

SEQ ID NO: 3319404 - RNA, 19 nt, Human
gagccagauuucacucucc

SEQ ID NO: 3319405 - RNA, 18 nt, Human
gagccagauuucacucuc

SEQ ID NO: 3319406 - RNA, 11 nt, Human
gacccacugcu

SEQ ID NO: 3319407 - RNA, 13 nt, Human
gacccaugcugcc

SEQ ID NO: 3319408 - RNA, 15 nt, Human
gacccaugcugcccu

SEQ ID NO: 3319409 - RNA, 14 nt, Human
gacccaugcugccc

SEQ ID NO: 3319410 - RNA, 16 nt, Human
gacccaugcugcccug

SEQ ID NO: 3319411 - RNA, 18 nt, Human
gacccugaggcccagagg

SEQ ID NO: 3319412 - RNA, 21 nt, Human
gacccugaggcccagagggcc

SEQ ID NO: 3319413 - RNA, 12 nt, Human
gacccugcccug

SEQ ID NO: 3319414 - RNA, 20 nt, Human
gacccugaggcccagagggc

SEQ ID NO: 3319415 - RNA, 19 nt, Human
gacccugaggcccagaggg

SEQ ID NO: 3319416 - RNA, 15 nt, Human
gacccugcccugugg

SEQ ID NO: 3319417 - RNA, 13 nt, Human
gacccugcccugu

SEQ ID NO: 3319418 - RNA, 16 nt, Human
gacccugcccuguggg

SEQ ID NO: 3319419 - RNA, 23 nt, Human
gacccugucucaaaaaaagaaaa

SEQ ID NO: 3319420 - RNA, 21 nt, Human
gaccugaggcccuucucucca

SEQ ID NO: 3319421 - RNA, 18 nt, Human
gaccugaggcccuucucu

SEQ ID NO: 3319422 - RNA, 15 nt, Human
gaccugaggcccuuc

SEQ ID NO: 3319423 - RNA, 14 nt, Human
gaccugaggcccuu

SEQ ID NO: 3319424 - RNA, 12 nt, Human
gaccucaggccu

SEQ ID NO: 3319425 - RNA, 11 nt, Human
gaccucaggcc

SEQ ID NO: 3319426 - RNA, 19 nt, Human
gaccgugaggccagagaca

SEQ ID NO: 3319427 - RNA, 14 nt, Human
gaccgugaggccag

SEQ ID NO: 3319428 - RNA, 21 nt, Human
gaccuuucaauaggaaaaacu

SEQ ID NO: 3319429 - RNA, 20 nt, Human
gaccuuucaauaggaaaaac

SEQ ID NO: 3319430 - RNA, 23 nt, Human
gaccuugaacuggguacuugugg

SEQ ID NO: 3319431 - RNA, 14 nt, Human
gacggagucccacc

SEQ ID NO: 3319432 - RNA, 18 nt, Human
gacggagucccaccuugg

SEQ ID NO: 3319433 - RNA, 21 nt, Human
gacggagucccaccuuggcug

SEQ ID NO: 3319434 - RNA, 20 nt, Human
gacguguuaugacuccagaa

SEQ ID NO: 3319435 - RNA, 17 nt, Human
gacguguuaugacucca

SEQ ID NO: 3319436 - RNA, 15 nt, Human
gacguguuaugacuc

SEQ ID NO: 3319437 - RNA, 14 nt, Human
gacuccugcaggca

SEQ ID NO: 3319438 - RNA, 16 nt, Human
gacuccugcaggcagc

SEQ ID NO: 3319439 - RNA, 15 nt, Human
gacuccugcaggcag

SEQ ID NO: 3319440 - RNA, 22 nt, Human
gacguguuaugacuccagaauu

SEQ ID NO: 3319441 - RNA, 17 nt, Human
gacuacucccccaggug

SEQ ID NO: 3319442 - RNA, 23 nt, Human
gacacccugugauggggcccugc

SEQ ID NO: 3319443 - RNA, 22 nt, Human
gacacccugugauggggcccug

SEQ ID NO: 3319444 - RNA, 13 nt, Human
gacacccugugau

SEQ ID NO: 3319445 - RNA, 12 nt, Human
gacacccuguga

SEQ ID NO: 3319446 - RNA, 18 nt, Human
gacacaggcccggcucca

SEQ ID NO: 3319447 - RNA, 15 nt, Human
gacacgaauauugcu

SEQ ID NO: 3319448 - RNA, 18 nt, Human
gacaccuugacagggcac

SEQ ID NO: 3319449 - RNA, 20 nt, Human
gacaccuugacagggcacac

SEQ ID NO: 3319450 - RNA, 15 nt, Human
gacaccuugacaggg

SEQ ID NO: 3319451 - RNA, 17 nt, Human
gacaccuugacagggca

SEQ ID NO: 3319452 - RNA, 19 nt, Human
gacacgaauauugcugaug

SEQ ID NO: 3319453 - RNA, 18 nt, Human
gacacgaauauugcugau

SEQ ID NO: 3319454 - RNA, 17 nt, Human
gacacgaauauugcuga

SEQ ID NO: 3319455 - RNA, 15 nt, Human
gacacuaaccacgcu

SEQ ID NO: 3319456 - RNA, 16 nt, Human
gacacuaaccacgcug

SEQ ID NO: 3319457 - RNA, 17 nt, Human
gacacuaaccacgcugg

SEQ ID NO: 3319458 - RNA, 18 nt, Human
gacacuaaccacgcugga

SEQ ID NO: 3319459 - RNA, 14 nt, Human
gaagucuuuguaca

SEQ ID NO: 3319460 - RNA, 16 nt, Human
gaagucuuuguacaga

SEQ ID NO: 3319461 - RNA, 21 nt, Human
gacaaggauugcuacuguccu

SEQ ID NO: 3319462 - RNA, 22 nt, Human
gacaaggauugcuacuguccua

SEQ ID NO: 3319463 - RNA, 16 nt, Human
gacaaugacccagugg

SEQ ID NO: 3319464 - RNA, 12 nt, Human
gacacaggcccg

SEQ ID NO: 3319465 - RNA, 15 nt, Human
gacacaggcccggcu

SEQ ID NO: 3319466 - RNA, 17 nt, Human
gacacaggcccggcucc

SEQ ID NO: 3319467 - RNA, 22 nt, Human
gacacaagccuucggcgccuua

SEQ ID NO: 3319468 - RNA, 19 nt, Human
gacaauuuauuauggcaca

SEQ ID NO: 3319469 - RNA, 13 nt, Human
gacaauuuauuau

SEQ ID NO: 3319470 - RNA, 12 nt, Human
gacaauuuauua

SEQ ID NO: 3319471 - RNA, 18 nt, Human
gacaaugcaaaccaucau

SEQ ID NO: 3319472 - RNA, 16 nt, Human
gacaaugcaaaccauc

SEQ ID NO: 3319473 - RNA, 12 nt, Human
gacaaugcaaac

SEQ ID NO: 3319474 - RNA, 21 nt, Human
gacaaugacuuacuguacaug

SEQ ID NO: 3319475 - RNA, 20 nt, Human
gacaaugacuuacuguacau

SEQ ID NO: 3319476 - RNA, 17 nt, Human
gacaaugacuuacugua

SEQ ID NO: 3319477 - RNA, 21 nt, Human
gacaugucuuuucuugcauga

SEQ ID NO: 3319478 - RNA, 17 nt, Human
gacaugucuuuucuugc

SEQ ID NO: 3319479 - RNA, 16 nt, Human
gacauacuaaccagca

SEQ ID NO: 3319480 - RNA, 15 nt, Human
gacauacuaaccagc

SEQ ID NO: 3319481 - RNA, 21 nt, Human
gacaggcaagcaccuccugcc

SEQ ID NO: 3319482 - RNA, 14 nt, Human
gacaggcaaugcug

SEQ ID NO: 3319483 - RNA, 16 nt, Human
gacaggcaaugcuggc

SEQ ID NO: 3319484 - RNA, 24 nt, Human
gacaggcaaugcuggcuguuggcu

SEQ ID NO: 3319485 - RNA, 17 nt, Human
gacaggcaaugcuggcu

SEQ ID NO: 3319486 - RNA, 18 nt, Human
gacaggcauguucucuga

SEQ ID NO: 3319487 - RNA, 19 nt, Human
gacaggcauguucucugag

SEQ ID NO: 3319488 - RNA, 15 nt, Human
gacagcugccuggga

SEQ ID NO: 3319489 - RNA, 14 nt, Human
gacagcugccuggg

SEQ ID NO: 3319490 - RNA, 21 nt, Human
gacagcugccugggaucccuc

SEQ ID NO: 3319491 - RNA, 12 nt, Human
gacagacacagg

SEQ ID NO: 3319492 - RNA, 14 nt, Human
gacagacacaggcc

SEQ ID NO: 3319493 - RNA, 20 nt, Human
gacacuaaccacgcuggacc

SEQ ID NO: 3319494 - RNA, 15 nt, Human
gacagacacaggccc

SEQ ID NO: 3319495 - RNA, 16 nt, Human
gacagacacaggcccg

SEQ ID NO: 3319496 - RNA, 13 nt, Human
gacagcugccugg

SEQ ID NO: 3319497 - RNA, 12 nt, Human
gacagcugccug

SEQ ID NO: 3319498 - RNA, 17 nt, Human
cuugcaugaggcuagug

SEQ ID NO: 3319499 - RNA, 21 nt, Human
cuugcaugaggcuaguguggu

SEQ ID NO: 3319500 - RNA, 18 nt, Human
cuugcagacucuacagag

SEQ ID NO: 3319501 - RNA, 14 nt, Human
cuugcaauggcagc

SEQ ID NO: 3319502 - RNA, 22 nt, Human
cuugcaaaguaucccuacugua

SEQ ID NO: 3319503 - RNA, 20 nt, Human
cuugaccauucuccaccugc

SEQ ID NO: 3319504 - RNA, 17 nt, Human
cuugaccauucuccacc

SEQ ID NO: 3319505 - RNA, 14 nt, Human
cuugagagggugga

SEQ ID NO: 3319506 - RNA, 19 nt, Human
cuugagccuugaacuuuga

SEQ ID NO: 3319507 - RNA, 22 nt, Human
cuugagccuugaacuuugaccu

SEQ ID NO: 3319508 - RNA, 20 nt, Human
cuugagccuugaacuuugac

SEQ ID NO: 3319509 - RNA, 14 nt, Human
cuugaacuccuggc

SEQ ID NO: 3319510 - RNA, 15 nt, Human
cuugaacuccuggcc

SEQ ID NO: 3319511 - RNA, 17 nt, Human
cuugaacuccuggccuc

SEQ ID NO: 3319512 - RNA, 18 nt, Human
cuugaacuccuggccuca

SEQ ID NO: 3319513 - RNA, 18 nt, Human
cuugaacuggguacuugu

SEQ ID NO: 3319514 - RNA, 20 nt, Human
cuugaacuggguacuugugg

SEQ ID NO: 3319515 - RNA, 15 nt, Human
cuugaacuuugaccu

SEQ ID NO: 3319516 - RNA, 19 nt, Human
cuugaacuccuggccucaa

SEQ ID NO: 3319517 - RNA, 16 nt, Human
cuugaacuggguacuu

SEQ ID NO: 3319518 - RNA, 22 nt, Human
cuucuuuauaauucuacuuuga

SEQ ID NO: 3319519 - RNA, 19 nt, Human
cuugaaauauaggaacuua

SEQ ID NO: 3319520 - RNA, 16 nt, Human
cuuguggacacagcuc

SEQ ID NO: 3319521 - RNA, 17 nt, Human
cuuguggacacagcucu

SEQ ID NO: 3319522 - RNA, 18 nt, Human
cuuguggacacagcucuu

SEQ ID NO: 3319523 - RNA, 20 nt, Human
cuugguuuguaaauuaacuu

SEQ ID NO: 3319524 - RNA, 21 nt, Human
cuuguaaauagcucagguguc

SEQ ID NO: 3319525 - RNA, 16 nt, Human
cuuggggaccagagcu

SEQ ID NO: 3319526 - RNA, 17 nt, Human
cuuggggaccagagcug

SEQ ID NO: 3319527 - RNA, 19 nt, Human
cuuggggaccagagcugcc

SEQ ID NO: 3319528 - RNA, 18 nt, Human
cuuggggaccagagcugc

SEQ ID NO: 3319529 - RNA, 13 nt, Human
cuugcuugcuuuu

SEQ ID NO: 3319530 - RNA, 12 nt, Human
cuuggcugcagg

SEQ ID NO: 3319531 - RNA, 13 nt, Human
cuuggcugcaggg

SEQ ID NO: 3319532 - RNA, 23 nt, Human
cuuggcucaaguccucuuuucug

SEQ ID NO: 3319533 - RNA, 13 nt, Human
cuuggauuguccc

SEQ ID NO: 3319534 - RNA, 20 nt, Human
cuuuccugaggcugggcucc

SEQ ID NO: 3319535 - RNA, 16 nt, Human
cuuuccugaggcuggg

SEQ ID NO: 3319536 - RNA, 17 nt, Human
cuuuccugaggcugggc

SEQ ID NO: 3319537 - RNA, 14 nt, Human
cuuugcagacaggc

SEQ ID NO: 3319538 - RNA, 15 nt, Human
cuuugcagacaggca

SEQ ID NO: 3319539 - RNA, 23 nt, Human
cuuuggaaagaguaggaagacuu

SEQ ID NO: 3319540 - RNA, 19 nt, Human
cuuuggaaagaguaggaag

SEQ ID NO: 3319541 - RNA, 14 nt, Human
cuuuccaggaaggc

SEQ ID NO: 3319542 - RNA, 16 nt, Human
cuuuccaaaguacacu

SEQ ID NO: 3319543 - RNA, 22 nt, Human
cuuuccaaaguacacuguuuca

SEQ ID NO: 3319544 - RNA, 22 nt, Human
cuuuucauuuaggugaggaagc

SEQ ID NO: 3319545 - RNA, 23 nt, Human
cuuuuccaacccucaucaccaac

SEQ ID NO: 3319546 - RNA, 13 nt, Human
cuuuuccaacccu

SEQ ID NO: 3319547 - RNA, 20 nt, Human
cuuuucgcaggauucuuccu

SEQ ID NO: 3319548 - RNA, 21 nt, Human
cuuuucgcaggauucuuccuc

SEQ ID NO: 3319549 - RNA, 17 nt, Human
cuuuuuuauacauaaac

SEQ ID NO: 3319550 - RNA, 16 nt, Human
cuuuuuuauacauaaa

SEQ ID NO: 3319551 - RNA, 15 nt, Human
cuuuuuuauacauaa

SEQ ID NO: 3319552 - RNA, 16 nt, Human
gaaaaagaaaaaauau

SEQ ID NO: 3319553 - RNA, 11 nt, Human
gaaaaagaaaa

SEQ ID NO: 3319554 - RNA, 18 nt, Human
cuuuuuuauacauaaaca

SEQ ID NO: 3319555 - RNA, 22 nt, Human
cuuuuuaauauugauaugcuua

SEQ ID NO: 3319556 - RNA, 13 nt, Human
cuuuucuuuucuu

SEQ ID NO: 3319557 - RNA, 16 nt, Human
cuuuucuuucagccaa

SEQ ID NO: 3319558 - RNA, 17 nt, Human
cuuuucuuucagccaag

SEQ ID NO: 3319559 - RNA, 16 nt, Human
gaaaggaaagaggcuc

SEQ ID NO: 3319560 - RNA, 11 nt, Human
gaaaggaaaga

SEQ ID NO: 3319561 - RNA, 22 nt, Human
gaaaguacuucuccacccugcu

SEQ ID NO: 3319562 - RNA, 16 nt, Human
gaaagaguaggaagac

SEQ ID NO: 3319563 - RNA, 16 nt, Human
gaaagaucaaaagguu

SEQ ID NO: 3319564 - RNA, 16 nt, Human
gaaaaaugagccuggc

SEQ ID NO: 3319565 - RNA, 17 nt, Human
gaacacuccuucacaga

SEQ ID NO: 3319566 - RNA, 20 nt, Human
gaacagacuggaagcacagc

SEQ ID NO: 3319567 - RNA, 19 nt, Human
gaacagacuggaagcacag

SEQ ID NO: 3319568 - RNA, 16 nt, Human
gaacacuccuucacag

SEQ ID NO: 3319569 - RNA, 15 nt, Human
gaacacuccuucaca

SEQ ID NO: 3319570 - RNA, 22 nt, Human
gaacagacuggaagcacagcuu

SEQ ID NO: 3319571 - RNA, 18 nt, Human
gaaauaucugaaaaugua

SEQ ID NO: 3319572 - RNA, 19 nt, Human
gaaauaucugaaaauguau

SEQ ID NO: 3319573 - RNA, 17 nt, Human
gaaauauaggaacuuaa

SEQ ID NO: 3319574 - RNA, 17 nt, Human
gaaauguacagcaagga

SEQ ID NO: 3319575 - RNA, 19 nt, Human
gaaaugggcagagcagaga

SEQ ID NO: 3319576 - RNA, 17 nt, Human
gaaaugggcagagcaga

SEQ ID NO: 3319577 - RNA, 18 nt, Human
gaaaugaggucagagccu

SEQ ID NO: 3319578 - RNA, 11 nt, Human
gaaaugagcug

SEQ ID NO: 3319579 - RNA, 15 nt, Human
gaaaugggcagagca

SEQ ID NO: 3319580 - RNA, 16 nt, Human
gaaaugggcagagcag

SEQ ID NO: 3319581 - RNA, 18 nt, Human
gaaccacaucuugcucug

SEQ ID NO: 3319582 - RNA, 17 nt, Human
gaacuuaaauaauguga

SEQ ID NO: 3319583 - RNA, 14 nt, Human
gaacuuaaauaaug

SEQ ID NO: 3319584 - RNA, 17 nt, Human
gaacuuggcgcugcccc

SEQ ID NO: 3319585 - RNA, 18 nt, Human
gaacuuggcgcugccccu

SEQ ID NO: 3319586 - RNA, 17 nt, Human
gaacuugggccacugug

SEQ ID NO: 3319587 - RNA, 17 nt, Human
gaacuuuccaggaaggc

SEQ ID NO: 3319588 - RNA, 14 nt, Human
gaagaagcucucuc

SEQ ID NO: 3319589 - RNA, 22 nt, Human
gaacuuugaccucugcagcaau

SEQ ID NO: 3319590 - RNA, 16 nt, Human
gaacuuugaccucugc

SEQ ID NO: 3319591 - RNA, 16 nt, Human
gaagacuucaucccuc

SEQ ID NO: 3319592 - RNA, 15 nt, Human
gaagacuucaucccu

SEQ ID NO: 3319593 - RNA, 17 nt, Human
gaagacuucaucccucu

SEQ ID NO: 3319594 - RNA, 12 nt, Human
gaagagccuugc

SEQ ID NO: 3319595 - RNA, 18 nt, Human
gaagcauuuacuuugugu

SEQ ID NO: 3319596 - RNA, 13 nt, Human
gaagggggcuggg

SEQ ID NO: 3319597 - RNA, 18 nt, Human
gaagucuuagauguauau

SEQ ID NO: 3319598 - RNA, 13 nt, Human
gaagucacacagu

SEQ ID NO: 3319599 - RNA, 20 nt, Human
gaaguaauaugcacacauuu

SEQ ID NO: 3319600 - RNA, 19 nt, Human
gaaguaauaugcacacauu

SEQ ID NO: 3319601 - RNA, 20 nt, Human
gaaggaaacccagcucuggu

SEQ ID NO: 3319602 - RNA, 19 nt, Human
gaaggaaacccagcucugg

SEQ ID NO: 3319603 - RNA, 14 nt, Human
gaagccgcuggggc

SEQ ID NO: 3319604 - RNA, 20 nt, Human
gaagccgcuggggccaguug

SEQ ID NO: 3319605 - RNA, 18 nt, Human
gaagccgcuggggccagu

SEQ ID NO: 3319606 - RNA, 19 nt, Human
gaaggacauugcggacagc

SEQ ID NO: 3319607 - RNA, 20 nt, Human
gaaggacauugcggacagcc

SEQ ID NO: 3319608 - RNA, 21 nt, Human
gaaggacauugcggacagcca

SEQ ID NO: 3319609 - RNA, 22 nt, Human
gaaggaaacccagcucuggucc

SEQ ID NO: 3319610 - RNA, 21 nt, Human
gaaggaaacccagcucugguc

SEQ ID NO: 3319611 - RNA, 15 nt, Human
gaaggaacguccccu

SEQ ID NO: 3319612 - RNA, 19 nt, Human
gaaggaagacuucaucccu

SEQ ID NO: 3319613 - RNA, 14 nt, Human
cuggccugugucua

SEQ ID NO: 3319614 - RNA, 17 nt, Human
cuggccuggccccucag

SEQ ID NO: 3319615 - RNA, 16 nt, Human
cuggccuggccccuca

SEQ ID NO: 3319616 - RNA, 16 nt, Human
cuggccugagcuggga

SEQ ID NO: 3319617 - RNA, 14 nt, Human
cuggccucugcacu

SEQ ID NO: 3319618 - RNA, 13 nt, Human
cuggccucugcac

SEQ ID NO: 3319619 - RNA, 13 nt, Human
cuggccuggcccc

SEQ ID NO: 3319620 - RNA, 14 nt, Human
cuggccuggccccu

SEQ ID NO: 3319621 - RNA, 18 nt, Human
cuggccugagcugggaug

SEQ ID NO: 3319622 - RNA, 15 nt, Human
cuggccugagcuggg

SEQ ID NO: 3319623 - RNA, 23 nt, Human
cuggccucaagugauucuccugc

SEQ ID NO: 3319624 - RNA, 12 nt, Human
cuggccucugca

SEQ ID NO: 3319625 - RNA, 22 nt, Human
cuggccucaagugauucuccug

SEQ ID NO: 3319626 - RNA, 16 nt, Human
cuggcacccggccccu

SEQ ID NO: 3319627 - RNA, 17 nt, Human
cuggcacccggccccug

SEQ ID NO: 3319628 - RNA, 18 nt, Human
cuggcacccggccccugc

SEQ ID NO: 3319629 - RNA, 22 nt, Human
cuggcacccggccccugcuggu

SEQ ID NO: 3319630 - RNA, 14 nt, Human
cuggcaagaaugug

SEQ ID NO: 3319631 - RNA, 18 nt, Human
cuggaauauauaaccagu

SEQ ID NO: 3319632 - RNA, 15 nt, Human
cuggcacuauaaugu

SEQ ID NO: 3319633 - RNA, 16 nt, Human
cuggcacuauaaugua

SEQ ID NO: 3319634 - RNA, 22 nt, Human
cuggcaugggaaugaaugucag

SEQ ID NO: 3319635 - RNA, 19 nt, Human
cuggcaugggaaugaaugu

SEQ ID NO: 3319636 - RNA, 18 nt, Human
cuggcaugggaaugaaug

SEQ ID NO: 3319637 - RNA, 16 nt, Human
cuggcaugggaaugaa

SEQ ID NO: 3319638 - RNA, 24 nt, Human
cuggcaugggaaugaaugucagug

SEQ ID NO: 3319639 - RNA, 22 nt, Human
cuggccagaugcaccagcccuu

SEQ ID NO: 3319640 - RNA, 16 nt, Human
cuggcuguuggcuggg

SEQ ID NO: 3319641 - RNA, 17 nt, Human
cuggcuguuggcugggg

SEQ ID NO: 3319642 - RNA, 20 nt, Human
cuggcugguuagagguuccc

SEQ ID NO: 3319643 - RNA, 22 nt, Human
cuggcuggguggcaccagcagc

SEQ ID NO: 3319644 - RNA, 21 nt, Human
cugggagagccuuccaggggu

SEQ ID NO: 3319645 - RNA, 20 nt, Human
cugggagagccuuccagggg

SEQ ID NO: 3319646 - RNA, 19 nt, Human
cugggagagccuuccaggg

SEQ ID NO: 3319647 - RNA, 18 nt, Human
cugggagagccuuccagg

SEQ ID NO: 3319648 - RNA, 17 nt, Human
cugggagagccuuccag

SEQ ID NO: 3319649 - RNA, 22 nt, Human
cugggagaaccaaaaagaggcu

SEQ ID NO: 3319650 - RNA, 21 nt, Human
cugggaggucaaggcugcagu

SEQ ID NO: 3319651 - RNA, 19 nt, Human
cugggaggucaaggcugca

SEQ ID NO: 3319652 - RNA, 17 nt, Human
cugggauuacaggugug

SEQ ID NO: 3319653 - RNA, 20 nt, Human
cugggauuacaggugugaac

SEQ ID NO: 3319654 - RNA, 20 nt, Human
cugggaucccucauccucau

SEQ ID NO: 3319655 - RNA, 18 nt, Human
cugggaugauuggagggg

SEQ ID NO: 3319656 - RNA, 22 nt, Human
cugucucaaaaaaagaaaaaga

SEQ ID NO: 3319657 - RNA, 21 nt, Human
cuguccuacucugugucaggu

SEQ ID NO: 3319658 - RNA, 22 nt, Human
cugucccuuacgugaguccugg

SEQ ID NO: 3319659 - RNA, 16 nt, Human
cuguccuacucugugu

SEQ ID NO: 3319660 - RNA, 17 nt, Human
cuguccuacucuguguc

SEQ ID NO: 3319661 - RNA, 18 nt, Human
cuguccuacucuguguca

SEQ ID NO: 3319662 - RNA, 20 nt, Human
cuguccuacucugugucagg

SEQ ID NO: 3319663 - RNA, 14 nt, Human
cugucccccugaca

SEQ ID NO: 3319664 - RNA, 13 nt, Human
cugucccccugac

SEQ ID NO: 3319665 - RNA, 22 nt, Human
cuguaccucuugagccuugaac

SEQ ID NO: 3319666 - RNA, 14 nt, Human
cuguaucccaugag

SEQ ID NO: 3319667 - RNA, 15 nt, Human
cuguaucccaugagc

SEQ ID NO: 3319668 - RNA, 18 nt, Human
cuguaucccaugagccuc

SEQ ID NO: 3319669 - RNA, 23 nt, Human
cugucauuugagcagggcucagc

SEQ ID NO: 3319670 - RNA, 22 nt, Human
cugucccagugccgagaaggaa

SEQ ID NO: 3319671 - RNA, 17 nt, Human
cuguaauuugugauaca

SEQ ID NO: 3319672 - RNA, 18 nt, Human
cuguaauuugugauacaa

SEQ ID NO: 3319673 - RNA, 23 nt, Human
cuguacagagcccacgcccccac

SEQ ID NO: 3319674 - RNA, 21 nt, Human
cuguaauuugugauacaaugc

SEQ ID NO: 3319675 - RNA, 22 nt, Human
cuguacagagcccacgccccca

SEQ ID NO: 3319676 - RNA, 21 nt, Human
cuguaccucuugagccuugaa

SEQ ID NO: 3319677 - RNA, 23 nt, Human
cuguacaugaaaacacauuuuuc

SEQ ID NO: 3319678 - RNA, 22 nt, Human
cuguacaugaaaacacauuuuu

SEQ ID NO: 3319679 - RNA, 12 nt, Human
cugguggcagcu

SEQ ID NO: 3319680 - RNA, 14 nt, Human
cugguggcagcuca

SEQ ID NO: 3319681 - RNA, 13 nt, Human
cugguggcagcuc

SEQ ID NO: 3319682 - RNA, 20 nt, Human
cugguucaggguuggccccu

SEQ ID NO: 3319683 - RNA, 15 nt, Human
cuggguuggagggug

SEQ ID NO: 3319684 - RNA, 22 nt, Human
cugggcucccuucccaccucuc

SEQ ID NO: 3319685 - RNA, 21 nt, Human
cugggcucccuucccaccucu

SEQ ID NO: 3319686 - RNA, 20 nt, Human
cugggcucccuucccaccuc

SEQ ID NO: 3319687 - RNA, 19 nt, Human
cugggcucccuucccaccu

SEQ ID NO: 3319688 - RNA, 16 nt, Human
cuggguacuuguggac

SEQ ID NO: 3319689 - RNA, 14 nt, Human
cuggguacuugugg

SEQ ID NO: 3319690 - RNA, 18 nt, Human
cuggguacuuguggacac

SEQ ID NO: 3319691 - RNA, 13 nt, Human
cuggucccacuca

SEQ ID NO: 3319692 - RNA, 23 nt, Human
cuggucucaaacucuugaccuca

SEQ ID NO: 3319693 - RNA, 21 nt, Human
cugguccauagagagcaagac

SEQ ID NO: 3319694 - RNA, 13 nt, Human
cugcccggcaggg

SEQ ID NO: 3319695 - RNA, 19 nt, Human
cugccccuggcagccccug

SEQ ID NO: 3319696 - RNA, 17 nt, Human
cugccccuggcagcccc

SEQ ID NO: 3319697 - RNA, 18 nt, Human
cugccccuggcagccccu

SEQ ID NO: 3319698 - RNA, 13 nt, Human
cugcccaggcccc

SEQ ID NO: 3319699 - RNA, 12 nt, Human
cugcccaccugg

SEQ ID NO: 3319700 - RNA, 14 nt, Human
cugcccaggccccu

SEQ ID NO: 3319701 - RNA, 15 nt, Human
cugcccaggccccug

SEQ ID NO: 3319702 - RNA, 15 nt, Human
cugccauuucugaga

SEQ ID NO: 3319703 - RNA, 16 nt, Human
cugcccaggccccugc

SEQ ID NO: 3319704 - RNA, 18 nt, Human
cugcccaggccccugcca

SEQ ID NO: 3319705 - RNA, 19 nt, Human
cugcccaggccccugccac

SEQ ID NO: 3319706 - RNA, 20 nt, Human
cugcccaggccccugccacc

SEQ ID NO: 3319707 - RNA, 22 nt, Human
cugccaggaagccagcaggcuc

SEQ ID NO: 3319708 - RNA, 21 nt, Human
cugccauccagguucagcuug

SEQ ID NO: 3319709 - RNA, 15 nt, Human
cugccauccucccaa

SEQ ID NO: 3319710 - RNA, 19 nt, Human
cugccaggaagccagcagg

SEQ ID NO: 3319711 - RNA, 21 nt, Human
cugccaggaagccagcaggcu

SEQ ID NO: 3319712 - RNA, 20 nt, Human
cugccaggaagccagcaggc

SEQ ID NO: 3319713 - RNA, 14 nt, Human
cugccaggaagcca

SEQ ID NO: 3319714 - RNA, 13 nt, Human
cugccaggaagcc

SEQ ID NO: 3319715 - RNA, 15 nt, Human
cugcauaugaaagga

SEQ ID NO: 3319716 - RNA, 20 nt, Human
cugcaucaagaugugacaug

SEQ ID NO: 3319717 - RNA, 21 nt, Human
cugccacccuggggagaaagu

SEQ ID NO: 3319718 - RNA, 12 nt, Human
cugccacccugg

SEQ ID NO: 3319719 - RNA, 21 nt, Human
cugcacuccccugcugggugu

SEQ ID NO: 3319720 - RNA, 18 nt, Human
cugcacuccccugcuggg

SEQ ID NO: 3319721 - RNA, 13 nt, Human
cugcagagggcac

SEQ ID NO: 3319722 - RNA, 16 nt, Human
cugcagcaauaaagca

SEQ ID NO: 3319723 - RNA, 15 nt, Human
cugcagcaauaaagc

SEQ ID NO: 3319724 - RNA, 10 nt, Human
cugcagaggg

SEQ ID NO: 3319725 - RNA, 14 nt, Human
cugcaccgggccac

SEQ ID NO: 3319726 - RNA, 15 nt, Human
cugcaccgggccaca

SEQ ID NO: 3319727 - RNA, 15 nt, Human
cugcaccggcuggcc

SEQ ID NO: 3319728 - RNA, 14 nt, Human
cugcaccggcuggc

SEQ ID NO: 3319729 - RNA, 23 nt, Human
cugaggcccuucucuccagcccc

SEQ ID NO: 3319730 - RNA, 22 nt, Human
cugaggcccuucucuccagccc

SEQ ID NO: 3319731 - RNA, 20 nt, Human
cugcacuccccugcugggug

SEQ ID NO: 3319732 - RNA, 19 nt, Human
cugcacuccccugcugggu

SEQ ID NO: 3319733 - RNA, 13 nt, Human
cugcacuccccug

SEQ ID NO: 3319734 - RNA, 18 nt, Human
cugcaccgggccacagag

SEQ ID NO: 3319735 - RNA, 19 nt, Human
cugcacuccagccugggug

SEQ ID NO: 3319736 - RNA, 20 nt, Human
cugcacuccagccuggguga

SEQ ID NO: 3319737 - RNA, 16 nt, Human
cugcaguugccaguca

SEQ ID NO: 3319738 - RNA, 13 nt, Human
cugcaguugccag

SEQ ID NO: 3319739 - RNA, 17 nt, Human
cugcagcaauaaagcag

SEQ ID NO: 3319740 - RNA, 13 nt, Human
cugcugcuggcug

SEQ ID NO: 3319741 - RNA, 12 nt, Human
cugcugcuggcu

SEQ ID NO: 3319742 - RNA, 15 nt, Human
cugcuggguguggcg

SEQ ID NO: 3319743 - RNA, 14 nt, Human
cugcuggguguggc

SEQ ID NO: 3319744 - RNA, 17 nt, Human
cugcuggguguggcgca

SEQ ID NO: 3319745 - RNA, 21 nt, Human
cugcuugaggcaacucaucuu

SEQ ID NO: 3319746 - RNA, 20 nt, Human
cugcuugaggcaacucaucu

SEQ ID NO: 3319747 - RNA, 13 nt, Human
cugcuugaggcaa

SEQ ID NO: 3319748 - RNA, 17 nt, Human
cugcuuuuggucugugu

SEQ ID NO: 3319749 - RNA, 15 nt, Human
cugcuuuuggucugu

SEQ ID NO: 3319750 - RNA, 19 nt, Human
cugcuugugaaaggaaaga

SEQ ID NO: 3319751 - RNA, 19 nt, Human
cugcuugggcuucauccuc

SEQ ID NO: 3319752 - RNA, 18 nt, Human
cugcuugggcuucauccu

SEQ ID NO: 3319753 - RNA, 17 nt, Human
cugcuugggcuucaucc

SEQ ID NO: 3319754 - RNA, 15 nt, Human
cugcuugggcuucau

SEQ ID NO: 3319755 - RNA, 13 nt, Human
cugcuugggcuuc

SEQ ID NO: 3319756 - RNA, 20 nt, Human
cugcuugcuugcuuuuuaau

SEQ ID NO: 3319757 - RNA, 22 nt, Human
cugcuugaggcaacucaucuua

SEQ ID NO: 3319758 - RNA, 23 nt, Human
cugcggugcuaucucccccagcc

SEQ ID NO: 3319759 - RNA, 22 nt, Human
cugcggugcuaucucccccagc

SEQ ID NO: 3319760 - RNA, 21 nt, Human
cugcggugcuaucucccccag

SEQ ID NO: 3319761 - RNA, 20 nt, Human
cugcggugcuaucuccccca

SEQ ID NO: 3319762 - RNA, 20 nt, Human
cugcgguccacccaggagcc

SEQ ID NO: 3319763 - RNA, 23 nt, Human
cugcuccucuccccagcaaguga

SEQ ID NO: 3319764 - RNA, 19 nt, Human
cugcuccucuccccagcaa

SEQ ID NO: 3319765 - RNA, 20 nt, Human
cugcuccucuccccagcaag

SEQ ID NO: 3319766 - RNA, 15 nt, Human
cugcucuccgaccag

SEQ ID NO: 3319767 - RNA, 12 nt, Human
cugcucugguua

SEQ ID NO: 3319768 - RNA, 13 nt, Human
cugcugcaguugc

SEQ ID NO: 3319769 - RNA, 10 nt, Human
cugcugcagu

SEQ ID NO: 3319770 - RNA, 14 nt, Human
cugcugcaguugcc

SEQ ID NO: 3319771 - RNA, 19 nt, Human
cugccugaagucacacagu

SEQ ID NO: 3319772 - RNA, 18 nt, Human
cugccugaagucacacag

SEQ ID NO: 3319773 - RNA, 16 nt, Human
cugccugaagucacac

SEQ ID NO: 3319774 - RNA, 21 nt, Human
cugcccugcccaccuggccuc

SEQ ID NO: 3319775 - RNA, 17 nt, Human
cugcccugcccaccugg

SEQ ID NO: 3319776 - RNA, 20 nt, Human
cugcccugcccaccuggccu

SEQ ID NO: 3319777 - RNA, 23 nt, Human
cugcgguccacccaggagccccg

SEQ ID NO: 3319778 - RNA, 19 nt, Human
cugcggugcuaucuccccc

SEQ ID NO: 3319779 - RNA, 18 nt, Human
cugcggugcuaucucccc

SEQ ID NO: 3319780 - RNA, 18 nt, Human
cucacuauguugcccagg

SEQ ID NO: 3319781 - RNA, 17 nt, Human
cucccaaagugcuggga

SEQ ID NO: 3319782 - RNA, 13 nt, Human
cuccaugugggcu

SEQ ID NO: 3319783 - RNA, 22 nt, Human
cucccaacucaccccagcccca

SEQ ID NO: 3319784 - RNA, 18 nt, Human
cucccaaagugcugggau

SEQ ID NO: 3319785 - RNA, 17 nt, Human
cucccaacucaccccag

SEQ ID NO: 3319786 - RNA, 16 nt, Human
cucccaacucacccca

SEQ ID NO: 3319787 - RNA, 23 nt, Human
cucccaucugugaaaggaaagag

SEQ ID NO: 3319788 - RNA, 18 nt, Human
cucccaucugugaaagga

SEQ ID NO: 3319789 - RNA, 15 nt, Human
cucccaucugugaaa

SEQ ID NO: 3319790 - RNA, 14 nt, Human
cucccaucugugaa

SEQ ID NO: 3319791 - RNA, 11 nt, Human
cucccaucugu

SEQ ID NO: 3319792 - RNA, 21 nt, Human
cucccaucucacacaugagca

SEQ ID NO: 3319793 - RNA, 17 nt, Human
cucccgaauagcuggga

SEQ ID NO: 3319794 - RNA, 16 nt, Human
cucccgaauagcuggg

SEQ ID NO: 3319795 - RNA, 13 nt, Human
cuccccugcuggg

SEQ ID NO: 3319796 - RNA, 15 nt, Human
cucccgaguagcugg

SEQ ID NO: 3319797 - RNA, 18 nt, Human
cucccgaauagcugggac

SEQ ID NO: 3319798 - RNA, 16 nt, Human
cucccgaguagcuggg

SEQ ID NO: 3319799 - RNA, 17 nt, Human
cucccgaguagcuggga

SEQ ID NO: 3319800 - RNA, 12 nt, Human
cuccccagcaag

SEQ ID NO: 3319801 - RNA, 20 nt, Human
cuccccagcaagugagagcu

SEQ ID NO: 3319802 - RNA, 20 nt, Human
cuccccagccccaucccaaa

SEQ ID NO: 3319803 - RNA, 12 nt, Human
cuccccugcugg

SEQ ID NO: 3319804 - RNA, 22 nt, Human
cuccucuccccagcaagugaga

SEQ ID NO: 3319805 - RNA, 22 nt, Human
cuccuccagccgccaugcuccu

SEQ ID NO: 3319806 - RNA, 18 nt, Human
cucccucagucuggcccu

SEQ ID NO: 3319807 - RNA, 17 nt, Human
cucccuuucuucccuac

SEQ ID NO: 3319808 - RNA, 20 nt, Human
cuccugcaggcagccaggcc

SEQ ID NO: 3319809 - RNA, 18 nt, Human
cuccugcaggcagccagg

SEQ ID NO: 3319810 - RNA, 11 nt, Human
cuccugcccuu

SEQ ID NO: 3319811 - RNA, 13 nt, Human
cuccugccucagc

SEQ ID NO: 3319812 - RNA, 14 nt, Human
cuccugccucagcc

SEQ ID NO: 3319813 - RNA, 17 nt, Human
cuccugcaggcagccag

SEQ ID NO: 3319814 - RNA, 16 nt, Human
cuccugcaggcagcca

SEQ ID NO: 3319815 - RNA, 11 nt, Human
cuccugcaggc

SEQ ID NO: 3319816 - RNA, 16 nt, Human
cuccugugugugcgcc

SEQ ID NO: 3319817 - RNA, 19 nt, Human
cuccugugugugcgccuac

SEQ ID NO: 3319818 - RNA, 22 nt, Human
cuccugccucgaacuggcugca

SEQ ID NO: 3319819 - RNA, 15 nt, Human
cuccugccucagccu

SEQ ID NO: 3319820 - RNA, 13 nt, Human
cucucucaggcca

SEQ ID NO: 3319821 - RNA, 12 nt, Human
cucucucacucc

SEQ ID NO: 3319822 - RNA, 18 nt, Human
cucuccucugcugcuggc

SEQ ID NO: 3319823 - RNA, 15 nt, Human
cucuccucugcugcu

SEQ ID NO: 3319824 - RNA, 14 nt, Human
cucuccucugcugc

SEQ ID NO: 3319825 - RNA, 13 nt, Human
cucuccucugcug

SEQ ID NO: 3319826 - RNA, 14 nt, Human
cucuccccagcaag

SEQ ID NO: 3319827 - RNA, 22 nt, Human
cucuccccagcaagugagagcu

SEQ ID NO: 3319828 - RNA, 12 nt, Human
cucuccucugcu

SEQ ID NO: 3319829 - RNA, 19 nt, Human
cucuccagccccuggaugc

SEQ ID NO: 3319830 - RNA, 13 nt, Human
cucuccccagcaa

SEQ ID NO: 3319831 - RNA, 14 nt, Human
cucuccagccccug

SEQ ID NO: 3319832 - RNA, 18 nt, Human
cucuccagccccuggaug

SEQ ID NO: 3319833 - RNA, 17 nt, Human
cucuccagccccuggau

SEQ ID NO: 3319834 - RNA, 16 nt, Human
cucuccagccccugga

SEQ ID NO: 3319835 - RNA, 15 nt, Human
cucuccagccccugg

SEQ ID NO: 3319836 - RNA, 21 nt, Human
cucucaggccagcugcuuggg

SEQ ID NO: 3319837 - RNA, 19 nt, Human
cucucaggccagcugcuug

SEQ ID NO: 3319838 - RNA, 18 nt, Human
cucucaggccagcugcuu

SEQ ID NO: 3319839 - RNA, 17 nt, Human
cucucaggccagcugcu

SEQ ID NO: 3319840 - RNA, 15 nt, Human
cucuaguuugauuaa

SEQ ID NO: 3319841 - RNA, 21 nt, Human
cucuaguuugauuaaauucuu

SEQ ID NO: 3319842 - RNA, 20 nt, Human
cucuaguuugauuaaauucu

SEQ ID NO: 3319843 - RNA, 19 nt, Human
cucuaguuugauuaaauuc

SEQ ID NO: 3319844 - RNA, 12 nt, Human
cucucaggccaa

SEQ ID NO: 3319845 - RNA, 21 nt, Human
cucucaggccaaacucaccug

SEQ ID NO: 3319846 - RNA, 20 nt, Human
cucucaggccaaacucaccu

SEQ ID NO: 3319847 - RNA, 15 nt, Human
cucucaggccagcug

SEQ ID NO: 3319848 - RNA, 13 nt, Human
cucucaggccagc

SEQ ID NO: 3319849 - RNA, 23 nt, Human
cucucaggccaaacucaccugcc

SEQ ID NO: 3319850 - RNA, 22 nt, Human
cucucaggccaaacucaccugc

SEQ ID NO: 3319851 - RNA, 23 nt, Human
cucuagggaaaaaccagcgugug

SEQ ID NO: 3319852 - RNA, 20 nt, Human
cucuaccauccccuguagag

SEQ ID NO: 3319853 - RNA, 13 nt, Human
cucuacccuggca

SEQ ID NO: 3319854 - RNA, 19 nt, Human
cuccuucacagaugggugc

SEQ ID NO: 3319855 - RNA, 14 nt, Human
cuccugugugugcg

SEQ ID NO: 3319856 - RNA, 17 nt, Human
cuccuucacagaugggu

SEQ ID NO: 3319857 - RNA, 16 nt, Human
cuccuucacagauggg

SEQ ID NO: 3319858 - RNA, 13 nt, Human
cucuacagaggcc

SEQ ID NO: 3319859 - RNA, 19 nt, Human
cucuacagaggccaugggc

SEQ ID NO: 3319860 - RNA, 14 nt, Human
cucuacagaggcca

SEQ ID NO: 3319861 - RNA, 16 nt, Human
cucuacagaggccaug

SEQ ID NO: 3319862 - RNA, 13 nt, Human
cucuacaaaaagc

SEQ ID NO: 3319863 - RNA, 15 nt, Human
cugagccagauuuca

SEQ ID NO: 3319864 - RNA, 21 nt, Human
cugagccagauuucacucucc

SEQ ID NO: 3319865 - RNA, 20 nt, Human
cugagccagauuucacucuc

SEQ ID NO: 3319866 - RNA, 19 nt, Human
cugagccagauuucacucu

SEQ ID NO: 3319867 - RNA, 18 nt, Human
cugagccagauuucacuc

SEQ ID NO: 3319868 - RNA, 17 nt, Human
cugagccagauuucacu

SEQ ID NO: 3319869 - RNA, 18 nt, Human
cugagacagcccgggcuc

SEQ ID NO: 3319870 - RNA, 17 nt, Human
cugagacagcccgggcu

SEQ ID NO: 3319871 - RNA, 16 nt, Human
cugagacagcccgggc

SEQ ID NO: 3319872 - RNA, 20 nt, Human
cugaggcccuucucuccagc

SEQ ID NO: 3319873 - RNA, 19 nt, Human
cugaggcccuucucuccag

SEQ ID NO: 3319874 - RNA, 18 nt, Human
cugaggcccuucucucca

SEQ ID NO: 3319875 - RNA, 15 nt, Human
cugaggcccuucucu

SEQ ID NO: 3319876 - RNA, 14 nt, Human
cugaggcccuucuc

SEQ ID NO: 3319877 - RNA, 23 nt, Human
cugaggcccagagggccugcaag

SEQ ID NO: 3319878 - RNA, 21 nt, Human
cugaggcccagagggccugca

SEQ ID NO: 3319879 - RNA, 19 nt, Human
cugaggcccagagggccug

SEQ ID NO: 3319880 - RNA, 18 nt, Human
cugaggcccagagggccu

SEQ ID NO: 3319881 - RNA, 17 nt, Human
cugaggcccagagggcc

SEQ ID NO: 3319882 - RNA, 16 nt, Human
cugaggcccagagggc

SEQ ID NO: 3319883 - RNA, 15 nt, Human
cugaggcccagaggg

SEQ ID NO: 3319884 - RNA, 14 nt, Human
cugaggcccagagg

SEQ ID NO: 3319885 - RNA, 13 nt, Human
cugaggcccagag

SEQ ID NO: 3319886 - RNA, 12 nt, Human
cugaggcccaga

SEQ ID NO: 3319887 - RNA, 21 nt, Human
cugacaggcaaugcuggcugu

SEQ ID NO: 3319888 - RNA, 21 nt, Human
cugacauuguuggccaaagcc

SEQ ID NO: 3319889 - RNA, 22 nt, Human
cugacauuguuggccaaagcca

SEQ ID NO: 3319890 - RNA, 12 nt, Human
cugacccacugc

SEQ ID NO: 3319891 - RNA, 16 nt, Human
cugacccaugcugccc

SEQ ID NO: 3319892 - RNA, 15 nt, Human
cugacccaugcugcc

SEQ ID NO: 3319893 - RNA, 14 nt, Human
cugacccaugcugc

SEQ ID NO: 3319894 - RNA, 13 nt, Human
cugacccacugcu

SEQ ID NO: 3319895 - RNA, 14 nt, Human
cugacccacugcuu

SEQ ID NO: 3319896 - RNA, 13 nt, Human
cugacccaugcug

SEQ ID NO: 3319897 - RNA, 16 nt, Human
cugacuguuuucucuu

SEQ ID NO: 3319898 - RNA, 18 nt, Human
cugacuguuuucucuuga

SEQ ID NO: 3319899 - RNA, 15 nt, Human
cugagacagcccggg

SEQ ID NO: 3319900 - RNA, 14 nt, Human
cugagacagcccgg

SEQ ID NO: 3319901 - RNA, 15 nt, Human
cucuggcagcucaga

SEQ ID NO: 3319902 - RNA, 14 nt, Human
cucuggcagcucag

SEQ ID NO: 3319903 - RNA, 12 nt, Human
cucuggcagcuc

SEQ ID NO: 3319904 - RNA, 16 nt, Human
cucuggacaggcaugu

SEQ ID NO: 3319905 - RNA, 14 nt, Human
cucuggacaggcau

SEQ ID NO: 3319906 - RNA, 13 nt, Human
cucucuccucccu

SEQ ID NO: 3319907 - RNA, 22 nt, Human
cucugccugaagucacacagug

SEQ ID NO: 3319908 - RNA, 10 nt, Human
cucugccuga

SEQ ID NO: 3319909 - RNA, 21 nt, Human
cucugccugaagucacacagu

SEQ ID NO: 3319910 - RNA, 15 nt, Human
cucuggacaggcaug

SEQ ID NO: 3319911 - RNA, 13 nt, Human
cucuuccaggcug

SEQ ID NO: 3319912 - RNA, 15 nt, Human
cucuuccaggcuggg

SEQ ID NO: 3319913 - RNA, 14 nt, Human
cucuuccaggcugg

SEQ ID NO: 3319914 - RNA, 15 nt, Human
cucuuagaaaaacca

SEQ ID NO: 3319915 - RNA, 13 nt, Human
cucuuagaaaaac

SEQ ID NO: 3319916 - RNA, 15 nt, Human
cucugugucaggugg

SEQ ID NO: 3319917 - RNA, 21 nt, Human
cucuuggguucaagcgauucu

SEQ ID NO: 3319918 - RNA, 19 nt, Human
cucuuggguucaagcgauu

SEQ ID NO: 3319919 - RNA, 22 nt, Human
cucuugaaauauaggaacuuaa

SEQ ID NO: 3319920 - RNA, 18 nt, Human
cucuuuaaugucacaggc

SEQ ID NO: 3319921 - RNA, 16 nt, Human
cucuugguccugcugc

SEQ ID NO: 3319922 - RNA, 15 nt, Human
cucuugguccugcug

SEQ ID NO: 3319923 - RNA, 13 nt, Human
cucuugguccugc

SEQ ID NO: 3319924 - RNA, 20 nt, Human
cucuuuaaugucacaggcag

SEQ ID NO: 3319925 - RNA, 21 nt, Human
cucuuuaaugucacaggcagg

SEQ ID NO: 3319926 - RNA, 22 nt, Human
cucuuuaaugucacaggcaggu

SEQ ID NO: 3319927 - RNA, 23 nt, Human
cucuuuaaugucacaggcagguc

SEQ ID NO: 3319928 - RNA, 13 nt, Human
cucuuucccuccc

SEQ ID NO: 3319929 - RNA, 17 nt, Human
cucuuucccucccuucc

SEQ ID NO: 3319930 - RNA, 19 nt, Human
cugaagaauugaaaaacca

SEQ ID NO: 3319931 - RNA, 23 nt, Human
cugaaagcccugagcuuucugcu

SEQ ID NO: 3319932 - RNA, 19 nt, Human
cugaaagcccugagcuuuc

SEQ ID NO: 3319933 - RNA, 18 nt, Human
cugaaagcccugagcuuu

SEQ ID NO: 3319934 - RNA, 17 nt, Human
cugaaagcccugagcuu

SEQ ID NO: 3319935 - RNA, 16 nt, Human
cugaaagcccugagcu

SEQ ID NO: 3319936 - RNA, 15 nt, Human
cugaaagcccugagc

SEQ ID NO: 3319937 - RNA, 16 nt, Human
cgcuacccgggaaggg

SEQ ID NO: 3319938 - RNA, 21 nt, Human
cgcuaagagggagggagggcu

SEQ ID NO: 3319939 - RNA, 22 nt, Human
cgcuaagagggagggagggcuc

SEQ ID NO: 3319940 - RNA, 15 nt, Human
cgcugugcugcccug

SEQ ID NO: 3319941 - RNA, 17 nt, Human
cgcugugcugcccugcc

SEQ ID NO: 3319942 - RNA, 16 nt, Human
cgcugugcugcccugc

SEQ ID NO: 3319943 - RNA, 22 nt, Human
cgcugucagccauuccuguucc

SEQ ID NO: 3319944 - RNA, 20 nt, Human
cggaaaacaugcuacacacu

SEQ ID NO: 3319945 - RNA, 15 nt, Human
cggaaaacaugcuac

SEQ ID NO: 3319946 - RNA, 14 nt, Human
cgcugugcugcccu

SEQ ID NO: 3319947 - RNA, 22 nt, Human
cgccagauucuuuccugaggcu

SEQ ID NO: 3319948 - RNA, 20 nt, Human
ccucugcccacucccugcaa

SEQ ID NO: 3319949 - RNA, 19 nt, Human
ccucugcccacucccugca

SEQ ID NO: 3319950 - RNA, 17 nt, Human
ccucugcccacucccug

SEQ ID NO: 3319951 - RNA, 16 nt, Human
cgccaucccagcccca

SEQ ID NO: 3319952 - RNA, 14 nt, Human
cgccaucccagccc

SEQ ID NO: 3319953 - RNA, 23 nt, Human
cgccaggggaaaaucagccugcu

SEQ ID NO: 3319954 - RNA, 22 nt, Human
cgcccaggcuuagucacugaga

SEQ ID NO: 3319955 - RNA, 13 nt, Human
cggccccugcugg

SEQ ID NO: 3319956 - RNA, 18 nt, Human
cggccccugcugguucag

SEQ ID NO: 3319957 - RNA, 19 nt, Human
cggccccugcugguucagg

SEQ ID NO: 3319958 - RNA, 24 nt, Human
cggccaggccagagggagugacag

SEQ ID NO: 3319959 - RNA, 17 nt, Human
cggccaccugcggugcu

SEQ ID NO: 3319960 - RNA, 16 nt, Human
cggccaccugcggugc

SEQ ID NO: 3319961 - RNA, 15 nt, Human
cggccaccugcggug

SEQ ID NO: 3319962 - RNA, 11 nt, Human
cggccaccugc

SEQ ID NO: 3319963 - RNA, 13 nt, Human
cggaagagccuug

SEQ ID NO: 3319964 - RNA, 14 nt, Human
cgguccacccagga

SEQ ID NO: 3319965 - RNA, 15 nt, Human
cgguccacccaggag

SEQ ID NO: 3319966 - RNA, 16 nt, Human
cgguccacccaggagc

SEQ ID NO: 3319967 - RNA, 20 nt, Human
cgguccacccaggagccccg

SEQ ID NO: 3319968 - RNA, 20 nt, Human
cggugagaggggaacagacu

SEQ ID NO: 3319969 - RNA, 21 nt, Human
cggugagaggggaacagacug

SEQ ID NO: 3319970 - RNA, 23 nt, Human
cggggacagcuccuucuguccua

SEQ ID NO: 3319971 - RNA, 15 nt, Human
cgggggcagagaggg

SEQ ID NO: 3319972 - RNA, 23 nt, Human
cggcuggccuggccccucagggu

SEQ ID NO: 3319973 - RNA, 19 nt, Human
cggcuggccuggccccuca

SEQ ID NO: 3319974 - RNA, 22 nt, Human
cggcuggccuggccccucaggg

SEQ ID NO: 3319975 - RNA, 22 nt, Human
cggggacagcuccuucuguccu

SEQ ID NO: 3319976 - RNA, 14 nt, Human
cgggcacucagaag

SEQ ID NO: 3319977 - RNA, 22 nt, Human
cgggcacucagaagacacugau

SEQ ID NO: 3319978 - RNA, 20 nt, Human
cgggaggucgaggcaggagg

SEQ ID NO: 3319979 - RNA, 18 nt, Human
cgggaggucgaggcagga

SEQ ID NO: 3319980 - RNA, 16 nt, Human
cuaaauguugaaagau

SEQ ID NO: 3319981 - RNA, 17 nt, Human
cuaacauggaaguacua

SEQ ID NO: 3319982 - RNA, 15 nt, Human
cuaacauggaaguac

SEQ ID NO: 3319983 - RNA, 18 nt, Human
cuaaauggaaccacucua

SEQ ID NO: 3319984 - RNA, 17 nt, Human
cuaaauggaaccacucu

SEQ ID NO: 3319985 - RNA, 16 nt, Human
cuaaauggaaccacuc

SEQ ID NO: 3319986 - RNA, 15 nt, Human
cuaaauggaaccacu

SEQ ID NO: 3319987 - RNA, 17 nt, Human
cguggcugcuucaagga

SEQ ID NO: 3319988 - RNA, 14 nt, Human
cgucugacaggcaa

SEQ ID NO: 3319989 - RNA, 16 nt, Human
cgucuaccugaggggc

SEQ ID NO: 3319990 - RNA, 16 nt, Human
cgucucauacucaccu

SEQ ID NO: 3319991 - RNA, 21 nt, Human
cggugcuaucucccccagccc

SEQ ID NO: 3319992 - RNA, 20 nt, Human
cggugcuaucucccccagcc

SEQ ID NO: 3319993 - RNA, 18 nt, Human
cggugcuaucucccccag

SEQ ID NO: 3319994 - RNA, 16 nt, Human
cgugcacacaccagag

SEQ ID NO: 3319995 - RNA, 20 nt, Human
cgucugacaggcaaugcugg

SEQ ID NO: 3319996 - RNA, 21 nt, Human
cgucugacaggcaaugcuggc

SEQ ID NO: 3319997 - RNA, 22 nt, Human
cgucugacaggcaaugcuggcu

SEQ ID NO: 3319998 - RNA, 21 nt, Human
cgugcaguggugcgaucuggg

SEQ ID NO: 3319999 - RNA, 23 nt, Human
cgugcauaccacuuuuguucuug

SEQ ID NO: 3320000 - RNA, 18 nt, Human
cgugcacacaccagagcc

SEQ ID NO: 3320001 - RNA, 19 nt, Human
cgugcacacaccagagccc

SEQ ID NO: 3320002 - RNA, 14 nt, Human
cgugcacacaccag

SEQ ID NO: 3320003 - RNA, 21 nt, Human
cuaggcauuugcugaauacag

SEQ ID NO: 3320004 - RNA, 19 nt, Human
cuagugugguguuuccugg

SEQ ID NO: 3320005 - RNA, 23 nt, Human
cuagugugguguuuccuggcacu

SEQ ID NO: 3320006 - RNA, 22 nt, Human
cuagugugguguuuccuggcac

SEQ ID NO: 3320007 - RNA, 21 nt, Human
cuagugugguguuuccuggca

SEQ ID NO: 3320008 - RNA, 15 nt, Human
cuaggaacacuccuu

SEQ ID NO: 3320009 - RNA, 13 nt, Human
cuaggaacacucc

SEQ ID NO: 3320010 - RNA, 21 nt, Human
cuaggaagacuuuggaaagag

SEQ ID NO: 3320011 - RNA, 17 nt, Human
cuaggaggucucuaaga

SEQ ID NO: 3320012 - RNA, 22 nt, Human
cuaggaccccuccaugugggcu

SEQ ID NO: 3320013 - RNA, 23 nt, Human
cuauauuguuuucaguguacaug

SEQ ID NO: 3320014 - RNA, 22 nt, Human
cuauauuguuuucaguguacau

SEQ ID NO: 3320015 - RNA, 20 nt, Human
cuaucaaguauuauaccuuu

SEQ ID NO: 3320016 - RNA, 14 nt, Human
cuaugacacaugca

SEQ ID NO: 3320017 - RNA, 12 nt, Human
cuaugcauuuga

SEQ ID NO: 3320018 - RNA, 11 nt, Human
cuaugcauuug

SEQ ID NO: 3320019 - RNA, 23 nt, Human
cucacaguccuuaccagcagagc

SEQ ID NO: 3320020 - RNA, 18 nt, Human
cucaagugauucuccugc

SEQ ID NO: 3320021 - RNA, 19 nt, Human
cucaagugauucuccugcc

SEQ ID NO: 3320022 - RNA, 20 nt, Human
cucaagugauucuccugccu

SEQ ID NO: 3320023 - RNA, 20 nt, Human
cucaccagccccagugccca

SEQ ID NO: 3320024 - RNA, 21 nt, Human
cucaccagccccagugcccac

SEQ ID NO: 3320025 - RNA, 19 nt, Human
cucaccagccccagugccc

SEQ ID NO: 3320026 - RNA, 13 nt, Human
cucaccccagccc

SEQ ID NO: 3320027 - RNA, 12 nt, Human
cucaccccagcc

SEQ ID NO: 3320028 - RNA, 16 nt, Human
cucacuauguugccca

SEQ ID NO: 3320029 - RNA, 17 nt, Human
cucacuauguugcccag

SEQ ID NO: 3320030 - RNA, 17 nt, Human
cucaaccuccugggcua

SEQ ID NO: 3320031 - RNA, 21 nt, Human
cucaacucuccuccagaguca

SEQ ID NO: 3320032 - RNA, 20 nt, Human
cucaacucuccuccagaguc

SEQ ID NO: 3320033 - RNA, 19 nt, Human
cucaacucuccuccagagu

SEQ ID NO: 3320034 - RNA, 14 nt, Human
cuaugcauuugaaa

SEQ ID NO: 3320035 - RNA, 13 nt, Human
cuacucuguguca

SEQ ID NO: 3320036 - RNA, 16 nt, Human
cuacucugugucaggu

SEQ ID NO: 3320037 - RNA, 21 nt, Human
cuacucugugucagguggggc

SEQ ID NO: 3320038 - RNA, 21 nt, Human
cuacccgggaagggggcuggg

SEQ ID NO: 3320039 - RNA, 20 nt, Human
cuacccgggaagggggcugg

SEQ ID NO: 3320040 - RNA, 15 nt, Human
cuacccgggaagggg

SEQ ID NO: 3320041 - RNA, 14 nt, Human
cuacccgggaaggg

SEQ ID NO: 3320042 - RNA, 17 nt, Human
cuacuguaauuugugau

SEQ ID NO: 3320043 - RNA, 16 nt, Human
cuacuguaauuuguga

SEQ ID NO: 3320044 - RNA, 21 nt, Human
cuagacgagcaggcuucuucc

SEQ ID NO: 3320045 - RNA, 20 nt, Human
cuagacgagcaggcuucuuc

SEQ ID NO: 3320046 - RNA, 17 nt, Human
cuagagugaacuugggc

SEQ ID NO: 3320047 - RNA, 17 nt, Human
cuagcacuuugggaggc

SEQ ID NO: 3320048 - RNA, 17 nt, Human
cuaaccagcagaaaugc

SEQ ID NO: 3320049 - RNA, 14 nt, Human
cuaaccacgcugga

SEQ ID NO: 3320050 - RNA, 16 nt, Human
cuaaccagcagaaaug

SEQ ID NO: 3320051 - RNA, 17 nt, Human
cuaaccacgcuggaccu

SEQ ID NO: 3320052 - RNA, 19 nt, Human
cuaagcuauucaguaauaa

SEQ ID NO: 3320053 - RNA, 21 nt, Human
cuaagcuauucaguaauaacu

SEQ ID NO: 3320054 - RNA, 15 nt, Human
cuaaggugugcucug

SEQ ID NO: 3320055 - RNA, 18 nt, Human
cuacacugugcugagucu

SEQ ID NO: 3320056 - RNA, 15 nt, Human
cuacacacugcaugu

SEQ ID NO: 3320057 - RNA, 13 nt, Human
cuacacacugcau

SEQ ID NO: 3320058 - RNA, 15 nt, Human
cuacagaggccaugg

SEQ ID NO: 3320059 - RNA, 20 nt, Human
cuacccagcgagcccuggug

SEQ ID NO: 3320060 - RNA, 19 nt, Human
cuacccagcgagcccuggu

SEQ ID NO: 3320061 - RNA, 17 nt, Human
cuacccacccuccuuuc

SEQ ID NO: 3320062 - RNA, 13 nt, Human
cuacccacccucc

SEQ ID NO: 3320063 - RNA, 22 nt, Human
cuacccacccuccuuucaccac

SEQ ID NO: 3320064 - RNA, 14 nt, Human
cuaauguacugcau

SEQ ID NO: 3320065 - RNA, 16 nt, Human
cuaauguacugcauau

SEQ ID NO: 3320066 - RNA, 18 nt, Human
cuaauauguaacaagcca

SEQ ID NO: 3320067 - RNA, 20 nt, Human
cuaauaaaauuuaaaagucu

SEQ ID NO: 3320068 - RNA, 16 nt, Human
cuaaggugugcucuga

SEQ ID NO: 3320069 - RNA, 21 nt, Human
cuaauaaaauuuaaaagucuu

SEQ ID NO: 3320070 - RNA, 16 nt, Human
uuuccugaggcugggc

SEQ ID NO: 3320071 - RNA, 17 nt, Human
uuaccacagacauacua

SEQ ID NO: 3320072 - RNA, 14 nt, Human
uuaccacagacaua

SEQ ID NO: 3320073 - RNA, 23 nt, Human
uuacauuuuuaagugcugcauuu

SEQ ID NO: 3320074 - RNA, 20 nt, Human
uuucuguucuuucuggcuau

SEQ ID NO: 3320075 - RNA, 23 nt, Human
uuucuacucgaguuacagacaaa

SEQ ID NO: 3320076 - RNA, 18 nt, Human
uuucuaaaggcuaccuuu

SEQ ID NO: 3320077 - RNA, 21 nt, Human
uuucuaaaggcuaccuuugua

SEQ ID NO: 3320078 - RNA, 20 nt, Human
uuucuaaaggcuaccuuugu

SEQ ID NO: 3320079 - RNA, 22 nt, Human
uuugaagaugccgcauuuggau

SEQ ID NO: 3320080 - RNA, 19 nt, Human
uuugaacugauaaagauga

SEQ ID NO: 3320081 - RNA, 17 nt, Human
uuugaacugauaaagau

SEQ ID NO: 3320082 - RNA, 14 nt, Human
uuugaacucuucaa

SEQ ID NO: 3320083 - RNA, 15 nt, Human
uuugaacugauaaag

SEQ ID NO: 3320084 - RNA, 23 nt, Human
uuucuuagggaaggauacaaaag

SEQ ID NO: 3320085 - RNA, 18 nt, Human
uuucuuagggaaggauac

SEQ ID NO: 3320086 - RNA, 13 nt, Human
uuucuucucccuc

SEQ ID NO: 3320087 - RNA, 12 nt, Human
uuucuucucccu

SEQ ID NO: 3320088 - RNA, 17 nt, Human
uuuggucuacacugugc

SEQ ID NO: 3320089 - RNA, 21 nt, Human
uuuggaauuuugugcccccau

SEQ ID NO: 3320090 - RNA, 14 nt, Human
uuuggaauuuugug

SEQ ID NO: 3320091 - RNA, 16 nt, Human
uuugcuuugugauuuu

SEQ ID NO: 3320092 - RNA, 15 nt, Human
uuugcuuugugauuu

SEQ ID NO: 3320093 - RNA, 17 nt, Human
uuuuaaagaaugcucuu

SEQ ID NO: 3320094 - RNA, 21 nt, Human
uuuguucuggcucuuccaggc

SEQ ID NO: 3320095 - RNA, 12 nt, Human
uuuuaaaugcac

SEQ ID NO: 3320096 - RNA, 11 nt, Human
uuuuaaaugca

SEQ ID NO: 3320097 - RNA, 21 nt, Human
uuuuaaaugcaccuggaauau

SEQ ID NO: 3320098 - RNA, 20 nt, Human
uuuugacaaggggcaguggu

SEQ ID NO: 3320099 - RNA, 15 nt, Human
uuuuggucuguguga

SEQ ID NO: 3320100 - RNA, 14 nt, Human
uuuuggcugcugaa

SEQ ID NO: 3320101 - RNA, 16 nt, Human
uuuucuuucagccaag

SEQ ID NO: 3320102 - RNA, 19 nt, Human
uuuuguagagccagggucu

SEQ ID NO: 3320103 - RNA, 16 nt, Human
uuuugucauauaagau

SEQ ID NO: 3320104 - RNA, 19 nt, Human
uuuuuccuucagugccuua

SEQ ID NO: 3320105 - RNA, 23 nt, Human
uuuuuaagaaaaaggaugcacag

SEQ ID NO: 3320106 - RNA, 11 nt, Human
uuuuuccuuca

SEQ ID NO: 3320107 - RNA, 14 nt, Human
guauuuuacuaaua

SEQ ID NO: 3320108 - RNA, 15 nt, Human
gucaccccggccacc

SEQ ID NO: 3320109 - RNA, 15 nt, Human
gucaagugaaaaagg

SEQ ID NO: 3320110 - RNA, 19 nt, Human
guauuuuguuuuugucuua

SEQ ID NO: 3320111 - RNA, 14 nt, Human
gucagagccugcag

SEQ ID NO: 3320112 - RNA, 15 nt, Human
gucagagccugcagu

SEQ ID NO: 3320113 - RNA, 16 nt, Human
gucagagccugcaguu

SEQ ID NO: 3320114 - RNA, 22 nt, Human
gucaccccggccaccugcggug

SEQ ID NO: 3320115 - RNA, 18 nt, Human
gucaccccggccaccugc

SEQ ID NO: 3320116 - RNA, 17 nt, Human
gucaccccggccaccug

SEQ ID NO: 3320117 - RNA, 19 nt, Human
gucacucuggcagcucaga

SEQ ID NO: 3320118 - RNA, 17 nt, Human
gucacucuggcagcuca

SEQ ID NO: 3320119 - RNA, 16 nt, Human
gucacucuggcagcuc

SEQ ID NO: 3320120 - RNA, 14 nt, Human
gucacucuggcagc

SEQ ID NO: 3320121 - RNA, 13 nt, Human
gucacucuggcag

SEQ ID NO: 3320122 - RNA, 12 nt, Human
gucacucuggca

SEQ ID NO: 3320123 - RNA, 19 nt, Human
gucccugcacuugcagacu

SEQ ID NO: 3320124 - RNA, 21 nt, Human
gucccugcacuugcagacucu

SEQ ID NO: 3320125 - RNA, 16 nt, Human
gucccugcacuugcag

SEQ ID NO: 3320126 - RNA, 20 nt, Human
gucccaccuuggcugcaggg

SEQ ID NO: 3320127 - RNA, 23 nt, Human
gucccaccuuggcugcagggagu

SEQ ID NO: 3320128 - RNA, 23 nt, Human
guccacccaggagccccgaggcc

SEQ ID NO: 3320129 - RNA, 12 nt, Human
guccacccagga

SEQ ID NO: 3320130 - RNA, 21 nt, Human
gucccaccuuggcugcaggga

SEQ ID NO: 3320131 - RNA, 14 nt, Human
guagucaggugccu

SEQ ID NO: 3320132 - RNA, 16 nt, Human
guaggguuauaauaau

SEQ ID NO: 3320133 - RNA, 15 nt, Human
guagagugugccuga

SEQ ID NO: 3320134 - RNA, 16 nt, Human
guagggcgggaggaug

SEQ ID NO: 3320135 - RNA, 23 nt, Human
guagggcgggaggauguucuggg

SEQ ID NO: 3320136 - RNA, 21 nt, Human
guagggcgggaggauguucug

SEQ ID NO: 3320137 - RNA, 22 nt, Human
guagggcgggaggauguucugg

SEQ ID NO: 3320138 - RNA, 15 nt, Human
guaugaggcauuugu

SEQ ID NO: 3320139 - RNA, 13 nt, Human
guaugaggcauuu

SEQ ID NO: 3320140 - RNA, 19 nt, Human
guaucuggugacuuuccuc

SEQ ID NO: 3320141 - RNA, 12 nt, Human
guaucuggugac

SEQ ID NO: 3320142 - RNA, 12 nt, Human
guaucugagcag

SEQ ID NO: 3320143 - RNA, 21 nt, Human
guaugaucacggcucacugca

SEQ ID NO: 3320144 - RNA, 20 nt, Human
guaugaucacggcucacugc

SEQ ID NO: 3320145 - RNA, 20 nt, Human
guaugaggcauuuguuugaa

SEQ ID NO: 3320146 - RNA, 17 nt, Human
guaugaggcauuuguuu

SEQ ID NO: 3320147 - RNA, 22 nt, Human
guauaugucaagccauaauugu

SEQ ID NO: 3320148 - RNA, 21 nt, Human
gugcgaucuggguucacugca

SEQ ID NO: 3320149 - RNA, 14 nt, Human
gugccaugugccag

SEQ ID NO: 3320150 - RNA, 16 nt, Human
gugccaugugccaggu

SEQ ID NO: 3320151 - RNA, 14 nt, Human
gugcgccuacagga

SEQ ID NO: 3320152 - RNA, 14 nt, Human
gugcggccuuuggc

SEQ ID NO: 3320153 - RNA, 23 nt, Human
gugauccacccaccucagccucc

SEQ ID NO: 3320154 - RNA, 24 nt, Human
gugauccacccaccucagccuccc

SEQ ID NO: 3320155 - RNA, 18 nt, Human
gugauuuuuguaauuuuu

SEQ ID NO: 3320156 - RNA, 13 nt, Human
gugauuuuuguaa

SEQ ID NO: 3320157 - RNA, 21 nt, Human
gugcauaccacuuuuguucuu

SEQ ID NO: 3320158 - RNA, 22 nt, Human
gugcauaccacuuuuguucuug

SEQ ID NO: 3320159 - RNA, 20 nt, Human
gugcaguggugcgaucuggg

SEQ ID NO: 3320160 - RNA, 23 nt, Human
gugcaguggugcgaucuggguuc

SEQ ID NO: 3320161 - RNA, 21 nt, Human
gugaaugaugauccuaggcau

SEQ ID NO: 3320162 - RNA, 20 nt, Human
gugacaaggauugcuacugu

SEQ ID NO: 3320163 - RNA, 12 nt, Human
gugacagaggca

SEQ ID NO: 3320164 - RNA, 13 nt, Human
gugacagaggcag

SEQ ID NO: 3320165 - RNA, 14 nt, Human
gugacagaggcagc

SEQ ID NO: 3320166 - RNA, 12 nt, Human
gugaccucugcc

SEQ ID NO: 3320167 - RNA, 15 nt, Human
gugacagaggcagcc

SEQ ID NO: 3320168 - RNA, 13 nt, Human
gugaccucugccu

SEQ ID NO: 3320169 - RNA, 14 nt, Human
gugaccucugccug

SEQ ID NO: 3320170 - RNA, 14 nt, Human
gugagccacugcac

SEQ ID NO: 3320171 - RNA, 15 nt, Human
gugagccacugcacc

SEQ ID NO: 3320172 - RNA, 20 nt, Human
gugagccacugcaccgggcc

SEQ ID NO: 3320173 - RNA, 19 nt, Human
gugagccgagaucacgcca

SEQ ID NO: 3320174 - RNA, 17 nt, Human
gugaggaugaaaaaaua

SEQ ID NO: 3320175 - RNA, 17 nt, Human
gugauacaaugcugugc

SEQ ID NO: 3320176 - RNA, 15 nt, Human
gugauacaaugcugu

SEQ ID NO: 3320177 - RNA, 17 nt, Human
gugaguugauagcacag

SEQ ID NO: 3320178 - RNA, 22 nt, Human
gugauccacccaccucagccuc

SEQ ID NO: 3320179 - RNA, 17 nt, Human
gucuguucuuuccaaag

SEQ ID NO: 3320180 - RNA, 14 nt, Human
gucuguucuuucca

SEQ ID NO: 3320181 - RNA, 18 nt, Human
gucugugccauuuuguau

SEQ ID NO: 3320182 - RNA, 16 nt, Human
gucuugaacuccuggc

SEQ ID NO: 3320183 - RNA, 17 nt, Human
gucuugaacuccuggcc

SEQ ID NO: 3320184 - RNA, 21 nt, Human
gucuugaacuccuggccucaa

SEQ ID NO: 3320185 - RNA, 18 nt, Human
gucuugaacuccuggccu

SEQ ID NO: 3320186 - RNA, 20 nt, Human
gucuugaacuccuggccuca

SEQ ID NO: 3320187 - RNA, 16 nt, Human
gucuugcaauggcagc

SEQ ID NO: 3320188 - RNA, 17 nt, Human
gucuugcaauggcagcc

SEQ ID NO: 3320189 - RNA, 18 nt, Human
gucuugcaauggcagccu

SEQ ID NO: 3320190 - RNA, 19 nt, Human
gucuugcaauggcagccuu

SEQ ID NO: 3320191 - RNA, 20 nt, Human
gucuugcaauggcagccuug

SEQ ID NO: 3320192 - RNA, 21 nt, Human
gucuugcaauggcagccuugg

SEQ ID NO: 3320193 - RNA, 23 nt, Human
gucuugcaauggcagccuuggca

SEQ ID NO: 3320194 - RNA, 16 nt, Human
gucuuuuuucacuaca

SEQ ID NO: 3320195 - RNA, 15 nt, Human
gucccugccaaugga

SEQ ID NO: 3320196 - RNA, 14 nt, Human
gucccugccaaugg

SEQ ID NO: 3320197 - RNA, 11 nt, Human
gucccugccaa

SEQ ID NO: 3320198 - RNA, 19 nt, Human
guccuuaccagcagagcac

SEQ ID NO: 3320199 - RNA, 18 nt, Human
guccuuaccagcagagca

SEQ ID NO: 3320200 - RNA, 21 nt, Human
guccuuaccagcagagcaccu

SEQ ID NO: 3320201 - RNA, 16 nt, Human
gucgggcaugacacga

SEQ ID NO: 3320202 - RNA, 21 nt, Human
gucggaaaacaugcuacacac

SEQ ID NO: 3320203 - RNA, 18 nt, Human
gucucacuauguugccca

SEQ ID NO: 3320204 - RNA, 11 nt, Human
gucucacucug

SEQ ID NO: 3320205 - RNA, 19 nt, Human
gucucacuauguugcccag

SEQ ID NO: 3320206 - RNA, 15 nt, Human
gucucacucugucgc

SEQ ID NO: 3320207 - RNA, 16 nt, Human
gucucacucugucgcc

SEQ ID NO: 3320208 - RNA, 18 nt, Human
gucucacucugucgccca

SEQ ID NO: 3320209 - RNA, 19 nt, Human
gucucacucugucgcccag

SEQ ID NO: 3320210 - RNA, 22 nt, Human
gucucacucugucgcccagucu

SEQ ID NO: 3320211 - RNA, 17 nt, Human
guucaucauccuaagcu

SEQ ID NO: 3320212 - RNA, 18 nt, Human
guucaucuugaauuguaa

SEQ ID NO: 3320213 - RNA, 13 nt, Human
guucaucuugaau

SEQ ID NO: 3320214 - RNA, 12 nt, Human
guucaucuugaa

SEQ ID NO: 3320215 - RNA, 19 nt, Human
guucacugcaaccuccgcc

SEQ ID NO: 3320216 - RNA, 22 nt, Human
guuccucauuagcauuuugcua

SEQ ID NO: 3320217 - RNA, 14 nt, Human
guuccuaauccucu

SEQ ID NO: 3320218 - RNA, 20 nt, Human
guuccaccaucaagccacca

SEQ ID NO: 3320219 - RNA, 17 nt, Human
guuccaccaucaagcca

SEQ ID NO: 3320220 - RNA, 20 nt, Human
guucaagcgauucuucugcu

SEQ ID NO: 3320221 - RNA, 16 nt, Human
guucaauucucauuug

SEQ ID NO: 3320222 - RNA, 23 nt, Human
guucaauucucauuugucacaca

SEQ ID NO: 3320223 - RNA, 18 nt, Human
guucaagcgauucuucug

SEQ ID NO: 3320224 - RNA, 19 nt, Human
guucaagcgauucuucugc

SEQ ID NO: 3320225 - RNA, 19 nt, Human
guuauuaaaaaucucaaau

SEQ ID NO: 3320226 - RNA, 21 nt, Human
guuaugacuccagaauuuccc

SEQ ID NO: 3320227 - RNA, 23 nt, Human
guuaccauuuugggguacccacu

SEQ ID NO: 3320228 - RNA, 21 nt, Human
guuacauuuuuaagugcugca

SEQ ID NO: 3320229 - RNA, 18 nt, Human
guuacauaagauaaaugu

SEQ ID NO: 3320230 - RNA, 19 nt, Human
guuacauaagauaaaugug

SEQ ID NO: 3320231 - RNA, 17 nt, Human
guuacagacaaagcgug

SEQ ID NO: 3320232 - RNA, 15 nt, Human
guuacagacaaagcg

SEQ ID NO: 3320233 - RNA, 22 nt, Human
guuaguuucuccaagcaggaca

SEQ ID NO: 3320234 - RNA, 19 nt, Human
guuaguuucuccaagcagg

SEQ ID NO: 3320235 - RNA, 16 nt, Human
guuaguuucuccaagc

SEQ ID NO: 3320236 - RNA, 15 nt, Human
guuacucagaauucu

SEQ ID NO: 3320237 - RNA, 22 nt, Human
guuacuaaguuuuuauggcuuu

SEQ ID NO: 3320238 - RNA, 19 nt, Human
guucugauccuaguuccac

SEQ ID NO: 3320239 - RNA, 17 nt, Human
guugaaaaacagcugag

SEQ ID NO: 3320240 - RNA, 20 nt, Human
guucuuuccaaaguacacug

SEQ ID NO: 3320241 - RNA, 18 nt, Human
guucuuuccaaaguacac

SEQ ID NO: 3320242 - RNA, 14 nt, Human
guucuuuccaaagu

SEQ ID NO: 3320243 - RNA, 13 nt, Human
guucuuuccaaag

SEQ ID NO: 3320244 - RNA, 12 nt, Human
guucuggcucuu

SEQ ID NO: 3320245 - RNA, 20 nt, Human
guucuggcucuuccaggcug

SEQ ID NO: 3320246 - RNA, 16 nt, Human
guucuggcucuuccag

SEQ ID NO: 3320247 - RNA, 23 nt, Human
guucuggcagaguugaagacaga

SEQ ID NO: 3320248 - RNA, 11 nt, Human
guucugggaca

SEQ ID NO: 3320249 - RNA, 12 nt, Human
guucugggacac

SEQ ID NO: 3320250 - RNA, 14 nt, Human
guucugggacacag

SEQ ID NO: 3320251 - RNA, 15 nt, Human
guucugggacacagu

SEQ ID NO: 3320252 - RNA, 16 nt, Human
guucugggacacaguu

SEQ ID NO: 3320253 - RNA, 18 nt, Human
guucuuucacccuuuucu

SEQ ID NO: 3320254 - RNA, 16 nt, Human
guugaagacagagcua

SEQ ID NO: 3320255 - RNA, 15 nt, Human
guugcaggaccucag

SEQ ID NO: 3320256 - RNA, 14 nt, Human
guugccagucaccc

SEQ ID NO: 3320257 - RNA, 13 nt, Human
guugccagucacc

SEQ ID NO: 3320258 - RNA, 23 nt, Human
guugccagucaccccggccaccu

SEQ ID NO: 3320259 - RNA, 18 nt, Human
guugccagucaccccggc

SEQ ID NO: 3320260 - RNA, 17 nt, Human
guugccagucaccccgg

SEQ ID NO: 3320261 - RNA, 16 nt, Human
guugccagucaccccg

SEQ ID NO: 3320262 - RNA, 12 nt, Human
guugcccaggca

SEQ ID NO: 3320263 - RNA, 14 nt, Human
guugcccaggcagg

SEQ ID NO: 3320264 - RNA, 18 nt, Human
guuggcaaaaaggcagga

SEQ ID NO: 3320265 - RNA, 14 nt, Human
guuggcaaaaaggc

SEQ ID NO: 3320266 - RNA, 23 nt, Human
guuggccaaagccaaagcuaggc

SEQ ID NO: 3320267 - RNA, 17 nt, Human
guuggccaggcuggucu

SEQ ID NO: 3320268 - RNA, 19 nt, Human
guuggccaggcuggucuca

SEQ ID NO: 3320269 - RNA, 14 nt, Human
guuggccaguguga

SEQ ID NO: 3320270 - RNA, 15 nt, Human
guuggccaggcuggu

SEQ ID NO: 3320271 - RNA, 14 nt, Human
guuggccaggcugg

SEQ ID NO: 3320272 - RNA, 13 nt, Human
guuggccaggcug

SEQ ID NO: 3320273 - RNA, 21 nt, Human
guguggagaagcggcuggcag

SEQ ID NO: 3320274 - RNA, 13 nt, Human
guguggagaagcg

SEQ ID NO: 3320275 - RNA, 15 nt, Human
gugugcucugaucau

SEQ ID NO: 3320276 - RNA, 22 nt, Human
gugugcucugaucauccacugu

SEQ ID NO: 3320277 - RNA, 12 nt, Human
gugugcucugau

SEQ ID NO: 3320278 - RNA, 22 nt, Human
gugucucuugguccugcugcag

SEQ ID NO: 3320279 - RNA, 21 nt, Human
gugucucuugguccugcugca

SEQ ID NO: 3320280 - RNA, 20 nt, Human
gugucucuugguccugcugc

SEQ ID NO: 3320281 - RNA, 19 nt, Human
gugucucuugguccugcug

SEQ ID NO: 3320282 - RNA, 18 nt, Human
gugucucuugguccugcu

SEQ ID NO: 3320283 - RNA, 20 nt, Human
gugugagucaccaagcccag

SEQ ID NO: 3320284 - RNA, 15 nt, Human
gugucgggcaugaca

SEQ ID NO: 3320285 - RNA, 23 nt, Human
gugucccugcacuugcagacucu

SEQ ID NO: 3320286 - RNA, 14 nt, Human
guguccggucccug

SEQ ID NO: 3320287 - RNA, 17 nt, Human
gugucucccuucauccu

SEQ ID NO: 3320288 - RNA, 14 nt, Human
gugucucuuggucc

SEQ ID NO: 3320289 - RNA, 22 nt, Human
guuaaaauaccagccaguaaau

SEQ ID NO: 3320290 - RNA, 15 nt, Human
guuacacuaaaaggu

SEQ ID NO: 3320291 - RNA, 16 nt, Human
guuacacuaaaaggug

SEQ ID NO: 3320292 - RNA, 13 nt, Human
guuacagacaaag

SEQ ID NO: 3320293 - RNA, 18 nt, Human
guguuaugacuccagaau

SEQ ID NO: 3320294 - RNA, 12 nt, Human
guguuacuaagu

SEQ ID NO: 3320295 - RNA, 14 nt, Human
guguuacuaaguuu

SEQ ID NO: 3320296 - RNA, 23 nt, Human
guggcugcuucaaggauccugag

SEQ ID NO: 3320297 - RNA, 19 nt, Human
guggcuggguuggagggug

SEQ ID NO: 3320298 - RNA, 22 nt, Human
guggcugcuucaaggauccuga

SEQ ID NO: 3320299 - RNA, 19 nt, Human
guggcugcuucaaggaucc

SEQ ID NO: 3320300 - RNA, 16 nt, Human
guggcugcuucaagga

SEQ ID NO: 3320301 - RNA, 15 nt, Human
guggcugcuucaagg

SEQ ID NO: 3320302 - RNA, 22 nt, Human
guggcuuaaaacaacacucaca

SEQ ID NO: 3320303 - RNA, 14 nt, Human
guggcucacgccug

SEQ ID NO: 3320304 - RNA, 14 nt, Human
guggcugcuucaag

SEQ ID NO: 3320305 - RNA, 12 nt, Human
guggcugcuuca

SEQ ID NO: 3320306 - RNA, 18 nt, Human
guggggaccucaggccug

SEQ ID NO: 3320307 - RNA, 15 nt, Human
guggggaccucaggc

SEQ ID NO: 3320308 - RNA, 13 nt, Human
guggggcagcuug

SEQ ID NO: 3320309 - RNA, 17 nt, Human
guggggcagcuugaggg

SEQ ID NO: 3320310 - RNA, 23 nt, Human
guggguuucuaaagcugccagcc

SEQ ID NO: 3320311 - RNA, 15 nt, Human
gugggcuaguugggc

SEQ ID NO: 3320312 - RNA, 17 nt, Human
gugggcccaaugcacuu

SEQ ID NO: 3320313 - RNA, 17 nt, Human
guguacauggaauaaca

SEQ ID NO: 3320314 - RNA, 22 nt, Human
guguacauggaauaacauguaa

SEQ ID NO: 3320315 - RNA, 13 nt, Human
gugucccugcacu

SEQ ID NO: 3320316 - RNA, 16 nt, Human
gugucccugcacuugc

SEQ ID NO: 3320317 - RNA, 18 nt, Human
gugucccugcacuugcag

SEQ ID NO: 3320318 - RNA, 20 nt, Human
gugucccaaaaagaaaggag

SEQ ID NO: 3320319 - RNA, 21 nt, Human
guguaaguauucuuauuuaau

SEQ ID NO: 3320320 - RNA, 19 nt, Human
guggugcgaucuggguuca

SEQ ID NO: 3320321 - RNA, 14 nt, Human
guggugaccucugc

SEQ ID NO: 3320322 - RNA, 17 nt, Human
guggugaccucugccug

SEQ ID NO: 3320323 - RNA, 21 nt, Human
guggugagaggcauccaguau

SEQ ID NO: 3320324 - RNA, 17 nt, Human
gugguagagugugccug

SEQ ID NO: 3320325 - RNA, 19 nt, Human
gugguaugaucacggcuca

SEQ ID NO: 3320326 - RNA, 16 nt, Human
guggucccaccccaca

SEQ ID NO: 3320327 - RNA, 15 nt, Human
guggucccaccccac

SEQ ID NO: 3320328 - RNA, 14 nt, Human
guggucccacccca

SEQ ID NO: 3320329 - RNA, 18 nt, Human
gugguccuaaucuucuga

SEQ ID NO: 3320330 - RNA, 17 nt, Human
guggucccaccccacac

SEQ ID NO: 3320331 - RNA, 15 nt, Human
uacccacugcucugg

SEQ ID NO: 3320332 - RNA, 23 nt, Human
uacauuuuuaagugcugcauuua

SEQ ID NO: 3320333 - RNA, 15 nt, Human
uaccuacauacaauu

SEQ ID NO: 3320334 - RNA, 22 nt, Human
uaccuuuuuuagaguugauacu

SEQ ID NO: 3320335 - RNA, 19 nt, Human
uaccuuuuuuagaguugau

SEQ ID NO: 3320336 - RNA, 13 nt, Human
uaccuuuuuuaga

SEQ ID NO: 3320337 - RNA, 18 nt, Human
uaccucggugccuuccuc

SEQ ID NO: 3320338 - RNA, 22 nt, Human
uaccuuuuuuauacauaaacaa

SEQ ID NO: 3320339 - RNA, 17 nt, Human
uaccuuuuuuauacaua

SEQ ID NO: 3320340 - RNA, 16 nt, Human
uaccuuuuuuauacau

SEQ ID NO: 3320341 - RNA, 13 nt, Human
uaccuuuuuuaua

SEQ ID NO: 3320342 - RNA, 21 nt, Human
uacgaaaagaggggaagagac

SEQ ID NO: 3320343 - RNA, 18 nt, Human
uacgaaaagaggggaaga

SEQ ID NO: 3320344 - RNA, 14 nt, Human
uacuaaggaaucuu

SEQ ID NO: 3320345 - RNA, 21 nt, Human
uacuaauagacaauuuauuau

SEQ ID NO: 3320346 - RNA, 20 nt, Human
uacuaauagacaauuuauua

SEQ ID NO: 3320347 - RNA, 13 nt, Human
uacuaacuuuccu

SEQ ID NO: 3320348 - RNA, 13 nt, Human
uacuuguggacac

SEQ ID NO: 3320349 - RNA, 16 nt, Human
uacuguccuacccacc

SEQ ID NO: 3320350 - RNA, 21 nt, Human
uacugucuucaguaagccgug

SEQ ID NO: 3320351 - RNA, 14 nt, Human
uacuacaguuuguu

SEQ ID NO: 3320352 - RNA, 13 nt, Human
uacuacaguuugu

SEQ ID NO: 3320353 - RNA, 20 nt, Human
uacuacaguccucccaucuc

SEQ ID NO: 3320354 - RNA, 22 nt, Human
uacuacaguccucccaucucac

SEQ ID NO: 3320355 - RNA, 18 nt, Human
uacucgaguuacagacaa

SEQ ID NO: 3320356 - RNA, 22 nt, Human
uacucgaguuacagacaaagcg

SEQ ID NO: 3320357 - RNA, 17 nt, Human
uacugcauaugaaagga

SEQ ID NO: 3320358 - RNA, 21 nt, Human
uacacugugcugagucugaag

SEQ ID NO: 3320359 - RNA, 15 nt, Human
uacacacugcauguu

SEQ ID NO: 3320360 - RNA, 11 nt, Human
uacacacacac

SEQ ID NO: 3320361 - RNA, 23 nt, Human
uacacaaugguuuucuugugugu

SEQ ID NO: 3320362 - RNA, 14 nt, Human
uacaaaguagaagu

SEQ ID NO: 3320363 - RNA, 18 nt, Human
uacaaaguagaagucuua

SEQ ID NO: 3320364 - RNA, 15 nt, Human
uacaggagugagcac

SEQ ID NO: 3320365 - RNA, 22 nt, Human
uacaggaaguacuggagaaaau

SEQ ID NO: 3320366 - RNA, 15 nt, Human
uacaggaaguacugg

SEQ ID NO: 3320367 - RNA, 14 nt, Human
uacaggaaguacug

SEQ ID NO: 3320368 - RNA, 20 nt, Human
uacaguugaaaaacagcuga

SEQ ID NO: 3320369 - RNA, 18 nt, Human
uacaguuuguuaguauga

SEQ ID NO: 3320370 - RNA, 19 nt, Human
uacaguugaaaaacagcug

SEQ ID NO: 3320371 - RNA, 17 nt, Human
uacaguugaaaaacagc

SEQ ID NO: 3320372 - RNA, 16 nt, Human
uacacugugcugaguc

SEQ ID NO: 3320373 - RNA, 20 nt, Human
uacacuguuucaaacuuuac

SEQ ID NO: 3320374 - RNA, 23 nt, Human
uacacugugcugagucugaaggc

SEQ ID NO: 3320375 - RNA, 22 nt, Human
uacacugugcugagucugaagg

SEQ ID NO: 3320376 - RNA, 16 nt, Human
uacacuuacacuuuau

SEQ ID NO: 3320377 - RNA, 22 nt, Human
uacacuguuucaaacuuuacua

SEQ ID NO: 3320378 - RNA, 19 nt, Human
uacacuguuucaaacuuua

SEQ ID NO: 3320379 - RNA, 20 nt, Human
uacagcuugaccgugaggcc

SEQ ID NO: 3320380 - RNA, 13 nt, Human
uacaggaaguacu

SEQ ID NO: 3320381 - RNA, 18 nt, Human
uacaggaagguagaaaua

SEQ ID NO: 3320382 - RNA, 14 nt, Human
uacauggaauaaca

SEQ ID NO: 3320383 - RNA, 18 nt, Human
uacauggaauaacaugua

SEQ ID NO: 3320384 - RNA, 19 nt, Human
uacauggaauaacauguaa

SEQ ID NO: 3320385 - RNA, 22 nt, Human
uacauggaauaacauguaauua

SEQ ID NO: 3320386 - RNA, 22 nt, Human
uacauuuuuaagugcugcauuu

SEQ ID NO: 3320387 - RNA, 19 nt, Human
uacauuuuuaagugcugca

SEQ ID NO: 3320388 - RNA, 14 nt, Human
uacauuuuuaagug

SEQ ID NO: 3320389 - RNA, 16 nt, Human
uacauaagauaaaugu

SEQ ID NO: 3320390 - RNA, 16 nt, Human
uacaugaaaacacauu

SEQ ID NO: 3320391 - RNA, 23 nt, Human
uacaugaaaacacauuuuucuua

SEQ ID NO: 3320392 - RNA, 19 nt, Human
uacaugaaaacacauuuuu

SEQ ID NO: 3320393 - RNA, 18 nt, Human
uacaugaaaacacauuuu

SEQ ID NO: 3320394 - RNA, 17 nt, Human
uacaugaaaacacauuu

SEQ ID NO: 3320395 - RNA, 16 nt, Human
uacauaaacaaguccu

SEQ ID NO: 3320396 - RNA, 21 nt, Human
uacaguuuguuaguaugaggc

SEQ ID NO: 3320397 - RNA, 19 nt, Human
uacaguuuguuaguaugag

SEQ ID NO: 3320398 - RNA, 23 nt, Human
uagaauuaguggcacuugcuuuu

SEQ ID NO: 3320399 - RNA, 20 nt, Human
uagaagucuuagauguauau

SEQ ID NO: 3320400 - RNA, 15 nt, Human
uagagguucaaagau

SEQ ID NO: 3320401 - RNA, 14 nt, Human
uagagguucaaaga

SEQ ID NO: 3320402 - RNA, 12 nt, Human
uagagugggagc

SEQ ID NO: 3320403 - RNA, 17 nt, Human
uagaguugauacuacag

SEQ ID NO: 3320404 - RNA, 14 nt, Human
uagaguugauacua

SEQ ID NO: 3320405 - RNA, 17 nt, Human
uagccugccucuucucu

SEQ ID NO: 3320406 - RNA, 12 nt, Human
uagcugggacua

SEQ ID NO: 3320407 - RNA, 15 nt, Human
uagcugggacuacag

SEQ ID NO: 3320408 - RNA, 17 nt, Human
uagcugggacuacaggc

SEQ ID NO: 3320409 - RNA, 16 nt, Human
uagcucaggugucccu

SEQ ID NO: 3320410 - RNA, 18 nt, Human
uagccugugccucuggga

SEQ ID NO: 3320411 - RNA, 20 nt, Human
uagcucaggugucccugcac

SEQ ID NO: 3320412 - RNA, 21 nt, Human
uagcucaggugucccugcacu

SEQ ID NO: 3320413 - RNA, 12 nt, Human
uagcucauucuc

SEQ ID NO: 3320414 - RNA, 16 nt, Human
uagauacuguaucaug

SEQ ID NO: 3320415 - RNA, 11 nt, Human
uagcagggaaa

SEQ ID NO: 3320416 - RNA, 19 nt, Human
uagcauacguacacauuuu

SEQ ID NO: 3320417 - RNA, 18 nt, Human
uagcauacguacacauuu

SEQ ID NO: 3320418 - RNA, 17 nt, Human
uagcauacguacacauu

SEQ ID NO: 3320419 - RNA, 16 nt, Human
uagcauacguacacau

SEQ ID NO: 3320420 - RNA, 16 nt, Human
uaguuugauuaaauuc

SEQ ID NO: 3320421 - RNA, 15 nt, Human
uaguuugauuaaauu

SEQ ID NO: 3320422 - RNA, 11 nt, Human
uauaaacuuua

SEQ ID NO: 3320423 - RNA, 14 nt, Human
uauaaacuuuaccu

SEQ ID NO: 3320424 - RNA, 13 nt, Human
uauaaacuuuacc

SEQ ID NO: 3320425 - RNA, 16 nt, Human
uauaaacuuuaccuuu

SEQ ID NO: 3320426 - RNA, 15 nt, Human
uauaaacuuuaccuu

SEQ ID NO: 3320427 - RNA, 17 nt, Human
uauaaacuuuaccuuuu

SEQ ID NO: 3320428 - RNA, 16 nt, Human
uaguaugguggcuggg

SEQ ID NO: 3320429 - RNA, 15 nt, Human
uaguaugaggcauuu

SEQ ID NO: 3320430 - RNA, 20 nt, Human
uaguggcuuaaaacaacacu

SEQ ID NO: 3320431 - RNA, 22 nt, Human
uaguuguuugauucagacagcu

SEQ ID NO: 3320432 - RNA, 21 nt, Human
uaguuguuugauucagacagc

SEQ ID NO: 3320433 - RNA, 20 nt, Human
uaguuguuugauucagacag

SEQ ID NO: 3320434 - RNA, 17 nt, Human
uaggugugggggaagca

SEQ ID NO: 3320435 - RNA, 13 nt, Human
uagguguggggga

SEQ ID NO: 3320436 - RNA, 23 nt, Human
uaggugugacugaauuucuuuug

SEQ ID NO: 3320437 - RNA, 21 nt, Human
uaggugugacugaauuucuuu

SEQ ID NO: 3320438 - RNA, 19 nt, Human
uaggugugacugaauuucu

SEQ ID NO: 3320439 - RNA, 18 nt, Human
uaguaugaggcauuuguu

SEQ ID NO: 3320440 - RNA, 17 nt, Human
uaguaugaggcauuugu

SEQ ID NO: 3320441 - RNA, 11 nt, Human
uaggugacaga

SEQ ID NO: 3320442 - RNA, 16 nt, Human
uaggugacagagugag

SEQ ID NO: 3320443 - RNA, 22 nt, Human
uagcuggucuuauuuguaaagc

SEQ ID NO: 3320444 - RNA, 19 nt, Human
uaucaggugcugccaucca

SEQ ID NO: 3320445 - RNA, 17 nt, Human
uaucaggugcugccauc

SEQ ID NO: 3320446 - RNA, 20 nt, Human
uaucaggugcugccauccag

SEQ ID NO: 3320447 - RNA, 17 nt, Human
uaucaugacaaagacug

SEQ ID NO: 3320448 - RNA, 15 nt, Human
uaaaacaacacucac

SEQ ID NO: 3320449 - RNA, 17 nt, Human
uaaaacacaacaucuuu

SEQ ID NO: 3320450 - RNA, 23 nt, Human
uaaaacacaacaucuuuuucuac

SEQ ID NO: 3320451 - RNA, 22 nt, Human
uaaaacacaacaucuuuuucua

SEQ ID NO: 3320452 - RNA, 12 nt, Human
uaaaaggugacc

SEQ ID NO: 3320453 - RNA, 12 nt, Human
uaaaaggagcca

SEQ ID NO: 3320454 - RNA, 21 nt, Human
uaaaagguaugcaaucaaauc

SEQ ID NO: 3320455 - RNA, 14 nt, Human
uaaaagauacaguu

SEQ ID NO: 3320456 - RNA, 20 nt, Human
uaaaagauacaguuacucag

SEQ ID NO: 3320457 - RNA, 17 nt, Human
uaaaagauacaguuacu

SEQ ID NO: 3320458 - RNA, 21 nt, Human
uaaaagauacaguuacucaga

SEQ ID NO: 3320459 - RNA, 17 nt, Human
uaaaggcuaccuuugua

SEQ ID NO: 3320460 - RNA, 20 nt, Human
uaaagccugaguuugcuuuc

SEQ ID NO: 3320461 - RNA, 15 nt, Human
uaaaggcuaccuuug

SEQ ID NO: 3320462 - RNA, 12 nt, Human
uaaagaaaacug

SEQ ID NO: 3320463 - RNA, 19 nt, Human
uaaagcagcguuucuauga

SEQ ID NO: 3320464 - RNA, 17 nt, Human
uaaagcagcguuucuau

SEQ ID NO: 3320465 - RNA, 16 nt, Human
uaaagcagcguuucua

SEQ ID NO: 3320466 - RNA, 22 nt, Human
uaaacuugguuuuuaaaaaacu

SEQ ID NO: 3320467 - RNA, 19 nt, Human
uaaacaagaccacguuucu

SEQ ID NO: 3320468 - RNA, 20 nt, Human
uaaacaagaccacguuucua

SEQ ID NO: 3320469 - RNA, 22 nt, Human
uaaacaagaccacguuucuaaa

SEQ ID NO: 3320470 - RNA, 21 nt, Human
uaaacaagaccacguuucuaa

SEQ ID NO: 3320471 - RNA, 14 nt, Human
guuuagauaauaca

SEQ ID NO: 3320472 - RNA, 15 nt, Human
guuguuacauuuuua

SEQ ID NO: 3320473 - RNA, 14 nt, Human
guuguuacauuuuu

SEQ ID NO: 3320474 - RNA, 14 nt, Human
guugugguuaaucu

SEQ ID NO: 3320475 - RNA, 22 nt, Human
guuguggauuuaacagaaaugu

SEQ ID NO: 3320476 - RNA, 12 nt, Human
guugucagcuga

SEQ ID NO: 3320477 - RNA, 19 nt, Human
guuggcugggggccucagu

SEQ ID NO: 3320478 - RNA, 20 nt, Human
guuggccccugcccggcugc

SEQ ID NO: 3320479 - RNA, 13 nt, Human
guuggccccugcc

SEQ ID NO: 3320480 - RNA, 14 nt, Human
guuggccccugccc

SEQ ID NO: 3320481 - RNA, 12 nt, Human
guuggcuggggg

SEQ ID NO: 3320482 - RNA, 20 nt, Human
guuuguaaauuaacuuuuau

SEQ ID NO: 3320483 - RNA, 18 nt, Human
guuuggggaugagaaagg

SEQ ID NO: 3320484 - RNA, 20 nt, Human
guuugauucagacagcugcc

SEQ ID NO: 3320485 - RNA, 16 nt, Human
guuugauucagacagc

SEQ ID NO: 3320486 - RNA, 18 nt, Human
guuuguuucugaaaggga

SEQ ID NO: 3320487 - RNA, 17 nt, Human
guuugagaucagccugg

SEQ ID NO: 3320488 - RNA, 23 nt, Human
guuugauuaaauucuugcaaagu

SEQ ID NO: 3320489 - RNA, 20 nt, Human
guuuuccaugaguccccugu

SEQ ID NO: 3320490 - RNA, 19 nt, Human
guuuuccaugaguccccug

SEQ ID NO: 3320491 - RNA, 20 nt, Human
guuuuccagguuuaagcugu

SEQ ID NO: 3320492 - RNA, 11 nt, Human
guuuucacucu

SEQ ID NO: 3320493 - RNA, 12 nt, Human
guuuucacucuu

SEQ ID NO: 3320494 - RNA, 17 nt, Human
guuuucaaaauaaaaau

SEQ ID NO: 3320495 - RNA, 20 nt, Human
guuuguuucugaaagggacg

SEQ ID NO: 3320496 - RNA, 18 nt, Human
uaacaccaugauuaacca

SEQ ID NO: 3320497 - RNA, 11 nt, Human
uaaauuauuuu

SEQ ID NO: 3320498 - RNA, 22 nt, Human
uaaauucuugcaaaguaucccu

SEQ ID NO: 3320499 - RNA, 18 nt, Human
uaaauucuugcaaaguau

SEQ ID NO: 3320500 - RNA, 17 nt, Human
uaaauucuugcaaagua

SEQ ID NO: 3320501 - RNA, 16 nt, Human
uaaauucuugcaaagu

SEQ ID NO: 3320502 - RNA, 17 nt, Human
uaaaugggggugcauuu

SEQ ID NO: 3320503 - RNA, 14 nt, Human
uaaaugggggugca

SEQ ID NO: 3320504 - RNA, 19 nt, Human
uaaaugggggugcauuuga

SEQ ID NO: 3320505 - RNA, 18 nt, Human
uaaaugggggugcauuug

SEQ ID NO: 3320506 - RNA, 22 nt, Human
uaaaugucucuuuaaugucaca

SEQ ID NO: 3320507 - RNA, 20 nt, Human
uaaaugucuaguuguaacac

SEQ ID NO: 3320508 - RNA, 17 nt, Human
uaaaugcccagccccuu

SEQ ID NO: 3320509 - RNA, 16 nt, Human
uaaaugcccagccccu

SEQ ID NO: 3320510 - RNA, 15 nt, Human
uaaaugcccagcccc

SEQ ID NO: 3320511 - RNA, 14 nt, Human
uaaaugcccagccc

SEQ ID NO: 3320512 - RNA, 16 nt, Human
uaaauggaaccacucu

SEQ ID NO: 3320513 - RNA, 13 nt, Human
uaaaugcccagcc

SEQ ID NO: 3320514 - RNA, 19 nt, Human
uaagaaccuuuugagugcc

SEQ ID NO: 3320515 - RNA, 23 nt, Human
uaagaaaaaggaugcacagaguu

SEQ ID NO: 3320516 - RNA, 19 nt, Human
uaagaaaaaggaugcacag

SEQ ID NO: 3320517 - RNA, 18 nt, Human
uaagaaaaaggaugcaca

SEQ ID NO: 3320518 - RNA, 16 nt, Human
uaagaaaaaggaugca

SEQ ID NO: 3320519 - RNA, 23 nt, Human
uaaccaguguuguggauuuaaca

SEQ ID NO: 3320520 - RNA, 16 nt, Human
uaaccacuucagcuga

SEQ ID NO: 3320521 - RNA, 11 nt, Human
uaacagaaaug

SEQ ID NO: 3320522 - RNA, 14 nt, Human
uaagugcugcauuu

SEQ ID NO: 3320523 - RNA, 23 nt, Human
uaagugaggaugaaaaaauaaca

SEQ ID NO: 3320524 - RNA, 12 nt, Human
uaagugagagag

SEQ ID NO: 3320525 - RNA, 20 nt, Human
uaagugguacuaacuuuccu

SEQ ID NO: 3320526 - RNA, 22 nt, Human
uaagugcugcauuuaaaagaua

SEQ ID NO: 3320527 - RNA, 18 nt, Human
uaagugcugcauuuaaaa

SEQ ID NO: 3320528 - RNA, 16 nt, Human
uaagugcugcauuuaa

SEQ ID NO: 3320529 - RNA, 15 nt, Human
uaagugcugcauuua

SEQ ID NO: 3320530 - RNA, 12 nt, Human
uaagaggcaggg

SEQ ID NO: 3320531 - RNA, 15 nt, Human
uaagaggcagggucu

SEQ ID NO: 3320532 - RNA, 16 nt, Human
uaaggauguucuagca

SEQ ID NO: 3320533 - RNA, 20 nt, Human
uaagguggguacgggagggu

SEQ ID NO: 3320534 - RNA, 15 nt, Human
uaaggugugcucuga

SEQ ID NO: 3320535 - RNA, 17 nt, Human
uaaggguaucuggugac

SEQ ID NO: 3320536 - RNA, 15 nt, Human
uaaugcgugcauacc

SEQ ID NO: 3320537 - RNA, 23 nt, Human
uaaugcgugcauaccacuuuugu

SEQ ID NO: 3320538 - RNA, 22 nt, Human
uaaugcgugcauaccacuuuug

SEQ ID NO: 3320539 - RNA, 19 nt, Human
uaaugcgugcauaccacuu

SEQ ID NO: 3320540 - RNA, 15 nt, Human
uaauggggcggugag

SEQ ID NO: 3320541 - RNA, 14 nt, Human
uaauuaaguacuau

SEQ ID NO: 3320542 - RNA, 17 nt, Human
uaauuaaguacuaugua

SEQ ID NO: 3320543 - RNA, 20 nt, Human
uaauauuaaggaagacaaug

SEQ ID NO: 3320544 - RNA, 13 nt, Human
uaaucuaaaugga

SEQ ID NO: 3320545 - RNA, 12 nt, Human
uaaucuaaaugg

SEQ ID NO: 3320546 - RNA, 19 nt, Human
uaauaugcacacauuuuuu

SEQ ID NO: 3320547 - RNA, 18 nt, Human
uaauaugcacacauuuuu

SEQ ID NO: 3320548 - RNA, 17 nt, Human
uaauaugcacacauuuu

SEQ ID NO: 3320549 - RNA, 16 nt, Human
uaauaugcacacauuu

SEQ ID NO: 3320550 - RNA, 15 nt, Human
uaauaugcacacauu

SEQ ID NO: 3320551 - RNA, 17 nt, Human
uguuuuaagaggcaggg

SEQ ID NO: 3320552 - RNA, 19 nt, Human
uguuuuaaggaugcuugua

SEQ ID NO: 3320553 - RNA, 23 nt, Human
uguuuuaaggaugcuuguacaua

SEQ ID NO: 3320554 - RNA, 22 nt, Human
uguuuuaaggaugcuuguacau

SEQ ID NO: 3320555 - RNA, 16 nt, Human
uguuuuaagaggcagg

SEQ ID NO: 3320556 - RNA, 22 nt, Human
uuaaacuuaaucuaaauggaac

SEQ ID NO: 3320557 - RNA, 14 nt, Human
uuaaaacccaagug

SEQ ID NO: 3320558 - RNA, 14 nt, Human
uuaaaugcccagcc

SEQ ID NO: 3320559 - RNA, 16 nt, Human
uuaaaugcccagcccc

SEQ ID NO: 3320560 - RNA, 15 nt, Human
uuaaaugcccagccc

SEQ ID NO: 3320561 - RNA, 22 nt, Human
uuaauuaaaacacaacaucuuu

SEQ ID NO: 3320562 - RNA, 17 nt, Human
uuacauuuuuaagugcu

SEQ ID NO: 3320563 - RNA, 12 nt, Human
uuacauuuuuaa

SEQ ID NO: 3320564 - RNA, 13 nt, Human
uuacacuuuaugc

SEQ ID NO: 3320565 - RNA, 20 nt, Human
uuacacuuuaugcacaaaau

SEQ ID NO: 3320566 - RNA, 13 nt, Human
uuaacuuuuauaa

SEQ ID NO: 3320567 - RNA, 12 nt, Human
uuaacuuuuaua

SEQ ID NO: 3320568 - RNA, 13 nt, Human
uuaaaugcccagc

SEQ ID NO: 3320569 - RNA, 19 nt, Human
ugugugcacguacacacac

SEQ ID NO: 3320570 - RNA, 13 nt, Human
uguguuuauuguc

SEQ ID NO: 3320571 - RNA, 16 nt, Human
uguguuuauugucaaa

SEQ ID NO: 3320572 - RNA, 18 nt, Human
uguucagcuccagcucac

SEQ ID NO: 3320573 - RNA, 20 nt, Human
uguucagcuccagcucacca

SEQ ID NO: 3320574 - RNA, 21 nt, Human
uguucagcuccagcucaccag

SEQ ID NO: 3320575 - RNA, 17 nt, Human
uguuaguaugaggcauu

SEQ ID NO: 3320576 - RNA, 20 nt, Human
uguuaguaugaggcauuugu

SEQ ID NO: 3320577 - RNA, 19 nt, Human
uguuaguaugaggcauuug

SEQ ID NO: 3320578 - RNA, 14 nt, Human
uguuacuaaguuuu

SEQ ID NO: 3320579 - RNA, 23 nt, Human
uguucuuucuggcuaugcauuug

SEQ ID NO: 3320580 - RNA, 21 nt, Human
uguucuggcucuuccaggcug

SEQ ID NO: 3320581 - RNA, 20 nt, Human
uguucuggcucuuccaggcu

SEQ ID NO: 3320582 - RNA, 17 nt, Human
uguucuggcucuuccag

SEQ ID NO: 3320583 - RNA, 16 nt, Human
uguucucucuucucca

SEQ ID NO: 3320584 - RNA, 15 nt, Human
uguucucucuucucc

SEQ ID NO: 3320585 - RNA, 19 nt, Human
uguucaucauccuaagcua

SEQ ID NO: 3320586 - RNA, 12 nt, Human
uguucucugccc

SEQ ID NO: 3320587 - RNA, 12 nt, Human
uguucuggcucu

SEQ ID NO: 3320588 - RNA, 16 nt, Human
uguucuggcucuucca

SEQ ID NO: 3320589 - RNA, 13 nt, Human
uguucuggcucuu

SEQ ID NO: 3320590 - RNA, 15 nt, Human
uguucucugcccucc

SEQ ID NO: 3320591 - RNA, 14 nt, Human
uguucucugcccuc

SEQ ID NO: 3320592 - RNA, 13 nt, Human
uguucucugcccu

SEQ ID NO: 3320593 - RNA, 19 nt, Human
uguuggcugggggccucag

SEQ ID NO: 3320594 - RNA, 17 nt, Human
uguuggcugggggccuc

SEQ ID NO: 3320595 - RNA, 15 nt, Human
uguuggccaggcugg

SEQ ID NO: 3320596 - RNA, 16 nt, Human
uguuggccaggcuggu

SEQ ID NO: 3320597 - RNA, 23 nt, Human
uguggcgcagcauauucaggaag

SEQ ID NO: 3320598 - RNA, 18 nt, Human
uguggacacagcucuucu

SEQ ID NO: 3320599 - RNA, 16 nt, Human
uguggacacagcucuu

SEQ ID NO: 3320600 - RNA, 19 nt, Human
uguggacacagcucuucuc

SEQ ID NO: 3320601 - RNA, 12 nt, Human
uguguagggcgg

SEQ ID NO: 3320602 - RNA, 21 nt, Human
ugugcauuaucuagauacugu

SEQ ID NO: 3320603 - RNA, 20 nt, Human
ugugcauuaucuagauacug

SEQ ID NO: 3320604 - RNA, 23 nt, Human
ugugcauuaucuagauacuguau

SEQ ID NO: 3320605 - RNA, 14 nt, Human
ugugcacguacaca

SEQ ID NO: 3320606 - RNA, 14 nt, Human
ugugcauuaucuag

SEQ ID NO: 3320607 - RNA, 19 nt, Human
ugugcauuaucuagauacu

SEQ ID NO: 3320608 - RNA, 16 nt, Human
ugugcauuaucuagau

SEQ ID NO: 3320609 - RNA, 14 nt, Human
ugugcgccuacagg

SEQ ID NO: 3320610 - RNA, 19 nt, Human
ugugcgccuacaggaguga

SEQ ID NO: 3320611 - RNA, 21 nt, Human
ugugaaaagaaaaaugagccu

SEQ ID NO: 3320612 - RNA, 23 nt, Human
ugugaaaagaaaaaugagccugg

SEQ ID NO: 3320613 - RNA, 23 nt, Human
ugucuuuucuugcaugaggcuag

SEQ ID NO: 3320614 - RNA, 14 nt, Human
ugucuuuggacccu

SEQ ID NO: 3320615 - RNA, 21 nt, Human
ugucuuuucuugcaugaggcu

SEQ ID NO: 3320616 - RNA, 16 nt, Human
ugucuuuggacccuga

SEQ ID NO: 3320617 - RNA, 15 nt, Human
ugugacauguuuuau

SEQ ID NO: 3320618 - RNA, 12 nt, Human
ugugaggaagcc

SEQ ID NO: 3320619 - RNA, 20 nt, Human
ugugaggaagccgcuggggc

SEQ ID NO: 3320620 - RNA, 18 nt, Human
ugugaggaagccgcuggg

SEQ ID NO: 3320621 - RNA, 13 nt, Human
ugugaggaagccg

SEQ ID NO: 3320622 - RNA, 19 nt, Human
ugugagucaccaagcccag

SEQ ID NO: 3320623 - RNA, 21 nt, Human
ugugagucaccaagcccaguu

SEQ ID NO: 3320624 - RNA, 15 nt, Human
ugugagucaccaagc

SEQ ID NO: 3320625 - RNA, 17 nt, Human
ugugagucaccaagccc

SEQ ID NO: 3320626 - RNA, 13 nt, Human
ugucacacacuuu

SEQ ID NO: 3320627 - RNA, 17 nt, Human
ugucacacacuuuggcu

SEQ ID NO: 3320628 - RNA, 12 nt, Human
ugucacaggcag

SEQ ID NO: 3320629 - RNA, 19 nt, Human
uguauuuuacuaauaaaau

SEQ ID NO: 3320630 - RNA, 20 nt, Human
uguauucucuccuguaccuc

SEQ ID NO: 3320631 - RNA, 22 nt, Human
uguauucucuccuguaccucuu

SEQ ID NO: 3320632 - RNA, 16 nt, Human
uguccuacccacccuc

SEQ ID NO: 3320633 - RNA, 12 nt, Human
uguccuacucug

SEQ ID NO: 3320634 - RNA, 17 nt, Human
uguccuacucuguguca

SEQ ID NO: 3320635 - RNA, 20 nt, Human
uguccuacccacccuccuuu

SEQ ID NO: 3320636 - RNA, 16 nt, Human
uguccccgacccuugc

SEQ ID NO: 3320637 - RNA, 13 nt, Human
uguccccaccgca

SEQ ID NO: 3320638 - RNA, 22 nt, Human
uguccccaccgcagacaggacc

SEQ ID NO: 3320639 - RNA, 19 nt, Human
uguccccaccgcagacagg

SEQ ID NO: 3320640 - RNA, 18 nt, Human
uguccccaccgcagacag

SEQ ID NO: 3320641 - RNA, 13 nt, Human
ugucaccugaaga

SEQ ID NO: 3320642 - RNA, 23 nt, Human
ugucccaaaaagaaaggagggga

SEQ ID NO: 3320643 - RNA, 16 nt, Human
ugucauuugagcaggg

SEQ ID NO: 3320644 - RNA, 18 nt, Human
uguacagagcccacgccc

SEQ ID NO: 3320645 - RNA, 13 nt, Human
uguacagagccca

SEQ ID NO: 3320646 - RNA, 17 nt, Human
uguacagagcccacgcc

SEQ ID NO: 3320647 - RNA, 16 nt, Human
uguacagagcccacgc

SEQ ID NO: 3320648 - RNA, 15 nt, Human
uguacgucugacagg

SEQ ID NO: 3320649 - RNA, 19 nt, Human
uguacugcauaugaaagga

SEQ ID NO: 3320650 - RNA, 14 nt, Human
ugccugguggcagc

SEQ ID NO: 3320651 - RNA, 15 nt, Human
ugccugguggcagcu

SEQ ID NO: 3320652 - RNA, 18 nt, Human
ugccugggcagaaggaag

SEQ ID NO: 3320653 - RNA, 21 nt, Human
ugccugggaucccucauccuc

SEQ ID NO: 3320654 - RNA, 18 nt, Human
ugccccuggcagccccug

SEQ ID NO: 3320655 - RNA, 20 nt, Human
ugccucgaacuggcugcaaa

SEQ ID NO: 3320656 - RNA, 18 nt, Human
ugccucgaacuggcugca

SEQ ID NO: 3320657 - RNA, 19 nt, Human
ugccucgaacuggcugcaa

SEQ ID NO: 3320658 - RNA, 14 nt, Human
ugcgaucuggguuc

SEQ ID NO: 3320659 - RNA, 15 nt, Human
ugcgaucuggguuca

SEQ ID NO: 3320660 - RNA, 19 nt, Human
ugcgaucuggguucacugc

SEQ ID NO: 3320661 - RNA, 20 nt, Human
ugcgaucuggguucacugca

SEQ ID NO: 3320662 - RNA, 21 nt, Human
ugcgaucuggguucacugcaa

SEQ ID NO: 3320663 - RNA, 15 nt, Human
ugcuaaaugugaaug

SEQ ID NO: 3320664 - RNA, 13 nt, Human
ugcgccuacagga

SEQ ID NO: 3320665 - RNA, 22 nt, Human
ugcgccuacaggagugagcacu

SEQ ID NO: 3320666 - RNA, 14 nt, Human
ugcgccuacaggag

SEQ ID NO: 3320667 - RNA, 16 nt, Human
ugcgccuacaggagug

SEQ ID NO: 3320668 - RNA, 15 nt, Human
ugcucacauaucugu

SEQ ID NO: 3320669 - RNA, 16 nt, Human
ugcucacauaucuguc

SEQ ID NO: 3320670 - RNA, 14 nt, Human
ugcuccucucccca

SEQ ID NO: 3320671 - RNA, 18 nt, Human
ugcuccuuucuuguuuua

SEQ ID NO: 3320672 - RNA, 17 nt, Human
ugcuccucuccccagca

SEQ ID NO: 3320673 - RNA, 13 nt, Human
ugcugcuggcugg

SEQ ID NO: 3320674 - RNA, 23 nt, Human
ugcugcaguugccagucaccccg

SEQ ID NO: 3320675 - RNA, 18 nt, Human
ugcugcaguugccaguca

SEQ ID NO: 3320676 - RNA, 16 nt, Human
ugcugcaguugccagu

SEQ ID NO: 3320677 - RNA, 22 nt, Human
ugcugacagacacaggcccggc

SEQ ID NO: 3320678 - RNA, 23 nt, Human
ugcugacagacacaggcccggcu

SEQ ID NO: 3320679 - RNA, 19 nt, Human
ugcugacagacacaggccc

SEQ ID NO: 3320680 - RNA, 13 nt, Human
ugcugaaggcucg

SEQ ID NO: 3320681 - RNA, 12 nt, Human
ugcugaaggcuc

SEQ ID NO: 3320682 - RNA, 13 nt, Human
ugcugauggugca

SEQ ID NO: 3320683 - RNA, 17 nt, Human
ugcugauggugcaauga

SEQ ID NO: 3320684 - RNA, 15 nt, Human
ugcugauggugcaau

SEQ ID NO: 3320685 - RNA, 16 nt, Human
ugcagugcuuccaagg

SEQ ID NO: 3320686 - RNA, 19 nt, Human
ugcaggcagccaggccaca

SEQ ID NO: 3320687 - RNA, 14 nt, Human
ugcaggcagccagg

SEQ ID NO: 3320688 - RNA, 13 nt, Human
ugcaggcagccag

SEQ ID NO: 3320689 - RNA, 14 nt, Human
ugcaguugccaguc

SEQ ID NO: 3320690 - RNA, 13 nt, Human
ugcaguugccagu

SEQ ID NO: 3320691 - RNA, 22 nt, Human
ugcagugguaugaucacggcuc

SEQ ID NO: 3320692 - RNA, 21 nt, Human
ugcaccggcuggccuggcccc

SEQ ID NO: 3320693 - RNA, 17 nt, Human
ugcaccgggccacagag

SEQ ID NO: 3320694 - RNA, 22 nt, Human
ugcaccgggccacagagaaagu

SEQ ID NO: 3320695 - RNA, 14 nt, Human
ugcaccgggccaca

SEQ ID NO: 3320696 - RNA, 15 nt, Human
ugcaccgggccacag

SEQ ID NO: 3320697 - RNA, 23 nt, Human
ugcaccggcuggccuggccccuc

SEQ ID NO: 3320698 - RNA, 19 nt, Human
ugaguccccuguuuguuuc

SEQ ID NO: 3320699 - RNA, 14 nt, Human
ugcacuuuguucug

SEQ ID NO: 3320700 - RNA, 12 nt, Human
ugcacuuuguuc

SEQ ID NO: 3320701 - RNA, 23 nt, Human
ugcagcaauaaagcagcguuucu

SEQ ID NO: 3320702 - RNA, 20 nt, Human
ugcagcaauaaagcagcguu

SEQ ID NO: 3320703 - RNA, 19 nt, Human
ugccacccuggggagaaag

SEQ ID NO: 3320704 - RNA, 22 nt, Human
ugccacuacggaauaguuggcu

SEQ ID NO: 3320705 - RNA, 18 nt, Human
ugccagguuuuuggucug

SEQ ID NO: 3320706 - RNA, 19 nt, Human
ugccagguuuuuggucuga

SEQ ID NO: 3320707 - RNA, 22 nt, Human
ugccagguuuuuggucugaccc

SEQ ID NO: 3320708 - RNA, 14 nt, Human
ugcaucaagaugug

SEQ ID NO: 3320709 - RNA, 19 nt, Human
ugccccucaacucuccucc

SEQ ID NO: 3320710 - RNA, 17 nt, Human
ugccccuggcagccccu

SEQ ID NO: 3320711 - RNA, 23 nt, Human
ugccccucaacucuccuccagag

SEQ ID NO: 3320712 - RNA, 11 nt, Human
ugcccaggcug

SEQ ID NO: 3320713 - RNA, 16 nt, Human
ugcccacucccugcaa

SEQ ID NO: 3320714 - RNA, 15 nt, Human
ugcccacucccugca

SEQ ID NO: 3320715 - RNA, 14 nt, Human
ugcccacucccugc

SEQ ID NO: 3320716 - RNA, 13 nt, Human
ugcccaccuggcc

SEQ ID NO: 3320717 - RNA, 13 nt, Human
ugcccacucccug

SEQ ID NO: 3320718 - RNA, 21 nt, Human
ugccauccagguucagcuugu

SEQ ID NO: 3320719 - RNA, 20 nt, Human
ugccauccagguucagcuug

SEQ ID NO: 3320720 - RNA, 14 nt, Human
ugggauccuccagg

SEQ ID NO: 3320721 - RNA, 15 nt, Human
ugggauccuccaggu

SEQ ID NO: 3320722 - RNA, 15 nt, Human
ugggagugagcuggu

SEQ ID NO: 3320723 - RNA, 22 nt, Human
ugggagcugccuguucagcucc

SEQ ID NO: 3320724 - RNA, 17 nt, Human
ugggagcugccuguuca

SEQ ID NO: 3320725 - RNA, 21 nt, Human
ugggagcugccuguucagcuc

SEQ ID NO: 3320726 - RNA, 15 nt, Human
ugggcagaggaaagc

SEQ ID NO: 3320727 - RNA, 13 nt, Human
ugggauccuggag

SEQ ID NO: 3320728 - RNA, 18 nt, Human
ugggauccuccaggugca

SEQ ID NO: 3320729 - RNA, 16 nt, Human
ugggauuacaggugug

SEQ ID NO: 3320730 - RNA, 12 nt, Human
ugggacacccug

SEQ ID NO: 3320731 - RNA, 12 nt, Human
ugggagcugccu

SEQ ID NO: 3320732 - RNA, 13 nt, Human
ugggagcugccug

SEQ ID NO: 3320733 - RNA, 14 nt, Human
ugggagcugccugu

SEQ ID NO: 3320734 - RNA, 13 nt, Human
ugggagcaaaaga

SEQ ID NO: 3320735 - RNA, 22 nt, Human
uggcuuccuaaaauucagugga

SEQ ID NO: 3320736 - RNA, 14 nt, Human
uggcuuuugugcau

SEQ ID NO: 3320737 - RNA, 21 nt, Human
uggcugcuucaaggauccuga

SEQ ID NO: 3320738 - RNA, 16 nt, Human
uggcugcuucaaggau

SEQ ID NO: 3320739 - RNA, 21 nt, Human
uggcugggggccucagugcca

SEQ ID NO: 3320740 - RNA, 20 nt, Human
uggcugggggccucagugcc

SEQ ID NO: 3320741 - RNA, 15 nt, Human
ugggggugcauuuga

SEQ ID NO: 3320742 - RNA, 12 nt, Human
ugggggugcauu

SEQ ID NO: 3320743 - RNA, 18 nt, Human
ugggggcugggcagagga

SEQ ID NO: 3320744 - RNA, 17 nt, Human
ugggggcugggcagagg

SEQ ID NO: 3320745 - RNA, 20 nt, Human
ugggggaucacagccucuga

SEQ ID NO: 3320746 - RNA, 21 nt, Human
ugggggaucacagccucugaa

SEQ ID NO: 3320747 - RNA, 16 nt, Human
ugggcuaguugggcuu

SEQ ID NO: 3320748 - RNA, 17 nt, Human
ugggcuggugucaccug

SEQ ID NO: 3320749 - RNA, 23 nt, Human
ugggcuggguucuacccaggugc

SEQ ID NO: 3320750 - RNA, 22 nt, Human
ugggcuaagugauccucccacc

SEQ ID NO: 3320751 - RNA, 16 nt, Human
ugggcagaggaaagca

SEQ ID NO: 3320752 - RNA, 21 nt, Human
ugggcuugucuguagauuuua

SEQ ID NO: 3320753 - RNA, 15 nt, Human
ugggcuucaguggca

SEQ ID NO: 3320754 - RNA, 23 nt, Human
ugguauuggcuagagguucaaag

SEQ ID NO: 3320755 - RNA, 18 nt, Human
uggguuucuaaagcugcc

SEQ ID NO: 3320756 - RNA, 17 nt, Human
uggguuucuaaagcugc

SEQ ID NO: 3320757 - RNA, 21 nt, Human
uggguuucuaaagcugccagc

SEQ ID NO: 3320758 - RNA, 14 nt, Human
uggguguggcgcag

SEQ ID NO: 3320759 - RNA, 22 nt, Human
uggguucuacccaggugcuagg

SEQ ID NO: 3320760 - RNA, 16 nt, Human
uggguucuacccaggu

SEQ ID NO: 3320761 - RNA, 15 nt, Human
uggguucuacccagg

SEQ ID NO: 3320762 - RNA, 19 nt, Human
ugggguuuaucagaauucu

SEQ ID NO: 3320763 - RNA, 20 nt, Human
uggacuaacuugucuuugga

SEQ ID NO: 3320764 - RNA, 19 nt, Human
uggacaugcacagcuaaca

SEQ ID NO: 3320765 - RNA, 13 nt, Human
uggacaugcacag

SEQ ID NO: 3320766 - RNA, 14 nt, Human
uggaauaacaugua

SEQ ID NO: 3320767 - RNA, 15 nt, Human
uggaauaacauguaa

SEQ ID NO: 3320768 - RNA, 19 nt, Human
uggaauaacauguaauuaa

SEQ ID NO: 3320769 - RNA, 17 nt, Human
uggaauaaggagaauga

SEQ ID NO: 3320770 - RNA, 16 nt, Human
uggaauauauaaccag

SEQ ID NO: 3320771 - RNA, 15 nt, Human
uggaauauauaacca

SEQ ID NO: 3320772 - RNA, 20 nt, Human
uggaaagaguaggaagacuu

SEQ ID NO: 3320773 - RNA, 21 nt, Human
uggaaagacuuuuccaacccu

SEQ ID NO: 3320774 - RNA, 20 nt, Human
uggaaaaauagccugccucu

SEQ ID NO: 3320775 - RNA, 17 nt, Human
uggaaaaauagccugcc

SEQ ID NO: 3320776 - RNA, 18 nt, Human
uggaggaaggaaacccag

SEQ ID NO: 3320777 - RNA, 12 nt, Human
uggaggaaggaa

SEQ ID NO: 3320778 - RNA, 17 nt, Human
uggauuuaacagaaaug

SEQ ID NO: 3320779 - RNA, 24 nt, Human
uggauuuaacagaaauguacagca

SEQ ID NO: 3320780 - RNA, 20 nt, Human
uggauuuaacagaaauguac

SEQ ID NO: 3320781 - RNA, 21 nt, Human
uggcacccggccccugcuggu

SEQ ID NO: 3320782 - RNA, 13 nt, Human
uggcagcugcuuu

SEQ ID NO: 3320783 - RNA, 23 nt, Human
uggcagcugcgguccacccagga

SEQ ID NO: 3320784 - RNA, 20 nt, Human
uggccagaugcaccagcccu

SEQ ID NO: 3320785 - RNA, 21 nt, Human
uggccagaugcaccagcccuu

SEQ ID NO: 3320786 - RNA, 12 nt, Human
uccugaggcugg

SEQ ID NO: 3320787 - RNA, 19 nt, Human
uccugaggcugggcucccu

SEQ ID NO: 3320788 - RNA, 17 nt, Human
uccugaggcugggcucc

SEQ ID NO: 3320789 - RNA, 16 nt, Human
uccugaggcugggcuc

SEQ ID NO: 3320790 - RNA, 15 nt, Human
uccugaggcugggcu

SEQ ID NO: 3320791 - RNA, 14 nt, Human
uccugagccagauu

SEQ ID NO: 3320792 - RNA, 19 nt, Human
uccugagccagauuucacu

SEQ ID NO: 3320793 - RNA, 18 nt, Human
uccugagccagauuucac

SEQ ID NO: 3320794 - RNA, 19 nt, Human
uccucuguacagagcccac

SEQ ID NO: 3320795 - RNA, 23 nt, Human
uccucuguacagagcccacgccc

SEQ ID NO: 3320796 - RNA, 17 nt, Human
uccugagccagauuuca

SEQ ID NO: 3320797 - RNA, 17 nt, Human
uccucuaggaggucucu

SEQ ID NO: 3320798 - RNA, 21 nt, Human
uccucuaggaggucucuaaga

SEQ ID NO: 3320799 - RNA, 21 nt, Human
uccuccuuuucacaguucucu

SEQ ID NO: 3320800 - RNA, 15 nt, Human
uccucuggccugugu

SEQ ID NO: 3320801 - RNA, 13 nt, Human
uccucuguacaga

SEQ ID NO: 3320802 - RNA, 17 nt, Human
uccucugcugcuggcug

SEQ ID NO: 3320803 - RNA, 12 nt, Human
uccuccucagau

SEQ ID NO: 3320804 - RNA, 10 nt, Human
uccuccaggu

SEQ ID NO: 3320805 - RNA, 13 nt, Human
uccuccaggugca

SEQ ID NO: 3320806 - RNA, 12 nt, Human
uccuccaggugc

SEQ ID NO: 3320807 - RNA, 22 nt, Human
uccuccaggugcacaagcucca

SEQ ID NO: 3320808 - RNA, 20 nt, Human
uccuccaggugcacaagcuc

SEQ ID NO: 3320809 - RNA, 18 nt, Human
uccuccaggugcacaagc

SEQ ID NO: 3320810 - RNA, 14 nt, Human
uccuccaggugcac

SEQ ID NO: 3320811 - RNA, 21 nt, Human
uccuaguuccaccaucaagcc

SEQ ID NO: 3320812 - RNA, 12 nt, Human
uccuaguuccac

SEQ ID NO: 3320813 - RNA, 17 nt, Human
uccuaguuccaccauca

SEQ ID NO: 3320814 - RNA, 14 nt, Human
uccuaguuccacca

SEQ ID NO: 3320815 - RNA, 16 nt, Human
uccuaagcuauucagu

SEQ ID NO: 3320816 - RNA, 22 nt, Human
ucccaugagccucagcauccug

SEQ ID NO: 3320817 - RNA, 18 nt, Human
ucccucccuuccucuuuc

SEQ ID NO: 3320818 - RNA, 20 nt, Human
ucccugcacuugcagacucu

SEQ ID NO: 3320819 - RNA, 17 nt, Human
ucccucuggggcuguuc

SEQ ID NO: 3320820 - RNA, 13 nt, Human
ucccucuggggcu

SEQ ID NO: 3320821 - RNA, 16 nt, Human
ucccugccaauggacu

SEQ ID NO: 3320822 - RNA, 14 nt, Human
ucccugccaaugga

SEQ ID NO: 3320823 - RNA, 16 nt, Human
ucccuucccaccucuc

SEQ ID NO: 3320824 - RNA, 14 nt, Human
ucccuucccaccuc

SEQ ID NO: 3320825 - RNA, 21 nt, Human
ucccuucccacuggaggcaug

SEQ ID NO: 3320826 - RNA, 17 nt, Human
ucccuucccaccucucu

SEQ ID NO: 3320827 - RNA, 21 nt, Human
uccgaaagggacuuggaagcu

SEQ ID NO: 3320828 - RNA, 17 nt, Human
uccgaccagacaccuug

SEQ ID NO: 3320829 - RNA, 22 nt, Human
uccgaaagggacuuggaagcuc

SEQ ID NO: 3320830 - RNA, 20 nt, Human
uccgcuuucuacccagcgag

SEQ ID NO: 3320831 - RNA, 21 nt, Human
uccgcuuucuacccagcgagc

SEQ ID NO: 3320832 - RNA, 14 nt, Human
ucuaauauguaaca

SEQ ID NO: 3320833 - RNA, 12 nt, Human
ucuagggaaaaa

SEQ ID NO: 3320834 - RNA, 21 nt, Human
ucuacucgaguuacagacaaa

SEQ ID NO: 3320835 - RNA, 20 nt, Human
ucuacucgaguuacagacaa

SEQ ID NO: 3320836 - RNA, 18 nt, Human
ucuaggaggucucuaaga

SEQ ID NO: 3320837 - RNA, 18 nt, Human
ucuacucuagggaaaaac

SEQ ID NO: 3320838 - RNA, 14 nt, Human
ucucacuguugccc

SEQ ID NO: 3320839 - RNA, 15 nt, Human
ucucacuguugccca

SEQ ID NO: 3320840 - RNA, 23 nt, Human
ucucacucugucgcccagucugg

SEQ ID NO: 3320841 - RNA, 21 nt, Human
ucucacacaugagcaucaggc

SEQ ID NO: 3320842 - RNA, 22 nt, Human
ucucacucugucgcccagucug

SEQ ID NO: 3320843 - RNA, 20 nt, Human
ucucacugccaugccagcuu

SEQ ID NO: 3320844 - RNA, 16 nt, Human
ucucacacaugagcau

SEQ ID NO: 3320845 - RNA, 13 nt, Human
ucucaaauuucua

SEQ ID NO: 3320846 - RNA, 16 nt, Human
ucucaaauuucuaaau

SEQ ID NO: 3320847 - RNA, 14 nt, Human
ucucaaauuucuaa

SEQ ID NO: 3320848 - RNA, 23 nt, Human
ucgucacugcuuaacuucacaua

SEQ ID NO: 3320849 - RNA, 14 nt, Human
ucgcccagucugga

SEQ ID NO: 3320850 - RNA, 19 nt, Human
ucgcccagucuggaaugca

SEQ ID NO: 3320851 - RNA, 23 nt, Human
ucgcccagucuggaaugcagugg

SEQ ID NO: 3320852 - RNA, 18 nt, Human
ucggaaaacaugcuacac

SEQ ID NO: 3320853 - RNA, 15 nt, Human
ucggaaaacaugcua

SEQ ID NO: 3320854 - RNA, 17 nt, Human
ucgcaggauucuuccuc

SEQ ID NO: 3320855 - RNA, 21 nt, Human
ucgcaggauucuuccucccuc

SEQ ID NO: 3320856 - RNA, 23 nt, Human
ucgcaggauucuuccucccuccc

SEQ ID NO: 3320857 - RNA, 22 nt, Human
uccuuuucgcaggauucuuccu

SEQ ID NO: 3320858 - RNA, 18 nt, Human
uccuuuucgcaggauucu

SEQ ID NO: 3320859 - RNA, 21 nt, Human
uccuuaccagcagagcaccuu

SEQ ID NO: 3320860 - RNA, 20 nt, Human
uccuuaccagcagagcaccu

SEQ ID NO: 3320861 - RNA, 23 nt, Human
uccuugaaaacacuguucucugc

SEQ ID NO: 3320862 - RNA, 22 nt, Human
uccuugaaaacacuguucucug

SEQ ID NO: 3320863 - RNA, 21 nt, Human
uccuuggugucgggcaugaca

SEQ ID NO: 3320864 - RNA, 18 nt, Human
uccuuggugucgggcaug

SEQ ID NO: 3320865 - RNA, 17 nt, Human
uccuuugugaggaagcc

SEQ ID NO: 3320866 - RNA, 22 nt, Human
uccuuugugaggaagccgcugg

SEQ ID NO: 3320867 - RNA, 18 nt, Human
uccuuugugaggaagccg

SEQ ID NO: 3320868 - RNA, 17 nt, Human
ucagcacgauuucuguu

SEQ ID NO: 3320869 - RNA, 16 nt, Human
ucagcacgauuucugu

SEQ ID NO: 3320870 - RNA, 15 nt, Human
ucagcacgauuucug

SEQ ID NO: 3320871 - RNA, 15 nt, Human
ucagcauccuggcac

SEQ ID NO: 3320872 - RNA, 16 nt, Human
ucagcauccuggcacc

SEQ ID NO: 3320873 - RNA, 17 nt, Human
ucagcauccuggcaccc

SEQ ID NO: 3320874 - RNA, 18 nt, Human
ucagcauccuggcacccg

SEQ ID NO: 3320875 - RNA, 12 nt, Human
ucagccucccaa

SEQ ID NO: 3320876 - RNA, 22 nt, Human
ucagccucccaaagugcuggga

SEQ ID NO: 3320877 - RNA, 12 nt, Human
ucagccucccga

SEQ ID NO: 3320878 - RNA, 16 nt, Human
ucagccugcuccagcu

SEQ ID NO: 3320879 - RNA, 15 nt, Human
ucagcuccagcucac

SEQ ID NO: 3320880 - RNA, 18 nt, Human
ucagcuccagcucaccag

SEQ ID NO: 3320881 - RNA, 21 nt, Human
ucagcuccagcucaccagccc

SEQ ID NO: 3320882 - RNA, 15 nt, Human
ucagcugcuacuacu

SEQ ID NO: 3320883 - RNA, 15 nt, Human
ucaguccauagcaga

SEQ ID NO: 3320884 - RNA, 15 nt, Human
ucaggugcugccauc

SEQ ID NO: 3320885 - RNA, 20 nt, Human
ucagguggggucacucuggc

SEQ ID NO: 3320886 - RNA, 17 nt, Human
ucagguggggucacucu

SEQ ID NO: 3320887 - RNA, 14 nt, Human
ucagguggggcagc

SEQ ID NO: 3320888 - RNA, 18 nt, Human
ucaggugcugccauccag

SEQ ID NO: 3320889 - RNA, 20 nt, Human
ucaggugcugccauccaggu

SEQ ID NO: 3320890 - RNA, 15 nt, Human
ucagguggggcagcu

SEQ ID NO: 3320891 - RNA, 16 nt, Human
ucagguggggcagcuu

SEQ ID NO: 3320892 - RNA, 21 nt, Human
ucagguggggcagcuugaggg

SEQ ID NO: 3320893 - RNA, 18 nt, Human
ucagugugacugaucucu

SEQ ID NO: 3320894 - RNA, 17 nt, Human
ucagucugauucccaag

SEQ ID NO: 3320895 - RNA, 15 nt, Human
ucauacucaccucac

SEQ ID NO: 3320896 - RNA, 18 nt, Human
ucccaacucaccccagcc

SEQ ID NO: 3320897 - RNA, 17 nt, Human
ucccaacucaccccagc

SEQ ID NO: 3320898 - RNA, 21 nt, Human
ucccaacucaccccagcccca

SEQ ID NO: 3320899 - RNA, 19 nt, Human
ucccaacucaccccagccc

SEQ ID NO: 3320900 - RNA, 20 nt, Human
uccauagagagcaagacgcu

SEQ ID NO: 3320901 - RNA, 17 nt, Human
uccauagagagcaagac

SEQ ID NO: 3320902 - RNA, 15 nt, Human
uccauagagagcaag

SEQ ID NO: 3320903 - RNA, 18 nt, Human
ucccaccucagccucccg

SEQ ID NO: 3320904 - RNA, 16 nt, Human
ucccaccucagccucc

SEQ ID NO: 3320905 - RNA, 14 nt, Human
ucccaccucucuca

SEQ ID NO: 3320906 - RNA, 18 nt, Human
ucccaccucucucacucc

SEQ ID NO: 3320907 - RNA, 17 nt, Human
ucccaccucucucacuc

SEQ ID NO: 3320908 - RNA, 19 nt, Human
ucccaccuuggcugcaggg

SEQ ID NO: 3320909 - RNA, 21 nt, Human
ucccaccuuggcugcagggag

SEQ ID NO: 3320910 - RNA, 18 nt, Human
ucccaccuuggcugcagg

SEQ ID NO: 3320911 - RNA, 20 nt, Human
ucccaccucucucacuccuu

SEQ ID NO: 3320912 - RNA, 14 nt, Human
ucccacucagucca

SEQ ID NO: 3320913 - RNA, 15 nt, Human
ucccaugagccucag

SEQ ID NO: 3320914 - RNA, 16 nt, Human
ucccaugagccucagc

SEQ ID NO: 3320915 - RNA, 18 nt, Human
ucccaggcauuccccagg

SEQ ID NO: 3320916 - RNA, 17 nt, Human
ucccaggcauuccccag

SEQ ID NO: 3320917 - RNA, 14 nt, Human
uccaagcaggacau

SEQ ID NO: 3320918 - RNA, 20 nt, Human
uccaagaccuucuccuucac

SEQ ID NO: 3320919 - RNA, 19 nt, Human
uccaagaccuucuccuuca

SEQ ID NO: 3320920 - RNA, 12 nt, Human
uccaagaagccc

SEQ ID NO: 3320921 - RNA, 14 nt, Human
uccaagaagcccag

SEQ ID NO: 3320922 - RNA, 16 nt, Human
uccaagaagcccagga

SEQ ID NO: 3320923 - RNA, 15 nt, Human
uccaagaagcccagg

SEQ ID NO: 3320924 - RNA, 21 nt, Human
uccacaagagcccaggccucc

SEQ ID NO: 3320925 - RNA, 19 nt, Human
uccacaagagcccaggccu

SEQ ID NO: 3320926 - RNA, 20 nt, Human
uccacaagagcccaggccuc

SEQ ID NO: 3320927 - RNA, 14 nt, Human
uccacuuucuagcc

SEQ ID NO: 3320928 - RNA, 21 nt, Human
uccacccugcucuccgaccag

SEQ ID NO: 3320929 - RNA, 13 nt, Human
uccacccugcucu

SEQ ID NO: 3320930 - RNA, 14 nt, Human
uccacccugcucuc

SEQ ID NO: 3320931 - RNA, 21 nt, Human
uccacugugccaugugccagg

SEQ ID NO: 3320932 - RNA, 22 nt, Human
uccacugugccaugugccaggu

SEQ ID NO: 3320933 - RNA, 16 nt, Human
ucugucgcccagucug

SEQ ID NO: 3320934 - RNA, 13 nt, Human
ucugucuaggaau

SEQ ID NO: 3320935 - RNA, 20 nt, Human
ucuguccuacucugugucag

SEQ ID NO: 3320936 - RNA, 15 nt, Human
ucuguacagagccca

SEQ ID NO: 3320937 - RNA, 14 nt, Human
ucuguacagagccc

SEQ ID NO: 3320938 - RNA, 12 nt, Human
ucuguccuggga

SEQ ID NO: 3320939 - RNA, 17 nt, Human
ucugucgcccagucugg

SEQ ID NO: 3320940 - RNA, 13 nt, Human
ucugcugcuggcu

SEQ ID NO: 3320941 - RNA, 11 nt, Human
ucugcugcugg

SEQ ID NO: 3320942 - RNA, 21 nt, Human
ucugcuccucuccccagcaag

SEQ ID NO: 3320943 - RNA, 16 nt, Human
ucugccugcccaggcc

SEQ ID NO: 3320944 - RNA, 17 nt, Human
ucugccugcccaggccc

SEQ ID NO: 3320945 - RNA, 18 nt, Human
ucugccugcccaggcccc

SEQ ID NO: 3320946 - RNA, 20 nt, Human
ucugccugcccaggccccug

SEQ ID NO: 3320947 - RNA, 17 nt, Human
ucugcugcuggcugguu

SEQ ID NO: 3320948 - RNA, 15 nt, Human
ucugcugcuggcugg

SEQ ID NO: 3320949 - RNA, 14 nt, Human
ucugcugcuggcug

SEQ ID NO: 3320950 - RNA, 16 nt, Human
ucuggaaugcaguggu

SEQ ID NO: 3320951 - RNA, 15 nt, Human
ucugccucugacaca

SEQ ID NO: 3320952 - RNA, 18 nt, Human
ucugccucugacacacag

SEQ ID NO: 3320953 - RNA, 21 nt, Human
ucugccucccaucacccgcua

SEQ ID NO: 3320954 - RNA, 20 nt, Human
ucugccucccaucacccgcu

SEQ ID NO: 3320955 - RNA, 17 nt, Human
ucugccucccaucaccc

SEQ ID NO: 3320956 - RNA, 16 nt, Human
ucugccucccaucacc

SEQ ID NO: 3320957 - RNA, 23 nt, Human
ucugccucugacacacagcucug

SEQ ID NO: 3320958 - RNA, 21 nt, Human
ucugccucugacacacagcuc

SEQ ID NO: 3320959 - RNA, 22 nt, Human
ucugccucugacacacagcucu

SEQ ID NO: 3320960 - RNA, 19 nt, Human
ucugccugaagucacacag

SEQ ID NO: 3320961 - RNA, 20 nt, Human
ucugccugaagucacacagu

SEQ ID NO: 3320962 - RNA, 18 nt, Human
ucugccauauucuguugg

SEQ ID NO: 3320963 - RNA, 12 nt, Human
ucugcccacucc

SEQ ID NO: 3320964 - RNA, 22 nt, Human
ucugccauauucuguuggccag

SEQ ID NO: 3320965 - RNA, 23 nt, Human
ucugccauauucuguuggccagu

SEQ ID NO: 3320966 - RNA, 15 nt, Human
ucugccucccaucac

SEQ ID NO: 3320967 - RNA, 13 nt, Human
ucugccucccauc

SEQ ID NO: 3320968 - RNA, 12 nt, Human
ucugccucccau

SEQ ID NO: 3320969 - RNA, 14 nt, Human
ucugcccacucccu

SEQ ID NO: 3320970 - RNA, 13 nt, Human
ucugcccacuccc

SEQ ID NO: 3320971 - RNA, 22 nt, Human
ucugaggaauccagacccggcu

SEQ ID NO: 3320972 - RNA, 18 nt, Human
ucugaggaauccagaccc

SEQ ID NO: 3320973 - RNA, 21 nt, Human
ucugaggaauccagacccggc

SEQ ID NO: 3320974 - RNA, 21 nt, Human
ucugcaagaauugaagcagga

SEQ ID NO: 3320975 - RNA, 22 nt, Human
ucugacccaugcugcccuguga

SEQ ID NO: 3320976 - RNA, 20 nt, Human
ucugacccaugcugcccugu

SEQ ID NO: 3320977 - RNA, 19 nt, Human
ucugacccaugcugcccug

SEQ ID NO: 3320978 - RNA, 18 nt, Human
ucugagaggacuuuucuu

SEQ ID NO: 3320979 - RNA, 21 nt, Human
ucuugaaauauaggaacuuaa

SEQ ID NO: 3320980 - RNA, 20 nt, Human
ucuugaaauauaggaacuua

SEQ ID NO: 3320981 - RNA, 22 nt, Human
ucuugaagacuuuucuuucagc

SEQ ID NO: 3320982 - RNA, 13 nt, Human
ucuugaagacuuu

SEQ ID NO: 3320983 - RNA, 15 nt, Human
ucuugcaugaggcua

SEQ ID NO: 3320984 - RNA, 15 nt, Human
ucuugcucugcugac

SEQ ID NO: 3320985 - RNA, 23 nt, Human
ucuugcucugcugacagacacag

SEQ ID NO: 3320986 - RNA, 14 nt, Human
ucuugcucugcuga

SEQ ID NO: 3320987 - RNA, 21 nt, Human
ucuucagagacuccugcaggc

SEQ ID NO: 3320988 - RNA, 14 nt, Human
ucuucagaucucua

SEQ ID NO: 3320989 - RNA, 22 nt, Human
ucuuauccaacaucaacaucuu

SEQ ID NO: 3320990 - RNA, 14 nt, Human
ucuuagauguauau

SEQ ID NO: 3320991 - RNA, 15 nt, Human
ucuuagauguauaua

SEQ ID NO: 3320992 - RNA, 17 nt, Human
ucugugucagguggggc

SEQ ID NO: 3320993 - RNA, 20 nt, Human
ucugugucagguggggcagc

SEQ ID NO: 3320994 - RNA, 23 nt, Human
ucuuagguuggcaaaaaggcagg

SEQ ID NO: 3320995 - RNA, 20 nt, Human
ucuuagguuggcaaaaaggc

SEQ ID NO: 3320996 - RNA, 12 nt, Human
ucuuucccuccc

SEQ ID NO: 3320997 - RNA, 17 nt, Human
ucuuuccaaaguacacu

SEQ ID NO: 3320998 - RNA, 13 nt, Human
ucuuucccucccu

SEQ ID NO: 3320999 - RNA, 13 nt, Human
ucuuguguguuua

SEQ ID NO: 3321000 - RNA, 23 nt, Human
ucuuuccaaaguacacuguuuca

SEQ ID NO: 3321001 - RNA, 13 nt, Human
ucuuugcagacag

SEQ ID NO: 3321002 - RNA, 23 nt, Human
ucuuugagugaagcugggagaac

SEQ ID NO: 3321003 - RNA, 14 nt, Human
ucuuugcagacagg

SEQ ID NO: 3321004 - RNA, 17 nt, Human
ucuuugcagacaggcaa

SEQ ID NO: 3321005 - RNA, 13 nt, Human
ucuuuggacccug

SEQ ID NO: 3321006 - RNA, 15 nt, Human
ucuuuggacccugag

SEQ ID NO: 3321007 - RNA, 14 nt, Human
ucuuuggacccuga

SEQ ID NO: 3321008 - RNA, 14 nt, Human
ugaaaauucagugg

SEQ ID NO: 3321009 - RNA, 20 nt, Human
ugaaaagaaaaaugagccug

SEQ ID NO: 3321010 - RNA, 15 nt, Human
ugaaaagaaaaauga

SEQ ID NO: 3321011 - RNA, 19 nt, Human
ugaaaagaaaaaugagccu

SEQ ID NO: 3321012 - RNA, 21 nt, Human
ugaaaacacauuuuucuuagg

SEQ ID NO: 3321013 - RNA, 21 nt, Human
ugaaaacacuguucucugccc

SEQ ID NO: 3321014 - RNA, 20 nt, Human
ugaaaacacuguucucugcc

SEQ ID NO: 3321015 - RNA, 17 nt, Human
ugaaaacacuguucucu

SEQ ID NO: 3321016 - RNA, 20 nt, Human
ugaaaacacauuuuucuuag

SEQ ID NO: 3321017 - RNA, 23 nt, Human
ugaaaacacuguucucugcccuc

SEQ ID NO: 3321018 - RNA, 22 nt, Human
ugaaaacacuguucucugcccu

SEQ ID NO: 3321019 - RNA, 20 nt, Human
ugaccagcaccaucucuccu

SEQ ID NO: 3321020 - RNA, 17 nt, Human
ugacagacacaggcccg

SEQ ID NO: 3321021 - RNA, 18 nt, Human
ugacagacacaggcccgg

SEQ ID NO: 3321022 - RNA, 23 nt, Human
ugacaucaacugcaucaagaugu

SEQ ID NO: 3321023 - RNA, 22 nt, Human
ugacagagcaagugagacccug

SEQ ID NO: 3321024 - RNA, 15 nt, Human
ugacacacagcucug

SEQ ID NO: 3321025 - RNA, 14 nt, Human
ugacacacagcucu

SEQ ID NO: 3321026 - RNA, 13 nt, Human
ugacagacacagg

SEQ ID NO: 3321027 - RNA, 14 nt, Human
ugacagacacaggc

SEQ ID NO: 3321028 - RNA, 16 nt, Human
ugacagacacaggccc

SEQ ID NO: 3321029 - RNA, 18 nt, Human
ugacaaggauugcuacug

SEQ ID NO: 3321030 - RNA, 23 nt, Human
ugacaaggauugcuacuguccua

SEQ ID NO: 3321031 - RNA, 21 nt, Human
ugaauuguaaggaaugauuaa

SEQ ID NO: 3321032 - RNA, 13 nt, Human
ugaauuguaagga

SEQ ID NO: 3321033 - RNA, 23 nt, Human
ugacaacacucauugaccugagg

SEQ ID NO: 3321034 - RNA, 13 nt, Human
ugacaacacucau

SEQ ID NO: 3321035 - RNA, 23 nt, Human
ugaaugaugauccuaggcauuug

SEQ ID NO: 3321036 - RNA, 21 nt, Human
ugaaggcuggguucugauccu

SEQ ID NO: 3321037 - RNA, 20 nt, Human
ugaaggcuggguucugaucc

SEQ ID NO: 3321038 - RNA, 18 nt, Human
ugaaggccccgcccaggc

SEQ ID NO: 3321039 - RNA, 20 nt, Human
ugaaggccccgcccaggcuu

SEQ ID NO: 3321040 - RNA, 19 nt, Human
ugaaggccccgcccaggcu

SEQ ID NO: 3321041 - RNA, 16 nt, Human
ugaaggcuggguucug

SEQ ID NO: 3321042 - RNA, 19 nt, Human
ugaagacucauucuucugu

SEQ ID NO: 3321043 - RNA, 20 nt, Human
ugaagacucauucuucugua

SEQ ID NO: 3321044 - RNA, 23 nt, Human
ugaacuggguacuuguggacaca

SEQ ID NO: 3321045 - RNA, 21 nt, Human
ugacucuuucuauuguuucuu

SEQ ID NO: 3321046 - RNA, 16 nt, Human
ugacuuuccucuuugg

SEQ ID NO: 3321047 - RNA, 13 nt, Human
ugaccauucucca

SEQ ID NO: 3321048 - RNA, 14 nt, Human
ugagaccaaccugg

SEQ ID NO: 3321049 - RNA, 18 nt, Human
ugagaggggaacagacug

SEQ ID NO: 3321050 - RNA, 14 nt, Human
ugagaggggaacag

SEQ ID NO: 3321051 - RNA, 15 nt, Human
ugagaaauaaaguuu

SEQ ID NO: 3321052 - RNA, 22 nt, Human
ugacuuuucuguccgagcuuug

SEQ ID NO: 3321053 - RNA, 21 nt, Human
ugaggugggaggaucucuuga

SEQ ID NO: 3321054 - RNA, 17 nt, Human
ugaggucagagccugca

SEQ ID NO: 3321055 - RNA, 21 nt, Human
ugaggcugggcucccuuccca

SEQ ID NO: 3321056 - RNA, 18 nt, Human
ugaggucagagccugcag

SEQ ID NO: 3321057 - RNA, 19 nt, Human
ugaggucagagccugcagu

SEQ ID NO: 3321058 - RNA, 15 nt, Human
ugaggcucugcccuu

SEQ ID NO: 3321059 - RNA, 16 nt, Human
ugaggcucugcccuug

SEQ ID NO: 3321060 - RNA, 16 nt, Human
ugaggcugggcucccu

SEQ ID NO: 3321061 - RNA, 15 nt, Human
ugaggcugggcuccc

SEQ ID NO: 3321062 - RNA, 18 nt, Human
ugaggcucugcccuuggu

SEQ ID NO: 3321063 - RNA, 19 nt, Human
ugagcucaggaguuugaga

SEQ ID NO: 3321064 - RNA, 11 nt, Human
ugagcucagga

SEQ ID NO: 3321065 - RNA, 23 nt, Human
ugagccgagaucacgccacugca

SEQ ID NO: 3321066 - RNA, 20 nt, Human
ugagcagggcucagcgggga

SEQ ID NO: 3321067 - RNA, 22 nt, Human
ugagcagggcucagcggggaca

SEQ ID NO: 3321068 - RNA, 23 nt, Human
ugagcagggcucagcggggacag

SEQ ID NO: 3321069 - RNA, 22 nt, Human
ugagccgagaucacgccacugc

SEQ ID NO: 3321070 - RNA, 22 nt, Human
ugaggaugaaaaaauaacacug

SEQ ID NO: 3321071 - RNA, 14 nt, Human
gcuggguuggaggg

SEQ ID NO: 3321072 - RNA, 21 nt, Human
gcuggguuggaggguguccca

SEQ ID NO: 3321073 - RNA, 15 nt, Human
gcuggguucugaucc

SEQ ID NO: 3321074 - RNA, 15 nt, Human
gcuggguucuaccca

SEQ ID NO: 3321075 - RNA, 20 nt, Human
gcuguaucccaugagccuca

SEQ ID NO: 3321076 - RNA, 23 nt, Human
gcuguaucccaugagccucagca

SEQ ID NO: 3321077 - RNA, 19 nt, Human
gcuguaucccaugagccuc

SEQ ID NO: 3321078 - RNA, 20 nt, Human
gcuucacggaagagccuugc

SEQ ID NO: 3321079 - RNA, 19 nt, Human
gcuucacggaagagccuug

SEQ ID NO: 3321080 - RNA, 22 nt, Human
gcuucaaggauccugagccaga

SEQ ID NO: 3321081 - RNA, 17 nt, Human
gcugugcugcccugccc

SEQ ID NO: 3321082 - RNA, 18 nt, Human
gcugugcucuggacaggc

SEQ ID NO: 3321083 - RNA, 13 nt, Human
gcugugcugcccu

SEQ ID NO: 3321084 - RNA, 21 nt, Human
gcugugcucuggacaggcaug

SEQ ID NO: 3321085 - RNA, 12 nt, Human
gcugugcugccc

SEQ ID NO: 3321086 - RNA, 21 nt, Human
gcuguuggcugggggccucag

SEQ ID NO: 3321087 - RNA, 22 nt, Human
gcuguuggcugggggccucagu

SEQ ID NO: 3321088 - RNA, 22 nt, Human
gcugugcugcccugcccaccug

SEQ ID NO: 3321089 - RNA, 19 nt, Human
gcugugcugcccugcccac

SEQ ID NO: 3321090 - RNA, 16 nt, Human
gcuuguacauaaugcg

SEQ ID NO: 3321091 - RNA, 14 nt, Human
gcuuguacauaaug

SEQ ID NO: 3321092 - RNA, 22 nt, Human
gcuggaccuugaacuggguacu

SEQ ID NO: 3321093 - RNA, 12 nt, Human
gcuggagugcag

SEQ ID NO: 3321094 - RNA, 19 nt, Human
gcugggauuacagguguga

SEQ ID NO: 3321095 - RNA, 18 nt, Human
gcugggauuacaggugug

SEQ ID NO: 3321096 - RNA, 13 nt, Human
gcugggcagagga

SEQ ID NO: 3321097 - RNA, 15 nt, Human
gcugggcagaggaaa

SEQ ID NO: 3321098 - RNA, 14 nt, Human
gcugggcagaggaa

SEQ ID NO: 3321099 - RNA, 14 nt, Human
gcuggagugcagug

SEQ ID NO: 3321100 - RNA, 15 nt, Human
gcuggagugcaguga

SEQ ID NO: 3321101 - RNA, 17 nt, Human
gcuggccuggccccuca

SEQ ID NO: 3321102 - RNA, 16 nt, Human
gcuggccuggccccuc

SEQ ID NO: 3321103 - RNA, 16 nt, Human
gcugggauuacaggug

SEQ ID NO: 3321104 - RNA, 19 nt, Human
gcuggccuggccccucagg

SEQ ID NO: 3321105 - RNA, 18 nt, Human
gcuggccuggccccucag

SEQ ID NO: 3321106 - RNA, 20 nt, Human
gcugggcucccuucccaccu

SEQ ID NO: 3321107 - RNA, 17 nt, Human
gcugggcucccuuccca

SEQ ID NO: 3321108 - RNA, 16 nt, Human
gcugggcucccuuccc

SEQ ID NO: 3321109 - RNA, 12 nt, Human
gcugggcucccu

SEQ ID NO: 3321110 - RNA, 17 nt, Human
gcugggcagaggaaagc

SEQ ID NO: 3321111 - RNA, 16 nt, Human
gcugggcagaggaaag

SEQ ID NO: 3321112 - RNA, 19 nt, Human
gcugggcagaggaaagcaa

SEQ ID NO: 3321113 - RNA, 15 nt, Human
gcuggguguggcgca

SEQ ID NO: 3321114 - RNA, 14 nt, Human
gcugcaccggcugg

SEQ ID NO: 3321115 - RNA, 17 nt, Human
gcugcaccggcuggccu

SEQ ID NO: 3321116 - RNA, 16 nt, Human
gcugcaccggcuggcc

SEQ ID NO: 3321117 - RNA, 22 nt, Human
gcugcaccggcuggccuggccc

SEQ ID NO: 3321118 - RNA, 19 nt, Human
gcugcaccggcuggccugg

SEQ ID NO: 3321119 - RNA, 18 nt, Human
gcugcaccggcuggccug

SEQ ID NO: 3321120 - RNA, 21 nt, Human
gcugccauccagguucagcuu

SEQ ID NO: 3321121 - RNA, 23 nt, Human
gcugccauccagguucagcuugu

SEQ ID NO: 3321122 - RNA, 21 nt, Human
gcugccagccgagauagccaa

SEQ ID NO: 3321123 - RNA, 19 nt, Human
gcugccagccgagauagcc

SEQ ID NO: 3321124 - RNA, 13 nt, Human
gcugccaccugcc

SEQ ID NO: 3321125 - RNA, 18 nt, Human
gcugccugggaucccuca

SEQ ID NO: 3321126 - RNA, 16 nt, Human
gcugccugggaucccu

SEQ ID NO: 3321127 - RNA, 19 nt, Human
gcugccugggaucccucau

SEQ ID NO: 3321128 - RNA, 17 nt, Human
gcugccauccagguuca

SEQ ID NO: 3321129 - RNA, 13 nt, Human
gcugccugggauc

SEQ ID NO: 3321130 - RNA, 14 nt, Human
gcugacagacacag

SEQ ID NO: 3321131 - RNA, 15 nt, Human
gcugacagacacagg

SEQ ID NO: 3321132 - RNA, 13 nt, Human
gcugacagacaca

SEQ ID NO: 3321133 - RNA, 16 nt, Human
gcugacagacacaggc

SEQ ID NO: 3321134 - RNA, 20 nt, Human
gcugaaggcucgagcaugcc

SEQ ID NO: 3321135 - RNA, 12 nt, Human
gcugaaggcucg

SEQ ID NO: 3321136 - RNA, 17 nt, Human
gcugaaugguuuucaaa

SEQ ID NO: 3321137 - RNA, 22 nt, Human
gcugaauacagaggcaacugca

SEQ ID NO: 3321138 - RNA, 12 nt, Human
gcucuuccaggc

SEQ ID NO: 3321139 - RNA, 16 nt, Human
gcucuuccaggcuggg

SEQ ID NO: 3321140 - RNA, 15 nt, Human
gcucuuccaggcugg

SEQ ID NO: 3321141 - RNA, 15 nt, Human
gcucuguccugggag

SEQ ID NO: 3321142 - RNA, 14 nt, Human
gcucuguccuggga

SEQ ID NO: 3321143 - RNA, 16 nt, Human
gcucuguccugggagu

SEQ ID NO: 3321144 - RNA, 15 nt, Human
gcucucaggccagcu

SEQ ID NO: 3321145 - RNA, 14 nt, Human
gcucucaggccagc

SEQ ID NO: 3321146 - RNA, 13 nt, Human
gcucucaggccag

SEQ ID NO: 3321147 - RNA, 22 nt, Human
gcucccaggcauuccccaggag

SEQ ID NO: 3321148 - RNA, 17 nt, Human
gcucccaggcauucccc

SEQ ID NO: 3321149 - RNA, 14 nt, Human
gcuccccagcccca

SEQ ID NO: 3321150 - RNA, 21 nt, Human
gcucccaggcauuccccagga

SEQ ID NO: 3321151 - RNA, 20 nt, Human
gcucccaggcauuccccagg

SEQ ID NO: 3321152 - RNA, 16 nt, Human
gcuaggaacacuccuu

SEQ ID NO: 3321153 - RNA, 18 nt, Human
gcuaggaacacuccuuca

SEQ ID NO: 3321154 - RNA, 21 nt, Human
gcuaggaacacuccuucacag

SEQ ID NO: 3321155 - RNA, 19 nt, Human
gcuaggaacacuccuucac

SEQ ID NO: 3321156 - RNA, 22 nt, Human
gcuaggaccccuccaugugggc

SEQ ID NO: 3321157 - RNA, 14 nt, Human
gcuaggccuggcca

SEQ ID NO: 3321158 - RNA, 15 nt, Human
gcuaggccuggccag

SEQ ID NO: 3321159 - RNA, 20 nt, Human
gccuguucagcuccagcuca

SEQ ID NO: 3321160 - RNA, 17 nt, Human
gccuguucagcuccagc

SEQ ID NO: 3321161 - RNA, 19 nt, Human
gccuguucagcuccagcuc

SEQ ID NO: 3321162 - RNA, 22 nt, Human
gcucagguggggucacucuggc

SEQ ID NO: 3321163 - RNA, 21 nt, Human
gcucagguggggucacucugg

SEQ ID NO: 3321164 - RNA, 16 nt, Human
gcucagggccuggcuc

SEQ ID NO: 3321165 - RNA, 13 nt, Human
gcucagggccugg

SEQ ID NO: 3321166 - RNA, 12 nt, Human
gcucagggccug

SEQ ID NO: 3321167 - RNA, 15 nt, Human
gcucagagagggugg

SEQ ID NO: 3321168 - RNA, 20 nt, Human
gcucagagagggugggagug

SEQ ID NO: 3321169 - RNA, 18 nt, Human
gcucagagagggugggag

SEQ ID NO: 3321170 - RNA, 19 nt, Human
gccauauucuguuggccag

SEQ ID NO: 3321171 - RNA, 20 nt, Human
gccauauucuguuggccagu

SEQ ID NO: 3321172 - RNA, 15 nt, Human
gccauguuggccagg

SEQ ID NO: 3321173 - RNA, 16 nt, Human
gccauguuggccaggc

SEQ ID NO: 3321174 - RNA, 17 nt, Human
gccauguuggccaggcu

SEQ ID NO: 3321175 - RNA, 18 nt, Human
gccauguuggccaggcug

SEQ ID NO: 3321176 - RNA, 14 nt, Human
gccauguuggccag

SEQ ID NO: 3321177 - RNA, 15 nt, Human
gcccacgcuggagug

SEQ ID NO: 3321178 - RNA, 16 nt, Human
gcccacgcuggagugc

SEQ ID NO: 3321179 - RNA, 17 nt, Human
gcccacgcuggagugca

SEQ ID NO: 3321180 - RNA, 17 nt, Human
gcccaccuuggcucaag

SEQ ID NO: 3321181 - RNA, 18 nt, Human
gcccaccuuggcucaagu

SEQ ID NO: 3321182 - RNA, 14 nt, Human
gcccacgcccccac

SEQ ID NO: 3321183 - RNA, 13 nt, Human
gcccacgccccca

SEQ ID NO: 3321184 - RNA, 19 nt, Human
gccauguuggccaggcugg

SEQ ID NO: 3321185 - RNA, 20 nt, Human
gccauguuggccaggcuggu

SEQ ID NO: 3321186 - RNA, 22 nt, Human
gccauguuggccaggcuggucu

SEQ ID NO: 3321187 - RNA, 24 nt, Human
gccauguuggccaggcuggucuca

SEQ ID NO: 3321188 - RNA, 23 nt, Human
gccaggccacaagacccuugugg

SEQ ID NO: 3321189 - RNA, 12 nt, Human
gccaggccagag

SEQ ID NO: 3321190 - RNA, 21 nt, Human
gccaggcccucugcccacucc

SEQ ID NO: 3321191 - RNA, 20 nt, Human
gccaggcccucugcccacuc

SEQ ID NO: 3321192 - RNA, 19 nt, Human
gccaggcccucugcccacu

SEQ ID NO: 3321193 - RNA, 17 nt, Human
gccaggcccucugccca

SEQ ID NO: 3321194 - RNA, 16 nt, Human
gccaggcccucugccc

SEQ ID NO: 3321195 - RNA, 13 nt, Human
gccaggccagagg

SEQ ID NO: 3321196 - RNA, 15 nt, Human
gccaggcccucugcc

SEQ ID NO: 3321197 - RNA, 20 nt, Human
gccagcaggcucucaggcca

SEQ ID NO: 3321198 - RNA, 19 nt, Human
gccagcaggcucucaggcc

SEQ ID NO: 3321199 - RNA, 18 nt, Human
gccagcaggcucucaggc

SEQ ID NO: 3321200 - RNA, 17 nt, Human
gccagcaggcucucagg

SEQ ID NO: 3321201 - RNA, 21 nt, Human
gccagcaggcucucaggccag

SEQ ID NO: 3321202 - RNA, 16 nt, Human
gccagcaggcucucag

SEQ ID NO: 3321203 - RNA, 13 nt, Human
gccagcaggcucu

SEQ ID NO: 3321204 - RNA, 20 nt, Human
gccacauuccugaugcuucu

SEQ ID NO: 3321205 - RNA, 16 nt, Human
gccacauuccugaugc

SEQ ID NO: 3321206 - RNA, 22 nt, Human
gccaccaacauacucccaucug

SEQ ID NO: 3321207 - RNA, 19 nt, Human
gccaccaacauacucccau

SEQ ID NO: 3321208 - RNA, 21 nt, Human
gccaccaacauacucccaucu

SEQ ID NO: 3321209 - RNA, 20 nt, Human
gccaccaacauacucccauc

SEQ ID NO: 3321210 - RNA, 19 nt, Human
gccacugugaagagaacca

SEQ ID NO: 3321211 - RNA, 18 nt, Human
gccacugugaagagaacc

SEQ ID NO: 3321212 - RNA, 22 nt, Human
gccacugcaccgggccacagag

SEQ ID NO: 3321213 - RNA, 21 nt, Human
gccacugcacuauagccuagg

SEQ ID NO: 3321214 - RNA, 13 nt, Human
gccacccugggga

SEQ ID NO: 3321215 - RNA, 19 nt, Human
gccacccuggggagaaagu

SEQ ID NO: 3321216 - RNA, 23 nt, Human
gccacugcaccgggccacagaga

SEQ ID NO: 3321217 - RNA, 16 nt, Human
gccugccucuucucua

SEQ ID NO: 3321218 - RNA, 15 nt, Human
gccuggccccucagg

SEQ ID NO: 3321219 - RNA, 17 nt, Human
gccuggccccucagggu

SEQ ID NO: 3321220 - RNA, 16 nt, Human
gccuggccccucaggg

SEQ ID NO: 3321221 - RNA, 22 nt, Human
gccuggccccucagggucccug

SEQ ID NO: 3321222 - RNA, 20 nt, Human
gccuggccccucaggguccc

SEQ ID NO: 3321223 - RNA, 10 nt, Human
gccuggccug

SEQ ID NO: 3321224 - RNA, 21 nt, Human
gccugggaggucaaggcugca

SEQ ID NO: 3321225 - RNA, 14 nt, Human
gccugggaucccuc

SEQ ID NO: 3321226 - RNA, 22 nt, Human
gccugggaggucaaggcugcag

SEQ ID NO: 3321227 - RNA, 18 nt, Human
gccugggaucccucaucc

SEQ ID NO: 3321228 - RNA, 13 nt, Human
gccuccuccagcc

SEQ ID NO: 3321229 - RNA, 18 nt, Human
gccuccugcccuuaccug

SEQ ID NO: 3321230 - RNA, 12 nt, Human
gccucugggacu

SEQ ID NO: 3321231 - RNA, 17 nt, Human
gccugcccaggccccug

SEQ ID NO: 3321232 - RNA, 18 nt, Human
gccugcccaggccccugc

SEQ ID NO: 3321233 - RNA, 19 nt, Human
gccugcccaggccccugcc

SEQ ID NO: 3321234 - RNA, 23 nt, Human
gccucuucucuacucuagggaaa

SEQ ID NO: 3321235 - RNA, 12 nt, Human
gccucuucucua

SEQ ID NO: 3321236 - RNA, 13 nt, Human
gcccacucccugc

SEQ ID NO: 3321237 - RNA, 19 nt, Human
gcccacucccugcaaccug

SEQ ID NO: 3321238 - RNA, 15 nt, Human
gcccacucccugcaa

SEQ ID NO: 3321239 - RNA, 14 nt, Human
gcccacucccugca

SEQ ID NO: 3321240 - RNA, 22 nt, Human
gcccuaaaguguauuuuuuuac

SEQ ID NO: 3321241 - RNA, 22 nt, Human
gccccuggaugcagccucacag

SEQ ID NO: 3321242 - RNA, 18 nt, Human
gccccuggaugcagccuc

SEQ ID NO: 3321243 - RNA, 16 nt, Human
gccccuggaugcagcc

SEQ ID NO: 3321244 - RNA, 15 nt, Human
gccccuggaugcagc

SEQ ID NO: 3321245 - RNA, 18 nt, Human
gccccaaaacucuccucu

SEQ ID NO: 3321246 - RNA, 13 nt, Human
gccccugcccggc

SEQ ID NO: 3321247 - RNA, 14 nt, Human
gccccugcccggcu

SEQ ID NO: 3321248 - RNA, 14 nt, Human
gcccugccuccuuu

SEQ ID NO: 3321249 - RNA, 22 nt, Human
gcccugccuccuuugugaggaa

SEQ ID NO: 3321250 - RNA, 16 nt, Human
gcccugccuccuuugu

SEQ ID NO: 3321251 - RNA, 21 nt, Human
gcccugugggcccccaaaugg

SEQ ID NO: 3321252 - RNA, 16 nt, Human
gccgccaugcuccugg

SEQ ID NO: 3321253 - RNA, 20 nt, Human
gcccuuaccugccaggaagc

SEQ ID NO: 3321254 - RNA, 16 nt, Human
gcccuuaccugccagg

SEQ ID NO: 3321255 - RNA, 15 nt, Human
gccgccaugcuccug

SEQ ID NO: 3321256 - RNA, 14 nt, Human
ggccucccaacuca

SEQ ID NO: 3321257 - RNA, 13 nt, Human
ggccucccaacuc

SEQ ID NO: 3321258 - RNA, 21 nt, Human
ggccaaaggaagcacaugccu

SEQ ID NO: 3321259 - RNA, 15 nt, Human
ggccaaagccaaagc

SEQ ID NO: 3321260 - RNA, 12 nt, Human
ggccaaaggaag

SEQ ID NO: 3321261 - RNA, 21 nt, Human
ggccaaacucaccugccccuc

SEQ ID NO: 3321262 - RNA, 12 nt, Human
ggcauuguggga

SEQ ID NO: 3321263 - RNA, 17 nt, Human
ggccagaugcaccagcc

SEQ ID NO: 3321264 - RNA, 19 nt, Human
ggccagaugcaccagcccu

SEQ ID NO: 3321265 - RNA, 20 nt, Human
ggccagaugcaccagcccuu

SEQ ID NO: 3321266 - RNA, 13 nt, Human
ggccaagguggga

SEQ ID NO: 3321267 - RNA, 22 nt, Human
ggccagagggagugacagaggc

SEQ ID NO: 3321268 - RNA, 23 nt, Human
ggccagagggagugacagaggca

SEQ ID NO: 3321269 - RNA, 21 nt, Human
ggaugaauuccaaauucugcu

SEQ ID NO: 3321270 - RNA, 12 nt, Human
ggaugagaaagg

SEQ ID NO: 3321271 - RNA, 22 nt, Human
ggaugagaaagguugaagcacc

SEQ ID NO: 3321272 - RNA, 21 nt, Human
ggauuuugauccaagcugguc

SEQ ID NO: 3321273 - RNA, 23 nt, Human
ggauuaaacuuaaucuaaaugga

SEQ ID NO: 3321274 - RNA, 12 nt, Human
ggcagaaggaag

SEQ ID NO: 3321275 - RNA, 17 nt, Human
ggcagccaggccacaag

SEQ ID NO: 3321276 - RNA, 15 nt, Human
ggcagccaggccaca

SEQ ID NO: 3321277 - RNA, 10 nt, Human
ggcagagcag

SEQ ID NO: 3321278 - RNA, 14 nt, Human
ggcagccaggccac

SEQ ID NO: 3321279 - RNA, 21 nt, Human
ggagcagccacauuccugaug

SEQ ID NO: 3321280 - RNA, 13 nt, Human
ggagcagccacau

SEQ ID NO: 3321281 - RNA, 18 nt, Human
ggaggucgaggcaggagg

SEQ ID NO: 3321282 - RNA, 14 nt, Human
ggaggucgaggcag

SEQ ID NO: 3321283 - RNA, 16 nt, Human
ggaggucgaggcagga

SEQ ID NO: 3321284 - RNA, 15 nt, Human
ggaggucgaggcagg

SEQ ID NO: 3321285 - RNA, 12 nt, Human
ggaggaagagaa

SEQ ID NO: 3321286 - RNA, 21 nt, Human
ggaggcaugugaugagaggaa

SEQ ID NO: 3321287 - RNA, 13 nt, Human
ggaggccagccuu

SEQ ID NO: 3321288 - RNA, 18 nt, Human
ggaggccaaggugggagg

SEQ ID NO: 3321289 - RNA, 12 nt, Human
ggaggccagccu

SEQ ID NO: 3321290 - RNA, 22 nt, Human
ggagcugccuguucagcuccag

SEQ ID NO: 3321291 - RNA, 19 nt, Human
gcuuguacauaaugcgugc

SEQ ID NO: 3321292 - RNA, 12 nt, Human
gcuuguacauaa

SEQ ID NO: 3321293 - RNA, 13 nt, Human
ggacccugaggcc

SEQ ID NO: 3321294 - RNA, 14 nt, Human
ggacccugaggccc

SEQ ID NO: 3321295 - RNA, 18 nt, Human
ggacccugaggcccagag

SEQ ID NO: 3321296 - RNA, 15 nt, Human
ggacccugaggccca

SEQ ID NO: 3321297 - RNA, 15 nt, Human
ggagagcuagcagca

SEQ ID NO: 3321298 - RNA, 16 nt, Human
ggagagccuuccaggg

SEQ ID NO: 3321299 - RNA, 13 nt, Human
ggagagccuucca

SEQ ID NO: 3321300 - RNA, 18 nt, Human
ggagagccuuccaggggu

SEQ ID NO: 3321301 - RNA, 17 nt, Human
ggagagccuuccagggg

SEQ ID NO: 3321302 - RNA, 22 nt, Human
ggagagccuuccagggguggga

SEQ ID NO: 3321303 - RNA, 18 nt, Human
ggacucaaugcacugaca

SEQ ID NO: 3321304 - RNA, 22 nt, Human
ggacucaaugcacugacauugu

SEQ ID NO: 3321305 - RNA, 20 nt, Human
ggacuacaggugugagucac

SEQ ID NO: 3321306 - RNA, 22 nt, Human
ggagaaccaaaaagaggcuaug

SEQ ID NO: 3321307 - RNA, 9 nt, Human
ggacuuugu

SEQ ID NO: 3321308 - RNA, 19 nt, Human
ggagaaaauggacguguua

SEQ ID NO: 3321309 - RNA, 15 nt, Human
ggacuuggaagcucc

SEQ ID NO: 3321310 - RNA, 17 nt, Human
ggacuuggaagcuccgc

SEQ ID NO: 3321311 - RNA, 15 nt, Human
ggcuucaguggcagc

SEQ ID NO: 3321312 - RNA, 20 nt, Human
ggcuguaucccaugagccuc

SEQ ID NO: 3321313 - RNA, 22 nt, Human
ggcuguaucccaugagccucag

SEQ ID NO: 3321314 - RNA, 23 nt, Human
ggcuguaucccaugagccucagc

SEQ ID NO: 3321315 - RNA, 15 nt, Human
ggcugucaauuacag

SEQ ID NO: 3321316 - RNA, 19 nt, Human
ggcuguaucccaugagccu

SEQ ID NO: 3321317 - RNA, 16 nt, Human
ggcuggugucaccuga

SEQ ID NO: 3321318 - RNA, 16 nt, Human
ggcuucaguggcagcu

SEQ ID NO: 3321319 - RNA, 14 nt, Human
ggcuuuugugcauu

SEQ ID NO: 3321320 - RNA, 13 nt, Human
gggaaaaucagcc

SEQ ID NO: 3321321 - RNA, 23 nt, Human
gggaaaaucagccugcuccagcu

SEQ ID NO: 3321322 - RNA, 15 nt, Human
ggcuggccuggcccc

SEQ ID NO: 3321323 - RNA, 14 nt, Human
ggcuggcgugcagu

SEQ ID NO: 3321324 - RNA, 16 nt, Human
ggcuggcgugcagugg

SEQ ID NO: 3321325 - RNA, 20 nt, Human
ggcuggcgugcaguggugcg

SEQ ID NO: 3321326 - RNA, 22 nt, Human
ggcuggccuggccccucagggu

SEQ ID NO: 3321327 - RNA, 17 nt, Human
ggcuggccuggccccuc

SEQ ID NO: 3321328 - RNA, 16 nt, Human
ggcucccuucccaccu

SEQ ID NO: 3321329 - RNA, 18 nt, Human
ggcucccuucccaccucu

SEQ ID NO: 3321330 - RNA, 17 nt, Human
ggcucccuucccaccuc

SEQ ID NO: 3321331 - RNA, 22 nt, Human
ggcucccuucccaccucucuca

SEQ ID NO: 3321332 - RNA, 20 nt, Human
ggcucccuucccaccucucu

SEQ ID NO: 3321333 - RNA, 21 nt, Human
ggcugccaaugggagcucaug

SEQ ID NO: 3321334 - RNA, 20 nt, Human
ggcugcaugcgggcuuccuc

SEQ ID NO: 3321335 - RNA, 17 nt, Human
ggcugcagggaguccga

SEQ ID NO: 3321336 - RNA, 18 nt, Human
ggcucgagcaugccugga

SEQ ID NO: 3321337 - RNA, 24 nt, Human
ggcucuuccaggcugggagagccu

SEQ ID NO: 3321338 - RNA, 23 nt, Human
ggcucuuccaggcugggagagcc

SEQ ID NO: 3321339 - RNA, 20 nt, Human
ggcucuuccaggcugggaga

SEQ ID NO: 3321340 - RNA, 13 nt, Human
gggagggcuccag

SEQ ID NO: 3321341 - RNA, 11 nt, Human
gggagggcucc

SEQ ID NO: 3321342 - RNA, 22 nt, Human
aaaacuugauguguuaucucuu

SEQ ID NO: 3321343 - RNA, 14 nt, Human
aaaagcugggcagg

SEQ ID NO: 3321344 - RNA, 14 nt, Human
gggaacagacugga

SEQ ID NO: 3321345 - RNA, 22 nt, Human
gggaacagacuggaagcacagc

SEQ ID NO: 3321346 - RNA, 17 nt, Human
aaaaaucucaaauuucu

SEQ ID NO: 3321347 - RNA, 20 nt, Human
aaaaaucucaaauuucuaaa

SEQ ID NO: 3321348 - RNA, 19 nt, Human
aaaaaucucaaauuucuaa

SEQ ID NO: 3321349 - RNA, 15 nt, Human
aaaaccaauguucuc

SEQ ID NO: 3321350 - RNA, 18 nt, Human
aaaacguggcugcuucaa

SEQ ID NO: 3321351 - RNA, 17 nt, Human
aaaacguggcugcuuca

SEQ ID NO: 3321352 - RNA, 16 nt, Human
aaaacguggcugcuuc

SEQ ID NO: 3321353 - RNA, 14 nt, Human
aaaacguggcugcu

SEQ ID NO: 3321354 - RNA, 21 nt, Human
aaaacguggcugcuucaagga

SEQ ID NO: 3321355 - RNA, 22 nt, Human
aaaacugauuuuuuuuuccuuc

SEQ ID NO: 3321356 - RNA, 18 nt, Human
aaaacugauuuuuuuuuc

SEQ ID NO: 3321357 - RNA, 18 nt, Human
gggagggcuccagacaca

SEQ ID NO: 3321358 - RNA, 15 nt, Human
gggauuuccaugaug

SEQ ID NO: 3321359 - RNA, 23 nt, Human
gggcagagcagagaccaucccug

SEQ ID NO: 3321360 - RNA, 18 nt, Human
aaaauaguggugugauuu

SEQ ID NO: 3321361 - RNA, 12 nt, Human
aaaauagccugc

SEQ ID NO: 3321362 - RNA, 12 nt, Human
aaaauaaauuau

SEQ ID NO: 3321363 - RNA, 14 nt, Human
aaaauaccagccag

SEQ ID NO: 3321364 - RNA, 14 nt, Human
aaaauaccaaggaa

SEQ ID NO: 3321365 - RNA, 15 nt, Human
aaaauaccagccagu

SEQ ID NO: 3321366 - RNA, 12 nt, Human
ggucuguucuuu

SEQ ID NO: 3321367 - RNA, 21 nt, Human
ggucuugaacuccuggccuca

SEQ ID NO: 3321368 - RNA, 22 nt, Human
ggucuugaacuccuggccucaa

SEQ ID NO: 3321369 - RNA, 19 nt, Human
ggucuguucuuuccaaagu

SEQ ID NO: 3321370 - RNA, 17 nt, Human
ggucuguucuuuccaaa

SEQ ID NO: 3321371 - RNA, 22 nt, Human
ggugcacaagcuccaagcuccc

SEQ ID NO: 3321372 - RNA, 16 nt, Human
ggugcacaagcuccaa

SEQ ID NO: 3321373 - RNA, 11 nt, Human
aaaggaaagag

SEQ ID NO: 3321374 - RNA, 17 nt, Human
aaagcagugcaugcugu

SEQ ID NO: 3321375 - RNA, 17 nt, Human
aaagcuaggccuggcca

SEQ ID NO: 3321376 - RNA, 18 nt, Human
aaagcuaggccuggccag

SEQ ID NO: 3321377 - RNA, 22 nt, Human
aaagcagugcaugcugucccuu

SEQ ID NO: 3321378 - RNA, 21 nt, Human
aaagcagugcaugcugucccu

SEQ ID NO: 3321379 - RNA, 16 nt, Human
aaagcagugcaugcug

SEQ ID NO: 3321380 - RNA, 23 nt, Human
gguauuggcuagagguucaaaga

SEQ ID NO: 3321381 - RNA, 19 nt, Human
gguccacccaggagccccg

SEQ ID NO: 3321382 - RNA, 14 nt, Human
aaacuuuaccuuuu

SEQ ID NO: 3321383 - RNA, 20 nt, Human
gguccacccaggagccccga

SEQ ID NO: 3321384 - RNA, 22 nt, Human
gguccacccaggagccccgagg

SEQ ID NO: 3321385 - RNA, 12 nt, Human
ggucccacccca

SEQ ID NO: 3321386 - RNA, 15 nt, Human
aaagaugagugagca

SEQ ID NO: 3321387 - RNA, 18 nt, Human
aaagaggcuaugugagca

SEQ ID NO: 3321388 - RNA, 13 nt, Human
aaagaggcuaugu

SEQ ID NO: 3321389 - RNA, 14 nt, Human
aaagacuguacaaa

SEQ ID NO: 3321390 - RNA, 15 nt, Human
aaagacuguacaaag

SEQ ID NO: 3321391 - RNA, 19 nt, Human
aaagacuuuuccaacccuc

SEQ ID NO: 3321392 - RNA, 20 nt, Human
aaaauggaagacagcucuua

SEQ ID NO: 3321393 - RNA, 21 nt, Human
aaaauggacguguuaugacuc

SEQ ID NO: 3321394 - RNA, 21 nt, Human
aaaauguaggguuauaauaau

SEQ ID NO: 3321395 - RNA, 19 nt, Human
aaacacaaacgggcucagc

SEQ ID NO: 3321396 - RNA, 16 nt, Human
aaacaugcuacacacu

SEQ ID NO: 3321397 - RNA, 22 nt, Human
aaacaugcuacacacugcaugu

SEQ ID NO: 3321398 - RNA, 24 nt, Human
ggggaaaaucagccugcuccagcu

SEQ ID NO: 3321399 - RNA, 17 nt, Human
ggggaccucaggccugg

SEQ ID NO: 3321400 - RNA, 16 nt, Human
ggggaccucaggccug

SEQ ID NO: 3321401 - RNA, 15 nt, Human
ggggaccucaggccu

SEQ ID NO: 3321402 - RNA, 13 nt, Human
ggggaccucaggc

SEQ ID NO: 3321403 - RNA, 23 nt, Human
ggggcccugccuccuuugugagg

SEQ ID NO: 3321404 - RNA, 19 nt, Human
ggggcccugccuccuuugu

SEQ ID NO: 3321405 - RNA, 15 nt, Human
ggggcccugccuccu

SEQ ID NO: 3321406 - RNA, 16 nt, Human
ggggcccugccuccuu

SEQ ID NO: 3321407 - RNA, 17 nt, Human
ggggccaguuggucccc

SEQ ID NO: 3321408 - RNA, 20 nt, Human
ggguaucaggugcugccauc

SEQ ID NO: 3321409 - RNA, 22 nt, Human
gggucacucuggcagcucagag

SEQ ID NO: 3321410 - RNA, 22 nt, Human
gggucucacuauguugcccagg

SEQ ID NO: 3321411 - RNA, 23 nt, Human
gggucucacuauguugcccaggc

SEQ ID NO: 3321412 - RNA, 17 nt, Human
aaacguggcugcuucaa

SEQ ID NO: 3321413 - RNA, 16 nt, Human
aaacguggcugcuuca

SEQ ID NO: 3321414 - RNA, 16 nt, Human
aaacuggauuaaacuu

SEQ ID NO: 3321415 - RNA, 15 nt, Human
gaagcagaggaagga

SEQ ID NO: 3321416 - RNA, 14 nt, Human
gaagcacaugccuc

SEQ ID NO: 3321417 - RNA, 15 nt, Human
gaagcacaugccucu

SEQ ID NO: 3321418 - RNA, 20 nt, Human
gaagcacaugccucucucag

SEQ ID NO: 3321419 - RNA, 17 nt, Human
gaagcacaugccucucu

SEQ ID NO: 3321420 - RNA, 23 nt, Human
gaagauuuugaaauuuuuauuaa

SEQ ID NO: 3321421 - RNA, 23 nt, Human
gaagacaaugugaaaagaaaaau

SEQ ID NO: 3321422 - RNA, 22 nt, Human
gaagacaaugacuuacuguaca

SEQ ID NO: 3321423 - RNA, 16 nt, Human
gaagacaaugacuuac

SEQ ID NO: 3321424 - RNA, 15 nt, Human
gaacuccuggccuca

SEQ ID NO: 3321425 - RNA, 11 nt, Human
gaacuggcugc

SEQ ID NO: 3321426 - RNA, 12 nt, Human
gaacuggcugca

SEQ ID NO: 3321427 - RNA, 19 nt, Human
gaagcuccgcuuucuaccc

SEQ ID NO: 3321428 - RNA, 22 nt, Human
gaagcuccgcuuucuacccagc

SEQ ID NO: 3321429 - RNA, 17 nt, Human
gaaggccccgcccaggc

SEQ ID NO: 3321430 - RNA, 22 nt, Human
gaaggcuggguucugauccuag

SEQ ID NO: 3321431 - RNA, 20 nt, Human
gaaggcuggguucugauccu

SEQ ID NO: 3321432 - RNA, 21 nt, Human
gaaggcucgagcaugccugga

SEQ ID NO: 3321433 - RNA, 19 nt, Human
gaaggccccgcccaggcuu

SEQ ID NO: 3321434 - RNA, 18 nt, Human
gaaggccccgcccaggcu

SEQ ID NO: 3321435 - RNA, 19 nt, Human
gaaggcucgagcaugccug

SEQ ID NO: 3321436 - RNA, 19 nt, Human
gaaggcuggguucugaucc

SEQ ID NO: 3321437 - RNA, 15 nt, Human
gaaggcuggguucug

SEQ ID NO: 3321438 - RNA, 19 nt, Human
gaauauugcugauggugca

SEQ ID NO: 3321439 - RNA, 15 nt, Human
gaauauugcugaugg

SEQ ID NO: 3321440 - RNA, 14 nt, Human
gaauauugcugaug

SEQ ID NO: 3321441 - RNA, 22 nt, Human
gaaggggagauaaggguaucug

SEQ ID NO: 3321442 - RNA, 19 nt, Human
gacucugucucaaaaaaac

SEQ ID NO: 3321443 - RNA, 14 nt, Human
gacugaauuucuuu

SEQ ID NO: 3321444 - RNA, 18 nt, Human
gacgcuacccgggaaggg

SEQ ID NO: 3321445 - RNA, 16 nt, Human
gacgcuacccgggaag

SEQ ID NO: 3321446 - RNA, 15 nt, Human
gacgccaucccagcc

SEQ ID NO: 3321447 - RNA, 18 nt, Human
gacgccaucccagcccca

SEQ ID NO: 3321448 - RNA, 17 nt, Human
gacgccaucccagcccc

SEQ ID NO: 3321449 - RNA, 20 nt, Human
gaccaucccugaaggccccg

SEQ ID NO: 3321450 - RNA, 13 nt, Human
gaccucugccuga

SEQ ID NO: 3321451 - RNA, 14 nt, Human
gaccucugcagcaa

SEQ ID NO: 3321452 - RNA, 16 nt, Human
gacgccaucccagccc

SEQ ID NO: 3321453 - RNA, 13 nt, Human
gaccugaggcccu

SEQ ID NO: 3321454 - RNA, 11 nt, Human
gaccugaggcc

SEQ ID NO: 3321455 - RNA, 18 nt, Human
gaccagggauuuccauga

SEQ ID NO: 3321456 - RNA, 20 nt, Human
gaccagggauuuccaugaug

SEQ ID NO: 3321457 - RNA, 19 nt, Human
gaccaucccugaaggcccc

SEQ ID NO: 3321458 - RNA, 18 nt, Human
gaccaucccugaaggccc

SEQ ID NO: 3321459 - RNA, 13 nt, Human
gaccaucccugaa

SEQ ID NO: 3321460 - RNA, 12 nt, Human
gaccaucccuga

SEQ ID NO: 3321461 - RNA, 19 nt, Human
gacauuguuggccaaagcc

SEQ ID NO: 3321462 - RNA, 19 nt, Human
gacagcccgggcucugccu

SEQ ID NO: 3321463 - RNA, 18 nt, Human
gacagcccgggcucugcc

SEQ ID NO: 3321464 - RNA, 14 nt, Human
gacauugcggacag

SEQ ID NO: 3321465 - RNA, 15 nt, Human
gacauugcggacagc

SEQ ID NO: 3321466 - RNA, 17 nt, Human
gacagcccgggcucugc

SEQ ID NO: 3321467 - RNA, 13 nt, Human
gacacagcucuuc

SEQ ID NO: 3321468 - RNA, 14 nt, Human
gacacagcucuucu

SEQ ID NO: 3321469 - RNA, 16 nt, Human
gacacagcucuucucc

SEQ ID NO: 3321470 - RNA, 23 nt, Human
gacacagcucuucuccaggcugu

SEQ ID NO: 3321471 - RNA, 22 nt, Human
gacacagcucuucuccaggcug

SEQ ID NO: 3321472 - RNA, 20 nt, Human
gagccuuccaggggugggac

SEQ ID NO: 3321473 - RNA, 23 nt, Human
gagccuuccaggggugggacacc

SEQ ID NO: 3321474 - RNA, 13 nt, Human
gagccuugaacuu

SEQ ID NO: 3321475 - RNA, 17 nt, Human
gagccuuccaggggugg

SEQ ID NO: 3321476 - RNA, 14 nt, Human
gaggcagggucuca

SEQ ID NO: 3321477 - RNA, 22 nt, Human
gaggccaaggugggaggauugc

SEQ ID NO: 3321478 - RNA, 17 nt, Human
gaggccaaggugggagg

SEQ ID NO: 3321479 - RNA, 15 nt, Human
gaggcagggucucac

SEQ ID NO: 3321480 - RNA, 22 nt, Human
gaggcagggucucacucugucg

SEQ ID NO: 3321481 - RNA, 22 nt, Human
gaggcuagugugguguuuccug

SEQ ID NO: 3321482 - RNA, 14 nt, Human
gaggccagagacac

SEQ ID NO: 3321483 - RNA, 13 nt, Human
gaggccagagaca

SEQ ID NO: 3321484 - RNA, 15 nt, Human
gaggucgaggcagga

SEQ ID NO: 3321485 - RNA, 23 nt, Human
gaggugaccccagguuucuaugu

SEQ ID NO: 3321486 - RNA, 22 nt, Human
gagucagaaguuucugccgcag

SEQ ID NO: 3321487 - RNA, 12 nt, Human
gagucccaccuu

SEQ ID NO: 3321488 - RNA, 17 nt, Human
gagugacagaggcagcc

SEQ ID NO: 3321489 - RNA, 18 nt, Human
gagugacagaggcagccc

SEQ ID NO: 3321490 - RNA, 15 nt, Human
gagucaccaagccca

SEQ ID NO: 3321491 - RNA, 16 nt, Human
gagucaccaagcccag

SEQ ID NO: 3321492 - RNA, 17 nt, Human
gagucaccaagcccagu

SEQ ID NO: 3321493 - RNA, 22 nt, Human
gaguugauagcacagacccugc

SEQ ID NO: 3321494 - RNA, 17 nt, Human
gaguugauucagcucug

SEQ ID NO: 3321495 - RNA, 16 nt, Human
gaguugauucagcucu

SEQ ID NO: 3321496 - RNA, 15 nt, Human
gaguugauucagcuc

SEQ ID NO: 3321497 - RNA, 20 nt, Human
gagugacagaggcagcccca

SEQ ID NO: 3321498 - RNA, 18 nt, Human
gaguugauucagcucugc

SEQ ID NO: 3321499 - RNA, 22 nt, Human
gaguuguuacauuuuuaagugc

SEQ ID NO: 3321500 - RNA, 19 nt, Human
gcaagugagagcugggugu

SEQ ID NO: 3321501 - RNA, 21 nt, Human
gcacaucagcacgauuucugu

SEQ ID NO: 3321502 - RNA, 14 nt, Human
gcacacauuuuuua

SEQ ID NO: 3321503 - RNA, 14 nt, Human
gcacaccgggcacu

SEQ ID NO: 3321504 - RNA, 22 nt, Human
gcacaagcugcacccucaggca

SEQ ID NO: 3321505 - RNA, 23 nt, Human
gcaccgggccacagagaaaguac

SEQ ID NO: 3321506 - RNA, 14 nt, Human
gcaccgggccacag

SEQ ID NO: 3321507 - RNA, 23 nt, Human
gcacaucagcacgauuucuguuu

SEQ ID NO: 3321508 - RNA, 22 nt, Human
gcacaucagcacgauuucuguu

SEQ ID NO: 3321509 - RNA, 16 nt, Human
gcacuugcagacucua

SEQ ID NO: 3321510 - RNA, 16 nt, Human
gcacuccccugcuggg

SEQ ID NO: 3321511 - RNA, 22 nt, Human
gcacuccccugcuggguguggc

SEQ ID NO: 3321512 - RNA, 13 nt, Human
gcacucagaagac

SEQ ID NO: 3321513 - RNA, 16 nt, Human
gcacucagaagacacu

SEQ ID NO: 3321514 - RNA, 17 nt, Human
gcacuccccugcugggu

SEQ ID NO: 3321515 - RNA, 16 nt, Human
gaugagugagcaugcc

SEQ ID NO: 3321516 - RNA, 21 nt, Human
gaugaucuaggaagacuuugg

SEQ ID NO: 3321517 - RNA, 15 nt, Human
gaugaucuaggaaga

SEQ ID NO: 3321518 - RNA, 14 nt, Human
gaugauccuaggca

SEQ ID NO: 3321519 - RNA, 12 nt, Human
gauuauuggaaa

SEQ ID NO: 3321520 - RNA, 15 nt, Human
gauucuccugccuca

SEQ ID NO: 3321521 - RNA, 17 nt, Human
gauucuccugccucagc

SEQ ID NO: 3321522 - RNA, 18 nt, Human
gauucuccugccucagcc

SEQ ID NO: 3321523 - RNA, 14 nt, Human
gauucuccugccuc

SEQ ID NO: 3321524 - RNA, 17 nt, Human
gauucuuccucccuccc

SEQ ID NO: 3321525 - RNA, 18 nt, Human
gauucuuccucccucccu

SEQ ID NO: 3321526 - RNA, 22 nt, Human
cuggaugcagccucacaguccu

SEQ ID NO: 3321527 - RNA, 17 nt, Human
cuggaguucugguuccu

SEQ ID NO: 3321528 - RNA, 16 nt, Human
cuggaguucugguucc

SEQ ID NO: 3321529 - RNA, 15 nt, Human
cuggaguucugguuc

SEQ ID NO: 3321530 - RNA, 12 nt, Human
cugcugaaggcu

SEQ ID NO: 3321531 - RNA, 16 nt, Human
cugcucacauaucugu

SEQ ID NO: 3321532 - RNA, 19 nt, Human
cugcucacauaucugucau

SEQ ID NO: 3321533 - RNA, 14 nt, Human
cugcucacauaucu

SEQ ID NO: 3321534 - RNA, 13 nt, Human
cugcugacagugu

SEQ ID NO: 3321535 - RNA, 15 nt, Human
cugcugacaguguug

SEQ ID NO: 3321536 - RNA, 11 nt, Human
cugcugacagu

SEQ ID NO: 3321537 - RNA, 12 nt, Human
cugcugacagug

SEQ ID NO: 3321538 - RNA, 15 nt, Human
cugcugaaggcucga

SEQ ID NO: 3321539 - RNA, 14 nt, Human
cugcugaaggcucg

SEQ ID NO: 3321540 - RNA, 13 nt, Human
cugcugaaggcuc

SEQ ID NO: 3321541 - RNA, 20 nt, Human
cugcuuaacuucacauauug

SEQ ID NO: 3321542 - RNA, 21 nt, Human
cuggguggcaccagcagccug

SEQ ID NO: 3321543 - RNA, 14 nt, Human
cuggguguggcgca

SEQ ID NO: 3321544 - RNA, 15 nt, Human
cuggguguggcgcag

SEQ ID NO: 3321545 - RNA, 20 nt, Human
cugggcagaggaaagcaaag

SEQ ID NO: 3321546 - RNA, 12 nt, Human
cugggcagagga

SEQ ID NO: 3321547 - RNA, 16 nt, Human
cugggcagaggaaagc

SEQ ID NO: 3321548 - RNA, 13 nt, Human
cugggcagaggaa

SEQ ID NO: 3321549 - RNA, 20 nt, Human
cugggcagguuggugggggc

SEQ ID NO: 3321550 - RNA, 20 nt, Human
cuggguggcaccagcagccu

SEQ ID NO: 3321551 - RNA, 18 nt, Human
cuggguggcaccagcagc

SEQ ID NO: 3321552 - RNA, 13 nt, Human
cuggggagaaagu

SEQ ID NO: 3321553 - RNA, 12 nt, Human
cuggcccuuccu

SEQ ID NO: 3321554 - RNA, 22 nt, Human
cuggcuaugcauuugaaaauuu

SEQ ID NO: 3321555 - RNA, 16 nt, Human
cuggcuaugcauuuga

SEQ ID NO: 3321556 - RNA, 15 nt, Human
cuggcuaugcauuug

SEQ ID NO: 3321557 - RNA, 14 nt, Human
cuggcuaugcauuu

SEQ ID NO: 3321558 - RNA, 13 nt, Human
cuggcuaugcauu

SEQ ID NO: 3321559 - RNA, 14 nt, Human
cugggacaugggaa

SEQ ID NO: 3321560 - RNA, 22 nt, Human
cugggacaugggaaaggggaag

SEQ ID NO: 3321561 - RNA, 18 nt, Human
cugggacaugggaaaggg

SEQ ID NO: 3321562 - RNA, 13 nt, Human
cugggacuacagg

SEQ ID NO: 3321563 - RNA, 15 nt, Human
cugggacuacaggca

SEQ ID NO: 3321564 - RNA, 13 nt, Human
cugcauuggcuuu

SEQ ID NO: 3321565 - RNA, 14 nt, Human
cugcauuuaaaaga

SEQ ID NO: 3321566 - RNA, 19 nt, Human
cugcccugugggcccccaa

SEQ ID NO: 3321567 - RNA, 12 nt, Human
cugcccuuaccu

SEQ ID NO: 3321568 - RNA, 16 nt, Human
cugcccuuaccugcca

SEQ ID NO: 3321569 - RNA, 12 nt, Human
cugccauccagg

SEQ ID NO: 3321570 - RNA, 16 nt, Human
cugccauauucuguug

SEQ ID NO: 3321571 - RNA, 16 nt, Human
cugccauccagguuca

SEQ ID NO: 3321572 - RNA, 18 nt, Human
cugccauccagguucagc

SEQ ID NO: 3321573 - RNA, 19 nt, Human
cugccauccagguucagcu

SEQ ID NO: 3321574 - RNA, 23 nt, Human
cugccagggacagaggggguggc

SEQ ID NO: 3321575 - RNA, 22 nt, Human
cugccagggacagagggggugg

SEQ ID NO: 3321576 - RNA, 20 nt, Human
cugccagggacagagggggu

SEQ ID NO: 3321577 - RNA, 17 nt, Human
cugcauuuaaaagauac

SEQ ID NO: 3321578 - RNA, 15 nt, Human
cugcacuccagccug

SEQ ID NO: 3321579 - RNA, 22 nt, Human
cugcacuauagccuaggugaca

SEQ ID NO: 3321580 - RNA, 23 nt, Human
cugcacuauagccuaggugacag

SEQ ID NO: 3321581 - RNA, 13 nt, Human
cugcacuccagcc

SEQ ID NO: 3321582 - RNA, 16 nt, Human
cugcacuauagccuag

SEQ ID NO: 3321583 - RNA, 17 nt, Human
cugcacuauagccuagg

SEQ ID NO: 3321584 - RNA, 18 nt, Human
cugcacuauagccuaggu

SEQ ID NO: 3321585 - RNA, 20 nt, Human
cugcacuauagccuagguga

SEQ ID NO: 3321586 - RNA, 23 nt, Human
cugcagccucaaccuccugggcu

SEQ ID NO: 3321587 - RNA, 24 nt, Human
cugcagccucaaccuccugggcua

SEQ ID NO: 3321588 - RNA, 18 nt, Human
cugcacuccagccugggu

SEQ ID NO: 3321589 - RNA, 16 nt, Human
cugcacuccagccugg

SEQ ID NO: 3321590 - RNA, 17 nt, Human
cugcacuccagccuggg

SEQ ID NO: 3321591 - RNA, 20 nt, Human
cugcaggcagccaggccaca

SEQ ID NO: 3321592 - RNA, 19 nt, Human
cugcaggcagccaggccac

SEQ ID NO: 3321593 - RNA, 18 nt, Human
cugcaggcagccaggcca

SEQ ID NO: 3321594 - RNA, 17 nt, Human
cugcaggcagccaggcc

SEQ ID NO: 3321595 - RNA, 16 nt, Human
cugcaggcagccaggc

SEQ ID NO: 3321596 - RNA, 15 nt, Human
cugcaggcagccagg

SEQ ID NO: 3321597 - RNA, 14 nt, Human
cugcaggcagccag

SEQ ID NO: 3321598 - RNA, 13 nt, Human
cugcaggcagcca

SEQ ID NO: 3321599 - RNA, 12 nt, Human
cugcagcuuugu

SEQ ID NO: 3321600 - RNA, 23 nt, Human
cugcaccgggccacagagaaagu

SEQ ID NO: 3321601 - RNA, 20 nt, Human
cugcaccgggccacagagaa

SEQ ID NO: 3321602 - RNA, 20 nt, Human
cugcaagaauugaagcagga

SEQ ID NO: 3321603 - RNA, 12 nt, Human
cugcaagggagu

SEQ ID NO: 3321604 - RNA, 22 nt, Human
cugcaaccugauugugucucuu

SEQ ID NO: 3321605 - RNA, 18 nt, Human
cugcaagaauugaagcag

SEQ ID NO: 3321606 - RNA, 22 nt, Human
cugcaaccuccgccucuugggu

SEQ ID NO: 3321607 - RNA, 14 nt, Human
cugcaaccugauug

SEQ ID NO: 3321608 - RNA, 21 nt, Human
cugcaaccugauugugucucu

SEQ ID NO: 3321609 - RNA, 19 nt, Human
cugcaaccugauugugucu

SEQ ID NO: 3321610 - RNA, 20 nt, Human
cugcaaccuccgccucuugg

SEQ ID NO: 3321611 - RNA, 24 nt, Human
cugaugggcaacccccagccugcu

SEQ ID NO: 3321612 - RNA, 22 nt, Human
cugaugggcaacccccagccug

SEQ ID NO: 3321613 - RNA, 23 nt, Human
cugaugggcaacccccagccugc

SEQ ID NO: 3321614 - RNA, 21 nt, Human
cugcaaaggguaucaggugcu

SEQ ID NO: 3321615 - RNA, 22 nt, Human
cugcaaaggguaucaggugcug

SEQ ID NO: 3321616 - RNA, 20 nt, Human
cugaugcuucuucagagacu

SEQ ID NO: 3321617 - RNA, 19 nt, Human
cugaugcuucuucagagac

SEQ ID NO: 3321618 - RNA, 18 nt, Human
cugaugcuucuucagaga

SEQ ID NO: 3321619 - RNA, 18 nt, Human
cugaugggcaacccccag

SEQ ID NO: 3321620 - RNA, 21 nt, Human
cugaugggcaacccccagccu

SEQ ID NO: 3321621 - RNA, 15 nt, Human
cucuuaugggcuggg

SEQ ID NO: 3321622 - RNA, 14 nt, Human
cucuuaugggcugg

SEQ ID NO: 3321623 - RNA, 17 nt, Human
cugaugcuucuucagag

SEQ ID NO: 3321624 - RNA, 16 nt, Human
cugaugcuucuucaga

SEQ ID NO: 3321625 - RNA, 17 nt, Human
cuuccauggacuuuguu

SEQ ID NO: 3321626 - RNA, 16 nt, Human
cuuccauggacuuugu

SEQ ID NO: 3321627 - RNA, 20 nt, Human
cuuccagugaggcucugccc

SEQ ID NO: 3321628 - RNA, 19 nt, Human
cuuccagugaggcucugcc

SEQ ID NO: 3321629 - RNA, 17 nt, Human
cuuccagugaggcucug

SEQ ID NO: 3321630 - RNA, 18 nt, Human
cuuccagugaggcucugc

SEQ ID NO: 3321631 - RNA, 22 nt, Human
cuucagagacuccugcaggcag

SEQ ID NO: 3321632 - RNA, 21 nt, Human
cuucagagacuccugcaggca

SEQ ID NO: 3321633 - RNA, 16 nt, Human
cuucagagacuccugc

SEQ ID NO: 3321634 - RNA, 20 nt, Human
cuucagagacuccugcaggc

SEQ ID NO: 3321635 - RNA, 14 nt, Human
cuucaccuuugucc

SEQ ID NO: 3321636 - RNA, 18 nt, Human
cuuauugcccacgcugga

SEQ ID NO: 3321637 - RNA, 17 nt, Human
cuucaccuuugucccca

SEQ ID NO: 3321638 - RNA, 16 nt, Human
cuucauccuccucaga

SEQ ID NO: 3321639 - RNA, 15 nt, Human
cuucauccuccucag

SEQ ID NO: 3321640 - RNA, 13 nt, Human
cuucaucccucug

SEQ ID NO: 3321641 - RNA, 18 nt, Human
cuucaguggcagcugcuu

SEQ ID NO: 3321642 - RNA, 17 nt, Human
cuucaguggcagcugcu

SEQ ID NO: 3321643 - RNA, 23 nt, Human
cuucagagacuccugcaggcagc

SEQ ID NO: 3321644 - RNA, 21 nt, Human
cuuauggaacacucugagacu

SEQ ID NO: 3321645 - RNA, 21 nt, Human
cuuaugggcuggguucuaccc

SEQ ID NO: 3321646 - RNA, 14 nt, Human
cuuaugggcugggu

SEQ ID NO: 3321647 - RNA, 23 nt, Human
cuuaugggcuggguucuacccag

SEQ ID NO: 3321648 - RNA, 22 nt, Human
cuuaugggcuggguucuaccca

SEQ ID NO: 3321649 - RNA, 12 nt, Human
cuuauugcccac

SEQ ID NO: 3321650 - RNA, 13 nt, Human
cuuauugcccacg

SEQ ID NO: 3321651 - RNA, 18 nt, Human
cuuagcagggaaacagcu

SEQ ID NO: 3321652 - RNA, 19 nt, Human
cuuagauguauauauuucc

SEQ ID NO: 3321653 - RNA, 21 nt, Human
cuuaccucggugccuuccucu

SEQ ID NO: 3321654 - RNA, 19 nt, Human
cuuaccucggugccuuccu

SEQ ID NO: 3321655 - RNA, 13 nt, Human
cuuaccucggugc

SEQ ID NO: 3321656 - RNA, 19 nt, Human
cuuacccucauguucuuaa

SEQ ID NO: 3321657 - RNA, 18 nt, Human
cuuacccucauguucuua

SEQ ID NO: 3321658 - RNA, 17 nt, Human
cuuacccucauguucuu

SEQ ID NO: 3321659 - RNA, 16 nt, Human
cuguugggccaggagc

SEQ ID NO: 3321660 - RNA, 20 nt, Human
cuguugggccaggagccucc

SEQ ID NO: 3321661 - RNA, 17 nt, Human
cuguugggccaggagcc

SEQ ID NO: 3321662 - RNA, 13 nt, Human
cuuacacaauggu

SEQ ID NO: 3321663 - RNA, 13 nt, Human
cuguucagcucca

SEQ ID NO: 3321664 - RNA, 16 nt, Human
cugugucuugcaaugg

SEQ ID NO: 3321665 - RNA, 19 nt, Human
cugugucuugcaauggcag

SEQ ID NO: 3321666 - RNA, 19 nt, Human
cugugucagguggggcagc

SEQ ID NO: 3321667 - RNA, 20 nt, Human
cugugucagcauagaaguaa

SEQ ID NO: 3321668 - RNA, 21 nt, Human
cugugucagguggggcagcuu

SEQ ID NO: 3321669 - RNA, 14 nt, Human
cugugucuugcaau

SEQ ID NO: 3321670 - RNA, 19 nt, Human
cugugucucccuucauccu

SEQ ID NO: 3321671 - RNA, 14 nt, Human
cugugucucccuuc

SEQ ID NO: 3321672 - RNA, 22 nt, Human
cugugcugagucugaaggcugg

SEQ ID NO: 3321673 - RNA, 20 nt, Human
cugugcugagucugaaggcu

SEQ ID NO: 3321674 - RNA, 11 nt, Human
cugugcugccc

SEQ ID NO: 3321675 - RNA, 19 nt, Human
cugugcugagucugaaggc

SEQ ID NO: 3321676 - RNA, 18 nt, Human
cuucuucagagacuccug

SEQ ID NO: 3321677 - RNA, 22 nt, Human
cuucuucagagacuccugcagg

SEQ ID NO: 3321678 - RNA, 23 nt, Human
cuucugacccaugcugcccugug

SEQ ID NO: 3321679 - RNA, 21 nt, Human
cuucuucagagacuccugcag

SEQ ID NO: 3321680 - RNA, 20 nt, Human
cuucuucagagacuccugca

SEQ ID NO: 3321681 - RNA, 20 nt, Human
cuugaaugaugccaugagga

SEQ ID NO: 3321682 - RNA, 12 nt, Human
cuugcucugcug

SEQ ID NO: 3321683 - RNA, 23 nt, Human
cuugccgucuaccugaggggccu

SEQ ID NO: 3321684 - RNA, 19 nt, Human
cuugccgucuaccugaggg

SEQ ID NO: 3321685 - RNA, 12 nt, Human
cuugacagggca

SEQ ID NO: 3321686 - RNA, 20 nt, Human
cuugccgucuaccugagggg

SEQ ID NO: 3321687 - RNA, 13 nt, Human
cuuguggacacag

SEQ ID NO: 3321688 - RNA, 14 nt, Human
cuuguggacacagc

SEQ ID NO: 3321689 - RNA, 15 nt, Human
cuuguggacacagcu

SEQ ID NO: 3321690 - RNA, 22 nt, Human
cuuucaauaggaaaaacugauu

SEQ ID NO: 3321691 - RNA, 21 nt, Human
cuuucaauaggaaaaacugau

SEQ ID NO: 3321692 - RNA, 20 nt, Human
cuuucaauaggaaaaacuga

SEQ ID NO: 3321693 - RNA, 18 nt, Human
cuuucaauaggaaaaacu

SEQ ID NO: 3321694 - RNA, 22 nt, Human
cuuugacgccaucccagcccca

SEQ ID NO: 3321695 - RNA, 21 nt, Human
cuuugacgccaucccagcccc

SEQ ID NO: 3321696 - RNA, 19 nt, Human
cuuugacgccaucccagcc

SEQ ID NO: 3321697 - RNA, 18 nt, Human
cuuugacgccaucccagc

SEQ ID NO: 3321698 - RNA, 15 nt, Human
cuuuucaaaacauuu

SEQ ID NO: 3321699 - RNA, 14 nt, Human
cuuuuauaaacuuu

SEQ ID NO: 3321700 - RNA, 18 nt, Human
cuuuuauaaacuuuaccu

SEQ ID NO: 3321701 - RNA, 16 nt, Human
cuuuuauaaacuuuac

SEQ ID NO: 3321702 - RNA, 15 nt, Human
cuuuuauaaacuuua

SEQ ID NO: 3321703 - RNA, 16 nt, Human
cuuuggucuacacugu

SEQ ID NO: 3321704 - RNA, 20 nt, Human
cuuuggucuacacugugcug

SEQ ID NO: 3321705 - RNA, 23 nt, Human
cuccgcuuucuacccagcgagcc

SEQ ID NO: 3321706 - RNA, 14 nt, Human
cuccuuguguuacu

SEQ ID NO: 3321707 - RNA, 15 nt, Human
cuccuuucaccacau

SEQ ID NO: 3321708 - RNA, 16 nt, Human
cuccuguaccucuuga

SEQ ID NO: 3321709 - RNA, 19 nt, Human
cuccuggccucaagugauu

SEQ ID NO: 3321710 - RNA, 18 nt, Human
cuccugggcuaagugauc

SEQ ID NO: 3321711 - RNA, 19 nt, Human
cuccuggcccacugcaucg

SEQ ID NO: 3321712 - RNA, 18 nt, Human
cuccuggcccacugcauc

SEQ ID NO: 3321713 - RNA, 14 nt, Human
cuccucugcugcug

SEQ ID NO: 3321714 - RNA, 13 nt, Human
cuccucugcugcu

SEQ ID NO: 3321715 - RNA, 23 nt, Human
cuccaggugcacaagcuccaagc

SEQ ID NO: 3321716 - RNA, 15 nt, Human
cuccaggcuccuuua

SEQ ID NO: 3321717 - RNA, 23 nt, Human
cuccaggcuccuuuagcgcccag

SEQ ID NO: 3321718 - RNA, 20 nt, Human
cuccaggcuguaucccauga

SEQ ID NO: 3321719 - RNA, 22 nt, Human
cuccaggugcacaagcuccaag

SEQ ID NO: 3321720 - RNA, 20 nt, Human
cucccucuuucccucccuuc

SEQ ID NO: 3321721 - RNA, 19 nt, Human
cucugcacaagcugcaccc

SEQ ID NO: 3321722 - RNA, 21 nt, Human
cucugcacaagcugcacccuc

SEQ ID NO: 3321723 - RNA, 20 nt, Human
cucugcacaagcugcacccu

SEQ ID NO: 3321724 - RNA, 14 nt, Human
cucugcacuccccu

SEQ ID NO: 3321725 - RNA, 16 nt, Human
cucugcacuccccugc

SEQ ID NO: 3321726 - RNA, 15 nt, Human
cucugcacuccccug

SEQ ID NO: 3321727 - RNA, 13 nt, Human
cucuguacagagc

SEQ ID NO: 3321728 - RNA, 15 nt, Human
cucuguacagagccc

SEQ ID NO: 3321729 - RNA, 14 nt, Human
cucuguacagagcc

SEQ ID NO: 3321730 - RNA, 16 nt, Human
cucugcugcuggcugg

SEQ ID NO: 3321731 - RNA, 15 nt, Human
cucugcugcuggcug

SEQ ID NO: 3321732 - RNA, 14 nt, Human
cucugcugcuggcu

SEQ ID NO: 3321733 - RNA, 16 nt, Human
cucuguacagagccca

SEQ ID NO: 3321734 - RNA, 21 nt, Human
cucugcugacagacacaggcc

SEQ ID NO: 3321735 - RNA, 22 nt, Human
cucugcugacagacacaggccc

SEQ ID NO: 3321736 - RNA, 20 nt, Human
cucugcugacagacacaggc

SEQ ID NO: 3321737 - RNA, 13 nt, Human
cucugcugcuggc

SEQ ID NO: 3321738 - RNA, 23 nt, Human
cucugcugacagacacaggcccg

SEQ ID NO: 3321739 - RNA, 20 nt, Human
cucugcuccucuccccagca

SEQ ID NO: 3321740 - RNA, 21 nt, Human
cucugcuccucuccccagcaa

SEQ ID NO: 3321741 - RNA, 17 nt, Human
cucugcacuccccugcu

SEQ ID NO: 3321742 - RNA, 16 nt, Human
cucgguguggagaagc

SEQ ID NO: 3321743 - RNA, 17 nt, Human
cucgguguggagaagcg

SEQ ID NO: 3321744 - RNA, 18 nt, Human
cuccuuugugaggaagcc

SEQ ID NO: 3321745 - RNA, 17 nt, Human
cuccuuugugaggaagc

SEQ ID NO: 3321746 - RNA, 16 nt, Human
cucuccuccagaguca

SEQ ID NO: 3321747 - RNA, 12 nt, Human
cucuccuccaga

SEQ ID NO: 3321748 - RNA, 15 nt, Human
cucuccuccagaguc

SEQ ID NO: 3321749 - RNA, 13 nt, Human
cucuccuccagag

SEQ ID NO: 3321750 - RNA, 14 nt, Human
cuaugugagaccau

SEQ ID NO: 3321751 - RNA, 13 nt, Human
cuaucucccccag

SEQ ID NO: 3321752 - RNA, 17 nt, Human
cuauguugcccaggcag

SEQ ID NO: 3321753 - RNA, 18 nt, Human
cuauguugcccaggcagg

SEQ ID NO: 3321754 - RNA, 19 nt, Human
cuauguugcccaggcaggu

SEQ ID NO: 3321755 - RNA, 21 nt, Human
cuauguugcccaggcaggucu

SEQ ID NO: 3321756 - RNA, 22 nt, Human
cuauguugcccaggcaggucuu

SEQ ID NO: 3321757 - RNA, 21 nt, Human
cucaagugauucuccugccuc

SEQ ID NO: 3321758 - RNA, 23 nt, Human
cucaauuauuuugcauuuuuucu

SEQ ID NO: 3321759 - RNA, 11 nt, Human
cucaggccugg

SEQ ID NO: 3321760 - RNA, 22 nt, Human
cucaggccugggggcugggcag

SEQ ID NO: 3321761 - RNA, 18 nt, Human
cucaggccagcugcuugg

SEQ ID NO: 3321762 - RNA, 17 nt, Human
cucaggccagcugcuug

SEQ ID NO: 3321763 - RNA, 16 nt, Human
cucaggccagcugcuu

SEQ ID NO: 3321764 - RNA, 15 nt, Human
cucaggccagcugcu

SEQ ID NO: 3321765 - RNA, 21 nt, Human
cucaggccaaacucaccugcc

SEQ ID NO: 3321766 - RNA, 20 nt, Human
cucaggccaaacucaccugc

SEQ ID NO: 3321767 - RNA, 19 nt, Human
cucaggccaaacucaccug

SEQ ID NO: 3321768 - RNA, 13 nt, Human
cucagaagacacu

SEQ ID NO: 3321769 - RNA, 15 nt, Human
cucagaagacacuga

SEQ ID NO: 3321770 - RNA, 17 nt, Human
cucagaagacacugaug

SEQ ID NO: 3321771 - RNA, 20 nt, Human
cucagaagacacugaugggc

SEQ ID NO: 3321772 - RNA, 22 nt, Human
cucagaagacacugaugggcaa

SEQ ID NO: 3321773 - RNA, 17 nt, Human
cucaccuuucccaucuu

SEQ ID NO: 3321774 - RNA, 23 nt, Human
cucagaagacacugaugggcaac

SEQ ID NO: 3321775 - RNA, 19 nt, Human
cucagccucccgaauagcu

SEQ ID NO: 3321776 - RNA, 21 nt, Human
cucagccucccgaauagcugg

SEQ ID NO: 3321777 - RNA, 22 nt, Human
cucagccucccgaauagcuggg

SEQ ID NO: 3321778 - RNA, 13 nt, Human
cucagccucccga

SEQ ID NO: 3321779 - RNA, 20 nt, Human
cucagucuggcccuuccuuu

SEQ ID NO: 3321780 - RNA, 15 nt, Human
cucaguccauagcag

SEQ ID NO: 3321781 - RNA, 17 nt, Human
cucaguccauagcagag

SEQ ID NO: 3321782 - RNA, 22 nt, Human
cucagucuggcccuuccuuuuc

SEQ ID NO: 3321783 - RNA, 23 nt, Human
cucaggugucccugcacuugcag

SEQ ID NO: 3321784 - RNA, 20 nt, Human
ccuucuguccuacucugugu

SEQ ID NO: 3321785 - RNA, 21 nt, Human
ccuucuguccuacucuguguc

SEQ ID NO: 3321786 - RNA, 22 nt, Human
ccuucuguccuacucuguguca

SEQ ID NO: 3321787 - RNA, 23 nt, Human
ccuucucuccagccccuggaugc

SEQ ID NO: 3321788 - RNA, 21 nt, Human
ccuucucuccagccccuggau

SEQ ID NO: 3321789 - RNA, 14 nt, Human
ccuucucugaagga

SEQ ID NO: 3321790 - RNA, 16 nt, Human
ccuucucugaaggaca

SEQ ID NO: 3321791 - RNA, 20 nt, Human
ccuucucuccagccccugga

SEQ ID NO: 3321792 - RNA, 17 nt, Human
ccuuucaauaggaaaaa

SEQ ID NO: 3321793 - RNA, 15 nt, Human
ccuuucaauaggaaa

SEQ ID NO: 3321794 - RNA, 13 nt, Human
ccuguucagcucc

SEQ ID NO: 3321795 - RNA, 23 nt, Human
ccuguucagcuccagcucaccag

SEQ ID NO: 3321796 - RNA, 20 nt, Human
ccuguucagcuccagcucac

SEQ ID NO: 3321797 - RNA, 21 nt, Human
ccuguucagcuccagcucacc

SEQ ID NO: 3321798 - RNA, 14 nt, Human
ccuguucagcucca

SEQ ID NO: 3321799 - RNA, 15 nt, Human
ccuguucagcuccag

SEQ ID NO: 3321800 - RNA, 16 nt, Human
ccuguucagcuccagc

SEQ ID NO: 3321801 - RNA, 19 nt, Human
ccuguucagcuccagcuca

SEQ ID NO: 3321802 - RNA, 17 nt, Human
ccuguucuggcagaguu

SEQ ID NO: 3321803 - RNA, 12 nt, Human
ccuguucuggca

SEQ ID NO: 3321804 - RNA, 18 nt, Human
ccuguucccaugagauga

SEQ ID NO: 3321805 - RNA, 16 nt, Human
ccuguugggccaggag

SEQ ID NO: 3321806 - RNA, 20 nt, Human
ccuguugggccaggagccuc

SEQ ID NO: 3321807 - RNA, 19 nt, Human
ccuguugggccaggagccu

SEQ ID NO: 3321808 - RNA, 18 nt, Human
ccuguugggccaggagcc

SEQ ID NO: 3321809 - RNA, 17 nt, Human
ccuguugggccaggagc

SEQ ID NO: 3321810 - RNA, 16 nt, Human
ccuuagcaaauucugu

SEQ ID NO: 3321811 - RNA, 19 nt, Human
ccuuagcagggaaacagcu

SEQ ID NO: 3321812 - RNA, 20 nt, Human
ccuuagcagggaaacagcua

SEQ ID NO: 3321813 - RNA, 12 nt, Human
ccuucccaccuc

SEQ ID NO: 3321814 - RNA, 19 nt, Human
ccuucccaccucucucacu

SEQ ID NO: 3321815 - RNA, 14 nt, Human
ccuucccaccucuc

SEQ ID NO: 3321816 - RNA, 18 nt, Human
ccuuauggaacacucuga

SEQ ID NO: 3321817 - RNA, 17 nt, Human
ccuuauggaacacucug

SEQ ID NO: 3321818 - RNA, 16 nt, Human
ccuuauggaacacucu

SEQ ID NO: 3321819 - RNA, 14 nt, Human
ccuuauggaacacu

SEQ ID NO: 3321820 - RNA, 20 nt, Human
ccuuauggaacacucugaga

SEQ ID NO: 3321821 - RNA, 19 nt, Human
ccuuauggaacacucugag

SEQ ID NO: 3321822 - RNA, 22 nt, Human
ccuuauggaacacucugagacu

SEQ ID NO: 3321823 - RNA, 12 nt, Human
ccuuauggaaca

SEQ ID NO: 3321824 - RNA, 20 nt, Human
cgcugccccuggcagccccu

SEQ ID NO: 3321825 - RNA, 19 nt, Human
cgcugccccuggcagcccc

SEQ ID NO: 3321826 - RNA, 17 nt, Human
cgcuggagugcagugag

SEQ ID NO: 3321827 - RNA, 18 nt, Human
cgcuggagugcagugagc

SEQ ID NO: 3321828 - RNA, 23 nt, Human
cgccaaggcugggggaagaagcu

SEQ ID NO: 3321829 - RNA, 23 nt, Human
cggagucccaccuuggcugcagg

SEQ ID NO: 3321830 - RNA, 21 nt, Human
cggagucccaccuuggcugca

SEQ ID NO: 3321831 - RNA, 22 nt, Human
cggagucccaccuuggcugcag

SEQ ID NO: 3321832 - RNA, 15 nt, Human
cggagacggaguccc

SEQ ID NO: 3321833 - RNA, 20 nt, Human
cggagacggagucccaccuu

SEQ ID NO: 3321834 - RNA, 17 nt, Human
cggagacggagucccac

SEQ ID NO: 3321835 - RNA, 16 nt, Human
cguacacauuuuauuu

SEQ ID NO: 3321836 - RNA, 22 nt, Human
cguacacauuuuauuuuauuau

SEQ ID NO: 3321837 - RNA, 20 nt, Human
cgguggcucacgccuguaau

SEQ ID NO: 3321838 - RNA, 19 nt, Human
cgggcucagcaaaagaugc

SEQ ID NO: 3321839 - RNA, 12 nt, Human
cgggcucugccu

SEQ ID NO: 3321840 - RNA, 17 nt, Human
cgggccacagagaaagu

SEQ ID NO: 3321841 - RNA, 22 nt, Human
cuaacuugucuuuggacccuga

SEQ ID NO: 3321842 - RNA, 14 nt, Human
cuaacuugucuuug

SEQ ID NO: 3321843 - RNA, 18 nt, Human
cgugaguccuggcauggg

SEQ ID NO: 3321844 - RNA, 19 nt, Human
cgugaguccuggcauggga

SEQ ID NO: 3321845 - RNA, 15 nt, Human
cguguuaugacucca

SEQ ID NO: 3321846 - RNA, 19 nt, Human
cguguuaugacuccagaau

SEQ ID NO: 3321847 - RNA, 22 nt, Human
cgugagccacugcaccgggcca

SEQ ID NO: 3321848 - RNA, 14 nt, Human
cgugaggccagaga

SEQ ID NO: 3321849 - RNA, 14 nt, Human
cgugagccacugca

SEQ ID NO: 3321850 - RNA, 15 nt, Human
cgugagccacugcac

SEQ ID NO: 3321851 - RNA, 20 nt, Human
cgugagccacugcaccgggc

SEQ ID NO: 3321852 - RNA, 14 nt, Human
cgugacaacacuug

SEQ ID NO: 3321853 - RNA, 15 nt, Human
cgugacaacacuugu

SEQ ID NO: 3321854 - RNA, 12 nt, Human
cgugacaacacu

SEQ ID NO: 3321855 - RNA, 19 nt, Human
cuacaaaaagcauaaaaau

SEQ ID NO: 3321856 - RNA, 14 nt, Human
cuaaguuuuuaugg

SEQ ID NO: 3321857 - RNA, 14 nt, Human
ccgugaggccagag

SEQ ID NO: 3321858 - RNA, 13 nt, Human
ccgugaggccaga

SEQ ID NO: 3321859 - RNA, 12 nt, Human
ccgugaggccag

SEQ ID NO: 3321860 - RNA, 17 nt, Human
ccgucuaccugaggggc

SEQ ID NO: 3321861 - RNA, 12 nt, Human
ccggcuccaggc

SEQ ID NO: 3321862 - RNA, 13 nt, Human
ccggcuccaggcu

SEQ ID NO: 3321863 - RNA, 14 nt, Human
ccggcuccaggcuc

SEQ ID NO: 3321864 - RNA, 15 nt, Human
ccgucuaccugaggg

SEQ ID NO: 3321865 - RNA, 14 nt, Human
ccgucuaccugagg

SEQ ID NO: 3321866 - RNA, 14 nt, Human
ccuaaucuucugaa

SEQ ID NO: 3321867 - RNA, 17 nt, Human
ccuagcacuuugggagg

SEQ ID NO: 3321868 - RNA, 19 nt, Human
ccuagcauacguacacauu

SEQ ID NO: 3321869 - RNA, 18 nt, Human
ccggcaggguccuagaaa

SEQ ID NO: 3321870 - RNA, 15 nt, Human
ccggccccugcuggu

SEQ ID NO: 3321871 - RNA, 16 nt, Human
ccggccaccugcggug

SEQ ID NO: 3321872 - RNA, 20 nt, Human
cccugugauggggcccugcc

SEQ ID NO: 3321873 - RNA, 23 nt, Human
cccugugauggggcccugccucc

SEQ ID NO: 3321874 - RNA, 22 nt, Human
cccugugauggggcccugccuc

SEQ ID NO: 3321875 - RNA, 21 nt, Human
cccugugauggggcccugccu

SEQ ID NO: 3321876 - RNA, 17 nt, Human
ccgcagacaggaccagg

SEQ ID NO: 3321877 - RNA, 16 nt, Human
ccgcagacaggaccag

SEQ ID NO: 3321878 - RNA, 15 nt, Human
cccuuccucuuucca

SEQ ID NO: 3321879 - RNA, 19 nt, Human
ccgaaagggacuuggaagc

SEQ ID NO: 3321880 - RNA, 17 nt, Human
ccgaaaacguggcugcu

SEQ ID NO: 3321881 - RNA, 16 nt, Human
ccgaaaacguggcugc

SEQ ID NO: 3321882 - RNA, 15 nt, Human
ccgcagacaggacca

SEQ ID NO: 3321883 - RNA, 13 nt, Human
ccgaccagacacc

SEQ ID NO: 3321884 - RNA, 17 nt, Human
ccgaccagacaccuuga

SEQ ID NO: 3321885 - RNA, 16 nt, Human
ccgaauagcugggacu

SEQ ID NO: 3321886 - RNA, 20 nt, Human
cccugcccaccuggccucug

SEQ ID NO: 3321887 - RNA, 16 nt, Human
cccugagcuuucugcu

SEQ ID NO: 3321888 - RNA, 14 nt, Human
cccugcccggcugc

SEQ ID NO: 3321889 - RNA, 17 nt, Human
cccugcccggcugcgga

SEQ ID NO: 3321890 - RNA, 22 nt, Human
cccugcccaccuggccucugca

SEQ ID NO: 3321891 - RNA, 13 nt, Human
cccuggaugcagc

SEQ ID NO: 3321892 - RNA, 21 nt, Human
cccuggaugcagccucacagu

SEQ ID NO: 3321893 - RNA, 17 nt, Human
cccuggaugcagccuca

SEQ ID NO: 3321894 - RNA, 18 nt, Human
cccugaaagcccugagcu

SEQ ID NO: 3321895 - RNA, 14 nt, Human
cccugacaacacuc

SEQ ID NO: 3321896 - RNA, 22 nt, Human
cccugaaggccccgcccaggcu

SEQ ID NO: 3321897 - RNA, 20 nt, Human
cccugaaggccccgcccagg

SEQ ID NO: 3321898 - RNA, 22 nt, Human
cccugacaacacucauugaccu

SEQ ID NO: 3321899 - RNA, 16 nt, Human
cccugacaacacucau

SEQ ID NO: 3321900 - RNA, 19 nt, Human
cccugaaggccccgcccag

SEQ ID NO: 3321901 - RNA, 16 nt, Human
cccugaaggccccgcc

SEQ ID NO: 3321902 - RNA, 14 nt, Human
cccugaaggccccg

SEQ ID NO: 3321903 - RNA, 13 nt, Human
cccugaaggcccc

SEQ ID NO: 3321904 - RNA, 16 nt, Human
cccugaaagcccugag

SEQ ID NO: 3321905 - RNA, 12 nt, Human
cccugaaggccc

SEQ ID NO: 3321906 - RNA, 16 nt, Human
ccucuuugagugaagc

SEQ ID NO: 3321907 - RNA, 12 nt, Human
ccugaggggccu

SEQ ID NO: 3321908 - RNA, 21 nt, Human
ccugaggcugggcucccuucc

SEQ ID NO: 3321909 - RNA, 19 nt, Human
ccugaggcugggcucccuu

SEQ ID NO: 3321910 - RNA, 17 nt, Human
ccugaggcugggcuccc

SEQ ID NO: 3321911 - RNA, 16 nt, Human
ccugaggcugggcucc

SEQ ID NO: 3321912 - RNA, 21 nt, Human
ccugcaggcagccaggccaca

SEQ ID NO: 3321913 - RNA, 20 nt, Human
ccugcaggcagccaggccac

SEQ ID NO: 3321914 - RNA, 19 nt, Human
ccugcaggcagccaggcca

SEQ ID NO: 3321915 - RNA, 18 nt, Human
ccugcaggcagccaggcc

SEQ ID NO: 3321916 - RNA, 17 nt, Human
ccugcaggcagccaggc

SEQ ID NO: 3321917 - RNA, 16 nt, Human
ccugcaggcagccagg

SEQ ID NO: 3321918 - RNA, 12 nt, Human
ccugcagagggc

SEQ ID NO: 3321919 - RNA, 15 nt, Human
ccugcaggcagccag

SEQ ID NO: 3321920 - RNA, 15 nt, Human
ccugccucuucucua

SEQ ID NO: 3321921 - RNA, 21 nt, Human
ccugcugcaguugccagucac

SEQ ID NO: 3321922 - RNA, 22 nt, Human
ccugcugcaguugccagucacc

SEQ ID NO: 3321923 - RNA, 11 nt, Human
ccugcugcagu

SEQ ID NO: 3321924 - RNA, 12 nt, Human
ccugcugcaguu

SEQ ID NO: 3321925 - RNA, 20 nt, Human
ccugccuccuuugugaggaa

SEQ ID NO: 3321926 - RNA, 19 nt, Human
ccugccuccuuugugagga

SEQ ID NO: 3321927 - RNA, 15 nt, Human
ccugccuccuuugug

SEQ ID NO: 3321928 - RNA, 13 nt, Human
ccugccuccuuug

SEQ ID NO: 3321929 - RNA, 22 nt, Human
ccugccuccuuugugaggaagc

SEQ ID NO: 3321930 - RNA, 21 nt, Human
ccugccuccuuugugaggaag

SEQ ID NO: 3321931 - RNA, 23 nt, Human
ccugccuccuuugugaggaagcc

SEQ ID NO: 3321932 - RNA, 20 nt, Human
ccucugccucugacacacag

SEQ ID NO: 3321933 - RNA, 21 nt, Human
ccucugccucugacacacagc

SEQ ID NO: 3321934 - RNA, 23 nt, Human
ccucugccucugacacacagcuc

SEQ ID NO: 3321935 - RNA, 11 nt, Human
ccucugccuga

SEQ ID NO: 3321936 - RNA, 20 nt, Human
ccucugccugaagucacaca

SEQ ID NO: 3321937 - RNA, 16 nt, Human
ccucgaacuggcugca

SEQ ID NO: 3321938 - RNA, 15 nt, Human
ccucgaacuggcugc

SEQ ID NO: 3321939 - RNA, 18 nt, Human
ccuccuuugugaggaagc

SEQ ID NO: 3321940 - RNA, 19 nt, Human
ccuccuuugugaggaagcc

SEQ ID NO: 3321941 - RNA, 17 nt, Human
ccucccaccucagccuc

SEQ ID NO: 3321942 - RNA, 21 nt, Human
ccucccaacucaccccagccc

SEQ ID NO: 3321943 - RNA, 20 nt, Human
ccucccaacucaccccagcc

SEQ ID NO: 3321944 - RNA, 17 nt, Human
ccucccaacucacccca

SEQ ID NO: 3321945 - RNA, 11 nt, Human
ccucaggcagg

SEQ ID NO: 3321946 - RNA, 18 nt, Human
cccaccaucaugucuggc

SEQ ID NO: 3321947 - RNA, 15 nt, Human
cccacccaagggccu

SEQ ID NO: 3321948 - RNA, 15 nt, Human
cccaagcucugcucc

SEQ ID NO: 3321949 - RNA, 17 nt, Human
cccaagcucugcuccuc

SEQ ID NO: 3321950 - RNA, 18 nt, Human
cccaccgcagacaggacc

SEQ ID NO: 3321951 - RNA, 15 nt, Human
cccaccgcagacagg

SEQ ID NO: 3321952 - RNA, 16 nt, Human
ccaugaggaacaaggc

SEQ ID NO: 3321953 - RNA, 17 nt, Human
ccaugaggaacaaggca

SEQ ID NO: 3321954 - RNA, 17 nt, Human
ccaugggccuccugugu

SEQ ID NO: 3321955 - RNA, 14 nt, Human
cccccuuccaugga

SEQ ID NO: 3321956 - RNA, 12 nt, Human
ccccgcccaggc

SEQ ID NO: 3321957 - RNA, 13 nt, Human
ccccggccaccug

SEQ ID NO: 3321958 - RNA, 18 nt, Human
ccccggccaccugcggug

SEQ ID NO: 3321959 - RNA, 14 nt, Human
ccccggccaccugc

SEQ ID NO: 3321960 - RNA, 14 nt, Human
ccccgcccaggcuu

SEQ ID NO: 3321961 - RNA, 12 nt, Human
ccccagccccaa

SEQ ID NO: 3321962 - RNA, 10 nt, Human
ccccagcccc

SEQ ID NO: 3321963 - RNA, 21 nt, Human
ccccauucugccugcccaggc

SEQ ID NO: 3321964 - RNA, 14 nt, Human
ccccagccccaaaa

SEQ ID NO: 3321965 - RNA, 14 nt, Human
ccccagccccaucc

SEQ ID NO: 3321966 - RNA, 20 nt, Human
ccccaaaacucuccucugcu

SEQ ID NO: 3321967 - RNA, 18 nt, Human
ccccaaaacucuccucug

SEQ ID NO: 3321968 - RNA, 23 nt, Human
cccauucugccugcccaggcccc

SEQ ID NO: 3321969 - RNA, 17 nt, Human
cccagcccacuucugcc

SEQ ID NO: 3321970 - RNA, 19 nt, Human
cccagcccacuucugccau

SEQ ID NO: 3321971 - RNA, 21 nt, Human
cccagccccaaaacucuccuc

SEQ ID NO: 3321972 - RNA, 23 nt, Human
cccagccccaaaacucuccucug

SEQ ID NO: 3321973 - RNA, 19 nt, Human
cccauccucuguacagagc

SEQ ID NO: 3321974 - RNA, 15 nt, Human
cccauccucuguaca

SEQ ID NO: 3321975 - RNA, 13 nt, Human
cccauccucugua

SEQ ID NO: 3321976 - RNA, 14 nt, Human
cccauccucuguac

SEQ ID NO: 3321977 - RNA, 19 nt, Human
cccaggcuggcgugcagug

SEQ ID NO: 3321978 - RNA, 20 nt, Human
cccaggcuggcgugcagugg

SEQ ID NO: 3321979 - RNA, 18 nt, Human
cccaggcuggcgugcagu

SEQ ID NO: 3321980 - RNA, 19 nt, Human
ccacugcacuauagccuag

SEQ ID NO: 3321981 - RNA, 20 nt, Human
ccacugcacuauagccuagg

SEQ ID NO: 3321982 - RNA, 13 nt, Human
ccacugcaccggg

SEQ ID NO: 3321983 - RNA, 14 nt, Human
ccacugcaccgggc

SEQ ID NO: 3321984 - RNA, 17 nt, Human
ccacugcaccgggccac

SEQ ID NO: 3321985 - RNA, 19 nt, Human
ccacugcaccgggccacag

SEQ ID NO: 3321986 - RNA, 13 nt, Human
ccacuuucuagcc

SEQ ID NO: 3321987 - RNA, 19 nt, Human
ccacuuucuagccagagga

SEQ ID NO: 3321988 - RNA, 18 nt, Human
ccacuuucuagccagagg

SEQ ID NO: 3321989 - RNA, 20 nt, Human
ccacuuucuagccagaggag

SEQ ID NO: 3321990 - RNA, 17 nt, Human
ccagacccggcugcgug

SEQ ID NO: 3321991 - RNA, 16 nt, Human
ccagacccggcugcgu

SEQ ID NO: 3321992 - RNA, 21 nt, Human
ccacuuuuguucuugguuugu

SEQ ID NO: 3321993 - RNA, 15 nt, Human
ccacuuuuguucuug

SEQ ID NO: 3321994 - RNA, 14 nt, Human
ccacuuuuguucuu

SEQ ID NO: 3321995 - RNA, 18 nt, Human
ccagagacacaagccuuc

SEQ ID NO: 3321996 - RNA, 16 nt, Human
ccagagacacaagccu

SEQ ID NO: 3321997 - RNA, 20 nt, Human
ccagagggccugcaagggag

SEQ ID NO: 3321998 - RNA, 13 nt, Human
ccagaugcaccag

SEQ ID NO: 3321999 - RNA, 14 nt, Human
ccagaugcaccagc

SEQ ID NO: 3322000 - RNA, 19 nt, Human
ccaggggugggacacccug

SEQ ID NO: 3322001 - RNA, 13 nt, Human
ccaguaucuugaa

SEQ ID NO: 3322002 - RNA, 22 nt, Human
ccaggggugggacacccuguga

SEQ ID NO: 3322003 - RNA, 21 nt, Human
ccaggggugggacacccugug

SEQ ID NO: 3322004 - RNA, 20 nt, Human
ccaggggugggacacccugu

SEQ ID NO: 3322005 - RNA, 22 nt, Human
ccaguaucuugaagacuuuucu

SEQ ID NO: 3322006 - RNA, 19 nt, Human
ccaguaucuugaagacuuu

SEQ ID NO: 3322007 - RNA, 16 nt, Human
ccagucaccccggcca

SEQ ID NO: 3322008 - RNA, 13 nt, Human
ccagucaccccgg

SEQ ID NO: 3322009 - RNA, 18 nt, Human
ccagucaccccggccacc

SEQ ID NO: 3322010 - RNA, 17 nt, Human
ccagucaccccggccac

SEQ ID NO: 3322011 - RNA, 17 nt, Human
ccaggaaaggcuccagg

SEQ ID NO: 3322012 - RNA, 19 nt, Human
ccaggaaaggcuccaggag

SEQ ID NO: 3322013 - RNA, 18 nt, Human
ccaggaaaggcuccagga

SEQ ID NO: 3322014 - RNA, 12 nt, Human
ccagccccugga

SEQ ID NO: 3322015 - RNA, 21 nt, Human
ccagcgagcccugguggcagu

SEQ ID NO: 3322016 - RNA, 17 nt, Human
ccagccccuucugaccc

SEQ ID NO: 3322017 - RNA, 16 nt, Human
ccagccccuucugacc

SEQ ID NO: 3322018 - RNA, 15 nt, Human
ccagccccuucugac

SEQ ID NO: 3322019 - RNA, 18 nt, Human
ccagccccauccucugua

SEQ ID NO: 3322020 - RNA, 23 nt, Human
ccagccccauccucuguacagag

SEQ ID NO: 3322021 - RNA, 13 nt, Human
ccagcagccugga

SEQ ID NO: 3322022 - RNA, 15 nt, Human
ccagccccuggaugc

SEQ ID NO: 3322023 - RNA, 14 nt, Human
ccagccccuggaug

SEQ ID NO: 3322024 - RNA, 13 nt, Human
ccagccccuggau

SEQ ID NO: 3322025 - RNA, 12 nt, Human
ccagcagccugg

SEQ ID NO: 3322026 - RNA, 11 nt, Human
ccagcagccug

SEQ ID NO: 3322027 - RNA, 12 nt, Human
ccagcagaaaug

SEQ ID NO: 3322028 - RNA, 22 nt, Human
ccagcagaaaugccuuacccuc

SEQ ID NO: 3322029 - RNA, 17 nt, Human
ccagcagaaaugccuua

SEQ ID NO: 3322030 - RNA, 16 nt, Human
ccagcagaaaugccuu

SEQ ID NO: 3322031 - RNA, 17 nt, Human
caggaaaggcuccagga

SEQ ID NO: 3322032 - RNA, 16 nt, Human
caggaaaggcuccagg

SEQ ID NO: 3322033 - RNA, 19 nt, Human
caggaaaggcuccaggagc

SEQ ID NO: 3322034 - RNA, 21 nt, Human
cagcugacuuuucuguccgag

SEQ ID NO: 3322035 - RNA, 15 nt, Human
cagccugcuccagcu

SEQ ID NO: 3322036 - RNA, 19 nt, Human
cagccugcuccagcuguuc

SEQ ID NO: 3322037 - RNA, 17 nt, Human
cagccugcuccagcugu

SEQ ID NO: 3322038 - RNA, 16 nt, Human
cagccugcuccagcug

SEQ ID NO: 3322039 - RNA, 19 nt, Human
cagcguuucuaugacacau

SEQ ID NO: 3322040 - RNA, 15 nt, Human
cagcuaacauggaag

SEQ ID NO: 3322041 - RNA, 23 nt, Human
caggccagcugcuugggcuucau

SEQ ID NO: 3322042 - RNA, 12 nt, Human
caggccaggccc

SEQ ID NO: 3322043 - RNA, 11 nt, Human
caggccaggcc

SEQ ID NO: 3322044 - RNA, 19 nt, Human
caggaggaucacuugaguc

SEQ ID NO: 3322045 - RNA, 22 nt, Human
caggaggccagccuugaccauu

SEQ ID NO: 3322046 - RNA, 19 nt, Human
caggaggccagccuugacc

SEQ ID NO: 3322047 - RNA, 18 nt, Human
caggaggccagccuugac

SEQ ID NO: 3322048 - RNA, 14 nt, Human
caggcaaugcuggc

SEQ ID NO: 3322049 - RNA, 15 nt, Human
caggcaaugcuggcu

SEQ ID NO: 3322050 - RNA, 16 nt, Human
caggcaaugcuggcug

SEQ ID NO: 3322051 - RNA, 13 nt, Human
caggaccucaggu

SEQ ID NO: 3322052 - RNA, 23 nt, Human
caggaccucaggugagaagcaga

SEQ ID NO: 3322053 - RNA, 16 nt, Human
caggaccucaggugag

SEQ ID NO: 3322054 - RNA, 21 nt, Human
caggaccagggauuuccauga

SEQ ID NO: 3322055 - RNA, 14 nt, Human
caggccuccuacag

SEQ ID NO: 3322056 - RNA, 12 nt, Human
caggccuccuac

SEQ ID NO: 3322057 - RNA, 20 nt, Human
caggcugggagagccuucca

SEQ ID NO: 3322058 - RNA, 21 nt, Human
caggcugggagagccuuccag

SEQ ID NO: 3322059 - RNA, 16 nt, Human
caggggaaaagaggag

SEQ ID NO: 3322060 - RNA, 14 nt, Human
caggggaaaagagg

SEQ ID NO: 3322061 - RNA, 23 nt, Human
caggcugggagagccuuccaggg

SEQ ID NO: 3322062 - RNA, 22 nt, Human
caggcugggagagccuuccagg

SEQ ID NO: 3322063 - RNA, 20 nt, Human
cagcacgauuucuguuuaga

SEQ ID NO: 3322064 - RNA, 15 nt, Human
cagcacgauuucugu

SEQ ID NO: 3322065 - RNA, 14 nt, Human
cagcacgauuucug

SEQ ID NO: 3322066 - RNA, 22 nt, Human
cagccaggccacaagacccuug

SEQ ID NO: 3322067 - RNA, 18 nt, Human
cagauugcaacaggcugg

SEQ ID NO: 3322068 - RNA, 19 nt, Human
cagauuucacucuccuugg

SEQ ID NO: 3322069 - RNA, 17 nt, Human
cagcaccaucucuccuc

SEQ ID NO: 3322070 - RNA, 19 nt, Human
cagcaccaucucuccuccu

SEQ ID NO: 3322071 - RNA, 17 nt, Human
cagauugcaacaggcug

SEQ ID NO: 3322072 - RNA, 19 nt, Human
cagauugcaacaggcuggg

SEQ ID NO: 3322073 - RNA, 20 nt, Human
cagauugcaacaggcugggc

SEQ ID NO: 3322074 - RNA, 20 nt, Human
cagauuucacucuccuuggu

SEQ ID NO: 3322075 - RNA, 16 nt, Human
cagaggggguggccuc

SEQ ID NO: 3322076 - RNA, 14 nt, Human
cagaggggguggcc

SEQ ID NO: 3322077 - RNA, 19 nt, Human
cagauacuuggggggcuga

SEQ ID NO: 3322078 - RNA, 19 nt, Human
cagauagauauaugcucug

SEQ ID NO: 3322079 - RNA, 23 nt, Human
cagagacuccugcaggcagccag

SEQ ID NO: 3322080 - RNA, 20 nt, Human
cagagaggguggugaccucu

SEQ ID NO: 3322081 - RNA, 22 nt, Human
cagagaggguggugaccucugc

SEQ ID NO: 3322082 - RNA, 17 nt, Human
cagagaggguggugacc

SEQ ID NO: 3322083 - RNA, 12 nt, Human
cagagagggugg

SEQ ID NO: 3322084 - RNA, 13 nt, Human
cagaggggguggc

SEQ ID NO: 3322085 - RNA, 19 nt, Human
cagaggaaagcaaaggaga

SEQ ID NO: 3322086 - RNA, 17 nt, Human
cagaggaaagcaaagga

SEQ ID NO: 3322087 - RNA, 23 nt, Human
cagagagggugggagugggccca

SEQ ID NO: 3322088 - RNA, 23 nt, Human
cagagaggguggugaccucugcc

SEQ ID NO: 3322089 - RNA, 20 nt, Human
cagagagguuaaggugggua

SEQ ID NO: 3322090 - RNA, 13 nt, Human
cagagcugccacc

SEQ ID NO: 3322091 - RNA, 20 nt, Human
cagacuggaagcacagcuuc

SEQ ID NO: 3322092 - RNA, 21 nt, Human
cagacuggaagcacagcuuca

SEQ ID NO: 3322093 - RNA, 13 nt, Human
cagacuggaagca

SEQ ID NO: 3322094 - RNA, 14 nt, Human
cagacuggaagcac

SEQ ID NO: 3322095 - RNA, 16 nt, Human
cagacuggaagcacag

SEQ ID NO: 3322096 - RNA, 17 nt, Human
cagacuggaagcacagc

SEQ ID NO: 3322097 - RNA, 18 nt, Human
cagacuggaagcacagcu

SEQ ID NO: 3322098 - RNA, 23 nt, Human
cagacucuacagaggccaugggc

SEQ ID NO: 3322099 - RNA, 18 nt, Human
cagacucuacagaggcca

SEQ ID NO: 3322100 - RNA, 19 nt, Human
cagacucuacagaggccau

SEQ ID NO: 3322101 - RNA, 20 nt, Human
cagacucuacagaggccaug

SEQ ID NO: 3322102 - RNA, 21 nt, Human
cagacucuacagaggccaugg

SEQ ID NO: 3322103 - RNA, 17 nt, Human
cagacucuacagaggcc

SEQ ID NO: 3322104 - RNA, 22 nt, Human
cagacaggcaagcaccuccugc

SEQ ID NO: 3322105 - RNA, 23 nt, Human
cagacaggcaagcaccuccugcc

SEQ ID NO: 3322106 - RNA, 11 nt, Human
cagacaggcaa

SEQ ID NO: 3322107 - RNA, 24 nt, Human
cagacaggaccagggauuuccaug

SEQ ID NO: 3322108 - RNA, 17 nt, Human
cagacaggaccagggau

SEQ ID NO: 3322109 - RNA, 13 nt, Human
cagacaggcaagc

SEQ ID NO: 3322110 - RNA, 18 nt, Human
cagacaggcaagcaccuc

SEQ ID NO: 3322111 - RNA, 20 nt, Human
cagacaggcaagcaccuccu

SEQ ID NO: 3322112 - RNA, 21 nt, Human
cagacaggcaagcaccuccug

SEQ ID NO: 3322113 - RNA, 18 nt, Human
cagacagcugccugggau

SEQ ID NO: 3322114 - RNA, 17 nt, Human
cagacagcugccuggga

SEQ ID NO: 3322115 - RNA, 16 nt, Human
cagacagcugccuggg

SEQ ID NO: 3322116 - RNA, 15 nt, Human
cagacagcugccugg

SEQ ID NO: 3322117 - RNA, 16 nt, Human
cagacaggaccaggga

SEQ ID NO: 3322118 - RNA, 15 nt, Human
cagacaggaccaggg

SEQ ID NO: 3322119 - RNA, 13 nt, Human
cagacaggaccag

SEQ ID NO: 3322120 - RNA, 14 nt, Human
cagacagcugccug

SEQ ID NO: 3322121 - RNA, 13 nt, Human
cagacagcugccu

SEQ ID NO: 3322122 - RNA, 22 nt, Human
cauuuuuuuuaagaaaaaggau

SEQ ID NO: 3322123 - RNA, 23 nt, Human
cauuuuuuuuaagaaaaaggaug

SEQ ID NO: 3322124 - RNA, 18 nt, Human
cauuuaggugaggaagca

SEQ ID NO: 3322125 - RNA, 16 nt, Human
cauuuaggugaggaag

SEQ ID NO: 3322126 - RNA, 23 nt, Human
ccaauggacuaacuugucuuugg

SEQ ID NO: 3322127 - RNA, 21 nt, Human
ccaacucaccccagccccaaa

SEQ ID NO: 3322128 - RNA, 13 nt, Human
ccaagcucugcuc

SEQ ID NO: 3322129 - RNA, 16 nt, Human
ccaagcucugcuccuc

SEQ ID NO: 3322130 - RNA, 14 nt, Human
ccaagcucugcucc

SEQ ID NO: 3322131 - RNA, 15 nt, Human
ccaagcucugcuccu

SEQ ID NO: 3322132 - RNA, 15 nt, Human
ccaaaucagcugcua

SEQ ID NO: 3322133 - RNA, 23 nt, Human
ccaaaucagcugcuacuacuccu

SEQ ID NO: 3322134 - RNA, 13 nt, Human
ccaacucacccca

SEQ ID NO: 3322135 - RNA, 20 nt, Human
ccaaaguacacuguuucaaa

SEQ ID NO: 3322136 - RNA, 22 nt, Human
ccaaaguacacuguuucaaacu

SEQ ID NO: 3322137 - RNA, 18 nt, Human
cauguuggccaggcuggu

SEQ ID NO: 3322138 - RNA, 17 nt, Human
cauguuggccaggcugg

SEQ ID NO: 3322139 - RNA, 18 nt, Human
cauguucuuaauucuuag

SEQ ID NO: 3322140 - RNA, 21 nt, Human
cauguuacauaagauaaaugu

SEQ ID NO: 3322141 - RNA, 16 nt, Human
cauguucuuaauucuu

SEQ ID NO: 3322142 - RNA, 13 nt, Human
cauguucuuaauu

SEQ ID NO: 3322143 - RNA, 15 nt, Human
cauguccaagaagcc

SEQ ID NO: 3322144 - RNA, 16 nt, Human
cauguuacauaagaua

SEQ ID NO: 3322145 - RNA, 17 nt, Human
cauguuacauaagauaa

SEQ ID NO: 3322146 - RNA, 20 nt, Human
cauucuccuuguguuacuaa

SEQ ID NO: 3322147 - RNA, 19 nt, Human
cauucuccaccugccaggg

SEQ ID NO: 3322148 - RNA, 18 nt, Human
cauucuccaccugccagg

SEQ ID NO: 3322149 - RNA, 17 nt, Human
cauucuccaccugccag

SEQ ID NO: 3322150 - RNA, 17 nt, Human
caugcuccuggcccacu

SEQ ID NO: 3322151 - RNA, 16 nt, Human
caugcuccuggcccac

SEQ ID NO: 3322152 - RNA, 14 nt, Human
caugcuccuggccc

SEQ ID NO: 3322153 - RNA, 18 nt, Human
caugggaaaggggaaguu

SEQ ID NO: 3322154 - RNA, 21 nt, Human
cauggccucuucagaucucua

SEQ ID NO: 3322155 - RNA, 12 nt, Human
caugcaagguca

SEQ ID NO: 3322156 - RNA, 13 nt, Human
caugacaaagacu

SEQ ID NO: 3322157 - RNA, 23 nt, Human
cagucugauucccaagcucugcu

SEQ ID NO: 3322158 - RNA, 21 nt, Human
cagugcccacaggaucagucu

SEQ ID NO: 3322159 - RNA, 18 nt, Human
cagugcccacaggaucag

SEQ ID NO: 3322160 - RNA, 22 nt, Human
cagugcccacaggaucagucug

SEQ ID NO: 3322161 - RNA, 16 nt, Human
cagugggagcugccug

SEQ ID NO: 3322162 - RNA, 15 nt, Human
cagugggagcugccu

SEQ ID NO: 3322163 - RNA, 17 nt, Human
cagugggagcugccugu

SEQ ID NO: 3322164 - RNA, 18 nt, Human
cagugggagcugccuguu

SEQ ID NO: 3322165 - RNA, 20 nt, Human
cagugguaugaucacggcuc

SEQ ID NO: 3322166 - RNA, 20 nt, Human
caguuacucagaauucucua

SEQ ID NO: 3322167 - RNA, 21 nt, Human
cagugguaugaucacggcuca

SEQ ID NO: 3322168 - RNA, 19 nt, Human
caguggugcgaucuggguu

SEQ ID NO: 3322169 - RNA, 14 nt, Human
caguuacucagaau

SEQ ID NO: 3322170 - RNA, 21 nt, Human
cagucugauucccaagcucug

SEQ ID NO: 3322171 - RNA, 22 nt, Human
cagucugauucccaagcucugc

SEQ ID NO: 3322172 - RNA, 23 nt, Human
cauagcagagaaugaaagggccc

SEQ ID NO: 3322173 - RNA, 22 nt, Human
cauauuaccacagacauacuaa

SEQ ID NO: 3322174 - RNA, 23 nt, Human
cauaaugcgugcauaccacuuuu

SEQ ID NO: 3322175 - RNA, 16 nt, Human
cauacaguuugcacuu

SEQ ID NO: 3322176 - RNA, 23 nt, Human
cauacaggaagguagaaauaucu

SEQ ID NO: 3322177 - RNA, 22 nt, Human
caguuguuagugugucuuagug

SEQ ID NO: 3322178 - RNA, 18 nt, Human
caguuguuagugugucuu

SEQ ID NO: 3322179 - RNA, 21 nt, Human
caguuuguuaguaugaggcau

SEQ ID NO: 3322180 - RNA, 23 nt, Human
caguuuguuaguaugaggcauuu

SEQ ID NO: 3322181 - RNA, 21 nt, Human
caucagcacgauuucuguuua

SEQ ID NO: 3322182 - RNA, 19 nt, Human
caucagcacgauuucuguu

SEQ ID NO: 3322183 - RNA, 19 nt, Human
caucccaaacccuucagug

SEQ ID NO: 3322184 - RNA, 22 nt, Human
cauccucuguacagagcccacg

SEQ ID NO: 3322185 - RNA, 21 nt, Human
cauccucuguacagagcccac

SEQ ID NO: 3322186 - RNA, 20 nt, Human
caucccaaacccuucagugc

SEQ ID NO: 3322187 - RNA, 11 nt, Human
caucccagccc

SEQ ID NO: 3322188 - RNA, 14 nt, Human
auucauauuuacuu

SEQ ID NO: 3322189 - RNA, 19 nt, Human
auucucuaguuugauuaaa

SEQ ID NO: 3322190 - RNA, 20 nt, Human
auucucuaguuugauuaaau

SEQ ID NO: 3322191 - RNA, 23 nt, Human
auucucuaguuugauuaaauucu

SEQ ID NO: 3322192 - RNA, 12 nt, Human
auucucuuaucc

SEQ ID NO: 3322193 - RNA, 14 nt, Human
auucucuuauccaa

SEQ ID NO: 3322194 - RNA, 15 nt, Human
auucucuuauccaac

SEQ ID NO: 3322195 - RNA, 22 nt, Human
auuacaagcgugagccacugca

SEQ ID NO: 3322196 - RNA, 19 nt, Human
caaaagcaucuaugugaga

SEQ ID NO: 3322197 - RNA, 13 nt, Human
caaaagcauguga

SEQ ID NO: 3322198 - RNA, 20 nt, Human
caaaagguuaauaaaguaau

SEQ ID NO: 3322199 - RNA, 21 nt, Human
auuuuguuuuugucuuaaaaa

SEQ ID NO: 3322200 - RNA, 22 nt, Human
auuuuguuuuugucuuaaaaag

SEQ ID NO: 3322201 - RNA, 16 nt, Human
auuuuuauuaaauuau

SEQ ID NO: 3322202 - RNA, 16 nt, Human
caaaccaucauugaaa

SEQ ID NO: 3322203 - RNA, 14 nt, Human
caaaccaucauuga

SEQ ID NO: 3322204 - RNA, 17 nt, Human
caaaccaucauugaaau

SEQ ID NO: 3322205 - RNA, 14 nt, Human
auuuguuauaauga

SEQ ID NO: 3322206 - RNA, 12 nt, Human
auuucacucucc

SEQ ID NO: 3322207 - RNA, 19 nt, Human
auuucuguuuagauaauac

SEQ ID NO: 3322208 - RNA, 20 nt, Human
auuucuguuuagauaauaca

SEQ ID NO: 3322209 - RNA, 21 nt, Human
auuucuguuuagauaauacac

SEQ ID NO: 3322210 - RNA, 15 nt, Human
cacuacauucuguua

SEQ ID NO: 3322211 - RNA, 22 nt, Human
cacggaagagccuugcggaagg

SEQ ID NO: 3322212 - RNA, 16 nt, Human
cacggaagagccuugc

SEQ ID NO: 3322213 - RNA, 21 nt, Human
cacuacauuauaaaugucucu

SEQ ID NO: 3322214 - RNA, 14 nt, Human
cacuacauucuguu

SEQ ID NO: 3322215 - RNA, 13 nt, Human
cacuacauucugu

SEQ ID NO: 3322216 - RNA, 21 nt, Human
cacgcuggagugcagugagcc

SEQ ID NO: 3322217 - RNA, 16 nt, Human
cacgcuggagugcagu

SEQ ID NO: 3322218 - RNA, 17 nt, Human
cacgcuggagugcagug

SEQ ID NO: 3322219 - RNA, 18 nt, Human
cacgcuggagugcaguga

SEQ ID NO: 3322220 - RNA, 20 nt, Human
cacgcuggagugcagugagc

SEQ ID NO: 3322221 - RNA, 15 nt, Human
cacgcuggagugcag

SEQ ID NO: 3322222 - RNA, 17 nt, Human
cacccuggggagaaagu

SEQ ID NO: 3322223 - RNA, 12 nt, Human
caccugccaggg

SEQ ID NO: 3322224 - RNA, 11 nt, Human
caccugccagg

SEQ ID NO: 3322225 - RNA, 21 nt, Human
caccugccccucaacucuccu

SEQ ID NO: 3322226 - RNA, 18 nt, Human
caccugccccucaacucu

SEQ ID NO: 3322227 - RNA, 16 nt, Human
caccugccccucaacu

SEQ ID NO: 3322228 - RNA, 12 nt, Human
cacccugcucuc

SEQ ID NO: 3322229 - RNA, 12 nt, Human
cacccuccuuuc

SEQ ID NO: 3322230 - RNA, 24 nt, Human
caccugccuguugggccaggagcc

SEQ ID NO: 3322231 - RNA, 16 nt, Human
caccugcggugcuauc

SEQ ID NO: 3322232 - RNA, 19 nt, Human
caccugcggugcuaucucc

SEQ ID NO: 3322233 - RNA, 17 nt, Human
caccugcggugcuaucu

SEQ ID NO: 3322234 - RNA, 13 nt, Human
cacaucuugcucu

SEQ ID NO: 3322235 - RNA, 14 nt, Human
cacaucuugcucug

SEQ ID NO: 3322236 - RNA, 15 nt, Human
cacaucuugcucugc

SEQ ID NO: 3322237 - RNA, 20 nt, Human
cacaucuugcucugcugaca

SEQ ID NO: 3322238 - RNA, 21 nt, Human
cacaucuugcucugcugacag

SEQ ID NO: 3322239 - RNA, 22 nt, Human
cacaucuugcucugcugacaga

SEQ ID NO: 3322240 - RNA, 12 nt, Human
cacccagcccac

SEQ ID NO: 3322241 - RNA, 23 nt, Human
cacaucuugcucugcugacagac

SEQ ID NO: 3322242 - RNA, 19 nt, Human
cacaucuugcucugcugac

SEQ ID NO: 3322243 - RNA, 17 nt, Human
cacauuuauucugcuca

SEQ ID NO: 3322244 - RNA, 18 nt, Human
cacauuuauucugcucac

SEQ ID NO: 3322245 - RNA, 17 nt, Human
caccagccccagugccc

SEQ ID NO: 3322246 - RNA, 18 nt, Human
caccagccccagugccca

SEQ ID NO: 3322247 - RNA, 21 nt, Human
caccagccccagugcccacag

SEQ ID NO: 3322248 - RNA, 22 nt, Human
caccagccccagugcccacagg

SEQ ID NO: 3322249 - RNA, 16 nt, Human
caccagccccagugcc

SEQ ID NO: 3322250 - RNA, 19 nt, Human
caccagcccuuagcaggga

SEQ ID NO: 3322251 - RNA, 15 nt, Human
caagaagcccaggaa

SEQ ID NO: 3322252 - RNA, 14 nt, Human
caagaagcccagga

SEQ ID NO: 3322253 - RNA, 17 nt, Human
caagaaggaugauucaa

SEQ ID NO: 3322254 - RNA, 18 nt, Human
caagaagcccaggaaagg

SEQ ID NO: 3322255 - RNA, 14 nt, Human
caaccccuucgcuc

SEQ ID NO: 3322256 - RNA, 16 nt, Human
caaccccuucgcuccu

SEQ ID NO: 3322257 - RNA, 14 nt, Human
caagaccacguuuc

SEQ ID NO: 3322258 - RNA, 13 nt, Human
caagcaccuccug

SEQ ID NO: 3322259 - RNA, 14 nt, Human
caaucaaaucugcu

SEQ ID NO: 3322260 - RNA, 13 nt, Human
caauggcagccuu

SEQ ID NO: 3322261 - RNA, 14 nt, Human
caauggcagccuug

SEQ ID NO: 3322262 - RNA, 15 nt, Human
caauggcagccuugg

SEQ ID NO: 3322263 - RNA, 13 nt, Human
caauuuauuaugg

SEQ ID NO: 3322264 - RNA, 20 nt, Human
caauuuauuauggcacauca

SEQ ID NO: 3322265 - RNA, 15 nt, Human
caagcucugcuccuc

SEQ ID NO: 3322266 - RNA, 16 nt, Human
caagcucugcuccucu

SEQ ID NO: 3322267 - RNA, 17 nt, Human
caagcucccaggcauuc

SEQ ID NO: 3322268 - RNA, 15 nt, Human
caagcucccaggcau

SEQ ID NO: 3322269 - RNA, 14 nt, Human
caagcucccaggca

SEQ ID NO: 3322270 - RNA, 12 nt, Human
caagcucccagg

SEQ ID NO: 3322271 - RNA, 21 nt, Human
caagcuccaagcucccaggca

SEQ ID NO: 3322272 - RNA, 19 nt, Human
caagcuccaagcucccagg

SEQ ID NO: 3322273 - RNA, 18 nt, Human
caagcuccaagcucccag

SEQ ID NO: 3322274 - RNA, 17 nt, Human
caagcuccaagcuccca

SEQ ID NO: 3322275 - RNA, 14 nt, Human
caaggcaaggcugu

SEQ ID NO: 3322276 - RNA, 19 nt, Human
caaggauugcuacuguccu

SEQ ID NO: 3322277 - RNA, 20 nt, Human
caaggauugcuacuguccua

SEQ ID NO: 3322278 - RNA, 22 nt, Human
caaguauuauaccuuuuuuaga

SEQ ID NO: 3322279 - RNA, 17 nt, Human
caaguauuauaccuuuu

SEQ ID NO: 3322280 - RNA, 13 nt, Human
caaguauuauacc

SEQ ID NO: 3322281 - RNA, 20 nt, Human
aauaucugaaaauguaugug

SEQ ID NO: 3322282 - RNA, 16 nt, Human
aauaucugaaaaugua

SEQ ID NO: 3322283 - RNA, 17 nt, Human
aauaucugaaaauguau

SEQ ID NO: 3322284 - RNA, 18 nt, Human
aauaucugaaaauguaug

SEQ ID NO: 3322285 - RNA, 19 nt, Human
aauaucugaaaauguaugu

SEQ ID NO: 3322286 - RNA, 18 nt, Human
uaacuuuuauaaacuuua

SEQ ID NO: 3322287 - RNA, 17 nt, Human
uaacuuuuauaaacuuu

SEQ ID NO: 3322288 - RNA, 15 nt, Human
uaacuuuuauaaacu

SEQ ID NO: 3322289 - RNA, 17 nt, Human
aauauugauaugcuuau

SEQ ID NO: 3322290 - RNA, 18 nt, Human
aauauugauaugcuuaua

SEQ ID NO: 3322291 - RNA, 22 nt, Human
aauauugcugauggugcaauga

SEQ ID NO: 3322292 - RNA, 21 nt, Human
aauauugcugauggugcaaug

SEQ ID NO: 3322293 - RNA, 18 nt, Human
aauauugcugauggugca

SEQ ID NO: 3322294 - RNA, 15 nt, Human
aauauugcugauggu

SEQ ID NO: 3322295 - RNA, 13 nt, Human
aauauugcugaug

SEQ ID NO: 3322296 - RNA, 12 nt, Human
aauauugcugau

SEQ ID NO: 3322297 - RNA, 11 nt, Human
aauauugcuga

SEQ ID NO: 3322298 - RNA, 15 nt, Human
uaacauggaaguacu

SEQ ID NO: 3322299 - RNA, 14 nt, Human
uaacuaaaagguau

SEQ ID NO: 3322300 - RNA, 15 nt, Human
uaacuaaaagguaug

SEQ ID NO: 3322301 - RNA, 14 nt, Human
uaacauggaaguac

SEQ ID NO: 3322302 - RNA, 18 nt, Human
aauagacaauuuauuaug

SEQ ID NO: 3322303 - RNA, 23 nt, Human
aauagacaauuuauuauggcaca

SEQ ID NO: 3322304 - RNA, 13 nt, Human
aauagcugggacu

SEQ ID NO: 3322305 - RNA, 14 nt, Human
aauagcugggacua

SEQ ID NO: 3322306 - RNA, 19 nt, Human
aauaggaaaaacugauuuu

SEQ ID NO: 3322307 - RNA, 18 nt, Human
aauaggaaaaacugauuu

SEQ ID NO: 3322308 - RNA, 17 nt, Human
aauaggaaaaacugauu

SEQ ID NO: 3322309 - RNA, 16 nt, Human
aauaggaaaaacugau

SEQ ID NO: 3322310 - RNA, 15 nt, Human
aauaggaaaaacuga

SEQ ID NO: 3322311 - RNA, 17 nt, Human
uaaauuaacuuuuauaa

SEQ ID NO: 3322312 - RNA, 16 nt, Human
uaaauuaacuuuuaua

SEQ ID NO: 3322313 - RNA, 15 nt, Human
uaaauuaacuuuuau

SEQ ID NO: 3322314 - RNA, 14 nt, Human
uaaauuaacuuuua

SEQ ID NO: 3322315 - RNA, 12 nt, Human
uaaauuaacuuu

SEQ ID NO: 3322316 - RNA, 23 nt, Human
uaaaugcaccuggaauauauaac

SEQ ID NO: 3322317 - RNA, 15 nt, Human
uaaauguugaaagau

SEQ ID NO: 3322318 - RNA, 20 nt, Human
uaaauguugaaagaucaaaa

SEQ ID NO: 3322319 - RNA, 22 nt, Human
uaaaucuccaaaauaaaacuuu

SEQ ID NO: 3322320 - RNA, 15 nt, Human
uaaaucuccaaaaua

SEQ ID NO: 3322321 - RNA, 14 nt, Human
uaaaucuccaaaau

SEQ ID NO: 3322322 - RNA, 19 nt, Human
uaaauaaugugaaacugga

SEQ ID NO: 3322323 - RNA, 22 nt, Human
aauaacauguaauuaaguacua

SEQ ID NO: 3322324 - RNA, 18 nt, Human
aauaaaacuuuuuaaaau

SEQ ID NO: 3322325 - RNA, 15 nt, Human
aauaaaacuuuuuaa

SEQ ID NO: 3322326 - RNA, 14 nt, Human
aauaaaacuuuuua

SEQ ID NO: 3322327 - RNA, 12 nt, Human
aauaaaacuuuu

SEQ ID NO: 3322328 - RNA, 16 nt, Human
aauaaaucauaaaacu

SEQ ID NO: 3322329 - RNA, 20 nt, Human
aaguuuuuauggcuuuugug

SEQ ID NO: 3322330 - RNA, 12 nt, Human
aauguaugugua

SEQ ID NO: 3322331 - RNA, 14 nt, Human
aauguauguguaag

SEQ ID NO: 3322332 - RNA, 14 nt, Human
aauguacugcauau

SEQ ID NO: 3322333 - RNA, 18 nt, Human
aauguacugcauaugaaa

SEQ ID NO: 3322334 - RNA, 12 nt, Human
aauguacugcau

SEQ ID NO: 3322335 - RNA, 15 nt, Human
uacauaaugcgugca

SEQ ID NO: 3322336 - RNA, 20 nt, Human
uacauaaugcgugcauacca

SEQ ID NO: 3322337 - RNA, 19 nt, Human
uacauaaugcgugcauacc

SEQ ID NO: 3322338 - RNA, 17 nt, Human
uacauaaugcgugcaua

SEQ ID NO: 3322339 - RNA, 23 nt, Human
uacagagcccacgcccccacugg

SEQ ID NO: 3322340 - RNA, 23 nt, Human
uacacauuuuauuuuauuaugca

SEQ ID NO: 3322341 - RNA, 18 nt, Human
uacaccacuacauucugu

SEQ ID NO: 3322342 - RNA, 17 nt, Human
uacaccacuacauucug

SEQ ID NO: 3322343 - RNA, 16 nt, Human
uacaccacuacauucu

SEQ ID NO: 3322344 - RNA, 15 nt, Human
uacaccacuacauuc

SEQ ID NO: 3322345 - RNA, 20 nt, Human
uacaccacuacauucuguua

SEQ ID NO: 3322346 - RNA, 19 nt, Human
uacaccacuacauucuguu

SEQ ID NO: 3322347 - RNA, 15 nt, Human
uacaaaaagcauaaa

SEQ ID NO: 3322348 - RNA, 20 nt, Human
uacaaaaagcauaaaaauua

SEQ ID NO: 3322349 - RNA, 15 nt, Human
uacaaaagcauguga

SEQ ID NO: 3322350 - RNA, 14 nt, Human
aaugagccuggcaa

SEQ ID NO: 3322351 - RNA, 21 nt, Human
uacaagcgugagccacugcac

SEQ ID NO: 3322352 - RNA, 13 nt, Human
aaugcccagcccc

SEQ ID NO: 3322353 - RNA, 15 nt, Human
aaugcccagccccuu

SEQ ID NO: 3322354 - RNA, 14 nt, Human
aaugcccagccccu

SEQ ID NO: 3322355 - RNA, 18 nt, Human
aauggaagacagcucuua

SEQ ID NO: 3322356 - RNA, 16 nt, Human
aauggacguguuauga

SEQ ID NO: 3322357 - RNA, 24 nt, Human
aaugcccagccccuucugacccau

SEQ ID NO: 3322358 - RNA, 23 nt, Human
aaugcccagccccuucugaccca

SEQ ID NO: 3322359 - RNA, 22 nt, Human
aaugcccagccccuucugaccc

SEQ ID NO: 3322360 - RNA, 20 nt, Human
aaugcccagccccuucugac

SEQ ID NO: 3322361 - RNA, 21 nt, Human
aaugcugugcccuaaagugua

SEQ ID NO: 3322362 - RNA, 20 nt, Human
aaugcugugcccuaaagugu

SEQ ID NO: 3322363 - RNA, 13 nt, Human
aaugcugugcccu

SEQ ID NO: 3322364 - RNA, 20 nt, Human
aaucuucugaacuuggcgcu

SEQ ID NO: 3322365 - RNA, 13 nt, Human
aaucuucugaacu

SEQ ID NO: 3322366 - RNA, 21 nt, Human
uaaugacuuaagcacacuuga

SEQ ID NO: 3322367 - RNA, 15 nt, Human
uaaugacuuaagcac

SEQ ID NO: 3322368 - RNA, 22 nt, Human
uaaugaaagacuguacaaagua

SEQ ID NO: 3322369 - RNA, 23 nt, Human
uaaugaaagacuguacaaaguag

SEQ ID NO: 3322370 - RNA, 14 nt, Human
uaaugaaagacugu

SEQ ID NO: 3322371 - RNA, 17 nt, Human
uaaugaaagacuguaca

SEQ ID NO: 3322372 - RNA, 18 nt, Human
uaaugaaagacuguacaa

SEQ ID NO: 3322373 - RNA, 19 nt, Human
uaaugaaagacuguacaaa

SEQ ID NO: 3322374 - RNA, 13 nt, Human
uaaugaggaaacu

SEQ ID NO: 3322375 - RNA, 18 nt, Human
aaugacuuacuguacaug

SEQ ID NO: 3322376 - RNA, 17 nt, Human
aaugacuuacuguacau

SEQ ID NO: 3322377 - RNA, 14 nt, Human
aaugacuuacugua

SEQ ID NO: 3322378 - RNA, 15 nt, Human
aaugagccuggcaag

SEQ ID NO: 3322379 - RNA, 13 nt, Human
aaucucaaauaac

SEQ ID NO: 3322380 - RNA, 14 nt, Human
aaucucaaauuucu

SEQ ID NO: 3322381 - RNA, 15 nt, Human
aaucucaaauaacua

SEQ ID NO: 3322382 - RNA, 12 nt, Human
aaucucaaauuu

SEQ ID NO: 3322383 - RNA, 12 nt, Human
aaucuaaaugga

SEQ ID NO: 3322384 - RNA, 18 nt, Human
aaucuaaauggaaccacu

SEQ ID NO: 3322385 - RNA, 15 nt, Human
aaucuaaauggaacc

SEQ ID NO: 3322386 - RNA, 13 nt, Human
aaucuaaauggaa

SEQ ID NO: 3322387 - RNA, 20 nt, Human
uaaguuuuuauggcuuuugu

SEQ ID NO: 3322388 - RNA, 19 nt, Human
uaaguacuauguaucaaug

SEQ ID NO: 3322389 - RNA, 17 nt, Human
acaacaucuuuuucuac

SEQ ID NO: 3322390 - RNA, 22 nt, Human
acaagagcccaggccuccuaca

SEQ ID NO: 3322391 - RNA, 16 nt, Human
acaagaccacguuucu

SEQ ID NO: 3322392 - RNA, 18 nt, Human
acaagagcccaggccucc

SEQ ID NO: 3322393 - RNA, 17 nt, Human
acaagaccacguuucua

SEQ ID NO: 3322394 - RNA, 13 nt, Human
acaagcuccaagc

SEQ ID NO: 3322395 - RNA, 17 nt, Human
acaagcgugagccacug

SEQ ID NO: 3322396 - RNA, 22 nt, Human
acaagcuccaagcucccaggca

SEQ ID NO: 3322397 - RNA, 19 nt, Human
acaagcuccaagcucccag

SEQ ID NO: 3322398 - RNA, 17 nt, Human
acaagcuccaagcuccc

SEQ ID NO: 3322399 - RNA, 16 nt, Human
acaagcuccaagcucc

SEQ ID NO: 3322400 - RNA, 15 nt, Human
acaagcuccaagcuc

SEQ ID NO: 3322401 - RNA, 21 nt, Human
acaaagcgugguggacaugca

SEQ ID NO: 3322402 - RNA, 14 nt, Human
acaaaacuuuucua

SEQ ID NO: 3322403 - RNA, 18 nt, Human
aauuugggggaaaauuua

SEQ ID NO: 3322404 - RNA, 16 nt, Human
aauuuguuauaaugaa

SEQ ID NO: 3322405 - RNA, 20 nt, Human
aauuugugauacaaugcugu

SEQ ID NO: 3322406 - RNA, 14 nt, Human
uacgucugacaggc

SEQ ID NO: 3322407 - RNA, 16 nt, Human
uacgucugacaggcaa

SEQ ID NO: 3322408 - RNA, 22 nt, Human
uacucuacccucuuagaaaaac

SEQ ID NO: 3322409 - RNA, 16 nt, Human
uacucuacccucuuag

SEQ ID NO: 3322410 - RNA, 15 nt, Human
uacgucugacaggca

SEQ ID NO: 3322411 - RNA, 17 nt, Human
uacuguaauuugugaua

SEQ ID NO: 3322412 - RNA, 16 nt, Human
uacuguaauuugugau

SEQ ID NO: 3322413 - RNA, 15 nt, Human
uacuguaauuuguga

SEQ ID NO: 3322414 - RNA, 23 nt, Human
uacuguaauuugugauacaaugc

SEQ ID NO: 3322415 - RNA, 17 nt, Human
aauuuaccugaagucuu

SEQ ID NO: 3322416 - RNA, 15 nt, Human
aauuuaccugaaguc

SEQ ID NO: 3322417 - RNA, 14 nt, Human
aauuuauuauggca

SEQ ID NO: 3322418 - RNA, 13 nt, Human
aauuuauuauggc

SEQ ID NO: 3322419 - RNA, 15 nt, Human
uacuucugcuacaua

SEQ ID NO: 3322420 - RNA, 20 nt, Human
uacuucuccacccugcucuc

SEQ ID NO: 3322421 - RNA, 14 nt, Human
uacuucuuauacau

SEQ ID NO: 3322422 - RNA, 15 nt, Human
uacuucuuauacauu

SEQ ID NO: 3322423 - RNA, 16 nt, Human
uacuucuuauacauuu

SEQ ID NO: 3322424 - RNA, 13 nt, Human
uacuucuccaccc

SEQ ID NO: 3322425 - RNA, 18 nt, Human
uacuucuccacccugcuc

SEQ ID NO: 3322426 - RNA, 13 nt, Human
acacuccuucaca

SEQ ID NO: 3322427 - RNA, 13 nt, Human
acacucugagacu

SEQ ID NO: 3322428 - RNA, 11 nt, Human
acacucugaga

SEQ ID NO: 3322429 - RNA, 22 nt, Human
acacucacauuuauucugcuca

SEQ ID NO: 3322430 - RNA, 15 nt, Human
acacuguucucugcc

SEQ ID NO: 3322431 - RNA, 14 nt, Human
acacuguucucugc

SEQ ID NO: 3322432 - RNA, 20 nt, Human
acacuguucucugcccucca

SEQ ID NO: 3322433 - RNA, 18 nt, Human
acacuguucucugcccuc

SEQ ID NO: 3322434 - RNA, 17 nt, Human
acacuguucucugcccu

SEQ ID NO: 3322435 - RNA, 16 nt, Human
acacuguucucugccc

SEQ ID NO: 3322436 - RNA, 23 nt, Human
acacuguucucugcccuccaaga

SEQ ID NO: 3322437 - RNA, 22 nt, Human
acacuguucucugcccuccaag

SEQ ID NO: 3322438 - RNA, 15 nt, Human
acacuguuucaaacu

SEQ ID NO: 3322439 - RNA, 23 nt, Human
acacuguuucaaacuuuacuaug

SEQ ID NO: 3322440 - RNA, 18 nt, Human
acagaaaauucuucucca

SEQ ID NO: 3322441 - RNA, 21 nt, Human
acagacuggaagcacagcuuc

SEQ ID NO: 3322442 - RNA, 17 nt, Human
acagacuggaagcacag

SEQ ID NO: 3322443 - RNA, 19 nt, Human
acagacuggaagcacagcu

SEQ ID NO: 3322444 - RNA, 18 nt, Human
acagacacaggcccggcu

SEQ ID NO: 3322445 - RNA, 17 nt, Human
acagacacaggcccggc

SEQ ID NO: 3322446 - RNA, 15 nt, Human
acagacacaggcccg

SEQ ID NO: 3322447 - RNA, 15 nt, Human
acagaguuguuacau

SEQ ID NO: 3322448 - RNA, 21 nt, Human
acagaguuguuacauuuuuaa

SEQ ID NO: 3322449 - RNA, 20 nt, Human
acagauagauauaugcucug

SEQ ID NO: 3322450 - RNA, 20 nt, Human
acagauacuccuccaagguu

SEQ ID NO: 3322451 - RNA, 23 nt, Human
acagaugggugcuuggaggaagg

SEQ ID NO: 3322452 - RNA, 23 nt, Human
acagcccgggcucugccucccau

SEQ ID NO: 3322453 - RNA, 20 nt, Human
acagcccgggcucugccucc

SEQ ID NO: 3322454 - RNA, 22 nt, Human
acagcccgggcucugccuccca

SEQ ID NO: 3322455 - RNA, 21 nt, Human
acagcccgggcucugccuccc

SEQ ID NO: 3322456 - RNA, 13 nt, Human
uaucucagggccu

SEQ ID NO: 3322457 - RNA, 20 nt, Human
uaucccuacuguaauuugug

SEQ ID NO: 3322458 - RNA, 19 nt, Human
uaucccuacuguaauuugu

SEQ ID NO: 3322459 - RNA, 18 nt, Human
acagagcuacacagggga

SEQ ID NO: 3322460 - RNA, 21 nt, Human
acagagcaagugagacccugu

SEQ ID NO: 3322461 - RNA, 20 nt, Human
acagaguuguuacauuuuua

SEQ ID NO: 3322462 - RNA, 19 nt, Human
acagaguuguuacauuuuu

SEQ ID NO: 3322463 - RNA, 18 nt, Human
acagaguuguuacauuuu

SEQ ID NO: 3322464 - RNA, 17 nt, Human
acagaguuguuacauuu

SEQ ID NO: 3322465 - RNA, 16 nt, Human
acagaguuguuacauu

SEQ ID NO: 3322466 - RNA, 18 nt, Human
acaccucugcacaagcug

SEQ ID NO: 3322467 - RNA, 14 nt, Human
acaccuugacaggg

SEQ ID NO: 3322468 - RNA, 15 nt, Human
acaccuugacagggc

SEQ ID NO: 3322469 - RNA, 16 nt, Human
acaccuugacagggca

SEQ ID NO: 3322470 - RNA, 15 nt, Human
acacuaaccacgcug

SEQ ID NO: 3322471 - RNA, 19 nt, Human
acacuaaccacgcuggacc

SEQ ID NO: 3322472 - RNA, 16 nt, Human
acacuaaccacgcugg

SEQ ID NO: 3322473 - RNA, 17 nt, Human
acacuaaccacgcugga

SEQ ID NO: 3322474 - RNA, 20 nt, Human
uauaaccaguguuguggauu

SEQ ID NO: 3322475 - RNA, 22 nt, Human
uauaaccaguguuguggauuua

SEQ ID NO: 3322476 - RNA, 12 nt, Human
acacccagccca

SEQ ID NO: 3322477 - RNA, 13 nt, Human
acacccagcccac

SEQ ID NO: 3322478 - RNA, 22 nt, Human
acacauguccaagaagcccagg

SEQ ID NO: 3322479 - RNA, 21 nt, Human
acacauguccaagaagcccag

SEQ ID NO: 3322480 - RNA, 13 nt, Human
acacauguccaag

SEQ ID NO: 3322481 - RNA, 19 nt, Human
acacauguccaagaagccc

SEQ ID NO: 3322482 - RNA, 18 nt, Human
acacauguccaagaagcc

SEQ ID NO: 3322483 - RNA, 13 nt, Human
uaguagagacagg

SEQ ID NO: 3322484 - RNA, 21 nt, Human
uagguuggcaaaaaggcagga

SEQ ID NO: 3322485 - RNA, 22 nt, Human
acacagcucuucuccaggcugu

SEQ ID NO: 3322486 - RNA, 11 nt, Human
acacagugagu

SEQ ID NO: 3322487 - RNA, 22 nt, Human
acacaguauuacuucugcuaca

SEQ ID NO: 3322488 - RNA, 21 nt, Human
acaaugguuuucuuguguguu

SEQ ID NO: 3322489 - RNA, 15 nt, Human
acaaugguuuucuug

SEQ ID NO: 3322490 - RNA, 11 nt, Human
acacacagcuc

SEQ ID NO: 3322491 - RNA, 12 nt, Human
acacacagcucu

SEQ ID NO: 3322492 - RNA, 19 nt, Human
acacacagcucuguccugg

SEQ ID NO: 3322493 - RNA, 19 nt, Human
guuuucuguucuuucuggc

SEQ ID NO: 3322494 - RNA, 11 nt, Human
guuuucuguuc

SEQ ID NO: 3322495 - RNA, 22 nt, Human
guuugauucagacagcugccug

SEQ ID NO: 3322496 - RNA, 21 nt, Human
guuugauucagacagcugccu

SEQ ID NO: 3322497 - RNA, 23 nt, Human
guuucuaaaggcuaccuuuguau

SEQ ID NO: 3322498 - RNA, 22 nt, Human
guuucuaaaggcuaccuuugua

SEQ ID NO: 3322499 - RNA, 13 nt, Human
guuugccucugcc

SEQ ID NO: 3322500 - RNA, 13 nt, Human
aagggccuggccu

SEQ ID NO: 3322501 - RNA, 17 nt, Human
aagggccuggccugagc

SEQ ID NO: 3322502 - RNA, 14 nt, Human
aagggccuggccug

SEQ ID NO: 3322503 - RNA, 19 nt, Human
aagggccuggccugagcug

SEQ ID NO: 3322504 - RNA, 22 nt, Human
aaggggaauguuugccucugcc

SEQ ID NO: 3322505 - RNA, 23 nt, Human
aaggggaauguuugccucugccu

SEQ ID NO: 3322506 - RNA, 16 nt, Human
aaggguaucaggugcu

SEQ ID NO: 3322507 - RNA, 20 nt, Human
guuucuaaagcugccagccg

SEQ ID NO: 3322508 - RNA, 19 nt, Human
guuucuaaaggcuaccuuu

SEQ ID NO: 3322509 - RNA, 16 nt, Human
aaguaauaugcacaca

SEQ ID NO: 3322510 - RNA, 15 nt, Human
aaguaauaugcacac

SEQ ID NO: 3322511 - RNA, 12 nt, Human
aaguaauaugca

SEQ ID NO: 3322512 - RNA, 15 nt, Human
aaggcuaccuuugua

SEQ ID NO: 3322513 - RNA, 19 nt, Human
aaggcuaccuuuguauucu

SEQ ID NO: 3322514 - RNA, 18 nt, Human
aaggccaaaggaagcaca

SEQ ID NO: 3322515 - RNA, 16 nt, Human
aaggccaaaggaagca

SEQ ID NO: 3322516 - RNA, 17 nt, Human
guugcccaggcaggucu

SEQ ID NO: 3322517 - RNA, 14 nt, Human
aaggcuccaggagc

SEQ ID NO: 3322518 - RNA, 18 nt, Human
guugcccaggcaggucuu

SEQ ID NO: 3322519 - RNA, 21 nt, Human
guugcccaggcuggcgugcag

SEQ ID NO: 3322520 - RNA, 15 nt, Human
guugcccaggcaggu

SEQ ID NO: 3322521 - RNA, 17 nt, Human
guugcccaggcuggcgu

SEQ ID NO: 3322522 - RNA, 19 nt, Human
aaggaugcuuguacauaau

SEQ ID NO: 3322523 - RNA, 17 nt, Human
aaggaugcuuguacaua

SEQ ID NO: 3322524 - RNA, 19 nt, Human
aaggaugcccaaagaugca

SEQ ID NO: 3322525 - RNA, 18 nt, Human
aaggaugcacagaguugu

SEQ ID NO: 3322526 - RNA, 16 nt, Human
aaggaugcuuguacau

SEQ ID NO: 3322527 - RNA, 15 nt, Human
aaggaugcuuguaca

SEQ ID NO: 3322528 - RNA, 23 nt, Human
guugaugaucuuugcagacaggc

SEQ ID NO: 3322529 - RNA, 13 nt, Human
aaggauccugagc

SEQ ID NO: 3322530 - RNA, 14 nt, Human
aaggauccugagcc

SEQ ID NO: 3322531 - RNA, 23 nt, Human
aaggaugaucuaggaagacuuug

SEQ ID NO: 3322532 - RNA, 18 nt, Human
aaggaugaucuaggaaga

SEQ ID NO: 3322533 - RNA, 17 nt, Human
aaggauccugagccaga

SEQ ID NO: 3322534 - RNA, 15 nt, Human
aaggauccugagcca

SEQ ID NO: 3322535 - RNA, 13 nt, Human
guuggguggaugc

SEQ ID NO: 3322536 - RNA, 18 nt, Human
guuggucccccuuccaug

SEQ ID NO: 3322537 - RNA, 18 nt, Human
guuaaugauagcuacugu

SEQ ID NO: 3322538 - RNA, 18 nt, Human
guuaaucauuagguguga

SEQ ID NO: 3322539 - RNA, 17 nt, Human
guuaguaugaggcauuu

SEQ ID NO: 3322540 - RNA, 20 nt, Human
guuaguaugaggcauuuguu

SEQ ID NO: 3322541 - RNA, 19 nt, Human
aagccuccuccagccgcca

SEQ ID NO: 3322542 - RNA, 17 nt, Human
aagcuaggccuggccag

SEQ ID NO: 3322543 - RNA, 18 nt, Human
aagcuaggccuggccaga

SEQ ID NO: 3322544 - RNA, 16 nt, Human
aagcuaggccuggcca

SEQ ID NO: 3322545 - RNA, 17 nt, Human
guucaggguuggccccu

SEQ ID NO: 3322546 - RNA, 18 nt, Human
guucaggguuggccccug

SEQ ID NO: 3322547 - RNA, 19 nt, Human
guucaggguuggccccugc

SEQ ID NO: 3322548 - RNA, 15 nt, Human
guucagcuccagcuc

SEQ ID NO: 3322549 - RNA, 16 nt, Human
guucagcuccagcuca

SEQ ID NO: 3322550 - RNA, 17 nt, Human
guucagcuccagcucac

SEQ ID NO: 3322551 - RNA, 16 nt, Human
guucuacccaggugcu

SEQ ID NO: 3322552 - RNA, 21 nt, Human
guucccuuugacgccauccca

SEQ ID NO: 3322553 - RNA, 20 nt, Human
guucccuuugacgccauccc

SEQ ID NO: 3322554 - RNA, 23 nt, Human
guucugggacacaguucaauucu

SEQ ID NO: 3322555 - RNA, 18 nt, Human
guucuugguuuguaaauu

SEQ ID NO: 3322556 - RNA, 21 nt, Human
guucuugguuuguaaauuaac

SEQ ID NO: 3322557 - RNA, 17 nt, Human
guucuuaguuugcaguu

SEQ ID NO: 3322558 - RNA, 22 nt, Human
guugaugaucuuugcagacagg

SEQ ID NO: 3322559 - RNA, 20 nt, Human
guuccauggccucuucagau

SEQ ID NO: 3322560 - RNA, 16 nt, Human
guucccauuugcuccu

SEQ ID NO: 3322561 - RNA, 20 nt, Human
guucccauuugcuccuuucu

SEQ ID NO: 3322562 - RNA, 18 nt, Human
gugcuaggaacacuccuu

SEQ ID NO: 3322563 - RNA, 17 nt, Human
gugcuaggaacacuccu

SEQ ID NO: 3322564 - RNA, 22 nt, Human
gugcuaggaacacuccuucaca

SEQ ID NO: 3322565 - RNA, 21 nt, Human
gugcuaucucccccagcccca

SEQ ID NO: 3322566 - RNA, 18 nt, Human
aagaaaaagaaaaagaaa

SEQ ID NO: 3322567 - RNA, 17 nt, Human
aagaaaaaggaugcaca

SEQ ID NO: 3322568 - RNA, 15 nt, Human
aagaaaaaggaugca

SEQ ID NO: 3322569 - RNA, 18 nt, Human
aagaaaaaggaugcacag

SEQ ID NO: 3322570 - RNA, 20 nt, Human
aagaaagacuaucuaaaugu

SEQ ID NO: 3322571 - RNA, 22 nt, Human
aagaaagacuaucuaaauguug

SEQ ID NO: 3322572 - RNA, 15 nt, Human
gugccucaagagaag

SEQ ID NO: 3322573 - RNA, 22 nt, Human
gugccgagaaggaagccuccca

SEQ ID NO: 3322574 - RNA, 12 nt, Human
gugccucuggga

SEQ ID NO: 3322575 - RNA, 13 nt, Human
gugccucugggac

SEQ ID NO: 3322576 - RNA, 14 nt, Human
gugccuuauggaac

SEQ ID NO: 3322577 - RNA, 23 nt, Human
gugccuuauggaacacucugaga

SEQ ID NO: 3322578 - RNA, 21 nt, Human
gugccuuauggaacacucuga

SEQ ID NO: 3322579 - RNA, 13 nt, Human
aacuuuaccuuuu

SEQ ID NO: 3322580 - RNA, 17 nt, Human
aacuuggcgcugccccu

SEQ ID NO: 3322581 - RNA, 11 nt, Human
gugccuuaugg

SEQ ID NO: 3322582 - RNA, 18 nt, Human
aacuugucuuuggacccu

SEQ ID NO: 3322583 - RNA, 12 nt, Human
gugcuauguucu

SEQ ID NO: 3322584 - RNA, 22 nt, Human
gugcuaucucccccagccccau

SEQ ID NO: 3322585 - RNA, 19 nt, Human
gugcuaucucccccagccc

SEQ ID NO: 3322586 - RNA, 20 nt, Human
gugcugggauuacaggugug

SEQ ID NO: 3322587 - RNA, 21 nt, Human
gugcugggauuacaagcguga

SEQ ID NO: 3322588 - RNA, 22 nt, Human
gugcugggauuacaagcgugag

SEQ ID NO: 3322589 - RNA, 18 nt, Human
guggacacagcucuucuc

SEQ ID NO: 3322590 - RNA, 22 nt, Human
guggacacagcucuucuccagg

SEQ ID NO: 3322591 - RNA, 17 nt, Human
guggacacagcucuucu

SEQ ID NO: 3322592 - RNA, 21 nt, Human
guggaugccugguggcagcug

SEQ ID NO: 3322593 - RNA, 20 nt, Human
guggaugccugguggcagcu

SEQ ID NO: 3322594 - RNA, 18 nt, Human
guggcaccagcagccugg

SEQ ID NO: 3322595 - RNA, 19 nt, Human
guggcaccagcagccugga

SEQ ID NO: 3322596 - RNA, 19 nt, Human
guggauuuaacagaaaugu

SEQ ID NO: 3322597 - RNA, 18 nt, Human
guggauuuaacagaaaug

SEQ ID NO: 3322598 - RNA, 16 nt, Human
guggcagcucaccucu

SEQ ID NO: 3322599 - RNA, 14 nt, Human
guggcagcucaccu

SEQ ID NO: 3322600 - RNA, 16 nt, Human
aagaauugaagcagga

SEQ ID NO: 3322601 - RNA, 14 nt, Human
guggugguuuucug

SEQ ID NO: 3322602 - RNA, 16 nt, Human
gugguuucagaaaugu

SEQ ID NO: 3322603 - RNA, 20 nt, Human
gugggggaucacagccucug

SEQ ID NO: 3322604 - RNA, 14 nt, Human
guggguacgggagg

SEQ ID NO: 3322605 - RNA, 14 nt, Human
gugggagugggccc

SEQ ID NO: 3322606 - RNA, 13 nt, Human
gugggagugggcc

SEQ ID NO: 3322607 - RNA, 23 nt, Human
gugggaggaucucuugagccugg

SEQ ID NO: 3322608 - RNA, 22 nt, Human
gugggacacccugugauggggc

SEQ ID NO: 3322609 - RNA, 23 nt, Human
guggcgcagcauauucaggaagc

SEQ ID NO: 3322610 - RNA, 22 nt, Human
guggcgcagcauauucaggaag

SEQ ID NO: 3322611 - RNA, 19 nt, Human
aagagauugugguuucauu

SEQ ID NO: 3322612 - RNA, 22 nt, Human
aagacccuuguggucccacccc

SEQ ID NO: 3322613 - RNA, 21 nt, Human
aagacccuuguggucccaccc

SEQ ID NO: 3322614 - RNA, 18 nt, Human
aagacccuugugguccca

SEQ ID NO: 3322615 - RNA, 16 nt, Human
aagacuaucuaaaugu

SEQ ID NO: 3322616 - RNA, 17 nt, Human
aagacuaucuaaauguu

SEQ ID NO: 3322617 - RNA, 18 nt, Human
aagacuaucuaaauguug

SEQ ID NO: 3322618 - RNA, 17 nt, Human
aagacugaguacguugu

SEQ ID NO: 3322619 - RNA, 16 nt, Human
aagacuguacaaagua

SEQ ID NO: 3322620 - RNA, 21 nt, Human
aagacugaguacguugugcau

SEQ ID NO: 3322621 - RNA, 17 nt, Human
aagacuguacaaaguag

SEQ ID NO: 3322622 - RNA, 17 nt, Human
gugugacuacuccccca

SEQ ID NO: 3322623 - RNA, 18 nt, Human
gugucuuuuuucacuaca

SEQ ID NO: 3322624 - RNA, 17 nt, Human
gugucuugcaauggcag

SEQ ID NO: 3322625 - RNA, 18 nt, Human
gugucuugcaauggcagc

SEQ ID NO: 3322626 - RNA, 23 nt, Human
guguuuccuggcacugcuuccag

SEQ ID NO: 3322627 - RNA, 18 nt, Human
aagaugugacauguuuua

SEQ ID NO: 3322628 - RNA, 14 nt, Human
aagaugugacaugu

SEQ ID NO: 3322629 - RNA, 13 nt, Human
aagcaaaggagau

SEQ ID NO: 3322630 - RNA, 12 nt, Human
aagcaaaggaga

SEQ ID NO: 3322631 - RNA, 12 nt, Human
aagaugcagccg

SEQ ID NO: 3322632 - RNA, 18 nt, Human
aagagguuuuaaaaaaau

SEQ ID NO: 3322633 - RNA, 17 nt, Human
gugguuuucuguucuuu

SEQ ID NO: 3322634 - RNA, 17 nt, Human
aaaugaggucagagccu

SEQ ID NO: 3322635 - RNA, 19 nt, Human
aaaugaggucagagccugc

SEQ ID NO: 3322636 - RNA, 16 nt, Human
aaaugagguacucucc

SEQ ID NO: 3322637 - RNA, 23 nt, Human
aaaugagguacucuccuggaaau

SEQ ID NO: 3322638 - RNA, 19 nt, Human
aaaugagccuggcaagaau

SEQ ID NO: 3322639 - RNA, 13 nt, Human
aaaugagccuggc

SEQ ID NO: 3322640 - RNA, 13 nt, Human
aaaugcccagccc

SEQ ID NO: 3322641 - RNA, 15 nt, Human
aaaugcccagccccu

SEQ ID NO: 3322642 - RNA, 14 nt, Human
aaaugcccagcccc

SEQ ID NO: 3322643 - RNA, 18 nt, Human
aaaugcccagccccuucu

SEQ ID NO: 3322644 - RNA, 13 nt, Human
aaaugcccagcuu

SEQ ID NO: 3322645 - RNA, 15 nt, Human
aaaugggcagagcag

SEQ ID NO: 3322646 - RNA, 20 nt, Human
aaaugggcagagcagagacc

SEQ ID NO: 3322647 - RNA, 18 nt, Human
aaaugggcagagcagaga

SEQ ID NO: 3322648 - RNA, 14 nt, Human
aaaugcaccuggaa

SEQ ID NO: 3322649 - RNA, 22 nt, Human
aaaugcaccuggaauauauaac

SEQ ID NO: 3322650 - RNA, 18 nt, Human
aaaugcaccuggaauaua

SEQ ID NO: 3322651 - RNA, 17 nt, Human
aaaugaaaaucgugaca

SEQ ID NO: 3322652 - RNA, 17 nt, Human
aaaucucaaauuucuaa

SEQ ID NO: 3322653 - RNA, 16 nt, Human
aaaucucaaauuucua

SEQ ID NO: 3322654 - RNA, 15 nt, Human
aaaucucaaauuucu

SEQ ID NO: 3322655 - RNA, 13 nt, Human
aaaucgaugcagu

SEQ ID NO: 3322656 - RNA, 18 nt, Human
aaaucccuuaccucggug

SEQ ID NO: 3322657 - RNA, 15 nt, Human
aaaucccauuuaaaa

SEQ ID NO: 3322658 - RNA, 15 nt, Human
guaggaagacuuugg

SEQ ID NO: 3322659 - RNA, 18 nt, Human
guaggaagguuaauguuc

SEQ ID NO: 3322660 - RNA, 22 nt, Human
guagcucuaggagggcuggcaa

SEQ ID NO: 3322661 - RNA, 12 nt, Human
guagcugggacu

SEQ ID NO: 3322662 - RNA, 18 nt, Human
guagcugggacuacaggc

SEQ ID NO: 3322663 - RNA, 19 nt, Human
guagcugggacuacaggca

SEQ ID NO: 3322664 - RNA, 21 nt, Human
guagcugggacuacaggcacc

SEQ ID NO: 3322665 - RNA, 15 nt, Human
guaugggagagaaga

SEQ ID NO: 3322666 - RNA, 15 nt, Human
guauucuuauuuaau

SEQ ID NO: 3322667 - RNA, 21 nt, Human
guauucucuccuguaccucuu

SEQ ID NO: 3322668 - RNA, 14 nt, Human
guaugggagagaag

SEQ ID NO: 3322669 - RNA, 22 nt, Human
guaugaucacggcucacugcag

SEQ ID NO: 3322670 - RNA, 15 nt, Human
guaucccuacuguaa

SEQ ID NO: 3322671 - RNA, 21 nt, Human
guaucccaugagccucagcau

SEQ ID NO: 3322672 - RNA, 18 nt, Human
aaaugggggugcauuuga

SEQ ID NO: 3322673 - RNA, 17 nt, Human
aaaugggggugcauuug

SEQ ID NO: 3322674 - RNA, 16 nt, Human
aaaugggggugcauuu

SEQ ID NO: 3322675 - RNA, 15 nt, Human
aaaugggggugcauu

SEQ ID NO: 3322676 - RNA, 14 nt, Human
aaauucaugcugcu

SEQ ID NO: 3322677 - RNA, 16 nt, Human
aaauuccccacccuga

SEQ ID NO: 3322678 - RNA, 21 nt, Human
aaauuaacuuuuauaaacuuu

SEQ ID NO: 3322679 - RNA, 19 nt, Human
aaauuaacuuuuauaaacu

SEQ ID NO: 3322680 - RNA, 23 nt, Human
aaauuaacuuuuauaaacuuuac

SEQ ID NO: 3322681 - RNA, 22 nt, Human
aaauuaacuuuuauaaacuuua

SEQ ID NO: 3322682 - RNA, 22 nt, Human
guauuggcuagagguucaaaga

SEQ ID NO: 3322683 - RNA, 15 nt, Human
guauuuuuuuacuaa

SEQ ID NO: 3322684 - RNA, 14 nt, Human
guauuuuuuuacua

SEQ ID NO: 3322685 - RNA, 16 nt, Human
gucacacacuuuggcu

SEQ ID NO: 3322686 - RNA, 20 nt, Human
gucacacaguauuacuucug

SEQ ID NO: 3322687 - RNA, 21 nt, Human
guauuuuuuuacuaauagaca

SEQ ID NO: 3322688 - RNA, 17 nt, Human
guauuuuuuuacuaaua

SEQ ID NO: 3322689 - RNA, 18 nt, Human
gucaaaguggugagaggc

SEQ ID NO: 3322690 - RNA, 19 nt, Human
gucaaaguggugagaggca

SEQ ID NO: 3322691 - RNA, 19 nt, Human
gugaaccaccacacccagc

SEQ ID NO: 3322692 - RNA, 15 nt, Human
aacguggcugcuuca

SEQ ID NO: 3322693 - RNA, 19 nt, Human
aacguggcugcuucaagga

SEQ ID NO: 3322694 - RNA, 16 nt, Human
aacguggcugcuucaa

SEQ ID NO: 3322695 - RNA, 24 nt, Human
gucuuuucuugcaugaggcuagug

SEQ ID NO: 3322696 - RNA, 19 nt, Human
gucuuuucuugcaugaggc

SEQ ID NO: 3322697 - RNA, 14 nt, Human
gucuuuucuugcau

SEQ ID NO: 3322698 - RNA, 17 nt, Human
gucuuuggacccugagg

SEQ ID NO: 3322699 - RNA, 15 nt, Human
gucuuuggacccuga

SEQ ID NO: 3322700 - RNA, 14 nt, Human
gucuuuggacccug

SEQ ID NO: 3322701 - RNA, 15 nt, Human
gucuuagauguauau

SEQ ID NO: 3322702 - RNA, 23 nt, Human
aaccauuuugcugucccuuuucc

SEQ ID NO: 3322703 - RNA, 11 nt, Human
aacccagcucu

SEQ ID NO: 3322704 - RNA, 14 nt, Human
aacccagcucuggu

SEQ ID NO: 3322705 - RNA, 13 nt, Human
aacccagcucugg

SEQ ID NO: 3322706 - RNA, 17 nt, Human
aacccagcucuggucca

SEQ ID NO: 3322707 - RNA, 13 nt, Human
aacccccagccug

SEQ ID NO: 3322708 - RNA, 14 nt, Human
aacccccagccugc

SEQ ID NO: 3322709 - RNA, 15 nt, Human
aacccccagccugcu

SEQ ID NO: 3322710 - RNA, 17 nt, Human
aaccuccgccucuuggg

SEQ ID NO: 3322711 - RNA, 14 nt, Human
aaccuccugggcua

SEQ ID NO: 3322712 - RNA, 13 nt, Human
gucuccauguuug

SEQ ID NO: 3322713 - RNA, 16 nt, Human
aacauuuugucauaua

SEQ ID NO: 3322714 - RNA, 20 nt, Human
aaccacaucuugcucugcug

SEQ ID NO: 3322715 - RNA, 22 nt, Human
aaccacaucuugcucugcugac

SEQ ID NO: 3322716 - RNA, 20 nt, Human
aaccaucauugaaaucuuuu

SEQ ID NO: 3322717 - RNA, 19 nt, Human
aaccaucauugaaaucuuu

SEQ ID NO: 3322718 - RNA, 21 nt, Human
aaccaucauugaaaucuuuuu

SEQ ID NO: 3322719 - RNA, 18 nt, Human
aaccacaucuugcucugc

SEQ ID NO: 3322720 - RNA, 19 nt, Human
aacagguuuuccugaagaa

SEQ ID NO: 3322721 - RNA, 23 nt, Human
aacaggcugggcuucaguggcag

SEQ ID NO: 3322722 - RNA, 19 nt, Human
aacagacuggaagcacagc

SEQ ID NO: 3322723 - RNA, 22 nt, Human
aacaggcugggcuucaguggca

SEQ ID NO: 3322724 - RNA, 13 nt, Human
aacaggcugggcu

SEQ ID NO: 3322725 - RNA, 13 nt, Human
guccgagcuuuga

SEQ ID NO: 3322726 - RNA, 21 nt, Human
aacagaaauguacagcaagga

SEQ ID NO: 3322727 - RNA, 15 nt, Human
aacagaaauguacag

SEQ ID NO: 3322728 - RNA, 10 nt, Human
aacagaaaug

SEQ ID NO: 3322729 - RNA, 15 nt, Human
aacauacucccaucu

SEQ ID NO: 3322730 - RNA, 14 nt, Human
aacauacucccauc

SEQ ID NO: 3322731 - RNA, 20 nt, Human
aacacuguucucugcccucc

SEQ ID NO: 3322732 - RNA, 15 nt, Human
aacacuguucucugc

SEQ ID NO: 3322733 - RNA, 14 nt, Human
aacacucugagacu

SEQ ID NO: 3322734 - RNA, 13 nt, Human
aacacucugagac

SEQ ID NO: 3322735 - RNA, 12 nt, Human
aacacucugaga

SEQ ID NO: 3322736 - RNA, 11 nt, Human
aacacucugag

SEQ ID NO: 3322737 - RNA, 12 nt, Human
aacacuccuuca

SEQ ID NO: 3322738 - RNA, 21 nt, Human
aacacucauugaccugaggcc

SEQ ID NO: 3322739 - RNA, 17 nt, Human
aacacucauugaccuga

SEQ ID NO: 3322740 - RNA, 22 nt, Human
gucauuugagcagggcucagcg

SEQ ID NO: 3322741 - RNA, 19 nt, Human
gucauuugagcagggcuca

SEQ ID NO: 3322742 - RNA, 21 nt, Human
aacacuguucucugcccucca

SEQ ID NO: 3322743 - RNA, 21 nt, Human
gucauuugagcagggcucagc

SEQ ID NO: 3322744 - RNA, 23 nt, Human
aacaaggcaaggcugucaauuac

SEQ ID NO: 3322745 - RNA, 17 nt, Human
aacaagaccacguuucu

SEQ ID NO: 3322746 - RNA, 16 nt, Human
aacaagaccacguuuc

SEQ ID NO: 3322747 - RNA, 19 nt, Human
aacaagaccacguuucuaa

SEQ ID NO: 3322748 - RNA, 12 nt, Human
gucacaggcagg

SEQ ID NO: 3322749 - RNA, 16 nt, Human
gucacaggcaggucca

SEQ ID NO: 3322750 - RNA, 13 nt, Human
gucacaggcaggu

SEQ ID NO: 3322751 - RNA, 15 nt, Human
gucacaggcaggucc

SEQ ID NO: 3322752 - RNA, 22 nt, Human
agagaaaaaauauuuuccugcc

SEQ ID NO: 3322753 - RNA, 19 nt, Human
agacuuuucuuucagccaa

SEQ ID NO: 3322754 - RNA, 15 nt, Human
agacuguacaaagua

SEQ ID NO: 3322755 - RNA, 16 nt, Human
agacuguacaaaguag

SEQ ID NO: 3322756 - RNA, 14 nt, Human
agacuguacaaagu

SEQ ID NO: 3322757 - RNA, 20 nt, Human
agacucgcgacaaugcaaac

SEQ ID NO: 3322758 - RNA, 18 nt, Human
ucuuucuggcuaugcauu

SEQ ID NO: 3322759 - RNA, 13 nt, Human
ucuuucugcuuug

SEQ ID NO: 3322760 - RNA, 20 nt, Human
ucuuuauaauucuacuuuga

SEQ ID NO: 3322761 - RNA, 23 nt, Human
agacuccugcaggcagccaggcc

SEQ ID NO: 3322762 - RNA, 19 nt, Human
agacucgcgacaaugcaaa

SEQ ID NO: 3322763 - RNA, 18 nt, Human
agacucgcgacaaugcaa

SEQ ID NO: 3322764 - RNA, 17 nt, Human
agacucgcgacaaugca

SEQ ID NO: 3322765 - RNA, 15 nt, Human
agacucgcgacaaug

SEQ ID NO: 3322766 - RNA, 14 nt, Human
ucuugguuuguaaa

SEQ ID NO: 3322767 - RNA, 19 nt, Human
ucuugguccugcugcaguu

SEQ ID NO: 3322768 - RNA, 20 nt, Human
ucuuuaaugucacaggcagg

SEQ ID NO: 3322769 - RNA, 16 nt, Human
ucuugguuuguaaauu

SEQ ID NO: 3322770 - RNA, 19 nt, Human
ucuuuaaugucacaggcag

SEQ ID NO: 3322771 - RNA, 22 nt, Human
ucuuuaaugucacaggcagguc

SEQ ID NO: 3322772 - RNA, 20 nt, Human
ucuucuguacgucugacagg

SEQ ID NO: 3322773 - RNA, 23 nt, Human
agacauacuaaccagcagaaaug

SEQ ID NO: 3322774 - RNA, 17 nt, Human
ucuuauuuaaugaaaga

SEQ ID NO: 3322775 - RNA, 22 nt, Human
ucuucugcuucagccucccgag

SEQ ID NO: 3322776 - RNA, 19 nt, Human
ucuucugcuucagccuccc

SEQ ID NO: 3322777 - RNA, 21 nt, Human
ucuucuguacgucugacaggc

SEQ ID NO: 3322778 - RNA, 22 nt, Human
ucuucuguacgucugacaggca

SEQ ID NO: 3322779 - RNA, 16 nt, Human
ucuugagccuugaacu

SEQ ID NO: 3322780 - RNA, 17 nt, Human
ucuugagccuugaacuu

SEQ ID NO: 3322781 - RNA, 19 nt, Human
ucuugagccuugaacuuug

SEQ ID NO: 3322782 - RNA, 18 nt, Human
ucuugagccuugaacuuu

SEQ ID NO: 3322783 - RNA, 14 nt, Human
agacccggcugcgu

SEQ ID NO: 3322784 - RNA, 23 nt, Human
agaaccccaggguccuguagccc

SEQ ID NO: 3322785 - RNA, 19 nt, Human
agaauuaguggcacuugcu

SEQ ID NO: 3322786 - RNA, 21 nt, Human
agaauguguuuaaacuugguu

SEQ ID NO: 3322787 - RNA, 20 nt, Human
agaauucucagaaucucaaa

SEQ ID NO: 3322788 - RNA, 20 nt, Human
agaauuauaauuaguuccuc

SEQ ID NO: 3322789 - RNA, 14 nt, Human
agaauucucuaguu

SEQ ID NO: 3322790 - RNA, 19 nt, Human
ucuguuuagauaauacacc

SEQ ID NO: 3322791 - RNA, 16 nt, Human
ucuguuuagauaauac

SEQ ID NO: 3322792 - RNA, 23 nt, Human
ucuguuuagauaauacaccacua

SEQ ID NO: 3322793 - RNA, 13 nt, Human
ucuguuuagauaa

SEQ ID NO: 3322794 - RNA, 18 nt, Human
ucuguacgucugacaggc

SEQ ID NO: 3322795 - RNA, 13 nt, Human
agacacaagccuu

SEQ ID NO: 3322796 - RNA, 14 nt, Human
agacacaagccuuc

SEQ ID NO: 3322797 - RNA, 17 nt, Human
agaauucucuuauccaa

SEQ ID NO: 3322798 - RNA, 19 nt, Human
agaauucucuaguuugauu

SEQ ID NO: 3322799 - RNA, 18 nt, Human
agaauucucuaguuugau

SEQ ID NO: 3322800 - RNA, 17 nt, Human
agacacaggcccggcuc

SEQ ID NO: 3322801 - RNA, 19 nt, Human
agacacaggcccggcucca

SEQ ID NO: 3322802 - RNA, 20 nt, Human
agacacaggcccggcuccag

SEQ ID NO: 3322803 - RNA, 21 nt, Human
agacacaggcccggcuccagg

SEQ ID NO: 3322804 - RNA, 22 nt, Human
agacacaggcccggcuccaggc

SEQ ID NO: 3322805 - RNA, 20 nt, Human
agacacauguccaagaagcc

SEQ ID NO: 3322806 - RNA, 22 nt, Human
agacaccuugacagggcacacc

SEQ ID NO: 3322807 - RNA, 19 nt, Human
agacaccuugacagggcac

SEQ ID NO: 3322808 - RNA, 24 nt, Human
agacacauguccaagaagcccagg

SEQ ID NO: 3322809 - RNA, 23 nt, Human
agacacaggcccggcuccaggcu

SEQ ID NO: 3322810 - RNA, 16 nt, Human
agacacaggcccggcu

SEQ ID NO: 3322811 - RNA, 22 nt, Human
agacacauguccaagaagccca

SEQ ID NO: 3322812 - RNA, 21 nt, Human
agacacauguccaagaagccc

SEQ ID NO: 3322813 - RNA, 14 nt, Human
agacagcugccugg

SEQ ID NO: 3322814 - RNA, 13 nt, Human
agacagcugccug

SEQ ID NO: 3322815 - RNA, 12 nt, Human
ucuuagauguau

SEQ ID NO: 3322816 - RNA, 18 nt, Human
ucuuaugggcuggguucu

SEQ ID NO: 3322817 - RNA, 19 nt, Human
agacagucccugccaaugg

SEQ ID NO: 3322818 - RNA, 13 nt, Human
agacagucccugc

SEQ ID NO: 3322819 - RNA, 15 nt, Human
agacagcugccuggg

SEQ ID NO: 3322820 - RNA, 12 nt, Human
agacagcugccu

SEQ ID NO: 3322821 - RNA, 12 nt, Human
agacagucccug

SEQ ID NO: 3322822 - RNA, 23 nt, Human
ugaccauucuccaccugccaggg

SEQ ID NO: 3322823 - RNA, 12 nt, Human
ugacccacugcu

SEQ ID NO: 3322824 - RNA, 13 nt, Human
ugacccacugcuu

SEQ ID NO: 3322825 - RNA, 15 nt, Human
agaugcuucucacug

SEQ ID NO: 3322826 - RNA, 14 nt, Human
agaugcaccagccc

SEQ ID NO: 3322827 - RNA, 15 nt, Human
agaugcaccagcccu

SEQ ID NO: 3322828 - RNA, 20 nt, Human
ugacauuguuggccaaagcc

SEQ ID NO: 3322829 - RNA, 21 nt, Human
ugacauuguuggccaaagcca

SEQ ID NO: 3322830 - RNA, 18 nt, Human
ugaccaaugauggucacc

SEQ ID NO: 3322831 - RNA, 15 nt, Human
agaucagccugggca

SEQ ID NO: 3322832 - RNA, 13 nt, Human
agaucagccuggg

SEQ ID NO: 3322833 - RNA, 20 nt, Human
ugacagggcacaccgggcac

SEQ ID NO: 3322834 - RNA, 11 nt, Human
ugacagggcac

SEQ ID NO: 3322835 - RNA, 16 nt, Human
ugacagggcacaccgg

SEQ ID NO: 3322836 - RNA, 20 nt, Human
ugacaggcaaugcuggcugu

SEQ ID NO: 3322837 - RNA, 21 nt, Human
ugacacacagcucuguccugg

SEQ ID NO: 3322838 - RNA, 22 nt, Human
agagucagaaguuucugccgca

SEQ ID NO: 3322839 - RNA, 19 nt, Human
ugaaugucagugugacuga

SEQ ID NO: 3322840 - RNA, 18 nt, Human
ugaaugucagugugacug

SEQ ID NO: 3322841 - RNA, 20 nt, Human
ugaaugguuuucaaaauaaa

SEQ ID NO: 3322842 - RNA, 21 nt, Human
agaguuguuacauuuuuaagu

SEQ ID NO: 3322843 - RNA, 12 nt, Human
agaguuguuaca

SEQ ID NO: 3322844 - RNA, 22 nt, Human
agagucucacuguugcccaggc

SEQ ID NO: 3322845 - RNA, 22 nt, Human
agaguugauacuacaguuuguu

SEQ ID NO: 3322846 - RNA, 20 nt, Human
agaguugauacuacaguuug

SEQ ID NO: 3322847 - RNA, 17 nt, Human
agaguugauacuacagu

SEQ ID NO: 3322848 - RNA, 20 nt, Human
ugacacacagcucuguccug

SEQ ID NO: 3322849 - RNA, 17 nt, Human
agaucacgccacugcac

SEQ ID NO: 3322850 - RNA, 18 nt, Human
agaucacgccacugcacu

SEQ ID NO: 3322851 - RNA, 14 nt, Human
agaucacgccacug

SEQ ID NO: 3322852 - RNA, 15 nt, Human
agaucacgccacugc

SEQ ID NO: 3322853 - RNA, 16 nt, Human
agaucacgccacugca

SEQ ID NO: 3322854 - RNA, 12 nt, Human
agauaaaugugc

SEQ ID NO: 3322855 - RNA, 14 nt, Human
agagcugccaccug

SEQ ID NO: 3322856 - RNA, 18 nt, Human
agagcugccaccugccug

SEQ ID NO: 3322857 - RNA, 12 nt, Human
agagcagagacc

SEQ ID NO: 3322858 - RNA, 16 nt, Human
ucuuuggacccugagg

SEQ ID NO: 3322859 - RNA, 21 nt, Human
ucuuuggacccugaggcccag

SEQ ID NO: 3322860 - RNA, 17 nt, Human
ucuuuggacccugaggc

SEQ ID NO: 3322861 - RNA, 16 nt, Human
agagauugugguuuca

SEQ ID NO: 3322862 - RNA, 20 nt, Human
agagcagagaccaucccuga

SEQ ID NO: 3322863 - RNA, 18 nt, Human
agagcagagaccaucccu

SEQ ID NO: 3322864 - RNA, 17 nt, Human
agagcagagaccauccc

SEQ ID NO: 3322865 - RNA, 11 nt, Human
agagccuugcg

SEQ ID NO: 3322866 - RNA, 22 nt, Human
agagccuuccaggggugggaca

SEQ ID NO: 3322867 - RNA, 21 nt, Human
agagccuugcggaagguucua

SEQ ID NO: 3322868 - RNA, 15 nt, Human
ugaaauuuuuauuaa

SEQ ID NO: 3322869 - RNA, 22 nt, Human
ugaaccgaugagaaauaaaguu

SEQ ID NO: 3322870 - RNA, 14 nt, Human
ugaacuccuggccu

SEQ ID NO: 3322871 - RNA, 15 nt, Human
ugaacuccuggccuc

SEQ ID NO: 3322872 - RNA, 11 nt, Human
ugaacuccugg

SEQ ID NO: 3322873 - RNA, 12 nt, Human
ugaacuccuggc

SEQ ID NO: 3322874 - RNA, 22 nt, Human
ugaacuuugaccucugcagcaa

SEQ ID NO: 3322875 - RNA, 17 nt, Human
ugaacuuugaccucugc

SEQ ID NO: 3322876 - RNA, 20 nt, Human
ugaacuuugaccucugcagc

SEQ ID NO: 3322877 - RNA, 19 nt, Human
ugaacuuugaccucugcag

SEQ ID NO: 3322878 - RNA, 20 nt, Human
agagguucaaagauauuuug

SEQ ID NO: 3322879 - RNA, 19 nt, Human
agaggccaugggccuccug

SEQ ID NO: 3322880 - RNA, 17 nt, Human
agaggcuaugugagcac

SEQ ID NO: 3322881 - RNA, 10 nt, Human
agaggcaggg

SEQ ID NO: 3322882 - RNA, 13 nt, Human
agaggcagggucu

SEQ ID NO: 3322883 - RNA, 24 nt, Human
agaggcagccccauucugccugcc

SEQ ID NO: 3322884 - RNA, 13 nt, Human
agaggcagcccca

SEQ ID NO: 3322885 - RNA, 19 nt, Human
agaggcagccccauucugc

SEQ ID NO: 3322886 - RNA, 15 nt, Human
uccuucagugccuua

SEQ ID NO: 3322887 - RNA, 14 nt, Human
uccuucagugccuu

SEQ ID NO: 3322888 - RNA, 17 nt, Human
uccuucagugccuuaug

SEQ ID NO: 3322889 - RNA, 16 nt, Human
uccuucagugccuuau

SEQ ID NO: 3322890 - RNA, 15 nt, Human
uccuuuagcgcccag

SEQ ID NO: 3322891 - RNA, 19 nt, Human
uccuuuagcgcccaguugg

SEQ ID NO: 3322892 - RNA, 23 nt, Human
uccuuguguuacuaaguuuuuau

SEQ ID NO: 3322893 - RNA, 14 nt, Human
uccuuguguuacua

SEQ ID NO: 3322894 - RNA, 22 nt, Human
uccuuggugucgggcaugacac

SEQ ID NO: 3322895 - RNA, 22 nt, Human
uccuuuagcgcccaguugggug

SEQ ID NO: 3322896 - RNA, 16 nt, Human
ucgagcaugccuggau

SEQ ID NO: 3322897 - RNA, 15 nt, Human
ucgagcaugccugga

SEQ ID NO: 3322898 - RNA, 18 nt, Human
ucgagcaugccuggaugg

SEQ ID NO: 3322899 - RNA, 19 nt, Human
ucgcgacaaugcaaaccau

SEQ ID NO: 3322900 - RNA, 14 nt, Human
ucgcgacaaugcaa

SEQ ID NO: 3322901 - RNA, 16 nt, Human
ucgcgacaaugcaaac

SEQ ID NO: 3322902 - RNA, 22 nt, Human
acugcaucaagaugugacaugu

SEQ ID NO: 3322903 - RNA, 20 nt, Human
acugcaucaagaugugacau

SEQ ID NO: 3322904 - RNA, 16 nt, Human
acugcauguuugugau

SEQ ID NO: 3322905 - RNA, 15 nt, Human
acugcauguuuguga

SEQ ID NO: 3322906 - RNA, 22 nt, Human
uccuagaaauuccccacccuga

SEQ ID NO: 3322907 - RNA, 21 nt, Human
uccuagaaauuccccacccug

SEQ ID NO: 3322908 - RNA, 16 nt, Human
acugcauaugaaagga

SEQ ID NO: 3322909 - RNA, 18 nt, Human
acugcuuaacuucacaua

SEQ ID NO: 3322910 - RNA, 15 nt, Human
acuggauuaaacuua

SEQ ID NO: 3322911 - RNA, 20 nt, Human
acugcuuaacuucacauauu

SEQ ID NO: 3322912 - RNA, 21 nt, Human
acugcuugugaaaggaaagag

SEQ ID NO: 3322913 - RNA, 12 nt, Human
ucgggcaugaca

SEQ ID NO: 3322914 - RNA, 11 nt, Human
ucgggcaugac

SEQ ID NO: 3322915 - RNA, 17 nt, Human
ucgggaggucgaggcag

SEQ ID NO: 3322916 - RNA, 21 nt, Human
ucgggaggucgaggcaggagg

SEQ ID NO: 3322917 - RNA, 19 nt, Human
ucgggaggucgaggcagga

SEQ ID NO: 3322918 - RNA, 22 nt, Human
acugugcugagucugaaggcug

SEQ ID NO: 3322919 - RNA, 18 nt, Human
acuguccuacccacccuc

SEQ ID NO: 3322920 - RNA, 17 nt, Human
acuguccuacccacccu

SEQ ID NO: 3322921 - RNA, 14 nt, Human
ucuaaagcugccag

SEQ ID NO: 3322922 - RNA, 13 nt, Human
ucuaaagcugcca

SEQ ID NO: 3322923 - RNA, 15 nt, Human
ucuaaagcugccagc

SEQ ID NO: 3322924 - RNA, 19 nt, Human
acuguucucugcccuccaa

SEQ ID NO: 3322925 - RNA, 21 nt, Human
acuguucucugcccuccaaga

SEQ ID NO: 3322926 - RNA, 20 nt, Human
acuguucucugcccuccaag

SEQ ID NO: 3322927 - RNA, 14 nt, Human
acuguucucugccc

SEQ ID NO: 3322928 - RNA, 13 nt, Human
acuuaaucuaaau

SEQ ID NO: 3322929 - RNA, 16 nt, Human
acuuaaucuaaaugga

SEQ ID NO: 3322930 - RNA, 15 nt, Human
acuuaaucuaaaugg

SEQ ID NO: 3322931 - RNA, 17 nt, Human
acuguugcccaggcugg

SEQ ID NO: 3322932 - RNA, 18 nt, Human
acuguugcccaggcuggc

SEQ ID NO: 3322933 - RNA, 12 nt, Human
acuguugcccag

SEQ ID NO: 3322934 - RNA, 13 nt, Human
acuguugcccagg

SEQ ID NO: 3322935 - RNA, 14 nt, Human
acuguugcccaggc

SEQ ID NO: 3322936 - RNA, 15 nt, Human
acuuaaauaauguga

SEQ ID NO: 3322937 - RNA, 16 nt, Human
acuuaaauaaugugaa

SEQ ID NO: 3322938 - RNA, 18 nt, Human
acuuaaauaaugugaaac

SEQ ID NO: 3322939 - RNA, 17 nt, Human
acuuaaauaaugugaaa

SEQ ID NO: 3322940 - RNA, 15 nt, Human
acuucuccacccugc

SEQ ID NO: 3322941 - RNA, 16 nt, Human
acuucuccacccugcu

SEQ ID NO: 3322942 - RNA, 19 nt, Human
acuugagaauuacccuuuu

SEQ ID NO: 3322943 - RNA, 19 nt, Human
acuugagcccagagugaac

SEQ ID NO: 3322944 - RNA, 17 nt, Human
acuuguggacacagcuc

SEQ ID NO: 3322945 - RNA, 16 nt, Human
acuuguggacacagcu

SEQ ID NO: 3322946 - RNA, 14 nt, Human
acuucuccacccug

SEQ ID NO: 3322947 - RNA, 22 nt, Human
acuucgggaggucgaggcagga

SEQ ID NO: 3322948 - RNA, 13 nt, Human
ucucacuccuuga

SEQ ID NO: 3322949 - RNA, 12 nt, Human
ucucacucuguc

SEQ ID NO: 3322950 - RNA, 23 nt, Human
ucucacacaugagcaucaggcca

SEQ ID NO: 3322951 - RNA, 16 nt, Human
acuucagcugacuuuu

SEQ ID NO: 3322952 - RNA, 11 nt, Human
acuucagcuga

SEQ ID NO: 3322953 - RNA, 11 nt, Human
ucucacuccuu

SEQ ID NO: 3322954 - RNA, 19 nt, Human
ucucagggccuggucguuu

SEQ ID NO: 3322955 - RNA, 15 nt, Human
ucucagggccugguc

SEQ ID NO: 3322956 - RNA, 14 nt, Human
ucucagggccuggu

SEQ ID NO: 3322957 - RNA, 13 nt, Human
ucucagggccugg

SEQ ID NO: 3322958 - RNA, 12 nt, Human
ucucagggccug

SEQ ID NO: 3322959 - RNA, 15 nt, Human
acuuguggacacagc

SEQ ID NO: 3322960 - RNA, 11 nt, Human
ucuccaggcug

SEQ ID NO: 3322961 - RNA, 13 nt, Human
ucuccaaaauaaa

SEQ ID NO: 3322962 - RNA, 22 nt, Human
ucuccaaaauaaaacuuuuuaa

SEQ ID NO: 3322963 - RNA, 19 nt, Human
ucuccaaaauaaaacuuuu

SEQ ID NO: 3322964 - RNA, 17 nt, Human
ucuccaaaauaaaacuu

SEQ ID NO: 3322965 - RNA, 16 nt, Human
ucuccaggcuguaucc

SEQ ID NO: 3322966 - RNA, 21 nt, Human
ucuccuccuuuucacaguucu

SEQ ID NO: 3322967 - RNA, 17 nt, Human
acuuucuagccagagga

SEQ ID NO: 3322968 - RNA, 16 nt, Human
acuuucuagccagagg

SEQ ID NO: 3322969 - RNA, 14 nt, Human
acuuugaccucugc

SEQ ID NO: 3322970 - RNA, 16 nt, Human
ucuccauguuugaugu

SEQ ID NO: 3322971 - RNA, 17 nt, Human
ucucugcccuccaagac

SEQ ID NO: 3322972 - RNA, 16 nt, Human
ucucugcccuccaaga

SEQ ID NO: 3322973 - RNA, 15 nt, Human
ucucugcccuccaag

SEQ ID NO: 3322974 - RNA, 11 nt, Human
ucucugcccuc

SEQ ID NO: 3322975 - RNA, 14 nt, Human
ucucuccuguaccu

SEQ ID NO: 3322976 - RNA, 16 nt, Human
ucucuccuguaccucu

SEQ ID NO: 3322977 - RNA, 19 nt, Human
ucucuccagccccuggaug

SEQ ID NO: 3322978 - RNA, 18 nt, Human
ucucuccagccccuggau

SEQ ID NO: 3322979 - RNA, 16 nt, Human
ucucuccagccccugg

SEQ ID NO: 3322980 - RNA, 17 nt, Human
ucucuccagccccugga

SEQ ID NO: 3322981 - RNA, 21 nt, Human
ucucucaggccaaacucaccu

SEQ ID NO: 3322982 - RNA, 15 nt, Human
ucucucacuccuuga

SEQ ID NO: 3322983 - RNA, 13 nt, Human
ucucucacuccuu

SEQ ID NO: 3322984 - RNA, 16 nt, Human
acuuugaccucugcag

SEQ ID NO: 3322985 - RNA, 15 nt, Human
acuuugaccucugca

SEQ ID NO: 3322986 - RNA, 18 nt, Human
acuuugaccucugcagca

SEQ ID NO: 3322987 - RNA, 17 nt, Human
ucucuugagccugggag

SEQ ID NO: 3322988 - RNA, 18 nt, Human
ucucuugagccugggagg

SEQ ID NO: 3322989 - RNA, 16 nt, Human
ucucuugauucauaau

SEQ ID NO: 3322990 - RNA, 14 nt, Human
ucucuugauucaua

SEQ ID NO: 3322991 - RNA, 13 nt, Human
agaaaaagaaaaa

SEQ ID NO: 3322992 - RNA, 20 nt, Human
ucucuuuaaugucacaggca

SEQ ID NO: 3322993 - RNA, 17 nt, Human
agaaaaaggaugcacag

SEQ ID NO: 3322994 - RNA, 22 nt, Human
ucugagacucgcgacaaugcaa

SEQ ID NO: 3322995 - RNA, 23 nt, Human
ucugagacucgcgacaaugcaaa

SEQ ID NO: 3322996 - RNA, 17 nt, Human
ucugcacuccccugcug

SEQ ID NO: 3322997 - RNA, 19 nt, Human
ucugcacuccccugcuggg

SEQ ID NO: 3322998 - RNA, 18 nt, Human
ucugcacuccccugcugg

SEQ ID NO: 3322999 - RNA, 20 nt, Human
ucugcacuccccugcugggu

SEQ ID NO: 3323000 - RNA, 18 nt, Human
ucugcagcaauaaagcag

SEQ ID NO: 3323001 - RNA, 20 nt, Human
agaaauaucugaaaauguau

SEQ ID NO: 3323002 - RNA, 14 nt, Human
agaaauauaauuga

SEQ ID NO: 3323003 - RNA, 19 nt, Human
agaaauaucugaaaaugua

SEQ ID NO: 3323004 - RNA, 21 nt, Human
ucugaacuuggcgcugccccu

SEQ ID NO: 3323005 - RNA, 23 nt, Human
acgccagauucuuuccugaggcu

SEQ ID NO: 3323006 - RNA, 22 nt, Human
acgccagauucuuuccugaggc

SEQ ID NO: 3323007 - RNA, 16 nt, Human
ucccaaagcagugcau

SEQ ID NO: 3323008 - RNA, 18 nt, Human
ucccaaacccuucagugc

SEQ ID NO: 3323009 - RNA, 13 nt, Human
ucccaaagugcug

SEQ ID NO: 3323010 - RNA, 18 nt, Human
ucccaaagcagugcaugc

SEQ ID NO: 3323011 - RNA, 17 nt, Human
ucccaaagcagugcaug

SEQ ID NO: 3323012 - RNA, 21 nt, Human
ucccaaagcagugcaugcugu

SEQ ID NO: 3323013 - RNA, 14 nt, Human
ucccaccccacaca

SEQ ID NO: 3323014 - RNA, 20 nt, Human
acgggaggguaaggcugugg

SEQ ID NO: 3323015 - RNA, 16 nt, Human
ucccacaaaggagagc

SEQ ID NO: 3323016 - RNA, 20 nt, Human
ucccaccccacacacgccag

SEQ ID NO: 3323017 - RNA, 15 nt, Human
ucccaccccacacac

SEQ ID NO: 3323018 - RNA, 23 nt, Human
acguggcugcuucaaggauccug

SEQ ID NO: 3323019 - RNA, 15 nt, Human
acgguuuuacugcag

SEQ ID NO: 3323020 - RNA, 14 nt, Human
acguacacauuuua

SEQ ID NO: 3323021 - RNA, 22 nt, Human
ucccauaugccugggcagaagg

SEQ ID NO: 3323022 - RNA, 16 nt, Human
ucccauaugccugggc

SEQ ID NO: 3323023 - RNA, 15 nt, Human
ucccaucacccgcua

SEQ ID NO: 3323024 - RNA, 15 nt, Human
acuacauucuguuaa

SEQ ID NO: 3323025 - RNA, 17 nt, Human
uccccaccgcagacagg

SEQ ID NO: 3323026 - RNA, 21 nt, Human
uccccaccgcagacaggacca

SEQ ID NO: 3323027 - RNA, 18 nt, Human
uccccaccgcagacagga

SEQ ID NO: 3323028 - RNA, 17 nt, Human
ucccagcugugcucugg

SEQ ID NO: 3323029 - RNA, 13 nt, Human
acuacauucuguu

SEQ ID NO: 3323030 - RNA, 12 nt, Human
acuacauucugu

SEQ ID NO: 3323031 - RNA, 11 nt, Human
acuacauucug

SEQ ID NO: 3323032 - RNA, 14 nt, Human
acuacauucuguua

SEQ ID NO: 3323033 - RNA, 11 nt, Human
acuacaggcac

SEQ ID NO: 3323034 - RNA, 15 nt, Human
acuacaggcacccac

SEQ ID NO: 3323035 - RNA, 17 nt, Human
acuacaguccucccauc

SEQ ID NO: 3323036 - RNA, 14 nt, Human
acuacaguuuguua

SEQ ID NO: 3323037 - RNA, 13 nt, Human
acuacaguuuguu

SEQ ID NO: 3323038 - RNA, 15 nt, Human
acucauucuucugua

SEQ ID NO: 3323039 - RNA, 14 nt, Human
acucauugaccuga

SEQ ID NO: 3323040 - RNA, 17 nt, Human
acuccagaauuucccaa

SEQ ID NO: 3323041 - RNA, 15 nt, Human
acuccagaauuuccc

SEQ ID NO: 3323042 - RNA, 15 nt, Human
acucauugaccugag

SEQ ID NO: 3323043 - RNA, 17 nt, Human
acuccugcaggcagcca

SEQ ID NO: 3323044 - RNA, 19 nt, Human
acuccugcaggcagccagg

SEQ ID NO: 3323045 - RNA, 18 nt, Human
acuccugcaggcagccag

SEQ ID NO: 3323046 - RNA, 13 nt, Human
acuccagccuggg

SEQ ID NO: 3323047 - RNA, 23 nt, Human
acuccagaauuucccaaagcagu

SEQ ID NO: 3323048 - RNA, 12 nt, Human
acuccagccugg

SEQ ID NO: 3323049 - RNA, 12 nt, Human
ucccuuuuccuu

SEQ ID NO: 3323050 - RNA, 16 nt, Human
uccuagaaauucccca

SEQ ID NO: 3323051 - RNA, 17 nt, Human
uccggucccugucccag

SEQ ID NO: 3323052 - RNA, 21 nt, Human
acuccugcaggcagccaggcc

SEQ ID NO: 3323053 - RNA, 15 nt, Human
ucccugguggcagcu

SEQ ID NO: 3323054 - RNA, 12 nt, Human
ucccugucccag

SEQ ID NO: 3323055 - RNA, 16 nt, Human
ucccugaaggccccgc

SEQ ID NO: 3323056 - RNA, 18 nt, Human
ucccucuuucccucccuu

SEQ ID NO: 3323057 - RNA, 20 nt, Human
ucccucuuucccucccuucc

SEQ ID NO: 3323058 - RNA, 14 nt, Human
ucccucuuucccuc

SEQ ID NO: 3323059 - RNA, 15 nt, Human
ucccugaaggccccg

SEQ ID NO: 3323060 - RNA, 11 nt, Human
ucccugaaggc

SEQ ID NO: 3323061 - RNA, 20 nt, Human
ucccgaauagcugggacuac

SEQ ID NO: 3323062 - RNA, 18 nt, Human
ucccgaauagcugggacu

SEQ ID NO: 3323063 - RNA, 15 nt, Human
ucccgaguagcuggg

SEQ ID NO: 3323064 - RNA, 18 nt, Human
ucccgaguagcugggacu

SEQ ID NO: 3323065 - RNA, 16 nt, Human
ucccgaguagcuggga

SEQ ID NO: 3323066 - RNA, 17 nt, Human
ucccgaguagcugggac

SEQ ID NO: 3323067 - RNA, 12 nt, Human
acucaccccagc

SEQ ID NO: 3323068 - RNA, 21 nt, Human
acucacauuuauucugcucac

SEQ ID NO: 3323069 - RNA, 17 nt, Human
acuacucccccaggugg

SEQ ID NO: 3323070 - RNA, 17 nt, Human
accuuagacagucccug

SEQ ID NO: 3323071 - RNA, 14 nt, Human
accuuuugagugcc

SEQ ID NO: 3323072 - RNA, 20 nt, Human
accuuuugagugccuuacac

SEQ ID NO: 3323073 - RNA, 17 nt, Human
accuuuugagugccuua

SEQ ID NO: 3323074 - RNA, 19 nt, Human
uccagacccggcugcgugg

SEQ ID NO: 3323075 - RNA, 15 nt, Human
uccagacccggcugc

SEQ ID NO: 3323076 - RNA, 18 nt, Human
uccagacccggcugcgug

SEQ ID NO: 3323077 - RNA, 16 nt, Human
uccagaauuucccaaa

SEQ ID NO: 3323078 - RNA, 22 nt, Human
uccagaauuucccaaagcagug

SEQ ID NO: 3323079 - RNA, 20 nt, Human
uccagaauuucccaaagcag

SEQ ID NO: 3323080 - RNA, 14 nt, Human
uccagacccggcug

SEQ ID NO: 3323081 - RNA, 21 nt, Human
accuuuuuuauacauaaacaa

SEQ ID NO: 3323082 - RNA, 21 nt, Human
uccaggcuguaucccaugagc

SEQ ID NO: 3323083 - RNA, 20 nt, Human
accuuuuuuauacauaaaca

SEQ ID NO: 3323084 - RNA, 19 nt, Human
accuuuuuuauacauaaac

SEQ ID NO: 3323085 - RNA, 16 nt, Human
acgagcaggcuucuuc

SEQ ID NO: 3323086 - RNA, 17 nt, Human
acgccagauucuuuccu

SEQ ID NO: 3323087 - RNA, 19 nt, Human
acgccagauucuuuccuga

SEQ ID NO: 3323088 - RNA, 13 nt, Human
uccagccccugga

SEQ ID NO: 3323089 - RNA, 12 nt, Human
uccagccccugg

SEQ ID NO: 3323090 - RNA, 14 nt, Human
uccaggcuguaucc

SEQ ID NO: 3323091 - RNA, 23 nt, Human
uccaacccucaucaccaacgucu

SEQ ID NO: 3323092 - RNA, 17 nt, Human
uccaacccucaucacca

SEQ ID NO: 3323093 - RNA, 16 nt, Human
uccaacccucaucacc

SEQ ID NO: 3323094 - RNA, 14 nt, Human
uccaacccucauca

SEQ ID NO: 3323095 - RNA, 14 nt, Human
accugccaggaagc

SEQ ID NO: 3323096 - RNA, 12 nt, Human
accugccaggaa

SEQ ID NO: 3323097 - RNA, 16 nt, Human
uccaagcuggucccac

SEQ ID NO: 3323098 - RNA, 20 nt, Human
uccaagcuggucccacucag

SEQ ID NO: 3323099 - RNA, 21 nt, Human
uccaagcuggucccacucagu

SEQ ID NO: 3323100 - RNA, 18 nt, Human
uccaaggguacuaaggaa

SEQ ID NO: 3323101 - RNA, 21 nt, Human
accuggguaacuagggaagau

SEQ ID NO: 3323102 - RNA, 20 nt, Human
accuggccucugcacucccc

SEQ ID NO: 3323103 - RNA, 18 nt, Human
accuggccucugcacucc

SEQ ID NO: 3323104 - RNA, 23 nt, Human
accuggccucugcacuccccugc

SEQ ID NO: 3323105 - RNA, 19 nt, Human
accuguuucugcagccacu

SEQ ID NO: 3323106 - RNA, 18 nt, Human
accuuagacagucccugc

SEQ ID NO: 3323107 - RNA, 20 nt, Human
accuuagacagucccugcca

SEQ ID NO: 3323108 - RNA, 19 nt, Human
accuuagacagucccugcc

SEQ ID NO: 3323109 - RNA, 17 nt, Human
uccacccaccucagccu

SEQ ID NO: 3323110 - RNA, 18 nt, Human
uccacccaccucagccuc

SEQ ID NO: 3323111 - RNA, 19 nt, Human
uccacccaccucagccucc

SEQ ID NO: 3323112 - RNA, 12 nt, Human
uccacccaggag

SEQ ID NO: 3323113 - RNA, 14 nt, Human
uccacccaggagcc

SEQ ID NO: 3323114 - RNA, 15 nt, Human
uccacccaggagccc

SEQ ID NO: 3323115 - RNA, 14 nt, Human
accuggccucugca

SEQ ID NO: 3323116 - RNA, 17 nt, Human
accuggccucugcacuc

SEQ ID NO: 3323117 - RNA, 16 nt, Human
accuggccucugcacu

SEQ ID NO: 3323118 - RNA, 12 nt, Human
ucaggaagcuca

SEQ ID NO: 3323119 - RNA, 15 nt, Human
ucaggaagcucaggg

SEQ ID NO: 3323120 - RNA, 14 nt, Human
ucaggaagcucagg

SEQ ID NO: 3323121 - RNA, 13 nt, Human
ucaggaagcucag

SEQ ID NO: 3323122 - RNA, 22 nt, Human
ucauccuucuggaauaaggaga

SEQ ID NO: 3323123 - RNA, 19 nt, Human
ucauccuccucagaucuuc

SEQ ID NO: 3323124 - RNA, 13 nt, Human
ucauccuccucag

SEQ ID NO: 3323125 - RNA, 18 nt, Human
ucauccucauacccaccc

SEQ ID NO: 3323126 - RNA, 14 nt, Human
ucauccuucuggaa

SEQ ID NO: 3323127 - RNA, 13 nt, Human
accuccugccucg

SEQ ID NO: 3323128 - RNA, 12 nt, Human
accuccugccuc

SEQ ID NO: 3323129 - RNA, 23 nt, Human
accuccugccucgaacuggcugc

SEQ ID NO: 3323130 - RNA, 15 nt, Human
ucauccuaagcuauu

SEQ ID NO: 3323131 - RNA, 12 nt, Human
ucauucuucugu

SEQ ID NO: 3323132 - RNA, 13 nt, Human
ucauugaaaucuu

SEQ ID NO: 3323133 - RNA, 12 nt, Human
ucauugaaaucu

SEQ ID NO: 3323134 - RNA, 15 nt, Human
ucauugaccugaggc

SEQ ID NO: 3323135 - RNA, 14 nt, Human
ucauugaccugagg

SEQ ID NO: 3323136 - RNA, 12 nt, Human
ucauugaccuga

SEQ ID NO: 3323137 - RNA, 22 nt, Human
ucauugaaaucuuuuugcuuug

SEQ ID NO: 3323138 - RNA, 13 nt, Human
accuccugggcua

SEQ ID NO: 3323139 - RNA, 19 nt, Human
accucggugccuuccucuu

SEQ ID NO: 3323140 - RNA, 14 nt, Human
accugauugugucu

SEQ ID NO: 3323141 - RNA, 18 nt, Human
accugauugugucucuug

SEQ ID NO: 3323142 - RNA, 17 nt, Human
accugauugugucucuu

SEQ ID NO: 3323143 - RNA, 15 nt, Human
accugauugugucuc

SEQ ID NO: 3323144 - RNA, 16 nt, Human
accugaggggccucuu

SEQ ID NO: 3323145 - RNA, 21 nt, Human
accugaggcccuucucuccag

SEQ ID NO: 3323146 - RNA, 20 nt, Human
accugaggcccuucucucca

SEQ ID NO: 3323147 - RNA, 16 nt, Human
accugaggcccuucuc

SEQ ID NO: 3323148 - RNA, 15 nt, Human
accugaggcccuucu

SEQ ID NO: 3323149 - RNA, 21 nt, Human
accucuugagccuugaacuuu

SEQ ID NO: 3323150 - RNA, 14 nt, Human
accugaggcccuuc

SEQ ID NO: 3323151 - RNA, 16 nt, Human
acaucaacaucuuggu

SEQ ID NO: 3323152 - RNA, 18 nt, Human
acaucaacaucuugguca

SEQ ID NO: 3323153 - RNA, 13 nt, Human
acaucuugcucug

SEQ ID NO: 3323154 - RNA, 17 nt, Human
acaucuugcucugcuga

SEQ ID NO: 3323155 - RNA, 21 nt, Human
acaucuugcucugcugacaga

SEQ ID NO: 3323156 - RNA, 17 nt, Human
acaugaaaacacauuuu

SEQ ID NO: 3323157 - RNA, 18 nt, Human
acaucuugcucugcugac

SEQ ID NO: 3323158 - RNA, 19 nt, Human
acaucuugcucugcugaca

SEQ ID NO: 3323159 - RNA, 19 nt, Human
acaugaaaacacauuuuuc

SEQ ID NO: 3323160 - RNA, 18 nt, Human
acaugaaaacacauuuuu

SEQ ID NO: 3323161 - RNA, 16 nt, Human
acaugaaaacacauuu

SEQ ID NO: 3323162 - RNA, 16 nt, Human
acauauugauuuccgu

SEQ ID NO: 3323163 - RNA, 14 nt, Human
acauauugauuucc

SEQ ID NO: 3323164 - RNA, 23 nt, Human
acauauugauuuccguuaaaaua

SEQ ID NO: 3323165 - RNA, 22 nt, Human
acauauugauuuccguuaaaau

SEQ ID NO: 3323166 - RNA, 18 nt, Human
acauauugauuuccguua

SEQ ID NO: 3323167 - RNA, 23 nt, Human
uauuuccuauauuguuuucagug

SEQ ID NO: 3323168 - RNA, 22 nt, Human
uauuucccucaccuuucccauc

SEQ ID NO: 3323169 - RNA, 20 nt, Human
acaguugaaaaacagcugag

SEQ ID NO: 3323170 - RNA, 16 nt, Human
acaguugaaaaacagc

SEQ ID NO: 3323171 - RNA, 15 nt, Human
acaguugaaaaacag

SEQ ID NO: 3323172 - RNA, 20 nt, Human
acaguuuguuaguaugaggc

SEQ ID NO: 3323173 - RNA, 16 nt, Human
acaguuuguuaguaug

SEQ ID NO: 3323174 - RNA, 17 nt, Human
acauacucccaucugug

SEQ ID NO: 3323175 - RNA, 14 nt, Human
acauacucugcuua

SEQ ID NO: 3323176 - RNA, 13 nt, Human
acauacucccauc

SEQ ID NO: 3323177 - RNA, 22 nt, Human
acauacuaaccagcagaaaugc

SEQ ID NO: 3323178 - RNA, 21 nt, Human
acauacuaaccagcagaaaug

SEQ ID NO: 3323179 - RNA, 13 nt, Human
acauacuaaccag

SEQ ID NO: 3323180 - RNA, 19 nt, Human
acaugagcaucaggccagg

SEQ ID NO: 3323181 - RNA, 18 nt, Human
acaugagcaucaggccag

SEQ ID NO: 3323182 - RNA, 17 nt, Human
acaugagcaucaggcca

SEQ ID NO: 3323183 - RNA, 15 nt, Human
acaugaucuucuuua

SEQ ID NO: 3323184 - RNA, 17 nt, Human
acaugaucuucuuuaua

SEQ ID NO: 3323185 - RNA, 22 nt, Human
acaugcuacacacugcauguuu

SEQ ID NO: 3323186 - RNA, 18 nt, Human
ucaaauaacuaaaaggua

SEQ ID NO: 3323187 - RNA, 11 nt, Human
ucaaguauuau

SEQ ID NO: 3323188 - RNA, 15 nt, Human
ucaaguauuauaccu

SEQ ID NO: 3323189 - RNA, 23 nt, Human
ucaaguauuauaccuuuuuuaga

SEQ ID NO: 3323190 - RNA, 21 nt, Human
ucaaguauuauaccuuuuuua

SEQ ID NO: 3323191 - RNA, 16 nt, Human
ucaaguauuauaccuu

SEQ ID NO: 3323192 - RNA, 16 nt, Human
ucaacagguuuuccug

SEQ ID NO: 3323193 - RNA, 17 nt, Human
ucaaauuucuaaaucuc

SEQ ID NO: 3323194 - RNA, 12 nt, Human
acauucuguuaa

SEQ ID NO: 3323195 - RNA, 14 nt, Human
ucaaauuucuaaau

SEQ ID NO: 3323196 - RNA, 15 nt, Human
acauucuguuaauca

SEQ ID NO: 3323197 - RNA, 16 nt, Human
ucaaauuucuaaaucu

SEQ ID NO: 3323198 - RNA, 15 nt, Human
ucaaauuucuaaauc

SEQ ID NO: 3323199 - RNA, 19 nt, Human
acauguccaagaagcccag

SEQ ID NO: 3323200 - RNA, 21 nt, Human
acauguccaagaagcccagga

SEQ ID NO: 3323201 - RNA, 10 nt, Human
acccacugcu

SEQ ID NO: 3323202 - RNA, 11 nt, Human
acccacugcuc

SEQ ID NO: 3323203 - RNA, 13 nt, Human
acccacugcucug

SEQ ID NO: 3323204 - RNA, 14 nt, Human
acccacugcucugg

SEQ ID NO: 3323205 - RNA, 15 nt, Human
acccacugcucuggu

SEQ ID NO: 3323206 - RNA, 21 nt, Human
ucacucuuauugcccacgcug

SEQ ID NO: 3323207 - RNA, 23 nt, Human
ucacucuuauugcccacgcugga

SEQ ID NO: 3323208 - RNA, 22 nt, Human
accauggucggaaaacaugcua

SEQ ID NO: 3323209 - RNA, 18 nt, Human
ucagaaucucaaauaacu

SEQ ID NO: 3323210 - RNA, 19 nt, Human
ucagaaucucaaauaacua

SEQ ID NO: 3323211 - RNA, 16 nt, Human
ucagagacuccugcag

SEQ ID NO: 3323212 - RNA, 21 nt, Human
ucagagacuccugcaggcagc

SEQ ID NO: 3323213 - RNA, 20 nt, Human
ucagagacuccugcaggcag

SEQ ID NO: 3323214 - RNA, 17 nt, Human
ucagagacuccugcagg

SEQ ID NO: 3323215 - RNA, 12 nt, Human
ucagagccugca

SEQ ID NO: 3323216 - RNA, 21 nt, Human
ucagagagggugggagugggc

SEQ ID NO: 3323217 - RNA, 16 nt, Human
ucagagagggugggag

SEQ ID NO: 3323218 - RNA, 13 nt, Human
ucagagccugcag

SEQ ID NO: 3323219 - RNA, 14 nt, Human
ucagagccugcagu

SEQ ID NO: 3323220 - RNA, 15 nt, Human
ucagagccugcaguu

SEQ ID NO: 3323221 - RNA, 18 nt, Human
ucagagccugcaguuauu

SEQ ID NO: 3323222 - RNA, 14 nt, Human
ucagaagacacuga

SEQ ID NO: 3323223 - RNA, 22 nt, Human
ucagaaguuucugccgcagccc

SEQ ID NO: 3323224 - RNA, 19 nt, Human
ucagaaguuucugccgcag

SEQ ID NO: 3323225 - RNA, 14 nt, Human
ucagcggggacagc

SEQ ID NO: 3323226 - RNA, 14 nt, Human
accccuucgcuccu

SEQ ID NO: 3323227 - RNA, 15 nt, Human
accccuucgcuccug

SEQ ID NO: 3323228 - RNA, 12 nt, Human
acccccacccaa

SEQ ID NO: 3323229 - RNA, 22 nt, Human
ucagccaagaauucuuaaauau

SEQ ID NO: 3323230 - RNA, 19 nt, Human
acccagcgagcccuggugg

SEQ ID NO: 3323231 - RNA, 23 nt, Human
acccagcgagcccugguggcagu

SEQ ID NO: 3323232 - RNA, 23 nt, Human
ucagccguguaaccauggaccca

SEQ ID NO: 3323233 - RNA, 24 nt, Human
acccagcgagcccugguggcagug

SEQ ID NO: 3323234 - RNA, 15 nt, Human
ucacaguucucuccu

SEQ ID NO: 3323235 - RNA, 12 nt, Human
ucacauaucugu

SEQ ID NO: 3323236 - RNA, 15 nt, Human
ucacauaucugucau

SEQ ID NO: 3323237 - RNA, 13 nt, Human
ucaccccagcccc

SEQ ID NO: 3323238 - RNA, 20 nt, Human
ucaccccagccccaaaacuc

SEQ ID NO: 3323239 - RNA, 14 nt, Human
ucaccccagcccca

SEQ ID NO: 3323240 - RNA, 15 nt, Human
ucaccccggccaccu

SEQ ID NO: 3323241 - RNA, 15 nt, Human
accaauguucucucu

SEQ ID NO: 3323242 - RNA, 15 nt, Human
ucaagugaaaaagga

SEQ ID NO: 3323243 - RNA, 23 nt, Human
ucaagugaaaaaggaggaagaga

SEQ ID NO: 3323244 - RNA, 22 nt, Human
accaacauacucccaucuguga

SEQ ID NO: 3323245 - RNA, 21 nt, Human
accaacauacucccaucugug

SEQ ID NO: 3323246 - RNA, 19 nt, Human
accaacauacucccaucug

SEQ ID NO: 3323247 - RNA, 17 nt, Human
accaacauacucccauc

SEQ ID NO: 3323248 - RNA, 18 nt, Human
ucacuauguugcccaggc

SEQ ID NO: 3323249 - RNA, 17 nt, Human
ucacuauguugcccagg

SEQ ID NO: 3323250 - RNA, 19 nt, Human
ucacuauguugcccaggca

SEQ ID NO: 3323251 - RNA, 15 nt, Human
ucaccugccccucaa

SEQ ID NO: 3323252 - RNA, 13 nt, Human
ucaccugccccuc

SEQ ID NO: 3323253 - RNA, 15 nt, Human
ucaccucucccuugg

SEQ ID NO: 3323254 - RNA, 21 nt, Human
accacugcacuccagccuggg

SEQ ID NO: 3323255 - RNA, 18 nt, Human
ucaccccggccaccugcg

SEQ ID NO: 3323256 - RNA, 17 nt, Human
ucaccccggccaccugc

SEQ ID NO: 3323257 - RNA, 20 nt, Human
accacugcacuccagccugg

SEQ ID NO: 3323258 - RNA, 17 nt, Human
accacugcacuccagcc

SEQ ID NO: 3323259 - RNA, 15 nt, Human
accacuucagcugac

SEQ ID NO: 3323260 - RNA, 21 nt, Human
accacuuuuguucuugguuug

SEQ ID NO: 3323261 - RNA, 16 nt, Human
accacuuuuguucuug

SEQ ID NO: 3323262 - RNA, 15 nt, Human
accacuuuuguucuu

SEQ ID NO: 3323263 - RNA, 14 nt, Human
accagacaccuuga

SEQ ID NO: 3323264 - RNA, 11 nt, Human
accagacaggu

SEQ ID NO: 3323265 - RNA, 12 nt, Human
accagagcccac

SEQ ID NO: 3323266 - RNA, 14 nt, Human
accagagcccaccu

SEQ ID NO: 3323267 - RNA, 16 nt, Human
accagagcccaccuug

SEQ ID NO: 3323268 - RNA, 22 nt, Human
accacuuuuguucuugguuugu

SEQ ID NO: 3323269 - RNA, 23 nt, Human
uguggguuucuaaagcugccagc

SEQ ID NO: 3323270 - RNA, 21 nt, Human
uguggguuucuaaagcugcca

SEQ ID NO: 3323271 - RNA, 15 nt, Human
uguggucccacccca

SEQ ID NO: 3323272 - RNA, 13 nt, Human
uguggucccaccc

SEQ ID NO: 3323273 - RNA, 16 nt, Human
ugugguguuuccuggc

SEQ ID NO: 3323274 - RNA, 14 nt, Human
ugugguguuuccug

SEQ ID NO: 3323275 - RNA, 20 nt, Human
agugcugggauuacaggugu

SEQ ID NO: 3323276 - RNA, 19 nt, Human
agugcugcauuuaaaagau

SEQ ID NO: 3323277 - RNA, 17 nt, Human
agugcugcauuuaaaag

SEQ ID NO: 3323278 - RNA, 16 nt, Human
agugcugcauuuaaaa

SEQ ID NO: 3323279 - RNA, 21 nt, Human
agugcugggauuacaggugug

SEQ ID NO: 3323280 - RNA, 13 nt, Human
agugcugcauuua

SEQ ID NO: 3323281 - RNA, 12 nt, Human
agugcugcauuu

SEQ ID NO: 3323282 - RNA, 23 nt, Human
agugaguugauagcacagacccu

SEQ ID NO: 3323283 - RNA, 22 nt, Human
agugaguugauagcacagaccc

SEQ ID NO: 3323284 - RNA, 11 nt, Human
uguguguuuau

SEQ ID NO: 3323285 - RNA, 23 nt, Human
uguguguuuauugucaaaguggu

SEQ ID NO: 3323286 - RNA, 19 nt, Human
uguguguuuauugucaaag

SEQ ID NO: 3323287 - RNA, 20 nt, Human
ugugucucuugguccugcug

SEQ ID NO: 3323288 - RNA, 17 nt, Human
ugugucucuugguccug

SEQ ID NO: 3323289 - RNA, 16 nt, Human
ugugucucuugguccu

SEQ ID NO: 3323290 - RNA, 21 nt, Human
ugugucuugcaauggcagccu

SEQ ID NO: 3323291 - RNA, 20 nt, Human
ugugucuugcaauggcagcc

SEQ ID NO: 3323292 - RNA, 21 nt, Human
ugugucucuugguccugcugc

SEQ ID NO: 3323293 - RNA, 17 nt, Human
agugugguguuuccugg

SEQ ID NO: 3323294 - RNA, 19 nt, Human
agugugguguuuccuggca

SEQ ID NO: 3323295 - RNA, 16 nt, Human
agugugguguuuccug

SEQ ID NO: 3323296 - RNA, 21 nt, Human
agugguggugaacagaacaaa

SEQ ID NO: 3323297 - RNA, 18 nt, Human
aguggugguuuucuguuc

SEQ ID NO: 3323298 - RNA, 17 nt, Human
aguggugguuuucuguu

SEQ ID NO: 3323299 - RNA, 23 nt, Human
aguggugguuuucuguucuuucu

SEQ ID NO: 3323300 - RNA, 21 nt, Human
aguggugguuuucuguucuuu

SEQ ID NO: 3323301 - RNA, 20 nt, Human
aguggugguuuucuguucuu

SEQ ID NO: 3323302 - RNA, 19 nt, Human
aguggugguuuucuguucu

SEQ ID NO: 3323303 - RNA, 16 nt, Human
aguggugcgaucuggg

SEQ ID NO: 3323304 - RNA, 17 nt, Human
aguggugcgaucugggu

SEQ ID NO: 3323305 - RNA, 20 nt, Human
agugugucuuagugugugca

SEQ ID NO: 3323306 - RNA, 19 nt, Human
uguuccacaaguuaaauaa

SEQ ID NO: 3323307 - RNA, 20 nt, Human
uguuccacaaguuaaauaaa

SEQ ID NO: 3323308 - RNA, 15 nt, Human
uguucugggacacag

SEQ ID NO: 3323309 - RNA, 16 nt, Human
uguucugggacacagu

SEQ ID NO: 3323310 - RNA, 13 nt, Human
uguugcccaggca

SEQ ID NO: 3323311 - RNA, 12 nt, Human
uguugcccaggc

SEQ ID NO: 3323312 - RNA, 15 nt, Human
uguugcccaggcagg

SEQ ID NO: 3323313 - RNA, 16 nt, Human
uguugcccaggcaggu

SEQ ID NO: 3323314 - RNA, 17 nt, Human
uguugcccaggcagguc

SEQ ID NO: 3323315 - RNA, 18 nt, Human
uguugcccaggcaggucu

SEQ ID NO: 3323316 - RNA, 18 nt, Human
ugugauggggcccugccu

SEQ ID NO: 3323317 - RNA, 20 nt, Human
ugugauggggcccugccucc

SEQ ID NO: 3323318 - RNA, 19 nt, Human
ugugauggggcccugccuc

SEQ ID NO: 3323319 - RNA, 23 nt, Human
ugugcauuuggugguuucagaaa

SEQ ID NO: 3323320 - RNA, 20 nt, Human
ugugccagguuuuuggucug

SEQ ID NO: 3323321 - RNA, 12 nt, Human
ugugccaugugc

SEQ ID NO: 3323322 - RNA, 16 nt, Human
ugugccaugugccagg

SEQ ID NO: 3323323 - RNA, 21 nt, Human
uguggaguucaucuugaauug

SEQ ID NO: 3323324 - RNA, 17 nt, Human
uguggaguucaucuuga

SEQ ID NO: 3323325 - RNA, 21 nt, Human
ugugcugcccugcccaccugg

SEQ ID NO: 3323326 - RNA, 21 nt, Human
ugugcccccauguaagcaccc

SEQ ID NO: 3323327 - RNA, 17 nt, Human
agugaggcucugcccuu

SEQ ID NO: 3323328 - RNA, 16 nt, Human
agugaggcucugcccu

SEQ ID NO: 3323329 - RNA, 14 nt, Human
agugaggcucugcc

SEQ ID NO: 3323330 - RNA, 15 nt, Human
agugaggcucugccc

SEQ ID NO: 3323331 - RNA, 15 nt, Human
agugagucgaggaca

SEQ ID NO: 3323332 - RNA, 21 nt, Human
agugaguugauagcacagacc

SEQ ID NO: 3323333 - RNA, 21 nt, Human
agugaggcucugcccuugguu

SEQ ID NO: 3323334 - RNA, 20 nt, Human
agugaggcucugcccuuggu

SEQ ID NO: 3323335 - RNA, 19 nt, Human
agugaggcucugcccuugg

SEQ ID NO: 3323336 - RNA, 15 nt, Human
ugugacugaauuucu

SEQ ID NO: 3323337 - RNA, 16 nt, Human
ugugacugaauuucuu

SEQ ID NO: 3323338 - RNA, 14 nt, Human
agucuuuguacaga

SEQ ID NO: 3323339 - RNA, 23 nt, Human
agucuuagauguauauauuuccu

SEQ ID NO: 3323340 - RNA, 17 nt, Human
ugugaaccaccacaccc

SEQ ID NO: 3323341 - RNA, 20 nt, Human
ugugaaccaccacacccagc

SEQ ID NO: 3323342 - RNA, 19 nt, Human
ugugaaccaccacacccag

SEQ ID NO: 3323343 - RNA, 15 nt, Human
ugugaaaggaaagag

SEQ ID NO: 3323344 - RNA, 21 nt, Human
ugugaaaggaaagagggaggu

SEQ ID NO: 3323345 - RNA, 18 nt, Human
ugugaaaggaaagaggcu

SEQ ID NO: 3323346 - RNA, 11 nt, Human
uuagacagagu

SEQ ID NO: 3323347 - RNA, 11 nt, Human
uuagaaauaua

SEQ ID NO: 3323348 - RNA, 12 nt, Human
uuagaaauauaa

SEQ ID NO: 3323349 - RNA, 14 nt, Human
uuagaaauauaauu

SEQ ID NO: 3323350 - RNA, 20 nt, Human
uuacauaagauaaaugugcu

SEQ ID NO: 3323351 - RNA, 19 nt, Human
uuacuauggcccuggccua

SEQ ID NO: 3323352 - RNA, 23 nt, Human
uuacucagaauucucuaguuuga

SEQ ID NO: 3323353 - RNA, 18 nt, Human
uuacucagaauucucuag

SEQ ID NO: 3323354 - RNA, 14 nt, Human
uuacaggaaguacu

SEQ ID NO: 3323355 - RNA, 16 nt, Human
auaacuaaaagguaug

SEQ ID NO: 3323356 - RNA, 15 nt, Human
uuaauucuuagcuca

SEQ ID NO: 3323357 - RNA, 23 nt, Human
uuaaugaaagacuguacaaagua

SEQ ID NO: 3323358 - RNA, 20 nt, Human
uuaaugaaagacuguacaaa

SEQ ID NO: 3323359 - RNA, 19 nt, Human
uuaauuuuuuugagacaga

SEQ ID NO: 3323360 - RNA, 23 nt, Human
auaaacaagaccacguuucuaaa

SEQ ID NO: 3323361 - RNA, 22 nt, Human
auaaacaagaccacguuucuaa

SEQ ID NO: 3323362 - RNA, 15 nt, Human
auaaacaagaccacg

SEQ ID NO: 3323363 - RNA, 13 nt, Human
uuaagaggcaggg

SEQ ID NO: 3323364 - RNA, 15 nt, Human
uuaagaggcaggguc

SEQ ID NO: 3323365 - RNA, 16 nt, Human
uuaagaggcagggucu

SEQ ID NO: 3323366 - RNA, 17 nt, Human
uuaaguacuauguauca

SEQ ID NO: 3323367 - RNA, 22 nt, Human
uuaagugcugcauuuaaaagau

SEQ ID NO: 3323368 - RNA, 20 nt, Human
uuaaauucuugcaaaguauc

SEQ ID NO: 3323369 - RNA, 23 nt, Human
aguuguuugauucagacagcugc

SEQ ID NO: 3323370 - RNA, 21 nt, Human
aguuguuugauucagacagcu

SEQ ID NO: 3323371 - RNA, 18 nt, Human
aguuggucccccuuccau

SEQ ID NO: 3323372 - RNA, 16 nt, Human
aguuggcuaggacccc

SEQ ID NO: 3323373 - RNA, 17 nt, Human
aguuggguggaugccug

SEQ ID NO: 3323374 - RNA, 21 nt, Human
aguuggguggaugccuggugg

SEQ ID NO: 3323375 - RNA, 19 nt, Human
uguuuauugucaaaguggu

SEQ ID NO: 3323376 - RNA, 17 nt, Human
uguuuauugucaaagug

SEQ ID NO: 3323377 - RNA, 19 nt, Human
uguugcccaggcaggucuu

SEQ ID NO: 3323378 - RNA, 22 nt, Human
uguuugauucagacagcugccu

SEQ ID NO: 3323379 - RNA, 17 nt, Human
uguuugauucagacagc

SEQ ID NO: 3323380 - RNA, 14 nt, Human
aguucugguuccua

SEQ ID NO: 3323381 - RNA, 15 nt, Human
uguuuucucuugaga

SEQ ID NO: 3323382 - RNA, 20 nt, Human
uguuuuccaugaguccccug

SEQ ID NO: 3323383 - RNA, 17 nt, Human
uguuuucaguguacaug

SEQ ID NO: 3323384 - RNA, 14 nt, Human
ugggacuacaggca

SEQ ID NO: 3323385 - RNA, 15 nt, Human
ugggacuacaggcac

SEQ ID NO: 3323386 - RNA, 22 nt, Human
ugggagaaccaaaaagaggcua

SEQ ID NO: 3323387 - RNA, 20 nt, Human
ugggacucaaugcacugaca

SEQ ID NO: 3323388 - RNA, 18 nt, Human
ugggacucaaugcacuga

SEQ ID NO: 3323389 - RNA, 16 nt, Human
ugggagagccuuccag

SEQ ID NO: 3323390 - RNA, 18 nt, Human
ugggaggaucucuugagc

SEQ ID NO: 3323391 - RNA, 21 nt, Human
ugggagagaagagaaugcaca

SEQ ID NO: 3323392 - RNA, 19 nt, Human
ugggagagaagagaaugca

SEQ ID NO: 3323393 - RNA, 22 nt, Human
agggaaggauacaaaagcaugu

SEQ ID NO: 3323394 - RNA, 21 nt, Human
aggcccggcuccaggcuccuu

SEQ ID NO: 3323395 - RNA, 18 nt, Human
aggcccggcuccaggcuc

SEQ ID NO: 3323396 - RNA, 20 nt, Human
aggcccggcuccaggcuccu

SEQ ID NO: 3323397 - RNA, 16 nt, Human
agggagggcuccagac

SEQ ID NO: 3323398 - RNA, 15 nt, Human
agggagggcuccaga

SEQ ID NO: 3323399 - RNA, 14 nt, Human
agggagggcuccag

SEQ ID NO: 3323400 - RNA, 19 nt, Human
agggcucagcggggacagc

SEQ ID NO: 3323401 - RNA, 20 nt, Human
agggcucagcggggacagcu

SEQ ID NO: 3323402 - RNA, 22 nt, Human
agggcucagcggggacagcucc

SEQ ID NO: 3323403 - RNA, 23 nt, Human
agggcucagcggggacagcuccu

SEQ ID NO: 3323404 - RNA, 20 nt, Human
ugggaggccaaggugggagg

SEQ ID NO: 3323405 - RNA, 22 nt, Human
ugggaggauugcuugagcucag

SEQ ID NO: 3323406 - RNA, 19 nt, Human
ugggaggccaaggugggag

SEQ ID NO: 3323407 - RNA, 21 nt, Human
ugggaggaucucuugagccug

SEQ ID NO: 3323408 - RNA, 20 nt, Human
ugggaggaucucuugagccu

SEQ ID NO: 3323409 - RNA, 23 nt, Human
ugggcagaaggaagacuucaucc

SEQ ID NO: 3323410 - RNA, 12 nt, Human
ugggcagaagga

SEQ ID NO: 3323411 - RNA, 18 nt, Human
ugggccaggagccuccug

SEQ ID NO: 3323412 - RNA, 12 nt, Human
ugggcagagcag

SEQ ID NO: 3323413 - RNA, 11 nt, Human
ugggcagagca

SEQ ID NO: 3323414 - RNA, 16 nt, Human
ugggcccccaaaugga

SEQ ID NO: 3323415 - RNA, 21 nt, Human
ugggcccccaaauggaaaugg

SEQ ID NO: 3323416 - RNA, 13 nt, Human
agggagggcucca

SEQ ID NO: 3323417 - RNA, 15 nt, Human
agggagggagggcuc

SEQ ID NO: 3323418 - RNA, 23 nt, Human
uggggcugcaccggcuggccugg

SEQ ID NO: 3323419 - RNA, 22 nt, Human
uggggcugcaccggcuggccug

SEQ ID NO: 3323420 - RNA, 21 nt, Human
uggggccaguuggucccccuu

SEQ ID NO: 3323421 - RNA, 12 nt, Human
uggggcccugcc

SEQ ID NO: 3323422 - RNA, 16 nt, Human
uggggaccucaggccu

SEQ ID NO: 3323423 - RNA, 15 nt, Human
uggggaccucaggcc

SEQ ID NO: 3323424 - RNA, 14 nt, Human
uggggaccucaggc

SEQ ID NO: 3323425 - RNA, 12 nt, Human
agggcuccagac

SEQ ID NO: 3323426 - RNA, 13 nt, Human
aggggaaaagagg

SEQ ID NO: 3323427 - RNA, 14 nt, Human
aggggaacagacug

SEQ ID NO: 3323428 - RNA, 22 nt, Human
aggggaaaaucagccugcucca

SEQ ID NO: 3323429 - RNA, 18 nt, Human
aggggaaaaucagccugc

SEQ ID NO: 3323430 - RNA, 13 nt, Human
aggggaauguuug

SEQ ID NO: 3323431 - RNA, 17 nt, Human
ugggguacccacugcuc

SEQ ID NO: 3323432 - RNA, 18 nt, Human
ugggguacccacugcucu

SEQ ID NO: 3323433 - RNA, 19 nt, Human
ugggguacccacugcucug

SEQ ID NO: 3323434 - RNA, 15 nt, Human
ugggguaugggagag

SEQ ID NO: 3323435 - RNA, 14 nt, Human
uggggucacucugg

SEQ ID NO: 3323436 - RNA, 13 nt, Human
uggggucacucug

SEQ ID NO: 3323437 - RNA, 20 nt, Human
uggggucacucuggcagcuc

SEQ ID NO: 3323438 - RNA, 22 nt, Human
uggggucacucuggcagcucag

SEQ ID NO: 3323439 - RNA, 21 nt, Human
aggggaauguuugccucugcc

SEQ ID NO: 3323440 - RNA, 23 nt, Human
aggggagcaaaaucgaugcagug

SEQ ID NO: 3323441 - RNA, 19 nt, Human
aggggaauguuugccucug

SEQ ID NO: 3323442 - RNA, 20 nt, Human
aggggaauguuugccucugc

SEQ ID NO: 3323443 - RNA, 15 nt, Human
aggguaaggcugugg

SEQ ID NO: 3323444 - RNA, 14 nt, Human
agggucucacucug

SEQ ID NO: 3323445 - RNA, 15 nt, Human
agggucucacucugu

SEQ ID NO: 3323446 - RNA, 16 nt, Human
agggucucacucuguc

SEQ ID NO: 3323447 - RNA, 23 nt, Human
agggucucacuauguugcccagg

SEQ ID NO: 3323448 - RNA, 18 nt, Human
aggggguggccucccaac

SEQ ID NO: 3323449 - RNA, 20 nt, Human
aggggguggccucccaacuc

SEQ ID NO: 3323450 - RNA, 15 nt, Human
agggugggagugggc

SEQ ID NO: 3323451 - RNA, 16 nt, Human
aggguggugaccucug

SEQ ID NO: 3323452 - RNA, 20 nt, Human
ugguagagugugccugaagu

SEQ ID NO: 3323453 - RNA, 21 nt, Human
uggguggcaccagcagccugg

SEQ ID NO: 3323454 - RNA, 20 nt, Human
uggguggcaccagcagccug

SEQ ID NO: 3323455 - RNA, 17 nt, Human
uggguggcaccagcagc

SEQ ID NO: 3323456 - RNA, 17 nt, Human
uguaucaaugaguaaca

SEQ ID NO: 3323457 - RNA, 16 nt, Human
uguauuuuuuuacuaa

SEQ ID NO: 3323458 - RNA, 19 nt, Human
uguauucucuccuguaccu

SEQ ID NO: 3323459 - RNA, 17 nt, Human
ugucaauuacaggaagu

SEQ ID NO: 3323460 - RNA, 15 nt, Human
ugucaauuacaggaa

SEQ ID NO: 3323461 - RNA, 14 nt, Human
ugucaauuacagga

SEQ ID NO: 3323462 - RNA, 18 nt, Human
aguauuacuucugcuaca

SEQ ID NO: 3323463 - RNA, 15 nt, Human
aguauuacuucugcu

SEQ ID NO: 3323464 - RNA, 15 nt, Human
aguaugguggcuggg

SEQ ID NO: 3323465 - RNA, 16 nt, Human
aguaugguggcugggu

SEQ ID NO: 3323466 - RNA, 23 nt, Human
agucacacaguauuacuucugcu

SEQ ID NO: 3323467 - RNA, 14 nt, Human
aguaugguggcugg

SEQ ID NO: 3323468 - RNA, 19 nt, Human
agucaccccggccaccugc

SEQ ID NO: 3323469 - RNA, 15 nt, Human
agucacacagugagu

SEQ ID NO: 3323470 - RNA, 23 nt, Human
agucacacagugagucgaggaca

SEQ ID NO: 3323471 - RNA, 16 nt, Human
uguagagccagggucu

SEQ ID NO: 3323472 - RNA, 18 nt, Human
uguagagccagggucuca

SEQ ID NO: 3323473 - RNA, 15 nt, Human
aguaauaugcacaca

SEQ ID NO: 3323474 - RNA, 14 nt, Human
aguaauaugcacac

SEQ ID NO: 3323475 - RNA, 20 nt, Human
uguaggcauaaagucagggg

SEQ ID NO: 3323476 - RNA, 17 nt, Human
uguaggcauaaagucag

SEQ ID NO: 3323477 - RNA, 11 nt, Human
aguagagacag

SEQ ID NO: 3323478 - RNA, 17 nt, Human
aguagaagucuuagaug

SEQ ID NO: 3323479 - RNA, 21 nt, Human
aguagaagucuuagauguaua

SEQ ID NO: 3323480 - RNA, 19 nt, Human
aguagaagucuuagaugua

SEQ ID NO: 3323481 - RNA, 20 nt, Human
aguagaagucuuagauguau

SEQ ID NO: 3323482 - RNA, 15 nt, Human
uguaaauagcucagg

SEQ ID NO: 3323483 - RNA, 16 nt, Human
uguaaauagcucaggu

SEQ ID NO: 3323484 - RNA, 14 nt, Human
ugguuuucaaaaua

SEQ ID NO: 3323485 - RNA, 15 nt, Human
ugguuuguaaauuaa

SEQ ID NO: 3323486 - RNA, 15 nt, Human
ugguuuucaaaauaa

SEQ ID NO: 3323487 - RNA, 17 nt, Human
ugguuuucaaaauaaaa

SEQ ID NO: 3323488 - RNA, 12 nt, Human
aggugugcucug

SEQ ID NO: 3323489 - RNA, 14 nt, Human
agguuuaagcuguu

SEQ ID NO: 3323490 - RNA, 20 nt, Human
aggugucccugcacuugcag

SEQ ID NO: 3323491 - RNA, 19 nt, Human
agguggggucacucuggca

SEQ ID NO: 3323492 - RNA, 17 nt, Human
aggugugaaccaccaca

SEQ ID NO: 3323493 - RNA, 15 nt, Human
aggugugcucugauc

SEQ ID NO: 3323494 - RNA, 20 nt, Human
aggugugcucugaucaucca

SEQ ID NO: 3323495 - RNA, 15 nt, Human
aggugggauccucca

SEQ ID NO: 3323496 - RNA, 18 nt, Human
aggugccucaagagaagg

SEQ ID NO: 3323497 - RNA, 16 nt, Human
agguggggcagcuuga

SEQ ID NO: 3323498 - RNA, 23 nt, Human
agguggggcagcuugaggguugg

SEQ ID NO: 3323499 - RNA, 17 nt, Human
aggugggauccuccagg

SEQ ID NO: 3323500 - RNA, 16 nt, Human
aggugggauccuccag

SEQ ID NO: 3323501 - RNA, 14 nt, Human
aggugauccaccca

SEQ ID NO: 3323502 - RNA, 20 nt, Human
aggugauccacccaccucag

SEQ ID NO: 3323503 - RNA, 22 nt, Human
aggugacagagugagacucugu

SEQ ID NO: 3323504 - RNA, 13 nt, Human
aggugaccccagg

SEQ ID NO: 3323505 - RNA, 17 nt, Human
aggucuugaacuccugg

SEQ ID NO: 3323506 - RNA, 13 nt, Human
aggugacagagug

SEQ ID NO: 3323507 - RNA, 15 nt, Human
aggugacagagugag

SEQ ID NO: 3323508 - RNA, 23 nt, Human
aggugagaagcagaggaaggaga

SEQ ID NO: 3323509 - RNA, 21 nt, Human
aggugagaagcagaggaagga

SEQ ID NO: 3323510 - RNA, 16 nt, Human
aggugagaagcagagg

SEQ ID NO: 3323511 - RNA, 16 nt, Human
aggucuugaacuccug

SEQ ID NO: 3323512 - RNA, 14 nt, Human
aggucagagccugc

SEQ ID NO: 3323513 - RNA, 15 nt, Human
aggucagagccugca

SEQ ID NO: 3323514 - RNA, 17 nt, Human
aggucagagccugcagu

SEQ ID NO: 3323515 - RNA, 18 nt, Human
aggucagagccugcaguu

SEQ ID NO: 3323516 - RNA, 13 nt, Human
aggucagagccug

SEQ ID NO: 3323517 - RNA, 16 nt, Human
uggucagauuugaacu

SEQ ID NO: 3323518 - RNA, 15 nt, Human
uggucagauuugaac

SEQ ID NO: 3323519 - RNA, 20 nt, Human
ugguuaggcauugugggaag

SEQ ID NO: 3323520 - RNA, 18 nt, Human
ugguuaggcauuguggga

SEQ ID NO: 3323521 - RNA, 14 nt, Human
ugguggcagcugcg

SEQ ID NO: 3323522 - RNA, 13 nt, Human
ugguggcagcugc

SEQ ID NO: 3323523 - RNA, 15 nt, Human
ugguggcagcugcgg

SEQ ID NO: 3323524 - RNA, 19 nt, Human
uggugucgggcaugacacg

SEQ ID NO: 3323525 - RNA, 16 nt, Human
uggugcgaucuggguu

SEQ ID NO: 3323526 - RNA, 17 nt, Human
uggugcgaucuggguuc

SEQ ID NO: 3323527 - RNA, 18 nt, Human
aggcauugugggaagggg

SEQ ID NO: 3323528 - RNA, 22 nt, Human
aggcauaaagucagggguuccc

SEQ ID NO: 3323529 - RNA, 17 nt, Human
aggcaggugggauggau

SEQ ID NO: 3323530 - RNA, 15 nt, Human
aggcauaaagucagg

SEQ ID NO: 3323531 - RNA, 12 nt, Human
aggcagggucuc

SEQ ID NO: 3323532 - RNA, 22 nt, Human
aggcaggucuugaacuccuggc

SEQ ID NO: 3323533 - RNA, 12 nt, Human
aggcaggauggc

SEQ ID NO: 3323534 - RNA, 14 nt, Human
uggagaaaauggac

SEQ ID NO: 3323535 - RNA, 15 nt, Human
aggauugcuacuguc

SEQ ID NO: 3323536 - RNA, 17 nt, Human
aggauugcuacuguccu

SEQ ID NO: 3323537 - RNA, 18 nt, Human
aggauugcuacuguccua

SEQ ID NO: 3323538 - RNA, 17 nt, Human
aggcaagcaccuccugc

SEQ ID NO: 3323539 - RNA, 20 nt, Human
aggcaagcaccuccugccuc

SEQ ID NO: 3323540 - RNA, 18 nt, Human
aggcaagcaccuccugcc

SEQ ID NO: 3323541 - RNA, 19 nt, Human
aggcaagcaccuccugccu

SEQ ID NO: 3323542 - RNA, 16 nt, Human
aggcaaggcugucaau

SEQ ID NO: 3323543 - RNA, 20 nt, Human
uggagguacgaaaagagggg

SEQ ID NO: 3323544 - RNA, 20 nt, Human
aggcauuugcugaauacaga

SEQ ID NO: 3323545 - RNA, 16 nt, Human
aggcauuugcugaaua

SEQ ID NO: 3323546 - RNA, 14 nt, Human
uggagugcagugag

SEQ ID NO: 3323547 - RNA, 20 nt, Human
uggaugccugguggcagcug

SEQ ID NO: 3323548 - RNA, 21 nt, Human
uggaugccugguggcagcugc

SEQ ID NO: 3323549 - RNA, 23 nt, Human
uggaugccugguggcagcugcgg

SEQ ID NO: 3323550 - RNA, 21 nt, Human
uggcacaucagcacgauuucu

SEQ ID NO: 3323551 - RNA, 23 nt, Human
uggcacaucagcacgauuucugu

SEQ ID NO: 3323552 - RNA, 14 nt, Human
aggccccgcccagg

SEQ ID NO: 3323553 - RNA, 13 nt, Human
aggcccggcucca

SEQ ID NO: 3323554 - RNA, 17 nt, Human
aggcccggcuccaggcu

SEQ ID NO: 3323555 - RNA, 13 nt, Human
aggcccagagggc

SEQ ID NO: 3323556 - RNA, 16 nt, Human
uggcacccggccccug

SEQ ID NO: 3323557 - RNA, 18 nt, Human
uggcacccggccccugcu

SEQ ID NO: 3323558 - RNA, 19 nt, Human
uggcacccggccccugcug

SEQ ID NO: 3323559 - RNA, 20 nt, Human
uggcacccggccccugcugg

SEQ ID NO: 3323560 - RNA, 22 nt, Human
uggcagcucaccucucccuugg

SEQ ID NO: 3323561 - RNA, 21 nt, Human
uggcagcucaccucucccuug

SEQ ID NO: 3323562 - RNA, 23 nt, Human
uggcagcucaccucucccuugga

SEQ ID NO: 3323563 - RNA, 15 nt, Human
aggccagccuugacc

SEQ ID NO: 3323564 - RNA, 13 nt, Human
aggccagccuuga

SEQ ID NO: 3323565 - RNA, 22 nt, Human
aggacuuuucuuuguggcuucc

SEQ ID NO: 3323566 - RNA, 17 nt, Human
aggacuuuucuuugugg

SEQ ID NO: 3323567 - RNA, 19 nt, Human
aggacuuuucuuuguggcu

SEQ ID NO: 3323568 - RNA, 13 nt, Human
aggagcagccaca

SEQ ID NO: 3323569 - RNA, 12 nt, Human
aggagcagccac

SEQ ID NO: 3323570 - RNA, 16 nt, Human
aggagccuccugcccu

SEQ ID NO: 3323571 - RNA, 16 nt, Human
uggaagcacagcuuca

SEQ ID NO: 3323572 - RNA, 20 nt, Human
aggaugaucuaggaagacuu

SEQ ID NO: 3323573 - RNA, 16 nt, Human
aggauucuuccucccu

SEQ ID NO: 3323574 - RNA, 22 nt, Human
aggaugcacagaguuguuacau

SEQ ID NO: 3323575 - RNA, 23 nt, Human
aggaugaucuaggaagacuuugg

SEQ ID NO: 3323576 - RNA, 22 nt, Human
aggaugaucuaggaagacuuug

SEQ ID NO: 3323577 - RNA, 17 nt, Human
aggauucuuccucccuc

SEQ ID NO: 3323578 - RNA, 19 nt, Human
aggauucuuccucccuccc

SEQ ID NO: 3323579 - RNA, 13 nt, Human
aggaucagucuga

SEQ ID NO: 3323580 - RNA, 12 nt, Human
aggaucagucug

SEQ ID NO: 3323581 - RNA, 15 nt, Human
ugcuugagcucagga

SEQ ID NO: 3323582 - RNA, 17 nt, Human
ugcuuugugauuuuugu

SEQ ID NO: 3323583 - RNA, 22 nt, Human
ugcuuugugauuuuuguaauuu

SEQ ID NO: 3323584 - RNA, 20 nt, Human
ugcuuuugucuaugggacuc
